United States Patent
Gottesman et al.

(10) Patent No.: US 11,452,738 B2
(45) Date of Patent: Sep. 27, 2022

(54) TREATMENT OF THYMIC STROMAL LYMPHOPOIETIN (TSLP) RELATED DISEASES BY INHIBITION OF LONG-FORM TSLP TRANSCRIPTS

(71) Applicant: EMPIRICO INC., San Diego, CA (US)

(72) Inventors: Omri Gottesman, San Diego, CA (US); Shannon Bruse, San Diego, CA (US); Brian Cajes, San Diego, CA (US); David Lewis, Madison, WI (US); David Rozema, Cross Plains, WI (US)

(73) Assignee: EMPIRICO INC., San Diego, CA (US)

( * ) Notice: Subject to any disclaimer, the term of this patent is extended or adjusted under 35 U.S.C. 154(b) by 0 days.

(21) Appl. No.: 17/419,590

(22) PCT Filed: Jan. 3, 2020

(86) PCT No.: PCT/US2020/012188
§ 371 (c)(1),
(2) Date: Jun. 29, 2021

(87) PCT Pub. No.: WO2020/142693
PCT Pub. Date: Jul. 9, 2020

(65) Prior Publication Data
US 2022/0040220 A1 Feb. 10, 2022

Related U.S. Application Data

(60) Provisional application No. 62/788,551, filed on Jan. 4, 2019.

(51) Int. Cl.
*C12N 15/11* (2006.01)
*A61K 31/7125* (2006.01)
*C12N 15/113* (2010.01)

(52) U.S. Cl.
CPC ...... *A61K 31/7125* (2013.01); *C12N 15/1136* (2013.01); *C12N 2310/11* (2013.01); *C12N 2310/14* (2013.01); *C12N 2310/315* (2013.01); *C12N 2310/341* (2013.01); *C12N 2310/343* (2013.01); *C12N 2310/346* (2013.01); *C12N 2320/11* (2013.01)

(58) Field of Classification Search
None
See application file for complete search history.

(56) References Cited

U.S. PATENT DOCUMENTS

| | | | |
|---|---|---|---|
| 5,138,045 | A | 8/1992 | Cook et al. |
| 5,218,105 | A | 6/1993 | Cook et al. |
| 5,432,272 | A | 7/1995 | Benner |
| 5,459,255 | A | 10/1995 | Cook et al. |
| 9,441,227 | B2 | 9/2016 | Rossi et al. |
| 2005/0246794 | A1 * | 11/2005 | Khvorova .......... C12N 15/1137 536/23.1 |
| 2012/0022143 | A1 | 1/2012 | Jadhav et al. |
| 2020/0071393 | A1 | 3/2020 | Comeau et al. |

FOREIGN PATENT DOCUMENTS

| | | | | |
|---|---|---|---|---|
| KR | 20160016475 | A * | 2/2016 | ............ A61K 48/00 |
| WO | WO-2010111490 | A2 | 9/2010 | |
| WO | WO-2015009996 | A1 | 1/2015 | |
| WO | WO-2017042701 | A1 | 3/2017 | |

OTHER PUBLICATIONS

Machine translation of KR20160016475A, 23 pages (Year: 2016).*
Bjerkan et al., The short form of TSLP is constitutively translated in human keratinocytes and has characteristics of an antimicrobial peptide. Mucosal Immunology 8(1):49-56 (2015).
Camelo et al., IL-33, IL-25, and TSLP induce a distinct phenotypic and activation profile in human type 2 innate lymphoid cells. Blood Advances 1(10):577-589 (2017).
Chen et al., Targeting TSLP with shRNA alleviates airway inflammation and decreases epithelial CCL17 in a murine model of asthma. Molecular Therapy Nucleic Acids 5:e316 [1-11] doi: 10.1038/mtna.2016.29 (2016).
Dong et al., Distinct roles of short and long thymic stromal lymphopoietin isoforms in house dust mite-induced asthmatic airway epithelial barrier disruption. Scientific Reports 6:39559 [1-14]. doi: 10.1038/srep39559 (2016).
Feng et al., The united allergic airway: connections between allergic rhinitis, asthma, and chronic sinusitis. American Journal of Rhinology and Allergy. 26(3):187-190 (2012).
Fomasa et al., Dichotomy of short and long thymic stromal lymphopoietin isoforms in inflammatory disorders of the bowel and skin. Journal of Allergy and Clinical Immunology 136(2):413-422 (2015).
Harada et al., Functional analysis of the thymic stromal lymphopoietin variants in human bronchial epithelial cells. American Journal of Respiratory Cell and Molecular Biology 40(3):368-374 (2009).
Hui et al., Thymic stromal lymphopoietin (TSLP) secretion from human nasal epithelium is a function of TSLP genotype. Mucosal Immunology 8(5):993-939 (2015).
Hung et al.: shRNA for Thymic Stromal Lymphopoietin: A Novel Therapeutic Approach for Pulmonary Fibrosis. Journal of Cell Science & Therapy 4(3): 1-9 (2013).

(Continued)

*Primary Examiner* — Ekaterina Poliakova-Georgantas
(74) *Attorney, Agent, or Firm* — Wilson Sonsini Goodrich & Rosati

(57) ABSTRACT

Provided are compositions comprising an oligonucleotide that targets Thymic stromal lymphopoietin (TSLP). The oligonucleotide may include a small interfering RNA (siRNA) or an antisense oligonucleotide (ASO). Also provided herein are methods of treating an airway disorder by providing an oligonucleotide that targets TSLP to a subject in need thereof. In some embodiments, the oligonucleotide targeting is specific for a long isoform of TSLP (1fTSLP).

15 Claims, 3 Drawing Sheets
Specification includes a Sequence Listing.

(56) References Cited

OTHER PUBLICATIONS

Kariyawasam et al., Allergic rhinitis, chronic rhinosinusitis and asthma: unravelling a complex relationship. Current Opinion in Otolaryngology and Head Neck Surgery 21(1):79-86 (2013).

Li et al., Characterization of signaling pathways regulating the expression of pro-inflammatory long form thymic stromal lymphopoietin upon human metapneumovirus infection. Scientific Reports 8(1):883 [1-11] doi: 10.1038/s41598-018-19225-0 (2018).

Omori et al., Induction of IL-4 expression in CD4(+) T cells by thymic stromal lymphopoietin. Journal of Immunology 178(3):1396-1404 (2007).

PCT/US2020/012188 International Invitation to Pay Additional Fees dated Mar. 17, 2020.

PCT/US2020/012188 International Search Report and Written Opinion dated Jun. 12, 2020.

Rochman et al., TSLP signaling in CD4+ T cells programs a pathogenic T helper 2 cell state. doi: 10.1126/scisignal.aam885 Science Signaling 11(521):1-12 (2018).

Watanabe et al., Human thymic stromal lymphopoietin promotes dendritic cell-mediated CD4+ T cell homeostatic expansion. Nature Immunology 5(4):426-434 (2004).

Ziegler et al., The biology of thymic stromal lymphopoietin (TSLP). Advances in Pharmacology 66:129-155 (2013).

\* cited by examiner

TREATMENT OF THYMIC STROMAL LYMPHOPOIETIN (TSLP) RELATED DISEASES BY INHIBITION OF LONG-FORM TSLP TRANSCRIPTS

CROSS-REFERENCE TO RELATED APPLICATIONS

This application is a § 371 U.S. national stage entry of International Application No. PCT/US2020/012188, filed Jan. 3, 2021, which claims the benefit of U.S. Provisional Application No. 62/788,551, filed Jan. 4, 2019, which application is incorporated herein by reference in its entirety.

SEQUENCE LISTING

The instant application contains a Sequence Listing which has been submitted electronically in ASCII format and is hereby incorporated by reference in its entirety. Said ASCII copy, created on Jan. 2, 2020, is named 54462-707_601_SL.txt and is 8,727,589 bytes in size.

BACKGROUND

Chronic inflammation commonly affects both the upper and lower airways via similar mechanisms. Clinically, chronic airway inflammation often presents as allergic rhinitis (AR), non-allergic rhinitis (NAR) and chronic rhinosinusitis (CRS) in the upper airway, and as asthma, COPD and the asthma-COPD overlap syndrome (ACOS) in the lower airway. These observations have fostered increasingly strong support for the so-called unified airway hypothesis. The airway is a continuous structure lined with ciliated, pseudostratified columnar epithelium that extends from the nasal vestibule to the distal bronchioles. Its mucosal surface is constantly exposed to environmental insults and is thus highly adapted in its role as the first line of defense, instigated by the innate and adaptive arms of the immune system. Though these diseases are heterogeneous in terms of their presentation and disease course, comprising many endotypes, they all share a common endotype with patients displaying a Th2-dominant response characterized by airway inflammation with local and/or systemic eosinophilia, among other features. The epidemiological and pathophysiological observations have resulted in the established dogma that the eosinophilic endotypes of airway diseases benefit from similar therapeutic approaches, revolving around modulation of the dysregulated innate, adaptive and inflammatory responses that are characteristic of these diseases.

Thymic stromal lymphopoietin (TSLP) is a cytokine that is primarily expressed by epithelial cells and keratinocytes at barrier surfaces such as the lung, gut and skin. TSLP is an "alarmin" and is secreted in response to barrier tissue insults, including respiratory viruses, bacterial peptidoglycan, various cytokines, air pollutants and allergens. Once secreted, it signals through a heterodimeric receptor (IL7R/CRLF2) that is largely expressed on hematopoietic cells including dendritic cells (DCs), T cells, mast cells, type 2 innate lymphoid cells (ILC2s) and eosinophils. TSLP signaling promotes Th2 differentiation of CD4+ T cells both directly and indirectly through DCs and is also involved in the maintenance and function of ILC2 cells and the induction of pathogenic memory Th2 cells.

There are three known RNA transcripts of TSLP, but only two are protein coding: the canonical TSLP transcript variant 1 (NM 033035.5; SEQ ID NO: 14923) and a transcript variant 2 (NM_138551.4; SEQ ID NO: 14924). These two coding transcripts code for the long isoform of TSLP that is comprised of 159 amino acids (1fTSLP; variant 1), and for the short isoform (sfTSLP; variant 2) comprised of the last 63 residues of the C-terminal portion of 1fTSLP. These two isoforms arise not from alternative splicing but from alternate promoters (FIG. 1). sfTSLP does not signal through the TSLP receptor and is therefore functionally divergent from 1fTSLP. sfTSLP is constitutively expressed in barrier tissues and is a potent anti-microbial, while 1fTSLP expression and secretion is typically only observed in disease states. Consistent with 1fTSLP being a pro-inflammatory mediator of disease, 1fTSLP is induced by polyIC, ovalbumin, house dust mite (HDM), TNF-alpha, and IL4/13, whereas sfTSLP is not induced by these allergic and inflammatory stimuli. Notably, in house dust mite (HDM) mouse models of allergic airways disease, both mAb inhibition and genetic KO of 1fTSLP have been shown to protect against the development of allergic airways disease. Conversely, delivery of human sfTSLP to the lung has been shown to ameliorate allergic inflammation in the HDM mouse model. Given the divergent functions and contrasting effects of long and short form TSLP, it is desirable to develop a therapeutic that will specifically target the pro-inflammatory 1fTSLP while leaving the anti-microbial and anti-inflammatory sfTSLP intact.

Accordingly, therapies designed to inhibit 1fTSLP delivered locally to the lung via inhalation, or systemically, may be efficacious in treating asthma and related disorders of the upper and lower airway, including chronic rhinosinusitis, nasal polyps and allergic rhinitis.

SUMMARY

Described herein, in some embodiments, are compositions comprising an oligonucleotide that targets a long isoform of Thymic stromal lymphopoietin (1fTSLP) and when administered to a subject in an effective amount decreases an eosinophil count. In some embodiments, the eosinophil count is decreased by about 10% or more, as compared to prior to administration. Also described herein, in some embodiments, are compositions comprising an oligonucleotide that targets 1fTSLP and when administered to a subject in an effective amount decreases an inflammatory marker. In some embodiments, the inflammatory marker is decreased by about 10% or more, as compared to prior to administration. Also described herein, in some embodiments, are compositions comprising an oligonucleotide that targets 1fTSLP and when administered to a subject in an effective amount decreases mucus production. In some embodiments, the mucus production is decreased by about 10% or more, as compared to prior to administration. In some embodiments, the 1fTSLP is encoded by a nucleic acid comprising SEQ ID NO: 14923, or a variant thereof at least 70% identical, at least 75% identical, at least 80% identical, at least 85% identical, at least 90% identical, at least 91% identical, at least 92% identical, at least 93% identical, at least 94% identical, at least 95% identical, at least 96% identical, at least 97% identical, at least 98% identical, at least 99% identical, to SEQ ID NO: 14923. In some embodiments, the 1fTSLP is encoded by a nucleic acid comprising SEQ ID NO: 14923. In some embodiments, the oligonucleotide is specific for 1fTSLP, and/or does not target a short isoform of TSLP (sfTSLP). In some embodiments, the oligonucleotide comprises a modified internucleoside linkage. In some embodiments, the modified internucleoside linkage comprises alkylphosphonate, phosphorothioate, methylphosphonate, phosphorodithioate, alkylphosphonothioate, phosphoramidate, carbamate, carbonate, phosphate triester, acetamidate, or carboxymethyl ester, or a combination thereof. In some embodiments, the modified internucleoside linkage comprises one or more phosphorothioate linkages. In some embodiments, the oligonucleotide comprises 1, 2, 3, 4, 5, 6, 7, 8, 9, 10, 11, 12, 13, 14, 15, 16, 17, 18, 19, or 20 modified internucleoside linkages. In some embodiments, the oligonucleotide comprises 2 or more modified internucleoside linkages, 3 or more modified internucleoside linkages, 4 or more modified internucleoside linkages, 5 or more modified internucleoside linkages, 6 or more modified internucleoside linkages, 7 or more modified internucleoside linkages, 8 or more modified internucleoside linkages, 9 or more modified internucleoside linkages, 10 or more modified internucleoside linkages, 11 or more modified internucleoside linkages, 12 or more modified internucleoside linkages, 13 or more modified internucleoside linkages, 14 or more modified internucleoside linkages, 15 or more modified internucleoside linkages, 16 or more modified internucleoside linkages, 17 or more modified internucleoside linkages, 18 or more modified internucleoside linkages, 19 or more modified internucleoside linkages, or 20 or more modified internucleoside linkages. In some embodiments, the oligonucleotide comprises a modified nucleoside. In some embodiments, the modified nucleoside comprises a locked nucleic acid (LNA), hexitol nucleic acid (HLA), cyclohexene nucleic acid (CeNA), 2'-methoxyethyl, 2'-O-alkyl, 2'-O-allyl, 2'-O-allyl, 2'-fluoro, or 2'-deoxy, or a combination thereof. In some embodiments, the modified nucleoside comprises a LNA. In some embodiments, the modified nucleoside comprises a 2',4' constrained ethyl nucleic acid. In some embodiments, the modified nucleoside comprises a 2'-O-methyl nucleoside, 2'-deoxyfluoro nucleoside, 2'-O—N-methylacetamido (2'-O-NMA) nucleoside, a 2'-O-dimethylaminoethoxyethyl (2'-O-DMAEOE) nucleoside, 2'-O-aminopropyl (2'-O-AP) nucleoside, or 2'-ara-F, or a combination thereof. In some embodiments, the modified nucleoside comprises one or more 2'fluoro modified nucleosides. In some embodiments, the modified nucleoside comprises a 2' O-alkyl modified nucleoside. In some embodiments, the oligonucleotide comprises a lipid attached at a 3' or 5' terminus of the oligonucleotide. In some embodiments, the lipid comprises cholesterol, myristoyl, palmitoyl, stearoyl, lithocholoyl, docosanoyl, docosahexaenoyl, myristyl, palmityl stearyl, or α-tocopherol, or a combination thereof. In some embodiments, the oligonucleotide comprises 1, 2, 3, 4, 5, 6, 7, 8, 9, 10, 11, 12, 13, 14, 15, 16, 17, 18, 19, 20, or 21 modified nucleosides. In some embodiments, the oligonucleotide comprises 2 or more modified nucleosides, 3 or more modified nucleosides, 4 or more modified nucleosides, 5 or more modified nucleosides, 6 or more modified nucleosides, 7 or more modified nucleosides, 8 or more modified nucleosides, 9 or more modified nucleosides, 10 or more modified nucleosides, 11 or more modified nucleosides, 12 or more modified nucleosides, 13 or more modified nucleosides, 14 or more modified nucleosides, 15 or more modified nucleosides, 16 or more modified nucleosides, 17 or more modified nucleosides, 18 or more modified nucleosides, 19 or more modified nucleosides, 20 or more modified nucleosides, or 21 or more modified nucleosides. In some embodiments, the oligonucleotide comprises a small interfering RNA (siRNA) comprising a sense strand and an antisense strand. In some embodiments, the sense strand is 12-30 nucleosides in length. In some embodiments, the antisense strand is 12-30 nucleosides in length. Also described herein, in some embodiments, are compositions an oligonucleotide that targets 1fTSLP, wherein the oligonucleotide comprises a siRNA comprising a sense strand and an antisense strand, each strand is independently about 12-30 nucleosides in length, and at least one of the sense strand and the antisense strand comprises a nucleoside sequence comprising about 12-30 contiguous nucleosides of one of SEQ ID NO: 14923. Also described herein, in some embodiments, are compositions an oligonucleotide that targets 1fTSLP, wherein the oligonucleotide comprises an siRNA comprising a sense strand and an antisense strand, each strand is independently about 12-30 nucleosides in length, and at least one of the sense strand and the antisense strand comprises a nucleoside sequence comprising about 12-30 contiguous nucleosides of one of SEQ ID NO: 14925. In some embodiments, the sense strand and the antisense strand form a double-stranded RNA duplex. In some embodiments, the first base pair of the double-stranded RNA duplex is an AU base pair. In some embodiments, the sense strand comprises a 3' overhang comprising 1, 2, or more nucleosides. In some embodiments, the 3' overhang of the sense strand comprises 2 nucleosides. In some embodiments, the antisense strand comprises a 3' overhang comprising 1, 2, or more nucleosides. In some embodiments, the 3' overhang of the antisense strand comprises 2 nucleosides. In some embodiments, the sense strand comprises a nucleoside sequence comprising or consisting of the sequence of any one of SEQ ID NOs: 14935-17526, or a nucleic acid sequence thereof having 1 or 2 nucleoside substitutions, additions, or deletions. In some embodiments, the sense strand comprises a nucleoside sequence comprising or consisting of the sequence of any one of SEQ ID NOs: 14935-17526. In some embodiments, the antisense strand comprises a nucleoside sequence comprising or consisting of the sequence of any one of SEQ ID NOs: 26134-28725, or a nucleic acid sequence thereof having 1 or 2 nucleoside substitutions, additions, or deletions. In some embodiments, the antisense strand comprises a nucleoside sequence comprising or consisting of the sequence of any one of SEQ ID NOs: 26134-28725. In some embodiments, the siRNA binds with a 17 mer in a non-human primate 1fTSLP mRNA. In some embodiments, the siRNA binds with a 19 mer in a human 1fTSLP mRNA. In some embodiments, the siRNA binds with a human 1fTSLP mRNA and less than or equal to 20 human off-targets, with no more than 2 mismatches in the antisense strand. In some embodiments, the siRNA binds with a human 1fTSLP mRNA target site that does not harbor an SNP, with a minor allele frequency (MAF) greater or equal to 1% (pos. 2-18). In some embodiments, the sense strand comprises the nucleoside sequence of any one of SEQ ID NOs: 14941, 14942, 14947, 14948, 14950, 14957, 14959, 14960, 14961, 14962, 14973, 15004, 15005, 15013, 15035, 15039, 15040, 15041, 15043, 15047, 15048, 15049, 15050, 15051, 15052, 15056, 15057, 15059, 15062, 15082, 15094, 15096, 15097, 15098, 15101, 15102, 15107, 15108, 15111, 15114, 15117, 15123, 15127, 15128, 15164, 15174, 15178, 15184, 15186, 15187, 15188, 15190, 15191, 15194, 15195, 15197, 15230, 15235, 15236, 15238, 15240, 15241, 15246, 15252, 15253, 15260, 15263, 15264, 15272, 15274, 15276, 15278, 15279, 15282, 15283, 15286, 15294, 15302, 15303, 15307, 15310, 15314, 15319, 15320, 15321, 15322, 15324, or 15326, or a nucleic acid sequence thereof having 1 or 2 nucleoside substitutions, additions, or deletions; and/or wherein the antisense strand comprises the nucleoside sequence of any one of SEQ ID NOs: 26140, 26141, 26146, 26147, 26149, 26156, 26158, 26159, 26160, 26161, 26172, 26203, 26204, 26212, 26234, 26238, 26239, 26240, 26242, 26246, 26247, 26248, 26249, 26250, 26251, 26255, 26256, 26258, 26261, 26281, 26293, 26295, 26296, 26297, 26300, 26301, 26306, 26307, 26310, 26313, 26316, 26322, 26326, 26327, 26363, 26373, 26377, 26383, 26385, 26386, 26387, 26389, 26390, 26393, 26394, 26396, 26429, 26434, 26435, 26437, 26439, 26440, 26445, 26451, 26452, 26459, 26462, 26463, 26471, 26473, 26475, 26477, 26478, 26481, 26482, 26485, 26493, 26501, 26502, 26506, 26509, 26513, 26518, 26519, 26520, 26521, 26523, or 26525, or a nucleic acid sequence thereof having 1 or 2 nucleoside substitutions, additions, or deletions. In some embodiments, the sense strand comprises the nucleoside sequence of any one of SEQ ID NOs: 14941, 14942, 14947, 14948, 14950, 14957, 14959, 14960, 14961, 14962, 14973, 15004, 15005, 15013, 15035, 15039, 15040, 15041, 15043, 15047, 15048, 15049, 15050, 15051, 15052, 15056, 15057, 15059, 15062, 15082, 15094, 15096, 15097, 15098, 15101, 15102, 15107, 15108, 15111, 15114, 15117, 15123, 15127, 15128, 15164, 15174, 15178, 15184, 15186, 15187, 15188, 15190, 15191, 15194, 15195, 15197, 15230, 15235, 15236, 15238, 15240, 15241, 15246, 15252, 15253, 15260, 15263, 15264, 15272, 15274, 15276, 15278, 15279, 15282, 15283, 15286, 15294, 15302, 15303, 15307, 15310, 15314, 15319, 15320, 15321, 15322, 15324, or 15326; and/or wherein the antisense strand comprises the nucleoside sequence of any one of SEQ ID NOs: 26140, 26141, 26146, 26147, 26149, 26156, 26158, 26159, 26160, 26161, 26172, 26203, 26204, 26212, 26234, 26238, 26239, 26240, 26242, 26246, 26247, 26248, 26249, 26250, 26251, 26255, 26256, 26258, 26261, 26281, 26293, 26295, 26296, 26297, 26300, 26301, 26306, 26307, 26310, 26313, 26316, 26322, 26326, 26327, 26363, 26373, 26377, 26383, 26385, 26386, 26387, 26389, 26390, 26393, 26394, 26396, 26429, 26434, 26435, 26437, 26439, 26440, 26445, 26451, 26452, 26459, 26462, 26463, 26471, 26473, 26475, 26477, 26478, 26481, 26482, 26485, 26493, 26501, 26502, 26506, 26509, 26513, 26518, 26519, 26520, 26521, 26523, or 26525. In some embodiments, the sense strand comprises the nucleoside sequence of any one of SEQ ID NOs: 14942, 14947, 14948, 14950, 14957, 14959, 15004, 15035, 15039, 15040, 15041, 15043, 15047, 15048, 15049, 15050, 15051, 15057, 15059, 15082, 15094, 15096, 15097, 15098, 15102, 15107, 15108, 15111, 15114, 15123, 15127, 15128, 15164, 15184, 15186, 15187, 15188, 15190, 15191, 15194, 15195, 15230, 15235, 15236, 15238, 15241, 15246, 15252, 15260, 15263, 15272, 15276, 15278, 15279, 15283, 15294, 15302, 15307, 15314, 15322, 15324, or 15326; and/or wherein the antisense strand comprises the nucleoside sequence of any one of SEQ ID NOs: 26141, 26146, 26147, 26149, 26156, 26158, 26203, 26234, 26238, 26239, 26240, 26242, 26246, 26247, 26248, 26249, 26250, 26256, 26258, 26281, 26293, 26295, 26296, 26297, 26301, 26306, 26307, 26310, 26313, 26322, 26326, 26327, 26363, 26383, 26385, 26386, 26387, 26389, 26390, 26393, 26394, 26429, 26434, 26435, 26437, 26440, 26445, 26451, 26459, 26462, 26471, 26475, 26477, 26478, 26482, 26493, 26501, 26506, 26513, 26521, 26523, or 26525. In some embodiments, the sense strand comprises the nucleoside sequence of any one of SEQ ID NOs: 15041, 15048, 15051, 15082, 15096, 15111, 15114, 15123, 15128, 15187, 15194, 15230, 15235, 15238, 15241, 15252, 15272, 15278, 15307, or 15326; and/or wherein the antisense strand comprises the nucleoside sequence of any one of SEQ ID NOs: 26240, 26247, 26250, 26281, 26295, 26310, 26313, 26322, 26327, 26386, 26393, 26429, 26434, 26437, 26440, 26451, 26471, 26477, 26506, or 26525. In some embodiments, the sense strand comprises the nucleoside sequence of any one of SEQ ID NOs: 15048, 15051, 15082, 15096, 15111, 15114, 15123, 15128, 15194, 15230, 15235, 15238, 15241, 15252, 15272, 15278, 15307, or 15326; and/or wherein the antisense strand comprises the nucleoside sequence of any one of SEQ ID NOs: 26247, 26250, 26281, 26295, 26310, 26313, 26322, 26327, 26393, 26429, 26434, 26437, 26440, 26451, 26471, 26477, 26506, or 26525. In some embodiments, the sense strand comprises the nucleoside sequence of any one of SEQ ID NOs: 17527-20118, or a nucleic acid sequence thereof having 1 or 2 nucleoside substitutions, additions, or deletions. In some embodiments, the sense strand comprises the nucleoside sequence of any one of SEQ ID NOs: 17527-20118. In some embodiments, the sense strand comprises the nucleoside sequence of any one of SEQ ID NOs: 20119-22710, or a nucleic acid sequence thereof having 1 or 2 nucleoside substitutions, additions, or deletions. In some embodiments, the sense strand comprises the nucleoside sequence of any one of SEQ ID NOs: 20119-22710. In some embodiments, the antisense strand comprises the nucleoside sequence of any one of SEQ ID NOs: 28922-31513, or a nucleic acid sequence thereof having 1 or 2 nucleoside substitutions, additions, or deletions. In some embodiments, the antisense strand comprises the nucleoside sequence of any one of SEQ ID NOs: 28922-31513. In some embodiments, the antisense strand comprises the nucleoside sequence of any one of SEQ ID NOs: 31514-34105, or a nucleic acid sequence thereof having 1 or 2 nucleoside substitutions, additions, or deletions. In some embodiments, the antisense strand comprises the nucleoside sequence of any one of SEQ ID NOs: 31514-34105. In some embodiments, the sense strand comprises modification pattern 1S: 5'-NfsnsNfnNfnNfnNfnNfnNfnNfnNfnNfnNfsnsn-3' (SEQ ID NO: 34502), wherein "Nf" is a 2' fluoro-modified nucleoside, "n" is a 2' O-methyl modified nucleoside, and "s" is a phosphorothioate linkage. In some embodiments, the sense strand comprises modification pattern 2S: 5'-nsnsnnNfnNfNfNfnnnnnnnnnnnsnsn-3' (SEQ ID NO: 34504), wherein "Nf" is a 2' fluoro-modified nucleoside, "n" is a 2' O-methyl modified nucleoside, and "s" is a phosphorothioate linkage. In some embodiments, the sense strand comprises modification pattern 3S: 5'-nsnsnnNfnNfnNfnnnnnnnnnnnsnsn-3' (SEQ ID NO: 34507), wherein "Nf" is a 2' fluoro-modified nucleoside, "n" is a 2' O-methyl modified nucleoside, and "s" is a phosphorothioate linkage. In some embodiments, the sense strand comprises modification pattern 4S: 5'-NfsnsNfnNfnNfnNfnNfnNfnNfnNfnNfnNfsnsnN-Lipid-3' (SEQ ID NO: 34508), wherein "Nf" is a 2' fluoro-modified nucleoside, "n" is a 2' O-methyl modified nucleoside, "s" is a phosphorothioate linkage, and N comprises one or more nucleosides. In some embodiments, the sense strand comprises modification pattern 5S: 5'-nsnsnnNfnNfNfNfnnnnnnnnnnnsnsnN-Lipid-3' (SEQ ID NO: 34509), wherein "Nf" is a 2' fluoro-modified nucleoside, "n" is a 2' O-methyl modified nucleoside, "s" is a phosphorothioate linkage, and N comprises one or more nucleosides. In some embodiments, the antisense strand comprises modification pattern 1AS: 5'-nsNfsnNfnNfnNfnNfnnnNfnNfnNfsnsn-3' (SEQ ID NO: 34503), wherein "Nf" is a 2' fluoro-modified nucleoside, "n" is a 2' O-methyl modified nucleoside, and "s" is a phosphorothioate linkage. In some embodiments, the antisense strand comprises modification pattern 2AS: 5'-nsNfsnnnNfnNfNfNfnnnnNfnNfnnnsnsn-3' (SEQ ID NO: 34510), wherein "Nf" is a 2' fluoro-modified nucleoside, "n" is a 2' O-methyl modified nucleoside, and "s" is a phosphorothioate linkage. In some embodiments, the antisense strand comprises modification pattern 3AS: 5'-nsNfsnnnNfnnnnnnnNfnNfnnnsnsn-3' (SEQ ID NO: 34505), wherein "Nf" is a 2' fluoro-modified nucleoside, "n"

is a 2' O-methyl modified nucleoside, and "s" is a phosphorothioate linkage. In some embodiments, the antisense strand comprises modification pattern 4AS: 5'-nsNfsnNfnNfnnnnnnnNfnNfnnnsnsn-3' (SEQ ID NO: 34511), wherein "Nf" is a 2' fluoro-modified nucleoside, "n" is a 2' O-methyl modified nucleoside, and "s" is a phosphorothioate linkage. In some embodiments, the sense strand comprises pattern 1S and the antisense strand comprises pattern 1AS, 2AS, 3AS, or 4AS. In some embodiments, the sense strand comprises pattern 2S and the antisense strand comprises pattern 1AS, 2AS, 3AS, or 4AS. In some embodiments, the sense strand comprises pattern 3S and the antisense strand comprises pattern 1AS, 2AS, 3AS, or 4AS. In some embodiments, the sense strand comprises pattern 4S and the antisense strand comprises pattern 1AS, 2AS, 3AS, or 4AS. In some embodiments, the sense strand comprises the nucleoside sequence of any one of SEQ ID NOs: 17533, 17534, 17539, 17540, 17542, 17549, 17551, 17552, 17553, 17554, 17565, 17596, 17597, 17605, 17627, 17631, 17632, 17633, 17635, 17639, 17640, 17641, 17642, 17643, 17644, 17648, 17649, 17651, 17654, 17674, 17686, 17688, 17689, 17690, 17693, 17694, 17699, 17700, 17703, 17706, 17709, 17715, 17719, 17720, 17756, 17766, 17770, 17776, 17778, 17779, 17780, 17782, 17783, 17786, 17787, 17789, 17822, 17827, 17828, 17830, 17832, 17833, 17838, 17844, 17845, 17852, 17855, 17856, 17864, 17866, 17868, 17870, 17871, 17874, 17875, 17878, 17886, 17894, 17895, 17899, 17902, 17906, 17911, 17912, 17913, 17914, 17916, or 17918; and/or wherein the antisense strand comprises the nucleoside sequence of any one of SEQ ID NOs: 28928, 28929, 28934, 28935, 28937, 28944, 28946, 28947, 28948, 28949, 28960, 28991, 28992, 29000, 29022, 29026, 29027, 29028, 29030, 29034, 29035, 29036, 29037, 29038, 29039, 29043, 29044, 29046, 29049, 29069, 29081, 29083, 29084, 29085, 29088, 29089, 29094, 29095, 29098, 29101, 29104, 29110, 29114, 29115, 29151, 29161, 29165, 29171, 29173, 29174, 29175, 29177, 29178, 29181, 29182, 29184, 29217, 29222, 29223, 29225, 29227, 29228, 29233, 29239, 29240, 29247, 29250, 29251, 29259, 29261, 29263, 29265, 29266, 29269, 29270, 29273, 29281, 29289, 29290, 29294, 29297, 29301, 29306, 29307, 29308, 29309, 29311, or 29313. In some embodiments, the sense strand comprises the nucleoside sequence of any one of SEQ ID NOs: 17534, 17539, 17540, 17542, 17549, 17551, 17596, 17627, 17631, 17632, 17633, 17635, 17639, 17640, 17641, 17642, 17643, 17649, 17651, 17674, 17686, 17688, 17689, 17690, 17694, 17699, 17700, 17703, 17706, 17715, 17719, 17720, 17756, 17776, 17778, 17779, 17780, 17782, 17783, 17786, 17787, 17822, 17827, 17828, 17830, 17833, 17838, 17844, 17852, 17855, 17864, 17868, 17870, 17871, 17875, 17886, 17894, 17899, 17906, 17914, 17916, or 17918; and/or wherein the antisense strand comprises the nucleoside sequence of any one of SEQ ID NOs: 28929, 28934, 28935, 28937, 28944, 28946, 28991, 29022, 29026, 29027, 29028, 29030, 29034, 29035, 29036, 29037, 29038, 29044, 29046, 29069, 29081, 29083, 29084, 29085, 29089, 29094, 29095, 29098, 29101, 29110, 29114, 29115, 29151, 29171, 29173, 29174, 29175, 29177, 29178, 29181, 29182, 29217, 29222, 29223, 29225, 29228, 29233, 29239, 29247, 29250, 29259, 29263, 29265, 29266, 29270, 29281, 29289, 29294, 29301, 29309, 29311, or 29313. In some embodiments, the sense strand comprises the nucleoside sequence of any one of SEQ ID NOs: 17633, 17640, 17643, 17674, 17688, 17703, 17706, 17715, 17720, 17779, 17786, 17822, 17827, 17830, 17833, 17844, 17864, 17870, 17899, or 17918; and/or wherein the antisense strand comprises the nucleoside sequence of any one of SEQ ID NOs: 29028, 29035, 29038, 29069, 29083, 29098, 29101, 29110, 29115, 29174, 29181, 29217, 29222, 29225, 29228, 29239, 29259, 29265, 29294, or 29313. In some embodiments, the sense strand comprises the nucleoside sequence of any one of SEQ ID NOs: 17640, 17643, 17674, 17688, 17703, 17706, 17715, 17720, 17786, 17822, 17827, 17830, 17833, 17844, 17864, 17870, 17899, or 17918; and/or wherein the antisense strand comprises the nucleoside sequence of any one of SEQ ID NOs: 29035, 29038, 29069, 29083, 29098, 29101, 29110, 29115, 29181, 29217, 29222, 29225, 29228, 29239, 29259, 29265, 29294, or 29313. In some embodiments, the oligonucleotide comprises an antisense oligonucleotide (ASO). In some embodiments, the ASO is single-stranded and 12-30 nucleosides in length. Also described herein, in some embodiments, are compositions comprising an oligonucleotide that targets 1fTSLP, wherein the oligonucleotide comprises an ASO comprising an antisense strand about 12-30 nucleosides in length and comprising a nucleoside sequence comprising about 12-30 contiguous nucleosides of one of SEQ ID NO: 14923. Also described herein, in some embodiments, are compositions comprising an oligonucleotide that targets TSLP, wherein the oligonucleotide comprises an ASO comprising an antisense strand about 12-30 nucleosides in length and comprising a nucleoside sequence comprising about 12-30 contiguous nucleosides of one of SEQ ID NO: 14925. In some embodiments, the ASO is 15-25 nucleosides in length. In some embodiments, the ASO is 20 nucleosides in length. In some embodiments, the ASO comprises a nucleoside sequence comprising or consisting of the sequence of any one of SEQ ID NOs: 9971-12561, or a nucleic acid sequence thereof having 1 or 2 nucleoside substitutions, additions, or deletions. In some embodiments, the ASO comprises a nucleoside sequence comprising or consisting of the sequence of any one of SEQ ID NOs: 9971-12561. In some embodiments, the ASO comprises a nucleoside sequence comprising or consisting of the sequence of any one of SEQ ID NOs: 23299-25889, or a nucleic acid sequence thereof having 1 or 2 nucleoside substitutions, additions, or deletions. In some embodiments, the ASO comprises a nucleoside sequence comprising or consisting of the sequence of any one of SEQ ID NOs: 23299-25889. In some embodiments, the ASO comprises modification pattern: 5'-nsnsnsnsnsdNsdNsdNsdNsdNsdNsdNsdNsdNsnsnsn snsn-3' (SEQ ID NO: 34506) where "dN" is any deoxynucleotide, "n" is a 2'O-methyl or 2'O-methoxyethyl-modified nucleoside, and "s" is a phosphorothioate linkage. In some embodiments, the composition is a pharmaceutical composition. In some embodiments, the composition is sterile. Some embodiments further comprise a pharmaceutically acceptable carrier. In some embodiments, the pharmaceutically acceptable carrier comprises water, a buffer, or a saline solution. In some embodiments, the composition is formulated for administration by inhalation. In some embodiments, the oligonucleotide targets a sequence within the first 412 nucleotides of SEQ ID NO: 14923.

Described herein, in some embodiments, are methods of treating an airway disorder such as an airway inflammation disorder in a subject in need thereof, the method comprising administering to the subject a composition comprising an oligonucleotide that targets 1fTSLP. In some embodiments, the airway inflammation disorder comprises asthma. In some embodiments, the airway inflammation disorder comprises nasal polyps. In some embodiments, the airway inflammation disorder comprises allergic rhinitis. In some embodiments, the airway inflammation disorder comprises chronic rhinosinusitis. In some embodiments, the airway inflammation disorder comprises an increased blood eosinophil count. In some embodiments, the administration is by inhalation. In some embodiments, the subject is an animal, a mammal, a dog, a cat, cattle, a rodent, a mouse, a rat, a primate, or a monkey. In some embodiments, the subject is a human. In some embodiments, the subject is ≥40 years of age. In some embodiments, the subject is ≤85 years of age. In some embodiments, the subject is ≥40 and ≤85 years of age. In some embodiments, a baseline measurement is obtained from the subject prior to administering the composition to the subject. In some embodiments, the baseline measurement is a baseline observational measurement. In some embodiments, the baseline observational measurement is obtained using a scoring system. In some embodiments, the baseline observational measurement is obtained using microscopy. In some embodiments, the baseline observational measurement is obtained directly from the subject's skin or airway. In some embodiments, the baseline observational measurement is obtained from an image of the subject's skin or airway. In some embodiments, the baseline observational measurement is a baseline number of nasal polyps. In some embodiments, the baseline observational measurement is a baseline nasal polyp size. In some embodiments, the baseline observational measurement is a baseline mucus measurement. In some embodiments, the baseline observational measurement is a baseline mucus production measurement. In some embodiments, the baseline observational measurement is a baseline airway constriction measurement. In some embodiments, the baseline observational measurement is a baseline inflammation measurement, a baseline swelling measurement, or a baseline redness measurement. In some embodiments, the baseline measurement is obtained in a sample obtained from the subject prior to administering the composition to the subject. In some embodiments, the sample is an airway sample. In some embodiments, the sample is a mucus sample. In some embodiments, the sample is an airway tissue sample In some embodiments, the sample is an airway cell sample In some embodiments, the sample is a blood sample, a plasma sample, or a serum sample. In some embodiments, the baseline measurement is obtained using microscopy, PCR, an immunoassay, a colorimetric assay, or a fluorescence assay. In some embodiments, the baseline measurement is a baseline blood eosinophil measurement. In some embodiments, the baseline measurement is a baseline MUC5AC measurement. In some embodiments, the baseline measurement is a baseline inflammatory marker mRNA measurement. In some embodiments, the baseline measurement is a baseline inflammatory marker protein measurement. In some embodiments, the inflammatory marker comprises IL-4, IL-5, IL-13, or TNFα. In some embodiments, the baseline measurement is a baseline 1fTSLP mRNA measurement. In some embodiments, the baseline measurement is a baseline 1fTSLP protein measurement. In some embodiments, the baseline measurement is a baseline sfTSLP mRNA measurement. In some embodiments, the baseline measurement is a baseline sfTSLP protein measurement. In some embodiments, the composition reduces an observational measurement relative to the baseline observational measurement. In some embodiments, the observational measurement is obtained using a scoring system. In some embodiments, the observational measurement is obtained using microscopy. In some embodiments, the observational measurement is obtained directly from the subject's skin or airway. In some embodiments, the observational measurement is obtained from an image of the subject's skin or airway. In some embodiments, the observational measurement is a number of nasal polyps. In some embodiments, the observational measurement is a nasal polyp size. In some embodiments, the observational measurement is a mucus measurement. In some embodiments, the observational measurement is a mucus production measurement. In some embodiments, the observational measurement is an airway constriction measurement. In some embodiments, the observational measurement is an inflammation measurement, a swelling measurement, or a redness measurement. In some embodiments, the composition reduces a blood eosinophil measurement relative to the baseline blood eosinophil measurement. In some embodiments, the blood eosinophil measurement is obtained using microscopy, PCR, an immunoassay, a colorimetric assay, or a fluorescence assay. In some embodiments, the composition reduces a MUC5AC measurement relative to the baseline MUC5AC measurement. In some embodiments, the MUC5AC measurement is obtained using microscopy, PCR, an immunoassay, a colorimetric assay, or a fluorescence assay. In some embodiments, the composition reduces an inflammatory marker mRNA measurement relative to the baseline inflammatory marker mRNA measurement. In some embodiments, the inflammatory marker mRNA measurement is obtained using PCR. In some embodiments, the composition reduces an inflammatory marker protein measurement relative to the baseline inflammatory marker protein measurement. In some embodiments, the inflammatory marker protein measurement is obtained using microscopy, an immunoassay, a colorimetric assay, or a fluorescence assay. In some embodiments, the inflammatory marker comprises IL-4, IL-5, IL-13, or TNFα. In some embodiments, the composition reduces a 1fTSLP mRNA measurement relative to the baseline 1fTSLP mRNA measurement. In some embodiments, the 1fTSLP mRNA measurement is obtained using PCR. In some embodiments, the composition reduces a 1fTSLP protein measurement relative to the baseline 1fTSLP protein measurement. In some embodiments, the 1fTSLP protein measurement is obtained using microscopy, an immunoassay, a colorimetric assay, or a fluorescence assay. In some embodiments, the composition does not affect a sfTSLP mRNA measurement relative to the baseline sfTSLP mRNA measurement. In some embodiments, the sfTSLP mRNA measurement is obtained using PCR. In some embodiments, the composition does not affect a sfTSLP protein measurement relative to the baseline sfTSLP protein measurement. In some embodiments, the sfTSLP protein measurement is obtained using microscopy, an immunoassay, a colorimetric assay, or a fluorescence assay. In some embodiments, the blood eosinophil measurement is obtained in a second sample obtained from the subject after administering the composition to the subject. In some embodiments, the MUC5AC measurement is obtained in a second sample obtained from the subject after administering the composition to the subject. In some embodiments, the inflammatory marker mRNA measurement is obtained in a second sample obtained from the subject after administering the composition to the subject. In some embodiments, the inflammatory marker protein measurement is obtained in a second sample obtained from the subject after administering the composition to the subject. In some embodiments, the 1fTSLP mRNA measurement is obtained in a second sample obtained from the subject after administering the composition to the subject. In some embodiments, the 1fTSLP protein measurement is obtained in a second sample obtained from the subject after administering the composition to the subject. In some embodiments, the sfTSLP mRNA measurement is obtained in a second sample obtained from the subject after administering the composition to the subject. In some embodiments, the sfTSLP protein measurement is obtained in a second sample obtained from the subject after administering the composition to the subject. In some embodiments, the second sample is an airway sample. In some embodiments, the second sample is a mucus sample. In some embodiments, the second sample is an airway tissue sample. In some embodiments, the second sample is an airway cell sample. In some embodiments, the second sample is a blood sample, a plasma sample, or a serum sample. In some embodiments, the composition and/or oligonucleotide is a composition and/or oligonucleotide as described herein.

Described herein, in some embodiments, are uses of a composition described herein embodiments in a method as described herein.

In some aspects, the present disclosure relates to molecules for inhibition of long-form thymic stromal lymphopoietin (1fTSLP) gene products including dsRNA (dsRNA) agents such as small interfering RNAs (siRNAs) and antisense oligonucleotides for therapeutic use. Further provided are methods of inhibiting the expression of a target gene by administering these agents, e.g., for the treatment of various diseases involving 1fTSLP gene products.

A non-limiting example of a therapeutic molecule for inhibiting TSLP is RNA interference (RNAi), where double-stranded RNAi (dsRNA) can be utilized to block gene expression. Short dsRNA directs gene-specific, post-transcriptional silencing in many organisms, including vertebrates, and has provided a new tool for studying gene function. RNAi is mediated by RNA-induced silencing complex (RISC), a sequence-specific, multi-component nuclease that destroys messenger RNAs homologous to the silencing trigger. RISC is known to contain short RNAs (approximately 22 nucleotides) derived from the double-stranded RNA trigger, but the protein components of this activity remained unknown.

Another non-limiting example of a therapeutic molecule for inhibiting TSLP is antisense oligonucleotides. DNA-RNA and RNA-RNA hybridization are important to many aspects of nucleic acid function including DNA replication, transcription, and translation. Hybridization is also central to a variety of technologies that either detect a particular nucleic acid or alter its expression. Antisense nucleotides, for example, disrupt gene expression by hybridizing to target RNA, thereby interfering with RNA splicing, transcription, translation, and replication. Antisense DNA has the added feature that DNA-RNA hybrids serve as a substrate for digestion by ribonuclease H (RNaseH), an activity that is present in most cell types. Antisense molecules can be delivered into cells, as is the case for oligodeoxynucleotides (ODNs), or they can be expressed from endogenous genes as RNA molecules.

Another non-limiting example of a therapeutic molecule for inhibiting TSLP is splice switching antisense oligonucleotides (SSOs). These are short, synthetic, antisense, modified nucleic acids that hybridize with a pre-mRNA and disrupt the normal splicing repertoire of the transcript by blocking the RNA-RNA base-pairing or protein-RNA binding interactions that occur between components of the splicing machinery and the pre-mRNA. Splicing of pre-mRNA is required for the proper expression of the vast majority of protein-coding genes, and thus, targeting the process offers a means to manipulate protein production from a gene. As an example, the splicing of a pre-mRNA can also be used to alter the reading frame downstream of the splice site leading to a truncated protein with impaired function.

Splice switching antisense oligonucleotides differ from mRNA cleaving antisense oligonucleotides in that they do not recruit RNaseH to degrade the pre-mRNA-SSO complex and are strictly steric blocking. This is accomplished through the use of fully, or nearly fully, 2'-modified antisense oligonucleotides that therefore lack the necessary DNA-RNA hybrid region that is recognized by RNaseH. Another type of modified oligonucleotide that has been used extensively to modify splicing are phosphoramidite morpholinos (PMOs). PMOs have a morpholine ring in place of the furanose ring found in natural nucleic acids and a neutral phosphorodiamidate backbone in place of the negatively charged phosphodiester backbone.

In some embodiments, the present disclosure provides methods for inhibiting the action of a natural transcript by using antisense oligonucleotide(s) targeted to any region of the natural transcript. It is also contemplated herein that inhibition of the natural transcript can be achieved by siRNA, ribozymes and small molecules. In an exemplary embodiment, the natural transcript encodes for TSLP, and in some cases, 1fTSLP.

One embodiment provides a method of modulating function and/or expression of an 1fTSLP polynucleotide in patient cells or tissues, in vivo or in vitro, the method comprising contacting said cells or tissues with an antisense oligonucleotide 5 to 30 nucleotides in length, wherein said antisense oligonucleotide has at least 50% sequence identity to a reverse complement of a polynucleotide comprising 5 to 30 consecutive nucleotides within nucleotides 1 to 2629 of SEQ ID NO: 14923, and any variants, alleles, homologs, mutants, derivatives, fragments and complementary sequences thereof, thereby modulating function and/or expression of the 1fTSLP polynucleotide in patient cells or tissues, in vivo or in vitro. In some embodiments, the oligonucleotide comprises a sequence selected from SEQ ID NOS: 9971-12561. In some embodiments, the oligonucleotide comprises a sequence at least about 80%, 85%, 90%, or 95% identical to a sequence selected from SEQ ID NOS: 9971-12561.

In some embodiments, an oligonucleotide targets a natural sequence of 1fTSLP polynucleotides, for example, nucleotides set forth in SEQ ID NO: 14923, and any variants, alleles, homologs, mutants, derivatives, fragments and complementary sequences thereto. In some embodiments, the oligonucleotide comprises a sequence selected from SEQ ID NOS: 1-12561. In some embodiments, the oligonucleotide comprises a sequence at least about 80%, 85%, 90%, or 95% identical to a sequence selected from SEQ ID NOS: 1-12561.

In some embodiments, an oligonucleotide targets a natural sequence of 1fTSLP polynucleotides, for example, nucleotides set forth in SEQ ID NO: 14925, and any variants, alleles, homologs, mutants, derivatives, fragments and complementary sequences thereto. In some embodiments, the oligonucleotide comprises a sequence selected from SEQ ID NOS: 1-12561. In some embodiments, the oligonucleotide comprises a sequence at least about 80%, 85%, 90%, or 95% identical to a sequence selected from SEQ ID NOS: 1-12561.

In some embodiments, a composition comprises one or more antisense oligonucleotides which bind to sense 1fTSLP polynucleotides. In some embodiments, the oligonucleotide comprises a sequence selected from SEQ ID NOS: 9971-12561. In some embodiments, the oligonucleotide comprises a sequence at least about 80%, 85%, 90%, or 95% identical to a sequence selected from SEQ ID NOS: 9971-12561.

In some embodiments, the oligonucleotides comprise one or more modified or substituted nucleotides. In some embodiments, the oligonucleotides comprise one or more modified bonds. In some embodiments, the modified nucleotides comprise modified bases comprising phosphorothioate, methylphosphonate, peptide nucleic acids, 2'-O-methyl, methoxyethly, fluoro- or carbon, methylene or other locked nucleic acid (LNA) molecules. In some embodiments, the modified nucleotides are locked nucleic acid molecules, including a-L-LNA.

In some embodiments, the oligonucleotides are administered to a patient by inhalation, intranasally, subcutaneously, intramuscularly, intravenously or intraperitoneally.

In some embodiments, the oligonucleotides are administered in a pharmaceutical composition. A treatment regimen comprises administering the antisense compounds at least once to a patient; however, this treatment can be modified to include multiple doses over a period of time. The treatment can be combined with one or more other types of therapies.

In some embodiments, the oligonucleotides are encapsulated in a liposome or attached to a carrier molecule (e.g. cholesterol, TAT peptide).

In one aspect, provided herein is an RNA interference (RNAi) agent capable of inhibiting the expression of long-form thymic stromal lymphopoietin (1fTSLP), wherein the RNAi agent comprises a double-stranded RNA (dsRNA) comprising a sense strand and an antisense strand, each strand having 14 to 30 nucleotides. In some embodiments, the dsRNA has a length of 17-30 nucleotide pairs. In some embodiments, the sense strand and antisense strand each have 17-30 nucleotides. In some embodiments, the sense strand comprises a sequence at least about 80%, 85%, 90%, 95%, or 100% identical to a sequence selected from SEQ ID NOS: 1-5184. In some embodiments, the antisense strand comprises a sequence at least about 80%, 85%, 90%, 95%, or 100% identical to the reverse complement of the sense strand. In some embodiments, the antisense strand comprises a sequence at least about 80%, 85%, 90%, 95%, or 100% identical to a sequence selected from SEQ ID NOS: 1-5184. In some embodiments, the sequence of the sense strand comprises SEQ ID NO: 14929 and the sequence of the antisense strand comprises SEQ ID NO: 14930. In some embodiments, the RNAi agent comprises one or more nucleotide modifications selected from the group consisting of LNA, HNA, CeNA, 2'-methoxyethyl, 2'-O-alkyl, 2'-O-allyl, 2'-C-allyl, 2'-fluoro, and 2'-deoxy. In some embodiments, the nucleotides are modified with either 2'-OCH3 or 2'-F. In some embodiments, the RNAi agent comprises at least one ligand. In some embodiments, the RNAi agent comprises one or more nucleotide modifications selected from the group consisting of 2'-O-methyl nucleotide, 2'-deoxyfluoro nucleotide, 2'-O—N-methylacetamido (2'-O-NMA) nucleotide, a 2'-O-dimethylaminoethoxyethyl (2'-O-DMAEOE) nucleotide, 2'-O-aminopropyl (2'-O-AP) nucleotide, and 2'-ara-F. In some embodiments, the RNAi agent comprises at least one phosphorothioate or methylphosphonate internucleotide linkage. In some embodiments, the nucleotide at the 1 position of the 5'-end of the antisense strand of the dsRNA is selected from the group consisting of A, dA, dU, U, and dT. In some embodiments, the base pair at the 1 position of the 5'-end of the dsRNA is an AU base pair.

In another aspect, provided here is an RNA interference (RNAi) agent capable of inhibiting the expression of 1fTSLP, wherein the RNAi agent comprises a double-stranded RNA (dsRNA) comprising a sense strand and an antisense strand, each of the strands having 14 to 30 nucleotides, wherein the sense strand contains at least two motifs of three identical modifications on three consecutive nucleotides, a first of said sense strand motifs occurring at a cleavage site in the sense strand and a second of said sense strand motifs occurring at a different region of the sense strand that is separated from the first sense strand motif by at least one nucleotide; and wherein the antisense strand contains at least two motifs of three identical modifications on three consecutive nucleotides, a first of said antisense strand motifs occurring at or near the cleavage site in the antisense strand and a second of said antisense strand motifs occurring at a different region of the antisense strand that is separated from the first antisense strand motif by at least one nucleotide; wherein the modification in the first antisense strand motif is different than the modification in the second antisense strand motif. In some embodiments, at least one of the nucleotides occurring in the first sense strand motif forms a base pair with one of the nucleotides in the first antisense strand motif. In some embodiments, the dsRNA has 17-30 nucleotide base pairs. In some embodiments, the dsRNA has 17-19 nucleotide base pairs. In some embodiments, each strand has 17-23 nucleotides. In some embodiments, the modifications on the nucleotides of the sense strand and/or antisense strand are selected from the group consisting of LNA, HNA, CeNA, 2'-methoxyethyl, 2'-O-alkyl, 2'-O-allyl, 2'-C— allyl, 2'-fluoro, 2'-deoxy, and combinations thereof. In some embodiments, the modifications on the nucleotides of the sense strand and/or antisense strand are 2'-OCH3 or 2'-F. In some embodiments, the RNAi agent comprises a ligand attached to the 3' end of the sense strand.

In another aspect, provided herein is an RNA interference (RNAi) agent capable of inhibiting the expression of 1fTSLP, wherein the RNAi agent comprises a double-stranded RNA (dsRNA) comprising a sense strand and an antisense strand, each of the strands having 14 to 30 nucleotides, wherein the sense strand contains at least one motif of three 2'-F modifications on three consecutive nucleotides, one of said motifs occurring at or near the cleavage site in the sense strand; and wherein the antisense strand contains at least one motif of three 2'-O-methyl modifications on three consecutive nucleotides, one of said motifs occurring at or near the cleavage site in the antisense strand. In some embodiments, the sense strand comprises a sequence at least about 80%, 85%, 90%, 95%, or 100% identical to a sequence selected from SEQ ID NOS: 1-5184. In some embodiments, the antisense strand comprises a sequence at least about 80%, 85%, 90%, 95%, or 100% identical to the reverse complement of the sense strand. In some embodiments, the antisense strand comprises a sequence at least about 80%, 85%, 90%, 95%, or 100% identical to a sequence selected from SEQ ID NOS: 1-5184.

In another aspect, provided herein is a method of modulating a function of and/or the expression of a long-form thymic stromal lymphopoietin (1fTSLP) polynucleotide in patient cells or tissues, in vivo or in vitro, the method comprising: contacting said cells or tissues with at least one antisense oligonucleotide 5 to 30 nucleotides in length, wherein said at least one antisense oligonucleotide has at least 50% sequence identity to a reverse complement of a polynucleotide comprising 5 to 30 consecutive nucleotides within nucleotides 1 to 2610 of SEQ ID NO: 14923; thereby modulating a function of and/or the expression of the long-form thymic stromal lymphopoietin (1fTSLP) polynucleotide in patient cells or tissues, in vivo or in vitro. In some embodiments, at least one antisense oligonucleotide comprises SEQ ID NO: 14926. In some embodiments, the at least one antisense oligonucleotide comprises a sequence selected from SEQ ID NOS: 9971-12561. In some embodiments, the at least one antisense oligonucleotide comprises a sequence at least about 80%, 85%, 90%, 95%, or 100% identical to a sequence selected from SEQ ID NOS: 9971-12561. In some embodiments, a function of and/or the expression of the long-form thymic stromal lymphopoietin (1fTSLP) is increased in vivo or in vitro with respect to a control oligonucleotide that does not target or specifically hybridize to 1fTSLP. In some embodiments, a function of and/or the expression of the long-form thymic stromal lymphopoietin (1fTSLP) is decreased in vivo or in vitro with respect to a control oligonucleotide that does not target or specifically hybridize to 1fTSLP. In some embodiments, the at least one anti sense oligonucleotide targets a natural antisense sequence of a long-form thymic stromal lymphopoietin (1fTSLP) polynucleotide. In some embodiments, the at least one antisense oligonucleotide targets a natural sense sequence of a long-form thymic stromal lymphopoietin (1fTSLP) polynucleotide. In some embodiments, the at least one antisense oligonucleotide targets a nucleic acid sequence comprising coding and/or non-coding nucleic acid sequences of a long-form thymic stromal lymphopoietin (1fTSLP) polynucleotide. In some embodiments, the at least one antisense oligonucleotide targets overlapping and/or non-overlapping sequences of a long-form thymic stromal lymphopoietin (1fTSLP) polynucleotide. In some embodiments, the at least one antisense oligonucleotide comprises one or more modifications. In some embodiments, the one or more modifications is selected from: at least one modified sugar moiety, at least one modified internucleoside linkage, at least one modified nucleotide, and combinations thereof. In some embodiments, the one or more modifications comprise at least one modified sugar moiety selected from: a 2'-O-methoxyethyl modified sugar moiety, a 2'-methoxy modified sugar moiety, a 2'-O-alkyl modified sugar moiety, a bicyclic sugar moiety, and combinations thereof. In some embodiments, the one or more modifications comprise at least one modified internucleoside linkage selected from: a phosphorothioate, 2'-Omethoxyethyl (MOE), 2'-fluoro, alkylphosphonate, phosphorodithioate, alkylphosphonothioate, phosphoramidate, carbamate, carbonate, phosphate triester, acetamidate, carboxymethyl ester, and combinations thereof. In some embodiments, the one or more modifications comprise at least one modified nucleotide selected from: a peptide nucleic acid (PNA), a locked nucleic acid (LNA), an arabino-nucleic acid (FANA), an analogue, a derivative, and combinations thereof.

In another aspect, provided herein is a method of modulating a function of and/or the expression of a long-form thymic stromal lymphopoietin (1fTSLP) polynucleotide in patient cells or tissues, in vivo or in vitro, the method comprising: contacting said cells or tissues with at least one antisense oligonucleotide 5 to 30 nucleotides in length, wherein said antisense oligonucleotide has at least 50% sequence identity to an antisense oligonucleotide to the long-form thymic stromal lymphopoietin Off SLP) polynucleotide; thereby modulating a function of and/or the expression of the long-form thymic stromal lymphopoietin (1fTSLP) polynucleotide in patient cells or tissues, in vivo or in vitro. In some embodiments, at least one antisense oligonucleotide comprises SEQ ID NO: 14926. In some embodiments, the at least one antisense oligonucleotide comprises a sequence selected from SEQ ID NOS: 9971-12561. In some embodiments, the at least one antisense oligonucleotide comprises a sequence at least about 80%, 85%, 90%, 95%, or 100% identical to a sequence selected from SEQ ID NOS: 9971-12561. In some embodiments, a function of and/or the expression of the long-form thymic stromal lymphopoietin (1fTSLP) is increased in vivo or in vitro with respect to a control oligonucleotide that does not target or specifically hybridize to 1fTSLP. In some embodiments, a function of and/or the expression of the long-form thymic stromal lymphopoietin (1fTSLP) is decreased in vivo or in vitro with respect to a control oligonucleotide that does not target or specifically hybridize to 1fTSLP. In some embodiments, the at least one antisense oligonucleotide targets a natural antisense sequence of a long-form thymic stromal lymphopoietin (1fTSLP) polynucleotide. In some embodiments, the at least one antisense oligonucleotide targets a natural sense sequence of a long-form thymic stromal lymphopoietin (1fTSLP) polynucleotide. In some embodiments, the at least one anti sense oligonucleotide targets a nucleic acid sequence comprising coding and/or non-coding nucleic acid sequences of a long-form thymic stromal lymphopoietin (1fTSLP) polynucleotide. In some embodiments, the at least one anti sense oligonucleotide targets overlapping and/or non-overlapping sequences of a long-form thymic stromal lymphopoietin (1fTSLP) polynucleotide. In some embodiments, the at least one anti sense oligonucleotide comprises one or more modifications. In some embodiments, the one or more modifications is selected from: at least one modified sugar moiety, at least one modified internucleoside linkage, at least one modified nucleotide, and combinations thereof. In some embodiments, the one or more modifications comprise at least one modified sugar moiety selected from: a 2'-O-methoxyethyl modified sugar moiety, a 2'-methoxy modified sugar moiety, a 2'-O-alkyl modified sugar moiety, a bicyclic sugar moiety, and combinations thereof. In some embodiments, the one or more modifications comprise at least one modified internucleoside linkage selected from: a phosphorothioate, 2'-Omethoxyethyl (MOE), 2'-fluoro, alkylphosphonate, phosphorodithioate, alkylphosphonothioate, phosphoramidate, carbamate, carbonate, phosphate triester, acetamidate, carboxymethyl ester, and combinations thereof. In some embodiments, the one or more modifications comprise at least one modified nucleotide selected from: a peptide nucleic acid (PNA), a locked nucleic acid (LNA), an arabino-nucleic acid (FANA), an analogue, a derivative, and combinations thereof.

In another aspect, provided herein is a method of modulating a function of and/or the expression of a long-form thymic stromal lymphopoietin Off SLP) polynucleotide in patient cells or tissues, in vivo or in vitro, the method comprising: contacting said cells or tissues with at least one anti sense oligonucleotide that targets a region of a natural antisense oligonucleotide of the long-form thymic stromal lymphopoietin (1fTSLP) polynucleotide; thereby modulating a function of and/or the expression of the long-form thymic stromal lymphopoietin (1fTSLP) polynucleotide in patient cells or tissues, in vivo or in vitro. In some embodiments, at least one antisense oligonucleotide comprises SEQ ID NO: 14926. In some embodiments, the at least one antisense oligonucleotide comprises a sequence selected from SEQ ID NOS: 9971-12561. In some embodiments, the at least one antisense oligonucleotide comprises a sequence at least about 80%, 85%, 90%, 95%, or 100% identical to a sequence selected from SEQ ID NOS: 9971-12561. In some embodiments, a function of and/or the expression of the long-form thymic stromal lymphopoietin (1fTSLP) is increased in vivo or in vitro with respect to a control oligonucleotide that does not target or specifically hybridize to 1fTSLP. In some embodiments, a function of and/or the expression of the long-form thymic stromal lymphopoietin (1fTSLP) is decreased in vivo or in vitro with respect to a control oligonucleotide that does not target or specifically hybridize to 1fTSLP. In some embodiments, the at least one antisense oligonucleotide targets a natural antisense sequence of a long-form thymic stromal lymphopoietin (1fTSLP) polynucleotide. In some embodiments, the at least one antisense oligonucleotide targets a natural sense sequence of a long-form thymic stromal lymphopoietin (1fTSLP) polynucleotide. In some embodiments, the at least one anti sense oligonucleotide targets a nucleic acid sequence comprising coding and/or non-coding nucleic acid sequences of a long-form thymic stromal lymphopoietin (1fTSLP) polynucleotide. In some embodiments, the at least one anti sense oligonucleotide targets overlapping and/or non-overlapping sequences of a long-form thymic stromal lymphopoietin (1fTSLP) polynucleotide. In some embodiments, the at least one anti sense oligonucleotide comprises one or more modifications. In some embodiments, the one or more modifications is selected from: at least one modified sugar moiety, at least one modified internucleoside linkage, at least one modified nucleotide, and combinations thereof. In some embodiments, the one or more modifications comprise at least one modified sugar moiety selected from: a 2'-O-methoxyethyl modified sugar moiety, a 2'-methoxy modified sugar moiety, a 2'-O-alkyl modified sugar moiety, a bicyclic sugar moiety, and combinations thereof. In some embodiments, the one or more modifications comprise at least one modified internucleoside linkage selected from: a phosphorothioate, 2'-Omethoxyethyl (MOE), 2'-fluoro, alkylphosphonate, phosphorodithioate, alkylphosphonothioate, phosphoramidate, carbamate, carbonate, phosphate triester, acetamidate, carboxymethyl ester, and combinations thereof. In some embodiments, the one or more modifications comprise at least one modified nucleotide selected from: a peptide nucleic acid (PNA), a locked nucleic acid (LNA), an arabino-nucleic acid (FANA), an analogue, a derivative, and combinations thereof.

In another aspect, provided herein is a method of modulating a function of and/or the expression of a long-form thymic stromal lymphopoietin Off SLP) polynucleotide in patient cells or tissues, in vivo or in vitro, the method comprising: contacting said cells or tissues with at least one antisense oligonucleotide 5 to 30 nucleotides in length, wherein said at least one antisense oligonucleotide has at least about 80%, 85%, 90%, 95%, or 100% sequence identity to a sequence selected from SEQ ID NOS: 9971-12561; thereby modulating a function of and/or the expression of the 1fTSLP polynucleotide in patient cells or tissues, in vivo or in vitro. In some embodiments, at least one antisense oligonucleotide comprises SEQ ID NO: 14926. In some embodiments, the at least one antisense oligonucleotide comprises a sequence selected from SEQ ID NOS: 9971-12561. In some embodiments, the at least one antisense oligonucleotide comprises a sequence at least about 80%, 85%, 90%, 95%, or 100% identical to a sequence selected from SEQ ID NOS: 9971-12561. In some embodiments, a function of and/or the expression of the long-form thymic stromal lymphopoietin (1fTSLP) is increased in vivo or in vitro with respect to a control oligonucleotide that does not target or specifically hybridize to 1fTSLP. In some embodiments, a function of and/or the expression of the long-form thymic stromal lymphopoietin (1fTSLP) is decreased in vivo or in vitro with respect to a control oligonucleotide that does not target or specifically hybridize to 1fTSLP. In some embodiments, the at least one antisense oligonucleotide targets a natural antisense sequence of a long-form thymic stromal lymphopoietin (1fTSLP) polynucleotide. In some embodiments, the at least one antisense oligonucleotide targets a natural sense sequence of a long-form thymic stromal lymphopoietin (1fTSLP) polynucleotide. In some embodiments, the at least one antisense oligonucleotide targets a nucleic acid sequence comprising coding and/or non-coding nucleic acid sequences of a long-form thymic stromal lymphopoietin (1fTSLP) polynucleotide. In some embodiments, the at least one antisense oligonucleotide targets overlapping and/or non-overlapping sequences of a long-form thymic stromal lymphopoietin (1fTSLP) polynucleotide. In some embodiments, the at least one antisense oligonucleotide comprises one or more modifications. In some embodiments, the one or more modifications is selected from: at least one modified sugar moiety, at least one modified internucleoside linkage, at least one modified nucleotide, and combinations thereof. In some embodiments, the one or more modifications comprise at least one modified sugar moiety selected from: a 2'-O-methoxyethyl modified sugar moiety, a 2'-methoxy modified sugar moiety, a 2'-O-alkyl modified sugar moiety, a bicyclic sugar moiety, and combinations thereof. In some embodiments, the one or more modifications comprise at least one modified internucleoside linkage selected from: a phosphorothioate, 2'-Omethoxyethyl (MOE), 2'-fluoro, alkylphosphonate, phosphorodithioate, alkylphosphonothioate, phosphoramidate, carbamate, carbonate, phosphate triester, acetamidate, carboxymethyl ester, and combinations thereof. In some embodiments, the one or more modifications comprise at least one modified nucleotide selected from: a peptide nucleic acid (PNA), a locked nucleic acid (LNA), an arabino-nucleic acid (FANA), an analogue, a derivative, and combinations thereof.

In another aspect, provided herein is a method of modulating a function of and/or the expression of a long-form thymic stromal lymphopoietin (1fTSLP) gene in mammalian cells or tissues, in vivo or in vitro, the method comprising: contacting said cells or tissues with at least one short interfering RNA (siRNA) oligonucleotide 5 to 30 nucleotides in length, said at least one siRNA oligonucleotide being specific for an antisense polynucleotide of a long-form thymic stromal lymphopoietin (1fTSLP) polynucleotide, wherein said at least one siRNA oligonucleotide has at least 50% sequence identity to a complementary sequence of at least about five consecutive nucleic acids of the antisense and/or sense nucleic acid molecule of the long-form thymic stromal lymphopoietin (1fTSLP) polynucleotide; thereby modulating a function of and or the expression of long-form thymic stromal lymphopoietin, (1fTSLP) in mammalian cells or tissues in vivo or in vitro. In some embodiments, said oligonucleotide has at least 80% sequence identity to a sequence of at least about five consecutive nucleic acids that is complementary to the antisense and/or sense nucleic acid molecule of the long-form thymic stromal lymphopoietin (1fTSLP) polynucleotide. In some embodiments, the at least one siRNA oligonucleotide comprises a sequence selected from SEQ ID NOS: 1-5184. In some embodiments, the at least one siRNA oligonucleotide comprises a sequence at least about 80%, 85%, 90%, 95%, or 100% identical to a sequence selected from SEQ ID NOS: 1-5184.

In another aspect, provided herein is a method of modulating a function of and/or the expression of long-form thymic stromal lymphopoietin, (1fTSLP) in mammalian cells or tissues, in vivo or in vitro, the method comprising: contacting said cells or tissues with at least one antisense oligonucleotide of about 5 to 30 nucleotides in length, the antisense oligonucleotide specific for noncoding and/or coding sequences of a sense and/or natural antisense strand of a long-form thymic stromal lymphopoietin (1fTSLP) polynucleotide, wherein said at least one antisense oligonucleotide has at least 50% sequence identity to at least one nucleic acid sequence set forth as 1 to 2610 of SEQ ID NO: 14923 or its complement; thereby modulating the function and/or expression of the long-form thymic stromal lymphopoietin (1fTSLP) in mammalian cells or tissues, in vivo or in vitro. In some embodiments, the at least one antisense oligonucleotide comprises a sequence selected from SEQ ID NOS: 9971-12561. In some embodiments, the at least one antisense oligonucleotide comprises a sequence at least about 80%, 85%, 90%, 95%, or 100% identical to a sequence selected from SEQ ID NOS: 9971-12561.

In another aspect, provided herein is a synthetic, modified oligonucleotide comprising at least one modification wherein the at least one modification is selected from: at least one modified sugar moiety; at least one modified intenucleotide linkage; at least one modified nucleotide, and combinations thereof; wherein said oligonucleotide is an antisense compound which hybridizes to and modulates the function and/or expression of a long-form thymic stromal lymphopoietin (1fTSLP) polynucleotide in vivo or in vitro as compared to a control oligonucleotide that does not specifically hybridize to the 1fTSLP polynucleotide. In some embodiments, the at least one modification comprises an internucleotide linkage selected from the group consisting of: phosphorothioate, alkylphosphonate, phosphorodithioate, alkylphosphonothioate, phosphoramidate, carbamate, carbonate, phosphate triester, acetamidate, carboxymethyl ester, and combinations thereof. In some embodiments, said oligonucleotide comprises at least one phosphorothioate internucleotide linkage. In some embodiments, said oligonucleotide comprises a backbone of phosphorothioate internucleotide linkages. In some embodiments, the oligonucleotide comprises at least one modified nucleotide, said modified nucleotide selected from: a peptide nucleic acid, a locked nucleic acid (LNA), and an analogue, derivative, and a combination thereof. In some embodiments, the oligonucleotide comprises a plurality of modifications, wherein said modifications comprise modified nucleotides selected from: phosphorothioate, alkylphosphonate, phosphorodithioate, alkylphosphonothioate, phosphoramidate, carbamate, carbonate, phosphate triester, acetamidate, carboxymethyl ester, and a combination thereof. In some embodiments, the oligonucleotide comprises a plurality of modifications, wherein said modifications comprise modified nucleotides selected from: peptide nucleic acids, locked nucleic acids (LNA), and analogues, derivatives, and a combination thereof. In some embodiments, the oligonucleotide comprises at least one modified sugar moiety selected from: a 2'-O-methoxyethyl modified sugar moiety, a 2'-methoxy modified sugar moiety, a 2-O-alkyl modified sugar moiety, a bicyclic sugar moiety, and a combination thereof. In some embodiments, the oligonucleotide comprises a plurality of modifications, wherein said modifications comprise modified sugar moieties selected from: a 2'-O-methoxyethyl modified sugar moiety, a 2-methoxy modified sugar moiety, a 2'-O-alkyl modified sugar moiety, a bicyclic sugar moiety, and a combination thereof. In some embodiments, the oligonucleotide is of at least about 5 to 30 nucleotides in length and hybridizes to an antisense and/or sense strand of a long-form thymic stromal lymphopoietin Off SLP) polynucleotide, wherein said oligonucleotide has at least about 20% sequence identity to a complementary sequence of at least about five consecutive nucleic acids of the antisense and/or sense coding and/or noncoding nucleic acid sequences of the long-form thymic stromal lymphopoietin (1fTSLP) polynucleotide. In some embodiments, the oligonucleotide has at least about 80% sequence identity to a complementary sequence of at least about five consecutive nucleic acids of the antisense and or sense coding and/or noncoding nucleic acid sequence of the long-form thymic stromal lymphopoietin (1fTSLP) polynucleotide. In some embodiments, said oligonucleotide hybridizes to and modulates expression and/or function of at least one long-form thymic stromal lymphopoietin (1fTSLP) polynucleotide, in vivo or in vitro, as compared to the control oligonucleotide. In some embodiments, the oligonucleotide comprises the sequence set forth as SEQ ID NO: 14926. In some embodiments, the at least one antisense oligonucleotide comprises a sequence selected from SEQ ID NOS: 9971-12561. In some embodiments, the at least one antisense oligonucleotide comprises a sequence at least about 80%, 85%, 90%, 95%, or 100% identical to a sequence selected from SEQ ID NOS: 9971-12561.

In another aspect, provided herein is a composition comprising one or more oligonucleotides specific for one or more long-form thymic stromal lymphopoietin (1fTSLP) polynucleotides, said one or more oligonucleotides comprising an antisense sequence, complementary sequence, allele, homolog, isoform, variant, derivative, mutant, or fragment of the 1fTSLP polynucleotide, or a combination thereof. In some embodiments, the one or more oligonucleotides have at least about 40% sequence identity as compared to the nucleotide sequence set forth as SEQ ID NO: 14926. In some embodiments, the oligonucleotide comprises the nucleotide sequence set forth as SEQ ID NO: 14926. In some embodiments, the one or more oligonucleotides comprises a sequence selected from SEQ ID NOS: 1-14922. In some embodiments, the one or more oligonucleotides comprises a sequence at least about 80%, 85%, 90%, 95%, or 100% identical to a sequence selected from SEQ ID NOS: 1-14922. In some embodiments, the one or more oligonucleotides comprises one or more modifications or substitutions. In some embodiments, the one or more modifications are selected from: phosphorothioate, methylphosphonate, peptide nucleic acid, locked nucleic acid (LNA) molecules, and combinations thereof.

In another aspect, provided herein is a method of preventing or treating a disease associated with at least one long-form thymic stromal lymphopoietin (1fTSLP) polynucleotide and/or at least one encoded product thereof, the method comprising: administering to a subject in need thereof a therapeutically effective dose of at least one antisense oligonucleotide that binds to a natural antisense sequence of said at least one long-form thymic stromal lymphopoietin (1fTSLP) polynucleotide and modulates expression of said at least one long-form thymic stromal lymphopoietin (1fTSLP) polynucleotide; thereby preventing or treating the disease associated with the at least one long-form thymic stromal lymphopoietin (1fTSLP) polynucleotide and or at least one encoded product thereof. In some embodiments, a disease associated with the at least one long-form thymic stromal lymphopoietin (1fTSLP) polynucleotide is selected from: a disease or disorder associated with abnormal function and/or expression of 1fTSLP, inflammation of the nasal passageways, inflammation of the lower airway, a proliferative skin disease or disorder, ichthyosis, a disease or disorder associated with impaired epidermal lipid barrier, a disease or disorder associated with impaired adipocyte differentiation, a disease or disorder associated with impaired keratinocyte differentiation, an inflammatory skin disease or disorder, a cardiovascular disease or disorder, a coronary disease or disorder, myocardial infarction, cancer, glandular neoplasm, epithelial neoplasm, ovarian neoplasm, breast neoplasm, stroke and brain ischemia. In some embodiments, the proliferative skin disease or disorder comprises psoriasis, chronic proliferative dermatitis, atopic dermatitis, or a combination thereof. In some embodiments, the ichthyosis comprises autosomal recessive congenital ichthyosis (ARCI), collodion baby syndrome, nonbullous congenital ichthyosiform eiythroderma, lamellar ichthyosis, or a combination thereof. In some embodiments, the cancer is selected from lung cancer, epidermoid carcinoma, breast cancer, or a combination thereof.

In another aspect, provided herein is a method of preventing or treating a disease associated with at least one long-form thymic stromal lymphopoietin (1fTSLP) polynucleotide and/or at least one encoded product thereof, the method comprising: administering to a subject in need thereof a therapeutically effective dose of at least one anti sense oligonucleotide that binds to a natural sense sequence of said at least one long-form thymic stromal lymphopoietin (1fTSLP) polynucleotide and modulates expression of said at least one long-form thymic stromal lymphopoietin (1fTSLP) polynucleotide; thereby preventing or treating the disease associated with the at least one long-form thymic stromal lymphopoietin (1fTSLP) polynucleotide and or at least one encoded product thereof. In some embodiments, a disease associated with the at least one long-form thymic stromal lymphopoietin (1fTSLP) polynucleotide is selected from: a disease or disorder associated with abnormal function and/or expression of 1fTSLP, inflammation of the nasal passageways, inflammation of the lower airway, a proliferative skin disease or disorder, ichthyosis, a disease or disorder associated with impaired epidermal lipid barrier, a disease or disorder associated with impaired adipocyte differentiation, a disease or disorder associated with impaired keratinocyte differentiation, an inflammatory skin disease or disorder, a cardiovascular disease or disorder, a coronary disease or disorder, myocardial infarction, cancer, glandular neoplasm, epithelial neoplasm, ovarian neoplasm, breast neoplasm, stroke and brain ischemia. In some embodiments, the proliferative skin disease or disorder comprises psoriasis, chronic proliferative dermatitis, atopic dermatitis, or a combination thereof. In some embodiments, the ichthyosis comprises autosomal recessive congenital ichthyosis (ARCI), collodion baby syndrome, nonbullous congenital ichthyosiform eiythroderma, lamellar ichthyosis, or a combination thereof. In some embodiments, the cancer is selected from lung cancer, epidermoid carcinoma, breast cancer, or a combination thereof.

In another aspect, provided herein is a method of identifying and selecting at least one oligonucleotide for in vivo administration comprising: identifying at least one oligonucleotide comprising at least five consecutive nucleotides which are complementary to 1fTSLP or to a polynucleotide that is antisense to 1fTSLP; measuring the thermal melting point of a hybrid of an antisense oligonucleotide and the 1fTSLP or the polynucleotide that is antisense to the 1fTSLP under stringent hybridization conditions; and selecting at least one oligonucleotide for in vivo administration based on the information obtained.

In another aspect, provided herein is a method of treating a disease or condition mediated by TSLP, the method comprising administering to a subject in need thereof an oligonucleotide comprising a sequence at least about 80%, 85%, 90%, 95%, or 100% identical to a sequence selected from SEQ ID NOS: 1-14922. In some embodiments, the oligonucleotide comprises a sequence selected from SEQ ID NOS: 1-14922. In some embodiments, the TSLP is 1fTSLP. In some embodiments, the disease or condition comprises allergic rhinitis (AR), non-allergic rhinitis (NAR), chronic rhinosinusitis (CRS), asthma, COPD and asthma-COPD overlap syndrome (ACOS), or a combination thereof. In some embodiments, the oligonucleotide comprises dsRNA. In some embodiments, the oligonucleotide comprises a sequence at least about 80%, 85%, 90%, 95%, or 100% identical to a sequence selected from SEQ ID NOS: 1-9970. In some embodiments, the oligonucleotide comprises a sequence at least about 80%, 85%, 90%, 95%, or 100% identical to a sequence selected from SEQ ID NOS: 1-5184. In some embodiments, the oligonucleotide comprises a sequence at least about 80%, 85%, 90%, 95%, or 100% identical to a sequence selected from SEQ ID NOS: 9971-14922. In some embodiments, the oligonucleotide comprises a sequence at least about 80%, 85%, 90%, 95%, or 100% identical to a sequence selected from SEQ ID NOS: 9971-12561.

DETAILED DESCRIPTION

Figure 1:
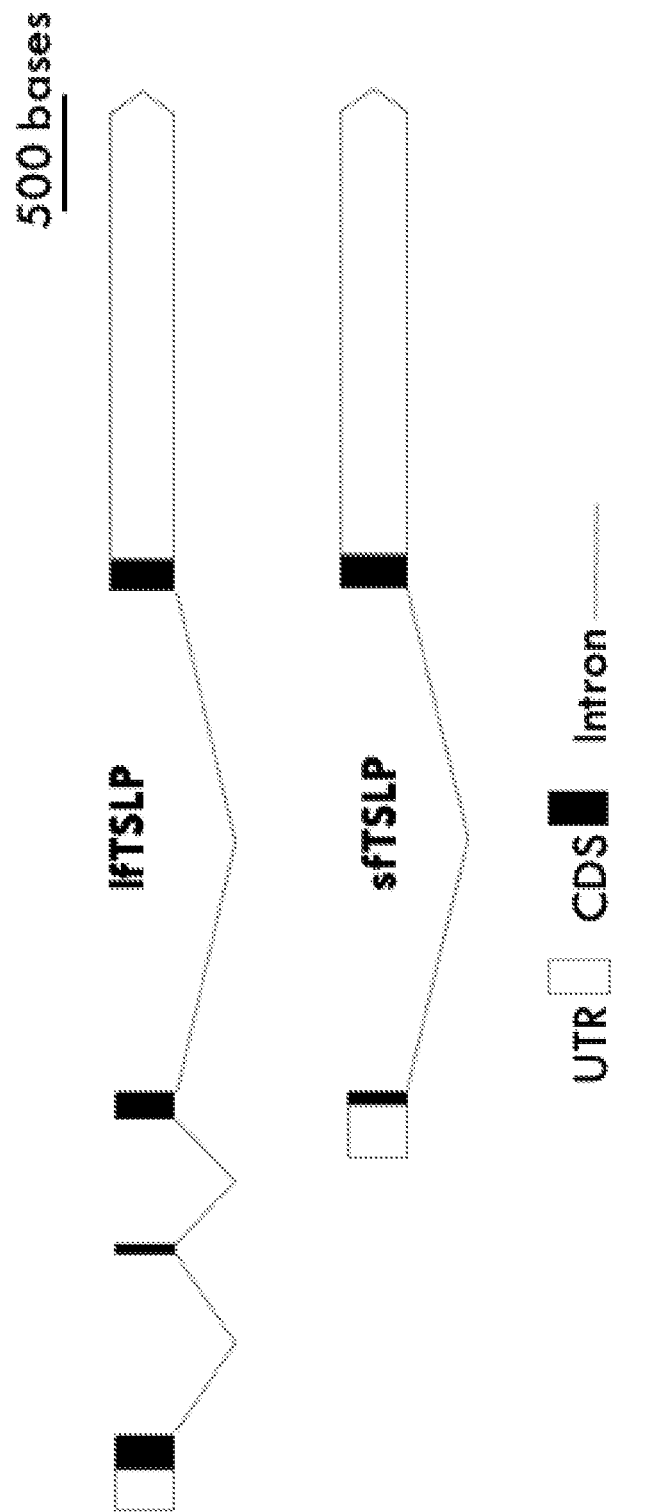
FIG. 1 is a schematic of the two isoforms of TSLP: 1fTSLP and sfTSLP.

Disclosed herein are compositions comprising an oligonucleotide that targets Thymic stromal lymphopoietin (TSLP). The oligonucleotide may include a small interfering RNA (siRNA) or an antisense oligonucleotide (ASO). Also provided herein are methods of treating an airway disorder by providing an oligonucleotide that targets TSLP to a subject in need thereof.

Definitions

The terminology used herein is for the purpose of describing particular embodiments only and is not intended to be limiting. As used herein, the singular forms "a", "an" and "the" are intended to include the plural forms as well, unless the context clearly indicates otherwise. Furthermore, to the extent that the terms "including", "includes", "having", "has", "with", or variants thereof are used in either the detailed description and or the claims, such terms are intended to be inclusive in a manner similar to the term "comprising."

The term "about" or "approximately" means within an acceptable error range for the particular value as determined by one of ordinary skill in the art, which will depend in part on how the value is measured or determined, i.e., the limitations of the measurement system. For example, "about" can mean within 1 or more than 1 standard deviation, per the practice in the art. Alternatively, "about" can mean a range of up to 20%, up to 10%, up to 5%, and up to 1% of a given value. Alternatively, particularly with respect to biological systems or processes, the term can mean within an order of magnitude, e.g., within 5-fold, or within 2-fold, of a value. Where particular values are described in the application and claims, unless otherwise stated the term "about" meaning within an acceptable error range for the particular value should be assumed.

In some embodiments, the term "mRNA" means the presently known mRNA transcript(s) of a targeted gene, and any further transcripts which may be elucidated.

In some embodiments, "dsRNA", "siRNA", and "iRNA agent" are used interchangeably as agents that can mediate silencing of a target RNA, e.g., mRNA, e.g., a transcript of a gene that encodes a protein. In some cases, the target RNA is TSLP or 1fTSLP. Such mRNA may also be referred to herein as mRNA to be silenced. Such a gene is also referred to as a target gene. In some cases, the RNA to be silenced is an endogenous gene or a pathogen gene. In addition, RNAs other than mRNA, e.g., tRNAs, and viral RNAs, can also be targeted.

In some embodiments, the phrase "mediates RNAi" refers to the ability to silence, in a sequence specific manner, a target RNA. While not wishing to be bound by theory, it is believed that silencing uses the RNAi machinery or process and a guide RNA, e.g., an siRNA agent.

In some embodiments, "specifically hybridizable" and "complementary" are terms which are used to indicate a sufficient degree of complementarity such that stable and specific binding occurs between a compound described herein and a target RNA molecule.

Specific binding may require a sufficient degree of complementarity to avoid non-specific binding of the oligomeric compound to non-target sequences under conditions in which specific binding is desired, i.e., under physiological conditions in the case of assays or therapeutic treatment, or in the case of in vitro assays, under conditions in which the assays are performed. The non-target sequences may differ by at least 5 nucleotides.

In some embodiments, a dsRNA agent of the invention is "sufficiently complementary" to a target RNA, e.g., a target mRNA, such that the dsRNA agent silences production of protein encoded by the target mRNA. In some embodiments, the dsRNA agent of the invention is "exactly complementary" to a target RNA, e.g., the target RNA and the dsRNA duplex agent anneal, for example to form a hybrid made exclusively of Watson-Crick base pairs in the region of exact complementarity. A "sufficiently complementary" target RNA can include an internal region (e.g., of at least 10 nucleotides) that is exactly complementary to a target RNA. Moreover, in some embodiments, the dsRNA agent of the invention specifically discriminates a single-nucleotide difference. In this case, the dsRNA agent only mediates RNAi if exact complementary is found in the region (e.g., within 7 nucleotides of) the single-nucleotide difference.

In some embodiments, the term "oligonucleotide" refers to a nucleic acid molecule (RNA or DNA) for example of length less than 100, 200, 300, or 400 nucleotides. Some embodiments relate to an oligonucleotide or nucleic acid sequence comprising one or more uracil nucleobases. In some embodiments, one or more of the uracil nucleobases may be substituted for one or more thymine nucleobases. Some embodiments relate to an oligonucleotide or nucleic acid sequence comprising one or more thymine nucleobases. In some embodiments, one or more of the thymine nucleobases may be substituted for one or more uracil nucleobases.

In some embodiments, "antisense oligonucleotides" or "antisense compound" is meant an RNA or DNA molecule that binds to another RNA or DNA (target RNA, DNA). For example, if it is an RNA oligonucleotide it binds to another RNA target by means of RNA-RNA interactions and alters the activity of the target RNA. An antisense oligonucleotide can upregulate or downregulate expression and/or function of a particular polynucleotide. The definition is meant to include any foreign RNA or DNA molecule which is useful from a therapeutic, diagnostic, or other viewpoint. Such molecules include, for example, antisense RNA and DNA molecules, interference RNA (RNAi), micro RNA, decoy RNA molecules, siRNA, enzymatic RNA, therapeutic editing RNA and agonist and antagonist RNA, antisense oligomeric compounds, antisense oligonucleotides, external guide sequence (EGS) oligonucleotides, alternate splicers, primers, probes, and other oligomeric compounds that hybridize to at least a portion of the target nucleic acid. As such, these compounds may be introduced in the form of single-stranded, double-stranded, partially single-stranded, or circular oligomeric compounds.

In some embodiments, the term "oligonucleotide" refers to an oligomer or polymer of ribonucleic acid (RNA) or deoxyribonucleic acid (DNA) or mimetics thereof. The term "oligonucleotide", also includes linear or circular oligomers of natural and/or modified monomers or linkages, including deoxyribonucleosides, ribonucleosides, substituted and alpha-anomeric forms thereof, peptide nucleic acids (PNA), locked nucleic acids (LNA), phosphorothioate, methylphosphonate, and the like. Oligonucleotides are capable of specifically binding to a target polynucleotide by way of a regular pattern of monomer-to-monomer interactions, such as Watson-Crick type of base pairing, Hoogsteen or reverse Hoogsteen types of base pairing, or the like.

In some embodiments, the oligonucleotide is "chimeric", that is, composed of different regions. "Chimeric" oligonucleotides contain two or more chemical regions, for example, DNA region(s), RNA region(s), PNA region(s), etc. Each chemical region is made up of at least one monomer unit, i.e., a nucleotide in the case of an oligonucleotides compound. These oligonucleotides typically comprise at least one region wherein the oligonucleotide is modified in order to exhibit one or more desired properties. The desired properties of the oligonucleotide include, but are not limited, for example, to increased resistance to nuclease degradation, increased cellular uptake, and/or increased binding affinity for the target nucleic acid. Different regions of the oligonucleotide may therefore have different properties. Chimeric oligonucleotides can be formed as mixed structures of two or more oligonucleotides, modified oligonucleotides, oligonucleosides and/or oligonucleotide analogs.

The oligonucleotide can be composed of regions that can be linked in "register", that is, when the monomers are linked consecutively, as in native DNA, or linked via spacers. The spacers are intended to constitute a covalent "bridge" between the regions and have, in some cases, a length not exceeding about 100 carbon atoms. The spacers may carry different functionalities, for example, having positive or negative charge, carry special nucleic acid binding properties (intercalators, groove binders, toxins, fluorophores etc.), being lipophilic, inducing special secondary structures like, for example, alanine containing peptides that induce alpha-helices.

In some embodiments, "1fTSLP" and "long-form thymic stromal lymphopoietin" are inclusive of all family members, mutants, alleles, fragments, species, coding and noncoding sequences, sense and antisense polynucleotide strands, etc. of the TSLP transcript variant 1 (NM_033035.5; SEQ ID NO: 14923). In some embodiments, "1fTSLP" and "long-form thymic stromal lymphopoietin" are used interchangeably in the present application.

In some embodiments, "oligonucleotide specific for" or "oligonucleotide which targets" refers to an oligonucleotide having a sequence (i) capable of forming a stable complex with a portion of the targeted gene, or (ii) capable of forming a stable duplex with a portion of a mRNA transcript of the targeted gene. Stability of the complexes and duplexes can be determined by theoretical calculations and/or in vitro assays.

In some embodiments, the term "target nucleic acid" encompasses DNA, RNA (including pre-mRNA and mRNA) transcribed from such DNA, and also cDNA derived from such RNA, coding, noncoding sequences, sense and antisense polynucleotides. The specific hybridization of an oligomeric compound with its target nucleic acid interferes with the normal function of the nucleic acid. This modulation of function of a target nucleic acid by compounds, which specifically hybridize to it, is generally referred to as "antisense". The functions of DNA that are modulated include, for example, replication and transcription. The functions of RNA that are modulated, include all vital functions such as, for example, translocation of the RNA to the site of protein translation, translation of protein from the RNA, splicing of the RNA to yield one or more mRNA species, and catalytic activity which may be engaged in or facilitated by the RNA. The overall effect of such interference with target nucleic acid function is modulation of the expression of an encoded product or oligonucleotides.

RNA interference "RNAi" is mediated by double stranded RNA (dsRNA) molecules that have sequence-specific homology to their "target" nucleic acid sequences. In certain embodiments, the mediators are 5-25 nucleotide "small interfering" RNA duplexes (siRNAs). The siRNAs are derived from the processing of dsRNA by an RNase enzyme known as Dicer. siRNA duplex products are recruited into a multi-protein siRNA complex termed RISC (RNA Induced Silencing Complex). Without wishing to be bound by any particular theory, a RISC is then believed to be guided to a target nucleic acid (suitably mRNA), where the siRNA duplex interacts in a sequence-specific way to mediate cleavage in a catalytic fashion. Small interfering RNAs can be synthesized and used according to procedures that are well known in the art and that will be familiar to the ordinarily skilled artisan. Small interfering RNAs for use in the methods herein suitably comprise between about 1 to about 50 nucleotides (nt). In examples of non-limiting embodiments, siRNAs can comprise about 5 to about 40 nt, about 5 to about 30 nt, about 10 to about 30 nt, about 15 to about 25 nt, or about 20-25 nucleotides.

In some embodiments, selection of appropriate oligonucleotides is facilitated by using computer programs that automatically align nucleic acid sequences and indicate regions of identity or homology. Such programs are used to compare nucleic acid sequences obtained, for example, by searching databases such as GenBank or by sequencing PCR products. Comparison of nucleic acid sequences from a range of species allows the selection of nucleic acid sequences that display an appropriate degree of identity between species. In the case of genes that have not been sequenced, Southern blots are performed to allow a determination of the degree of identity between genes in target species and other species. By performing Southern blots at varying degrees of stringency, as is well known in the art, it is possible to obtain an approximate measure of identity. These procedures allow the selection of oligonucleotides that exhibit a high degree of complementarity to target nucleic acid sequences in a subject to be controlled and a lower degree of complementarity to corresponding nucleic acid sequences in other species. One skilled in the art will realize that there is considerable latitude in selecting appropriate regions of genes.

In some embodiments, "enzymatic RNA" is meant an RNA molecule with enzymatic activity. Enzymatic nucleic acids (ribozymes) act by first binding to a target RNA. Such binding occurs through the target binding portion of an enzymatic nucleic acid which is held in close proximity to an enzymatic portion of the molecule that acts to cleave the target RNA. Thus, the enzymatic nucleic acid first recognizes and then binds a target RNA through base pairing, and once bound to the correct site, acts enzymatically to cut the target RNA.

In some embodiments, "decoy RNA" is meant an RNA molecule that mimics the natural binding domain for a ligand. The decoy RNA therefore competes with natural binding target for the binding of a specific ligand. For example, it has been shown that over-expression of HIV trans-activation response (TAR) RNA can act as a "decoy" and efficiently binds HIV tat protein, thereby preventing it from binding to TAR sequences encoded in the HIV RNA. This is meant to be a specific example. Those in the art will recognize that this is but one example, and some embodiments can be readily generated using techniques generally known in the art.

In some embodiments, "monomers" typically indicates monomers linked by phosphodiester bonds or analogs thereof to form oligonucleotides ranging in size from a few monomelic units, e.g., from about 3-4, to about several hundreds of monomelic units. Analogs of phosphodiester linkages include: phosphorothioate, phosphorodithioate, methylphosphornates, phosphoroselenoate, phosphoramidate, and the like, as more fully described below.

In some embodiments, "nucleotide" covers naturally occurring nucleotides as well as non-naturally occurring nucleotides. It should be clear to the person skilled in the art that various nucleotides which previously have been considered "non-naturally occurring" have subsequently been found in nature. Thus, "nucleotides" includes not only the known purine and pyrimidine heterocycles-containing molecules, but also heterocyclic analogues and tautomers thereof. Illustrative examples of other types of nucleotides are molecules containing adenine, guanine, thymine, cytosine, uracil, purine, xanthine, ^aminopurine, 8-oxo-N6-memyladenine, 7-deazaxanthine, 7-deazaguanine, N4,N4-ethanocytosin, N6,N6-ethano-2,6-diaminopurine, 5-methylcytosine, 5-(C3-C6)-alkynylcytosine, 5-fluorouracil, 5-bromouracil, pseudoisocytosine, 2-hydroxy-5-memyl-4-triazolopyridin, isocytosine, isoguanin, inosine and the "non-naturally occurring" nucleotides described in Benner et al, U.S. Pat. No. 5,432,272. The term "nucleotide" is intended to cover every and all of these examples as well as analogues and tautomers thereof. Especially interesting nucleotides are those containing adenine, guanine, thymine, cytosine, and uracil, which are considered as the naturally occurring nucleotides in relation to therapeutic and diagnostic application in humans. Nucleotides include the natural 2'-deoxy and 2'-hydroxyl sugars, as well as their analogs.

In some embodiments, "analogs" in reference to nucleotides includes synthetic nucleotides having modified base moieties and/or modified sugar moieties. Such analogs include synthetic nucleotides designed to enhance binding properties, e.g., duplex or triplex stability, specificity, or the like.

In some embodiments, "hybridization" means the pairing of at least substantially complementary strands of oligomeric compounds. One mechanism of pairing involves hydrogen bonding, which may be Watson-Crick, Hoogsteen or reversed Hoogsteen hydrogen bonding, between complementary nucleoside or nucleotide bases (nucleotides) of the strands of oligomeric compounds. For example, adenine and thymine are complementary nucleotides which pair through the formation of hydrogen bonds. Hybridization can occur under varying circumstances.

In some embodiments, an antisense compound is "specifically hybridizable" when binding of the compound to the target nucleic acid interferes with the normal function of the target nucleic acid to cause a modulation of function and/or activity, and there is a sufficient degree of complementarity to avoid non-specific binding of the antisense compound to non-target nucleic acid sequences under conditions in which specific binding is desired, i.e., under physiological conditions in the case of in vivo assays or therapeutic treatment, and under conditions in which assays are performed in the case of in vitro assays.

In some embodiments, "stringent hybridization conditions" or "stringent conditions" refers to conditions under which a compound will hybridize to its target sequence, but to a minimal number of other sequences. Stringent conditions are sequence-dependent and will be different in different circumstances and "stringent conditions" under which oligomeric compounds hybridize to a target sequence are determined by the nature and composition of the oligomeric compounds and the assays in which they are being investigated. In some cases, stringent hybridization conditions comprise low concentrations (<0.15M) of salts with inorganic cations such as Na+ or K+ (i.e., low ionic strength), temperature higher than about 20° C. to 25° C. and below the Tm of the oligomeric compound/target sequence complex, and the presence of denaturants such as formamide, dimethylformamide, dimethyl sulfoxide, or the detergent sodium dodecyl sulfate (SDS). For example, the hybridization rate decreases 1.1% for each 1% formamide. An example of a high stringency hybridization condition is 0.1× sodium chloride-sodium citrate buffer (SSC)/0.1% (w/v) SDS at 60° C. for 30 minutes.

In some embodiments, "complementary" refers to the capacity for precise pairing between two nucleotides on one or two oligomeric strands. For example, if a nucleobase at a certain position of an anti sense compound is capable of hydrogen bonding with a nucleobase at a certain position of a target nucleic acid, said target nucleic acid being a DNA, RNA, or oligonucleotide molecule, then the position of hydrogen bonding between the oligonucleotide and the target nucleic acid may be considered to be a complementary position. The oligomeric compound and the further DNA, RNA, or oligonucleotide molecule are complementary to each other when a sufficient number of complementary positions in each molecule are occupied by nucleotides which can hydrogen bond with each other. Thus, "specifically hybridizable" and "complementary" are terms which may be used to indicate a sufficient degree of precise pairing or complementarity over a sufficient number of nucleotides such that stable and specific binding occurs between the oligomeric compound and a target nucleic acid.

It is understood in the art that the sequence of an oligomeric compound need not be 100% complementary to that of its target nucleic acid to be specifically hybridizable. Moreover, an oligonucleotide may hybridize over one or more segments such that intervening or adjacent segments are not involved in the hybridization event (e.g., a loop structure, mismatch or hairpin structure). In some embodiments, oligomeric compounds disclosed herein comprise at least about 70%, or at least about 75%, or at least about 80%, or at least about 85%, or at least about 90%, or at least about 95%, or at least about 99% sequence complementarity to a target region within the target nucleic acid sequence to which they are targeted. For example, an antisense compound in which 18 of 20 nucleotides of the antisense compound are complementary to a target region, and would therefore specifically hybridize, would represent 90 percent complementarity. In this example, the remaining non-complementary nucleotides may be clustered or interspersed with complementary nucleotides and need not be contiguous to each other or to complementary nucleotides. As such, an antisense compound which is 18 nucleotides in length having 4 (four) noncomplementary nucleotides which are flanked by two regions of complete complementarity with the target nucleic acid would have 77.8% overall complementarity with the target nucleic acid and would thus fall within the scope of the present disclosure. Percent complementarity of an antisense compound with a region of a target nucleic acid can be determined routinely using BLAST programs (basic local alignment search tools) and Power-BLAST programs known in the art. Percent homology, sequence identity or complementarity, can be determined by, for example, the Gap program (Wisconsin Sequence Analysis Package, Version 8 for Unix, Genetics Computer Group, University Research Park, Madison Wis.), using default settings, which uses the algorithm of Smith and Waterman.

In some embodiments, the term "Thermal Melting Point (Tm)" refers to the temperature, under defined ionic strength, pH, and nucleic acid concentration, at which 50% of the oligonucleotides complementary to the target sequence hybridize to the target sequence at equilibrium. Typically, stringent conditions will be those in which the salt concentration is at least about 0.01 to 1.0 M Na ion concentration (or other salts) at pH 7.0 to 8.3 and the temperature is at least about 30° C. for short oligonucleotides (e.g., 10 to 50 nucleotide). Stringent conditions may also be achieved with the addition of destabilizing agents such as formamide.

In some embodiments, "modulation" means either an increase (stimulation) or a decrease (inhibition) in the expression of a gene.

In some embodiments, the term "variant", when used in the context of a polynucleotide sequence, may encompass a polynucleotide sequence related to a wild type gene. This definition may also include, for example, "allelic," "splice," "species," or "polymorphic" variants. A splice variant may have significant identity to a reference molecule, but will generally have a greater or lesser number of polynucleotides due to alternate splicing of exons during mRNA processing. The corresponding polypeptide may possess additional functional domains or an absence of domains. Species variants are polynucleotide sequences that vary from one species to another. Of particular utility are variants of wild type gene products. Variants may result from at least one mutation in the nucleic acid sequence and may result in altered mRNAs or in polypeptides whose structure or function may or may not be altered. Any given natural or recombinant gene may have none, one, or many allelic forms. Common mutational changes that give rise to variants are generally ascribed to natural deletions, additions, or substitutions of nucleotides. Each of these types of changes may occur alone, or in combination with the others, one or more times in a given sequence.

The resulting polypeptides generally will have significant amino acid identity relative to each other. A polymorphic variant is a variation in the polynucleotide sequence of a particular gene between individuals of a given species. Polymorphic variants also may encompass "single nucleotide polymorphisms" (SNPs,) or single base mutations in which the polynucleotide sequence varies by one base. The presence of SNPs may be indicative of, for example, a certain population with a propensity for a disease state, that is susceptibility versus resistance.

Derivative polynucleotides include nucleic acids subjected to chemical modification, for example, replacement of hydrogen by an alkyl, acyl, or amino group. Derivatives, e.g., derivative oligonucleotides, may comprise non-naturally-occurring portions, such as altered sugar moieties or inter-sugar linkages. Exemplary among these are phosphorothioate and other sulfur containing species which are known in the art. Derivative nucleic acids may also contain labels, including radionucleotides, enzymes, fluorescent agents, chemiluminescent agents, chromogenic agents, substrates, co factors, inhibitors, magnetic particles, and the like.

In some embodiments, a "derivative" polypeptide or peptide is one that is modified, for example, by glycosylation, pegylation, phosphorylation, sulfation, reduction/alkylation, acylation, chemical coupling, or mild formalin treatment. A derivative may also be modified to contain a detectable label, either directly or indirectly, including, but not limited to, a radioisotope, fluorescent, and enzyme label.

As used herein, the term "animal" or "patient" is meant to include, for example, humans, sheep, elks, deer, mule deer, minks, mammals, monkeys, horses, cattle, pigs, goats, dogs, cats, rats, mice, birds, chicken, reptiles, fish, insects and arachnids.

"Mammal" covers warm blooded mammals that are typically under medical care (e.g., humans and domesticated animals). Examples include feline, canine, equine, bovine, and human, as well as just human.

"Treating" or "treatment" includes the treatment of a disease-state in a mammal, and includes: (a) preventing the disease-state from occurring in a mammal, in particular, when such mammal is predisposed to the disease-state but has not yet been diagnosed as having it; (b) inhibiting the disease-state, e.g., arresting it development; and/or (c) relieving the disease-state, e.g., causing regression of the disease state until a desired endpoint is reached. Treating also includes the amelioration of a symptom of a disease (e.g., lessen the pain or discomfort), wherein such amelioration may or may not be directly affecting the disease (e.g., cause, transmission, expression, etc.). The term "treatment" is intended to encompass also prophylaxis, therapy and cure. The patient receiving this treatment is any animal in need, including primates, in particular humans, and other mammals such as equines, cattle, swine and sheep; and poultry and pets in general.

All genes, gene names, and gene products disclosed herein are intended to correspond to homologs from any species for which the compositions and methods disclosed herein are applicable. Thus, the terms include, but are not limited to genes and gene products from humans and mice. It is understood that when a gene or gene product from a particular species is disclosed, this disclosure is intended to be exemplary only, and is not to be interpreted as a limitation unless the context in which it appears clearly indicates. Thus, for example, for the genes disclosed herein, which in some embodiments relate to mammalian nucleic acid and amino acid sequences are intended to encompass homologous and/or orthologous genes and gene products from other animals including, but not limited to other mammals, fish, amphibians, reptiles, and birds. In some embodiments, the genes or nucleic acid sequences are human.

In some embodiments, the term "halo" refers to any radical of fluorine, chlorine, bromine or iodine. In some embodiments, the term "alkyl" refers to saturated and unsaturated non-aromatic hydrocarbon chains that may be a straight chain or branched chain, containing the indicated number of carbon atoms (these include without limitation propyl, allyl, or propargyl), which may be optionally inserted with N, O, or S. For example, Ci-Cio indicates that the group may have from 1 to 10 (inclusive) carbon atoms in it. The term "alkoxy" refers to an —O-alkyl radical. In some embodiments, the term "alkylene" refers to a divalent alkyl (i.e., —R—). The term "alkylenedioxo" refers to a divalent species of the structure —O—R—O—, in which R represents an alkylene. The term "aminoalkyl" refers to an alkyl substituted with an amino. In some embodiments, the term "mercapto" refers to an —SH radical. The term "thioalkoxy" refers to an —S-alkyl radical.

In some embodiments, the term "aryl" refers to a 6-carbon monocyclic or 10-carbon bicyclic aromatic ring system wherein 0, 1, 2, 3, or 4 atoms of each ring may be substituted by a substituent. Examples of aryl groups include phenyl, naphthyl and the like. In some embodiments, the term "arylalkyl" or the term "aralkyl" refers to alkyl substituted with an aryl. In some embodiments, the term "arylalkoxy" refers to an alkoxy substituted with aryl.

In some embodiments, the term "cycloalkyl" as employed herein includes saturated and partially unsaturated cyclic hydrocarbon groups having 3 to 12 carbons, for example, 3 to 8 carbons, and, for example, 3 to 6 carbons, wherein the cycloalkyl group additionally may be optionally substituted. Cycloalkyl groups include, without limitation, cyclopropyl, cyclobutyl, cyclopentyl, cyclopentenyl, cyclohexyl, cyclohexenyl, cycloheptyl, and cyclooctyl.

In some embodiments, the term "heteroaryl" refers to an aromatic 5-8 membered monocyclic, 8-12 membered bicyclic, or 11-14 membered tricyclic ring system having 1-3 heteroatoms if monocyclic, 1-6 heteroatoms if bicyclic, or 1-9 heteroatoms if tricyclic, said heteroatoms selected from O, N, or S (e.g., carbon atoms and 1-3, 1-6, or 1-9 heteroatoms of N, O, or S if monocyclic, bicyclic, or tricyclic, respectively), wherein 0, 1, 2, 3, or 4 atoms of each ring may be substituted by a substituent. Examples of heteroaryl groups include pyridyl, furyl or furanyl, imidazolyl, benzimidazolyl, pyrimidinyl, thiophenyl or thienyl, quinolinyl, indolyl, thiazolyl, and the like. In some embodiments, the term "heteroarylalkyl" or the term "heteroaralkyl" refers to an alkyl substituted with a heteroaryl. In some embodiments, the term "heteroarylalkoxy" refers to an alkoxy substituted with heteroaryl.

In some embodiments, the term "heterocyclyl" refers to a nonaromatic 5-8 membered monocyclic, 8-12 membered bicyclic, or 11-14 membered tricyclic ring system having 1-3 heteroatoms if monocyclic, 1-6 heteroatoms if bicyclic, or 1-9 heteroatoms if tricyclic, said heteroatoms selected from O, N, or S (e.g., carbon atoms and 1-3, 1-6, or 1-9 heteroatoms of N, O, or S if monocyclic, bicyclic, or tricyclic, respectively), wherein 0, 1, 2 or 3 atoms of each ring may be substituted by a substituent. Examples of heterocyclyl groups include trizolyl, tetrazolyl, piperazinyl, pyrrolidinyl, dioxanyl, morpholinyl, tetrahydrofuranyl, and the like.

In some embodiments, the term "oxo" refers to an oxygen atom, which forms a carbonyl when attached to carbon, an N-oxide when attached to nitrogen, and a sulfoxide or sulfone when attached to sulfur.

In some embodiments, the term "acyl" refers to an alkylcarbonyl, cycloalkylcarbonyl, arylcarbonyl, heterocyclylcarbonyl, or heteroarylcarbonyl substituent, any of which may be further substituted by substituents.

In some embodiments, the term "substituted" refers to the replacement of one or more hydrogen radicals in a given structure with the radical of a specified substituent including, but not limited to: halo, alkyl, alkenyl, alkynyl, aryl, heterocyclyl, thiol, alkylthio, arylthio, alkylthioalkyl, arylthioalkyl, alkyl sulfonyl, alkylsulfonylalkyl, arylsulfonylalkyl, alkoxy, aryloxy, aralkoxy, aminocarbonyl, alkylamino carbonyl, arylaminocarbonyl, alkoxycarbonyl, aryloxycarbonyl, haloalkyl, amino, trifluoromethyl, cyano, nitro, alkylamino, arylamino, alkylaminoalkyl, arylaminoalkyl, aminoalkylamino, hydroxy, alkoxyalkyl, carboxyalkyl, alkoxycarbonylalkyl, aminocarbonylalkyl, acyl, aralkoxycarbonyl, carboxylic acid, sulfonic acid, sulfonyl, phosphonic acid, aryl, heteroaryl, heterocyclic, and aliphatic. It is understood that the substituent can be further substituted.

Oligonucleotide Compounds and Compositions

In some embodiments, provided herein are oligonucleotide compounds that target a nucleic acid sequence of long-form thymic stromal lymphopoietin (1fTSLP), including, without limitation, sense and/or anti sense noncoding and/or coding sequences associated with 1fTSLP. In some embodiments, the target nucleic acid molecule is not limited to 1fTSLP polynucleotides alone but extends to any of the isoforms, receptors, homologs, non-coding regions and the like of 1fTSLP.

In some embodiments, provided is a composition comprising one or more antisense oligonucleotides or dsRNA agents targeted to a first nucleic acid and one or more additional antisense compounds targeted to a second nucleic acid target. For example, the first target may be a particular sequence of long-form thymic stromal lymphopoietin (1fTSLP), and the second target may be a region from another nucleotide sequence. Alternatively, compositions of the invention may contain two or more antisense oligonucleotide or dsRNA compounds targeted to different regions of the same 1fTSLP nucleic acid target. Numerous examples of antisense oligonucleotide or dsRNA compounds are illustrated herein and others may be selected from among suitable compounds known in the art. Two or more combined compounds may be used together or sequentially.

In some embodiments, a composition is provided that includes a plurality of antisense oligonucleotide or dsRNA agent species. In some embodiments, the antisense oligonucleotide or dsRNA agent species has sequences that are non-overlapping and non-adjacent to another species with respect to a naturally occurring target sequence. In some embodiments, the plurality of antisense oligonucleotide or dsRNA agent species is specific for different naturally occurring target genes. In some embodiments, the dsRNA agent is allele specific.

The disclosure provides methods, compositions, and kits, for administration and delivery of antisense oligonucleotide or dsRNA agents described herein.

Disclosed herein, in some embodiments, is are compositions comprising an oligonucleotide that targets a long isoform of Thymic stromal lymphopoietin (1fTSLP) and when administered to a subject in an effective amount decreases an eosinophil count. In some embodiments, the eosinophil count is decreased by about 2.5% or more, about 5% or more, or about 7.5% or more. In some embodiments, the eosinophil count is decreased by about 10% or more. In some embodiments, the eosinophil count is decreased by about 20% or more, about 30% or more, about 40% or more, about 50% or more, about 60% or more, about 70% or more, about 80% or more, about 90% or more, or about 100% or more. In some embodiments, the eosinophil count is decreased by about 200% or more, about 300% or more, about 400% or more, about 500% or more, about 600% or more, about 700% or more, about 800% or more, about 900% or more, or about 1000% or more. In some embodiments, the eosinophil count is decreased by no more than about 2.5%, no more than about 5%, or no more than about 7.5%. In some embodiments, the eosinophil count is decreased by no more than about 10%. In some embodiments, the eosinophil count is decreased by no more than about 20%, no more than about 30%, no more than about 40%, no more than about 50%, no more than about 60%, no more than about 70%, no more than about 80%, no more than about 90%, or no more than about 100%. In some embodiments, the eosinophil count is decreased by no more than about 200%, no more than about 300%, no more than about 400%, no more than about 500%, no more than about 600%, no more than about 700%, no more than about 800%, no more than about 900%, or no more than about 1000%. In some embodiments, the eosinophil count is decreased by 2.5%, 5%, 7.5%, 10%, 20%, 30%, 40%, 50%, 60%, 70%, 80%, 90%, 100%, 200% 300%, 400%, 500%, 600%, 700%, 800%, 900%, 1000%, or by a range defined by any of the two aforementioned percentages.

In some aspects, the composition comprises an oligonucleotide that targets 1fTSLP and when administered to a subject in an effective amount decreases an inflammatory marker. In some embodiments, the inflammatory marker is decreased by about 2.5% or more, about 5% or more, or about 7.5% or more. In some embodiments, the inflammatory marker is decreased by about 10% or more. In some embodiments, the inflammatory marker is decreased by about 20% or more, about 30% or more, about 40% or more, about 50% or more, about 60% or more, about 70% or more, about 80% or more, about 90% or more, or about 100% or more. In some embodiments, the inflammatory marker is decreased by about 200% or more, about 300% or more, about 400% or more, about 500% or more, about 600% or more, about 700% or more, about 800% or more, about 900% or more, or about 1000% or more. In some embodiments, the inflammatory marker is decreased by no more than about 2.5%, no more than about 5%, or no more than about 7.5%. In some embodiments, the inflammatory marker is decreased by no more than about 10%. In some embodiments, the inflammatory marker is decreased by no more than about 20%, no more than about 30%, no more than about 40%, no more than about 50%, no more than about 60%, no more than about 70%, no more than about 80%, no more than about 90%, or no more than about 100%. In some embodiments, the inflammatory marker is decreased by no more than about 200%, no more than about 300%, no more than about 400%, no more than about 500%, no more than about 600%, no more than about 700%, no more than about 800%, no more than about 900%, or no more than about 1000%. In some embodiments, the inflammatory marker is decreased by 2.5%, 5%, 7.5%, 10%, 20%, 30%, 40%, 50%, 60%, 70%, 80%, 90%, 100%, 200% 300%, 400%, 500%, 600%, 700%, 800%, 900%, 1000%, or by a range defined by any of the two aforementioned percentages.

In some aspects, the composition comprises an oligonucleotide that targets 1fTSLP and when administered to a subject in an effective amount decreases mucus production. In some embodiments, the mucus production is decreased by about 2.5% or more, about 5% or more, or about 7.5% or more. In some embodiments, the mucus production is decreased by about 10% or more. In some embodiments, the mucus production is decreased by about 20% or more, about 30% or more, about 40% or more, about 50% or more, about 60% or more, about 70% or more, about 80% or more, about 90% or more, or about 100% or more. In some embodiments, the mucus production is decreased by about 200% or more, about 300% or more, about 400% or more, about 500% or more, about 600% or more, about 700% or more, about 800% or more, about 900% or more, or about 1000% or more. In some embodiments, the mucus production is decreased by no more than about 2.5%, no more than about 5%, or no more than about 7.5%. In some embodiments, the mucus production is decreased by no more than about 10%. In some embodiments, the mucus production is decreased by no more than about 20%, no more than about 30%, no more than about 40%, no more than about 50%, no more than about 60%, no more than about 70%, no more than about 80%, no more than about 90%, or no more than about 100%. In some embodiments, the mucus production is decreased by no more than about 200%, no more than about 300%, no more than about 400%, no more than about 500%, no more than about 600%, no more than about 700%, no more than about 800%, no more than about 900%, or no more than about 1000%. In some embodiments, the mucus production is decreased by 2.5%, 5%, 7.5%, 10%, 20%, 30%, 40%, 50%, 60%, 70%, 80%, 90%, 100%, 200% 300%, 400%, 500%, 600%, 700%, 800%, 900%, 1000%, or by a range defined by any of the two aforementioned percentages.

In some embodiments, the 1fTSLP is encoded by a nucleic acid comprising SEQ ID NO: 14923, or a variant thereof at least 70% identical, at least 75% identical, at least 80% identical, at least 85% identical, at least 90% identical, at least 91% identical, at least 92% identical, at least 93% identical, at least 94% identical, at least 95% identical, at least 96% identical, at least 97% identical, at least 98% identical, at least 99% identical, to SEQ ID NO: 14923. In some embodiments, the 1fTSLP is encoded by a nucleic acid comprising SEQ ID NO: 14923.

In some embodiments, the oligonucleotide is specific for 1fTSLP, and/or does not target a short isoform of TSLP (sfTSLP). In some embodiments, the oligonucleotide is specific for sfTSLP, and/or does not target a long form of TSLP (1fTSLP). In some embodiments, the oligonucleotide targets both sfTSLP and 1fTSLP.

In some embodiments, the oligonucleotide comprises a modified internucleoside linkage. In some embodiments, the modified internucleoside linkage comprises alkylphosphonate, phosphorothioate, methylphosphonate, phosphorodithioate, alkylphosphonothioate, phosphoramidate, carbamate, carbonate, phosphate triester, acetamidate, or carboxymethyl ester, or a combination thereof. In some embodiments, the modified internucleoside linkage comprises one or more phosphorothioate linkages. In some embodiments, the oligonucleotide comprises no more than 18 modified internucleoside linkages. In some embodiments, the oligonucleotide comprises no more than 20 modified internucleoside linkages. In some embodiments, the oligonucleotide comprises 1, 2, 3, 4, 5, 6, 7, 8, 9, 10, 11, 12, 13, 14, 15, 16, 17, 18, 19, or 20 modified internucleoside linkages, or a range of modified internucleoside linkages defined by any two of the aforementioned numbers. In some embodiments, the oligonucleotide comprises 2 or more modified internucleoside linkages, 3 or more modified internucleoside linkages, 4 or more modified internucleoside linkages, 5 or more modified internucleoside linkages, 6 or more modified internucleoside linkages, 7 or more modified internucleoside linkages, 8 or more modified internucleoside linkages, 9 or more modified internucleoside linkages, 10 or more modified internucleoside linkages, 11 or more modified internucleoside linkages, 12 or more modified internucleoside linkages, 13 or more modified internucleoside linkages, 14 or more modified internucleoside linkages, 15 or more modified internucleoside linkages, 16 or more modified internucleoside linkages, 17 or more modified internucleoside linkages, 18 or more modified internucleoside linkages, 19 or more modified internucleoside linkages, or 20 or more modified internucleoside linkages.

In some embodiments, the oligonucleotide comprises a modified nucleoside. In some embodiments, the modified nucleoside comprises a locked nucleic acid (LNA), hexitol nucleic acid (HLA), cyclohexene nucleic acid (CeNA), 2'-methoxyethyl, 2'-O-alkyl, 2'-O-allyl, 2'-O-allyl, 2'-fluoro, or 2'-deoxy, or a combination thereof. In some embodiments, the modified nucleoside comprises an LNA. In some embodiments, the modified nucleoside comprises a 2',4' constrained ethyl nucleic acid. In some embodiments, the modified nucleoside comprises a 2'-O-methyl nucleoside, 2'-deoxyfluoro nucleoside, 2'-O—N-methylacetamido (2'-O-NMA) nucleoside, a 2'-O-dimethylaminoethoxyethyl (2'-O-DMAEOE) nucleoside, 2'-O-aminopropyl (2'-O-AP) nucleoside, or 2'-ara-F, or a combination thereof. In some embodiments, the modified nucleoside comprises one or more 2'fluoro modified nucleosides. In some embodiments, the modified nucleoside comprises a 2' O-alkyl modified nucleoside.

In some embodiments, the oligonucleotide comprises a lipid attached at a 3' or 5' terminus of the oligonucleotide. In some embodiments, the lipid comprises cholesterol, myristoyl, palmitoyl, stearoyl, lithocholoyl, docosanoyl, docosahexaenoyl, myristyl, palmityl stearyl, or α-tocopherol, or a combination thereof.

In some embodiments, the oligonucleotide comprises 1, 2, 3, 4, 5, 6, 7, 8, 9, 10, 11, 12, 13, 14, 15, 16, 17, 18, 19, 20, or 21 modified nucleosides, or a range of nucleosides defined by any two of the aforementioned numbers. In some embodiments, the oligonucleotide comprises no more than 19 modified nucleosides. In some embodiments, the oligonucleotide comprises no more than 21 modified nucleosides. In some embodiments, the oligonucleotide comprises 2 or more modified nucleosides, 3 or more modified nucleosides, 4 or more modified nucleosides, 5 or more modified nucleosides, 6 or more modified nucleosides, 7 or more modified nucleosides, 8 or more modified nucleosides, 9 or more modified nucleosides, 10 or more modified nucleosides, 11 or more modified nucleosides, 12 or more modified nucleosides, 13 or more modified nucleosides, 14 or more modified nucleosides, 15 or more modified nucleosides, 16 or more modified nucleosides, 17 or more modified nucleosides, 18 or more modified nucleosides, 19 or more modified nucleosides, 20 or more modified nucleosides, or 21 or more modified nucleosides.

dsRNA Agent

In one aspect, provided herein is a double-stranded RNAi (dsRNA) agent capable of inhibiting the expression of 1fTSLP. The dsRNA agent comprises a sense strand and an antisense strand. In some cases, the sense strand comprises a sequence at least about 80%, 85%, 90%, 95%, or 100% identical to a sequence selected from SEQ ID NOS: 1-5184. In some cases, the antisense strand comprises a sequence at least about 80%, 85%, 90%, 95%, or 100% identical to the reverse complement of the sense strand. In some cases, the antisense strand comprises a sequence at least about 80%, 85%, 90%, 95%, or 100% identical to a sequence selected from SEQ ID NOS: 1-5184.

In one aspect, provided herein is a double-stranded RNAi (dsRNA) agent capable of inhibiting the expression of sfTSLP. The dsRNA agent comprises a sense strand and an antisense strand. In some cases, the sense strand comprises a sequence at least about 80%, 85%, 90%, 95%, or 100% identical to a sequence selected from SEQ ID NOS: 5185-9970. In some cases, the antisense strand comprises a sequence at least about 80%, 85%, 90%, 95%, or 100% identical to the reverse complement of the sense strand. In some cases, the antisense strand comprises a sequence at least about 80%, 85%, 90%, 95%, or 100% identical to a sequence selected from SEQ ID NOS: 5185-9970.

In some cases, each strand of the dsRNA agent can range from 12-30 nucleotides in length. For example, each strand can be between 14-30 nucleotides in length, 17-30 nucleotides in length, 25-30 nucleotides in length, 27-30 nucleotides in length, 17-23 nucleotides in length, 17-21 nucleotides in length, 17-19 nucleotides in length, 19-25 nucleotides in length, 19-23 nucleotides in length, 19-21 nucleotides in length, 21-25 nucleotides in length, or 21-23 nucleotides in length.

The sense strand and anti sense strand typically form a duplex dsRNA. The duplex region of a dsRNA agent may be 12-30 nucleotide pairs in length. For example, the duplex region can be between 14-30 nucleotide pairs in length, 17-30 nucleotide pairs in length, 25-30 nucleotides in length, 27-30 nucleotide pairs in length, 17-23 nucleotide pairs in length, 17-21 nucleotide pairs in length, 17-19 nucleotide pairs in length, 19-25 nucleotide pairs in length, 19-23 nucleotide pairs in length, 19-21 nucleotide pairs in length, 21-25 nucleotide pairs in length, or 21-23 nucleotide pairs in length. In another example, the duplex region has a length of about 15, 16, 17, 18, 19, 20, 21, 22, 23, 24, 25, 26, and 27.

In some embodiments, the dsRNA agent comprises one or more overhang regions and/or capping groups at the 3'-end, or 5'-end, or both ends of a strand. In some cases, the overhang is about 1-6 nucleotides in length, for instance 2-6 nucleotides in length, 1-5 nucleotides in length, 2-5 nucleotides in length, 1-4 nucleotides in length, 2-4 nucleotides in length, 1-3 nucleotides in length, 2-3 nucleotides in length, or 1-2 nucleotides in length. The overhang can be the result of one strand being longer than the other, or the result of two strands of the same length being staggered. The overhang can form a mismatch with the target mRNA or it can be complementary to the gene sequences being targeted or can be other sequence. The first and second strands can also be joined, e.g., by additional bases to form a hairpin, or by other non-base linkers.

dsRNA Modifications

The modifications described herein in reference to dsRNA agents may be applicable to antisense oligonucleotides described elsewhere herein.

In some embodiments, one or more nucleotides in the sense and/or antisense strand of a dsRNA agent is modified. In some cases, every nucleotide in the sense strand and antisense strand of the dsRNA has been modified. The modifications on sense strand and antisense strand may each independently comprises at least two different modifications. In some cases, not every nucleotide in the sense and antisense strand is modified. In some cases, no nucleotide in the sense and/or antisense strand is modified. In some embodiments, the sense strand of the dsRNA agent comprises a modification pattern as described herein. In some embodiments, the antisense strand of the dsRNA agent comprises a modification pattern as described herein.

In some cases, the sense strand contains at least one motif of three identical modifications on three consecutive nucleotides, where at least one of the motifs occurs at or near the cleavage site in the antisense strand. In some cases, the antisense strand contains at least one motif of three identical modifications on three consecutive nucleotides. The modification pattern of the antisense strand may be shifted by one or more nucleotides relative to the modification pattern of the sense strand.

In some cases, the sense strand contains at least two motifs of three identical modifications on three consecutive nucleotides, when at least one of the motifs occurs at the cleavage site in the strand and at least one of the motifs occurs at another portion of the strand that is separated from the motif at the cleavage site by at least one nucleotide. In some cases, the antisense strand contains at least one motif of three identical modifications on three consecutive nucleotides, where at least one of the motifs occurs at or near the cleavage site in the strand and at least one of the motifs occurs at another portion of the strand that is separated from the motif at or near cleavage site by at least one nucleotide.

In some cases, the sense strand contains at least two motifs of three identical modifications on three consecutive nucleotides, where at least one of the motifs occurs at the cleavage site in the strand and at least one of the motifs occurs at another portion of the strand that is separated from the motif at the cleavage site by at least one nucleotide. In some cases, the antisense strand contains at least one motif of three identical modifications on three consecutive nucleotides, where at least one of the motifs occurs at or near the cleavage site in the strand and at least one of the motifs occurs at another portion of the strand that is separated from the motif at or near cleavage site by at least one nucleotide. In some cases, the modification in the motif occurring at the cleavage site in the sense strand is different than the modification in the motif occurring at or near the cleavage site in the antisense strand.

In some cases, the sense strand contains at least one motif of three 2'-F modifications on three consecutive nucleotides, where at least one of the motifs occurs at the cleavage site in the strand. In some cases, the antisense strand contains at least one motif of three 2'-O-methyl modifications on three consecutive nucleotides.

In some cases, the sense strand comprises one or more motifs of three identical modifications on three consecutive nucleotides, where the one or more additional motifs occur at another portion of the strand that is separated from the three 2'-F modifications at the cleavage site by at least one nucleotide. The antisense strand may comprise one or more motifs of three identical modifications on three consecutive nucleotides, where the one or more additional motifs occur at another portion of the strand that is separated from the three 2'-O-methyl modifications by at least one nucleotide. In some cases at least one of the nucleotides having a 2'-F modification may form a base pair with one of the nucleotides having a 2'-O-methyl modification.

In some embodiments, if the dsRNA agent comprises an overhang, the nucleotides in the overhang region of the dsRNA agent can each independently be a modified or unmodified nucleotide. Non-limiting examples of modifications include, but are not limited to, a 2'-sugar modification, such as, 2-F 2'-Omethyl, thymidine (T), 2'-O-methoxyethyl-5-methyluridine (Teo), 2'-O-methoxyethyl adenosine (Aeo), 2'-O-methoxyethyl-5-methylcytidine (m5Ceo), and any combinations thereof. For example, TT can be an overhang sequence for either end on either strand. The overhang can form a mismatch with the target mRNA or it can be complementary to the gene sequences being targeted or can be other sequence.

In some embodiments, if the dsRNA agent comprises an overhang, the 5'- and/or 3'-overhang at the sense strand, antisense strand or both strands of the dsRNA agent may be phosphorylated. In some embodiments, the overhang region contains two nucleotides having a phosphorothioate between the two nucleotides, where the two nucleotides can be the same or different. In some embodiments, the overhang is present at the 3'-end of the sense strand, antisense strand or both strands. In some embodiments, this 3'-overhang is present in the antisense strand. In some embodiments, this 3'-overhang is present in the sense strand.

In some embodiments, the modified dsRNA agent comprises one or more modified nucleotides including, but not limited to, 2'OMe nucleotides, 2'-deoxy-2'-fluoro (2'F) nucleotides, 2'-deoxy nucleotides, 2'-O-(2-methoxyethyl) (MOE) nucleotides, locked nucleic acid (LNA) nucleotides, or combinations thereof. In some embodiments, the modified dsRNA agent comprises 2'OMe nucleotides (e.g., 2'OMe purine and/or pyrimidine nucleotides) such as, for example, 2'OMe-guanosine nucleotides, 2'OMe-uridine nucleotides, 2'OMe-adenosine nucleotides, 2'OMe-cytosine nucleotides, or combinations thereof. In certain instances, the modified dsRNA agent does not comprise 2'OMe-cytosine nucleotides. In some embodiments, the modified dsRNA agent comprises a hairpin loop structure.

In certain aspects, the modified dsRNA agent has an IC50 less than or equal to ten-fold that of the corresponding unmodified dsRNA (e.g., the modified dsRNA agent has an IC50 that is less than or equal to ten-times the IC50 of the corresponding unmodified dsRNA agent). In some embodiments, the modified dsRNA agent has an IC50 less than or equal to three-fold that of the corresponding unmodified dsRNA agent. In some embodiments, the modified dsRNA agent has an IC50 less than or equal to two-fold that of the corresponding unmodified dsRNA agent. It will be readily apparent to those of skill in the art that a dose response curve can be generated and the IC50 values for the modified dsRNA agent and the corresponding unmodified dsRNA agent can be readily determined using methods known to those of skill in the art.

The modified dsRNA agent may have 3' overhangs of one, two, three, four, or more nucleotides on one or both sides of the double-stranded region, or may lack overhangs (i.e., have blunt ends). In some cases, the modified dsRNA agent has 3' overhangs of two nucleotides on each side of the double-stranded region. In certain instances, the 3' overhang on the antisense strand has complementarity to the target sequence and the 3' overhang on the sense strand has complementarity to the complementary strand of the target sequence. In some cases, the 3' overhangs do not have complementarity to the target sequence or the complementary strand thereof. In some embodiments, the 3' overhangs comprise one, two, three, four, or more nucleotides such as 2'-deoxy(2'H) nucleotides. In some cases, the 3' overhangs comprise deoxythymidine (dT) nucleotides.

In some embodiments, the modified dsRNA agent comprises from about 1% to about 100% (e.g., about 1%, 5%, 10%, 15%, 20%, 25%, 30%, 35%, 40%, 45%, 50%, 55%, 60%, 65%, 70%, 75%, 80%, 85%, 90%, 95%, or 100%) modified nucleotides in the double-stranded region of the dsRNA agent. In some embodiments, less than about 30% (e.g., less than about 30%, 25%, 20%, 15%, 10%, or 5%) or from about 1% to about 30% (e.g., from about 1%-30%, 5%-30%, 10%-30%, 15%-30%, 20%-30%, or 25%-30%) of the nucleotides in the double-stranded region of the dsRNA agent comprise modified nucleotides.

In some embodiments, the dsRNA agent does not comprise phosphate backbone modifications, e.g., in the sense and/or antisense strand of the double-stranded region. In some embodiments, the modified dsRNA agent does not comprise 2'-deoxy nucleotides, e.g., in the sense and/or antisense strand of the double-stranded region. In certain instances, the nucleotide at the 3'-end of the double-stranded region in the sense and/or antisense strand is not a modified nucleotide. In certain instances, the nucleotides near the 3'-end (e.g., within one, two, three, or four nucleotides of the 3'-end) of the double-stranded region in the sense and/or antisense strand are not modified nucleotides.

The dsRNA agent may have 3' overhangs of one, two, three, four, or more nucleotides on one or both sides of the double-stranded region, or may lack overhangs (i.e., have blunt ends). In some cases, the dsRNA agent has 3' overhangs of two nucleotides on each side of the double-stranded region. In some embodiments, the 3' overhangs comprise one, two, three, four, or more nucleotides such as 2'-deoxy (2'H) nucleotides. In some cases, the 3' overhangs comprise deoxythymidine (dT) nucleotides.

The dsRNA agent may also have a blunt end, located at the 5'-end of the antisense strand (or the 3'-end of the sense strand) or vice versa. In some cases, the antisense strand of the dsRNA has a nucleotide overhang at the 3'-end, and the 5'-end is blunt. While not bound by theory, the asymmetric blunt end at the 5'-end of the antisense strand and 3'-end overhang of the antisense strand may favor the guide strand loading into RISC process.

In some embodiments, the dsRNA agent may also have two blunt ends, at both ends of the dsRNA duplex.

In some embodiments, every nucleotide in the sense strand and antisense strand of the dsRNA agent, including the nucleotides that are part of the motifs, may be modified. Each nucleotide may be modified with the same or different modification which can include one or more alteration of one or both of the non-linking phosphate oxygens and/or of one or more of the linking phosphate oxygens; alteration of a constituent of the ribose sugar, e.g., of the 2' hydroxyl on the ribose sugar; wholesale replacement of the phosphate moiety with "dephospho" linkers; modification or replacement of a naturally occurring base; and replacement or modification of the ribose-phosphate backbone. In some embodiments, fewer than all nucleotides in the sense and antisense strand are modified.

As nucleic acids are polymers of subunits, in some cases, many of the modifications occur at a position which is repeated within a nucleic acid, e.g., a modification of a base, or a phosphate moiety, or a non-linking O of a phosphate moiety. In some cases the modification will occur at all of the subject positions in the nucleic acid but in other cases it will not. By way of example, a modification may only occur at a 3' or 5' terminal position, may only occur in a terminal region, e.g., at a position on a terminal nucleotide or in the last 2, 3, 4, 5, or 10 nucleotides of a strand. A modification may occur in a double strand region, a single strand region, or in both. A modification may occur only in the double strand region of a R A or may only occur in a single strand region of a RNA. For example, a phosphorothioate modification at a non-linking O position may only occur at one or both termini, may only occur in a terminal region, e.g., at a position on a terminal nucleotide or in the last 2, 3, 4, 5, or 10 nucleotides of a strand, or may occur in double strand and single strand regions, particularly at termini. The 5' end or ends can be phosphorylated.

It may be possible, e.g., to enhance stability, to include particular bases in overhangs, or to include modified nucleotides or nucleotide surrogates, in single strand overhangs, e.g., in a 5' or 3' overhang, or in both. For example, purine nucleotides may be included in overhangs. In some embodiments all or some of the bases in a 3' or 5' overhang may be modified, e.g., with a modification described herein. Modifications can include, e.g., the use of modifications at the 2' position of the ribose sugar with modifications that are known in the art, e.g., the use of deoxyribonucleotides, 2'-deoxy-2'-fluoro (2'-F) or 2'-O-methyl modified instead of the ribosugar of the nucleobase, and modifications in the phosphate group, e.g., phosphorothioate modifications. In some cases, overhangs need not be homologous with the target sequence.

In some embodiments, each residue of the sense strand and antisense strand is independently modified with LNA, HNA, CeNA, 2'-methoxyethyl, 2'-0-methyl, 2'-O-allyl, 2'-C-allyl, 2'-deoxy, or 2'-fluoro. The strands can contain more than one modification. In some embodiments, each residue of the sense strand and antisense strand is independently modified with 2'-0-methyl or 2'-fluoro.

In some embodiments, at least two different modifications are present on the sense strand and antisense strand. Those two modifications may be the 2'-0-methyl or 2'-fluoro modifications, or others.

In some embodiments, the sense strand and antisense strand each contains two differently modified nucleotides selected from 2'-O-methyl or 2'-fluoro.

In some embodiments, each residue of the sense strand and antisense strand is independently modified with 2'-O-methyl nucleotide, 2'-deoxyfluoro nucleotide, 2-O—N-methylacetamido (2'-O-NMA) nucleotide, a 2'-O-dimethylaminoethoxyethyl (2'-O-DMAEOE) nucleotide, 2'-O-aminopropyl (2'-O-AP) nucleotide, or 2'-ara-F nucleotide.

The type of modifications contained in an alternating motif may be the same or different. For example, if A, B, C, D each represent one type of modification on the nucleotide, the alternating pattern, i.e., modifications on every other nucleotide, may be the same, but each of the sense strand or antisense strand can be selected from several possibilities of modifications within the alternating motif such as "ABA-BAB . . . ", "AC AC AC . . . " "BDBDBD . . . " or "CDCDCD . . . ," etc.

In some embodiments, the dsRNA agent comprises the modification pattern for the alternating motif on the sense strand relative to the modification pattern for the alternating motif on the antisense strand is shifted. The shift may be such that the modified group of nucleotides of the sense strand corresponds to a differently modified group of nucleotides of the antisense strand and vice versa. For example, the sense strand when paired with the antisense strand in the dsRNA duplex, the alternating motif in the sense strand may start with "ABABAB" from 5'-3' of the strand and the alternating motif in the antisense strand may start with "BABABA" from 3'-5 of the strand within the duplex region. As another example, the alternating motif in the sense strand may start with "AABBAABB" from 5'-3' of the strand and the alternating motif in the anti sense strand may start with "BBAABBAA" from 3'-5 Of the strand within the duplex region, so that there is a complete or partial shift of the modification patterns between the sense strand and the anti sense strand.

In some embodiments, the dsRNA agent comprises the pattern of the alternating motif of 2'-O-methyl modification and 2'-F modification on the sense strand initially has a shift relative to the pattern of the alternating motif of 2'-O-methyl modification and 2'-F modification on the antisense strand initially, i.e., the 2'-O-methyl modified nucleotide on the sense strand base pairs with a 2'-F modified nucleotide on the antisense strand and vice versa. The 1 position of the sense strand may start with the 2'-F modification, and the 1 position of the antisense strand may start with the 2'-O-methyl modification. The introduction of one or more motifs of three identical modifications on three consecutive nucleotides to the sense strand and/or antisense strand interrupts the initial modification pattern present in the sense strand and/or antisense strand. This interruption of the modification pattern of the sense and/or anti sense strand by introducing one or more motifs of three identical modifications on three consecutive nucleotides to the sense and/or antisense strand may enhance the gene silencing activity to the target gene.

The dsRNA agent may comprise at least one phosphorothioate or methylphosphonate internucleotide linkage. The phosphorothioate or methylphosphonate internucleotide linkage modification may occur on any nucleotide of the sense strand or antisense strand or both in any position of the strand. For instance, the internucleotide linkage modification may occur on every nucleotide on the sense strand and/or antisense strand; each internucleotide linkage modification may occur in an alternating pattern on the sense strand or antisense strand; or the sense strand or antisense strand comprises both internucleotide linkage modifications in an alternating pattern. The alternating pattern of the internucleotide linkage modification on the sense strand may be the same or different from the antisense strand, and the alternating pattern of the internucleotide linkage modification on the sense strand may have a shift relative to the alternating pattern of the internucleotide linkage modification on the antisense strand.

In some embodiments, the dsRNA comprises the phosphorothioate or methylphosphonate internucleotide linkage modification in the overhang region. For example, the overhang region comprises two nucleotides having a phosphorothioate or methylphosphonate internucleotide linkage between the two nucleotides. Internucleotide linkage modifications also may be made to link the overhang nucleotides with the terminal paired nucleotides within duplex region. For example, at least 2, 3, 4, or all the overhang nucleotides may be linked through phosphorothioate or methylphosphonate internucleotide linkage, and optionally, there may be additional phosphorothioate or methylphosphonate internucleotide linkages linking the overhang nucleotide with a paired nucleotide that is next to the overhang nucleotide. For instance, there may be at least two phosphorothioate internucleotide linkages between the terminal three nucleotides, in which two of the three nucleotides are overhang nucleotides, and the third is a paired nucleotide next to the overhang nucleotide. In some cases, these terminal three nucleotides may be at the 3'-end of the antisense strand.

In some embodiments the sense strand of the dsRNA agent comprises 1-10 blocks of two to ten phosphorothioate or methylphosphonate internucleotide linkages separated by about 1, 2, 3, 4, 5, 6, 7, 8, 9, 10, 11, 12, 13, 14, 15 or 16 phosphate internucleotide linkages, wherein one of the phosphorothioate or methylphosphonate internucleotide linkages is placed at any position in the oligonucleotide sequence and the said sense strand is paired with an antisense strand comprising any combination of phosphorothioate, methylphosphonate and phosphate internucleotide linkages or an antisense strand comprising either phosphorothioate or methylphophonate or phosphate linkage.

In some embodiments the antisense strand of the dsRNA agent comprises two blocks of two phosphorothioate or methylphosphonate internucleotide linkages separated by about 1, 2, 3, 4, 5, 6, 7, 8, 9, 10, 11, 12, 13, 14, 15, 16, 17, or 18 phosphate internucleotide linkages, wherein one of the phosphorothioate or methylphosphonate internucleotide linkages is placed at any position in the oligonucleotide sequence and the said antisense strand is paired with a sense strand comprising any combination of phosphorothioate, methylphosphonate and phosphate internucleotide linkages or an antisense strand comprising either phosphorothioate or methylphophonate or phosphate linkage.

In some embodiments the antisense strand of the dsRNA agent comprises two blocks of three phosphorothioate or methylphosphonate internucleotide linkages separated by about 1, 2, 3, 4, 5, 6, 7, 8, 9, 10, 11, 12, 13, 14, 15 or 16 phosphate internucleotide linkages, wherein one of the phosphorothioate or methylphosphonate internucleotide linkages is placed at any position in the oligonucleotide sequence and the said antisense strand is paired with a sense strand comprising any combination of phosphorothioate, methylphosphonate and phosphate internucleotide linkages or an antisense strand comprising either phosphorothioate or methylphophonate or phosphate linkage.

In some embodiments the antisense strand of the dsRNA agent comprises two blocks of four phosphorothioate or methylphosphonate internucleotide linkages separated by about 1, 2, 3, 4, 5, 6, 7, 8, 9, 10, 11, 12, 13 or 14 phosphate internucleotide linkages, wherein one of the phosphorothioate or methylphosphonate internucleotide linkages is placed at any position in the oligonucleotide sequence and the said antisense strand is paired with a sense strand comprising any combination of phosphorothioate, methylphosphonate and phosphate internucleotide linkages or an antisense strand comprising either phosphorothioate or methylphophonate or phosphate linkage.

In some embodiments the antisense strand of the dsRNA agent comprises two blocks of five phosphorothioate or methylphosphonate internucleotide linkages separated by about 1, 2, 3, 4, 5, 6, 7, 8, 9, 10, 11 or 12 phosphate internucleotide linkages, wherein one of the phosphorothioate or methylphosphonate internucleotide linkages is placed at any position in the oligonucleotide sequence and the said antisense strand is paired with a sense strand comprising any combination of phosphorothioate, methylphosphonate and phosphate internucleotide linkages or an antisense strand comprising either phosphorothioate or methylphophonate or phosphate linkage.

In some embodiments the antisense strand of the dsRNA agent comprises two blocks of six phosphorothioate or methylphosphonate internucleotide linkages separated by about 1, 2, 3, 4, 5, 6, 7, 8, 9 or 10 phosphate internucleotide linkages, wherein one of the phosphorothioate or methylphosphonate internucleotide linkages is placed at any position in the oligonucleotide sequence and the said antisense strand is paired with a sense strand comprising any combination of phosphorothioate, methylphosphonate and phosphate internucleotide linkages or an antisense strand comprising either phosphorothioate or methylphophonate or phosphate linkage.

In some embodiments the antisense strand of the dsRNA agent comprises two blocks of seven phosphorothioate or methylphosphonate internucleotide linkages separated by about 1, 2, 3, 4, 5, 6, 7 or 8 phosphate internucleotide linkages, wherein one of the phosphorothioate or methylphosphonate internucleotide linkages is placed at any position in the oligonucleotide sequence and the said antisense strand is paired with a sense strand comprising any combination of phosphorothioate, methylphosphonate and phosphate internucleotide linkages or an antisense strand comprising either phosphorothioate or methylphophonate or phosphate linkage.

In some embodiments the antisense strand of the dsRNA agent comprises two blocks of eight phosphorothioate or methylphosphonate internucleotide linkages separated by about 1, 2, 3, 4, 5 or 6 phosphate internucleotide linkages, wherein one of the phosphorothioate or methylphosphonate internucleotide linkages is placed at any position in the oligonucleotide sequence and the said antisense strand is paired with a sense strand comprising any combination of phosphorothioate, methylphosphonate and phosphate internucleotide linkages or an antisense strand comprising either phosphorothioate or methylphophonate or phosphate linkage.

In some embodiments the antisense strand of the dsRNA agent comprises two blocks of nine phosphorothioate or methylphosphonate internucleotide linkages separated by about 1, 2, 3 or 4 phosphate internucleotide linkages, wherein one of the phosphorothioate or methylphosphonate internucleotide linkages is placed at any position in the oligonucleotide sequence and the said antisense strand is paired with a sense strand comprising any combination of phosphorothioate, methylphosphonate and phosphate internucleotide linkages or an antisense strand comprising either phosphorothioate or methylphophonate or phosphate linkage.

In some embodiments, the dsRNA agent comprises one or more phosphorothioate or methylphosphonate internucleotide linkage modification within 1-10 of the termini position(s) of the sense and/or antisense strand. For example, at least about 2, 3, 4, 5, 6, 7, 8, 9 or 10 nucleotides may be linked through phosphorothioate or methylphosphonate internucleotide linkage at one end or both ends of the sense and/or antisense strand.

In some embodiments, the dsRNA agent comprises one or more phosphorothioate or methylphosphonate internucleotide linkage modification within 1-10 of the internal region of the duplex of each of the sense and/or antisense strand. For example, at least about 2, 3, 4, 5, 6, 7, 8, 9 or 10 nucleotides may be linked through phosphorothioate methylphosphonate internucleotide linkage at position 8-16 of the duplex region counting from the 5'-end of the sense strand; the dsRNA can optionally further comprise one or more phosphorothioate or methylphosphonate internucleotide linkage modification within 1-10 of the termini position(s).

In some embodiments, the dsRNA agent comprises one to five phosphorothioate or methylphosphonate internucleotide linkage modification(s) within position 1-5 and one to five phosphorothioate or methylphosphonate internucleotide linkage modification(s) within position 18-23 of the sense strand (counting from the 5'-end), and one to five phosphorothioate or methylphosphonate internucleotide linkage modification at positions 1 and 2 and one to five within positions 18-23 of the antisense strand (counting from the 5'-end).

In some embodiments, the dsRNA agent comprises one phosphorothioate internucleotide linkage modification within position 1-5 and one phosphorothioate or methylphosphonate internucleotide linkage modification within position 18-23 of the sense strand (counting from the 5'-end), and one phosphorothioate internucleotide linkage modification at positions 1 and 2 and two phosphorothioate or methylphosphonate internucleotide linkage modifications within positions 18-23 of the antisense strand (counting from the 5'-end).

In some embodiments, the dsRNA agent comprises two phosphorothioate internucleotide linkage modifications within position 1-5 and one phosphorothioate internucleotide linkage modification within position 18-23 of the sense strand (counting from the 5'-end), and one phosphorothioate internucleotide linkage modification at positions 1 and 2 and two phosphorothioate internucleotide linkage modifications within positions 18-23 of the antisense strand (counting from the 5'-end).

In some embodiments, the dsRNA agent comprises two phosphorothioate internucleotide linkage modifications within position 1-5 and two phosphorothioate internucleotide linkage modifications within position 18-23 of the sense strand (counting from the 5'-end), and one phosphorothioate internucleotide linkage modification at positions 1 and 2 and two phosphorothioate internucleotide linkage modifications within positions 18-23 of the antisense strand (counting from the 5'-end). In some embodiments, the dsRNA agent comprises two phosphorothioate internucleotide linkage modifications within position 1-5 and two phosphorothioate internucleotide linkage modifications within position 18-23 of the sense strand (counting from the 5'-end), and one phosphorothioate internucleotide linkage modification at positions 1 and 2 and one phosphorothioate internucleotide linkage modification within positions 18-23 of the antisense strand (counting from the 5'-end).

In some embodiments, the dsRNA agent comprises one phosphorothioate internucleotide linkage modification within position 1-5 and one phosphorothioate internucleotide linkage modification within position 18-23 of the sense strand (counting from the 5'-end), and two phosphorothioate internucleotide linkage modifications at positions 1 and 2 and two phosphorothioate internucleotide linkage modifications within positions 18-23 of the antisense strand (counting from the 5'-end).

In some embodiments, the dsRNA agent comprises one phosphorothioate internucleotide linkage modification within position 1-5 and one within position 18-23 of the sense strand (counting from the 5'-end), and two phosphorothioate internucleotide linkage modification at positions 1 and 2 and one phosphorothioate internucleotide linkage modification within positions 18-23 of the antisense strand (counting from the 5'-end).

In some embodiments, the dsRNA agent comprises one phosphorothioate internucleotide linkage modification within position 1-5 (counting from the 5'-end), and two phosphorothioate internucleotide linkage modifications at positions 1 and 2 and one phosphorothioate internucleotide linkage modification within positions 18-23 of the antisense strand (counting from the 5'-end).

In some embodiments, the dsRNA agent comprises two phosphorothioate internucleotide linkage modifications within position 1-5 (counting from the 5'-end), and one phosphorothioate internucleotide linkage modification at positions 1 and 2 and two phosphorothioate internucleotide linkage modifications within positions 18-23 of the antisense strand (counting from the 5'-end).

In some embodiments, the dsRNA agent comprises two phosphorothioate internucleotide linkage modifications within position 1-5 and one within position 18-23 of the sense strand (counting from the 5'-end), and two phosphorothioate internucleotide linkage modifications at positions 1 and 2 and one phosphorothioate internucleotide linkage modification within positions 18-23 of the antisense strand (counting from the 5'-end).

In some embodiments, the dsRNA agent comprises two phosphorothioate internucleotide linkage modifications within position 1-5 and one phosphorothioate internucleotide linkage modification within position 18-23 of the sense strand (counting from the 5'-end), and two phosphorothioate internucleotide linkage modifications at positions 1 and 2 and two phosphorothioate internucleotide linkage modifications within positions 18-23 of the antisense strand (counting from the 5'-end).

In some embodiments, the dsRNA agent comprises two phosphorothioate internucleotide linkage modifications within position 1-5 and one phosphorothioate internucleotide linkage modification within position 18-23 of the sense strand (counting from the 5'-end), and one phosphorothioate internucleotide linkage modification at positions 1 and 2 and two phosphorothioate internucleotide linkage modifications within positions 18-23 of the antisense strand (counting from the 5'-end).

In some embodiments, the dsRNA agent comprises two phosphorothioate internucleotide linkage modifications at position 1 and 2, and two phosphorothioate internucleotide linkage modifications at position 20 and 21 of the sense strand (counting from the 5'-end), and one phosphorothioate internucleotide linkage modification at positions 1 and one at position 21 of the antisense strand (counting from the 5'-end).

In some embodiments, the dsRNA agent comprises one phosphorothioate internucleotide linkage modification at position 1, and one phosphorothioate internucleotide linkage modification at position 21 of the sense strand (counting from the 5'-end), and two phosphorothioate internucleotide linkage modifications at positions 1 and 2 and two phosphorothioate internucleotide linkage modifications at positions 20 and 21 the antisense strand (counting from the 5'-end).

In some embodiments, the dsRNA agent comprises two phosphorothioate internucleotide linkage modifications at position 1 and 2, and two phosphorothioate internucleotide linkage modifications at position 21 and 22 of the sense strand (counting from the 5'-end), and one phosphorothioate internucleotide linkage modification at positions 1 and one phosphorothioate internucleotide linkage modification at position 21 of the antisense strand (counting from the 5'-end).

In some embodiments, the dsRNA agent comprises one phosphorothioate internucleotide linkage modification at position 1, and one phosphorothioate internucleotide linkage modification at position 21 of the sense strand (counting from the 5'-end), and two phosphorothioate internucleotide linkage modifications at positions 1 and 2 and two phosphorothioate internucleotide linkage modifications at positions 21 and 22 the antisense strand (counting from the 5'-end).

In some embodiments, the dsRNA agent comprises two phosphorothioate internucleotide linkage modifications at position 1 and 2, and two phosphorothioate internucleotide linkage modifications at position 22 and 23 of the sense strand (counting from the 5'-end), and one phosphorothioate internucleotide linkage modification at positions 1 and one phosphorothioate internucleotide linkage modification at position 21 of the antisense strand (counting from the 5'-end).

In some embodiments, the dsRNA agent comprises one phosphorothioate internucleotide linkage modification at position 1, and one phosphorothioate internucleotide linkage modification at position 21 of the sense strand (counting from the 5'-end), and two phosphorothioate internucleotide linkage modifications at positions 1 and 2 and two phosphorothioate internucleotide linkage modifications at positions 23 and 23 the antisense strand (counting from the 5'-end).

In some embodiments, the dsRNA agent comprises mismatch(es) with the target, within the duplex, or combinations thereof. The mismatch can occur in an overhang region or the duplex region. The base pair can be ranked on the basis of their propensity to promote dissociation or melting (e.g., on the free energy of association or dissociation of a particular pairing, the simplest approach is to examine the pairs on an individual pair basis, though next neighbor or similar analysis can also be used). In some cases, in terms of promoting dissociation: A:U is preferred over G:C; G:U is preferred over G:C; and I:C is preferred over G:C (I=inosine). In some cases, mismatches, e.g., non-canonical or other than canonical pairings (as described elsewhere herein) are preferred over canonical (A:T, A:U, G:C) pairings; and pairings which include a universal base are preferred over canonical pairings. In some embodiments, the dsRNA agent comprises at least one of the first 1, 2, 3, 4, or 5 base pairs within the duplex regions from the 5'-end of the antisense strand can be chosen independently from the group of: A:U, G:U, I:C, and mismatched pairs, e.g., non-canonical or other than canonical pairings or pairings which include a universal base, to promote the dissociation of the antisense strand at the 5'-end of the duplex.

In some embodiments, the nucleotide at the 1 position within the duplex region from the 5'-end in the antisense strand is selected from the group consisting of A, dA, dU, U, and dT. In some embodiments, at least one of the first 1, 2 or 3 base pair within the duplex region from the 5'-end of the antisense strand is an AU base pair. For example, the first base pair within the duplex region from the 5'-end of the antisense strand is an AU base pair.

In some embodiments, the dsRNA agent is conjugated to one or more carbohydrate moieties, which may optimize one or more properties of the dsRNA agent. In some cases, the carbohydrate moiety is attached to a modified subunit of the dsRNA agent. For example, the ribose sugar of one or more ribonucleotide subunits of a dsRNA agent can be replaced with another moiety, e.g., a non-carbohydrate (e.g., cyclic) carrier to which is attached a carbohydrate ligand. A ribonucleotide subunit in which the ribose sugar of the subunit has been so replaced is referred to herein as a ribose replacement modification subunit (RRMS). A cyclic carrier may be a carbocyclic ring system, i.e., all ring atoms are carbon atoms, or a heterocyclic ring system, i.e., one or more ring atoms may be a heteroatom, e.g., nitrogen, oxygen, sulfur. The cyclic carrier may be a monocyclic ring system, or may contain two or more rings, e.g. fused rings. The cyclic carrier may be a fully saturated ring system, or it may contain one or more double bonds.

In some embodiments, a ligand is attached to the dsRNA via a carrier. In some cases, the carriers include (i) at least one "backbone attachment point" or two "backbone attachment points" and (ii) at least one "tethering attachment point." In some cases, a "backbone attachment point" refers to a functional group, e.g. a hydroxy 1 group, or generally, a bond available for, and that is suitable for incorporation of the carrier into the backbone, e.g., the phosphate, or modified phosphate, e.g., sulfur containing, backbone, of a ribonucleic acid. A "tethering attachment point" (TAP), in some embodiments, refers to a constituent ring atom of the cyclic carrier, e.g., a carbon atom or a heteroatom (distinct from an atom which provides a backbone attachment point), that connects a selected moiety. The moiety can be, e.g., a carbohydrate, e.g. monosaccharide, disaccharide, trisaccharide, tetrasaccharide, oligosaccharide and polysaccharide. Optionally, the selected moiety is connected by an intervening tether to the cyclic carrier. Thus, the cyclic carrier may include a functional group, e.g., an amino group, or generally, provide a bond, that is suitable for incorporation or tethering of another chemical entity, e.g., a ligand to the constituent ring.

In some embodiments the dsRNA agent is conjugated to a ligand via a carrier, wherein the carrier can be cyclic group or acyclic group; e.g., the cyclic group is selected from pyrrolidinyl, pyrazolinyl, pyrazolidinyl, imidazolinyl, imidazolidinyl, piperidinyl, piperazinyl, [1,3]dioxolane, oxazolidinyl, isoxazolidinyl, morpholinyl, thiazolidinyl, isothiazolidinyl, quinoxalinyl, pyridazinonyl, tetrahydrofuryl and decalin; e.g., the acyclic group is selected from serinol backbone or diethanolamine backbone. The dsRNA agent may optionally be conjugated to one or more ligands. The ligand can be attached to the sense strand, antisense strand or both strands, at the 3'-end, 5'-end or both ends. For instance, the ligand may be conjugated to the sense strand, in particular, the 3'-end of the sense strand.

In some embodiments, the dsRNA is modified to promote stability. Stabilization of synthetic siRNA, such as a dsRNA herein, against rapid nuclease degradation may be regarded as a prerequisite for in vivo and therapeutic applications. This can be achieved using a variety of stabilization chemistries previously developed for other nucleic acid drugs, such as ribozymes and antisense molecules. These include chemical modifications to the native 2'-OH group in the ribose sugar backbone, such as 2'-O-methyl (2'OMe) and 2'-Fluoro (2'F) substitutions that can be readily introduced into siRNA as 2'-modified nucleotides during RNA synthesis. In some cases, the introduction of chemical modifications to native siRNA duplexes can have a negative impact on RNAi activity, therefore the design of chemically modified siRNA may require a stochastic screening approach to identify duplexes that retain potent gene silencing activity.

In some cases, when cleavage of the sense strand is inhibited, the endonucleolytic cleavage of target mRNA is impaired In some cases, incorporation of a 2'-O-Me ribose to the Ago2 cleavage site in the sense strand inhibits RNAi. In some cases, with regard to phosphorothioate modifications, cleavage of the sense strand may be required for efficient RNAi.

In some cases, the dsRNA agent comprises 2'-F modified residues, e.g., at the Ago2 cleavage site. The modification may or may not be motif specific, e.g., one modification includes 2'-F modifications on all pyrimidines on both sense and antisense strands as long as pyrimidine residue is present, without any selectivity.

In some cases, the dsRNA agent comprises two T-F modified residues, e.g., at the Ago2 cleavage site, on the sense and/or antisense strand. In some cases, for each particular strand, either all pyrimidines or all purines are modified.

In some cases, the dsRNA agent comprises 2'-OMe modifications or various combinations of 2'-F, 2'-OMe and phosphorothioate modifications to stabilize the siRNA. In some cases, the residues at the cleavage site of the antisense strand are not be modified with 2'-OMe in order to increase the stability of the siRNA.

siRNAs

In some embodiments, the oligonucleotide comprises a small interfering RNA (siRNA) comprising a sense strand and an antisense strand. In some embodiments, the sense strand is 12-30 nucleosides in length. In some embodiments, the composition comprises a sense strand that is at least about 10, 11, 12, 13, 14, 15, 15, 17, 18, 19, 20, 21, 22, 23, 24, 25, 26, 27, 28, 29, or 30 nucleosides in length, or a range defined by any of the two aforementioned numbers. In some embodiments, the composition comprises an antisense strand is 12-30 nucleosides in length. In some embodiments, the composition comprises an antisense strand that is at least about 10, 11, 12, 13, 14, 15, 15, 17, 18, 19, 20, 21, 22, 23, 24, 25, 26, 27, 28, 29, or 30 nucleosides in length, or a range defined by any of the two aforementioned numbers.

In some embodiments, the composition comprises an oligonucleotide that targets TSLP, wherein the oligonucleotides comprises a siRNA comprising a sense strand and an antisense strand. In some embodiments, the sense strand is 12-30 nucleosides in length. In some embodiments, the composition comprises a sense strand that is at least about 10, 11, 12, 13, 14, 15, 15, 17, 18, 19, 20, 21, 22, 23, 24, 25, 26, 27, 28, 29, or 30 nucleosides in length, or a range defined by any of the two aforementioned numbers. In some embodiments, the composition comprises an antisense strand is 12-30 nucleosides in length. In some embodiments, the composition comprises an antisense strand that is at least about 10, 11, 12, 13, 14, 15, 15, 17, 18, 19, 20, 21, 22, 23, 24, 25, 26, 27, 28, 29, or 30 nucleosides in length, or a range defined by any of the two aforementioned numbers.

In certain aspects, the composition comprises an oligonucleotide that targets 1fTSLP, wherein the oligonucleotide comprises a siRNA comprising a sense strand and an antisense strand, each strand is independently about 12-30 nucleosides in length, and at least one of the sense strand and the antisense strand comprises a nucleoside sequence comprising about 12-30 contiguous nucleosides of one of SEQ ID NO: 14923. In some embodiments, at least one of the sense strand and the antisense strand comprise a nucleoside sequence comprising at least about 10, 11, 12, 13, 14, 15, 15, 17, 18, 19, 20, 21, 22, 23, 24, 25, 26, 27, 28, 29, 30, or more contiguous nucleosides of one of SEQ ID NO: 14923.

In certain aspects, the composition comprises an oligonucleotide that targets 1fTSLP, wherein the oligonucleotide comprises an siRNA comprising a sense strand and an antisense strand, each strand is independently about 12-30 nucleosides in length, and at least one of the sense strand and the antisense strand comprises a nucleoside sequence comprising about 12-30 contiguous nucleosides of one of SEQ ID NO: 14925. In some embodiments, at least one of the sense strand and the antisense strand comprise a nucleoside sequence comprising at least about 10, 11, 12, 13, 14, 15, 15, 17, 18, 19, 20, 21, 22, 23, 24, 25, 26, 27, 28, 29, 30, or more contiguous nucleosides of one of SEQ ID NO: 14925.

In certain aspects, the composition comprises an oligonucleotide that targets sfTSLP, wherein the oligonucleotide comprises a siRNA comprising a sense strand and an antisense strand, each strand is independently about 12-30 nucleosides in length, and at least one of the sense strand and the antisense strand comprises a nucleoside sequence comprising about 12-30 contiguous nucleosides of one of SEQ ID NO: 14924. In some embodiments, at least one of the sense strand and the antisense strand comprise a nucleoside sequence comprising at least about 10, 11, 12, 13, 14, 15, 15, 17, 18, 19, 20, 21, 22, 23, 24, 25, 26, 27, 28, 29, 30, or more contiguous nucleosides of one of SEQ ID NO: 14924.

In some embodiments, the sense strand and the antisense strand form a double-stranded RNA duplex. In some embodiments, the first base pair of the double-stranded RNA duplex is an AU base pair.

In some embodiments the composition comprises an oligonucleotide that inhibits the expression of 1fTSLP, wherein the sense strand comprises a nucleoside sequence comprising the sequence of any one of SEQ ID NOs: 14935-17526, or a nucleic acid sequence thereof having 1 or 2 nucleoside substitutions, additions, or deletions. In some embodiments, the sense strand comprises a nucleoside sequence consisting of the sequence of any one of SEQ ID NOs: 14935-17526, or a nucleic acid sequence thereof having 1 or 2 nucleoside substitutions, additions, or deletions. In some embodiments, the sense strand comprises a nucleoside sequence comprising the sequence of any one of SEQ ID NOs: 14935-17526. In some embodiments, the sense strand comprises a nucleoside sequence consisting of the sequence of any one of SEQ ID NOs: 14935-17526.

In some embodiments the composition comprises an oligonucleotide that inhibits the expression of sfTSLP, wherein the sense strand comprises a nucleoside sequence comprising or consisting of the sequence of any one of SEQ ID NOs: 22711-22906, or a nucleic acid sequence thereof having 1 or 2 nucleoside substitutions, additions, or deletions. In some embodiments, the sense strand comprises a nucleoside sequence comprising or consisting of the sequence of any one of SEQ ID NOs: 22711-22906.

In some embodiments, the composition comprises an oligonucleotide that inhibits the expression of 1fTSLP, wherein the oligonucleotide comprises a siRNA comprising a sense strand and an antisense strand, wherein the sense strand comprises a nucleoside sequence comprising or consisting of a sense strand sequence of any one of SEQ ID NOs: 14935-17526, or a nucleic acid sequence thereof having 1 or 2 nucleoside substitutions, additions, or deletions. In some embodiments, the sense strand comprises a nucleoside sequence comprising or consisting of a sense strand sequence of any one of SEQ ID NOs: 14935-17526, or a nucleic acid sequence thereof having 3 or 4 nucleoside substitutions, additions, or deletions. In some embodiments, the sense strand further comprises a 3' overhang. In some embodiments, the 3' overhang comprises 1, 2, 3, 4, 5, 6, 7, 8, 9, or 10 nucleosides, or a range of nucleotides defined by any two of the aforementioned numbers. In some embodiments, the 3' overhang comprises 1, 2, or more nucleosides. In some embodiments, the 3' overhang comprises 2 nucleosides. In some embodiments, the sense strand further comprises a 5' overhang. In some embodiments, the 5' overhang comprises 1, 2, 3, 4, 5, 6, 7, 8, 9, or 10 nucleosides, or a range of nucleotides defined by any two of the aforementioned numbers. In some embodiments, the 5' overhang comprises 1, 2, or more nucleosides. In some embodiments, the 5' overhang comprises 2 nucleosides. In some embodiments, the sense strand comprises a nucleoside sequence comprising or consisting of a sense strand sequence of any one of SEQ ID NOs: 14935-17526, or a nucleic acid sequence thereof having 1 or 2 nucleoside additions at the 3' end.

In some embodiments, the composition comprises an oligonucleotide that inhibits the expression of sfTSLP, wherein the oligonucleotide comprises a siRNA comprising a sense strand and an antisense strand, wherein the sense strand comprises a nucleoside sequence comprising or consisting of a sense strand sequence of any one of SEQ ID NOs: 22711-22906, or a nucleic acid sequence thereof having 1 or 2 nucleoside substitutions, additions, or deletions. In some embodiments, the sense strand comprises a nucleoside sequence comprising or consisting of a sense strand sequence of any one of SEQ ID NOs: 22711-22906, or a nucleic acid sequence thereof having 3 or 4 nucleoside substitutions, additions, or deletions. In some embodiments, the sense strand further comprises a 3' overhang. In some embodiments, the 3' overhang comprises 1, 2, 3, 4, 5, 6, 7, 8, 9, or 10 nucleosides, or a range of nucleotides defined by any two of the aforementioned numbers. In some embodiments, the 3' overhang comprises 1, 2, or more nucleosides. In some embodiments, the 3' overhang comprises 2 nucleosides. In some embodiments, the sense strand further comprises a 5' overhang. In some embodiments, the 5' overhang comprises 1, 2, 3, 4, 5, 6, 7, 8, 9, or 10 nucleosides, or a range of nucleotides defined by any two of the aforementioned numbers. In some embodiments, the 5' overhang comprises 1, 2, or more nucleosides. In some embodiments, the 5' overhang comprises 2 nucleosides. In some embodiments, the sense strand comprises a nucleoside sequence comprising or consisting of a sense strand sequence of any one of SEQ ID NOs: 22711-22906, or a nucleic acid sequence thereof having 1 or 2 nucleoside additions at the 3' end.

In some embodiments the composition comprises an oligonucleoside that inhibits the expression of 1fTSLP, wherein the antisense strand comprises a nucleoside sequence comprising or consisting of the sequence of any one of SEQ ID NOs: 26134-28725, or a nucleic acid sequence thereof having 1 or 2 nucleoside substitutions, additions, or deletions. In some embodiments, the antisense strand comprises a nucleoside sequence comprising or consisting of the sequence of any one of SEQ ID NOs: 26134-28725.

In some embodiments the composition comprises an oligonucleoside that inhibits the expression of sfTSLP, wherein the antisense strand comprises a nucleoside sequence comprising or consisting of the sequence of any one of SEQ ID NOs: 28726-28921, or a nucleic acid sequence thereof having 1 or 2 nucleoside substitutions, additions, or deletions. In some embodiments, the antisense strand comprises a nucleoside sequence comprising or consisting of the sequence of any one of SEQ ID NOs: 28726-28921.

In some embodiments, the composition comprises an oligonucleotide that inhibits the expression of 1fTSLP, wherein the oligonucleotide comprises a siRNA comprising a sense strand and an antisense strand, wherein the antisense strand comprises a nucleoside sequence comprising or consisting of a sense strand sequence of any one of SEQ ID NOs: 14935-17526, or a nucleic acid sequence thereof having 1 or 2 nucleoside substitutions, additions, or deletions. In some embodiments, the antisense strand comprises a nucleoside sequence comprising or consisting of a sense strand sequence of any one of SEQ ID NOs: 14935-17526, or a nucleic acid sequence thereof having 3 or 4 nucleoside substitutions, additions, or deletions. In some embodiments, the antisense strand further comprises a 3' overhang. In some embodiments, the 3' overhang comprises 1, 2, 3, 4, 5, 6, 7, 8, 9, or 10 nucleosides, or a range of nucleotides defined by any two of the aforementioned numbers. In some embodiments, the 3' overhang comprises 1, 2, or more nucleosides. In some embodiments, the 3' overhang comprises 2 nucleosides. In some embodiments, the antisense strand further comprises a 5' overhang. In some embodiments, the 5' overhang comprises 1, 2, 3, 4, 5, 6, 7, 8, 9, or 10 nucleosides, or a range of nucleotides defined by any two of the aforementioned numbers. In some embodiments, the 5' overhang comprises 1, 2, or more nucleosides. In some embodiments, the 5' overhang comprises 2 nucleosides. In some embodiments, the antisense strand comprises a nucleoside sequence comprising or consisting of a antisense strand sequence of any one of SEQ ID NOs: 26134-28725, or a nucleic acid sequence thereof having 1 or 2 nucleoside additions at the 3' end.

In some embodiments, the composition comprises an oligonucleotide that inhibits the expression of sfTSLP, wherein the oligonucleotide comprises a siRNA comprising a sense strand and an antisense strand, wherein the antisense strand comprises a nucleoside sequence comprising or consisting of a sense strand sequence of any one of SEQ ID NOs: 22711-22906, or a nucleic acid sequence thereof having 1 or 2 nucleoside substitutions, additions, or deletions. In some embodiments, the antisense strand comprises a nucleoside sequence comprising or consisting of a sense strand sequence of any one of SEQ ID NOs: 22711-22906, or a nucleic acid sequence thereof having 3 or 4 nucleoside substitutions, additions, or deletions. In some embodiments, the antisense strand further comprises a 3' overhang. In some embodiments, the 3' overhang comprises 1, 2, 3, 4, 5, 6, 7, 8, 9, or 10 nucleosides, or a range of nucleotides defined by any two of the aforementioned numbers. In some embodiments, the 3' overhang comprises 1, 2, or more nucleosides. In some embodiments, the 3' overhang comprises 2 nucleosides. In some embodiments, the antisense strand further comprises a 5' overhang. In some embodiments, the 5' overhang comprises 1, 2, 3, 4, 5, 6, 7, 8, 9, or 10 nucleosides, or a range of nucleotides defined by any two of the aforementioned numbers. In some embodiments, the 5' overhang comprises 1, 2, or more nucleosides. In some embodiments, the 5' overhang comprises 2 nucleosides. In some embodiments, the antisense strand comprises a nucleoside sequence comprising or consisting of a antisense strand sequence of any one of SEQ ID NOs: 28726-28921, or a nucleic acid sequence thereof having 1 or 2 nucleoside additions at the 3' end.

In some embodiments, the composition comprises an oligonucleotide that inhibits the expression of 1fTSLP, wherein the siRNA binds with a 17 mer in a non-human primate 1fTSLP mRNA. In some embodiments, the siRNA binds with a 12 mer, a 13 mer, a 14 mer, a 15 mer, a 16 mer, a 17 mer, a 18 mer, a 19 mer, a 20 mer, a 21 mer, a 22 mer, a 23 mer, a 24 mer, or a 25 mer in a human 1fTSLP mRNA.

In some embodiments, the composition comprises an oligonucleotide that inhibits the expression of sfTSLP, wherein the siRNA binds with a 17 mer in a non-human primate sfTSLP mRNA. In some embodiments, the siRNA binds with a 12 mer, a 13 mer, a 14 mer, a 15 mer, a 16 mer, a 17 mer, a 18 mer, a 19 mer, a 20 mer, a 21 mer, a 22 mer, a 23 mer, a 24 mer, or a 25 mer in a human sfTSLP mRNA.

In some embodiments, the composition comprises an oligonucleotide that inhibits the expression of 1fTSLP, wherein the siRNA binds with a 19 mer in a human 1fTSLP mRNA. In some embodiments, the siRNA binds with a 12 mer, a 13 mer, a 14 mer, a 15 mer, a 16 mer, a 17 mer, a 18 mer, a 19 mer, a 20 mer, a 21 mer, a 22 mer, a 23 mer, a 24 mer, or a 25 mer in a human 1fTSLP mRNA.

In some embodiments, the composition comprises an oligonucleotide that inhibits the expression of sfTSLP, wherein the siRNA binds with a 19 mer in a human sfTSLP mRNA. In some embodiments, the siRNA binds with a 12 mer, a 13 mer, a 14 mer, a 15 mer, a 16 mer, a 17 mer, a 18 mer, a 19 mer, a 20 mer, a 21 mer, a 22 mer, a 23 mer, a 24 mer, or a 25 mer in a human sfTSLP mRNA.

In some embodiments, the composition comprises an oligonucleotide that inhibits the expression of 1fTSLP, wherein the siRNA binds with a human 1fTSLP mRNA and less than or equal to 20 human off-targets, with no more than 2 mismatches in the antisense strand. In some embodiments, the composition comprises an oligonucleotide that inhibits the expression of 1fTSLP, wherein the oligonucleotide comprises a siRNA comprising a sense strand and an antisense strand, wherein the siRNA binds with a human 1fTSLP mRNA and less than or equal to 20 human off-targets, with no more than 2 mismatches in the antisense strand. In some embodiments, the siRNA binds with a human 1fTSLP mRNA and less than or equal to 10 human off-targets, with no more than 2 mismatches in the antisense strand. In some embodiments, the siRNA binds with a human 1fTSLP mRNA and less than or equal to 30 human off-targets, with no more than 2 mismatches in the antisense strand. In some embodiments, the siRNA binds with a human 1fTSLP mRNA and less than or equal to 40 human off-targets, with no more than 2 mismatches in the antisense strand. In some embodiments, the siRNA binds with a human 1fTSLP mRNA and less than or equal to 50 human off-targets, with no more than 2 mismatches in the antisense strand. In some embodiments, the siRNA binds with a human 1fTSLP mRNA and less than or equal to 10 human off-targets, with no more than 3 mismatches in the antisense strand. In some embodiments, the siRNA binds with a human 1fTSLP mRNA and less than or equal to 20 human off-targets, with no more than 3 mismatches in the antisense strand. In some embodiments, the siRNA binds with a human 1fTSLP mRNA and less than or equal to 30 human off-targets, with no more than 3 mismatches in the antisense strand. In some embodiments, the siRNA binds with a human 1fTSLP mRNA and less than or equal to 40 human off-targets, with no more than 3 mismatches in the antisense strand. In some embodiments, the siRNA binds with a human 1fTSLP mRNA and less than or equal to 50 human off-targets, with no more than 3 mismatches in the antisense strand.

In some embodiments, the composition comprises an oligonucleotide that inhibits the expression of sfTSLP, wherein the siRNA binds with a human sfTSLP mRNA and less than or equal to 20 human off-targets, with no more than 2 mismatches in the antisense strand. In some embodiments, the composition comprises an oligonucleotide that inhibits the expression of sfTSLP, wherein the oligonucleotide comprises a siRNA comprising a sense strand and an antisense strand, wherein the siRNA binds with a human sfTSLP mRNA and less than or equal to 20 human off-targets, with no more than 2 mismatches in the antisense strand. In some embodiments, the siRNA binds with a human sfTSLP mRNA and less than or equal to 10 human off-targets, with no more than 2 mismatches in the antisense strand. In some embodiments, the siRNA binds with a human sfTSLP mRNA and less than or equal to 30 human off-targets, with no more than 2 mismatches in the antisense strand. In some embodiments, the siRNA binds with a human sfTSLP mRNA and less than or equal to 40 human off-targets, with no more than 2 mismatches in the antisense strand. In some embodiments, the siRNA binds with a human sfTSLP mRNA and less than or equal to 50 human off-targets, with no more than 2 mismatches in the antisense strand. In some embodiments, the siRNA binds with a human sfTSLP mRNA and less than or equal to 10 human off-targets, with no more than 3 mismatches in the antisense strand. In some embodiments, the siRNA binds with a human sfTSLP mRNA and less than or equal to 20 human off-targets, with no more than 3 mismatches in the antisense strand. In some embodiments, the siRNA binds with a human sfTSLP mRNA and less than or equal to 30 human off-targets, with no more than 3 mismatches in the antisense strand. In some embodiments, the siRNA binds with a human sfTSLP mRNA and less than or equal to 40 human off-targets, with no more than 3 mismatches in the antisense strand. In some embodiments, the siRNA binds with a human sfTSLP mRNA and less than or equal to 50 human off-targets, with no more than 3 mismatches in the antisense strand.

In some embodiments, the composition comprises an oligonucleotide that inhibits the expression of 1fTSLP, wherein the oligonucleotide comprises a siRNA comprising a sense and an anti sense sequence, wherein the siRNA binds with a human 1fTSLP mRNA target site that does not harbor an SNP, with a minor allele frequency (MAF) greater or equal to 1% (pos. 2-18). In some embodiments, the MAF is greater or equal to about 2%, about 3%, about 4%, about 5%, about 6%, about 7%, about 8%, about 9%, about 10%, about 11%, about 12%, about 13%, about 14%, about 15%, about 16%, about 17%, about 18%, about 19%, or about 20%.

In some embodiments, the composition comprises an oligonucleotide that inhibits the expression of sfTSLP, wherein the oligonucleotide comprises a siRNA comprising a sense and an anti sense sequence, wherein the siRNA binds with a human sfTSLP mRNA target site that does not harbor an SNP, with a minor allele frequency (MAF) greater or equal to 1% (pos. 2-18). In some embodiments, the MAF is greater or equal to about 2%, about 3%, about 4%, about 5%, about 6%, about 7%, about 8%, about 9%, about 10%, about 11%, about 12%, about 13%, about 14%, about 15%, about 16%, about 17%, about 18%, about 19%, or about 20%.

In some embodiments, the composition comprises an oligonucleotide that inhibits the expression of 1fTSLP, wherein the oligonucleotide comprises a siRNA comprising a sense and an antisense sequence, wherein the sense strand comprises the nucleoside sequence of any one of SEQ ID NOs: 14941, 14942, 14947, 14948, 14950, 14957, 14959, 14960, 14961, 14962, 14973, 15004, 15005, 15013, 15035, 15039, 15040, 15041, 15043, 15047, 15048, 15049, 15050, 15051, 15052, 15056, 15057, 15059, 15062, 15082, 15094, 15096, 15097, 15098, 15101, 15102, 15107, 15108, 15111, 15114, 15117, 15123, 15127, 15128, 15164, 15174, 15178, 15184, 15186, 15187, 15188, 15190, 15191, 15194, 15195, 15197, 15230, 15235, 15236, 15238, 15240, 15241, 15246, 15252, 15253, 15260, 15263, 15264, 15272, 15274, 15276, 15278, 15279, 15282, 15283, 15286, 15294, 15302, 15303, 15307, 15310, 15314, 15319, 15320, 15321, 15322, 15324, or 15326, or a nucleic acid sequence thereof having 1 or 2 nucleoside substitutions, additions, or deletions; and/or wherein the antisense strand comprises the nucleoside sequence of any one of SEQ ID NOs: 26140, 26141, 26146, 26147, 26149, 26156, 26158, 26159, 26160, 26161, 26172, 26203, 26204, 26212, 26234, 26238, 26239, 26240, 26242, 26246, 26247, 26248, 26249, 26250, 26251, 26255, 26256, 26258, 26261, 26281, 26293, 26295, 26296, 26297, 26300, 26301, 26306, 26307, 26310, 26313, 26316, 26322, 26326, 26327, 26363, 26373, 26377, 26383, 26385, 26386, 26387, 26389, 26390, 26393, 26394, 26396, 26429, 26434, 26435, 26437, 26439, 26440, 26445, 26451, 26452, 26459, 26462, 26463, 26471, 26473, 26475, 26477, 26478, 26481, 26482, 26485, 26493, 26501, 26502, 26506, 26509, 26513, 26518, 26519, 26520, 26521, 26523, or 26525, or a nucleic acid sequence thereof having 1 or 2 nucleoside substitutions, additions, or deletions.

In some embodiments, the composition comprises an oligonucleotide that inhibits the expression of 1fTSLP, wherein the oligonucleotide comprises a siRNA comprising a sense and an antisense sequence, the sense strand comprises the nucleoside sequence of any one of SEQ ID NOs: 14941, 14942, 14947, 14948, 14950, 14957, 14959, 14960, 14961, 14962, 14973, 15004, 15005, 15013, 15035, 15039, 15040, 15041, 15043, 15047, 15048, 15049, 15050, 15051, 15052, 15056, 15057, 15059, 15062, 15082, 15094, 15096, 15097, 15098, 15101, 15102, 15107, 15108, 15111, 15114, 15117, 15123, 15127, 15128, 15164, 15174, 15178, 15184, 15186, 15187, 15188, 15190, 15191, 15194, 15195, 15197, 15230, 15235, 15236, 15238, 15240, 15241, 15246, 15252, 15253, 15260, 15263, 15264, 15272, 15274, 15276, 15278, 15279, 15282, 15283, 15286, 15294, 15302, 15303, 15307, 15310, 15314, 15319, 15320, 15321, 15322, 15324, or 15326; and/or wherein the antisense strand comprises the nucleoside sequence of any one of SEQ ID NOs: 26140, 26141, 26146, 26147, 26149, 26156, 26158, 26159, 26160, 26161, 26172, 26203, 26204, 26212, 26234, 26238, 26239, 26240, 26242, 26246, 26247, 26248, 26249, 26250, 26251, 26255, 26256, 26258, 26261, 26281, 26293, 26295, 26296, 26297, 26300, 26301, 26306, 26307, 26310, 26313, 26316, 26322, 26326, 26327, 26363, 26373, 26377, 26383, 26385, 26386, 26387, 26389, 26390, 26393, 26394, 26396, 26429, 26434, 26435, 26437, 26439, 26440, 26445, 26451, 26452, 26459, 26462, 26463, 26471, 26473, 26475, 26477, 26478, 26481, 26482, 26485, 26493, 26501, 26502, 26506, 26509, 26513, 26518, 26519, 26520, 26521, 26523, or 26525.

In some embodiments, the composition comprises an oligonucleotide that inhibits the expression of 1fTSLP, wherein the oligonucleotide comprises a siRNA comprising a sense and an antisense sequence, the sense strand comprising the nucleoside sequence of any one of SEQ ID NOs: 20125, 20126, 20131, 20132, 20134, 20141, 20143, 20144, 20145, 20146, 20157, 20188, 20189, 20197, 20219, 20223, 20224, 20225, 20227, 20231, 20232, 20233, 20234, 20235, 20236, 20240, 20241, 20243, 20246, 20266, 20278, 20280, 20281, 20282, 20285, 20286, 20291, 20292, 20295, 20298, 20301, 20307, 20311, 20312, 20348, 20358, 20362, 20368, 20370, 20371, 20372, 20374, 20375, 20378, 20379, 20381, 20414, 20419, 20420, 20422, 20424, 20425, 20430, 20436, 20437, 20444, 20447, 20448, 20456, 20458, 20460, 20462, 20463, 20466, 20467, 20470, 20478, 20486, 20487, 20491, 20494, 20498, 20503, 20504, 20505, 20506, 20508, or 20510, and/or the antisense strand comprising the nucleoside sequence of any one of SEQ ID NOs: 31520, 31521, 31526, 31527, 31529, 31536, 31538, 31539, 31540, 31541, 31552, 31583, 31584, 31592, 31614, 31618, 31619, 31620, 31622, 31626, 31627, 31628, 31629, 31630, 31631, 31635, 31636, 31638, 31641, 31661, 31673, 31675, 31676, 31677, 31680, 31681, 31686, 31687, 31690, 31693, 31696, 31702, 31706, 31707, 31743, 31753, 31757, 31763, 31765, 31766, 31767, 31769, 31770, 31773, 31774, 31776, 31809, 31814, 31815, 31817, 31819, 31820, 31825, 31831, 31832, 31839, 31842, 31843, 31851, 31853, 31855, 31857, 31858, 31861, 31862, 31865, 31873, 31881, 31882, 31886, 31889, 31893, 31898, 31899, 31900, 31901, 31903, or 31905.

In some embodiments, the composition comprises an oligonucleotide that inhibits the expression of 1fTSLP, wherein the oligonucleotide comprises a siRNA comprising a sense and an antisense sequence, the sense strand comprises the nucleoside sequence of any one of SEQ ID NOs: 14942, 14947, 14948, 14950, 14957, 14959, 15004, 15035, 15039, 15040, 15041, 15043, 15047, 15048, 15049, 15050, 15051, 15057, 15059, 15082, 15094, 15096, 15097, 15098, 15102, 15107, 15108, 15111, 15114, 15123, 15127, 15128, 15164, 15184, 15186, 15187, 15188, 15190, 15191, 15194, 15195, 15230, 15235, 15236, 15238, 15241, 15246, 15252, 15260, 15263, 15272, 15276, 15278, 15279, 15283, 15294, 15302, 15307, 15314, 15322, 15324, or 15326; and/or wherein the antisense strand comprises the nucleoside sequence of any one of SEQ ID NOs: 26141, 26146, 26147, 26149, 26156, 26158, 26203, 26234, 26238, 26239, 26240, 26242, 26246, 26247, 26248, 26249, 26250, 26256, 26258, 26281, 26293, 26295, 26296, 26297, 26301, 26306, 26307, 26310, 26313, 26322, 26326, 26327, 26363, 26383, 26385, 26386, 26387, 26389, 26390, 26393, 26394, 26429, 26434, 26435, 26437, 26440, 26445, 26451, 26459, 26462, 26471, 26475, 26477, 26478, 26482, 26493, 26501, 26506, 26513, 26521, 26523, or 26525. In some embodiments, the composition comprises an oligonucleotide that inhibits the expression of 1fTSLP, wherein the oligonucleotide comprises a siRNA comprising a sense and an antisense sequence, wherein the sense strand comprises the nucleoside sequence of any one of SEQ ID NOs: 15041, 15048, 15051, 15082, 15096, 15111, 15114, 15123, 15128, 15187, 15194, 15230, 15235, 15238, 15241, 15252, 15272, 15278, 15307, or 15326; and/or wherein the antisense strand comprises the nucleoside sequence of any one of SEQ ID NOs: 26240, 26247, 26250, 26281, 26295, 26310, 26313, 26322, 26327, 26386, 26393, 26429, 26434, 26437, 26440, 26451, 26471, 26477, 26506, or 26525.

In some embodiments, the composition comprises an oligonucleotide that inhibits the expression of 1fTSLP, wherein the oligonucleotide comprises a siRNA comprising a sense and an antisense sequence, wherein the sense strand comprises the nucleoside sequence of any one of SEQ ID NOs: 15048, 15051, 15082, 15096, 15111, 15114, 15123, 15128, 15194, 15230, 15235, 15238, 15241, 15252, 15272, 15278, 15307, or 15326; and/or wherein the antisense strand comprises the nucleoside sequence of any one of SEQ ID NOs: 26247, 26250, 26281, 26295, 26310, 26313, 26322, 26327, 26393, 26429, 26434, 26437, 26440, 26451, 26471, 26477, 26506, or 26525.

In some embodiments, the composition comprises an oligonucleotide that inhibits the expression of sfTSLP, wherein the oligonucleotide comprises a siRNA comprising a sense and an anti sense sequence, wherein the sense strand comprises the nucleoside sequence of any one of SEQ ID NOS: 22734, 22736, 22738, 22746, 22773, 22778, 22780, 22781, 22782, 22783, 22785, 22786, 22787, 22788, 22789, 22790, 22824, 22825, 22827, 22828, 22872, 22873, 22874, 22876, 22877, 22879, 22880, 22881, 22882, 22884, 22885, 22887, 22889, 22890, 22895, 22898, or 22904; and/or wherein the antisense strand comprises the nucleoside sequence of any one of SEQ ID NOS: 28749, 28751, 28753, 28761, 28788, 28793, 28795, 28796, 28797, 28798, 28800, 28801, 28802, 28803, 28804, 28805, 28839, 28840, 28842, 28843, 28887, 28888, 28889, 28891, 28892, 28894, 28895, 28896, 28897, 28899, 28900, 28902, 28904, 28905, 28910, 28913, or 28919.

In some embodiments, the composition comprises an oligonucleotide that inhibits the expression of sfTSLP, wherein the oligonucleotide comprises a siRNA comprising a sense and an anti sense sequence, wherein the sense strand comprises the nucleoside sequence of any one of SEQ ID NOs: 22930, 22932, 22934, 22942, 22969, 22974, 22976, 22977, 22978, 22979, 22981, 22982, 22983, 22984, 22985, 22986, 23020, 23021, 23023, 23024, 23068, 23069, 23070, 23072, 23073, 23075, 23076, 23077, 23078, 23080, 23081, 23083, 23085, 23086, 23091, 23094, or 23100; and/or wherein the antisense strand comprises the nucleoside sequence of any one of SEQ ID NOs: 34129, 34131, 34133, 34141, 34168, 34173, 34175, 34176, 34177, 34178, 34180, 34181, 34182, 34183, 34184, 34185, 34219, 34220, 34222, 34223, 34267, 34268, 34269, 34271, 34272, 34274, 34275, 34276, 34277, 34279, 34280, 34282, 34284, 34285, 34290, 34293, or 34299.

In some embodiments, the composition comprises an oligonucleotide that inhibits the expression of sfTSLP, wherein the oligonucleotide comprises a siRNA comprising a sense and an anti sense sequence, wherein the sense strand comprises the nucleoside sequence of any one of 22969, 22974, or 23094, and/or wherein the antisense strand comprises the nucleoside sequence of any one of SEQ ID NOS: 34168, 34173, or 34293.

In some embodiments, the composition comprises an oligonucleotide that inhibits the expression of sfTSLP, wherein the oligonucleotide comprises a siRNA comprising a sense and an anti sense sequence, wherein the sense strand comprises the nucleoside sequence of any one of SEQ ID NOs: 23126, 23128, 23130, 23138, 23165, 23170, 23172, 23173, 23174, 23175, 23177, 23178, 23179, 23180, 23181, 23182, 23216, 23217, 23219, 23220, 23264, 23265, 23266, 23268, 23269, 23271, 23272, 23273, 23274, 23276, 23277, 23279, 23281, 23282, 23287, 23290, or 23296, and/or wherein the antisense strand comprises the nucleoside sequence of any one of SEQ ID NOs: 34521, 34523, 34525, 34533, 34560, 34565, 34567, 34568, 34569, 34570, 34572, 34573, 34574, 34575, 34576, 34577, 34611, 34612, 34614, 34615, 34659, 34660, 34661, 34663, 34664, 34666, 34667, 34668, 34669, 34671, 34672, 34674, 34676, 34677, 34682, 34685, or 34691.

In some embodiments, the sense strand is complementary to or targets a sequence within the first 412 nucleotides of SEQ ID NO: 14923. In some embodiments, the antisense strand is complementary to or targets a sequence within the first 412 nucleotides of SEQ ID NO: 14923. In some embodiments, the sense strand is complementary to or targets a sequence within nucleotides 8-412 of SEQ ID NO: 14923. In some embodiments, the antisense strand is complementary to or targets a sequence within nucleotides 8-412 of SEQ ID NO: 14923.

In some embodiments, the sense strand is complementary to or targets a sequence within a sequence within a 5' UTR of 1fTSLP. In some embodiments, the antisense strand is complementary to or targets a sequence within a 5' UTR of 1fTSLP. In some embodiments, the sense strand is complementary to or targets a sequence within a 3' UTR of 1fTSLP. In some embodiments, the antisense strand is complementary to or targets a sequence within a 3' UTR of 1fTSLP. In some embodiments, the sense strand is complementary to or targets a sequence within a coding region of 1fTSLP. In some embodiments, the antisense strand is complementary to or targets a sequence within a coding region of 1fTSLP.

In some embodiments, the sense strand is complementary to or targets a sequence within a sequence within a 5' UTR of sfTSLP. In some embodiments, the antisense strand is complementary to or targets a sequence within a 5' UTR of sfTSLP. In some embodiments, the sense strand is complementary to or targets a sequence within a 3' UTR of sfTSLP. In some embodiments, the antisense strand is complementary to or targets a sequence within a 3' UTR of sfTSLP. In some embodiments, the sense strand is complementary to or targets a sequence within a coding region of sfTSLP. In some embodiments, the antisense strand is complementary to or targets a sequence within a coding region of sfTSLP.

siRNA Modifications

In some embodiments, the composition comprises an oligonucleotide that inhibits the expression of 1fTSLP, wherein the oligonucleotide comprises a siRNA comprising a sense strand and an antisense strand, wherein the sense strand comprises the nucleoside sequence of any one of SEQ ID NOs: 17527-20118. In some embodiments, the sense strand comprises the nucleoside sequence of any one of SEQ ID NOs: 17527-20118, or a nucleic acid sequence thereof having 1 or 2 nucleoside substitutions, additions, or deletions. In some embodiments, the sense strand comprises the nucleoside sequence of any one of SEQ ID NOs: 17527-20118, or a nucleic acid sequence thereof having 3 or 4 nucleoside substitutions, additions, or deletions.

In some embodiments, the composition comprises an oligonucleotide that inhibits the expression of sfTSLP, wherein the oligonucleotide comprises a siRNA comprising a sense strand and an antisense strand, wherein the sense strand comprises the nucleoside sequence of any one of SEQ ID NOs: 22907-23102. In some embodiments, the sense strand comprises the nucleoside sequence of any one of SEQ ID NOs: 22907-23102, or a nucleic acid sequence thereof having 1 or 2 nucleoside substitutions, additions, or deletions. In some embodiments, the sense strand comprises the nucleoside sequence of any one of SEQ ID NOs: 22907-23102, or a nucleic acid sequence thereof having 3 or 4 nucleoside substitutions, additions, or deletions.

In some embodiments, the composition comprises an oligonucleotide that inhibits the expression of 1fTSLP, wherein the oligonucleotide comprises an siRNA comprising a sense strand and an antisense strand, wherein the sense strand comprises the nucleoside sequence of any one of SEQ ID NOs: 20119-22710. In some embodiments, the sense strand comprises the nucleoside sequence of any one of SEQ ID NOs: 20119-22710, or a nucleic acid sequence thereof having 1 or 2 nucleoside substitutions, additions, or deletions. In some embodiments, the sense strand comprises the nucleoside sequence of any one of SEQ ID NOs: 20119-22710, or a nucleic acid sequence thereof having 3 or 4 nucleoside substitutions, additions, or deletions.

In some embodiments, the composition comprises an oligonucleotide that inhibits the expression of 1fTSLP, wherein the oligonucleotide comprises an siRNA comprising a sense strand and an antisense strand, wherein the anti sense strand comprises the nucleoside sequence of any one of SEQ ID NOs: 28922-31513. In some embodiments, the antisense strand comprises the nucleoside sequence of any one of SEQ ID NOs: 28922-31513, or a nucleic acid sequence thereof having 1 or 2 nucleoside substitutions, additions, or deletions. In some embodiments, the antisense strand comprises the nucleoside sequence of any one of SEQ ID NOs: 28922-31513, or a nucleic acid sequence thereof having 3 or 4 nucleoside substitutions, additions, or deletions.

In some embodiments, the composition comprises an oligonucleotide that inhibits the expression of sfTSLP, wherein the oligonucleotide comprises an siRNA comprising a sense strand and an antisense strand, wherein the anti sense strand comprises the nucleoside sequence of any one of SEQ ID NOs: 34106-34301. In some embodiments, the antisense strand comprises the nucleoside sequence of any one of SEQ ID NOs: 34106-34301, or a nucleic acid sequence thereof having 1 or 2 nucleoside substitutions, additions, or deletions. In some embodiments, the antisense strand comprises the nucleoside sequence of any one of SEQ ID NOs: 34106-34301, or a nucleic acid sequence thereof having 3 or 4 nucleoside substitutions, additions, or deletions.

In some embodiments, the composition comprises an oligonucleotide that inhibits the expression of 1fTSLP, wherein the oligonucleotide comprises an siRNA comprising a sense strand and an antisense strand, wherein the antisense strand comprises the nucleoside sequence of any one of SEQ ID NOs: 31514-34105. In some embodiments, the antisense strand comprises the nucleoside sequence of any one of SEQ ID NOs: 31514-34105, or a nucleic acid sequence thereof having 1 or 2 nucleoside substitutions, additions, or deletions. In some embodiments, the antisense strand comprises the nucleoside sequence of any one of SEQ ID NOs: 31514-34105, or a nucleic acid sequence thereof having 3 or 4 nucleoside substitutions, additions, or deletions.

In some embodiments, the composition comprises an oligonucleotide that inhibits the expression of sfTSLP, wherein the oligonucleotide comprises an siRNA comprising a sense strand and an antisense strand, wherein the antisense strand comprises the nucleoside sequence of any one of SEQ ID NOs: 34302-34497. In some embodiments, the antisense strand comprises the nucleoside sequence of any one of SEQ ID NOs: 34302-34497, or a nucleic acid sequence thereof having 1 or 2 nucleoside substitutions, additions, or deletions. In some embodiments, the antisense strand comprises the nucleoside sequence of any one of SEQ ID NOs: 34302-34497, or a nucleic acid sequence thereof having 3 or 4 nucleoside substitutions, additions, or deletions.

In some embodiments, the composition comprises an oligonucleotide that inhibits the expression of 1fTSLP, wherein the oligonucleotide comprises an siRNA comprising a sense strand and an antisense strand, wherein the sense strand comprises modification pattern 1S: 5'-NfsnsNfnNfnNfNfNfnNfnNfnNfnNfnNfsnsn-3' (SEQ ID NO: 34502), wherein "Nf" is a 2' fluoro-modified nucleoside, "n" is a 2' O-methyl modified nucleoside, and "s" is a phosphorothioate linkage. In some embodiments, the sense strand comprises modification pattern 2S: 5'-nsnsnnNfnNfNfNfnnnnnnnnnsnsn-3' (SEQ ID NO: 34504), wherein "Nf" is a 2' fluoro-modified nucleoside, "n" is a 2' O-methyl modified nucleoside, and "s" is a phosphorothioate linkage. In some embodiments, the sense strand comprises modification pattern 3S: 5'-nsnsnnNfnNfnNfnnnnnnnnnnnsnsn-3' (SEQ ID NO: 34507), wherein "Nf" is a 2' fluoro-modified nucleoside, "n" is a 2' O-methyl modified nucleoside, and "s" is a phosphorothioate linkage. In some embodiments, the sense strand comprises modification pattern 4S: 5'-NfsnsNfnNfnNfNfNfnNfnNffiNffiNfnNfnNfsnsnN-Lipid-3' (SEQ ID NO: 34508), wherein "Nf" is a 2' fluoro-modified nucleoside, "n" is a 2' O-methyl modified nucleoside, "s" is a phosphorothioate linkage, and N comprises one or more nucleosides. In some embodiments, the sense strand comprises modification pattern 5S: 5'-nsnsnnNffiNfNfNfnnnnnnnnnnsnsnN-Lipid-3' (SEQ ID NO: 34509), wherein "Nf" is a 2' fluoro-modified nucleoside, "n" is a 2' O-methyl modified nucleoside, "s" is a phosphorothioate linkage, and N comprises one or more nucleosides.

In some embodiments, the composition comprises an oligonucleotide that inhibits the expression of sfTSLP, wherein the oligonucleotide comprises an siRNA comprising a sense strand and an antisense strand, wherein the sense strand comprises modification pattern 1S 5'-NfsnsNfnNfnNfNfNfnNfnNfnNfnNfnNfsnsn-3' (SEQ ID NO: 34502), wherein "Nf" is a 2' fluoro-modified nucleoside, "n" is a 2' O-methyl modified nucleoside, and "s" is a phosphorothioate linkage. In some embodiments, the sense strand comprises modification pattern 2S: 5'-nsnsnnNfnNfNfNfnnnnnnnnnnsnsn-3' (SEQ ID NO: 34504), wherein "Nf" is a 2' fluoro-modified nucleoside, "n" is a 2' O-methyl modified nucleoside, and "s" is a phosphorothioate linkage. In some embodiments, the sense strand comprises modification pattern 3S: 5'-nsnsnnNfnNfnNfnnnnnnnnnnnsnsn-3' (SEQ ID NO: 34507), wherein "Nf" is a 2' fluoro-modified nucleoside, "n" is a 2' O-methyl modified nucleoside, and "s" is a phosphorothioate linkage. In some embodiments, the sense strand comprises modification pattern 4S: 5'-NfsnsNfnNfnNfNfNfnNfnNfnNfnNfnNfsnsnN-Lipid-3' (SEQ ID NO: 34508), wherein "Nf" is a 2' fluoro-modified nucleoside, "n" is a 2' O-methyl modified nucleoside, "s" is a phosphorothioate linkage, and N comprises one or more nucleosides. In some embodiments, the sense strand comprises modification pattern 5S: 5'-nsnsnnNfnNfNfNfnnnnnnnnnnnsnsnN-Lipid-3' (SEQ ID NO: 34509), wherein "Nf" is a 2' fluoro-modified nucleoside, "n" is a 2' O-methyl modified nucleoside, "s" is a phosphorothioate linkage, and N comprises one or more nucleosides.

In some embodiments, the composition comprises an oligonucleotide that inhibits the expression of 1fTSLP, wherein the oligonucleotide comprises an siRNA comprising a sense strand and an antisense strand, wherein the antisense strand comprises modification pattern 1AS: 5'-nsNfsnNfnNfnNfnNfnNfnnnNfnNfnNfsnsn-3' (SEQ ID NO: 34503), wherein "Nf" is a 2' fluoro-modified nucleoside, "n" is a 2' O-methyl modified nucleoside, and "s" is a phosphorothioate linkage. In some embodiments, the antisense strand comprises modification pattern 2AS: 5'-nsNfsnnnNfnNfNfnnnnNfnNfnnnsnsn-3' (SEQ ID NO: 34510), wherein "Nf" is a 2' fluoro-modified nucleoside, "n" is a 2' O-methyl modified nucleoside, and "s" is a phosphorothioate linkage. In some embodiments, the antisense strand comprises modification pattern 3AS: 5'-nsNfsnnnNfnnnnnnnNfnNfnnnsnsn-3' (SEQ ID NO: 34505), wherein "Nf" is a 2' fluoro-modified nucleoside, "n" is a 2' O-methyl modified nucleoside, and "s" is a phosphorothioate linkage. In some embodiments, the antisense strand comprises modification pattern 4AS: 5'-nsNfsnNfnNfnnnnnnnNfnNfnnnsnsn-3' (SEQ ID NO: 34511), wherein "Nf" is a 2' fluoro-modified nucleoside, "n" is a 2' O-methyl modified nucleoside, and "s" is a phosphorothioate linkage.

In some embodiments, the composition comprises an oligonucleotide that inhibits the expression of sfTSLP, wherein the oligonucleotide comprises an siRNA comprising a sense strand and an antisense strand, wherein the antisense strand comprises modification pattern 1AS: 5'-nsNfsnNfnNfnNfnNfnNfnnnNfnNfnNfsnsn-3' (SEQ ID NO: 34503), wherein "Nf" is a 2' fluoro-modified nucleoside, "n" is a 2' O-methyl modified nucleoside, and "s" is a phosphorothioate linkage. In some embodiments, the antisense strand comprises modification pattern 2AS: 5'-nsNfsnnnNfnNfNfnnnnNfnNfnnnsnsn-3' (SEQ ID NO: 34510), wherein "Nf" is a 2' fluoro-modified nucleoside, "n" is a 2' O-methyl modified nucleoside, and "s" is a phosphorothioate linkage. In some embodiments, the antisense strand comprises modification pattern 3AS: 5'-nsNfsnnnNfnnnnnnnNfnNfnnnsnsn-3' (SEQ ID NO: 34505), wherein "Nf" is a 2' fluoro-modified nucleoside, "n" is a 2' O-methyl modified nucleoside, and "s" is a phosphorothioate linkage. In some embodiments, the antisense strand comprises modification pattern 4AS: 5'-nsNfsnNfnNfnnnnnnnNfnNfnnnsnsn-3' (SEQ ID NO: 34511), wherein "Nf" is a 2' fluoro-modified nucleoside, "n" is a 2' O-methyl modified nucleoside, and "s" is a phosphorothioate linkage.

In some embodiments, the composition comprises an oligonucleotide that inhibits the expression of 1fTSLP, wherein the oligonucleotide comprises an siRNA comprising a sense strand and an antisense strand, wherein the sense strand comprises pattern 1S and the antisense strand comprises pattern 1AS, 2AS, 3AS, or 4AS. In some embodiments the sense strand comprises pattern 2S and the antisense strand comprises pattern 1AS, 2AS, 3AS, or 4AS. In some embodiments the sense strand comprises pattern 3S and the antisense strand comprises pattern 1AS, 2AS, 3AS, or 4AS. In some embodiments the sense strand comprises pattern 4S and the antisense strand comprises pattern 1AS, 2AS, 3AS, or 4AS.

In some embodiments, the composition comprises an oligonucleotide that inhibits the expression of sfTSLP, wherein the oligonucleotide comprises an siRNA comprising a sense strand and an antisense strand, wherein the sense strand comprises pattern 1S and the antisense strand comprises pattern 1AS, 2AS, 3AS, or 4AS. In some embodiments the sense strand comprises pattern 2S and the antisense strand comprises pattern 1AS, 2AS, 3AS, or 4AS. In some embodiments the sense strand comprises pattern 3S and the antisense strand comprises pattern 1AS, 2AS, 3AS, or 4AS. In some embodiments the sense strand comprises pattern 4S and the antisense strand comprises pattern 1AS, 2AS, 3AS, or 4AS.

In some embodiments, the composition comprises an oligonucleotide that inhibits the expression of 1fTSLP, wherein the oligonucleotide comprises an siRNA comprising a sense strand and an antisense strand, wherein the sense strand comprises the nucleoside sequence of any one of SEQ ID NOs: 17533, 17534, 17539, 17540, 17542, 17549, 17551, 17552, 17553, 17554, 17565, 17596, 17597, 17605, 17627, 17631, 17632, 17633, 17635, 17639, 17640, 17641, 17642, 17643, 17644, 17648, 17649, 17651, 17654, 17674, 17686, 17688, 17689, 17690, 17693, 17694, 17699, 17700, 17703, 17706, 17709, 17715, 17719, 17720, 17756, 17766, 17770, 17776, 17778, 17779, 17780, 17782, 17783, 17786, 17787, 17789, 17822, 17827, 17828, 17830, 17832, 17833, 17838, 17844, 17845, 17852, 17855, 17856, 17864, 17866, 17868, 17870, 17871, 17874, 17875, 17878, 17886, 17894, 17895, 17899, 17902, 17906, 17911, 17912, 17913, 17914, 17916, or 17918; and/or wherein the antisense strand comprises the nucleoside sequence of any one of SEQ ID NOs: 28928, 28929, 28934, 28935, 28937, 28944, 28946, 28947, 28948, 28949, 28960, 28991, 28992, 29000, 29022, 29026, 29027, 29028, 29030, 29034, 29035, 29036, 29037, 29038, 29039, 29043, 29044, 29046, 29049, 29069, 29081, 29083, 29084, 29085, 29088, 29089, 29094, 29095, 29098, 29101, 29104, 29110, 29114, 29115, 29151, 29161, 29165, 29171, 29173, 29174, 29175, 29177, 29178, 29181, 29182, 29184, 29217, 29222, 29223, 29225, 29227, 29228, 29233, 29239, 29240, 29247, 29250, 29251, 29259, 29261, 29263, 29265, 29266, 29269, 29270, 29273, 29281, 29289, 29290, 29294, 29297, 29301, 29306, 29307, 29308, 29309, 29311, or 29313. In some embodiments, the oligonucleotide comprises a modification pattern as described herein. In some embodiments, the oligonucleotide comprises a sense strand having the sequence of any one of SEQ ID NOs: 25890-25977. In some embodiments, the oligonucleotide comprises an antisense strand having the sequence of any one of SEQ ID NOs: 26012-26099. In some embodiments, the siRNA specifically targets 1fTSLP.

In some embodiments, the composition comprises an oligonucleotide that inhibits the expression of 1fTSLP, wherein the oligonucleotide comprises a siRNA comprising a sense and an antisense sequence, the sense strand comprising the nucleoside sequence of any one of SEQ ID NOs: 20125, 20126, 20131, 20132, 20134, 20141, 20143, 20144, 20145, 20146, 20157, 20188, 20189, 20197, 20219, 20223, 20224, 20225, 20227, 20231, 20232, 20233, 20234, 20235, 20236, 20240, 20241, 20243, 20246, 20266, 20278, 20280, 20281, 20282, 20285, 20286, 20291, 20292, 20295, 20298, 20301, 20307, 20311, 20312, 20348, 20358, 20362, 20368, 20370, 20371, 20372, 20374, 20375, 20378, 20379, 20381, 20414, 20419, 20420, 20422, 20424, 20425, 20430, 20436, 20437, 20444, 20447, 20448, 20456, 20458, 20460, 20462, 20463, 20466, 20467, 20470, 20478, 20486, 20487, 20491, 20494, 20498, 20503, 20504, 20505, 20506, 20508, or 20510, and/or the antisense strand comprising the nucleoside sequence of any one of SEQ ID NOs: 31520, 31521, 31526, 31527, 31529, 31536, 31538, 31539, 31540, 31541, 31552, 31583, 31584, 31592, 31614, 31618, 31619, 31620, 31622, 31626, 31627, 31628, 31629, 31630, 31631, 31635, 31636, 31638, 31641, 31661, 31673, 31675, 31676, 31677, 31680, 31681, 31686, 31687, 31690, 31693, 31696, 31702, 31706, 31707, 31743, 31753, 31757, 31763, 31765, 31766, 31767, 31769, 31770, 31773, 31774, 31776, 31809, 31814, 31815, 31817, 31819, 31820, 31825, 31831, 31832, 31839, 31842, 31843, 31851, 31853, 31855, 31857, 31858, 31861, 31862, 31865, 31873, 31881, 31882, 31886, 31889, 31893, 31898, 31899, 31900, 31901, 31903, or 31905; wherein the sense strand comprises Modification Pattern 2S, and/or the antisense strand comprises Modification Pattern 3AS.

In some embodiments, the composition comprises an oligonucleotide that inhibits the expression of 1fTSLP, wherein the oligonucleotide comprises an siRNA comprising a sense strand and an antisense strand, wherein the sense strand comprises the nucleoside sequence of any one of SEQ ID NOs: 17534, 17539, 17540, 17542, 17549, 17551, 17596, 17627, 17631, 17632, 17633, 17635, 17639, 17640, 17641, 17642, 17643, 17649, 17651, 17674, 17686, 17688, 17689, 17690, 17694, 17699, 17700, 17703, 17706, 17715, 17719, 17720, 17756, 17776, 17778, 17779, 17780, 17782, 17783, 17786, 17787, 17822, 17827, 17828, 17830, 17833, 17838, 17844, 17852, 17855, 17864, 17868, 17870, 17871, 17875, 17886, 17894, 17899, 17906, 17914, 17916, or 17918; and/or wherein the antisense strand comprises the nucleoside sequence of any one of SEQ ID NOs: 28929, 28934, 28935, 28937, 28944, 28946, 28991, 29022, 29026, 29027, 29028, 29030, 29034, 29035, 29036, 29037, 29038, 29044, 29046, 29069, 29081, 29083, 29084, 29085, 29089, 29094, 29095, 29098, 29101, 29110, 29114, 29115, 29151, 29171, 29173, 29174, 29175, 29177, 29178, 29181, 29182, 29217, 29222, 29223, 29225, 29228, 29233, 29239, 29247, 29250, 29259, 29263, 29265, 29266, 29270, 29281, 29289, 29294, 29301, 29309, 29311, or 29313. In some embodiments, the composition comprises an oligonucleotide that inhibits the expression of 1fTSLP, wherein the oligonucleotide comprises an siRNA comprising a sense strand and an antisense strand, wherein the sense strand comprises the nucleoside sequence of any one of SEQ ID NOs: 17633, 17640, 17643, 17674, 17688, 17703, 17706, 17715, 17720, 17779, 17786, 17822, 17827, 17830, 17833, 17844, 17864, 17870, 17899, or 17918; and/or wherein the antisense strand comprises the nucleoside sequence of any one of SEQ ID NOs: 29028, 29035, 29038, 29069, 29083, 29098, 29101, 29110, 29115, 29174, 29181, 29217, 29222, 29225, 29228, 29239, 29259, 29265, 29294, or 29313.

In some embodiments, the composition comprises an oligonucleotide that inhibits the expression of 1fTSLP, wherein the oligonucleotide comprises an siRNA comprising a sense strand and an antisense strand, wherein the sense strand comprises the nucleoside sequence of any one of SEQ ID NOs: 17640, 17643, 17674, 17688, 17703, 17706, 17715, 17720, 17786, 17822, 17827, 17830, 17833, 17844, 17864, 17870, 17899, or 17918; and/or wherein the antisense strand comprises the nucleoside sequence of any one of SEQ ID NOs: 29035, 29038, 29069, 29083, 29098, 29101, 29110, 29115, 29181, 29217, 29222, 29225, 29228, 29239, 29259, 29265, 29294, or 29313.

In some embodiments, the composition comprises an oligonucleotide that inhibits the expression of sfTSLP, wherein the oligonucleotide comprises a siRNA comprising a sense and an anti sense sequence, wherein the sense strand comprises the nucleoside sequence of any one of SEQ ID NOS: 22734, 22736, 22738, 22746, 22773, 22778, 22780, 22781, 22782, 22783, 22785, 22786, 22787, 22788, 22789, 22790, 22824, 22825, 22827, 22828, 22872, 22873, 22874, 22876, 22877, 22879, 22880, 22881, 22882, 22884, 22885, 22887, 22889, 22890, 22895, 22898, or 22904; and/or wherein the antisense strand comprises the nucleoside sequence of any one of SEQ ID NOS: 28749, 28751, 28753, 28761, 28788, 28793, 28795, 28796, 28797, 28798, 28800, 28801, 28802, 28803, 28804, 28805, 28839, 28840, 28842, 28843, 28887, 28888, 28889, 28891, 28892, 28894, 28895, 28896, 28897, 28899, 28900, 28902, 28904, 28905, 28910, 28913, or 28919. In some embodiments, the oligonucleotide comprises a modification pattern as described herein. In some embodiments, the siRNA targets sfTSLP. In some embodiments, the oligonucleotide comprises a sense strand having the sequence of any one of SEQ ID NOs: 25978-26011. In some embodiments, the oligonucleotide comprises an antisense strand having the sequence of any one of SEQ ID NOs: 26100-26133.

In some embodiments, the composition comprises an oligonucleotide that inhibits the expression of sfTSLP, wherein the oligonucleotide comprises a siRNA comprising a sense and an anti sense sequence, wherein the sense strand comprises the nucleoside sequence of any one of SEQ ID NOs: 22930, 22932, 22934, 22942, 22969, 22974, 22976, 22977, 22978, 22979, 22981, 22982, 22983, 22984, 22985, 22986, 23020, 23021, 23023, 23024, 23068, 23069, 23070, 23072, 23073, 23075, 23076, 23077, 23078, 23080, 23081, 23083, 23085, 23086, 23091, 23094, or 23100; and/or wherein the antisense strand comprises the nucleoside sequence of any one of SEQ ID NOs: 34129, 34131, 34133, 34141, 34168, 34173, 34175, 34176, 34177, 34178, 34180, 34181, 34182, 34183, 34184, 34185, 34219, 34220, 34222, 34223, 34267, 34268, 34269, 34271, 34272, 34274, 34275, 34276, 34277, 34279, 34280, 34282, 34284, 34285, 34290, 34293, or 34299.

In some embodiments, the composition comprises an oligonucleotide that inhibits the expression of sfTSLP, wherein the oligonucleotide comprises a siRNA comprising a sense and an anti sense sequence, wherein the sense strand comprises the nucleoside sequence of any one of 22969, 22974, or 23094, and/or wherein the antisense strand comprises the nucleoside sequence of any one of SEQ ID NOS: 34168, 34173, or 34293; wherein the sense strand comprises modification pattern 1S and/or the antisense strand comprises modification pattern 1AS.

In some embodiments, the composition comprises an oligonucleotide that inhibits the expression of sfTSLP, wherein the oligonucleotide comprises a siRNA comprising a sense and an antisense sequence, wherein the sense strand comprises the nucleoside sequence of any one of SEQ ID NOs: 23126, 23128, 23130, 23138, 23165, 23170, 23172, 23173, 23174, 23175, 23177, 23178, 23179, 23180, 23181, 23182, 23216, 23217, 23219, 23220, 23264, 23265, 23266, 23268, 23269, 23271, 23272, 23273, 23274, 23276, 23277, 23279, 23281, 23282, 23287, 23290, or 23296, and/or wherein the antisense strand comprises the nucleoside sequence of any one of SEQ ID NOs: 34521, 34523, 34525, 34533, 34560, 34565, 34567, 34568, 34569, 34570, 34572, 34573, 34574, 34575, 34576, 34577, 34611, 34612, 34614, 34615, 34659, 34660, 34661, 34663, 34664, 34666, 34667, 34668, 34669, 34671, 34672, 34674, 34676, 34677, 34682, 34685, or 34691; wherein the sense strand comprises modification pattern 2S, and/or the antisense strand comprises modification pattern 3AS.

In some embodiments, the sense strand comprises any one of modification patterns 1S, 2S, 3S, 4S, or 5S. In some embodiments, the sense strand comprises any one of modification patterns 1AS, 2AS, 3AS, or 4AS. In some embodiments, the sense strand comprises the modification pattern of SEQ ID NO: 34506.

In some embodiments, the antisense strand comprises any one of modification patterns 1S, 2 S, 3S, 4S, or 5S. In some embodiments, the antisense strand comprises any one of modification patterns 1AS, 2AS, 3AS, or 4AS. In some embodiments, the antisense strand comprises the modification pattern of SEQ ID NO: 34506. In some embodiments, the modification or modification pattern provides nuclease resistance to the siRNA.

Antisense Compounds

In one aspect, provided herein is an antisense compound or oligonucleotide for modulating the activity and/or expression of a target nucleic acid, e.g., TSLP or specifically 1fTSLP. In some embodiments, the antisense compound inhibits expression of TSLP or specifically 1fTSLP. In some cases, the antisense compound comprises a sequence at least about 80%, 85%, 90%, 95%, or 100% identical to a sequence selected from SEQ ID NOS: 9971-14922. In some cases, the antisense compound comprises a sequence at least about 80%, 85%, 90%, 95%, or 100% identical to a sequence selected from SEQ ID NOS: 9971-12561. In some embodiments, the antisense compound inhibits expression of sfTSLP. In some cases, the antisense compound comprises a sequence at least about 80%, 85%, 90%, 95%, or 100% identical to a sequence selected from SEQ ID NOS: 12562-14922.

In some embodiments, the antisense compound is specifically hybridizable to the target nucleic acid, where binding of the compound to the target nucleic acid interferes with the normal function of the target nucleic acid to cause, e.g., a loss of activity, and there is a sufficient degree of complementarity to avoid non-specific binding of the antisense compound to non-target nucleic acid sequences under conditions in which specific binding is desired. Such conditions include physiological conditions in the case of in vivo assays or therapeutic treatment, and conditions in which assays are performed in the case of in vitro assays.

In some embodiments, the antisense compounds include variants in which a different base is present at one or more of the nucleotide positions in the compound. For example, if the first nucleotide is an adenine, variants may be produced which contain thymidine, guanosine, cytidine or other natural or unnatural nucleotides at this position. This may be done at any of the positions of the antisense compound. These compounds are then tested using the methods described herein to determine their ability to inhibit expression of a target nucleic acid.

In some embodiments, homology, sequence identity or complementarity, between the antisense compound and target is from about 50% to about 60%. In some embodiments, homology, sequence identity or complementarity, is from about 60% to about 70%. In some embodiments, homology, sequence identity or complementarity, is from about 70% to about 80%. In some embodiments, homology, sequence identity or complementarity, is from about 80% to about 90%. In some embodiments, homology, sequence identity or complementarity, is about 90%, about 92%, about 94%, about 95%, about 96%, about 97%, about 98%, about 99% or about 100%.

In some embodiments, an antisense compound, whether DNA, RNA, chimeric, substituted etc, is specifically hybridizable when binding of the compound to the target DNA or RNA molecule interferes with the normal function of the target DNA or RNA, e.g., to cause a loss of utility, and there is a sufficient degree of complementarily to avoid nonspecific binding of the antisense compound to non-target sequences under conditions in which specific binding is desired, i.e., under physiological conditions in the case of in vivo assays or therapeutic treatment, and in the case of in vitro assays, under conditions in which the assays are performed.

In some embodiments, targeting of 1fTSLP includes without limitation, antisense sequences which are identified and expanded, using for example, PCR, hybridization etc., one or more of the sequences set forth as SEQ ID NOS: 9971-14922, and the like (e.g., oligonucleotides having at least about 80%, 85%, 90%, 95%, or 100% identity to a sequence selected from SEQ ID NOS: 9971-14922), to modulate the expression or function of 1fTSLP. In some embodiments, expression or function is down-regulated as compared to a control oligonucleotide that does not specifically hybridize to 1fTSLP.

In some embodiments, an antisense oligonucleotide comprises one or more modified nucleotides, shorter or longer fragments, modified bonds and the like. Examples of modified bonds or internucleotide linkages comprise phosphorothioate, phosphorodithioate or the like. In some embodiments, the nucleotides comprise a phosphorus derivative. The phosphorus derivative (or modified phosphate group) which may be attached to the sugar or sugar analog moiety in the modified oligonucleotides may be a monophosphate, diphosphate, triphosphate, alkylphosphate, alkanephosphate, phosphorothioate and the like.

In embodiments, oligomeric antisense compounds, particularly oligonucleotides, bind to target nucleic acid molecules and modulate the expression and/or function of molecules encoded by a target gene. The functions of DNA to be interfered comprise, for example, replication and transcription. The functions of RNA to be interfered comprise all vital functions such as, for example, translocation of the RNA to the site of protein translation, translation of protein from the RNA, splicing of the RNA to yield one or more mRNA species, and catalytic activity which may be engaged in or facilitated by the RNA. The functions may be up-regulated or inhibited depending on the functions desired.

The antisense compounds, include antisense oligomeric compounds, antisense oligonucleotides, external guide sequence (EGS) oligonucleotides, alternate splicers, primers, probes, and other oligomeric compounds that hybridize to at least a portion of the target nucleic acid. As such, these compounds may be introduced in the form of single-stranded, double-stranded, partially single-stranded, or circular oligomeric compounds.

Targeting an antisense compound to a particular nucleic acid molecule can be a multistep process. The process may begin with the identification of a target nucleic acid whose function is to be modulated. This target nucleic acid may be, for example, a cellular gene (or mRNA transcribed from the gene) whose expression is associated with a particular disorder or disease state. In some embodiments, the target nucleic acid encodes long-form thymic stromal lymphopoietin (1fTSLP).

The targeting process may include determination of at least one target region, segment, or site within the target nucleic acid for the antisense interaction to occur such that the desired effect, e.g., modulation of expression, will result. In some embodiments, the term "region" is defined as a portion of the target nucleic acid having at least one identifiable structure, function, or characteristic. Within regions of target nucleic acids are segments. "Segments" may be defined as smaller or sub-portions of regions within a target nucleic acid. "Sites" may be defined as positions within a target nucleic acid.

In some embodiments, the antisense oligonucleotides bind to the natural antisense sequences of long-form thymic stromal lymphopoietin (1fTSLP) and modulate the expression and/or function of 1fTSLP (SEQ ID NO: 14923). An example of antisense sequences include SEQ ID NOS: 14926, 9971-14922, and a sequence at least about 80%, 85%, 90%, 95%, or 100% identical to a sequence selected from SEQ ID NOS: 9971-12561. In some embodiments, the anti sense oligonucleotides bind to the natural antisense sequences of sfTSLP and modulate the expression and/or function of sfTSLP (SEQ ID NO 14924). An example of antisense oligonucleotides include a sequence at least about 80%, 85%, 90%, 95%, or 100% identical to a sequence selected from SEQ ID NOs: 12562-14922.

In some embodiments, the antisense oligonucleotides bind to one or more segments of long-form thymic stromal lymphopoietin (1fTSLP) polynucleotides and modulate the expression and/or function of 1fTSLP. In some cases, the segments comprise at least five consecutive nucleotides of the 1fTSLP sense or antisense polynucleotides.

In some embodiments, the antisense oligonucleotides bind to one or more segments of short-form thymic stromal lymphopoietin (sfTSLP) polynucleotides and modulate the expression and/or function of sfTSLP. In some cases, the segments comprise at least five consecutive nucleotides of the sfTSLP sense or antisense polynucleotides.

Since the translation initiation codon is typically 5'-AUG (in transcribed mRNA molecules; 5-ATG in the corresponding DNA molecule), the translation initiation codon may be referred to as the "AUG codon," the "start codon" or the "AUG start codon". A minority of genes has a translation initiation codon having the RNA sequence 5'-GUG, 5'-UUG or 5'-CUG; and 5'-AUA, 5'-ACG and 5'-CUG have been shown to function in vivo. Thus, in some cases, the terms "translation initiation codon" and "start codon" can encompass many codon sequences, even though the initiator amino acid in each instance is typically methionine (in eukaryotes) or formylmethionine (in prokaryotes). Eukaryotic and prokaryotic genes may have two or more alternative start codons, any one of which may be preferentially utilized for translation initiation in a particular cell type or tissue, or under a particular set of conditions. In some embodiments, "start codon" and "translation initiation codon" refer to the codon or codons that are used in vivo to initiate translation of an mRNA transcribed from a gene encoding long-form thymic stromal lymphopoietin, (1fTSLP), regardless of the sequence(s) of such codons. In some cases, a translation termination codon (or "stop codon") of a gene may have one of three sequences, i.e., 5'-UAA, 5'-UAG and 5'-UGA (the corresponding DNA sequences are 5'-TAA, 5'-TAG and 5'-TGA, respectively).

In some embodiments, the terms "start codon region" and "translation initiation codon region" refer to a portion of such an mRNA or gene that encompasses from about 25 to about 50 contiguous nucleotides in either direction (i.e., 5' or 3') from a translation initiation codon. In some cases, the terms "stop codon region" and "translation termination codon region" refer to a portion of such an mRNA or gene that encompasses from about 25 to about 50 contiguous nucleotides in either direction (i.e., 5' or 3') from a translation termination codon. Consequently, the "start codon region" (or "translation initiation codon region") and the "stop codon region" (or "translation termination codon region") are all regions that may be targeted effectively with the antisense compounds described herein.

The open reading frame (ORF) or "coding region," which is known in the art to refer to the region between the translation initiation codon and the translation termination codon, is also a region which may be targeted effectively. In some embodiments, a targeted region is the intragenic region encompassing the translation initiation or termination codon of the open reading frame (ORF) of a gene.

Another target region includes the 5' untranslated region (5'-UTR), known in the art to refer to the portion of an mRNA in the 5' direction from the translation initiation codon, and thus including nucleotides between the 5' cap site and the translation initiation codon of an mRNA (or corresponding nucleotides on the gene). Still another target region includes the 3' untranslated region (3'-UTR), known in the art to refer to the portion of an mRNA in the 3' direction from the translation termination codon, and thus including nucleotides between the translation termination codon and 3' end of an mRNA (or corresponding nucleotides on the gene). The 5' cap site of an mRNA comprises an N7-methylated guanosine residue joined to the 5-most residue of the mRNA via a 5-5' triphosphate linkage. The 5' cap region of an mRNA is considered to include the 5' cap structure itself as well as the first 50 nucleotides adjacent to the cap site. Another target region is the 5' cap region.

Although some eukaryotic mRNA transcripts are directly translated, many contain one or more regions, known as "introns," which are excised from a transcript before it is translated. The remaining (and therefore translated) regions are known as "exons" and are spliced together to form a continuous mRNA sequence. In some embodiments, targeting splice sites, i.e., intron-exon junctions or exon-intron junctions, is particularly useful in situations where aberrant splicing is implicated in disease, or where an overproduction of a particular splice product is implicated in disease. An aberrant fusion junction due to rearrangement or deletion is another embodiment of a target site. mRNA transcripts produced via the process of splicing of two (or more) mRNAs from different gene sources are known as "fusion transcripts". Introns can be effectively targeted using antisense compounds targeted to, for example, DNA or pre-mRNA.

In some embodiments, the antisense oligonucleotides bind to coding and/or non-coding regions of a target polynucleotide and modulate the expression and/or function of the target molecule.

In some embodiments, the antisense oligonucleotides bind to sense polynucleotides and modulate the expression and/or function of the target molecule.

Alternative RNA transcripts can be produced from the same genomic region of DNA. These alternative transcripts are generally known as "variants". More specifically, "pre-mRNA variants" are transcripts produced from the same genomic DNA that differ from other transcripts produced from the same genomic DNA in either their start or stop position and contain both intronic and exonic sequence.

Upon excision of one or more exon or intron regions, or portions thereof during splicing, pre-mRNA variants produce smaller "mRNA variants". Consequently, mRNA variants are processed pre-mRNA variants and each unique pre-mRNA variant must always produce a unique mRNA variant as a result of splicing. These mRNA variants are also known as "alternative splice variants". If no splicing of the pre-mRNA variant occurs then the pre-mRNA variant is identical to the mRNA variant.

Variants can be produced through the use of alternative signals to start or stop transcription. Pre-mRNAs and mRNAs can possess more than one start codon or stop codon. Variants that originate from a pre-mRNA or mRNA that use alternative start codons are known as "alternative start variants" of that pre-mRNA or mRNA. Those transcripts that use an alternative stop codon are known as "alternative stop variants" of that pre-mRNA or mRNA. One specific type of alternative stop variant is the "polyA variant" in which the multiple transcripts produced result from the alternative selection of one of the "polyA stop signals" by the transcription machinery, thereby producing transcripts that terminate at unique polyA sites. In some embodiments, the types of variants described herein are also embodiments of target nucleic acids.

In some embodiments, the locations on the target nucleic acid to which the antisense compounds hybridize are defined as at least a 5-nucleotide long portion of a target region to which an active antisense compound is targeted.

While the specific sequences of certain exemplary target segments are set forth herein, one of skill in the art will recognize that these serve to illustrate and describe particular embodiments. Additional target segments are readily identifiable by one having ordinary skill in the art in view of this disclosure.

Target segments 5-100 nucleotides in length comprising a stretch of at least five (5) consecutive nucleotides selected from within illustrative target segments are considered to be suitable for targeting as well.

In some embodiments, target segments can include DNA or RNA sequences that comprise at least the 5 consecutive nucleotides from the 5'-terminus of one of the target segments (the remaining nucleotides being a consecutive stretch of the same DNA or RNA beginning immediately upstream of the 54erminus of the target segment and continuing until the DNA or RNA contains about 5 to about 100 nucleotides). In some cases, target segments are represented by DNA or RNA sequences that comprise at least the 5 consecutive nucleotides from the 3'-terminus of one of the target segments (the remaining nucleotides being a consecutive stretch of the same DNA or RNA beginning immediately downstream of the 3'-terminus of the target segment and continuing until the DNA or RNA contains about 5 to about 100 nucleotides).

Once one or more target regions, segments or sites have been identified, antisense compounds are chosen which are sufficiently complementary to the target, i.e., hybridize sufficiently well and with sufficient specificity, to give the desired effect.

Antisense compounds include antisense oligonucleotides, ribozymes, external guide sequence (EGS) oligonucleotides, siRNA compounds, single- or double-stranded RNA interference (RNAi) compounds such as siRNA compounds, and other oligomeric compounds which hybridize to at least a portion of the target nucleic acid and modulate its function. As such, they may be DNA, RNA, DNA-like, RNA-like, or mixtures thereof, or may be mimetics of one or more of these. These compounds may be single-stranded, double-stranded, circular or hairpin oligomeric compounds and may contain structural elements such as internal or terminal bulges, mismatches or loops. Antisense compounds are routinely prepared linearly but can be joined or otherwise prepared to be circular and/or branched. Antisense compounds can include constructs such as, for example, two strands hybridized to form a wholly or partially double-stranded compound or a single strand with sufficient self-complementarity to allow for hybridization and formation of a fully or partially double-stranded compound. The two strands can be linked internally leaving free 3' or 5' termini or can be linked to form a continuous hairpin structure or loop. The hairpin structure may contain an overhang on either the 5' or 3' terminus producing an extension of single stranded character. The double stranded compounds optionally can include overhangs on the ends. Further modifications can include conjugate groups attached to one of the termini, selected nucleotide positions, sugar positions or to one of the internucleoside linkages. Alternatively, the two strands can be linked via a non-nucleic acid moiety or linker group. When formed from only one strand, dsRNA can take the form of a self-complementary hairpin-type molecule that doubles back on itself to form a duplex. Thus, the dsRNAs can be fully or partially double stranded. Specific modulation of gene expression can be achieved by stable expression of dsRNA hairpins in transgenic cell lines, however, in some embodiments, the gene expression or function is up regulated. When formed from two strands, or a single strand that takes the form of a self-complementary hairpin-type molecule doubled back on itself to form a duplex, the two strands (or duplex-forming regions of a single strand) are complementary RNA strands that base pair in Watson-Crick fashion.

Once introduced to a system, the compounds may elicit the action of one or more enzymes or structural proteins to effect cleavage or other modification of the target nucleic acid or may work via occupancy-based mechanisms. In general, nucleic acids (including oligonucleotides) may be described as "DNA-like" (i.e., generally having one or more 2'-deoxy sugars and, generally, T rather than U bases) or "RNA-like" (i.e., generally having one or more 2'-hydroxyl or 2'-modified sugars and, generally U rather than T bases). Nucleic acid helices can adopt more than one type of structure, most commonly the A- and B-forms. It is believed that, in general, oligonucleotides which have B-form-like structure are "DNA-like" and those which have A-form-like structure are "RNA-like." In some (chimeric) embodiments, an antisense compound may contain both A- and B-form regions.

In some embodiments, the desired oligonucleotides or antisense compounds, comprise at least one of: antisense RNA, antisense DNA, chimeric antisense oligonucleotides, antisense oligonucleotides comprising modified linkages, interference RNA (RNAi), short interfering RNA (siRNA); a micro, interfering RNA (miRNA); a small, temporal RNA (stRNA); or a short, hairpin RNA (shRNA); small RNA-induced gene activation (RNAa); small activating RNAs (saRNAs), or combinations thereof.

In some embodiments, the "target segments" identified herein may be employed in a screen for additional compounds that modulate the expression of long-form thymic stromal lymphopoietin (1fTSLP) polynucleotides. "Modulators" are those compounds that decrease or increase the expression of a nucleic acid molecule encoding 1fTSLP and which comprise at least a 5-nucleotide portion that is complementary to a target segment. The screening method comprises the steps of contacting a target segment of a nucleic acid molecule encoding sense or natural antisense polynucleotides of 1fTSLP with one or more candidate modulators, and selecting for one or more candidate modulators which decrease or increase the expression of a nucleic acid molecule encoding 1fTSLP polynucleotides. Once it is shown that the candidate modulator or modulators are capable of modulating (e.g. either decreasing or increasing) the expression of a nucleic acid molecule encoding 1fTSLP polynucleotides, the modulator may then be employed in further investigative studies of the function of 1fTSLP polynucleotides, or for use as a research, diagnostic, or therapeutic agent.

The target segments may be also be combined with their respective complementary antisense compounds to form stabilized double-stranded (duplexed) oligonucleotides.

Such double stranded oligonucleotide moieties have been shown in the art to modulate target expression and regulate translation as well as RNA processing via an antisense mechanism. Moreover, the double-stranded moieties may be subject to chemical modifications. For example, such double-stranded moieties have been shown to inhibit the target by the classical hybridization of antisense strand of the duplex to the target, thereby triggering enzymatic degradation of the target.

In some embodiments, an antisense oligonucleotide targets long-form thymic stromal lymphopoietin (1fTSLP) polynucleotides (e.g. accession number NM_033035.4), variants, alleles, isofolins, homologs, mutants, derivatives, fragments and complementary sequences thereto. In some embodiments, an antisense oligonucleotide targets short-form thymic stromal lymphopoietin (sfTSLP) polynucleotides (e.g. accession number NM 033035.4), variants, alleles, isofolins, homologs, mutants, derivatives, fragments and complementary sequences thereto. In some cases, the oligonucleotide is an antisense molecule.

In some embodiments, the target nucleic acid molecule is not limited to 1fTSLP alone but extends to any of the isoforms, receptors, homologs and the like of 1fTSLP molecules. In some embodiments, the target nucleic acid molecule is not limited to sfTSLP alone but extends to any of the isoforms, receptors, homologs and the like of sfTSLP molecules.

In some embodiments, the oligonucleotides are complementary to or bind to nucleic acid sequences of 1fTSLP transcripts and modulate expression and/or function of 1fTSLP molecules. In some embodiments, the oligonucleotides are complementary to or bind to nucleic acid sequences of sfTSLP transcripts and modulate expression and/or function of sfTSLP molecules.

In some embodiments, oligonucleotides comprise sequences of at least 5 consecutive nucleotides of to modulate expression and/or function of 1fTSLP molecules. In some embodiments, oligonucleotides comprise sequences of at least 5 consecutive nucleotides of to modulate expression and/or function of sfTSLP molecules.

The polynucleotide targets comprise 1fTSLP, including family members thereof, variants of 1fTSLP; mutants of 1fTSLP, including SNPs; noncoding sequences of 1fTSLP; alleles of 1fTSLP; species variants, fragments and the like. The polynucleotide targets comprise sfTSLP, including family members thereof, variants of sfTSLP; mutants of sfTSLP, including SNPs; noncoding sequences of sfTSLP; alleles of sfTSLP; species variants, fragments and the like. In some cases, the oligonucleotide is an antisense molecule.

In some embodiments, the oligonucleotide targeting 1fTSLP polynucleotides, comprise: antisense RNA, interference RNA (RNAi), short interfering RNA (siRNA); micro interfering RNA (miRNA); a small, temporal RNA (stRNA); or a short, hairpin RNA (shRNA); small RNA-induced gene activation (RNAa); or, small activating RNA (saRNA).

In some embodiments, targeting of long-form thymic stromal lymphopoietin (1fTSLP) polynucleotides, e.g. SEQ ID NO: 14923 modulate the expression or function of this target. In some embodiments, expression or function is down-regulated as compared to a control.

In some embodiments, targeting of long-form thymic stromal lymphopoietin (1fTSLP) polynucleotides, e.g. SEQ ID NO: 14925 modulate the expression or function of this target. In some embodiments, expression or function is down-regulated as compared to a control.

In some embodiments, targeting of short-form thymic stromal lymphopoietin (sfTSLP) polynucleotides, e.g. SEQ ID NO: 14924 modulate the expression or function of this target. In some embodiments, expression or function is down-regulated as compared to a control.

In some embodiments, antisense compounds comprise sequences set forth as SEQ ID NOS: 9971-12561, 14926 and 14927. These oligonucleotides can comprise one or more modified nucleotides, shorter or longer fragments, modified bonds and the like.

In some embodiments, SEQ ID NOS: 9971-14922, 14926, 14927 comprise one or more LNA nucleotides.

In some embodiments, SEQ ID NOS: 9971-14922, 14926, 14927 comprise one or more UNA nucleotides.

In some embodiments, SEQ ID NOS: 9971-14922, 14926, 14927 comprise one or more GNA nucleotides.

The antisense compounds can comprise an antisense portion from about 5 to about 80 nucleotides (i.e. from about 5 to about 80 linked nucleosides) in length. This refers to the length of the antisense strand or portion of the antisense compound. In other words, a single-stranded antisense compound may comprise from 5 to about 80 nucleotides, and a double-stranded antisense compound (such as a dsRNA, for example) may comprise a sense and an antisense strand or portion of 5 to about 80 nucleotides in length. One of ordinary skill in the art will appreciate that this comprehends antisense portions of about 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, or 80 nucleotides in length, or any range there within.

In some embodiments, the antisense compounds have antisense portions of 10 to 50 nucleotides in length. One having ordinary skill in the art will appreciate that this embodies oligonucleotides having antisense portions of about 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, or 50 nucleotides in length, or any range there within. In some embodiments, the oligonucleotides are 15 nucleotides in length.

In some embodiments, the antisense or oligonucleotide compounds have antisense portions of about 12 or 13 to 30 nucleotides in length. One having ordinary skill in the art will appreciate that this embodies antisense compounds having antisense portions of about 12, 13, 14, 15, 16, 17, 18, 19, 20, 21, 22, 23, 24, 25, 26, 27, 28, 29 or 30 nucleotides in length, or any range there within.

In some embodiments, the oligomeric compounds also include variants in which a different base is present at one or more of the nucleotide positions in the compound. For example, if the first nucleotide is an adenosine, variants may be produced which contain thymidine, guanosine or cytidine at this position. This may be done at any of the positions of the antisense or dsRNA compounds. These compounds are then tested using the methods described herein to determine their ability to inhibit expression of a target nucleic acid.

In some embodiments, homology, sequence identity or complementarity, between the antisense compound and target is from about 40% to about 60%. In some embodiments, homology, sequence identity or complementarity, is from about 60% to about 70%. In some embodiments, homology, sequence identity or complementarity, is from about 70% to about 80%. In some embodiments, homology, sequence identity or complementarity, is from about 80% to about 90%. In some embodiments, homology, sequence identity or complementarity, is about 90%, about 92%, about 94%, about 95%, about 96%, about 97%, about 98%, about 99% or about 100%.

In some embodiments, the antisense oligonucleotides, such as for example, nucleic acid molecules set forth in SEQ ID NOS: 9971-14922, 14926, 14927 comprise one or more substitutions or modifications. In some embodiments, the nucleotides are substituted with locked nucleic acids (LNA).

In some embodiments, the oligonucleotides target one or more regions of the nucleic acid molecules sense and/or antisense of coding and/or non-coding sequences associated with 1fTSLP and the sequences set forth as SEQ ID NO: 14923. The oligonucleotides are also targeted to overlapping regions of SEQ ID NOS: 14923 and 14924.

In some embodiments, oligonucleotides disclosed herein are chimeric oligonucleotides. "Chimeric oligonucleotides" or "chimeras," are oligonucleotides which contain two or more chemically distinct regions, each made up of at least one nucleotide. These oligonucleotides typically contain at least one region of modified nucleotides that confers one or more beneficial properties (such as, for example, increased nuclease resistance, increased uptake into cells, increased binding affinity for the target) and a region that is a substrate for enzymes capable of cleaving RNA:DNA or RNA:RNA hybrids. By way of example, RNase H is a cellular endonuclease which cleaves the RNA strand of an RNA:DNA duplex. Activation of RNase H, therefore, results in cleavage of the RNA target, thereby greatly enhancing the efficiency of antisense modulation of gene expression. Consequently, comparable results can often be obtained with shorter oligonucleotides when chimeric oligonucleotides are used, compared to phosphorothioate deoxyoligonucleotides hybridizing to the same target region. Cleavage of the RNA target can be routinely detected by gel electrophoresis and, if necessary, associated nucleic acid hybridization techniques known in the art. In some embodiments, a chimeric oligonucleotide comprises at least one region modified to increase target binding affinity, and, usually, a region that acts as a substrate for RNAse H. Affinity of an oligonucleotide for its target (in this case, a nucleic acid encoding ras) is routinely determined by measuring the Tm of an oligonucleotide target pair, which is the temperature at which the oligonucleotide and target dissociate; dissociation is detected spectrophotometrically. The higher the Tm, the greater is the affinity of the oligonucleotide for the target.

Chimeric antisense compounds may be formed as composite structures of two or more oligonucleotides, modified oligonucleotides, oligonucleosides and/or oligonucleotides mimetics as described above. Such; compounds have also been referred to in the art as hybrids or gapmers.

In some embodiments, the composition comprises an oligonucleotide that targets TSLP, wherein the oligonucleotide comprises an antisense oligonucleotide (ASO). In some embodiments, the oligonucleotide targets 1fTSLP. In some embodiments, the oligonucleotide targets sfTSLP. An ASO is a single-stranded or double-stranded oligonucleotide compound, or analog, variant, mimic, or mimetic thereof, having a sequence that is at least six nucleotides long and is designed to hybridize to a nucleic acid transcript via the binding, partially or wholly, of such compound to the nucleic acid transcript. In some embodiments, the ASO is double stranded. In some embodiments the ASO comprises an siRNA. In some embodiments, the ASO comprises an oligonucleotide other than an siRNA. In some embodiments, the ASO is single stranded.

In some embodiments, the ASO is 12-30 nucleosides in length. In some embodiments, the ASO is 14-30 nucleosides in length. In some embodiments the ASO is single-stranded and 12-30 nucleosides in length. In some embodiments, the ASO is at least about 10, 11, 12, 13, 14, 15, 15, 17, 18, 19, 20, 21, 22, 23, 24, 25, 26, 27, 28, 29, or 30 nucleosides in length, or a range defined by any of the two aforementioned numbers. In some embodiments, the ASO is 15-25 nucleosides in length. In some embodiments, the ASO is 20 nucleosides in length. In some embodiments, the ASO is double stranded. In some embodiments the ASO comprises an siRNA. In some embodiments, the ASO comprises an oligonucleotide other than an siRNA. In some embodiments, the ASO is single stranded.

In some embodiments, the composition comprises an oligonucleotide that targets 1fTSLP, wherein the oligonucleotide comprises an ASO comprising an antisense strand about 12-30 nucleosides in length and comprising a nucleoside sequence comprising about 12-30 contiguous nucleosides of one of SEQ ID NO: 14923. In some embodiments the ASO is single-stranded and 12-30 nucleosides in length and comprising a nucleoside sequence comprising about 12-30 contiguous nucleosides of one of SEQ ID NO: 14923. In some embodiments, the ASO is at least about 10, 11, 12, 13, 14, 15, 15, 17, 18, 19, 20, 21, 22, 23, 24, 25, 26, 27, 28, 29, or 30 nucleosides in length, or a range defined by any of the two aforementioned numbers. In some embodiments, the ASO is 15-25 nucleosides in length. In some embodiments, the ASO is 20 nucleosides in length. In some embodiments, the ASO is double stranded. In some embodiments the ASO comprises an siRNA. In some embodiments, the ASO comprises an oligonucleotide other than an siRNA. In some embodiments, the ASO is single stranded.

In some embodiments, the composition comprises an oligonucleotide that targets TSLP, wherein the oligonucleotide comprises an ASO comprising an antisense strand about 12-30 nucleosides in length and comprising a nucleoside sequence comprising about 12-30 contiguous nucleosides of one of SEQ ID NO: 14925 In some embodiments, the ASO is 12-30 nucleosides in length. In some embodiments, the ASO is 14-30 nucleosides in length. In some embodiments the ASO is single-stranded and 12-30 nucleosides in length. In some embodiments, the ASO is at least about 10, 11, 12, 13, 14, 15, 15, 17, 18, 19, 20, 21, 22, 23, 24, 25, 26, 27, 28, 29, or 30 nucleosides in length, or a range defined by any of the two aforementioned numbers. In some embodiments, the ASO is 15-25 nucleosides in length. In some embodiments, the ASO is 20 nucleosides in length. In some embodiments, the ASO is double stranded. In some embodiments the ASO comprises an siRNA. In some embodiments, the ASO comprises an oligonucleotide other than an siRNA. In some embodiments, the ASO is single stranded.

In some embodiments, the composition comprises an oligonucleotide that targets sfTSLP, wherein the oligonucleotide comprises an ASO comprising an antisense strand about 12-30 nucleosides in length and comprising a nucleoside sequence comprising about 12-30 contiguous nucleosides of one of SEQ ID NO: 14924. In some embodiments the ASO is single-stranded and 12-30 nucleosides in length and comprising a nucleoside sequence comprising about 12-30 contiguous nucleosides of one of SEQ ID NO: 14924. In some embodiments, the ASO is at least about 10, 11, 12, 13, 14, 15, 15, 17, 18, 19, 20, 21, 22, 23, 24, 25, 26, 27, 28, 29, or 30 nucleosides in length, or a range defined by any of the two aforementioned numbers. In some embodiments, the ASO is 15-25 nucleosides in length. In some embodiments, the ASO is 20 nucleosides in length. In some embodiments, the ASO is double stranded. In some embodiments the ASO comprises an siRNA. In some embodiments, the ASO comprises an oligonucleotide other than an siRNA. In some embodiments, the ASO is single stranded.

In some embodiments, the composition comprises an oligonucleotide that targets 1fTSLP, wherein the oligonucleotide comprises an ASO, wherein the ASO comprises a nucleoside sequence comprising or consisting of the sequence of any one of SEQ ID NOs: 9971-12561. In some embodiments the ASO comprises a nucleoside sequence comprising or consisting of the sequence of any one of SEQ ID NOs: 9971-12561, or a nucleic acid sequence thereof having 1 or 2 nucleoside substitutions, additions, or deletions. In some embodiments the ASO comprises a nucleoside sequence comprising or consisting of the sequence of any one of SEQ ID NOs: 9971-12561, or a nucleic acid sequence thereof having 3 or 4 nucleoside substitutions, additions, or deletions.

In some embodiments, the composition comprises an oligonucleotide that targets sfTSLP, wherein the oligonucleotide comprises an ASO, wherein the ASO comprises a nucleoside sequence comprising or consisting of the sequence of any one of SEQ ID NOs: 12562-14922. In some embodiments the ASO comprises a nucleoside sequence comprising or consisting of the sequence of any one of SEQ ID NOs: 12562-14922, or a nucleic acid sequence thereof having 1 or 2 nucleoside substitutions, additions, or deletions. In some embodiments the ASO comprises a nucleoside sequence comprising or consisting of the sequence of any one of SEQ ID NOs: 12562-14922, or a nucleic acid sequence thereof having 3 or 4 nucleoside substitutions, additions, or deletions.

Antisense Compound Modifications

In some embodiments, one or more nucleotides in an antisense compound are modified.

In some embodiments, the region of the oligonucleotide which is modified comprises at least one nucleotide modified at the 2' position of the sugar, e.g., a 2'-Oalkyl, 2,—O-alkyl-O-alkyl or 2'-fluoro-modified nucleotide. In some embodiments, RNA modifications include 2'-fluoro, 2'-amino and 2' O-methyl modifications on the ribose of pyrimidines, abasic residues or an inverted base at the 3' end of the RNA. Such oligonucleotides may have a higher Tm (i.e., higher target binding affinity) than 2'-deoxyoligonucleotides against a given target. The effect of such increased affinity is to greatly enhance RNAi oligonucleotide inhibition of gene expression. RNAse H is a cellular endonuclease that cleaves the RNA strand of RNA:DNA duplexes; activation of this enzyme therefore results in cleavage of the RNA target, and thus can greatly enhance the efficiency of RNAi inhibition. Cleavage of the RNA target can be routinely demonstrated by gel electrophoresis. In some embodiments, the chimeric oligonucleotide is also modified to enhance nuclease resistance. Cells contain a variety of exo- and endo-nucleases which can degrade nucleic acids. A number of nucleotide and nucleoside modifications have been shown to make the oligonucleotide into which they are incorporated more resistant to nuclease digestion than the native oligodeoxynucleotide. Nuclease resistance is routinely measured by incubating oligonucleotides with cellular extracts or isolated nuclease solutions and measuring the extent of intact oligonucleotide remaining over time, usually by gel electrophoresis. Oligonucleotides which have been modified to enhance their nuclease resistance survive intact for a longer time than unmodified oligonucleotides. A variety of oligonucleotide modifications have been demonstrated to enhance or confer nuclease resistance. In some cases, oligonucleotides contain at least one phosphorothioate modification. In some cases, oligonucleotide modifications which enhance target binding affinity are also, independently, able to enhance nuclease resistance.

Specific examples of some oligonucleotides include those comprising modified backbones, for example, phosphorothioates, phosphotriesters, methyl phosphonates, short chain alkyl or cycloalkyl intersugar linkages or short chain heteroatomic or heterocyclic intersugar linkages. In some cases, an oligonucleotide comprises a phosphorothioate backbone. In some cases, an oligonucleotide comprises heteroatom backbones, particularly $CH_2$—NH—O—$CH_2$, CH, ~N(CH3)—O~CH2 [known as a methylene(methylimino) or MM backbone], CH2—O~N ($CH_3$)~CH2, CH2—N (CH3)—N (CH3)~CH2 and O—N (CH3)—$CH_2$—$CH_2$ backbones, wherein the native phosphodiester backbone is represented as O—P—O—CH,). In some cases, an oligonucleotide comprises a morpholino backbone structures. In some embodiments, such as the peptide nucleic acid (PNA) backbone, the phosphodiester backbone of the oligonucleotide is replaced with a polyamide backbone, the nucleotides being bound directly or indirectly to the aza nitrogen atoms of the polyamide backbone. Oligonucleotides may also comprise one or more substituted sugar moieties. In some cases, oligonucleotides comprise one of the following at the 2' position: OH, SH, SCH3, F, OCN, $OCH_3$ OCH3, $OCH_3$ O($CH_2$)n CH3, O(CH2)n NH2 or O($CH_2$)n CH3 where n is from 1 to about 10; CI to CIO lower alkyl, alkoxyalkoxy, substituted lower alkyl, alkaryl or aralkyl; CI; Br; CN; CF3; OCF3; 0~, S—, or N-alkyl; O—, S—, or N-alkenyl; SOCH3; SO2 CH3; ONO2; NO2; N3; NH2; heterocycloalkyl; heterocycloalkaryl; aminoalkylamino; polyalkylamino; substituted silyl; an RNA cleaving group; a reporter group; an intercalator; a group for improving the pharmacokinetic properties of an oligonucleotide; or a group for improving the pharmacodynamic properties of an oligonucleotide and other substituents having similar properties. A non-limiting exemplary modification includes 2'-methoxyethoxy-O—$CH_2$ $CH_2$ $OCH_3$, also known as 2'-O-(2-methoxyethyl). Other exemplary modifications include 2'-methoxy (2'-O—$CH_3$), 2'-propoxy (2'-OCH2 CH2CH3) and 2'-fluoro (2'-F). Similar modifications may also be made at other positions on the oligonucleotide, particularly the 3' position of the sugar on the 3' terminal nucleotide and the 5' position of 5' terminal nucleotide. Oligonucleotides may also have sugar mimetics such as cyclobutyls in place of the pentofuranosyl group.

Oligonucleotides may also include, additionally or alternatively, nucleobase (often referred to in the art simply as "base") modifications or substitutions. As used herein, "unmodified" or "natural" nucleotides include adenine (A), guanine (G), mymine (T), cytosine (C) and uracil (U). Modified nucleotides include nucleotides found only infrequently or transiently in natural nucleic acids, e.g., hypoxanthine, 6-methyladenine, 5-Me pyrirnidines, particularly 5-methylcytosine (also referred to as 5-methyl-2' deoxycytosine and often referred to in the art as 5-Me—C), 5-hydroxymethylcytosine glycosyl HMC and gentobiosyl HMC, as well as synthetic nucleotides, e.g., 2-aminoadenine, 2-(methylamino)adenine, 2-(imidazolylalkyl)adenine, 2-(aminoalkyamino)adenine or other heterosubstituted alkyladenines, 2-thiouracil, 2-tmothvmine, 5-bromouracil, 5-hydroxymethyluracil, 8-azaguanine, 7-deazaguanine, N6 (6-aminohexyl)adenine and 2,6-diaminopurine. A "universal" base known in the art, e.g., inosine, may be included. 5-Me-C substitutions have been shown to increase nucleic acid duplex stability by 0.6-1.2° C. and are suitable base substitutions.

Another modification of the oligonucleotides involves chemically linking to the oligonucleotide one or more moieties or conjugates which enhance the activity or cellular uptake of the oligonucleotide. Such moieties include but are not limited to lipid moieties such as a cholesterol moiety, a cholesteryl moiety, an aliphatic chain, e.g., dodecandiol or undecyl residues, a polyamine or a polyethylene glycol chain, or Adamantane acetic acid. Oligonucleotides comprising lipophilic moieties, and methods for preparing such oligonucleotides are known in the art, for example, U.S. Pat. Nos. 5,138,045, 5,218,105 and 5,459,255.

It is not necessary for all positions in a given oligonucleotide to be uniformly modified, and in fact more than one of the aforementioned modifications may be incorporated in a single oligonucleotide or even at within a single nucleoside within an oligonucleotide. Oligonucleotides may be chimeric oligonucleotides, e.g., as hereinbefore defined.

In some embodiments, the nucleic acid molecule is conjugated with a moiety including but not limited to abasic nucleotides, polyether, polyamine, polyamides, peptides, carbohydrates, lipid, or polyhydrocarbon compounds. Those skilled in the art will recognize that these molecules can be linked to one or more of any nucleotides comprising the nucleic acid molecule at several positions on the sugar, base or phosphate group.

The oligonucleotides may be conveniently and routinely made through the well-known technique of solid phase synthesis. Equipment for such synthesis is sold by several vendors including Applied Biosystems. Any other means for such synthesis may also be employed; the actual synthesis of the oligonucleotides is well within the talents of one of ordinary skill in the art. It is also well known to use similar techniques to prepare other oligonucleotides such as the phosphorothioates and alkylated derivatives. It is also well known to use similar techniques and commercially available modified amiditcs and controlled-pore glass (CPG) products such as biotin, fluorescein, acridine or psoralen-modified amidites and/or CPG (available from Glen Research, Sterling Va.) to synthesize fluorescently labeled, biotinylated or other modified oligonucleotides such as cholesterol-modified oligonucleotides.

In some embodiments, use of modifications such as the use of LNA monomers to enhance the potency, specificity and duration of action and broaden the routes of administration of oligonucleotides comprised of current chemistries such as MOE, ANA, FAN A, PS etc. This can be achieved by substituting some of the monomers in the current oligonucleotides by LNA monomers. The LNA modified oligonucleotide may have a size similar to the parent compound or may be larger or smaller. In some cases, such LNA-modified oligonucleotides contain less than about 70%, less than about 60%, or less than about 50% LNA monomers, and that their sizes are between about 5 and 25 nucleotides, or between about 12 and 20 nucleotides.

In some embodiments, modified oligonucleotide backbones comprise, but are not limited to, phosphorothioates, chiral phosphorothioates, phosphorodithioates, phosphotriesters, aniinoalkylphosphotriesters, methyl and other alkyl phosphonates comprising 3'alkylene phosphonates and chiral phosphonates, phosphinates, phosphoramidates comprising 3'-amino phosphoramidate and aminoalkylphosphoramidates, thionophosphoramidates, thionoalkylphosphonates, thionoalkylphosphotriesters, and boranophosphates having normal 3-5' linkages, 2-5' linked analogs of these, and those having inverted polarity wherein the adjacent pairs of nucleoside units are linked 3'-5' to 5'-3' or 2'-5' to 5'-2. Various salts, mixed salts and free acid forms are also included.

In some embodiments, modified oligonucleotide backbones that do not include a phosphorus atom therein have backbones that are formed by short chain alkyl or cycloalkyl intenucleoside linkages, mixed heteroatom and alkyl or cycloalkyl internucleoside linkages, or one or more short chain heteroatomic or heterocyclic intenucleoside linkages. These comprise those having morpholino linkages (formed in part from the sugar portion of a nucleoside); siloxane backbones; sulfide, sulfoxide and sulfone backbones; formacetyl and thioformacetyl backbones; methylene formacetyl and thioformacetyl backbones; alkene containing backbones; sulfamate backbones; methyleneimino and methylenehydrazino backbones; sulfonate and sulfonamide backbones; amide backbones; and others having mixed N, O, S and $CH_2$ component parts.

In some embodiments, both the sugar and the internucleoside linkage, i.e., the backbone, of the nucleotide units are replaced with novel groups while the base units are maintained for hybridization with the target nucleic acid. One such oligomeric compound, an oligonucleotide mimetic that has been shown to have excellent hybridization properties, is referred to as a peptide nucleic acid (PNA). In PNA compounds, the sugar-backbone of an oligonucleotide is replaced with an amide containing backbone, in particular an aminoethylglycine backbone. The nucleobases are retained and are bound directly or indirectly to aza nitrogen atoms of the amide portion of the backbone.

In some embodiments, the oligonucleotides comprise a heteroatom backbone, e.g., —$CH_2$—NH—O—$CH_2$—, —$CH_2$—N ($CH_3$)—O—$CH_2$— known as a methylene (memylimino) or MMI backbone, —$CH_2$—O—N ($CH_3$)—$CH_2$—, —$CH_2$N($CH_3$)—N($CH_3$) $CH_2$—, and —O—N ($CH_3$)—$CH_2$—$CH_2$—, wherein the native phosphodiester backbone is represented as —O—P—O—$CH_2$—O. In some embodiments, oligonucleotides comprise morpholino backbone structures.

Modified oligonucleotides may also contain one or more substituted sugar moieties. In some embodiments, oligonucleotides comprise one of the following at the 2' position: OH; F; O—, S—, or N-alkyl; O—, S—, or N-alkenyl; O—, S- or N-alkynyl; or O alkyl-O-alkyl, wherein the alkyl, alkenyl and alkynyl may be substituted or unsubstituted C to CO alkyl or C2 to CO alkenyl and alkynyl. Non-limiting examples are $O(CH_2)n$ OmCH3, $O(CH_2)n$, OCH3, $O(CH_2)$nNH2, $O(CH_2)$nCH3, $O(CH_2)$nONH2, and $O(CH_2$nON$(CH_2)$nCH3)2 where n and m can be from 1 to about 10. In some embodiments, oligonucleotides comprise one of the following at the 2' position: C to CO, (lower alkyl, substituted lower alkyl, alkaryl, aralkyl, O-alkaryl or O-aralkyl, SH, SCH3, OCN, CI, Br, CN, CF3, OCF3, SOCH3, SO2CH3, ONO2, NO2, N3, NH2, heterocycloalkyl, heterocycloalkaryl, ammoalkylamino, polyalkylamino, substituted silyl, an RNA cleaving group, a reporter group, an intercalator, a group for improving the pharmacokinetic properties of an oligonucleotide, or a group for improving the pharmacodynamic properties of an oligonucleotide, and other substituents having similar properties. An exemplary modification comprises 2'-methoxyethoxy (2'-O—$CH_2CH_2OCH3$, also known as 2'-O-(2-methoxyethyl) or 2'-MOE) i.e., an alkoxyalkoxy group. Another exemplary modification comprises 2'-dimethylaminooxyethoxy, i.e., a $O(CH_2)2ON(CH_3)2$ group, also known as 2-DMAOE, as described in examples herein below, and 2'-dimemylaminoethoxyethoxy (also known in die art as 2'-O-dimethylaminoethoxyethyl or 2'-DMAEOE), i.e., 2'-O—$CH_2$—O—$CH_2$—N($CH_2$)2.

Another exemplary modification comprises 2-methoxy (2-O CH3), 2'-aminopropoxy (2'-O—$CH_2CH_2CH_2NH2$) and 2-fluoro (2'-F). Similar modifications may also be made at other positions on the oligonucleotide, particularly the 3' position of the sugar on the 3' terminal nucleotide or in 2'-5' linked oligonucleotides and the 5' position of 5' terminal nucleotide. Oligonucleotides may also have sugar mimetics such as cyclobut 1 moieties in place of the pentofuranosyl sugar.

Oligonucleotides may also comprise nucleobase (often referred to in the art simply as "base") modifications or substitutions. In some embodiments, as used herein, "unmodified" or "natural" nucleotides comprise the purine bases adenine (A) and guanine (G), and the pyrimidine bases mymine (T), cytosine (C) and uracil (U). Modified nucleotides comprise other synthetic and natural nucleotides such as 5-methylcytosine (5-me-C), 5-hydroxymethyl cytosine, xanthine, hypoxanthine, 2-aminoadenine, 6-methyl and other alkyl derivatives of adenine and guanine, 2-propyl and other alkyl derivatives of adenine and guanine, 2-thiouracil, 2-thiothymine and 2-thiocytosine, 5-halouracil and cytosine, 5-propynyl uracil and cytosine, 6-azo uracil, cytosine and thymine, 5-uracil (pseudo-uracil), 4-thiouracil, 8-halo, 8-amino, 8-thiol, 8-thioalkyl, 8-hydroxyl and other 8-substituted adenines and guanines, 5-halo particularly 5-bromo, 5-trifluoromethyl and other 5-substituted uracils and cytosines, 7-methylquanine and 7-methyladenine, 8-azaguanine and 8-azaadenine, 7-deazgnanine and 7-deazaadenine and 3-deazaguanine and 3-deazaadenine.

Certain nucleotides may be particularly useful for increasing the binding affinity of the oligomeric compounds. In some cases, these comprise 5-substituted pyrimidines, 6-azapyrirnidines and N-2, N-6 and 0-6 substituted purines, comprising 2-aminopropyladenine, 5-propynyluracil and/or 5-propynylcytosine. 5-methylcytosine substitutions have been shown to increase nucleic acid duplex stability by 0.6-1.2° C., even more particularly when combined with 2'-Omethoxyethyl sugar modifications.

Another modification of the oligonucleotides involves chemically linking to the oligonucleotide one or more moieties or conjugates, which may enhance the activity, cellular distribution, or cellular uptake of the oligonucleotide. Such moieties comprise but are not limited to, lipid moieties such as a cholesterol moiety, cholic acid, a thioether, e.g., hexyl-S-tritylthiol, a thiocholesterol, an aliphatic chain, e.g., dodecandiol or undecyl residues, a phospholipid, e.g., di-hexadecyl-rac-glycerol or triethylammonium 1,2-di-O-hexadecyl-rac-glycero-3-H-phosphonate, a polyamine or a polyethylene glycol chain, or Adamantane acetic acid, a palmityl moiety, or an octadecylamine or hexylamino-carbonyl-t oxycholesterol moiety.

In some embodiments, the composition comprises an oligonucleotide that inhibits the expression of 1fTSLP, wherein the oligonucleotide comprises an ASO, wherein the ASO comprises a nucleoside sequence comprising or consisting of the sequence of any one of SEQ ID NOs: 23299-25889. In some embodiments, the ASO comprises a nucleoside sequence comprising or consisting of the sequence of any one of SEQ ID NOs: 23299-25889, or a nucleic acid sequence thereof having 1 or 2 nucleoside substitutions, additions, or deletions. In some embodiments, the ASO comprises a nucleoside sequence comprising or consisting of the sequence of any one of SEQ ID NOs: 23299-25889, or a nucleic acid sequence thereof having 3 or 4 nucleoside substitutions, additions, or deletions.

In some embodiments, the composition comprises an oligonucleotide that inhibits the expression of 1fTSLP, wherein the oligonucleotide comprises an ASO, wherein the ASO comprises modification pattern: 5'-nsnsnsnsnsdNsdNsdNsdNsdNsdNsdNsdNsdNsdNsnsnsn snsn-3' (SEQ ID NO: 34506) where "dN" is any deoxynucleotide, "n" is a 2'O-methyl or 2'O-methoxyethyl-modified nucleoside, and "s" is a phosphorothioate linkage.

In some embodiments, the composition comprises an oligonucleotide that inhibits the expression of sfTSLP, wherein the oligonucleotide comprises an ASO, wherein the ASO comprises modification pattern: 5'-nsnsnsnsnsdNsdNsdNsdNsdNsdNsdNsdNsdNsdNsnsnsn snsn-3' (SEQ ID NO: 34506) where "dN" is any deoxynucleotide, "n" is a 2'O-methyl or 2'O-methoxyethyl-modified nucleoside, and "s" is a phosphorothioate linkage.

In some embodiments, the ASO comprises any one of modification patterns 1S, 2S, 3S, 4S, 5S, 1AS, 2AS, 3AS, or 4AS. In some embodiments, the modification or modification pattern provides nuclease resistance to the ASO.

Ligands

A wide variety of entities can be coupled to the oligonucleotides described herein. In some embodiments, the entities are ligands, which are coupled, e.g., covalently, either directly or indirectly via an intervening tether. In some embodiments, a ligand is coupled to a dsRNA agent. In some embodiments, a ligand is coupled to an antisense compound.

In some embodiments, a ligand alters the distribution, targeting or lifetime of the molecule into which it is incorporated. In some embodiments a ligand provides an enhanced affinity for a selected target, e.g., molecule, cell or cell type, compartment, receptor e.g., a cellular or organ compartment, tissue, organ or region of the body, as, e.g., compared to a species absent such a ligand. Ligands providing enhanced affinity for a selected target are also termed targeting ligands. These moieties or conjugates can include conjugate groups covalently bound to functional groups such as primary or secondary hydroxyl groups. Conjugate groups include intercalators, reporter molecules, polyamines, polyamides, polyethylene glycols, polyethers, groups that enhance the pharmacodynamic properties of oligomers, and groups that enhance the pharmacokinetic properties of oligomers. Typical conjugate groups include cholesterols, lipids, phospholipids, biotin, phenazine, folate, phenanthridine, anthraquinone, acridine, fluoresceins, rhc-«Jamines, coumarins, and dyes. Groups that enhance the pharmacodynamic properties include groups that improve uptake, enhance resistance to degradation, and or strengthen sequence-specific hybridization with the target nucleic acid. Groups that enhance the pharmacokinetic properties include groups that improve uptake, distribution, metabolism or excretion of the compounds herein. Conjugate moieties include, but are not limited to, lipid moieties such as a cholesterol moiety, cholic acid, a thioether, e.g., hexyl-5-tritylthiol, a thiocholesterol, an aliphatic chain, e.g., dodecandiol or undecyl residues, a phospholipid, e.g., di-hexadecyl-rac-glycerol or triethylammonium 1,2-di-O-hexadecyl-rac-glycero-3-Hphosphonate, a polyamine or a polyethylene glycol chain, or Adamantane acetic acid, a palmityl moiety, or an octadecylamine or hexylamino-carbonyl-oxycholesterol moiety. Oligonucleotides may also be conjugated to active drug substances, for example, aspirin, warfarin, phenylbutazone, ibuprofen, suprofen, fenbufen, ketoprofen, (S)-(+)-pranoprofen, carprofen, dansylsarcosine, 2,3,5-triiodobenzoic acid, flufenamic acid, folinic acid, a benzolhiadiazide, chlorothiazide, a diazepine, indomethicin, a barbiturate, a cephalosporin, a sulfa drug, an antidiabetic, an antibacterial or an antibiotic.

Some ligands can have endosomolytic properties. The endosomolytic ligands promote the lysis of the endosome and/or transport of the composition, or its components, from the endosome to the cytoplasm of the cell. The endosomolytic ligand may be a polyanionic peptide or peptidomimetic which shows pH-dependent membrane activity and fusogenicity. In some embodiments, the endosomolytic ligand assumes its active conformation at endosomal pH. The "active" conformation is that conformation in which the endosomolytic ligand promotes lysis of the endosome and/ or transport of the composition, or its components, from the endosome to the cytoplasm of the cell. Exemplary endosomolytic ligands include the GALA peptide, the EALA peptide, and their derivatives. In some embodiments, the endosomolytic component may contain a chemical group (e.g., an amino acid) which will undergo a change in charge or protonation in response to a change in pH. The endosomolytic component may be linear or branched. Ligands can improve transport, hybridization, and specificity properties and may also improve nuclease resistance of the resultant natural or modified oligoribonucleotide, or a polymeric molecule comprising any combination of monomers described herein and/or natural or modified ribonucleotides.

Ligands in general can include therapeutic modifiers, e.g., for enhancing uptake; diagnostic compounds or reporter groups e.g., for monitoring distribution; cross-linking agents; and nuclease-resistance conferring moieties. General examples include lipids, steroids, vitamins, sugars, proteins, peptides, polyamines, and peptide mimics.

Ligands can include a naturally occurring substance, such as a protein (e.g., human serum albumin (HSA), low-density lipoprotein (LDL), high-density lipoprotein (HDL), or globulin); a carbohydrate (e.g., a dextran, pullulan, chitin, chitosan, inulin, cyclodextrin or hyaluronic acid); or a lipid. The ligand may also be a recombinant or synthetic molecule, such as a synthetic polymer, e.g., a synthetic polyamino acid, an oligonucleotide (e.g. an aptamer). Examples of polyamino acids include polyamino acid is a polylysine (PLL), poly L-aspartic acid, poly L-glutamic acid, styrenemaleic acid anhydride copolymer, poly(L-lactide-co-glycolied) copolymer, divinyl ether-maleic anhydride copolymer, N-(2-hydroxypropyl)methacrylamide copolymer (RMPA), polyethylene glycol (PEG), polyvinyl alcohol (PVA), polyurethane, poly(2-ethylacryllic acid), N-isopropylacrylamide polymers, or polyphosphazine. Example of polyamines include: polyethylenimine, polylysine (PLL), spermine, spermidine, polyamine, pseudopeptide-polyamine, peptidomimetic polyamine, dendrimer polyamine, arginine, amidine, protamine, cationic lipid, cationic porphyrin, quaternary salt of a polyamine, or an alpha helical peptide.

Ligands can also include targeting groups, e.g., a cell or tissue targeting agent, e.g., a lectin, glycoprotein, lipid or protein, e.g., an antibody, that binds to a specified cell type such as a kidney cell. A targeting group can be a thyrotropin, melanotropin, lectin, glycoprotein, surfactant protein A, Mucin carbohydrate, multivalent lactose, multivalent galactose, N-acetyl-galactosamine, N-acetyl-gulucosamine multivalent mannose, multivalent fucose, glycosylated polyaminoacids, multivalent galactose, transferrin, bisphosphonate, polyglutamate, polyaspartate, a lipid, cholesterol, a steroid, bile acid, folate, vitamin B12, biotin, an RGD peptide, an RGD peptide mimetic or an aptamer.

Additional examples of ligands include dyes, intercalating agents (e.g. acridines), cross-linkers (e.g. psoralene, mitomycin C), porphyrins (TPPC4, texaphyrin, Sapphyrin), polycyclic aromatic hydrocarbons (e.g., phenazine, dihydrophenazine), artificial endonucleases or a chelator (e.g. EDTA), lipophilic molecules, e.g., cholesterol, cholic acid, adamantane acetic acid, 1-pyrene butyric acid, dihydrotestosterone, 1,3-Bis-O(hexadecyl)glycerol, geranyloxyhexyl group, hexadecylglycerol, borneol, menthol, 1,3-propanediol, heptadecyl group, palmitic acid, myristic acid, O3-(oleoyl)lithocholic acid, 03-(oleoyl)cholenic acid, dimethoxytrityl, or phenoxazine) and peptide conjugates (e.g., antennapedia peptide, Tat peptide), alkylating agents, phosphate, amino, mercapto, PEG (e.g., PEG-40K), MPEG, [MPEG]2, polyamino, alkyl, substituted alkyl, radiolabeled markers, enzymes, haptens (e.g. biotin), transport/absorption facilitators (e.g., aspirin, vitamin E, folic acid), synthetic ribonucleases (e.g., imidazole, bisimidazole, histamine, imidazole clusters, acridine-imidazole conjugates, Eu3+ complexes of tetraazamacrocycles), dinitrophenyl, HRP, or AP.

Ligands can be proteins, e.g., glycoproteins, or peptides, e.g., molecules having a specific affinity for a co-ligand, or antibodies e.g., an antibody, that binds to a specified cell type such as a cancer cell, endothelial cell, or bone cell. Ligands may also include hormones and hormone receptors. They can also include non-peptidic species, such as lipids, lectins, carbohydrates, vitamins, cofactors, multivalent lactose, multivalent galactose, N-acetyl-galactosamine, N-acetyl-gulucosamine multivalent mannose, multivalent fucose, or aptamers. The ligand can be, for example, a lipopolysaccharide, an activator of p38 MAP kinase, or an activator of NF-KB.

The ligand can be a substance, e.g., a drug, which can increase the uptake of the iRNA agent into the cell, for example, by disrupting the cell's cytoskeleton, e.g., by disrupting the cell's microtubules, microfilaments, and/or intermediate filaments. The drug can be, for example, taxon, vincristine, vinblastine, cytochalasin, nocodazole, japlakinolide, latrunculin A, phalloidin, swinholide A, indanocine, or myoservin.

The ligand can increase the uptake of the oligonucleotide into the cell by activating an inflammatory response, for example. Exemplary ligands that would have such an effect include tumor necrosis factor alpha (TNF alpha), interleukin-1 beta, or gamma interferon.

In another aspect, the ligand is a moiety, e.g., a vitamin, which is taken up by a target cell, e.g., a proliferating cell. These are particularly useful for treating disorders characterized by unwanted cell proliferation, e.g., of the malignant or non-malignant type, e.g., cancer cells. Exemplary vitamins include vitamin A, E, and K. Other exemplary vitamins include B vitamins, e.g., folic acid, B12, riboflavin, biotin, pyridoxal or other vitamins or nutrients taken up by cancer cells. Also included are HAS, low density lipoprotein (LDL) and high-density lipoprotein (HDL). In another aspect, the ligand is a cell-permeation agent, e.g., a helical cell-permeation agent. In some cases, the agent is amphipathic. An exemplary agent is a peptide such as tat or antennopedia. If the agent is a peptide, it can be modified, including a peptidylmimetic, invertomers, non-peptide or pseudo-peptide linkages, and use of D-amino acids. The helical agent is may be an alpha-helical agent, which may have a lipophilic and a lipophobic phase.

The ligand can be a peptide or peptidomimetic. A peptidomimetic (also referred to herein as an oligopeptidomimetic) is a molecule capable of folding into a defined three-dimensional structure similar to a natural peptide. The peptide or peptidomimetic moiety can be about 5-50 amino acids long, e.g., about 5, 10, 15, 20, 25, 30, 35, 40, 45, or 50 amino acids long. A peptide or peptidomimetic can be, for example, a cell permeation peptide, cationic peptide, amphipathic peptide, or hydrophobic peptide (e.g., consisting primarily of Tyr, Trp or Phe). The peptide moiety can be a dendrimer peptide, constrained peptide or crosslinked peptide. In another alternative, the peptide moiety can include a hydrophobic membrane translocation sequence (MTS). An exemplary hydrophobic MTS-containing peptide is RFGF derived from human fibroblast growth factor 4 and having the amino acid sequence AAVALLPAVLLALLAP (SEQ ID NO: 34498) An RFGF analogue (e.g., amino acid sequence AALLPVLLAAP (SEQ ID NO: 34499) containing a hydrophobic MTS can also be a targeting moiety. The peptide moiety can be a "delivery" peptide, which can carry large polar molecules including peptides, oligonucleotides, and protein across cell membranes. For example, sequences from the HW Tat protein (GRKKRRQRRRPPQ (SEQ ID NO: 34500)) and the Drosophila Antennapedia protein (RQIKIWFQNRRMKWK (SEQ ID NO: 34501)) have been found to be capable of functioning as delivery peptides. A peptide or peptidomimetic can be encoded by a random sequence of DNA, such as a peptide identified from a phage-display library, or one-bead-one-compound (OBOC) combinatorial library. In some cases, the peptide or peptidomimetic tethered to an antisense oligonucleotide or iRNA agent via an incorporated monomer unit is a cell targeting peptide such as an arginine-glycine-aspartic acid (RGD)-peptide, or RGD mimic. A peptide moiety can range in length from about 5 amino acids to about 40 amino acids. The peptide moieties can have a structural modification, such as to increase stability or direct conformational properties. Any of the structural modifications described below can be utilized. An RGD peptide moiety can be used to target a tumor cell, such as an endothelial tumor cell or a breast cancer tumor cell. An RGD peptide can facilitate targeting of an iRNA agent to tumors of a variety of other tissues, including the lung, kidney, spleen, or liver. In some cases, the RGD peptide will facilitate targeting of an iRNA agent to the kidney. The RGD peptide can be linear or cyclic, and can be modified, e.g., glycosylated or methylated to facilitate targeting to specific tissues. For example, a glycosylated RGD peptide can deliver an iRNA agent to a tumor cell expressing yB3. Peptides that target markers enriched in proliferating cells can be used. E.g., RGD containing peptides and peptidomimetics can target cancer cells, in particular cells that exhibit an integrin. Thus, one could use RGD peptides, cyclic peptides containing RGD, RGD peptides that include D-amino acids, as well as synthetic RGD mimics. In addition to RGD, one can use other moieties that target the integrin ligand. Generally, such ligands can be used to control proliferating cells and angiogenesis. Exemplary conjugates of this type ligands that targets PECAM-1, VEGF, or other cancer gene, e.g., a cancer gene described herein.

In some embodiments, a "cell permeation peptide" is capable of permeating a cell, e.g., a microbial cell, such as a bacterial or fungal cell, or a mammalian cell, such as a human cell. A microbial cell-permeating peptide can be, for example, an a-helical linear peptide (e.g., LL-37 or Ceropin PI), a disulfide bond-containing peptide (e.g., a-defensin, β-defensin or bactenecin), or a peptide containing only one or two dominating amino acids (e.g., PR-39 or indolicidin). A cell permeation peptide can also include a nuclear localization signal (NLS). For example, a cell permeation peptide can be a bipartite amphipathic peptide, such as MPG, which is derived from the fusion peptide domain of HIV-1 gp41 and the NLS of SV40 large T antigen.

In some embodiments, a targeting peptide can be an amphipathic α-helical peptide. Exemplary amphipathic α-helical peptides include, but are not limited to, cecropins, lycotoxins, paradaxins, buforin, CPF, bombinin-like peptide (BLP), cathelicidins, ceratotoxins, S. clava peptides, hagfish intestinal antimicrobial peptides (HFIAPs), magainines, brevinins-2, dermaseptins, melittins, pleurocidin, H2A peptides, Xenopus peptides, esculentinis-1, and caerins. A number of factors may be considered to maintain the integrity of helix stability. For example, a maximum number of helix stabilization residues will be utilized (e.g., leu, ala, or lys), and a minimum number helix destabilization residues will be utilized (e.g., proline, or cyclic monomeric units. The capping residue will be considered (for example Gly is an exemplary N-capping residue and/or C-terminal amidation can be used to provide an extra H-bond to stabilize the helix. Formation of salt bridges between residues with opposite charges, separated by i±3, or i±4 positions can provide stability. For example, cationic residues such as lysine, arginine, homo-arginine, ornithine or histidine can form salt bridges with the anionic residues glutamate or aspartate.

Peptide and peptidomimetic ligands include those having naturally occurring or modified peptides, e.g., D or L peptides; α, β, or γ peptides; N-methyl peptides; azapeptides; peptides having one or more amide, i.e., peptide, linkages replaced with one or more urea, thiourea, carbamate, or sulfonyl urea linkages; or cyclic peptides.

The targeting ligand can be any ligand that is capable of targeting a specific receptor. Examples are: folate, GalNAc, galactose, mannose, mannose-6P, clusters of sugars such as GalNAc cluster, mannose cluster, galactose cluster, or an apatamer. A cluster is a combination of two or more sugar units. The targeting ligands also include integrin receptor ligands, Chemokine receptor ligands, transferrin, biotin, serotonin receptor ligands, PSMA, endothelin, GCPII, somatostatin, LDL and HDL ligands. The ligands can also be based on nucleic acid, e.g., an aptamer. The aptamer can be unmodified or have any combination of modifications disclosed herein.

Endosomal release agents include imidazoles, poly or oligoimidazoles, PEIs, peptides, fusogenic peptides, polycaboxylates, polyacations, masked oligo or poly cations or anions, acetals, polyacetals, ketals/polyketyals, orthoesters, polymers with masked or unmasked cationic or anionic charges, dendrimers with masked or unmasked cationic or anionic charges.

PK modulator stands for pharmacokinetic modulator. PK modulator include lipophiles, bile acids, steroids, phospholipid analogues, peptides, protein binding agents, PEG, vitamins etc. Exemplary PK modulator include, but are not limited to, cholesterol, fatty acids, cholic acid, lithocholic acid, dialkylglycerides, diacylglyceride, phospholipids, sphingolipids, naproxen, ibuprofen, vitamin E, biotin etc. Oligonucleotides that comprise a number of phosphorothioate linkages are also known to bind to serum protein, thus short oligonucleotides, e.g. oligonucleotides of about 5 bases, 10 bases, 15 bases or 20 bases, comprising multiple of phosphorothioate linkages in the backbone are also amenable as ligands (e.g. as PK modulating ligands).

In addition, aptamers that bind serum components (e.g. serum proteins) are also amenable as PK modulating ligands.

When two or more ligands are present, the ligands can all have same properties, all have different properties or some ligands have the same properties while others have different properties. For example, a ligand can have targeting properties, have endosomolytic activity or have PK modulating properties. In some embodiments, all the ligands have different properties.

Ligands can be coupled to the oligonucleotides at various places, for example, 3'-end, 5'-end, and/or at an internal position. In some embodiments, the ligand is attached to the oligonucleotides via an intervening tether, e.g. a carrier described herein. The ligand or tethered ligand may be present on a monomer when said monomer is incorporated into the growing strand. In some embodiments, the ligand may be incorporated via coupling to a "precursor" monomer after said "precursor" monomer has been incorporated into the growing strand. For example, a monomer having, e.g., an amino-terminated tether (i.e., having no associated ligand), e.g., TAP-(CH$_2$)nNH2 may be incorporated into a growing oligonucleotide strand. In a subsequent operation, i.e., after incorporation of the precursor monomer into the strand, a ligand having an electrophilic group, e.g., a pentafluorophenyl ester or aldehyde group, can subsequently be attached to the precursor monomer by coupling the electrophilic group of the ligand with the terminal nucleophilic group of the precursor monomer's tether. In another example, a monomer having a chemical group suitable for taking part in Click Chemistry reaction may be incorporated e.g., an azide or alkyne terminated tether/linker. In a subsequent operation, i.e., after incorporation of the precursor monomer into the strand, a ligand having complementary chemical group, e.g. an alkyne or azide can be attached to the precursor monomer by coupling the alkyne and the azide together.

For double-stranded oligonucleotides, ligands can be attached to one or both strands. In some embodiments, a double-stranded iRNA agent contains a ligand conjugated to the sense strand. In some embodiments, a double-stranded iRNA agent contains a ligand conjugated to the antisense strand.

In some embodiments, ligand can be conjugated to nucleobases, sugar moieties, or internucleosidic linkages of nucleic acid molecules. Conjugation to purine nucleobases or derivatives thereof can occur at any position including, endocyclic and exocyclic atoms. In some embodiments, the 2-, 6-, 7-, or 8-positions of a purine nucleobase are attached to a conjugate moiety. Conjugation to pyrimidine nucleobases or derivatives thereof can also occur at any position. In some embodiments, the 2-, 5-, and 6-positions of a pyrimidine nucleobase can be substituted with a conjugate moiety. Conjugation to sugar moieties of nucleosides can occur at any carbon atom. Example carbon atoms of a sugar moiety that can be attached to a conjugate moiety include the 2', 3', and 5' carbon atoms. The F position can also be attached to a conjugate moiety, such as in an abasic residue. Internucleosidic linkages can also bear conjugate moieties. For phosphorus-containing linkages (e.g., phosphodiester, phosphorothioate, phosphorodithiotate, phosphoroamidate, and the like), the conjugate moiety can be attached directly to the phosphorus atom or to an O, N, or S atom bound to the phosphorus atom. For amine- or amide-containing internucleosidic linkages (e.g., PNA), the conjugate moiety can be attached to the nitrogen atom of the amine or amide or to an adjacent carbon atom.

Any suitable ligand in the field of RNA interference may be used, although the ligand is typically a carbohydrate e.g. monosaccharide (such as GalNAc), disaccharide, trisaccharide, tetrasaccharide, polysaccharide. Linkers that conjugate the ligand to the nucleic acid include those discussed above. For example, the ligand can be one or more GalNAc (N-acetylglucosamine) derivatives attached through a bivalent or trivalent branched linker.

Cleavable Linking Groups

In some embodiments, an oligonucleotide compound or composition comprising an oligonucleotide compound comprises a cleavable linking group. In some cases a dsRNA agent comprises or is connected to a cleavable linking group. In some cases an antisense compound comprises or is connected to a cleavable linking group.

In some embodiments, a cleavable linking group is one which is sufficiently stable outside the cell, but which upon entry into a target cell is cleaved to release the two parts the linker is holding together. In some embodiments, the cleavable linking group is cleaved at least 10 times or more, or at least 100 times faster in the target cell or under a first reference condition (which can, e.g., be selected to mimic or represent intracellular conditions) than in the blood of a subject, or under a second reference condition (which can, e.g., be selected to mimic or represent conditions found in the blood or serum).

Cleavable linking groups are susceptible to cleavage agents, e.g., pH, redox potential or the presence of degradative agents. Generally, cleavage agents are more prevalent or found at higher levels or activities inside cells than in serum or blood.

Examples of such degradative agents include: redox agents which are selected for particular substrates or which have no substrate specificity, including, e.g., oxidative or reductive enzymes or reductive agents such as mercaptans, present in cells, that can degrade a redox cleavable linking group by reduction; esterases; endosomes or agents that can create an acidic environment, e.g., those that result in a pH of five or lower; enzymes that can hydrolyze or degrade an acid cleavable linking group by acting as a general acid, peptidases (which can be substrate specific), and phosphatases.

A cleavable linkage group, such as a disulfide bond can be susceptible to pH. The pH of human serum is 7.4, while the average intracellular pH is slightly lower, ranging from about 7.1-7.3. Endosomes have a more acidic pH, in the range of 5.5-6.0, and lysosomes have an even more acidic pH at around 5.0. Some linkers will have a cleavable linking group that is cleaved at a particular pH, thereby releasing the cationic lipid from the ligand inside the cell, or into the desired compartment of the cell.

A linker can include a cleavable linking group that is cleavable by a particular enzyme. The type of cleavable linking group incorporated into a linker can depend on the cell to be targeted. For example, liver targeting ligands can be linked to the cationic lipids through a linker that includes an ester group. Liver cells are rich in esterases, and therefore the linker will be cleaved more efficiently in liver cells than in cell types that are not esterase-rich. Other cell-types rich in esterases include cells of the lung, renal cortex, and testis.

Linkers that contain peptide bonds can be used when targeting cell types rich in peptidases, such as liver cells and synoviocytes. In general, the suitability of a candidate cleavable linking group can be evaluated by testing the ability of a degradative agent (or condition) to cleave the candidate linking group. It will also be desirable to also test the candidate cleavable linking group for the ability to resist cleavage in the blood or when in contact with other non-target tissue. Thus one can determine the relative susceptibility to cleavage between a first and a second condition, where the first is selected to be indicative of cleavage in a target cell and the second is selected to be indicative of cleavage in other tissues or biological fluids, e.g., blood or serum. The evaluations can be carried out in cell free systems, in cells, in cell culture, in organ or tissue culture, or in whole animals. It may be useful to make initial evaluations in cell-free or culture conditions and to confirm by further evaluations in whole animals. In some embodiments, useful candidate compounds are cleaved at least 2, 4, 10 or 100 times faster in the cell (or under in vitro conditions selected to mimic intracellular conditions) as compared to blood or serum (or under in vitro conditions selected to mimic extracellular conditions).

Redox Cleavable Linking Groups

One class of cleavable linking groups are redox cleavable linking groups that are cleaved upon reduction or oxidation. An example of reductively cleavable linking group is a disulphide linking group (—S—S—). To determine if a candidate cleavable linking group is a suitable "reductively cleavable linking group," or for example is suitable for use with a particular oligonucleotide and particular targeting agent one can look to methods described herein. For example, a candidate can be evaluated by incubation with dithiothreitol (DTT), or other reducing agent using reagents know in the art, which mimic the rate of cleavage which would be observed in a cell, e.g., a target cell. The candidates can also be evaluated under conditions which are selected to mimic blood or serum conditions. In some embodiments, candidate compounds are cleaved by at most 10% in the blood. In some embodiments, useful candidate compounds are degraded at least 2, 4, 10 or 100 times faster in the cell (or under in vitro conditions selected to mimic intracellular conditions) as compared to blood (or under in vitro conditions selected to mimic extracellular conditions). The rate of cleavage of candidate compounds can be determined using standard enzyme kinetics assays under conditions chosen to mimic intracellular media and compared to conditions chosen to mimic extracellular media.

Phosphate-Based Cleavable Linking Groups

Phosphate-based cleavable linking groups are cleaved by agents that degrade or hydrolyze the phosphate group. An example of an agent that cleaves phosphate groups in cells are enzymes such as phosphatases in cells. Examples of phosphate-based linking groups are —O—P(O)(ORk)-O—, —O—P(S)(ORk)-O—, —O—P(S)(SRk)-O—, —S—P(O)(ORk)-O—, —O—P(O)(ORk)-S—, —S—P(O)(ORk)-S—, —O—P(S)(ORk)-S—, —S—P(S)(ORk)-O—, —O—P(O)(Rk)-O—, —O—P(S)(Rk)-O—, —S—P(O)(Rk)-O—, —S—P(S)(Rk)-O—, —S—P(O)(Rk)-S—, —O—P(S)(Rk)-S—. Some embodiments are —O—P(O)(OH)—O—, —O—P(S)(OH)—O—, —O—P(S)(SH)—O—, —S—P(O)(OH)—O—, —O—P(O)(OH)—S—, —S—P(O)(OH)—S—, —O—P(S)(OH)—S—, —S—P(S)(OH)—O—, —O—P(O)(H)—O—, —O—P(S)(H)—O—, —S—P(O)(H)—O—, —S—P(S)(H)—O—, —S—P(O)(H)—S—, —O—P(S)(H)—S—. An exemplary embodiment is —O—P(O)(OH)—O—. These candidates can be evaluated using methods analogous to those described above.

Acid Cleavable Linking Groups

Acid cleavable linking groups are linking groups that are cleaved under acidic conditions. In some embodiments acid cleavable linking groups are cleaved in an acidic environment with a pH of about 6.5 or lower (e.g., about 6.0, 5.5, 5.0, or lower), or by agents such as enzymes that can act as a general acid. In a cell, specific low pH organelles, such as endosomes and lysosomes can provide a cleaving environment for acid cleavable linking groups. Examples of acid cleavable linking groups include but are not limited to hydrazones, esters, and esters of amino acids. Acid cleavable groups can have the general formula —C=NN—C(O)O, or —OC(O). An exemplary embodiment is when the carbon attached to the oxygen of the ester (the alkoxy group) is an aryl group, substituted alkyl group, or tertiary alkyl group such as dimethyl pentyl or t-butyl. These candidates can be evaluated using methods analogous to those described above.

Ester-Based Linking Groups

Ester-based cleavable linking groups are cleaved by enzymes such as esterases and amidases in cells. Examples of ester-based cleavable linking groups include but are not limited to esters of alkylene, alkenylene and alkynylene groups. Ester cleavable linking groups have the general formula —C(O)O—, or —OC(O)—. These candidates can be evaluated using methods analogous to those described above.

Peptide-Based Cleaving Groups

Peptide-based cleavable linking groups are cleaved by enzymes such as peptidases and proteases in cells. Peptide-based cleavable linking groups are peptide bonds formed between amino acids to yield oligopeptides (e.g., dipeptides, tripeptides etc.) and polypeptides. Peptide-based cleavable groups do not include the amide group (—C(O)NH—). The amide group can be formed between any alkylene, alkenylene or alkynelene. A peptide bond is a special type of amide bond formed between amino acids to yield peptides and proteins. The peptide based cleavage group is generally limited to the peptide bond (i.e., the amide bond) formed between amino acids yielding peptides and proteins and does not include the entire amide functional group. Peptide-based cleavable linking groups have the general formula —NHCHRAC(O)NHCHRBC(O)—, where RA and RB are the R groups of the two adjacent amino acids. These candidates can be evaluated using methods analogous to those described above. As used herein, "carbohydrate" refers to a compound which is either a carbohydrate per se made up of one or more monosaccharide units having at least 6 carbon atoms (which may be linear, branched or cyclic) with an oxygen, nitrogen or sulfur atom bonded to each carbon atom; or a compound having as a part thereof a carbohydrate moiety made up of one or more monosaccharide units each having at least six carbon atoms (which may be linear, branched or cyclic), with an oxygen, nitrogen or sulfur atom bonded to each carbon atom. Representative carbohydrates include the sugars (mono-, di-, tri- and oligosaccharides containing from about 4-9 monosaccharide units), and polysaccharides such as starches, glycogen, cellulose and polysaccharide gums. Specific monosaccharides include C5 and above (e.g., C5-C8) sugars; di- and trisaccharides include sugars having two or three monosaccharide units (e.g., C5-C8).

Nucleotide Mimics

In some embodiments, an oligonucleotide disclosed herein is a naked oligonucleotide. Naked oligonucleotides are defined as systems that contain no agents that are associated with the nucleic acid either covalently or non-covalently. The absence of any delivery vehicle may require that the oligonucleotide itself be sufficiently nuclease resistant, sufficiently long circulating and cell targeted. For small, solid-phase synthesized oligonucleotides such as those used in antisense oligonucleotides, RNAi, and innate immune stimulators, the use of nucleotide mimics may provide the required drug-like properties.

In some embodiments, an oligonucleotide of the present disclosure comprises nucleotides that replace phosphodiester group. The substitution of one non-bridging oxygen of a phosphodiester with a sulfur atom creates the phosphorothioate (PS) linkage. A PS bond creates a new stereocenter in the nucleotide and when synthesized under standard achiral conditions creates diastereomeric mixtures of Rp and Sp at the phosphorous atom.

There are other functional groups that have been identified as replacements of the phosphodiester group in the oligonucleotide. Like phosphates and phosphorothioates, there are a variety of functional groups that are negatively charged such as phosphorodithioate (PS2) and thio-phosphoramidates. There are number of analogues that are uncharged such as phosphorodiamidate morpholino oligomer (PMO), peptide nucleic acid (PNA), phosphotriesters, and phosphonates. It has been postulated that the uncharged analogues are not only nuclease resistant, but may also be more membrane permeable; however, the size and hydrophilicity of uncharged oligonucleotides still preclude their passive diffusion across membranes.

Morpholino oligos (PMOs) use a hydrolytically stable, uncharged phosphordiamidate functional group.

Peptide nucleic acids (PNAs) are—as their name suggests—based upon the amide functional group.

Enemas and intramuscular, intravitreal, intrathecal injections have been used for the administration of a variety of oligonucleotides with and without PS bonds.

In some embodiments, an oligonucleotide of the present disclosure comprises a nucleoside analogue that alters the structure of ribose. There are a variety of nucleotide mimics wherein the ribose or deoxyribose is modified to increase affinity for target and/or increase nuclease resistance. In some cases, there are modifications to all five positions of the ribose ring. In some cases, modifications are made to the 2' position of ribose.

In some embodiments, an oligonucleotide of the present disclosure comprises a modifications at the 1' position. In some cases, the oligonucleotide comprises a cytidine mimic that is designed to have increased affinity for guanosine bases due to hydrogen bonding through an aminoethyl group. In some cases, the oligonucleotide comprises a C-5 propynyl pyrimidines.

In some embodiments, an oligonucleotide of the present disclosure comprises a 2' modifications. Modifications of the hydroxyl group at the 2' position of ribose may be used to mimic the structure of the ribose ring while inhibiting ribonucleases that require the 2'OH group for hydrolysis of RNA. In some cases, the oligonucleotide comprises a 2'-O-Methyl ribonucleic acid that is naturally occurring and may increase binding affinity to RNA itself while being resistant to ribonuclease. In some cases, the oligonucleotide comprises a 2'-O-Methyl group. In some cases, the oligonucleotide comprises a 2'-O-Methoxyethyl(MOE) modification, which may mimic the ribonuclease resistance of 0-methyl, attenuate protein-oligonucleotide interactions and have increased affinity for RNA.

In some embodiments, an oligonucleotide of the present disclosure comprises a 2'-deoxy-2'-fluoro (2'-F) analogue of nucleosides that adopt a C3'-endo conformation characteristic of the sugars in RNA helices.

In some embodiments, an oligonucleotide of the present disclosure comprises a 4'- and 5'-modifications, where alkoxy substituents at the 4' position of 2'deoxyribose mimic the conformation of ribose.

In some embodiments, an oligonucleotide of the present disclosure comprises a bicyclic 2'-4'-modification. There are a variety of ribose derivatives that lock the carbohydrate ring into the 3' endo conformation by the formation of bicyclic structures with a bridge between the 2' oxygen and the 4' position. The original bicyclic structure has a methylene bridging group and are termed locked nucleic acids (LNAs).

The bicyclic structure "locks" the ribose into its preferred 3' endo conformation and increases base pairing affinity. It has been shown the that incorporation of LNAs into a DNA duplex can increase melting points up to 8° C. per LNA. Subsequently, a variety of bicyclic nucleotides have been developed such as Bridged Nucleic Acids (BNAs), Ethyl-bridged (ENAs), constrained ethyl (cEt) nucleic acids and tricyclic structures with varying affinity for target sites. LNAs can be incorporated into antagomirs, splice blocking oligonucleotides, either strand of an RNAi duplex; however, like other 3' endo conformers, LNAs are not substrates for RNAse H.

In some embodiments, an oligonucleotide of the present disclosure comprises an acyclic nucleic acid analog. In some cases, the analog comprises an alternative ribose ring structure. These include those in which the bond between 2' and 3' carbons in the ribose is absent, as well as those containing substitution of the ribose ring with a three-carbon backbone. Examples of acyclic nucleic acid analogs include unlocked nucleic acid (UNA) and glycol nucleic acids (GNA). Incorporation of these analogs reduce the melting temperature of the RNAi duplex and can be incorporated into either strand. Incorporation at the 5' end of the sense strand, or passenger strand, inhibits incorporation into this strand into RISC. Incorporation into the seed region of the antisense strand, or guide strand, can reduce off-target activity. Acyclic nucleic acid analogs may also increase resistance of the RNAi duplex to 3'-exonuclease activity.

In some embodiments, an oligonucleotide of the present disclosure comprises a modification patterns. Without being bound by theory, for RNAi duplexes, recognition by RISC requires RNA-like 3'-endo nucleotides and some patterns of RNA analogues. A pattern of alternating 2'-O-methyl groups may provide stability against nucleases, but not all permutations of alternating 2'-O-methyl are active RNAi agents. The fact that one may remove all 2'-hydroxy groups with alternating 2'-fluoro and 2'-O-methyl groups to produce duplexes that are resistant to nucleases and active in RNAi may suggest the 2'-hydroxy group is not absolutely required for activity, but that some sites in the RNAi duplex are sensitive to the added steric bulk of the methyl group.

Conjugated Oligonucleotides

Oligonucleotides may have groups conjugated via covalent bonds that prolong circulation, provide targeting to tissues and facilitate intracellular delivery.

In some embodiments, an oligonucleotide of the present disclosure is conjugated to polyethylene glycol (PEG), which may prevent clearance by two mechanisms: the increase in molecular weight above threshold for renal clearance and the prevention of non-specific interactions with extracellular surfaces and serum components. PEG may be incorporated into nucleic acid delivery vehicles by attachment to components that non-covalently associate with the nucleic acids, e.g. PEGylated lipids and polymers. PEG may also be directly conjugated to increase nucleic acid circulation times, decrease nonspecific interactions and alter biodistribution. In some cases, the targeting is passive and the potency of the nucleic may be compromised as PEG MW increases.

Another class of molecules that can be conjugated in order to increases circulation times is the attachment of lipophilic groups such as cholesterol or other lipophilic moiety with >12 carbons which interact with serum components such as albumen and lipoproteins thereby increasing circulation times and passive accumulation in the liver. In some cases, extensive PS modification increases circulation times through associations with serum components, with roughly 10 PS groups required for serum binding.

Formulations, Compositions, and Delivery

In some embodiments, the antisense oligonucleotide or dsRNA is administered in buffer.

In some embodiments, antisense oligonucleotide or dsRNA agent (sometimes referred to as siRNA) compounds described herein can be formulated for administration to a subject. A formulated anti sense oligonucleotide or siRNA composition can assume a variety of states. In some examples, the composition is at least partially crystalline, uniformly crystalline, and/or anhydrous (e.g., less than 80, 50, 30, 20, or 10% water). In another example, the antisense oligonucleotide or siRNA is in an aqueous phase, e.g., in a solution that includes water.

The aqueous phase or the crystalline compositions can, e.g., be incorporated into a delivery vehicle, e.g., a liposome (particularly for the aqueous phase) or a particle (e.g., a microparticle as can be appropriate for a crystalline composition). Generally, the antisense oligonucleotide or siRNA composition is formulated in a manner that is compatible with the intended method of administration, as described herein. For example, in particular embodiments the composition is prepared by at least one of the following methods: spray drying, lyophilization, vacuum drying, evaporation, fluid bed drying, or a combination of these techniques; or sonication with a lipid, freeze-drying, condensation and other self-assembly. In some embodiments, the composition is formulation for administration by inhalation.

An antisense oligonucleotide or siRNA preparation can be formulated in combination with another agent, e.g., another therapeutic agent or an agent that stabilizes an antisense oligonucleotide or siRNA, e.g., a protein that complexes with siRNA to form an iRNP. Still other agents include chelators, e.g., EDTA (e.g., to remove divalent cations such as Mg2+), salts, RNAse inhibitors (e.g., a broad specificity RNAse inhibitor such as RNAsin) and so forth.

In some embodiments, the antisense oligonucleotide or siRNA preparation includes another antisense oligonucleotide or siRNA compound, e.g., a second siRNA that can mediate RNAi with respect to a second gene, or with respect to the same gene. Still other preparation can include at least 3, 5, ten, twenty, fifty, or a hundred or more different antisense oligonucleotide or siRNA species. Such siRNAs can mediate RNAi with respect to a similar number of different genes.

In some embodiments, the antisense oligonucleotide or siRNA preparation includes at least a second therapeutic agent (e.g., an agent other than a RNA or a DNA). For example, an antisense oligonucleotide or siRNA composition for the treatment of a viral disease, e.g., HIV, might include a known antiviral agent (e.g., a protease inhibitor or reverse transcriptase inhibitor). In another example, a siRNA composition for the treatment of a cancer might further comprise a chemotherapeutic agent.

Liposomes

For ease of exposition the formulations, compositions and methods in this section are discussed largely with regard to unmodified antisense oligonucleotide or siRNA compounds. It may be understood, however, that these formulations, compositions and methods can be practiced with other antisense oligonucleotide or siRNA compounds, e.g., modified antisense oligonucleotide or siRNAs. An antisense oligonucleotide or siRNA compound, e.g., a double-stranded siRNA compound, or ssiRNA compound, (e.g., a precursor, e.g., a larger siRNA compound which can be processed into a ssiRNA compound, or a DNA which encodes an siRNA compound, e.g., a double-stranded siRNA compound, or ssiRNA compound, or precursor thereof) preparation can be formulated for delivery in a membranous molecular assembly, e.g., a liposome or a micelle. In some embodiments, the term "liposome" refers to a vesicle composed of amphiphilic lipids arranged in at least one bilayer, e.g., one bilayer or a plurality of bilayers. Liposomes include unilamellar and multilamellar vesicles that have a membrane formed from a lipophilic material and an aqueous interior. The aqueous portion contains the antisense oligonucleotide or siRNA composition. The lipophilic material isolates the aqueous interior from an aqueous exterior, which typically does not include the antisense oligonucleotide or siRNA composition, although in some examples, it may. Liposomes are useful for the transfer and delivery of active ingredients to the site of action. Because the liposomal membrane is structurally similar to biological membranes, when liposomes are applied to a tissue, the liposomal bilayer fuses with bilayer of the cellular membranes. As the merging of the liposome and cell progresses, the internal aqueous contents that include the antisense oligonucleotide or siRNA are delivered into the cell where the antisense oligonucleotide or siRNA can specifically bind to a target RNA. In some cases the liposomes are also specifically targeted, e.g., to direct the antisense oligonucleotide or siRNA to particular cell types.

A liposome containing an antisense oligonucleotide or siRNA can be prepared by a variety of methods. In one example, the lipid component of a liposome is dissolved in a detergent so that micelles are formed with the lipid component. For example, the lipid component can be an amphipathic cationic lipid or lipid conjugate. The detergent can have a high critical micelle concentration and may be nonionic. Exemplary detergents include cholate, CHAPS, octylglucoside, deoxycholate, and lauroyl sarcosine. The antisense oligonucleotide or siRNA preparation is then added to the micelles that include the lipid component. The cationic groups on the lipid interact with the antisense oligonucleotide or siRNA and condense around the anti sense oligonucleotide or siRNA to form a liposome. After condensation, the detergent is removed, e.g., by dialysis, to yield a liposomal preparation of antisense oligonucleotide or siRNA.

If necessary, a carrier compound that assists in condensation can be added during the condensation reaction, e.g., by controlled addition. For example, the carrier compound can be a polymer other than a nucleic acid (e.g., spermine or spermidine). pH can also be adjusted to favor condensation.

Commonly used techniques for preparing lipid aggregates of appropriate size for use as delivery vehicles include sonication and freeze-thaw plus extrusion. Microfluidization can be used when consistently small (50 to 200 nm) and relatively uniform aggregates are desired. These methods are readily adapted to packaging antisense oligonucleotide or siRNA preparations into liposomes.

Liposomes that are pH-sensitive or negatively-charged entrap nucleic acid molecules rather than complex with them. Since both the nucleic acid molecules and the lipid are similarly charged, repulsion rather than complex formation occurs.

Nevertheless, some nucleic acid molecules are entrapped within the aqueous interior of these liposomes. pH-sensitive liposomes have been used to deliver DNA encoding the thymidine kinase gene to cell monolayers in culture where expression of the exogenous gene was detected in the target cells.

One type of liposomal composition includes phospholipids other than naturally-derived phosphatidylcholine. Neutral liposome compositions, for example, can be formed from dimyristoyl phosphatidylcholine (DMPC) or dipalmitoyl phosphatidylcholine (DPPC). Anionic liposome compositions generally are formed from dimyristoyl phosphatidylglycerol, while anionic fusogenic liposomes are formed primarily from dioleoyl phosphatidylethanolamine (DOPE). Another type of liposomal composition is formed from phosphatidylcholine (PC) such as, for example, soybean PC, and egg PC. Another type is formed from mixtures of phospholipid and/or phosphatidylcholine and/or cholesterol.

In some embodiments, cationic liposomes are used. Cationic liposomes possess the advantage of being able to fuse to the cell membrane. Non-cationic liposomes, although not able to fuse as efficiently with the plasma membrane, are taken up by macrophages in vivo and can be used to deliver antisense oligonucleotide or siRNAs to macrophages.

Further advantages of liposomes include: liposomes obtained from natural phospholipids are biocompatible and biodegradable; liposomes can incorporate a wide range of water and lipid soluble drugs; liposomes can protect encapsulated antisense oligonucleotide or siRNAs in their internal compartments from metabolism and degradation. Some considerations in the preparation of liposome formulations are the lipid surface charge, vesicle size and the aqueous volume of the liposomes.

A positively charged synthetic cationic lipid, N-[1-(2,3-dioleyloxy)propyl]-N,N,N-trimethylammonium chloride (DOTMA) can be used to form small liposomes that interact spontaneously with nucleic acid to form lipid-nucleic acid complexes which are capable of fusing with the negatively charged lipids of the cell membranes of tissue culture cells, resulting in delivery of siRNA.

A DOTMA analogue, 1,2-bis(oleoyloxy)-3-(trimethylammonia)propane (DOTAP) can be used in combination with a phospholipid to form DNA-complexing vesicles. Lipofectin™ Bethesda Research Laboratories, Gaithersburg, Md.) is an effective agent for the delivery of highly anionic nucleic acids into living tissue culture cells that comprise positively charged DOTMA liposomes which interact spontaneously with negatively charged polynucleotides to form complexes. When enough positively charged liposomes are used, the net charge on the resulting complexes is also positive. Positively charged complexes prepared in this way spontaneously attach to negatively charged cell surfaces, fuse with the plasma membrane, and efficiently deliver functional nucleic acids into, for example, tissue culture cells. Another commercially available cationic lipid, 1,2-bis(oleoyloxy)-3,3-(trimethylammonia)propane ("DOTAP") (Boehringer Mannheim, Indianapolis, Ind.) differs from DOTMA in that the oleoyl moieties are linked by ester, rather than ether linkages.

Other reported cationic lipid compounds include those that have been conjugated to a variety of moieties including, for example, carboxyspermine which has been conjugated to one of two types of lipids and includes compounds such as 5-carboxyspermylglycine dioctaoleoylamide ("DOGS") (Transfectam™, Promega, Madison, Wis.) and dipalmitoylphosphatidylethanolamine 5-carboxyspermyl-amide ("DPPES").

Another cationic lipid conjugate includes derivatization of the lipid with cholesterol ("DC-Choi") which may be formulated into liposomes in combination with DOPE. Lipopolylysine, made by conjugating polylysine to DOPE, may be effective for transfection in the presence of serum. For certain cell lines, these liposomes containing conjugated cationic lipids, are said to exhibit lower toxicity and provide more efficient transfection than the DOTMA-containing compositions. Other commercially available cationic lipid products include DMRIE and DMRIE-HP (Vical, La Jolla, California) and Lipofectamine (DOSPA) (Life Technology, Inc., Gaithersburg, Md.).

Liposomal formulations may be particularly suited for topical administration, and may present an advantage over other formulations. Such advantages include reduced side effects related to high systemic absorption of the administered drug, increased accumulation of the administered drug at the desired target, and the ability to administer antisense oligonucleotide or siRNA, into the skin. In some implementations, liposomes are used for delivering antisense oligonucleotide or siRNA to epidermal cells and also to enhance the penetration of antisense oligonucleotide or siRNA into dermal tissues, e.g., into skin. For example, the liposomes can be applied topically.

In some embodiments, non-ionic liposomal systems are used to deliver an oligonucleotide to the skin, e.g., using non-ionic surfactant and cholesterol. Non-ionic liposomal formulations comprising Novasome I (glyceryl dilaurate/cholesterol/polyoxyethylene-10-stearyl ether) and Novasome II (glyceryl distearate/cholesterol/polyoxyethylene-10-stearyl ether) may be used to deliver an oligonucleotide. Such formulations with antisense oligonucleotide or siRNA are useful for treating a dermatological disorder.

Liposomes that include antisense oligonucleotide or siRNA can be made highly deformable. Such deformability can enable the liposomes to penetrate through pore that are smaller than the average radius of the liposome. For example, transfersomes are a type of deformable liposomes. Transferosomes can be made by adding surface edge activators, usually surfactants, to a standard liposomal composition. Transfersomes that include antisense oligonucleotide or siRNA can be delivered, for example, subcutaneously by infection in order to deliver antisense oligonucleotide or siRNA to keratinocytes in the skin. In order to cross intact mammalian skin, lipid vesicles must pass through a series of fine pores, each with a diameter less than 50 nm, under the influence of a suitable transdermal gradient. In addition, due to the lipid properties, these transferosomes can be self-optimizing (adaptive to the shape of pores, e.g., in the skin), self-repairing, and can frequently reach their targets without fragmenting, and often self-loading.

In some embodiments, an oligonucleotide is formulated with a surfactant. Surfactants find wide application in formulations such as emulsions (including microemulsions) and liposomes (see above). In some embodiments, the antisense oligonucleotide or siRNA is formulated as an emulsion that includes a surfactant. The most common way of classifying and ranking the properties of the many different types of surfactants, both natural and synthetic, is by the use of the hydrophile/lipophile balance (HLB). The nature of the hydrophilic group provides a useful means for categorizing the different surfactants used in formulations.

If the surfactant molecule is not ionized, it is classified as a nonionic surfactant. Nonionic surfactants find wide application in pharmaceutical products and are usable over a wide range of pH values. In general their HLB values range from 2 to about 18 depending on their structure. Nonionic surfactants include nonionic esters such as ethylene glycol esters, propylene glycol esters, glyceryl esters, polyglyceryl esters, sorbitan esters, sucrose esters, and ethoxylated esters. Nonionic alkanolamides and ethers such as fatty alcohol ethoxylates, propoxylated alcohols, and ethoxylated/propoxylated block polymers are also included in this class.

The polyoxy ethylene surfactants are the most popular members of the nonionic surfactant class.

If the surfactant molecule carries a negative charge when it is dissolved or dispersed in water, the surfactant is classified as anionic. Anionic surfactants include carboxylates such as soaps, acyl lactylates, acyl amides of amino acids, esters of sulfuric acid such as alkyl sulfates and ethoxylated alkyl sulfates, sulfonates such as alkyl benzene sulfonates, acyl isethionates, acyl taurates and sulfo succinates, and phosphates. The most important members of the anionic surfactant class are the alkyl sulfates and the soaps. If the surfactant molecule carries a positive charge when it is dissolved or dispersed in water, the surfactant is classified as cationic. Cationic surfactants include quaternary ammonium salts and ethoxylated amines. The quaternary ammonium salts are the most used members of this class.

If the surfactant molecule has the ability to carry either a positive or negative charge, the surfactant is classified as amphoteric. Amphoteric surfactants include acrylic acid derivatives, substituted alkylamides, N-alkylbetaines and phosphatides.

Micelles and other Membranous Formulations

For ease of exposition the micelles and other formulations, compositions and methods in this section are discussed largely with regard to unmodified antisense oligonucleotide or siRNA compounds. It may be understood, however, that these micelles and other formulations, compositions and methods can be practiced with other antisense oligonucleotide or siRNA compounds, e.g., modified antisense oligonucleotide or siRNA compounds. The antisense oligonucleotide or siRNA compound, e.g., a double-stranded siRNA compound, or ssiRNA compound, (e.g., a precursor, e.g., a larger siRNA compound which can be processed into a ssiRNA compound, or a DNA which encodes an siRNA compound, e.g., a double-stranded siRNA compound, or ssiRNA compound, or precursor thereof) composition can be provided as a micellar formulation. In some embodiments, "micelles" are a particular type of molecular assembly in which amphipathic molecules are arranged in a spherical structure such that all the hydrophobic portions of the molecules are directed inward, leaving the hydrophilic portions in contact with the surrounding aqueous phase. The converse arrangement exists if the environment is hydrophobic.

A mixed micellar formulation suitable for delivery through transdermal membranes may be prepared by mixing an aqueous solution of the antisense oligonucleotide or siRNA composition, an alkali metal Cs to C22 alkyl sulphate, and a micelle forming compounds. Exemplary micelle forming compounds include lecithin, hyaluronic acid, pharmaceutically acceptable salts of hyaluronic acid, glycolic acid, lactic acid, chamomile extract, cucumber extract, oleic acid, linoleic acid, linolenic acid, monoolein, monooleates, monolaurates, borage oil, evening of primrose oil, menthol, trihydroxy oxo cholanyl glycine and pharmaceutically acceptable salts thereof, glycerin, polyglycerin, lysine, polylysine, triolein, polyoxy ethylene ethers and analogues thereof, polidocanol alkyl ethers and analogues thereof, chenodeoxycholate, deoxycholate, and mixtures thereof. The micelle forming compounds may be added at the same time or after addition of the alkali metal alkyl sulphate. Mixed micelles will form with substantially any kind of mixing of the ingredients but vigorous mixing in order to provide smaller size micelles.

In one method a first micellar composition is prepared which contains the siRNA composition and at least the alkali metal alkyl sulphate. The first micellar composition is then mixed with at least three micelle forming compounds to form a mixed micellar composition. In another method, the micellar composition is prepared by mixing the siRNA composition, the alkali metal alkyl sulphate and at least one of the micelle forming compounds, followed by addition of the remaining micelle forming compounds, with vigorous mixing.

Phenol and/or m-cresol may be added to the mixed micellar composition to stabilize the formulation and protect against bacterial growth. Alternatively, phenol and/or m-cresol may be added with the micelle forming ingredients. An isotonic agent such as glycerin may also be added after formation of the mixed micellar composition.

For delivery of the micellar formulation as a spray, the formulation can be put into an aerosol dispenser and the dispenser is charged with a propellant. The propellant, which is under pressure, is in liquid form in the dispenser. The ratios of the ingredients are adjusted so that the aqueous and propellant phases become one, i.e., there is one phase. If there are two phases, it is necessary to shake the dispenser prior to dispensing a portion of the contents, e.g., through a metered valve. The dispensed dose of pharmaceutical agent is propelled from the metered valve in a fine spray.

Propellants may include hydrogen-containing chlorofluorocarbons, hydrogen-containing fluorocarbons, dimethyl ether and diethyl ether. In certain embodiments, HFA 134a (1,1,1,2 tetrafluoroethane) may be used.

Pharmaceutical Compositions

The oligonucleotides disclosed herein may be formulated in a pharmaceutical composition. The specific concentrations of the oligonucleotide can be determined by experimentation.

For ease of exposition the particles, formulations, compositions and methods in this section are discussed largely with regard to antisense oligonucleotide or siRNA compounds. It may be understood, however, that these particles, formulations, compositions and methods can be practiced with modified antisense oligonucleotide or siRNA compounds. In some embodiments, an antisense oligonucleotide or siRNA compound, e.g., a double-stranded siRNA compound, or ssiRNA compound, (e.g., a precursor, e.g., a larger siRNA compound which can be processed into a ssiRNA compound, or a DNA which encodes an siRNA compound, e.g., a double-stranded siRNA compound, or siRNA compound, or precursor thereof) preparations may be incorporated into a particle, e.g., a microparticle. Microparticles can be produced by spray-drying, but may also be produced by other methods including lyophilization, evaporation, fluid bed drying, vacuum drying, or a combination of these techniques.

The anti sense oligonucleotide or siRNA agents may be formulated for pharmaceutical use. Pharmaceutically acceptable compositions comprise a therapeutically-effective amount of one or more of the antisense oligonucleotide or dsRNA agents in any of the preceding embodiments, taken alone or formulated together with one or more pharmaceutically acceptable carriers (additives), excipient and/or diluents. In dome embodiments, the composition is a pharmaceutical composition.

The pharmaceutical compositions may be specially formulated for administration in solid or liquid form, including those adapted for the following: (1) oral administration, for example, drenches (aqueous or non-aqueous solutions or suspensions), tablets, e.g., those targeted for buccal, sublingual, and systemic absorption, boluses, powders, granules, pastes for application to the tongue; (2) parenteral administration, for example, by subcutaneous, intramuscular, intravenous or epidural injection as, for example, a sterile solution or suspension, or sustained-release formulation; (3) topical application, for example, as a cream, ointment, or a controlled-release patch or spray applied to the skin; (4) intravaginally or intrarectally, for example, as a pessary, cream or foam; (5) sublingually; (6) ocularly; (7) transdermally; (8) nasally; (9) inhalation; or (10) endotracheally. In some embodiments, the composition is sterile.

In some embodiments, a "therapeutically-effective amount" is an amount of a compound, material, or composition comprising an oligonucleotide herein which is effective for producing some desired therapeutic effect in at least a sub-population of cells in an animal at a reasonable benefit/risk ratio applicable to any medical treatment.

In some embodiments, "pharmaceutically acceptable" is employed herein to refer to those compounds, materials, compositions, and/or dosage forms which are, within the scope of sound medical judgment, suitable for use in contact with the tissues of human beings and animals without excessive toxicity, irritation, allergic response, or other problem or complication, commensurate with a reasonable benefit/risk ratio.

In some embodiments, "pharmaceutically-acceptable carrier" as used herein means a pharmaceutically-acceptable material, composition or vehicle, such as a liquid or solid filler, diluent, excipient, manufacturing aid (e.g., lubricant, talc magnesium, calcium or zinc stearate, or steric acid), or solvent encapsulating material, involved in carrying or transporting the subject compound from one organ, or portion of the body, to another organ, or portion of the body. Each carrier must be "acceptable" in the sense of being compatible with the other ingredients of the formulation and not injurious to the patient. Some examples of materials which can serve as pharmaceutically-acceptable carriers include: (1) sugars, such as lactose, glucose and sucrose; (2) starches, such as corn starch and potato starch; (3) cellulose, and its derivatives, such as sodium carboxymethyl cellulose, ethyl cellulose and cellulose acetate; (4) powdered tragacanth; (5) malt; (6) gelatin; (7) lubricating agents, such as magnesium state, sodium lauryl sulfate and talc; (8) excipients, such as cocoa butter and suppository waxes; (9) oils, such as peanut oil, cottonseed oil, safflower oil, sesame oil, olive oil, corn oil and soybean oil; (10) glycols, such as propylene glycol; (11) polyols, such as glycerin, sorbitol, mannitol and polyethylene glycol; (12) esters, such as ethyl oleate and ethyl laurate; (13) agar; (14) buffering agents, such as magnesium hydroxide and aluminum hydroxide; (15) alginic acid; (16) pyrogen-free water; (17) isotonic saline; (18) Ringer's solution; (19) ethyl alcohol; (20) pH buffered solutions; (21) polyesters, polycarbonates and/or polyanhydrides; (22) bulking agents, such as polypeptides and amino acids (23) serum component, such as serum albumin, HDL and LDL; and (22) other non-toxic compatible substances employed in pharmaceutical formulations. In some embodiments, the composition comprises a pharmaceutically acceptable carried. In some embodiments, the pharmaceutically acceptable carriers comprises water, a buffer, or a saline solution.

The formulations may conveniently be presented in unit dosage form and may be prepared by any methods well known in the art of pharmacy. The amount of active ingredient which can be combined with a carrier material to produce a single dosage form will vary depending upon the host being treated, the particular mode of administration. The amount of active ingredient which can be combined with a carrier material to produce a single dosage form will generally be that amount of the compound which produces a therapeutic effect. Generally, out of one hundred percent, this amount will range from about 0.1 percent to about ninety-nine percent of active ingredient, from about 5 percent to about 70 percent, or from about 10 percent to about 30 percent.

In certain embodiments, a formulation comprises an excipient selected from the group consisting of cyclodextrins, celluloses, liposomes, micelle forming agents, e.g., bile acids, and polymeric carriers, e.g., polyesters and polyanhydrides; and a compound disclosed herein. In certain embodiments, an aforementioned formulation renders orally bio available a compound disclosed herein.

An agent preparation can be formulated in combination with another agent, e.g., another therapeutic agent or an agent that stabilizes an antisense oligonucleotide or iRNA, e.g., a protein that complexes with antisense oligonucleotide or iRNA to form particle. Still other agents include chelators, e.g., EDTA (e.g., to remove divalent cations such as Mg2+), salts, RNAse inhibitors (e.g., a broad specificity RNAse inhibitor such as RNAsin) and so forth.

Methods of preparing these formulations or compositions include the step of bringing into association a compound disclosed herein with the carrier and, optionally, one or more accessory ingredients. In general, the formulations are prepared by uniformly and intimately bringing into association a compound disclosed herein with liquid carriers, or finely divided solid carriers, or both, and then, if necessary, shaping the product.

In some cases, in order to prolong the effect of a drug, it is desirable to slow the absorption of the drug from subcutaneous or intramuscular injection. This may be accomplished by the use of a liquid suspension of crystalline or amorphous material having poor water solubility. The rate of absorption of the drug then depends upon its rate of dissolution which, in turn, may depend upon crystal size and crystalline form. Alternatively, delayed absorption of a parenterally-administered drug form is accomplished by dissolving or suspending the drug in an oil vehicle.

The compounds disclosed herein may be formulated for administration in any convenient way for use in human or veterinary medicine, by analogy with other pharmaceuticals.

Further provided are pharmaceutical compositions of the oligonucleotide molecules described. These pharmaceutical compositions include salts of the above compounds, e.g., acid addition salts, for example, salts of hydrochloric, hydrobromic, acetic acid, and benzene sulfonic acid. These pharmaceutical formulations or pharmaceutical compositions can comprise a pharmaceutically acceptable carrier or diluent.

In some embodiments, pharmaceutical compositions (e.g. oligonucleotides and/or lipid nanoparticle formulations thereof) further comprise conventional pharmaceutical excipients and/or additives. Suitable pharmaceutical excipients include preservatives, flavoring agents, stabilizers, antioxidants, osmolality adjusting agents, buffers, and pH adjusting agents. Suitable additives include physiologically biocompatible buffers (e.g., trimethylamine hydrochloride), addition of chelants (such as, for example, DTPA or DTPA-bisamide) or calcium chelate complexes (as for example calcium DTPA, CaNaDTPA-bisamide), or, optionally, additions of calcium or sodium salts (for example, calcium chloride, calcium ascorbate, calcium gluconate or calcium lactate). In addition, antioxidants and suspending agents can be used.

In some embodiments, the siRNA and LNP compositions and formulations provided herein for use in pulmonary delivery further comprise one or more surfactants. Suitable surfactants or surfactant components for enhancing the uptake of the compositions include synthetic and natural as well as full and truncated forms of surfactant protein A, surfactant protein B, surfactant protein C, surfactant protein D and surfactant Protein E, di-saturated phosphatidylcholine (other than dipalmitoyl), dipalmitoylphosphatidylcholine, phosphatidylcholine, phosphatidylglycerol, phosphatidylinositol, phosphatidylethanolamine, phosphatidylserine; phosphatidic acid, ubiquinones, lysophosphatidylethanolamine, lysophosphatidylcholine, palmitoyl-lysophosphatidylcholine, dehydroepiandrosterone, dolichols, sulfatidic acid, glycerol-3-phosphate, dihydroxyacetone phosphate, glycerol, glycero-3-phosphocholine, dihydroxyacetone, palmitate, cytidine diphosphate (CDP) diacylglycerol, CDP choline, choline, choline phosphate; as well as natural and artificial lamellar bodies which are the natural carrier vehicles for the components of surfactant, omega-3 fatty acids, polyenic acid, polyenoic acid, lecithin, palmitinic acid, non-ionic block copolymers of ethylene or propylene oxides, polyoxypropylene, monomeric and polymeric, polyoxyethylene, monomeric and polymeric, poly (vinyl amine) with dextran and/or alkanoyl side chains, Brij 35, Triton X-100 and synthetic surfactants ALEC, Exosurf, Survan and Atovaquone, among others. These surfactants can be used either as single or part of a multiple component surfactant in a formulation, or as covalently bound additions to the 5' and/or 3' ends of the nucleic acid component of a pharmaceutical composition herein.

Aerosol Formulations

The compositions disclosed herein, either alone or in combination with other suitable components, can be made into aerosol formulations (i.e., they can be "nebulized") to be administered via inhalation (e.g., intranasally or intratracheally). Aerosol formulations can be placed into pressurized acceptable propellants, such as dichlorodifluoromethane, propane, nitrogen, and the like.

In some embodiments, the oligonucleotide molecules and formulations thereof are administered via pulmonary delivery, such as by inhalation of an aerosol or spray dried formulation administered by an inhalation device or nebulizer, providing rapid local uptake of the nucleic acid molecules into relevant pulmonary tissues. Solid particulate compositions containing respirable dry particles of micronized nucleic acid compositions can be prepared by grinding dried or lyophilized nucleic acid compositions. A solid particulate composition comprising the oligonucleotide compositions can optionally contain a dispersant which serves to facilitate the formation of an aerosol as well as other therapeutic compounds. A suitable dispersant is lactose, which can be blended with the nucleic acid compound in any suitable ratio.

Spray compositions comprising oligonucleotide molecules can, for example, be formulated as aqueous solutions or suspensions or as aerosols delivered from pressurized packs, such as a metered dose inhaler, with the use of a suitable liquefied propellant. In some embodiments, aerosol compositions suitable for inhalation can be either a suspension or a solution and generally contain an oligonucleotide molecule and a suitable propellant such as a fluorocarbon or hydrogen-containing chlorofluorocarbon or mixtures thereof, particularly hydrofluoroalkanes, especially 1,1,1,2-tetrafluoroethane, 1,1,1,2,3,3,3-heptafluoro-n-propane or a mixture thereof. The aerosol composition can optionally contain additional formulation excipients well known in the art such as surfactants. In some embodiments a pharmaceutical aerosol formulation comprising a compound disclosed herein and a fluorocarbon or hydrogen-containing chlorofluorocarbon or mixtures thereof as propellant, optionally in combination with a surfactant and/or a co-solvent.

The aerosol formulations can be buffered by the addition of suitable buffering agents.

Aerosol formulations can include optional additives including preservatives if the formulation is not prepared sterile. Non-limiting examples include, methyl hydroxybenzoate, anti-oxidants, flavorings, volatile oils, buffering agents and emulsifiers and other formulation surfactants. In some embodiments, fluorocarbon or perfluorocarbon carriers are used to reduce degradation and provide safer biocompatible non-liquid particulate suspension compositions (e.g., oligonucleotide and/or lipid nanoparticle formulations thereof). In some embodiments, a device comprising a nebulizer delivers a composition (e.g., oligonucleotide and/or lipid nanoparticle formulations thereof) comprising fluorochemicals that are bacteriostatic thereby decreasing the potential for microbial growth in compatible devices.

Capsules and cartridges comprising the composition for use in an inhaler or insufflator, of for example gelatin, can be formulated containing a powder mix for inhalation of a compound disclosed herein and a suitable powder base such as lactose or starch.

The aerosol compositions can be administered into the respiratory system as a formulation including particles of respirable size, e.g. particles of a size sufficiently small to pass through the nose, mouth and larynx upon inhalation and through the bronchi and alveoli of the lungs. In general, respirable particles range from about 0.5 to 10 microns in size. In some embodiments, the particulate range can be from 1 to 5 microns. In some embodiments, the particulate range can be from 2 to 3 microns. Particles of non-respirable size which are included in the aerosol tend to deposit in the throat and be swallowed, and the quantity of non-respirable particles in the aerosol is thus minimized. For nasal administration, the particle size may be in the range of 10-500 µm to ensure retention in the nasal cavity.

In some embodiments, an oligonucleotide is administered topically to the nose for example, for the treatment of rhinitis, via pressurized aerosol formulations, aqueous formulations administered to the nose by pressurized pump or by nebulization. Suitable formulations contain water as the diluent or carrier for this purpose. In certain embodiments, the aqueous formulations for administration of the composition to the lung or nose can be provided with conventional excipients such as buffering agents, tonicity modifying agents and the like.

Gene Therapy Vector

In some embodiments, double-stranded RNAi agents or antisense oligonucleotides are produced in a cell in vivo, e.g., from exogenous DNA templates that are delivered into the cell. For example, the DNA templates can be inserted into vectors and used as gene therapy vectors. Gene therapy vectors can be delivered to a subject by, for example, intravenous injection, local administration, or by stereotactic injection. The pharmaceutical preparation of the gene therapy vector can include the gene therapy vector in an acceptable diluent, or can comprise a slow release matrix in which the gene delivery vehicle is imbedded. The DNA templates, for example, can include two transcription units, one that produces a transcript that includes the top strand of a dsRNA agent and one that produces a transcript that includes the bottom strand of a dsRNA agent. When the templates are transcribed, the dsRNA agent is produced, and processed into siRNA agent fragments that mediate gene silencing.

Delivery Vehicles Based Upon Complexation of Nucleic Acid

In some embodiments, complexation of oligonucleotide therapeutics with cationic agents inhibits nuclease from degrading the oligonucleotide by forming a steric barrier and by inhibiting nuclease binding by neutralizing anionic charge. The process of forming compact particles of nucleic acids from their extended chains is called condensation, which may be achieved by the addition of multiply-charged cationic species. Multiple positive charges can either be covalently attached to one another in a polycation or non-covalently associated with one another in a complex such as the surface of a cationic liposome. The resulting polycation-polyanion interaction is a colloidal dispersion where the nucleic acid particles vary in size and shape depending on the nucleic acid and the condensing cation. In general, the particles are greater than 20 nm in size, and—in the absence of agents to modulate surface charge such as polyethylene glycol (PEG)—have surface charges >20 mV.

The pharmacokinetics and biodistribution of nanoparticles are dependent upon their size and charge. Upon iv administration, large (>200 nm) and/or highly positively charged (surface charge >20 mV) are primarily distributed among endothelial tissues and macrophages in the liver and spleen and have a half-life of circulation less than 2 hours. Reduction in size (<100 nm) and surface charge (~0 mV) results increased circulation times. Local administration of positively charged polyplexes results in association with cells at site of application such as epithelial cells.

Strategies for Cytoplasmic Delivery

There are a variety of strategies to facilitate cytoplasmic delivery of oligonucleotides including endosomal buffering (i.e. proton sponge), titratable amphiphiles, cell penetrating peptides and masked membrane lytic polymers.

The mechanism of endosomal buffering (i.e. proton sponge) to facilitate endosomolysis relies on the ability of agents such as polyamines to buffer endosomal/lysosomal compartments. The resistance to acidification is postulated to result in increased osmotic pressure that results in lysis of the lysosomal compartment. Titratable amphiphiles are polymers/peptides whose structure is pH-dependent in such a way that at acidic pH they are hydrophobic and membrane disruptive. Typically, titratable amphiphiles are polyanionic polymers or peptides composed of carboxylic acids that become neutral and membrane disruptive upon acidification. Cell penetrating peptides (CPPs) are cationic peptides, with a high propensity of guanidinium groups, that enter cells without any apparent membrane lysis. Masked lytic polymers are membrane disruptive polymers whose membrane interactivity is attenuated by reversible covalent modification. Like titratable amphiphiles, the mechanism of endosomolysis by masked polymers relies on the use of amphipathic polymers whose ability to lyse membranes is controlled such that the activity is only functional in the acidic environment of the endosome/lysosome. In the case of titratable amphiphiles, the mechanism of control is a reversible protonation of carboxylic acids. In the case of masked polymers, the control of membrane activity is the irreversible cleavage of a group that inhibits membrane interactivity of the polymer.

Liposomal Delivery Systems

Nucleic acids entrapped in lipids (lipoplexes) are a common vehicle for the delivery of nucleic acids. Cationic lipids form electrostatic complexes between nucleic acid and lipids. In addition to the cationic lipids, there are typically neutral or anionic helper lipids which are composed of unsaturated fatty acids and are postulated to assist in fusion between the lipoplex and the cellular membrane, and PEGylated lipids, which prevent aggregation during formulation and storage and non-specific interactions in vivo.

Lipids are water insoluble and nucleic acids are organic solvent insoluble. To mix these components in a controlled manner such that formulations are repeatable and relatively homogenous in size, detergents or water-miscible organic solvents such as ethanol are used. After formation of electrostatically-associated complexes, the amphipathic detergent or solvent is then removed by dialysis or solvent exchange. Depending on the components and the mixing procedure is possible to formulate lipoplexes that are well less than 100 nm.

Although the transfection efficiencies of lipoplexes are difficult to predict and optimization is empirical, there are a few design features that have been identified to aid transfection efficiency in vivo: pH-sensitive cationic lipids, the use of unsaturation in the lipid chains and the hydrophobic-hydrophilic balance of PEG-lipids to balance circulation times and transfection efficiencies.

There have been several studies that have shown a correlation between the pKa of the amine groups of the cationic lipid, which is buffer in the range of the endosomal/lysosomal pathway (pH 4-7), and transfection ability. To synthesize lipids with such pKa values, lipids commonly have closely-spaced amines or imidazole groups. The effect of these weakly basic amine groups in the lipoplexes produces several attractive attributes that facilitate in vivo transfection: reduced surface charge at neutral pH thereby decreasing nonspecific interactions in vivo, increased surface charge in acid environment of endosomes and lysosomes thereby increasing electrostatic interactions with the cellular membrane in these compartments and providing buffering groups that can provide endosomolytic activity via the proton sponge mechanism.

Another common motif observed in cationic and helper lipids used in lipoplexes is the presence of unsaturation in their component fatty acids with oleic (18 carbon chain with one double bond) and linoleic (18 carbons with 2 double bonds) being very common. The incorporation of these groups increases fluidity of membranes, aids in the formation of fusogenic lipid structures and facilitates the release of cationic lipids from nucleic acids.

PEG-conjugated lipids are incorporated into lipoplexes to aid in the formation of nonaggregating small complexes and for the prevention of nonspecific interactions in vivo. Due to the hydrophilicity of PEG, their lipid conjugates are not permanently associated with lipoplexes and diffuse from the complexes with dilution and interaction with amphiphilic components in vivo. This loss of PEG shielding from the surface of the lipoplexes aids in transfection efficiency. In general, longer saturated fatty acid chains increase circulation while unsaturation and shorter chains decrease circulation.

A commonly invoked tumor targeting mechanism is the Enhanced Permeability and Retention (EPR) effect, which is when nanoparticles accumulate in tumor tissue much more than they do in normal tissues due to the leaky disorganized vasculature associated with tumor tissues and their lack of lymphatic drainage. EPR-based targeting requires long circulating particles.

Polymer Based Delivery Vehicles

Like lipoplexes, polymer-based transfection vehicles (polyplexes) provide nuclease protection and condensation of larger nucleic acids. Polyplexes are based upon cationic polymers that form electrostatic complexes with anionic nucleic acids. Polycations may be purely synthetic (such as polyethyleneimine), naturally occurring (such as histones, protamine, spermine and spermidine) or synthetic polymers based upon cationic amino acids such as ornithine, lysine and arginine.

Polycations form electrostatic complexes with polyanionic nucleic acids. The strength of the association is dependent upon the size of the nucleic acid and the size and charge density of the polycation.

There are three common strategies to improve the stability and surface charge of polyplexes to improve the circulation and targeting of ability of polyplexes: crosslinking of polycation, addition of a synthetic polyanion and conjugation of PEG.

Crosslinking, also called lateral stabilization and caging, is the formation of covalent polyamine-polyamine bonds after complexation/condensation of the nucleic acid. The crosslinking is accomplished by the addition of bifunctional, amine-reactive reagents that form a 3-D network of bonds around the nucleic acid, thereby making the polyplex resistant to displacement by salts and polyelectrolytes. The stability of the polyplexes is such that the nucleic acid is no longer active unless a mechanism of reversibility is introduced to allow for release of the nucleic acid. A common way to introduce reversibility is the use of disulfide-containing crosslinking reagent that can be reduced in the cytoplasm allowing release of nucleic acid therapeutic.

A common method to reduce the surface charge of a polyplex is the conjugation of PEG, a method commonly known as steric stabilization. The resulting PEG modified polyplexes have prolonged circulation in vivo. PEG modifications can be added to the size chains of polyamines—either before or after polyplex formation—or at the end of the polymer as a block copolymer of PEG and polycation.

Crosslinking and PEGylation are often combined to make stabilized polyplexes of reduced surface charge for systemic administration that can either be passively or actively targeted. As observed for lipoplexes, a variety of small molecule (such as GalNAc, RGD and folate) and biologic targeting ligands (such as transferrin and antibodies) have been conjugated to PEG-modified polyplexes for tissues selective targeting.

The most commonly used polymer for polyplexes—and the originator of the proton sponge mechanism—is polyethylenimine (PEI). PEI's high density of amine groups endows it with high charge density and a continuum of amine pKa's that buffer in the entire pH range of the endosome. The buffering capacity of PEI has been mimicked by the addition of weakly basic imidazole groups.

Oligonucleotide vehicle formulation. The solution conditions in which the oligonucleotide is dissolved, or its delivery vehicle is dispersed may play a role in its delivery. Hypotonic and hypertonic solution conditions may aid in cytoplasmic delivery for systemic and locally administration.

Respiratory System Delivery Formulations

In some embodiments, an oligonucleotide disclosed herein is delivered to the respiratory tract via drops. Drops may be advantageous as they are low-cost and relatively straightforward to manufacture. In some cases, the oligonucleotide is administered using a meter-dosed pump sprays. Meter-dosed pump sprays may accurately deliver volumes between 25 and 200 μL. The particle size of the drops from pump sprays is a product of the device, patient handling, as well as the formulation, which varies based on the viscosity and surface tension of the product. Respiratory tract formulations can also be delivered as powders. Powder drug delivery provides a high mass of active ingredients for a given volume.

Once small particle suspensions having therapeutically effective concentrations of 1fTSLP inhibitors have been prepared, solid concentrates can also be prepared by known methods, such as lyophilization, spray-drying and/or supercritical fluid extraction. These solid concentrates can then be resuspended at the time of administration. Also, these solid concentrates may also be compounded to produce a single dosage form such as tablets, capsules, lozenges, suppositories, coated tablets, capsules, ampoules, suppositories, delayed release formulations, controlled release formulations, extended release formulations, pulsatile release formulations, immediate release formulations, gastroretentive formulations, effervescent tablets, fast melt tablets, oral liquid and sprinkle formulations. The solid concentrates may also be formulated in a form selected from the group consisting of a patch, a powder preparation for inhalation, a suspension, an ointment and an emulsion.

Small particle compositions 1fTSLP inhibitors can also be formulated in therapeutically effective concentrations for delivery as an aerosol for respiratory delivery to the lungs or as a suspension.

Small particles of can be made using any appropriate method including, but not limited to, precipitation methods, mechanical/physical particle size reduction methods such as milling and homogenization, phospholipids coating methods, surfactant coating methods, spray-drying methods, supercritical fluid methods, and hot melt methods.

To increase the residence time for respiratory tract absorption of drugs after delivery, formulators may add viscosity-increasing and mucoadhesive agents to the formulations. To permit effective dosing of the formulation while maintaining an increased residence time, an in-situ gelling formulation may be used, example of a gel forming agents are gellan and pectin. Another strategy is the use of thixotropic rheological properties that have a low viscosity during actuation. Another method of utilizing mucoadhesive excipients in the formulation intended for respiratory tract delivery is to produce microspheres of drug within the excipient.

Methods and Routes for Administration

The present disclosure includes administration to the respiratory tract of a mammal in a therapeutically effective amount of an oligonucleotide disclosed herein. Respiratory administering or respiratory administration includes administering the composition to the respiratory tract. Pharmaceutical compositions for respiratory administration of a composition may be prepared as sprays, drops, suspensions, gels, ointments, creams or powders.

For topical administration, suitable formulations may include biocompatible oil, wax, gel, powder, polymer, or other liquid or solid carriers. Such formulations may be administered by applying directly to affected tissues, for example, a liquid formulation to treat infection of conjunctival tissue can be administered drop wise to the subject's eye, or a cream formulation can be administered to a wound site.

The compositions disclosed herein can be administered parenterally such as, for example, by intravenous, intramuscular, intrathecal or subcutaneous injection. Parenteral administration can be accomplished by incorporating the compositions into a solution or suspension. Such solutions or suspensions may also include sterile diluents such as water for injection, saline solution, fixed oils, polyethylene glycols, glycerine, propylene glycol or other synthetic solvents. Parenteral formulations may also include antibacterial agents such as, for example, benzyl alcohol or methyl parabens, antioxidants such as, for example, ascorbic acid or sodium bisulfite and chelating agents such as EDTA. Buffers such as acetates, citrates or phosphates and agents for the adjustment of tonicity such as sodium chloride or dextrose may also be added. The parenteral preparation can be enclosed in ampules, disposable syringes or multiple dose vials made of glass or plastic.

Rectal administration includes administering the pharmaceutical compositions into the rectum or large intestine. This can be accomplished using suppositories or enemas. Suppository formulations can easily be made by methods known in the art. For example, suppository formulations can be prepared by heating glycerin to about 120 C, dissolving the pharmaceutical composition in the glycerin, mixing the heated glycerin after which purified water may be added, and pouring the hot mixture into a suppository mold.

Transdermal administration includes percutaneous absorption of the composition through the skin. Transdermal formulations include patches, ointments, creams, gels, salves and the like.

In addition to the usual meaning of administering the formulations described herein to any part, tissue or organ whose primary function is gas exchange with the external environment, "pulmonary" is also meant to include a tissue or cavity that is contingent to the respiratory tract, in particular, the sinuses. For pulmonary administration, an aerosol formulation containing the active agent, a manual pump spray, nebulizer or pressurized metered-dose inhaler as well as dry powder formulations are contemplated. Suitable formulations of this type can also include other agents, such as antistatic agents, to maintain the disclosed compounds as effective aerosols.

A drug delivery device for delivering aerosols comprises a suitable aerosol canister with a metering valve containing a pharmaceutical aerosol formulation as described and an actuator housing adapted to hold the canister and allow for drug delivery. The canister in the drug delivery device has a head space representing greater than about 15% of the total volume of the canister. Often, the polymer intended for pulmonary administration is dissolved, suspended or emulsified in a mixture of a solvent, surfactant and propellant. The mixture is maintained under pressure in a canister that has been sealed with a metering valve.

The pharmaceutical compositions described herein may be co-administered with one or more additional agents separately or in the same formulation. Such additional agents include, for example, anti-histamines, beta agonists (e.g., albuterol), antibiotics, antiinflammatories (e.g. ibuprofen, prednisone (corticosteroid) or pentoxifylline), anti-fungals, (e.g. Amphotericin B, Fluconazole, Ketoconazol, and Itraconazol), steroids, decongestants, bronchodialators, and the like. The formulation may also contain preserving agents, solubilizing agents, chemical buffers, surfactants, emulsifiers, colorants, odorants and sweeteners.

The pharmaceutical composition described herein can be used to treat a patient suffering from a condition mediated by 1fTSLP. In some embodiments, the condition is an inflammatory condition.

Conditions mediated by 1fTSLP activity include, but are not limited to asthma, rheumatoid arthritis, gout, psoriasis, allergic rhinitis, respiratory distress syndrome, chronic obstructive pulmonary disease, acne, atopic dermatitis, atherosclerosis, aortic aneurysm, sickle cell disease, acute lung injury, ischemia/reperfusion injury, nasal polyposis, inflammatory bowel disease (including, for example, ulcerative colitis and Crohn's disease), irritable bowel syndrome, cancer, tumors, respiratory syncytial virus, sepsis, endotoxin shock and myocardial infarction. In some embodiments, the condition mediated by 1fTSLP activity is an inflammatory condition. Inflammatory conditions include, but are not limited to, appendicitis, peptic, gastric or duodenal ulcers, peritonitis, pancreatitis, acute or ischemic colitis, diverticulitis, epiglottitis, achalasia, cholangitis, cholecystitis, hepatitis, inflammatory bowel disease (including, for example, Crohn's disease and ulcerative colitis), enteritis, Whipple's disease, asthma, chronic obstructive pulmonary disease, acute lung injury, ileus (including, for example, post-operative ileus), allergy, anaphylactic shock, immune complex disease, organ ischemia, reperfusion injury, organ necrosis, hay fever, sepsis, septicemia, endotoxic shock, cachexia, hyperpyrexia, eosinophilic granuloma, granulomatosis, sarcoidosis, septic abortion, epididymitis, vaginitis, prostatitis, urethritis, bronchitis, emphysema, rhinitis, cystic fibrosis, pneumonitis, pneumoultramicroscopic silicovolcanoconiosis, alvealitis, bronchiolitis, pharyngitis, pleurisy, sinusitis, influenza, respiratory syncytial virus, herpes, disseminated bacteremia, Dengue fever, candidiasis, malaria, filariasis, amebiasis, hydatid cysts, burns, dermatitis, dermatomyositis, sunburn, urticaria, warts, wheals, vasulitis, angiitis, endocarditis, arteritis, atherosclerosis, thrombophlebitis, pericarditis, myocarditis, myocardial ischemia, periarteritis nodosa, rheumatic fever, Alzheimer's disease, coeliac disease, congestive heart failure, adult respiratory distress syndrome, meningitis, encephalitis, multiple sclerosis, cerebral infarction, cerebral embolism, Guillame-Barre syndrome, neuritis, neuralgia, spinal cord injury, paralysis, uveitis, arthritides, arthralgias, osteomyelitis, fasciitis, Paget's disease, gout, periodontal disease, rheumatoid arthritis, synovitis, myasthenia gravis, thryoiditis, systemic lupus erythematosus, Goodpasture's syndrome, Behcet's syndrome, allograft rejection, graft-versus-host disease, Type I diabetes, ankylosing spondylitis, Berger's disease, Type II diabetes, Retier's syndrome, or Hodgkins disease.

Respiratory Tract Delivery Devices

For most purposes, a broad distribution of the drug on the mucosal surfaces appears desirable for drugs intended for local action or systemic absorption and for vaccines. In eosinophilic chronic airway diseases, targeted delivery to lung epithelium is desired.

Compositions disclosed herein can be administered into the respiratory system as particles of respirable size, e.g. particles of a size sufficiently small to pass through the nose, mouth and larynx upon inhalation and through the bronchi and alveoli of the lungs. In general, respirable particles range from about 0.5 to 10 microns in size. In some embodiments, the particulate range can be from 1 to 5 microns. In some embodiments, the particulate range can be from 2 to 3 microns. For nasal administration, the particle size may be in the range of 10-500 μm to ensure retention in the nasal cavity.

In some embodiments, an oligonucleotide of the present disclosure is delivered using a respiratory tract delivery device. Liquid respiratory formulations are often aqueous solutions, but suspensions and emulsions can also be delivered. Liquid formulations are considered convenient particularly for topical indications where humidification counteracts the dryness and crusting often accompanying chronic respiratory diseases. In traditional spray pump systems, preservatives are typically required to maintain microbiological stability in liquid formulations.

In some embodiments, an oligonucleotide of the present disclosure is delivered in drops with a pipette. Drops may be administered by sucking liquid into a glass dropper, inserting the dropper into the nostril with an extended neck before squeezing the rubber top to emit the drops.

In some embodiments, an oligonucleotide of the present disclosure is delivered as a liquid with rhinyle catheter and squirt tube. A simple way for a physician or trained assistant to deposit drug in the nose is to insert the tip of a fine catheter or micropipette to the desired area under visual control and squirt the liquid into the desired location.

In some embodiments, an oligonucleotide of the present disclosure is delivered using a squeeze bottle. By squeezing a partly air-filled plastic bottle, the drug is atomized when delivered from a jet outlet. The dose and particle size vary with the force applied.

In some embodiments, an oligonucleotide of the present disclosure is delivered using a metered-dose spray pump. The pump may deliver 100 μl (25-200 μl) per spray, and may offer high reproducibility of the emitted dose and plume geometry in in vitro tests. The particle size and plume geometry can vary within certain limits and depend on the properties of the pump, the formulation, the orifice of the actuator, and the force applied. In some cases, the spray systems is configured to avoid the need for preservatives. These systems use a collapsible bag, a movable piston, or a compressed gas to compensate for the emitted liquid volume. The solutions with a collapsible bag and a movable piston compensating for the emitted liquid volume offer the additional advantage that they can be emitted upside down, without the risk of sucking air into the dip tube and compromising the subsequent spray. This may be useful for some products where the patients are bedridden and where a headdown application is recommended. Some systems have a ball valve at the tip to prevent contamination of the liquid inside the applicator tip. Pumps have been designed with side-actuation. The pump was designed with a shorter tip to avoid contact with the sensitive mucosal surfaces. New designs to reduce the need for priming and re-priming, and pumps incorporating pressure point features to improve the dose reproducibility and dose counters and lock-out mechanisms for enhanced dose control and safety are available. Importantly, the in vivo deposition and clinical performance of metered-dose spray pumps can be enhanced for some applications by adapting the pumps to a novel breath powered "Bi-Directional" delivery technology.

In some embodiments, an oligonucleotide of the present disclosure is delivered via a single- or duo-dose spray device. Metered-dose spray pumps require priming and some degree of overfill to maintain dose conformity for the labeled number of doses. For expensive drugs and vaccines intended for single administration or sporadic use and where tight control of the dose and formulation is of particular importance, single-dose or duo-dose spray devices may be preferred. A simple variant of a single-dose spray device (MAD) is a nosepiece with a spray tip is fitted to a standard syringe. The liquid drug to be delivered is first drawn into the syringe and then the spray tip is fitted onto the syringe.

In some embodiments, an oligonucleotide of the present disclosure is delivered via a respiratory pressurized metered-dose inhaler (pMDI). The particles from a pMDI are released at a high speed with the expansion of a compressed gas. The particles emitted from traditional pMDIs have a particle velocity much higher than a spray pump (5,200 vs. 1,500 cm/s at a distance 1-2 cm from the actuator tip). The issues related to the high particle speed and "cold Freon effect" have been reduced with hydrofluoroalkane (HFA)-based pMDI for respiratory use offering lower particle speeds. Like spray pumps, respiratory pMDIs produce a localized deposition on the anterior non-ciliated epithelium of the respiratory vestibule and in the anterior parts of the narrow respiratory valve, but due to quick evaporation of the spray delivered with a pMDI, noticeable "drip-out" may be less of an issue.

In some embodiments, an oligonucleotide of the present disclosure is delivered via a powered nebulizer or atomizer. Nebulizers use compressed gasses (air, oxygen, and nitrogen) or ultrasonic or mechanical power to break up medical solutions and suspensions into small aerosol droplets that can be directly inhaled into the mouth or nose. The smaller particles and slow speed of the nebulized aerosol are advocated to increase penetration into the respiratory tract.

In some embodiments, an oligonucleotide of the present disclosure is delivered using a powder device. Powder medication formulations can offer advantages, including greater stability than liquid formulations and potential that preservatives may not be required. Powders tend to stick to the moist surface of mucosa before being dissolved and cleared. The use of bioadhesive excipients or agents that slow ciliary action may decrease clearance rates and improve absorption. A number of factors like moisture sensitivity, solubility, particle size, particle shape, and flow characteristics will impact deposition and absorption.

In some cases a powder sprayer has a compressible compartment to provide a pressure that when released creates a plume of powder particles fairly similar to that of a liquid spray. In some cases a breath-actuated inhaler is used where the subject uses his own breath to inhale the powder into the nostril from a blister or capsule.

In some embodiments, an oligonucleotide conjugated with cholesterol or lipid containing >18 carbon atoms administered to lung epithelium increases residence time with tissue and increases intracellular delivery resulting in mRNA reduction.

In some embodiments, an oligonucleotide is administered to respiratory tract in a solution that is hypotonic.

In some embodiments, an agent for decreasing 1fTSLP expression is administered using an aerosol spray device.

In some embodiments, an agent for decreasing 1fTSLP expression is formulated as powder and administered using a using a powder delivery device.

Routes of Delivery

A composition that includes an antisense oligonucleotide or dsRNA agent can be delivered to a subject by a variety of routes. Exemplary routes include: intravenous, subcutaneous, topical, rectal, anal, vaginal, nasal, endotracheally, inhalation, pulmonary, ocular.

The anti sense oligonucleotide or dsRNA agent can be incorporated into pharmaceutical compositions suitable for administration. Such compositions typically include one or more species of anti sense oligonucleotide or dsRNA agent and a pharmaceutically acceptable carrier. As used herein the language "pharmaceutically acceptable carrier" is intended to include any and all solvents, dispersion media, coatings, antibacterial and antifungal agents, isotonic and absorption delaying agents, and the like, compatible with pharmaceutical administration. The use of such media and agents for pharmaceutically active substances is well known in the art. Except insofar as any conventional media or agent is incompatible with the active compound, use thereof in the compositions is contemplated. Supplementary active compounds can also be incorporated into the compositions.

The compositions disclosed herein may be administered in a number of ways depending upon whether local or systemic treatment is desired and upon the area to be treated. Administration may be topical (including ophthalmic, vaginal, rectal, intranasal, inhalation, endotracheal, transdermal), oral or parenteral. Parenteral administration includes intravenous drip, subcutaneous, intraperitoneal or intramuscular injection, or intrathecal or intraventricular administration.

The route and site of administration may be chosen to enhance targeting. For example, to target muscle cells, intramuscular injection into the muscles of interest would be a logical choice. Lung cells might be targeted by administering the antisense oligonucleotide or dsRNA agent in aerosol form.

Exemplary formulations for topical administration include those in which the antisense oligonucleotides or dsRNAs are in admixture with a topical delivery agent such as lipids, liposomes, fatty acids, fatty acid esters, steroids, chelating agents and surfactants. Exemplary lipids and liposomes include neutral (e.g. dioleoyl-phosphatidyl DOPE etlianolaniine, dimyristoylphosphatidyl choline DMPC, distearolyphosphatidyl choline) negative (e.g. dimyristoylphosphatidyl glycerol DMPG) and cationic (e.g. dioleoyltetramemylaminopropyl DOTAP and dioleoyl-phosphatidyl ethanolamine DOTMA).

For topical or other administration, antisense oligonucleotides or dsRNAs may be encapsulated within liposomes or may form complexes thereto, in particular to cationic liposomes. Alternatively, antisense oligonucleotides or dsRNAs may be complexed to lipids, in particular to cationic lipids.

Compositions and formulations for oral administration include powders or granules, microparticulates, nanoparticulates, suspensions or solutions in water or non-aqueous media, capsules, gel capsules, sachets, tablets or rninitablets. Thickeners, flavoring agents, diluents, emulsifiers, dispersing aids or binders may be desirable. Exemplary surfactants include fatty acids and or esters or salts thereof, bile acids and/or salts thereof. In some cases, penetration enhancers, for example, fatty acids salts are combined with bile acids salts. An exemplary combination is the sodium salt of lauric acid, capric acid and UDCA. Further penetration enhancers include polyoxyethylene-9-lauryl ether, polyoxyethylene-20-cetyl ether. Oligonucleotides may be delivered orally, in granular form including sprayed dried particles, or complexed to form micro or nanoparticles.

Compositions and formulations for pulmonary administration may include sterile aqueous solutions that may also contain buffers, diluents and other suitable additives such as, but not limited to, penetration enhancers, carrier compounds and other pharmaceutically acceptable carriers or excipients.

Dosage

In one aspect, provided is a method of administering an antisense oligonucleotide or dsRNA agent to a subject (e.g., a human subject). The method includes administering a unit dose of the antisense oligonucleotide or dsRNA agent that is 14-30 nucleotides (nt) long, for example, 21-23 nt, and is complementary to a target RNA (e.g., 1fTSLP), and optionally includes at least one 3' overhang 1-5 nucleotide long. In some embodiments, the unit dose is less than 10 mg per kg of bodyweight, or less than 10, 5, 2, 1, 0.5, 0.1, 0.05, 0.01, 0.005, 0.001, 0.0005, 0.0001, 0.00005 or 0.00001 mg per kg of bodyweight, and less than 200 nmole of the antisense oligonucleotide or dsRNA agent (e.g., about 4.4×1016 copies) per kg of bodyweight, or less than 1500, 750, 300, 150, 75, 15, 7.5, 1.5, 0.75, 0.15, 0.075, 0.015, 0.0075, 0.0015, 0.00075, 0.00015 nmole of the antisense oligonucleotide or RNA agent per kg of bodyweight.

The defined amount can be an amount effective to treat or prevent a disease or disorder, e.g., a disease or disorder associated with the target RNA. The unit dose, for example, can be administered by injection (e.g., intravenous, subcutaneous or intramuscular), an inhaled dose, or a topical application. In some embodiments dosages may be less than 10, 5, 2, 1, or 0.1 mg/kg of body weight.

In some embodiments, the unit dose is administered less frequently than once a day, e.g., less than every 2, 4, 8 or 30 days. In some embodiments, the unit dose is not administered with a frequency (e.g., not a regular frequency). For example, the unit dose may be administered a single time.

In some embodiments, the effective dose is administered with other traditional therapeutic modalities. For example, a therapeutic agent useful for treating a disease or disorder affecting the lungs.

In some embodiments, a subject is administered an initial dose and one or more maintenance doses of an antisense oligonucleotide or dsRNA agent. The maintenance dose or doses can be the same or lower than the initial dose, e.g., one-half less of the initial dose. A maintenance regimen can include treating the subject with a dose or doses ranging from 0.01 μg to 15 mg/kg of body weight per day, e.g., 10, 1, 0.1, 0.01, 0.001, or 0.00001 mg per kg of bodyweight per day. The maintenance doses are, for example, administered no more than once every 2, 5, 10, or 30 days. Further, the treatment regimen may last for a period of time which will vary depending upon the nature of the particular disease, its severity and the overall condition of the patient. In certain embodiments the dosage may be delivered no more than once per day, e.g., no more than once per 24, 36, 48, or more hours, e.g., no more than once for every 5 or 8 days.

Following treatment, the patient can be monitored for changes in his condition and for alleviation of the symptoms of the disease state. The dosage of the compound may either be increased in the event the patient does not respond significantly to current dosage levels, or the dose may be decreased if an alleviation of the symptoms of the disease state is observed, if the disease state has been ablated, or if undesired side-effects are observed. The effective dose can be administered in a single dose or in two or more doses, as desired or considered appropriate under the specific circumstances. If desired to facilitate repeated or frequent infusions, implantation of a delivery device, e.g., a pump, semi-permanent stent (e.g., intravenous, intraperitoneal, intracisternal or intracapsular), or reservoir may be advisable.

The anti sense oligonucleotide or dsRNA agents can be administered to mammals, particularly large mammals such as nonhuman primates or humans in a number of ways.

In some embodiments, the administration of the antisense oligonucleotide or dsRNA agent is parenteral, e.g., intravenous (e.g., as a bolus or as a diffusible infusion), intradermal, intraperitoneal, intramuscular, intrathecal, intraventricular, intracranial, subcutaneous, transmucosal, buccal, sublingual, endoscopic, rectal, oral, vaginal, topical, inhalation, pulmonary, intranasal, urethral or ocular. Administration can be provided by the subject or by another person, e.g., a health care provider. The medication can be provided in measured doses or in a dispenser which delivers a metered dose. Selected modes of delivery are discussed elsewhere herein.

Methods

Embodiments also relate to methods for inhibiting the expression of a target gene. The method comprises the step of administering the antisense oligonucleotide or dsRNA agents in any of the preceding embodiments, in an amount sufficient to inhibit expression of the target gene. In some embodiments, the target gene is 1fTSLP. Another aspect relates to a method of modulating the expression of a target gene in a cell, comprising providing to said cell an antisense oligonucleotide or dsRNA agent. In some embodiments, the target gene is sfTSLP. In some embodiments, the antisense oligonucleotide or dsRNA agent described herein is modified.

The present disclosure provides vitro and in vivo methods for treatment of a disease or disorder in a mammal by downregulating or silencing the transcription and/or translation of a target gene of interest. In some embodiments, the method comprises introducing an antisense oligonucleotide or dsRNA agent that silences expression (e.g., mRNA and/or protein levels) of a target sequence into a cell by contacting the cell with a modified antisense oligonucleotide or dsRNA agent described herein. In some embodiments, the method comprises in vivo delivery of an anti sense oligonucleotide or dsRNA agent that silences expression of a target sequence by administering to a mammal a modified antisense oligonucleotide or dsRNA described herein. Administration of the antisense oligonucleotide or dsRNA can be by any route known in the art, such as, e.g., oral, intranasal, inhalation, intravenous, intraperitoneal, intramuscular, intra-articular, intralesional, intratracheal, endotracheal, subcutaneous, or intradermal. In some cases, delivery is by respiratory tract administration. In some embodiments, the target sequence is 1fTSLP. In some embodiments, the target sequence is sfTSLP.

In certain embodiments, the antisense oligonucleotide or dsRNA agent comprises a carrier system, e.g., to deliver the antisense oligonucleotide or dsRNA agent into a cell of a mammal. Non-limiting examples of carrier systems include nucleic acid-lipid particles, liposomes, micelles, virosomes, nucleic acid complexes, and mixtures thereof. In certain instances, the antisense oligonucleotide or dsRNA molecule is complexed with a lipid such as a cationic lipid to form a lipoplex. In certain instances, the antisense oligonucleotide or dsRNA agent is complexed with a polymer such as a cationic polymer (e.g., polyethylenimine (PEI)) to form a polyplex. The anti sense oligonucleotide or dsRNA agent may also be complexed with cyclodextrin or a polymer thereof. In some embodiments, the antisense oligonucleotide or dsRNA agent is encapsulated in a nucleic acid-lipid particle.

In some aspects, disclosed herein is a method of treating an airway disorder in a subject in need thereof, the method comprising administering to the subject a composition comprising an oligonucleotide that targets 1fTSLP. In some embodiments, the airway disorder comprises airway inflammation. In some embodiments, the airway disorder comprises an airway inflammation disorder. In some embodiments, the airway inflammation disorder comprises a Th2 inflammatory disorder. In some embodiments, the airway inflammation disorder comprises asthma. In some embodiments, the airway inflammation disorder comprises nasal polyps. In some embodiments, the airway inflammation disorder comprises allergic rhinitis. In some embodiments, the airway inflammation disorder comprises chronic rhinosinusitis. In some embodiments, the airway inflammation disorder comprises an increased blood eosinophil count. In some embodiments, the administration is by inhalation.

Assessing Up-Regulation or Inhibition of Gene Expression

Transfer of an exogenous nucleic acid into a host cell or organism can be assessed by directly detecting the presence of the nucleic acid in the cell or organism. For example, the presence of the exogenous nucleic acid can be detected by Southern blot or by a polymerase chain reaction (PCR) technique using primers that specifically amplify nucleotide sequences associated with the nucleic acid. Expression of the exogenous nucleic acids can also be measured using conventional methods including gene expression analysis.

For instance, mRNA produced from an exogenous nucleic acid can be detected and quantified using a Northern blot and reverse transcription PCR (RT-PCR).

Expression of RNA from the exogenous nucleic acid can also be detected by measuring an enzymatic activity or a reporter protein activity. For example, antisense or dsRNA modulatory activity can be measured indirectly as a decrease or increase in target nucleic acid expression as an indication that the exogenous nucleic acid is producing the effector RNA. Based on sequence conservation, primers can be designed and used to amplify coding regions of the target genes. Initially, the most highly expressed coding region from each gene can be used to build a model control gene, although any coding or non-coding region can be used. Each control gene is assembled by inserting each coding region between a reporter coding region and its poly(A) signal. These plasmids would produce an mRNA with a reporter gene in the upstream portion of the gene and a potential RNAi target in the 3' non-coding region. The effectiveness of individual antisense oligonucleotides or dsRNA would be assayed by modulation of the reporter gene. Reporter genes include acetohydroxyacid synthase (AHAS), alkaline phosphatase (AP), beta galactosidase (LacZ), beta glucoronidase (GUS), chloramphenicol acetyltransferase (CAT), green fluorescent protein (GFP), red fluorescent protein (RFP), yellow fluorescent protein (YFP), cyan fluorescent protein (CFP), horseradish peroxidase (HRP), luciferase (Lac), nopaline synthase (NOS), octopine synthase (OCS), and derivatives thereof. Multiple selectable markers are available that confer resistance to ampicillin, bleomycin, chloramphenicol, gentamycin, hygromycin, kanamycin, lincomycin, methotrexate, phosphinothricin, puromycin, and tetracycline. Methods to determine modulation of a reporter gene are well known in the art, and include, but are not limited to, fluorometric methods (e.g. fluorescence spectroscopy, Fluorescence Activated Cell Sorting (FACS), fluorescence microscopy), antibiotic resistance determination.

1fTSLP protein and mRNA expression can be assayed using methods known to those of skill in the art and described elsewhere herein. For example, immunoassays such as the ELISA can be used to measure protein levels.

In some embodiments, 1fTSLP expression (e.g., mRNA or protein) in a sample (e.g., cells or tissues in vivo or in vitro) treated using an antisense oligonucleotide or dsRNA agent is evaluated by comparison with 1fTSLP expression in a control sample. For example, expression of the protein or nucleic acid can be compared using methods known to those of skill in the art with that in a mock-treated or untreated sample. In some cases, comparison with a sample treated with a control antisense oligonucleotide (e.g., one having an altered or different sequence) can be made depending on the information desired. In some embodiments, a difference in the expression of the 1fTSLP protein or nucleic acid in a treated vs an untreated sample can be compared with the difference in expression of a different nucleic acid (including any standard deemed appropriate by the researcher, e.g., a housekeeping gene) in a treated sample vs. an untreated sample.

Observed differences can be expressed as desired, e.g., in the form of a ratio or fraction, for use in a comparison with control. In embodiments, the level of 1fTSLP mRNA or protein, in a sample treated with an antisense oligonucleotide or dsRNA, is increased or decreased by about 1.25-fold to about 10-fold or more relative to an untreated sample or a sample treated with a control nucleic acid. In embodiments, the level of 1fTSLP mRNA or protein is increased or decreased by at least about 1.25-fold, at least about 1.3-fold, at least about 1.4-fold, at least about 1.5-fold, at least about 1.6-fold, at least about 1.7-fold, at least about 1.8-fold, at least about 2-fold, at least about 2.5-fold, at least about 3-fold, at least about 3.5-fold, at least about 4-fold, at least about 4.5-fold, at least about 5-fold, at least about 5.5-fold, at least about 6-fold, at least about 6.5-fold, at least about 7-fold, at least about 7.5-fold, at least about 8-fold, at least about 8.5-fold, at least about 9-fold, at least about 9.5-fold, or at least about 10-fold or more. In some embodiments, the level of sfTSLP mRNA or protein is increased or decreased by at least about 1.25-fold, at least about 1.3-fold, at least about 1.4-fold, at least about 1.5-fold, at least about 1.6-fold, at least about 1.7-fold, at least about 1.8-fold, at least about 2-fold, at least about 2.5-fold, at least about 3-fold, at least about 3.5-fold, at least about 4-fold, at least about 4.5-fold, at least about 5-fold, at least about 5.5-fold, at least about 6-fold, at least about 6.5-fold, at least about 7-fold, at least about 7.5-fold, at least about 8-fold, at least about 8.5-fold, at least about 9-fold, at least about 9.5-fold, or at least about 10-fold or more.

Subjects

Some embodiments of the methods described herein include treatment of a subject. Examples of subjects include vertebrates, animals, mammals, dogs, cats, cattle, rodents, mice, rats, primates, monkeys, and humans. In some embodiments, the subject is a vertebrate. In some embodiments, the subject is an animal. In some embodiments, the subject is a mammal. In some embodiments, the subject is a dog. In some embodiments, the subject is a cat. In some embodiments, the subject is a cattle. In some embodiments, the subject is a mouse. In some embodiments, the subject is a rat. In some embodiments, the subject is a primate. In some embodiments, the subject is a monkey. In some embodiments, the subject is an animal, a mammal, a dog, a cat, cattle, a rodent, a mouse, a rat, a primate, or a monkey. In some embodiments, the subject is a human.

In some embodiments, the subject is ≥90 years of age. In some embodiments, the subject is ≥85 years of age. In some embodiments, the subject is ≥80 years of age. In some embodiments, the subject is ≥70 years of age. In some embodiments, the subject is ≥60 years of age. In some embodiments, the subject is ≥50 years of age. In some embodiments, the subject is ≥40 years of age. In some embodiments, the subject is ≥30 years of age. In some embodiments, the subject is ≥20 years of age. In some embodiments, the subject is ≥10 years of age. In some embodiments, the subject is ≥1 years of age. In some embodiments, the subject is ≥0 years of age.

In some embodiments, the subject is ≤100 years of age. In some embodiments, the subject is ≤90 years of age. In some embodiments, the subject is ≤85 years of age. In some embodiments, the subject is ≤80 years of age. In some embodiments, the subject is ≤70 years of age. In some embodiments, the subject is ≤60 years of age. In some embodiments, the subject is ≤50 years of age. In some embodiments, the subject is ≤40 years of age. In some embodiments, the subject is ≤30 years of age. In some embodiments, the subject is ≤20 years of age. In some embodiments, the subject is ≤10 years of age. In some embodiments, the subject is ≤1 years of age.

In some embodiments, the subject is between 0 and 100 years of age. In some embodiments, the subject is between 20 and 90 years of age. In some embodiments, the subject is between 30 and 80 years of age. In some embodiments, the subject is between 40 and 75 years of age. In some embodiments, the subject is between 50 and 70 years of age. In some embodiments, the subject is between 40 and 85 years of age.

Baseline

Some embodiments of the methods described herein include obtaining a baseline measurement from a subject. For example, in some embodiments, a baseline measurement is obtained from the subject prior to treating the subject.

In some embodiments, the baseline measurement is a baseline observational measurement. In some embodiments, the baseline observational measurement is obtained using a scoring system. In some embodiments, the baseline observational measurement is obtained using microscopy. In some embodiments, the baseline observational measurement is obtained directly from the subject's skin or airway. In some embodiments, the baseline observational measurement is obtained from an image of the subject's skin or airway. In some embodiments, the baseline observational measurement is a baseline number of nasal polyps. In some embodiments, the baseline observational measurement is a baseline nasal polyp size. In some embodiments, the baseline observational measurement is a baseline mucus measurement. In some embodiments, the baseline observational measurement is a baseline mucus production measurement. In some embodiments, the baseline observational measurement is a baseline airway constriction measurement. In some embodiments, the baseline observational measurement is a baseline inflammation measurement, a baseline swelling measurement, or a baseline redness measurement.

In some embodiments, the baseline measurement is obtained using microscopy, PCR, an immunoassay, a colorimetric assay, or a fluorescence assay.

In some embodiments, the baseline measurement is obtained in a sample obtained from the subject prior to administering the composition to the subject. In some embodiments, the sample is an airway sample. In some embodiments, the sample is a mucus sample. In some embodiments, the sample is an airway tissue sample. In some embodiments, the sample is an airway cell sample. In some embodiments, the sample is a blood sample, a plasma sample, or a serum sample. In some embodiments, the baseline measurement is a baseline blood eosinophil measurement. In some embodiments, the baseline measurement is a baseline MUC5AC measurement.

In some embodiments, the baseline measurement is a baseline inflammatory marker mRNA measurement. In some embodiments, the baseline measurement is a baseline lfTSLP mRNA measurement. In some embodiments, the baseline measurement is a baseline sfTSLP mRNA measurement.

In some embodiments, the baseline measurement is a baseline inflammatory marker protein measurement. In some embodiments, the inflammatory marker comprises IL-4, IL-5, IL-13, or TNFα. In some embodiments, the baseline measurement is a baseline lfTSLP protein measurement. In some embodiments, the baseline measurement is a baseline sfTSLP protein measurement.

Effect

In some embodiments, the composition reduces an observational measurement relative to the baseline observational measurement. In some embodiments, the observational measurement is obtained using a scoring system. In some embodiments, the observational measurement is obtained using microscopy. In some embodiments, the observational measurement is obtained directly from the subject's skin or airway. In some embodiments, the observational measurement is obtained from an image of the subject's skin or airway. In some embodiments, the observational measurement is a number of nasal polyps. In some embodiments, the observational measurement is a nasal polyp size. In some embodiments, the observational measurement is a mucus measurement. In some embodiments, the observational measurement is a mucus production measurement. In some embodiments, the observational measurement is an airway constriction measurement. In some embodiments, the observational measurement is an inflammation measurement, a swelling measurement, or a redness measurement.

In some embodiments, the composition reduces a blood eosinophil measurement relative to the baseline blood eosinophil measurement. In some embodiments, the blood eosinophil measurement is obtained using microscopy, PCR, an immunoassay, a colorimetric assay, or a fluorescence assay. In some embodiments, the blood eosinophil measurement is obtained in a second sample obtained from the subject after administering the composition to the subject.

In some embodiments, the composition reduces a MUC5AC measurement relative to the baseline MUC5AC measurement. In some embodiments, the MUC5AC measurement is obtained using microscopy, PCR, an immunoassay, a colorimetric assay, or a fluorescence assay. In some embodiments, the MUC5AC measurement is obtained in a second sample obtained from the subject after administering the composition to the subject.

In some embodiments, the composition reduces an inflammatory marker mRNA measurement relative to the baseline inflammatory marker mRNA measurement. In some embodiments, the inflammatory marker mRNA measurement is obtained using PCR. In some embodiments, the inflammatory marker mRNA measurement is obtained in a second sample obtained from the subject after administering the composition to the subject.

In some embodiments, the composition reduces a lfTSLP mRNA measurement relative to the baseline lfTSLP mRNA measurement. In some embodiments, the lfTSLP mRNA measurement is obtained using PCR. In some embodiments, the lfTSLP mRNA measurement is obtained in a second sample obtained from the subject after administering the composition to the subject.

In some embodiments, the composition does not affect a sfTSLP mRNA measurement relative to the baseline sfTSLP mRNA measurement. In some embodiments, the sfTSLP mRNA measurement is obtained using PCR. In some embodiments, the sfTSLP mRNA measurement is obtained in a second sample obtained from the subject after administering the composition to the subject.

In some embodiments, the composition reduces an inflammatory marker protein measurement relative to the baseline inflammatory marker protein measurement. In some embodiments, the inflammatory marker protein measurement is obtained using microscopy, an immunoassay, a colorimetric assay, or a fluorescence assay. In some embodiments, the inflammatory marker protein measurement is obtained in a second sample obtained from the subject after administering the composition to the subject. In some embodiments, the inflammatory marker comprises IL-4, IL-5, IL-13, or TNFα.

In some embodiments, the composition reduces a lfTSLP protein measurement relative to the baseline lfTSLP protein measurement. In some embodiments, the lfTSLP protein measurement is obtained using microscopy, an immunoassay, a colorimetric assay, or a fluorescence assay. In some embodiments, the lfTSLP protein measurement is obtained in a second sample obtained from the subject after administering the composition to the subject.

In some embodiments, the composition does not affect a sfTSLP protein measurement relative to the baseline sfTSLP protein measurement. In some embodiments, the sfTSLP protein measurement is obtained using microscopy, an immunoassay, a colorimetric assay, or a fluorescence assay. In some embodiments, the sfTSLP protein measurement is obtained in a second sample obtained from the subject after administering the composition to the subject.

In some embodiments, the second sample is an airway sample. In some embodiments, the second sample is a mucus sample. In some embodiments, the second sample is an airway tissue sample. In some embodiments, the second sample is an airway cell sample. In some embodiments, the second sample is a blood sample, a plasma sample, or a serum sample.

Kits, Research Reagents, Diagnostics, and Therapeutics

The compounds disclosed herein can be utilized for diagnostics, therapeutics, and prophylaxis, and as research reagents and components of kits. Furthermore, antisense oligonucleotides or dsRNA, which inhibit gene expression may be used to elucidate the function of particular genes or to distinguish between functions of various members of a biological pathway.

For use in kits and diagnostics and in various biological systems, the compounds disclosed herein, either alone or in combination with other compounds or therapeutics, may be useful as tools in differential and/or combinatorial analyses to elucidate expression patterns of a portion or the entire complement of genes expressed within cells and tissues.

In some embodiments, the term "biological system" or "system" is any organism, cell, cell culture or tissue that expresses, or is made competent to express products of the long-form thymic stromal lymphopoietin (1fTSLP) genes. These include, but are not limited to, humans, transgenic animals, cells, cell cultures, tissues, xenografts, transplants and combinations thereof.

As one non limiting example, expression patterns within cells or tissues treated with one or more antisense compounds or dsRNAs are compared to control cells or tissues not treated with antisense compounds or dsRNAs and the patterns produced are analyzed for differential levels of gene expression as they pertain, for example, to disease association, signaling pathway, cellular localization, expression level, size, structure or function of the genes examined. These analyses can be performed on stimulated or unstimulated cells and in the presence or absence of other compounds that affect expression patterns.

Examples of methods of gene expression analysis include DNA arrays or microarrays, SAGE (serial analysis of gene expression), READS (restriction enzyme amplification of digested cDNAs), TOGA (total gene expression analysis), protein arrays and proteomics, expressed sequence tag (EST) sequencing, subtractive RNA fingerprinting (SuRF), subtractive cloning, differential display (DD), comparative genomic hybridization, FISH (fluorescent in situ hybridization) techniques and mass spectrometry methods.

In some embodiments, the compounds disclosed herein are useful for research and diagnostics, because these compounds hybridize to nucleic acids encoding long-form thymic stromal lymphopoietin (1fTSLP). For example, oligonucleotides that hybridize with such efficiency and under such conditions as disclosed herein as to be effective 1fTSLP modulators are effective primers or probes under conditions favoring gene amplification or detection, respectively. These primers and probes are useful in methods requiring the specific detection of nucleic acid molecules encoding 1fTSLP and in the amplification of said nucleic acid molecules for detection or for use in further studies of 1fTSLP. Hybridization of the antisense oligonucleotides, particularly the primers and probes, with a nucleic acid encoding 1fTSLP can be detected, e.g., by conjugation of an enzyme to the oligonucleotide, radiolabeling of the oligonucleotide, or any other suitable detection means. Kits using such detection means for detecting the level of 1fTSLP in a sample may also be prepared.

The specificity and sensitivity of antisense and sRNA are also harnessed by those of skill in the art for therapeutic uses. For therapeutics, an animal, e.g., a human, suspected of having a disease or disorder which can be treated by modulating the expression of 1fTSLP polynucleotides is treated by administering oligonucleotide compounds disclosed herein. For example, in one non-limiting embodiment, the methods comprise the step of administering to the animal in need of treatment, a therapeutically effective amount of 1fTSLP modulator. The 1fTSLP modulators disclosed herein effectively modulate the activity of the 1fTSLP or modulate the expression of the 1fTSLP protein. In some embodiments, the activity or expression of 1fTSLP in an animal is inhibited by about 10% as compared to a control. The control may be an oligonucleotide that does not specifically hybridize to 1fTSLP. In some cases, the activity or expression of 1fTSLP in an animal is inhibited by about 30%. In some cases, the activity or expression of 1fTSLP in an animal is inhibited by 50% or more. Thus, the oligomeric compounds may modulate expression of long-form thymic stromal lymphopoietin (1fTSLP) mRNA by at least 10%, by at least 50%, by at least 25%, by at least 30%, by at least 40%, by at least 50%, by at least 60%, by at least 70%, by at least 75%, by at least 80%, by at least 85%, by at least 90%, by at least 95%, by at least 98%, by at least 99%, or by 100% as compared to a control. The reduction of the expression of long-form thymic stromal lymphopoietin, (1fTSLP) may be measured in serum, blood, adipose tissue, liver or any other body fluid, tissue or organ of the animal. In some cases, the cells contained within said fluids, tissues or organs being analyzed contain a nucleic acid molecule encoding 1fTSLP peptides and or the 1fTSLP protein itself.

Drug Discovery

The compounds disclosed herein can also be applied in the areas of drug discovery and target validation. The compounds and target segments identified herein may be used in drug discovery efforts to elucidate relationships that exist between long-form thymic stromal lymphopoietin (1fTSLP) polynucleotides and a disease state, phenotype, or condition. These methods include detecting or modulating 1fTSLP polynucleotides comprising contacting a sample, tissue, cell, or organism with the compounds disclosed herein, measuring the nucleic acid or protein level of 1fTSLP polynucleotides and/or a related phenotypic or chemical endpoint at some time after treatment, and optionally comparing the measured value to a non-treated sample or sample treated with a further compound disclosed herein. These methods can also be performed in parallel or in combination with other experiments to determine the function of unknown genes for the process of target validation or to determine the validity of a particular gene product as a target for treatment or prevention of a particular disease, condition, or phenotype.

This disclosure is further illustrated by the following examples, which should not be construed as further limiting. The contents of all references, pending patent applications and published patents, cited throughout this application are hereby expressly incorporated by reference.

Sequence Information

Some embodiments include one or more nucleic acid sequences in the following table:

TABLE 1

Sequences

| SEQ ID NO: | DESCRIPTION |
| --- | --- |
| 1-5184 | lfTSLP siRNA oligonucleotide sequences |
| 5185-9970 | sfTSLP siRNA oligonucleotide sequences |
| 9971-12561 | lfTSLP antisense oligonucleotide sequences |
| 12562-14922 | sfTSLP antisense oligonucleotide sequences |
| 14923 | Full-length lfTSLP human mRNA (GenBank Acc. # NM_033035.5) |
| 14924 | Full-length sfTSLP human mRNA (GenBank Acc. # NM_138551.4) |
| 14925 | Full-length lfTSLP human pre-mRNA (GenBank Acc. # NC_000005.10 nt 111, 071, 692 . . . 111, 078, 024) |
| 14926 | Antisense oligonucleotide targeting lfTSLP |
| 14927 | Antisense oligonucleotide targeting sfTSLP |
| 14928 | non-targeting control antisense oligonucleotide |
| 14929 | Sense strand oligonucleotide targeting lfTSLP |
| 14930 | Antisense strand oligonucleotide targeting lfTSLP |
| 14931 | Sense strand oligonucleotide targeting sfTSLP |
| 14932 | Antisense strand oligonucleotide targeting sfTSLP |
| 14933 | Sense strand non-targeting (control) oligonucleotide |
| 14934 | Antisense strand non-targeting (control) oligonucleotide |
| 14935-17526 | lfTSLP siRNA sense strand sequences |
| 17527-20118 | lfTSLP siRNA sense strand sequences for modifications |
| 20119-22710 | lfTSLP siRNA sense strand sequences for alternative modifications |
| 22711-22906 | sfTSLP siRNA sense strand sequences |
| 22907-23102 | sfTSLP siRNA sense strand sequences for modifications |
| 23103-23298 | sfTSLP siRNA sense strand sequences for alternative modifications |
| 23299-25889 | lfTSLP Antisense oligonucleotide sequences for modifications |
| 25890-25977 | Modified lfTSLP siRNA sense strand sequences |
| 25978-26011 | Modified sfTSLP siRNA sense strand sequences |
| 26012-26099 | Modified lfTSLP siRNA antisense strand sequences |
| 26100-26133 | Modified sfTSLP siRNA antisense strand sequences |
| 26134-28725 | lfTSLP siRNAs antisense strand sequences |
| 28726-28921 | sfTSLP siRNAs antisense strand sequences |
| 28922-31513 | lfTSLP siRNA antisense strand sequences for modifications |
| 31514-34105 | lfTSLP siRNA antisense strand sequences for alternative modifications |
| 34106-34301 | sfTSLP siRNA antisense strand sequences for modifications |
| 34302-34497 | sfTSLP siRNA antisense strand sequences for alternative modifications |
| 34498 | Example RFGF derived from human fibroblast growth factor 4 |
| 34499 | Example RFGF analogue |
| 34500 | Sequence from the HIV Tat protein |
| 34501 | Sequence from the Drosophila Antennapedia protein |
| 34502 | Modification pattern 1S |
| 34503 | Modification pattern 1AS |
| 34504 | Modification pattern 2S |
| 34505 | Modification pattern 3AS |
| 34506 | ASO modification pattern |
| 34507 | Modification pattern 3S |
| 34508 | Modification pattern 4S |
| 34509 | Modification pattern 5S |
| 34510 | Modification pattern 2AS |
| 34511 | Modification pattern 4AS |

Embodiments

Some embodiments include one or more of the following:

1. A composition comprising an oligonucleotide that targets a long isoform of Thymic stromal lymphopoietin (lfTSLP) and when administered to a subject in an effective amount decreases an eosinophil count.

2. The composition of embodiment 1, wherein the eosinophil count is decreased by about 10% or more, as compared to prior to administration.

3. A composition comprising an oligonucleotide that targets lfTSLP and when administered to a subject in an effective amount decreases an inflammatory marker.

4 The composition of embodiment 3, wherein the inflammatory marker is decreased by about 10% or more, as compared to prior to administration.

5. A composition comprising an oligonucleotide that targets lfTSLP and when administered to a subject in an effective amount decreases mucus production.

6. The composition of embodiment 5, wherein the mucus production is decreased by about 10% or more, as compared to prior to administration.

7 The composition of any one of embodiments 1-6, wherein the lfTSLP is encoded by a nucleic acid comprising SEQ ID NO: 14923, or a variant thereof at least 70% identical, at least 75% identical, at least 80% identical, at least 85% identical, at least 90% identical, at least 91% identical, at least 92% identical, at least 93% identical, at least 94% identical, at least 95% identical, at least 96% identical, at least 97% identical, at least 98% identical, at least 99% identical, to SEQ ID NO: 14923.

8. The composition of any one of embodiments 1-7, wherein the 1fTSLP is encoded by a nucleic acid comprising SEQ ID NO: 14923.

9. The composition of any one of embodiments 1-8, wherein the oligonucleotide is specific for 1fTSLP, and/or does not target a short isoform of TSLP (sfTSLP).

10. The composition of any one of embodiments 1-9, wherein the oligonucleotide comprises a modified internucleoside linkage.

11. The composition of embodiment 10, wherein the modified internucleoside linkage comprises alkylphosphonate, phosphorothioate, methylphosphonate, phosphorodithioate, alkylphosphonothioate, phosphoramidate, carbamate, carbonate, phosphate triester, acetamidate, or carboxymethyl ester, or a combination thereof.

12. The composition of embodiment 10, wherein the modified internucleoside linkage comprises one or more phosphorothioate linkages.

13. The composition of any one of embodiments 1-12, wherein the oligonucleotide comprises 1, 2, 3, 4, 5, 6, 7, 8, 9, 10, 11, 12, 13, 14, 15, 16, 17, 18, 19, or 20 modified internucleoside linkages.

14. The composition of any one of embodiments 1-13, wherein the oligonucleotide comprises 2 or more modified internucleoside linkages, 3 or more modified internucleoside linkages, 4 or more modified internucleoside linkages, 5 or more modified internucleoside linkages, 6 or more modified internucleoside linkages, 7 or more modified internucleoside linkages, 8 or more modified internucleoside linkages, 9 or more modified internucleoside linkages, 10 or more modified internucleoside linkages, 11 or more modified internucleoside linkages, 12 or more modified internucleoside linkages, 13 or more modified internucleoside linkages, 14 or more modified internucleoside linkages, 15 or more modified internucleoside linkages, 16 or more modified internucleoside linkages, 17 or more modified internucleoside linkages, 18 or more modified internucleoside linkages, 19 or more modified internucleoside linkages, or 20 or more modified internucleoside linkages.

15. The composition of any one of embodiments 1-14, wherein the oligonucleotide comprises a modified nucleoside.

16. The composition of embodiment 15, wherein the modified nucleoside comprises a locked nucleic acid (LNA), hexitol nucleic acid (HLA), cyclohexene nucleic acid (CeNA), 2'-methoxyethyl, 2'-O-alkyl, 2'-O-allyl, 2'-O-allyl, 2'-fluoro, or 2'-deoxy, or a combination thereof.

17. The composition of embodiment 15, wherein the modified nucleoside comprises a LNA.

18. The composition of embodiment 15, wherein the modified nucleoside comprises a 2',4' constrained ethyl nucleic acid.

19. The composition of embodiment 15, wherein the modified nucleoside comprises a 2'-O-methyl nucleoside, 2'-deoxyfluoro nucleoside, 2'-O—N-methylacetamido (2'-O-NMA) nucleoside, a 2'-O-dimethylaminoethoxyethyl (2'-O-DMAEOE) nucleoside, 2'-O-aminopropyl (2'-O-AP) nucleoside, or 2'-ara-F, or a combination thereof.

20. The composition of embodiment 15, wherein the modified nucleoside comprises one or more 2'fluoro modified nucleosides.

21. The composition of embodiment 15, wherein the modified nucleoside comprises a 2' O-alkyl modified nucleoside.

22. The composition of embodiment 15, wherein the oligonucleotide comprises a lipid attached at a 3' or 5' terminus of the oligonucleotide.

23. The composition of embodiment 22, wherein the lipid comprises cholesterol, myristoyl, palmitoyl, stearoyl, lithocholoyl, docosanoyl, docosahexaenoyl, myristyl, palmityl stearyl, or α-tocopherol, or a combination thereof.

24. The composition of any one of embodiments 1-23, wherein the oligonucleotide comprises 1, 2, 3, 4, 5, 6, 7, 8, 9, 10, 11, 12, 13, 14, 15, 16, 17, 18, 19, 20, or 21 modified nucleosides.

25. The composition of any one of embodiments 1-24, wherein the oligonucleotide comprises 2 or more modified nucleosides, 3 or more modified nucleosides, 4 or more modified nucleosides, 5 or more modified nucleosides, 6 or more modified nucleosides, 7 or more modified nucleosides, 8 or more modified nucleosides, 9 or more modified nucleosides, 10 or more modified nucleosides, 11 or more modified nucleosides, 12 or more modified nucleosides, 13 or more modified nucleosides, 14 or more modified nucleosides, 15 or more modified nucleosides, 16 or more modified nucleosides, 17 or more modified nucleosides, 18 or more modified nucleosides, 19 or more modified nucleosides, 20 or more modified nucleosides, or 21 or more modified nucleosides.

26. The composition of any one of embodiments 1-25, wherein the oligonucleotide comprises a small interfering RNA (siRNA) comprising a sense strand and an antisense strand.

27. The composition of embodiment 26, wherein the sense strand is 12-30 nucleosides in length.

28. The composition of embodiment 26 or 27, wherein the antisense strand is 12-30 nucleosides in length.

29. A composition comprising an oligonucleotide that targets 1fTSLP, wherein the oligonucleotide comprises a siRNA comprising a sense strand and an antisense strand, each strand is independently about 12-30 nucleosides in length, and at least one of the sense strand and the antisense strand comprises a nucleoside sequence comprising about 12-30 contiguous nucleosides of one of SEQ ID NO: 14923.

30. A composition comprising an oligonucleotide that targets 1fTSLP, wherein the oligonucleotide comprises an siRNA comprising a sense strand and an antisense strand, each strand is independently about 12-30 nucleosides in length, and at least one of the sense strand and the antisense strand comprises a nucleoside sequence comprising about 12-30 contiguous nucleosides of one of SEQ ID NO: 14925.

31. The composition of any one of embodiments 26-30, wherein the sense strand and the anti sense strand form a double-stranded RNA duplex.

32. The composition of embodiment 31, wherein the first base pair of the double-stranded RNA duplex is an AU base pair.

33. The composition of any one of embodiments 26-32, wherein the sense strand comprises a 3' overhang comprising 1, 2, or more nucleosides.

34. The composition of embodiment 33, wherein the 3' overhang of the sense strand comprises 2 nucleosides.

35. The composition of any one of embodiments 26-34, wherein the antisense strand comprises a 3' overhang comprising 1, 2, or more nucleosides.

36. The composition of embodiment 34, wherein the 3' overhang of the antisense strand comprises 2 nucleosides.

37. The composition of any one of embodiments 26-36, wherein the sense strand comprises a nucleoside sequence comprising or consisting of the sequence of any one of SEQ ID NOs: 14935-17526, or a nucleic acid sequence thereof having 1 or 2 nucleoside substitutions, additions, or deletions.

38. The composition of any one of embodiments 26-37, wherein the sense strand comprises a nucleoside sequence comprising or consisting of the sequence of any one of SEQ ID NOs: 14935-17526.

39. The composition of any one of embodiments 26-38, wherein the antisense strand comprises a nucleoside sequence comprising or consisting of the sequence of any one of SEQ ID NOs: 26134-28725, or a nucleic acid sequence thereof having 1 or 2 nucleoside substitutions, additions, or deletions.

40. The composition of any one of embodiments 26-39, wherein the antisense strand comprises a nucleoside sequence comprising or consisting of the sequence of any one of SEQ ID NOs: 26134-28725.

41. The composition of any one of embodiments 26-40, wherein the siRNA binds with a 17 mer in a non-human primate 1fTSLP mRNA.

42. The composition of any one of embodiments 26-41, wherein the siRNA binds with a 19 mer in a human 1fTSLP mRNA.

43. The composition of any one of embodiments 26-42, wherein the siRNA binds with a human 1fTSLP mRNA and less than or equal to 20 human off-targets, with no more than 2 mismatches in the antisense strand.

44. The composition of any one of embodiments 26-43, wherein the siRNA binds with a human 1fTSLP mRNA target site that does not harbor an SNP, with a minor allele frequency (MAF) greater or equal to 1% (pos. 2-18).

45. The composition of any one of embodiments 26-44, wherein the sense strand comprises the nucleoside sequence of any one of SEQ ID NOs: 14941, 14942, 14947, 14948, 14950, 14957, 14959, 14960, 14961, 14962, 14973, 15004, 15005, 15013, 15035, 15039, 15040, 15041, 15043, 15047, 15048, 15049, 15050, 15051, 15052, 15056, 15057, 15059, 15062, 15082, 15094, 15096, 15097, 15098, 15101, 15102, 15107, 15108, 15111, 15114, 15117, 15123, 15127, 15128, 15164, 15174, 15178, 15184, 15186, 15187, 15188, 15190, 15191, 15194, 15195, 15197, 15230, 15235, 15236, 15238, 15240, 15241, 15246, 15252, 15253, 15260, 15263, 15264, 15272, 15274, 15276, 15278, 15279, 15282, 15283, 15286, 15294, 15302, 15303, 15307, 15310, 15314, 15319, 15320, 15321, 15322, 15324, or 15326, or a nucleic acid sequence thereof having 1 or 2 nucleoside substitutions, additions, or deletions; and/or wherein the antisense strand comprises the nucleoside sequence of any one of SEQ ID NOs: 26140, 26141, 26146, 26147, 26149, 26156, 26158, 26159, 26160, 26161, 26172, 26203, 26204, 26212, 26234, 26238, 26239, 26240, 26242, 26246, 26247, 26248, 26249, 26250, 26251, 26255, 26256, 26258, 26261, 26281, 26293, 26295, 26296, 26297, 26300, 26301, 26306, 26307, 26310, 26313, 26316, 26322, 26326, 26327, 26363, 26373, 26377, 26383, 26385, 26386, 26387, 26389, 26390, 26393, 26394, 26396, 26429, 26434, 26435, 26437, 26439, 26440, 26445, 26451, 26452, 26459, 26462, 26463, 26471, 26473, 26475, 26477, 26478, 26481, 26482, 26485, 26493, 26501, 26502, 26506, 26509, 26513, 26518, 26519, 26520, 26521, 26523, or 26525, or a nucleic acid sequence thereof having 1 or 2 nucleoside substitutions, additions, or deletions.

46. The composition of any one of embodiments 26-45, wherein the sense strand comprises the nucleoside sequence of any one of SEQ ID NOs: 14941, 14942, 14947, 14948, 14950, 14957, 14959, 14960, 14961, 14962, 14973, 15004, 15005, 15013, 15035, 15039, 15040, 15041, 15043, 15047, 15048, 15049, 15050, 15051, 15052, 15056, 15057, 15059, 15062, 15082, 15094, 15096, 15097, 15098, 15101, 15102, 15107, 15108, 15111, 15114, 15117, 15123, 15127, 15128, 15164, 15174, 15178, 15184, 15186, 15187, 15188, 15190, 15191, 15194, 15195, 15197, 15230, 15235, 15236, 15238, 15240, 15241, 15246, 15252, 15253, 15260, 15263, 15264, 15272, 15274, 15276, 15278, 15279, 15282, 15283, 15286, 15294, 15302, 15303, 15307, 15310, 15314, 15319, 15320, 15321, 15322, 15324, or 15326; and/or wherein the antisense strand comprises the nucleoside sequence of any one of SEQ ID NOs: 26140, 26141, 26146, 26147, 26149, 26156, 26158, 26159, 26160, 26161, 26172, 26203, 26204, 26212, 26234, 26238, 26239, 26240, 26242, 26246, 26247, 26248, 26249, 26250, 26251, 26255, 26256, 26258, 26261, 26281, 26293, 26295, 26296, 26297, 26300, 26301, 26306, 26307, 26310, 26313, 26316, 26322, 26326, 26327, 26363, 26373, 26377, 26383, 26385, 26386, 26387, 26389, 26390, 26393, 26394, 26396, 26429, 26434, 26435, 26437, 26439, 26440, 26445, 26451, 26452, 26459, 26462, 26463, 26471, 26473, 26475, 26477, 26478, 26481, 26482, 26485, 26493, 26501, 26502, 26506, 26509, 26513, 26518, 26519, 26520, 26521, 26523, or 26525.

47. The composition of any one of embodiments 26-46, wherein the sense strand comprises the nucleoside sequence of any one of SEQ ID NOs: 14942, 14947, 14948, 14950, 14957, 14959, 15004, 15035, 15039, 15040, 15041, 15043, 15047, 15048, 15049, 15050, 15051, 15057, 15059, 15082, 15094, 15096, 15097, 15098, 15102, 15107, 15108, 15111, 15114, 15123, 15127, 15128, 15164, 15184, 15186, 15187, 15188, 15190, 15191, 15194, 15195, 15230, 15235, 15236, 15238, 15241, 15246, 15252, 15260, 15263, 15272, 15276, 15278, 15279, 15283, 15294, 15302, 15307, 15314, 15322, 15324, or 15326; and/or wherein the antisense strand comprises the nucleoside sequence of any one of SEQ ID NOs: 26141, 26146, 26147, 26149, 26156, 26158, 26203, 26234, 26238, 26239, 26240, 26242, 26246, 26247, 26248, 26249, 26250, 26256, 26258, 26281, 26293, 26295, 26296, 26297, 26301, 26306, 26307, 26310, 26313, 26322, 26326, 26327, 26363, 26383, 26385, 26386, 26387, 26389, 26390, 26393, 26394, 26429, 26434, 26435, 26437, 26440, 26445, 26451, 26459, 26462, 26471, 26475, 26477, 26478, 26482, 26493, 26501, 26506, 26513, 26521, 26523, or 26525.

48. The composition of any one of embodiments 26-47, wherein the sense strand comprises the nucleoside sequence of any one of SEQ ID NOs: 15041, 15048, 15051, 15082, 15096, 15111, 15114, 15123, 15128, 15187, 15194, 15230, 15235, 15238, 15241, 15252, 15272, 15278, 15307, or 15326; and/or wherein the antisense strand comprises the nucleoside sequence of any one of SEQ ID NOs: 26240, 26247, 26250, 26281, 26295, 26310, 26313, 26322, 26327, 26386, 26393, 26429, 26434, 26437, 26440, 26451, 26471, 26477, 26506, or 26525.

49. The composition of any one of embodiments 26-48, wherein the sense strand comprises the nucleoside sequence of any one of SEQ ID NOs: 15048, 15051, 15082, 15096, 15111, 15114, 15123, 15128, 15194, 15230, 15235, 15238, 15241, 15252, 15272, 15278, 15307, or 15326; and/or wherein the antisense strand comprises the nucleoside sequence of any one of SEQ ID NOs: 26247, 26250, 26281, 26295, 26310, 26313, 26322, 26327, 26393, 26429, 26434, 26437, 26440, 26451, 26471, 26477, 26506, or 26525.

50. The composition of any one of embodiments 26-49, wherein the sense strand comprises the nucleoside sequence of any one of SEQ ID NOs: 17527-20118, or a nucleic acid sequence thereof having 1 or 2 nucleoside substitutions, additions, or deletions.

51. The composition of any one of embodiments 26-50, wherein the sense strand comprises the nucleoside sequence of any one of SEQ ID NOs: 17527-20118.

52. The composition of any one of embodiments 26-51 wherein the sense strand comprises the nucleoside sequence of any one of SEQ ID NOs: 20119-22710, or a nucleic acid sequence thereof having 1 or 2 nucleoside substitutions, additions, or deletions.

53. The composition of any one of embodiments 26-52, wherein the sense strand comprises the nucleoside sequence of any one of SEQ ID NOs: 20119-22710.

54. The composition of any one of embodiments 26-53, wherein the antisense strand comprises the nucleoside sequence of any one of SEQ ID NOs: 28922-31513, or a nucleic acid sequence thereof having 1 or 2 nucleoside substitutions, additions, or deletions.

55. The composition of any one of embodiments 26-54, wherein the antisense strand comprises the nucleoside sequence of any one of SEQ ID NOs: 28922-31513.

56. The composition of any one of embodiments 26-55, wherein the antisense strand comprises the nucleoside sequence of any one of SEQ ID NOs: 31514-34105, or a nucleic acid sequence thereof having 1 or 2 nucleoside substitutions, additions, or deletions.

57. The composition of any one of embodiments 26-56, wherein the antisense strand comprises the nucleoside sequence of any one of SEQ ID NOs: 31514-34105.

58. The composition of any one of embodiments 26-57, wherein the sense strand comprises modification pattern 1S: 5'-NfsnsNfnNfnNfNfNfnNfnNfnNfnNfnNfsnsn-3' (SEQ ID NO: 34502), wherein "Nf" is a 2' fluoro-modified nucleoside, "n" is a 2' O-methyl modified nucleoside, and "s" is a phosphorothioate linkage.

59. The composition of any one of embodiments 26-57, wherein the sense strand comprises modification pattern 2S: 5'-nsnsnnNfnNfNfNfnnnnnnnnnnnsnsn-3' (SEQ ID NO: 34504), wherein "Nf" is a 2' fluoro-modified nucleoside, "n" is a 2' O-methyl modified nucleoside, and "s" is a phosphorothioate linkage.

60. The composition of any one of embodiments 26-57, wherein the sense strand comprises modification pattern 3S: 5'-nsnsnnNfnNfnNfnnnnnnnnnnnsnsn-3' (SEQ ID NO: 34507), wherein "Nf" is a 2' fluoro-modified nucleoside, "n" is a 2' O-methyl modified nucleoside, and "s" is a phosphorothioate linkage.

61. The composition of any one of embodiments 26-57, wherein the sense strand comprises modification pattern 4S: 5'-NfsnsNfriNfnNfnNfNfNfnNfnNfnNthNfnNfsnsnN-Lipid-3' (SEQ ID NO: 34508), wherein "Nf" is a 2' fluoro-modified nucleoside, "n" is a 2' O-methyl modified nucleoside, "s" is a phosphorothioate linkage, and N comprises one or more nucleosides.

62. The composition of any one of embodiments 26-57, wherein the sense strand comprises modification pattern 5S: 5'-nsnsnnNfnNfNfNfnnnnnnnnnnnsnsnN-Lipid-3' (SEQ ID NO: 34509), wherein "Nf" is a 2' fluoro-modified nucleoside, "n" is a 2' O-methyl modified nucleoside, "s" is a phosphorothioate linkage, and N comprises one or more nucleosides.

63. The composition of any one of embodiments 26-62, wherein the antisense strand comprises modification pattern 1AS: 5'-nsNfsnNfnNfnNfnNfnNfnnnNfnNfnNfsnsn-3' (SEQ ID NO: 34503), wherein "Nf" is a 2' fluoro-modified nucleoside, "n" is a 2' O-methyl modified nucleoside, and "s" is a phosphorothioate linkage.

64. The composition of any one of embodiments 26-62, wherein the antisense strand comprises modification pattern 2AS: 5'-nsNfsnnnNfnNfNfnnnnNfnNfnnnsnsn-3' (SEQ ID NO: 34510), wherein "Nf" is a 2' fluoro-modified nucleoside, "n" is a 2' O-methyl modified nucleoside, and "s" is a phosphorothioate linkage.

65. The composition of any one of embodiments 26-62, wherein the antisense strand comprises modification pattern 3AS: 5'-nsNfsnnnNfnnnnnnnNfnNfnnnsnsn-3' (SEQ ID NO: 34505), wherein "Nf" is a 2' fluoro-modified nucleoside, "n" is a 2' O-methyl modified nucleoside, and "s" is a phosphorothioate linkage.

66. The composition of any one of embodiments 26-62, wherein the antisense strand comprises modification pattern 4AS: 5'-nsNfsnNfnNfnnnnnnnNfnNfnnnsnsn-3' (SEQ ID NO: 34511), wherein "Nf" is a 2' fluoro-modified nucleoside, "n" is a 2' O-methyl modified nucleoside, and "s" is a phosphorothioate linkage.

67. The composition of any one of embodiments 26-57, wherein the sense strand comprises pattern 1s and the antisense strand comprises pattern 1AS, 2AS, 3AS, or 4AS.

68. The composition of any one of embodiments 26-57, wherein the sense strand comprises pattern 2S and the antisense strand comprises pattern 1AS, 2AS, 3AS, or 4AS.

69. The composition of any one of embodiments 26-57, wherein the sense strand comprises pattern 3S and the antisense strand comprises pattern 1AS, 2AS, 3AS, or 4AS.

70. The composition of any one of embodiments 26-57, wherein the sense strand comprises pattern 4S and the antisense strand comprises pattern 1AS, 2AS, 3AS, or 4AS.

71. The composition of any one of embodiments 26-57, wherein the sense strand comprises the nucleoside sequence of any one of SEQ ID NOs: 17533, 17534, 17539, 17540, 17542, 17549, 17551, 17552, 17553, 17554, 17565, 17596, 17597, 17605, 17627, 17631, 17632, 17633, 17635, 17639, 17640, 17641, 17642, 17643, 17644, 17648, 17649, 17651, 17654, 17674, 17686, 17688, 17689, 17690, 17693, 17694, 17699, 17700, 17703, 17706, 17709, 17715, 17719, 17720, 17756, 17766, 17770, 17776, 17778, 17779, 17780, 17782, 17783, 17786, 17787, 17789, 17822, 17827, 17828, 17830, 17832, 17833, 17838, 17844, 17845, 17852, 17855, 17856, 17864, 17866, 17868, 17870, 17871, 17874, 17875, 17878, 17886, 17894, 17895, 17899, 17902, 17906, 17911, 17912, 17913, 17914, 17916, or 17918; and/or wherein the antisense strand comprises the nucleoside sequence of any one of SEQ ID NOs: 28928, 28929, 28934, 28935, 28937, 28944, 28946, 28947, 28948, 28949, 28960, 28991, 28992, 29000, 29022, 29026, 29027, 29028, 29030, 29034, 29035, 29036, 29037, 29038, 29039, 29043, 29044, 29046, 29049, 29069, 29081, 29083, 29084, 29085, 29088, 29089, 29094, 29095, 29098, 29101, 29104, 29110, 29114, 29115, 29151, 29161, 29165, 29171, 29173, 29174, 29175, 29177, 29178, 29181, 29182, 29184, 29217, 29222, 29223, 29225, 29227, 29228, 29233, 29239, 29240, 29247, 29250, 29251, 29259, 29261, 29263, 29265, 29266, 29269, 29270, 29273, 29281, 29289, 29290, 29294, 29297, 29301, 29306, 29307, 29308, 29309, 29311, or 29313.

72. The composition of any one of embodiments 26-57, wherein the sense strand comprises the nucleoside sequence of any one of SEQ ID NOs: 17534, 17539, 17540, 17542, 17549, 17551, 17596, 17627, 17631, 17632, 17633, 17635, 17639, 17640, 17641, 17642, 17643, 17649, 17651, 17674, 17686, 17688, 17689, 17690, 17694, 17699, 17700, 17703, 17706, 17715, 17719, 17720, 17756, 17776, 17778, 17779, 17780, 17782, 17783, 17786, 17787, 17822, 17827, 17828, 17830, 17833, 17838, 17844, 17852, 17855, 17864, 17868, 17870, 17871, 17875, 17886, 17894, 17899, 17906, 17914, 17916, or 17918; and/or wherein the antisense strand comprises the nucleoside sequence of any one of SEQ ID NOs: 28929, 28934, 28935, 28937, 28944, 28946, 28991, 29022, 29026, 29027, 29028, 29030, 29034, 29035, 29036, 29037, 29038, 29044, 29046, 29069, 29081, 29083, 29084, 29085, 29089, 29094, 29095, 29098, 29101, 29110, 29114, 29115, 29151, 29171, 29173, 29174, 29175, 29177, 29178, 29181, 29182, 29217, 29222, 29223, 29225, 29228, 29233, 29239, 29247, 29250, 29259, 29263, 29265, 29266, 29270, 29281, 29289, 29294, 29301, 29309, 29311, or 29313.

73. The composition of any one of embodiments 26-57, wherein the sense strand comprises the nucleoside sequence of any one of SEQ ID NOs: 17633, 17640, 17643, 17674, 17688, 17703, 17706, 17715, 17720, 17779, 17786, 17822, 17827, 17830, 17833, 17844, 17864, 17870, 17899, or 17918; and/or wherein the antisense strand comprises the nucleoside sequence of any one of SEQ ID NOs: 29028, 29035, 29038, 29069, 29083, 29098, 29101, 29110, 29115, 29174, 29181, 29217, 29222, 29225, 29228, 29239, 29259, 29265, 29294, or 29313.

74. The composition of any one of embodiments 26-57, wherein the sense strand comprises the nucleoside sequence of any one of SEQ ID NOs: 17640, 17643, 17674, 17688, 17703, 17706, 17715, 17720, 17786, 17822, 17827, 17830, 17833, 17844, 17864, 17870, 17899, or 17918; and/or wherein the antisense strand comprises the nucleoside sequence of any one of SEQ ID NOs: 29035, 29038, 29069, 29083, 29098, 29101, 29110, 29115, 29181, 29217, 29222, 29225, 29228, 29239, 29259, 29265, 29294, or 29313.

75. The composition of any one of embodiments 1-25, wherein the oligonucleotide comprises an antisense oligonucleotide (ASO).

76. The composition of embodiment 75, wherein the ASO is single-stranded and 12-30 nucleosides in length.

77. A composition comprising an oligonucleotide that targets 1fTSLP, wherein the oligonucleotide comprises an ASO comprising an antisense strand about 12-30 nucleosides in length and comprising a nucleoside sequence comprising about 12-30 contiguous nucleosides of one of SEQ ID NO: 14923.

78. A composition comprising an oligonucleotide that targets TSLP, wherein the oligonucleotide comprises an ASO comprising an antisense strand about 12-30 nucleosides in length and comprising a nucleoside sequence comprising about 12-30 contiguous nucleosides of one of SEQ ID NO: 14925.

79. The composition of any one of embodiments 75-78, wherein the ASO is 15-25 nucleosides in length.

80. The composition of any one of embodiments 75-79, wherein the ASO is 20 nucleosides in length.

81. The composition of any one of embodiments 75-80, wherein the ASO comprises a nucleoside sequence comprising or consisting of the sequence of any one of SEQ ID NOs: 9971-12561, or a nucleic acid sequence thereof having 1 or 2 nucleoside substitutions, additions, or deletions.

82. The composition of any one of embodiments 75-81, wherein the ASO comprises a nucleoside sequence comprising or consisting of the sequence of any one of SEQ ID NOs: 9971-12561.

83. The composition of any one of embodiments 75-82, wherein the ASO comprises a nucleoside sequence comprising or consisting of the sequence of any one of SEQ ID NOs: 23299-25889, or a nucleic acid sequence thereof having 1 or 2 nucleoside substitutions, additions, or deletions.

84. The composition of any one of embodiments 75-83, wherein the ASO comprises a nucleoside sequence comprising or consisting of the sequence of any one of SEQ ID NOs: 23299-25889.

85. The composition of any one of embodiments 75-84, wherein the ASO comprises modification pattern: 5'-nsnsnsnsnsdNsdNsdNsdNsdNsdNsdNsdNsnsnsnsnsn-3' (SEQ ID NO: 34506) where "dN" is any deoxynucleotide, "n" is a 2'O-methyl or 2'O-methoxyethyl-modified nucleoside, and "s" is a phosphorothioate linkage.

86. The composition of any one of embodiments 1-85, wherein the composition is a pharmaceutical composition.

87. The composition of any one of embodiments 1-86, wherein the composition is sterile.

88. The composition of any one of embodiments 1-87, further comprising a pharmaceutically acceptable carrier.

89. The composition of embodiment 88, wherein the pharmaceutically acceptable carrier comprises water, a buffer, or a saline solution.

90. The composition of any one of embodiments 1-89, formulated for administration by inhalation.

91. A method of treating an airway inflammation disorder in a subject in need thereof, the method comprising administering to the subject a composition comprising an oligonucleotide that targets 1fTSLP.

92. The method of embodiment 91, wherein the airway inflammation disorder comprises asthma.

93. The method of embodiment 91, wherein the airway inflammation disorder comprises nasal polyps.

94. The method of embodiment 91, wherein the airway inflammation disorder comprises allergic rhinitis.

95. The method of embodiment 91, wherein the airway inflammation disorder comprises chronic rhinosinusitis.

96. The method of any one of embodiments 91-95, wherein the airway inflammation disorder comprises an increased blood eosinophil count.

97. The method of any one of embodiments 91-96, wherein the administration is by inhalation.

98. The method of any one of embodiments 91-97, wherein the subject is an animal, a mammal, a dog, a cat, cattle, a rodent, a mouse, a rat, a primate, or a monkey.

99. The method of any one of embodiments 91-98, wherein the subject is a human.

100. The method of any one of embodiments 91-99, wherein the subject is ≥40 years of age.

101. The method of any one of embodiments 91-100, wherein the subject is ≤85 years of age.

102. The method of any one of embodiments 91-101, wherein the subject is ≥40 and ≤85 years of age.

103. The method of any one of embodiments 91-102, wherein a baseline measurement is obtained from the subject prior to administering the composition to the subject.

104. The method of embodiment 103, wherein the baseline measurement is a baseline observational measurement.

105. The method of embodiment 104, wherein the baseline observational measurement is obtained using a scoring system.

106. The method of embodiment 104 or 105, wherein the baseline observational measurement is obtained using microscopy.

107. The method of any one of embodiments 104-106, wherein the baseline observational measurement is obtained directly from the subject's skin or airway.

108. The method of any one of embodiments 104-106, wherein the baseline observational measurement is obtained from an image of the subject's skin or airway.

109. The method of any one of embodiments 104-108, wherein the baseline observational measurement is a baseline number of nasal polyps.

110. The method of any one of embodiments 104-108, wherein the baseline observational measurement is a baseline nasal polyp size.

111. The method of any one of embodiments 104-108, wherein the baseline observational measurement is a baseline mucus measurement.

112. The method of any one of embodiments 104-108, wherein the baseline observational measurement is a baseline mucus production measurement.

113. The method of any one of embodiments 104-108, wherein the baseline observational measurement is a baseline airway constriction measurement.

114. The method of any one of embodiments 104-108, wherein the baseline observational measurement is a baseline inflammation measurement, a baseline swelling measurement, or a baseline redness measurement.

115. The method of embodiment 103, wherein the baseline measurement is obtained in a sample obtained from the subject prior to administering the composition to the subject.

116. The method of embodiment 115, wherein the sample is an airway sample.

117. The method of embodiment 115 or 116, wherein the sample is a mucus sample.

118. The method of embodiment 115, wherein the sample is an airway tissue sample 119. The method of embodiment 115, wherein the sample is an airway cell sample 120. The method of embodiment 115, wherein the sample is a blood sample, a plasma sample, or a serum sample.

121. The method of any one of embodiments 115-120, wherein the baseline measurement is obtained using microscopy, PCR, an immunoassay, a colorimetric assay, or a fluorescence assay.

122. The method of any one of embodiments 115-121, wherein the baseline measurement is a baseline blood eosinophil measurement.

123. The method of any one of embodiments 115-121, wherein the baseline measurement is a baseline MUC5AC measurement.

124. The method of any one of embodiments 115-121, wherein the baseline measurement is a baseline inflammatory marker mRNA measurement.

125. The method of any one of embodiments 115-121, wherein the baseline measurement is a baseline inflammatory marker protein measurement.

126. The method of embodiment 124 or 125, wherein the inflammatory marker comprises IL-4, IL-5, IL-13, or TNFα.

127. The method of any one of embodiments 115-121, wherein the baseline measurement is a baseline 1fTSLP mRNA measurement.

128. The method of any one of embodiments 115-121, wherein the baseline measurement is a baseline 1fTSLP protein measurement.

129. The method of any one of embodiments 115-121, wherein the baseline measurement is a baseline sfTSLP mRNA measurement.

130. The method of any one of embodiments 115-121, wherein the baseline measurement is a baseline sfTSLP protein measurement.

131. The method of any of embodiments 104-114, wherein the composition reduces an observational measurement relative to the baseline observational measurement.

132. The method of embodiment 131, wherein the observational measurement is obtained using a scoring system.

133. The method of embodiment 131 or 132, wherein the observational measurement is obtained using microscopy.

134. The method of any one of embodiments 131-133, wherein the observational measurement is obtained directly from the subject's skin or airway.

135. The method of any one of embodiments 131-133, wherein the observational measurement is obtained from an image of the subject's skin or airway.

136. The method of any one of embodiments 131-133, wherein the observational measurement is a number of nasal polyps.

137. The method of any one of embodiments 131-133, wherein the observational measurement is a nasal polyp size.

138. The method of any one of embodiments 131-133, wherein the observational measurement is a mucus measurement.

139. The method of any one of embodiments 131-133, wherein the observational measurement is a mucus production measurement.

140. The method of any one of embodiments 131-133, wherein the observational measurement is an airway constriction measurement.

141. The method of any one of embodiments 131-133, wherein the observational measurement is an inflammation measurement, a swelling measurement, or a redness measurement.

142. The method of embodiment 122, wherein the composition reduces a blood eosinophil measurement relative to the baseline blood eosinophil measurement.

143. The method of embodiment 142, wherein the blood eosinophil measurement is obtained using microscopy, PCR, an immunoassay, a colorimetric assay, or a fluorescence assay.

144. The method of embodiment 123, wherein the composition reduces a MUC5AC measurement relative to the baseline MUC5AC measurement.

145. The method of embodiment 144, wherein the MUC5AC measurement is obtained using microscopy, PCR, an immunoassay, a colorimetric assay, or a fluorescence assay.

146. The method of embodiment 124, wherein the composition reduces an inflammatory marker mRNA measurement relative to the baseline inflammatory marker mRNA measurement.

147. The method of embodiment 146, wherein the inflammatory marker mRNA measurement is obtained using PCR.

148. The method of embodiment 125, wherein the composition reduces an inflammatory marker protein measurement relative to the baseline inflammatory marker protein measurement.

149. The method of embodiment 148, wherein the inflammatory marker protein measurement is obtained using microscopy, an immunoassay, a colorimetric assay, or a fluorescence assay.

150. The method of any one of embodiments 146-149, wherein the inflammatory marker comprises IL-4, IL-5, IL-13, or TNFα.

151. The method of embodiment 127, wherein the composition reduces a 1fTSLP mRNA measurement relative to the baseline 1fTSLP mRNA measurement.

152. The method of embodiment 151, wherein the 1fTSLP mRNA measurement is obtained using PCR.

153. The method of embodiment 128, wherein the composition reduces a 1fTSLP protein measurement relative to the baseline 1fTSLP protein measurement.

154. The method of embodiment 153, wherein the 1fTSLP protein measurement is obtained using microscopy, an immunoassay, a colorimetric assay, or a fluorescence assay.

155. The method of embodiment 129, wherein the composition does not affect a sfTSLP mRNA measurement relative to the baseline sfTSLP mRNA measurement.

156. The method of embodiment 155, wherein the sfTSLP mRNA measurement is obtained using PCR.

157. The method of embodiment 130, wherein the composition does not affect a sfTSLP protein measurement relative to the baseline sfTSLP protein measurement.

158. The method of embodiment 157, wherein the sfTSLP protein measurement is obtained using microscopy, an immunoassay, a colorimetric assay, or a fluorescence assay.

159. The method of embodiment 142 or 143, wherein the blood eosinophil measurement is obtained in a second sample obtained from the subject after administering the composition to the subject.

160. The method of embodiment 144 or 145, wherein the MUC5AC measurement is obtained in a second sample obtained from the subject after administering the composition to the subject.

161. The method of any one of embodiments 146, 147, or 150, wherein the inflammatory marker mRNA measurement is obtained in a second sample obtained from the subject after administering the composition to the subject.

162. The method of any one of embodiments 148-150, wherein the inflammatory marker protein measurement is obtained in a second sample obtained from the subject after administering the composition to the subject.

163. The method of embodiment 151 or 152, wherein the lfTSLP mRNA measurement is obtained in a second sample obtained from the subject after administering the composition to the subject.

164. The method of embodiment 153 or 154, wherein the lfTSLP protein measurement is obtained in a second sample obtained from the subject after administering the composition to the subject.

165. The method of embodiment 155 or 156, wherein the sfTSLP mRNA measurement is obtained in a second sample obtained from the subject after administering the composition to the subject.

166. The method of embodiment 157 or 158, wherein the sfTSLP protein measurement is obtained in a second sample obtained from the subject after administering the composition to the subject.

167. The method of any one of embodiments 159-166, wherein the second sample is an airway sample.

168. The method of any one of embodiments 159-167, wherein the second sample is a mucus sample.

169. The method of any one of embodiments 159-168, wherein the second sample is an airway tissue sample.

170. The method of any one of embodiments 159-169, wherein the second sample is an airway cell sample.

171. The method of any one of embodiments 159-170, wherein the second sample is a blood sample, a plasma sample, or a serum sample.

172. The method of any one of embodiments 91-171, wherein the lfTSLP is encoded by a nucleic acid comprising SEQ ID NO: 14923, or a variant thereof at least 70% identical, at least 75% identical, at least 80% identical, at least 85% identical, at least 90% identical, at least 91% identical, at least 92% identical, at least 93% identical, at least 94% identical, at least 95% identical, at least 96% identical, at least 97% identical, at least 98% identical, at least 99% identical, to SEQ ID NO: 14923.

173. The method of any one of embodiments 91-172, wherein the lfTSLP is encoded by a nucleic acid comprising SEQ ID NO: 14923.

174. The method of any one of embodiments 91-173, wherein the oligonucleotide is specific for lfT'SLP, and/or does not target a short isoform of TSLP (sfT'SLP).

175. The method of any one of embodiments 91-174, wherein the oligonucleotide comprises a modified internucleoside linkage.

176. The method of embodiment 175, wherein the modified internucleoside linkage comprises alkylphosphonate, phosphorothioate, methylphosphonate, phosphorodithioate, alkylphosphonothioate, phosphoramidate, carbamate, carbonate, phosphate triester, acetamidate, or carboxymethyl ester, or a combination thereof.

177. The method of embodiment 175, wherein the modified internucleoside linkage comprises one or more phosphorothioate linkages.

178. The method of any one of embodiments 91-177, wherein the oligonucleotide comprises 1, 2, 3, 4, 5, 6, 7, 8, 9, 10, 11, 12, 13, 14, 15, 16, 17, 18, 19, or 20 modified internucleoside linkages.

179. The method of any one of embodiments 91-178, wherein the oligonucleotide comprises 2 or more modified internucleoside linkages, 3 or more modified internucleoside linkages, 4 or more modified internucleoside linkages, 5 or more modified internucleoside linkages, 6 or more modified internucleoside linkages, 7 or more modified internucleoside linkages, 8 or more modified internucleoside linkages, 9 or more modified internucleoside linkages, 10 or more modified internucleoside linkages, 11 or more modified internucleoside linkages, 12 or more modified internucleoside linkages, 13 or more modified internucleoside linkages, 14 or more modified internucleoside linkages, 15 or more modified internucleoside linkages, 16 or more modified internucleoside linkages, 17 or more modified internucleoside linkages, 18 or more modified internucleoside linkages, 19 or more modified internucleoside linkages, or 20 or more modified internucleoside linkages.

180. The method of any one of embodiments 91-179, wherein the oligonucleotide comprises a modified nucleoside.

181. The method of embodiment 180, wherein the modified nucleoside comprises a locked nucleic acid (LNA), hexitol nucleic acid (HLA), cyclohexene nucleic acid (CeNA), 2'-methoxyethyl, 2'-O-alkyl, 2'-O-allyl, 2'-O-allyl, 2'-fluoro, or 2'-deoxy, or a combination thereof.

182. The method of embodiment 180, wherein the modified nucleoside comprises a LNA.

183. The method of embodiment 180, wherein the modified nucleoside comprises a 2',4' constrained ethyl nucleic acid.

184. The method of embodiment 180, wherein the modified nucleoside comprises a 2'-O-methyl nucleoside, 2'-deoxyfluoro nucleoside, 2'-O—N-methylacetamido (2'-O-NMA) nucleoside, a 2'-O-dimethylaminoethoxyethyl (2'-O-DMAEOE) nucleoside, 2'-O-aminopropyl (2'-O-AP) nucleoside, or 2'-ara-F, or a combination thereof.

185. The method of embodiment 180, wherein the modified nucleoside comprises one or more 2'fluoro modified nucleosides.

186. The method of embodiment 180, wherein the modified nucleoside comprises a 2' 0-alkyl modified nucleoside.

187. The method of embodiment 180, wherein the oligonucleotide comprises a lipid attached at a 3' or 5' terminus of the oligonucleotide.

188. The method of embodiment 187, wherein the lipid comprises cholesterol, myristoyl, palmitoyl, stearoyl, lithocholoyl, docosanoyl, docosahexaenoyl, myristyl, palmityl stearyl, or α-tocopherol, or a combination thereof.

189. The method of any one of embodiments 91-188, wherein the oligonucleotide comprises 1, 2, 3, 4, 5, 6, 7, 8, 9, 10, 11, 12, 13, 14, 15, 16, 17, 18, 19, 20, or 21 modified nucleosides.

190. The method of any one of embodiments 91-189, wherein the oligonucleotide comprises 2 or more modified nucleosides, 3 or more modified nucleosides, 4 or more modified nucleosides, 5 or more modified nucleosides, 6 or more modified nucleosides, 7 or more modified nucleosides, 8 or more modified nucleosides, 9 or more modified nucleosides, 10 or more modified nucleosides, 11 or more modified nucleosides, 12 or more modified nucleosides, 13 or more modified nucleosides, 14 or more modified nucleosides, 15 or more modified nucleosides, 16 or more modified nucleosides, 17 or more modified nucleosides, 18 or more modified nucleosides, 19 or more modified nucleosides, 20 or more modified nucleosides, or 21 or more modified nucleosides.

191. The method of any one of embodiments 91-190, wherein the oligonucleotide comprises a small interfering RNA (siRNA) comprising a sense strand and an antisense strand.

192. The method of embodiment 191, wherein the sense strand is 12-30 nucleosides in length.

193. The method of embodiment 191 or 192, wherein the antisense strand is 12-30 nucleosides in length.

194. A composition comprising an oligonucleotide that targets 1fTSLP, wherein the oligonucleotide comprises a siRNA comprising a sense strand and an antisense strand, each strand is independently about 12-30 nucleosides in length, and at least one of the sense strand and the antisense strand comprises a nucleoside sequence comprising about 12-30 contiguous nucleosides of one of SEQ ID NO: 14923.

195. A composition comprising an oligonucleotide that targets 1fTSLP, wherein the oligonucleotide comprises an siRNA comprising a sense strand and an antisense strand, each strand is independently about 12-30 nucleosides in length, and at least one of the sense strand and the antisense strand comprises a nucleoside sequence comprising about 12-30 contiguous nucleosides of one of SEQ ID NO: 14925.

196. The method of any one of embodiments 191-195, wherein the sense strand and the anti sense strand form a double-stranded RNA duplex.

197. The method of embodiment 196, wherein the first base pair of the double-stranded RNA duplex is an AU base pair.

198. The method of any one of embodiments 191-197, wherein the sense strand comprises a 3' overhang comprising 1, 2, or more nucleosides.

199. The method of embodiment 198, wherein the 3' overhang of the sense strand comprises 2 nucleosides.

200. The method of any one of embodiments 191-199, wherein the antisense strand comprises a 3' overhang comprising 1, 2, or more nucleosides.

201. The method of embodiment 200, wherein the 3' overhang of the antisense strand comprises 2 nucleosides.

202. The method of any one of embodiments 191-201, wherein the sense strand comprises a nucleoside sequence comprising or consisting of the sequence of any one of SEQ ID NOs: 14935-17526, or a nucleic acid sequence thereof having 1 or 2 nucleoside substitutions, additions, or deletions.

203. The method of any one of embodiments 191-202, wherein the sense strand comprises a nucleoside sequence comprising or consisting of the sequence of any one of SEQ ID NOs: 14935-17526.

204. The method of any one of embodiments 191-203, wherein the antisense strand comprises a nucleoside sequence comprising or consisting of the sequence of any one of SEQ ID NOs: 26134-28725, or a nucleic acid sequence thereof having 1 or 2 nucleoside substitutions, additions, or deletions.

205. The method of any one of embodiments 191-204, wherein the antisense strand comprises a nucleoside sequence comprising or consisting of the sequence of any one of SEQ ID NOs: 26134-28725.

206. The method of any one of embodiments 191-205, wherein the siRNA binds with a 17 mer in a non-human primate 1fTSLP mRNA.

207. The method of any one of embodiments 191-206, wherein the siRNA binds with a 19 mer in a human 1fTSLP mRNA.

208. The method of any one of embodiments 191-206, wherein the siRNA binds with a human 1fTSLP mRNA and less than or equal to 20 human off-targets, with no more than 2 mismatches in the antisense strand.

209. The method of any one of embodiments 191-208, wherein the siRNA binds with a human 1fTSLP mRNA target site that does not harbor an SNP, with a minor allele frequency (MAF) greater or equal to 1% (pos. 2-18).

210. The method of any one of embodiments 191-209, wherein the sense strand comprises the nucleoside sequence of any one of SEQ ID NOs: 14941, 14942, 14947, 14948, 14950, 14957, 14959, 14960, 14961, 14962, 14973, 15004, 15005, 15013, 15035, 15039, 15040, 15041, 15043, 15047, 15048, 15049, 15050, 15051, 15052, 15056, 15057, 15059, 15062, 15082, 15094, 15096, 15097, 15098, 15101, 15102, 15107, 15108, 15111, 15114, 15117, 15123, 15127, 15128, 15164, 15174, 15178, 15184, 15186, 15187, 15188, 15190, 15191, 15194, 15195, 15197, 15230, 15235, 15236, 15238, 15240, 15241, 15246, 15252, 15253, 15260, 15263, 15264, 15272, 15274, 15276, 15278, 15279, 15282, 15283, 15286, 15294, 15302, 15303, 15307, 15310, 15314, 15319, 15320, 15321, 15322, 15324, or 15326, or a nucleic acid sequence thereof having 1 or 2 nucleoside substitutions, additions, or deletions; and/or wherein the antisense strand comprises the nucleoside sequence of any one of SEQ ID NOs: 26140, 26141, 26146, 26147, 26149, 26156, 26158, 26159, 26160, 26161, 26172, 26203, 26204, 26212, 26234, 26238, 26239, 26240, 26242, 26246, 26247, 26248, 26249, 26250, 26251, 26255, 26256, 26258, 26261, 26281, 26293, 26295, 26296, 26297, 26300, 26301, 26306, 26307, 26310, 26313, 26316, 26322, 26326, 26327, 26363, 26373, 26377, 26383, 26385, 26386, 26387, 26389, 26390, 26393, 26394, 26396, 26429, 26434, 26435, 26437, 26439, 26440, 26445, 26451, 26452, 26459, 26462, 26463, 26471, 26473, 26475, 26477, 26478, 26481, 26482, 26485, 26493, 26501, 26502, 26506, 26509, 26513, 26518, 26519, 26520, 26521, 26523, or 26525, or a nucleic acid sequence thereof having 1 or 2 nucleoside substitutions, additions, or deletions.

211. The method of any one of embodiments 191-210, wherein the sense strand comprises the nucleoside sequence of any one of SEQ ID NOs: 14941, 14942, 14947, 14948, 14950, 14957, 14959, 14960, 14961, 14962, 14973, 15004, 15005, 15013, 15035, 15039, 15040, 15041, 15043, 15047, 15048, 15049, 15050, 15051, 15052, 15056, 15057, 15059, 15062, 15082, 15094, 15096, 15097, 15098, 15101, 15102, 15107, 15108, 15111, 15114, 15117, 15123, 15127, 15128, 15164, 15174, 15178, 15184, 15186, 15187, 15188, 15190, 15191, 15194, 15195, 15197, 15230, 15235, 15236, 15238, 15240, 15241, 15246, 15252, 15253, 15260, 15263, 15264, 15272, 15274, 15276, 15278, 15279, 15282, 15283, 15286, 15294, 15302, 15303, 15307, 15310, 15314, 15319, 15320, 15321, 15322, 15324, or 15326; and/or wherein the antisense strand comprises the nucleoside sequence of any one of SEQ ID NOs: 26140, 26141, 26146, 26147, 26149, 26156, 26158, 26159, 26160, 26161, 26172, 26203, 26204, 26212, 26234, 26238, 26239, 26240, 26242, 26246, 26247, 26248, 26249, 26250, 26251, 26255, 26256, 26258, 26261, 26281, 26293, 26295, 26296, 26297, 26300, 26301, 26306, 26307, 26310, 26313, 26316, 26322, 26326, 26327, 26363, 26373, 26377, 26383, 26385, 26386, 26387, 26389, 26390, 26393, 26394, 26396, 26429, 26434, 26435, 26437, 26439, 26440, 26445, 26451, 26452, 26459, 26462, 26463, 26471, 26473, 26475, 26477, 26478, 26481, 26482, 26485, 26493, 26501, 26502, 26506, 26509, 26513, 26518, 26519, 26520, 26521, 26523, or 26525.

212. The method of any one of embodiments 191-211, wherein the sense strand comprises the nucleoside sequence of any one of SEQ ID NOs: 14942, 14947, 14948, 14950, 14957, 14959, 15004, 15035, 15039, 15040, 15041, 15043, 15047, 15048, 15049, 15050, 15051, 15057, 15059, 15082, 15094, 15096, 15097, 15098, 15102, 15107, 15108, 15111, 15114, 15123, 15127, 15128, 15164, 15184, 15186, 15187, 15188, 15190, 15191, 15194, 15195, 15230, 15235, 15236, 15238, 15241, 15246, 15252, 15260, 15263, 15272, 15276, 15278, 15279, 15283, 15294, 15302, 15307, 15314, 15322, 15324, or 15326; and/or wherein the antisense strand comprises the nucleoside sequence of any one of SEQ ID NOs: 26141, 26146, 26147, 26149, 26156, 26158, 26203, 26234, 26238, 26239, 26240, 26242, 26246, 26247, 26248, 26249, 26250, 26256, 26258, 26281, 26293, 26295, 26296, 26297, 26301, 26306, 26307, 26310, 26313, 26322, 26326, 26327, 26363, 26383, 26385, 26386, 26387, 26389, 26390, 26393, 26394, 26429, 26434, 26435, 26437, 26440, 26445, 26451, 26459, 26462, 26471, 26475, 26477, 26478, 26482, 26493, 26501, 26506, 26513, 26521, 26523, or 26525.

213. The method of any one of embodiments 191-212, wherein the sense strand comprises the nucleoside sequence of any one of SEQ ID NOs: 15041, 15048, 15051, 15082, 15096, 15111, 15114, 15123, 15128, 15187, 15194, 15230, 15235, 15238, 15241, 15252, 15272, 15278, 15307, or 15326; and/or wherein the antisense strand comprises the nucleoside sequence of any one of SEQ ID NOs: 26240, 26247, 26250, 26281, 26295, 26310, 26313, 26322, 26327, 26386, 26393, 26429, 26434, 26437, 26440, 26451, 26471, 26477, 26506, or 26525.

214. The method of any one of embodiments 191-213, wherein the sense strand comprises the nucleoside sequence of any one of SEQ ID NOs: 15048, 15051, 15082, 15096, 15111, 15114, 15123, 15128, 15194, 15230, 15235, 15238, 15241, 15252, 15272, 15278, 15307, or 15326; and/or wherein the antisense strand comprises the nucleoside sequence of any one of SEQ ID NOs: 26247, 26250, 26281, 26295, 26310, 26313, 26322, 26327, 26393, 26429, 26434, 26437, 26440, 26451, 26471, 26477, 26506, or 26525.

215. The method of any one of embodiments 191-214, wherein the sense strand comprises the nucleoside sequence of any one of SEQ ID NOs: 17527-20118, or a nucleic acid sequence thereof having 1 or 2 nucleoside substitutions, additions, or deletions.

216. The method of any one of embodiments 191-215, wherein the sense strand comprises the nucleoside sequence of any one of SEQ ID NOs: 17527-20118.

217. The method of any one of embodiments 191-216 wherein the sense strand comprises the nucleoside sequence of any one of SEQ ID NOs: 20119-22710, or a nucleic acid sequence thereof having 1 or 2 nucleoside substitutions, additions, or deletions.

218. The method of any one of embodiments 191-217, wherein the sense strand comprises the nucleoside sequence of any one of SEQ ID NOs: 20119-22710.

219. The method of any one of embodiments 191-218, wherein the antisense strand comprises the nucleoside sequence of any one of SEQ ID NOs: 28922-31513, or a nucleic acid sequence thereof having 1 or 2 nucleoside substitutions, additions, or deletions.

220. The method of any one of embodiments 191-219, wherein the antisense strand comprises the nucleoside sequence of any one of SEQ ID NOs: 28922-31513.

221. The method of any one of embodiments 191-220, wherein the antisense strand comprises the nucleoside sequence of any one of SEQ ID NOs: 31514-34105, or a nucleic acid sequence thereof having 1 or 2 nucleoside substitutions, additions, or deletions.

222. The method of any one of embodiments 191-221, wherein the antisense strand comprises the nucleoside sequence of any one of SEQ ID NOs: 31514-34105.

223. The method of any one of embodiments 191-222, wherein the sense strand comprises modification pattern 1S: 5'-NfsnsNfnNfnNfNfNfnNfnNfnNfnNfnNfsnsn-3' (SEQ ID NO: 34502), wherein "Nf" is a 2' fluoro-modified nucleoside, "n" is a 2' O-methyl modified nucleoside, and "s" is a phosphorothioate linkage.

224. The method of any one of embodiments 191-222, wherein the sense strand comprises modification pattern 2S: 5'-nsnsnnNfnNfNfNfnnnnnnnnnnnsnsn-3' (SEQ ID NO: 34504), wherein "Nf" is a 2' fluoro-modified nucleoside, "n" is a 2' O-methyl modified nucleoside, and "s" is a phosphorothioate linkage.

225. The method of any one of embodiments 191-222, wherein the sense strand comprises modification pattern 3S: 5'-nsnsnnNfnNfnNfnnnnnnnnnnnsnsn-3' (SEQ ID NO: 34507), wherein "Nf" is a 2' fluoro-modified nucleoside, "n" is a 2' O-methyl modified nucleoside, and "s" is a phosphorothioate linkage.

226. The method of any one of embodiments 191-222, wherein the sense strand comprises modification pattern 4S: 5'-NfsnsNfnNfnNfNfNffiNfnNfnNthNfnNfsnsnN-Lipid-3' (SEQ ID NO: 34508), wherein "Nf" is a 2' fluoro-modified nucleoside, "n" is a 2' O-methyl modified nucleoside, "s" is a phosphorothioate linkage, and N comprises one or more nucleosides.

227. The method of any one of embodiments 191-222, wherein the sense strand comprises modification pattern 5S: 5'-nsnsnnNfnNfNfNfnnnnnnnnnnnsnsnN-Lipid-3' (SEQ ID NO: 34509), wherein "Nf" is a 2' fluoro-modified nucleoside, "n" is a 2' O-methyl modified nucleoside, "s" is a phosphorothioate linkage, and N comprises one or more nucleosides.

228. The method of any one of embodiments 191-227, wherein the antisense strand comprises modification pattern 1AS: 5'-nsNfsnNfnNfnNfnNfnNfnnnNfnNfnNfnsnsn-3' (SEQ ID NO: 34503), wherein "Nf" is a 2' fluoro-modified nucleoside, "n" is a 2' O-methyl modified nucleoside, and "s" is a phosphorothioate linkage.

229. The method of any one of embodiments 191-227, wherein the antisense strand comprises modification pattern 2AS: 5'-nsNfsnnnNfnNfNfnnnnNfnNfnnnsnsn-3' (SEQ ID NO: 34510), wherein "Nf" is a 2' fluoro-modified nucleoside, "n" is a 2' O-methyl modified nucleoside, and "s" is a phosphorothioate linkage.

230. The method of any one of embodiments 191-227, wherein the antisense strand comprises modification pattern 3AS: 5'-nsNfsnnnNfnnnnnnnNfnNfnnnsnsn-3' (SEQ ID NO: 34505), wherein "Nf" is a 2' fluoro-modified nucleoside, "n" is a 2' O-methyl modified nucleoside, and "s" is a phosphorothioate linkage.

231. The method of any one of embodiments 191-227, wherein the antisense strand comprises modification pattern 4AS: 5'-nsNfsnNfnNfnnnnnnnNfnNfnnnsnsn-3' (SEQ ID NO: 34511), wherein "Nf" is a 2' fluoro-modified nucleoside, "n" is a 2' O-methyl modified nucleoside, and "s" is a phosphorothioate linkage.

232. The method of any one of embodiments 191-222, wherein the sense strand comprises pattern 1S and the antisense strand comprises pattern 1AS, 2AS, 3AS, or 4AS.

233. The method of any one of embodiments 191-222, wherein the sense strand comprises pattern 2S and the antisense strand comprises pattern 1AS, 2AS, 3AS, or 4AS.

234. The method of any one of embodiments 191-222, wherein the sense strand comprises pattern 3S and the antisense strand comprises pattern 1AS, 2AS, 3AS, or 4AS.

235. The method of any one of embodiments 191-222, wherein the sense strand comprises pattern 4S and the antisense strand comprises pattern 1AS, 2AS, 3AS, or 4AS.

236. The method of any one of embodiments 191-222, wherein the sense strand comprises the nucleoside sequence of any one of SEQ ID NOs: 17533, 17534, 17539, 17540, 17542, 17549, 17551, 17552, 17553, 17554, 17565, 17596, 17597, 17605, 17627, 17631, 17632, 17633, 17635, 17639, 17640, 17641, 17642, 17643, 17644, 17648, 17649, 17651, 17654, 17674, 17686, 17688, 17689, 17690, 17693, 17694, 17699, 17700, 17703, 17706, 17709, 17715, 17719, 17720, 17756, 17766, 17770, 17776, 17778, 17779, 17780, 17782, 17783, 17786, 17787, 17789, 17822, 17827, 17828, 17830, 17832, 17833, 17838, 17844, 17845, 17852, 17855, 17856, 17864, 17866, 17868, 17870, 17871, 17874, 17875, 17878, 17886, 17894, 17895, 17899, 17902, 17906, 17911, 17912, 17913, 17914, 17916, or 17918; and/or wherein the antisense strand comprises the nucleoside sequence of any one of SEQ ID NOs: 28928, 28929, 28934, 28935, 28937, 28944, 28946, 28947, 28948, 28949, 28960, 28991, 28992, 29000, 29022, 29026, 29027, 29028, 29030, 29034, 29035, 29036, 29037, 29038, 29039, 29043, 29044, 29046, 29049, 29069, 29081, 29083, 29084, 29085, 29088, 29089, 29094, 29095, 29098, 29101, 29104, 29110, 29114, 29115, 29151, 29161, 29165, 29171, 29173, 29174, 29175, 29177, 29178, 29181, 29182, 29184, 29217, 29222, 29223, 29225, 29227, 29228, 29233, 29239, 29240, 29247, 29250, 29251, 29259, 29261, 29263, 29265, 29266, 29269, 29270, 29273, 29281, 29289, 29290, 29294, 29297, 29301, 29306, 29307, 29308, 29309, 29311, or 29313.

237. The method of any one of embodiments 191-222, wherein the sense strand comprises the nucleoside sequence of any one of SEQ ID NOs: 17534, 17539, 17540, 17542, 17549, 17551, 17596, 17627, 17631, 17632, 17633, 17635, 17639, 17640, 17641, 17642, 17643, 17649, 17651, 17674, 17686, 17688, 17689, 17690, 17694, 17699, 17700, 17703, 17706, 17715, 17719, 17720, 17756, 17776, 17778, 17779, 17780, 17782, 17783, 17786, 17787, 17822, 17827, 17828, 17830, 17833, 17838, 17844, 17852, 17855, 17864, 17868, 17870, 17871, 17875, 17886, 17894, 17899, 17906, 17914, 17916, or 17918; and/or wherein the antisense strand comprises the nucleoside sequence of any one of SEQ ID NOs: 28929, 28934, 28935, 28937, 28944, 28946, 28991, 29022, 29026, 29027, 29028, 29030, 29034, 29035, 29036, 29037, 29038, 29044, 29046, 29069, 29081, 29083, 29084, 29085, 29089, 29094, 29095, 29098, 29101, 29110, 29114, 29115, 29151, 29171, 29173, 29174, 29175, 29177, 29178, 29181, 29182, 29217, 29222, 29223, 29225, 29228, 29233, 29239, 29247, 29250, 29259, 29263, 29265, 29266, 29270, 29281, 29289, 29294, 29301, 29309, 29311, or 29313.

238. The method of any one of embodiments 191-222, wherein the sense strand comprises the nucleoside sequence of any one of SEQ ID NOs: 17633, 17640, 17643, 17674, 17688, 17703, 17706, 17715, 17720, 17779, 17786, 17822, 17827, 17830, 17833, 17844, 17864, 17870, 17899, or 17918; and/or wherein the antisense strand comprises the nucleoside sequence of any one of SEQ ID NOs: 29028, 29035, 29038, 29069, 29083, 29098, 29101, 29110, 29115, 29174, 29181, 29217, 29222, 29225, 29228, 29239, 29259, 29265, 29294, or 29313.

239. The method of any one of embodiments 191-222, wherein the sense strand comprises the nucleoside sequence of any one of SEQ ID NOs: 17640, 17643, 17674, 17688, 17703, 17706, 17715, 17720, 17786, 17822, 17827, 17830, 17833, 17844, 17864, 17870, 17899, or 17918; and/or wherein the antisense strand comprises the nucleoside sequence of any one of SEQ ID NOs: 29035, 29038, 29069, 29083, 29098, 29101, 29110, 29115, 29181, 29217, 29222, 29225, 29228, 29239, 29259, 29265, 29294, or 29313.

240. The method of any one of embodiments 91-190, wherein the oligonucleotide comprises an antisense oligonucleotide (ASO).

241. The method of embodiment 240, wherein the ASO is single-stranded and 12-30 nucleosides in length.

242. A composition comprising an oligonucleotide that targets 1fTSLP, wherein the oligonucleotide comprises an ASO comprising an antisense strand about 12-30 nucleosides in length and comprising a nucleoside sequence comprising about 12-30 contiguous nucleosides of one of SEQ ID NO: 14923.

243. A composition comprising an oligonucleotide that targets TSLP, wherein the oligonucleotide comprises an ASO comprising an antisense strand about 12-30 nucleosides in length and comprising a nucleoside sequence comprising about 12-30 contiguous nucleosides of one of SEQ ID NO: 14925.

244. The method of any one of embodiments 240-243, wherein the ASO is 15-25 nucleosides in length.

245. The method of any one of embodiments 240-244, wherein the ASO is 20 nucleosides in length.

246. The method of any one of embodiments 240-245, wherein the ASO comprises a nucleoside sequence comprising or consisting of the sequence of any one of SEQ ID NOs: 9971-12561, or a nucleic acid sequence thereof having 1 or 2 nucleoside substitutions, additions, or deletions.

247. The method of any one of embodiments 240-246, wherein the ASO comprises a nucleoside sequence comprising or consisting of the sequence of any one of SEQ ID NOs: 9971-12561.

248. The method of any one of embodiments 240-247, wherein the ASO comprises a nucleoside sequence comprising or consisting of the sequence of any one of SEQ ID NOs: 23299-25889, or a nucleic acid sequence thereof having 1 or 2 nucleoside substitutions, additions, or deletions.

249. The method of any one of embodiments 240-248, wherein the ASO comprises a nucleoside sequence comprising or consisting of the sequence of any one of SEQ ID NOs: 23299-25889.

250. The method of any one of embodiments 240-249, wherein the ASO comprises modification pattern: 5'-nsnsnsnsnsdNsdNsdNsdNsdNsdNsdNsdNsnsnsn snsn-3' (SEQ ID NO: 34506) where "dN" is any deoxynucleotide, "n" is a 2'O-methyl or 2'O-methoxyethyl-modified nucleoside, and "s" is a phosphorothioate linkage.

251. The method of any one of embodiments 91-250, wherein the composition is a pharmaceutical composition.

252. The method of any one of embodiments 91-251, wherein the composition is sterile.

253. The method of any one of embodiments 91-252, further comprising a pharmaceutically acceptable carrier.

254. The method of embodiment 253, wherein the pharmaceutically acceptable carrier comprises water, a buffer, or a saline solution.

255. The method of any one of embodiments 91-254, formulated for administration by inhalation.

256. The method of any one of embodiments 91-255, wherein the oligonucleotide targets a sequence within the first 412 nucleotides of SEQ ID NO: 14923.

257. The composition of any one of embodiments 1-90, wherein the oligonucleotide targets a sequence within the first 412 nucleotides of SEQ ID NO: 14923.

258. Use of the composition of any one of embodiments 1-90 or 257, in a method of any one of embodiments 91-256.

Further Embodiments

Some embodiments include one or more of the following:

1. An RNA interference (RNAi) agent capable of inhibiting the expression of long-form thymic stromal lymphopoietin (1fTSLP), wherein the RNAi agent comprises a double-stranded RNA (dsRNA) comprising a sense strand and an antisense strand, each strand having 14 to 30 nucleotides.

2. The RNAi agent of embodiment 1, wherein the dsRNA has a length of 17-30 nucleotide pairs.

3. The RNAi agent of embodiment 1 or embodiment 2, wherein the sense strand and antisense strand each have 17-30 nucleotides.

4. The RNAi agent of any of embodiments 1-3, wherein the sense strand comprises a sequence at least about 80%, 85%, 90%, 95%, or 100% identical to a sequence selected from SEQ ID NOS: 1-5184.

5. The RNAi agent of any of embodiments 1-4, wherein the antisense strand comprises a sequence at least about 80%, 85%, 90%, 95%, or 100% identical to the reverse complement of the sense strand.

6. The RNAi agent of any of embodiments 1-5, wherein the antisense strand comprises a sequence at least about 80%, 85%, 90%, 95%, or 100% identical to a sequence selected from SEQ ID NOS: 1-5184.

7. The RNAi agent of any of embodiments 1-3, wherein the sequence of the sense strand comprises SEQ ID NO: 14929 and the sequence of the antisense strand comprises SEQ ID NO: 14930.

8. The RNAi agent of any of embodiments 1-7, comprising one or more nucleotide modifications selected from the group consisting of LNA, HNA, CeNA, 2'-methoxyethyl, 2'-O-alkyl, 2'-O-allyl, 2'-C-allyl, 2'-fluoro, and 2'-deoxy.

9. The RNAi agent of any of embodiments 1-8, wherein the nucleotides are modified with either 2'-OCH$_3$ or 2'-F.

10. The RNAi agent of any of embodiments 1-9, further comprising at least one ligand.

11. The RNAi agent of any of embodiments 1-10, comprising one or more nucleotide modifications selected from the group consisting of 2'-O-methyl nucleotide, 2'-deoxyfluoro nucleotide, 2'-O—N-methylacetamido (2'-O-NMA) nucleotide, a 2'-O-dimethylaminoethoxyethyl (2'-O-DMAEOE) nucleotide, 2'-O-aminopropyl (2'-O-AP) nucleotide, and 2'-ara-F.

12. The RNAi agent of any of embodiments 1-11, further comprising at least one phosphorothioate or methylphosphonate internucleotide linkage.

13. The RNAi agent of any of embodiments 1-12, wherein the nucleotide at the 1 position of the 5'-end of the antisense strand of the dsRNA is selected from the group consisting of A, dA, dU, U, and dT.

14. The RNAi agent of any of embodiments 1-13, wherein the base pair at the 1 position of the 5'-end of the dsRNA is an AU base pair.

15. An RNA interference (RNAi) agent capable of inhibiting the expression of 1fTSLP, wherein the RNAi agent comprises a double-stranded RNA (dsRNA) comprising a sense strand and an antisense strand, each of the strands having 14 to 30 nucleotides, wherein the sense strand contains at least two motifs of three identical modifications on three consecutive nucleotides, a first of said sense strand motifs occurring at a cleavage site in the sense strand and a second of said sense strand motifs occurring at a different region of the sense strand that is separated from the first sense strand motif by at least one nucleotide; and wherein the antisense strand contains at least two motifs of three identical modifications on three consecutive nucleotides, a first of said antisense strand motifs occurring at or near the cleavage site in the antisense strand and a second of said antisense strand motifs occurring at a different region of the anti sense strand that is separated from the first antisense strand motif by at least one nucleotide; wherein the modification in the first antisense strand motif is different than the modification in the second antisense strand motif.

16. The RNAi agent of embodiment 15, wherein at least one of the nucleotides occurring in the first sense strand motif forms a base pair with one of the nucleotides in the first antisense strand motif.

17. The RNAi agent of embodiment 15 or embodiment 16, wherein the dsRNA has 17-30 nucleotide base pairs.

18. The RNAi agent of embodiment 17, wherein the dsRNA has 17-19 nucleotide base pairs.

19. The RNAi agent of any of embodiments 15-18, wherein each strand has 17-23 nucleotides.

20. The RNAi agent of any of embodiments 15-19, wherein the modifications on the nucleotides of the sense strand and/or antisense strand are selected from the group consisting of LNA, HNA, CeNA, 2'-methoxyethyl, 2'-O-alkyl, 2'-O-allyl, 2'-C— allyl, 2'-fluoro, 2'-deoxy, and combinations thereof.

21. The RNAi agent of any of embodiments 15-20, wherein the modifications on the nucleotides of the sense strand and/or antisense strand are 2'-OCH$_3$ or 2'-F.

22. The RNAi agent of any of embodiments 15-21, further comprising a ligand attached to the 3' end of the sense strand.

23. An RNA interference (RNAi) agent capable of inhibiting the expression of 1fTSLP, wherein the RNAi agent comprises a double-stranded RNA (dsRNA) comprising a sense strand and an antisense strand, each of the strands having 14 to 30 nucleotides, wherein the sense strand contains at least one motif of three 2'-F modifications on three consecutive nucleotides, one of said motifs occurring at or near the cleavage site in the sense strand; and wherein the antisense strand contains at least one motif of three 2'-O-methyl modifications on three consecutive nucleotides, one of said motifs occurring at or near the cleavage site in the antisense strand.

24. The RNAi agent of embodiment 23, wherein the sense strand comprises a sequence at least about 80%, 85%, 90%, 95%, or 100% identical to a sequence selected from SEQ ID NOS: 1-5184.

25. The RNAi agent of embodiment 23 or embodiment 24, wherein the antisense strand comprises a sequence at least about 80%, 85%, 90%, 95%, or 100% identical to the reverse complement of the sense strand.

26. The RNAi agent of any of embodiments 23-25, wherein the antisense strand comprises a sequence at least about 80%, 85%, 90%, 95%, or 100% identical to a sequence selected from SEQ ID NOS: 1-5184.

27. A method of modulating a function of and/or the expression of a long-form thymic stromal lymphopoietin (1fTSLP) polynucleotide in patient cells or tissues, in vivo or in vitro, the method comprising: contacting said cells or tissues with at least one antisense oligonucleotide 5 to 30 nucleotides in length, wherein said at least one antisense oligonucleotide has at least 50% sequence identity to a reverse complement of a polynucleotide comprising 5 to 30 consecutive nucleotides within nucleotides 1 to 2610 of SEQ ID NO: 14923; thereby modulating a function of and/or the expression of the long-form thymic stromal lymphopoietin (1fTSLP) polynucleotide in patient cells or tissues, in vivo or in vitro.

28. A method of modulating a function of and/or the expression of a long-form thymic stromal lymphopoietin (1fTSLP) polynucleotide in patient cells or tissues, in vivo or in vitro, the method comprising: contacting said cells or tissues with at least one antisense oligonucleotide 5 to 30 nucleotides in length, wherein said antisense oligonucleotide has at least 50% sequence identity to an antisense oligonucleotide to the long-form thymic stromal lymphopoietin (1fTSLP) polynucleotide; thereby modulating a function of and/or the expression of the long-form thymic stromal lymphopoietin (1fTSLP) polynucleotide in patient cells or tissues, in vivo or in vitro.

29. A method of modulating a function of and/or the expression of a long-form thymic stromal lymphopoietin (1fTSLP) polynucleotide in patient cells or tissues, in vivo or in vitro, the method comprising: contacting said cells or tissues with at least one antisense oligonucleotide that targets a region of a natural antisense oligonucleotide of the long-form thymic stromal lymphopoietin (1fTSLP) polynucleotide; thereby modulating a function of and/or the expression of the long-form thymic stromal lymphopoietin (1fTSLP) polynucleotide in patient cells or tissues, in vivo or in vitro.

30. A method of modulating a function of and/or the expression of a long-form thymic stromal lymphopoietin (1fTSLP) polynucleotide in patient cells or tissues, in vivo or in vitro, the method comprising: contacting said cells or tissues with at least one antisense oligonucleotide 5 to 30 nucleotides in length, wherein said at least one antisense oligonucleotide has at least about 80%, 85%, 90%, 95%, or 100% sequence identity to a sequence selected from SEQ ID NOS: 9971-12561; thereby modulating a function of and/or the expression of the 1fTSLP polynucleotide in patient cells or tissues, in vivo or in vitro.

31. The method of any one of embodiments 27-29, wherein the at least one antisense oligonucleotide comprises SEQ ID NO: 14926.

32. The method of any one of embodiments 27-29, wherein the at least one antisense oligonucleotide comprises a sequence selected from SEQ ID NOS: 9971-12561.

33. The method of any one of embodiments 27-29, wherein the at least one antisense oligonucleotide comprises a sequence at least about 80%, 85%, 90%, 95%, or 100% identical to a sequence selected from SEQ ID NOS: 9971-12561.

34. The method of any of embodiments 27-33, wherein a function of and/or the expression of the long-form thymic stromal lymphopoietin (1fTSLP) is increased in vivo or in vitro with respect to a control oligonucleotide that does not target or specifically hybridize to 1fTSLP.

35. The method of any of embodiments 27-33, wherein a function of and/or the expression of the long-form thymic stromal lymphopoietin (1fTSLP) is decreased in vivo or in vitro with respect to a control oligonucleotide that does not target or specifically hybridize to 1fTSLP.

36. The method of any of embodiments 27-35, wherein the at least one antisense oligonucleotide targets a natural antisense sequence of a long-form thymic stromal lymphopoietin (1fTSLP) polynucleotide.

37. The method of any of embodiments 27-35, wherein the at least one antisense oligonucleotide targets a natural sense sequence of a long-form thymic stromal lymphopoietin (1fTSLP) polynucleotide.

38. The method of any of embodiments 27-37, wherein the at least one antisense oligonucleotide targets a nucleic acid sequence comprising coding and/or non-coding nucleic acid sequences of a long-form thymic stromal lymphopoietin (1fTSLP) polynucleotide.

39. The method of any of embodiments 27-38, wherein the at least one antisense oligonucleotide targets overlapping and/or non-overlapping sequences of a long-form thymic stromal lymphopoietin (1fTSLP) polynucleotide.

40. The method of any of embodiments 27-39, wherein the at least one antisense oligonucleotide comprises one or more modifications.

41. The method of embodiment 40, wherein the one or more modifications is selected from: at least one modified sugar moiety, at least one modified internucleoside linkage, at least one modified nucleotide, and combinations thereof.

42. The method of embodiment 40, wherein the one or more modifications comprise at least one modified sugar moiety selected from: a 2'-O-methoxyethyl modified sugar moiety, a 2'-methoxy modified sugar moiety, a 2'-O-alkyl modified sugar moiety, a bicyclic sugar moiety, and combinations thereof.

43. The method of embodiment 40, wherein the one or more modifications comprise at least one modified internucleoside linkage selected from: a phosphorothioate, 2'-Omethoxyethyl (MOE), 2'-fluoro, alkylphosphonate, phosphorodithioate, alkylphosphonothioate, phosphoramidate, carbamate, carbonate, phosphate triester, acetamidate, carboxymethyl ester, and combinations thereof.

44. The method of embodiment 40, wherein the one or more modifications comprise at least one modified nucleotide selected from: a peptide nucleic acid (PNA), a locked nucleic acid (LNA), an arabino-nucleic acid (FANA), an analogue, a derivative, and combinations thereof.

45. A method of modulating a function of and/or the expression of a long-form thymic stromal lymphopoietin (1fTSLP) gene in mammalian cells or tissues, in vivo or in vitro, the method comprising: contacting said cells or tissues with at least one short interfering RNA (siRNA) oligonucleotide 5 to 30 nucleotides in length, said at least one siRNA oligonucleotide being specific for an antisense polynucleotide of a long-form thymic stromal lymphopoietin (1fTSLP) polynucleotide, wherein said at least one siRNA oligonucleotide has at least 50% sequence identity to a complementary sequence of at least about five consecutive nucleic acids of the antisense and/or sense nucleic acid molecule of the long-form thymic stromal lymphopoietin (1fTSLP) polynucleotide; thereby modulating a function of and or the expression of long-form thymic stromal lymphopoietin, (1fTSLP) in mammalian cells or tissues in vivo or in vitro.

46. The method of embodiment 45, wherein said oligonucleotide has at least 80% sequence identity to a sequence of at least about five consecutive nucleic acids that is complementary to the antisense and/or sense nucleic acid molecule of the long-form thymic stromal lymphopoietin (1fTSLP) polynucleotide.

47. The method of embodiment 45 or embodiment 46, wherein the at least one siRNA oligonucleotide comprises a sequence selected from SEQ ID NOS: 1-5184.

48. The method of embodiment 45 or embodiment 46, wherein the at least one siRNA oligonucleotide comprises a sequence at least about 80%, 85%, 90%, 95%, or 100% identical to a sequence selected from SEQ ID NOS: 1-5184.

49. A method of modulating a function of and/or the expression of long-form thymic stromal lymphopoietin, (1fTSLP) in mammalian cells or tissues, in vivo or in vitro, the method comprising: contacting said cells or tissues with at least one antisense oligonucleotide of about 5 to 30 nucleotides in length, the antisense oligonucleotide specific for noncoding and/or coding sequences of a sense and/or natural antisense strand of a long-form thymic stromal lymphopoietin (1fTSLP) polynucleotide, wherein said at least one antisense oligonucleotide has at least 50% sequence identity to at least one nucleic acid sequence set forth as 1 to 2610 of SEQ ID NO: 14923 or its complement; thereby modulating the function and/or expression of the long-form thymic stromal lymphopoietin (1fTSLP) in mammalian cells or tissues, in vivo or in vitro.

50. The method of embodiment 49, wherein the at least one antisense oligonucleotide comprises a sequence selected from SEQ ID NOS: 9971-12561.

51. The method of embodiment 49, wherein the at least one antisense oligonucleotide comprises a sequence at least about 80%, 85%, 90%, 95%, or 100% identical to a sequence selected from SEQ ID NOS: 9971-12561.

52. A synthetic, modified oligonucleotide comprising at least one modification wherein the at least one modification is selected from: at least one modified sugar moiety; at least one modified intenucleotide linkage; at least one modified nucleotide, and combinations thereof; wherein said oligonucleotide is an antisense compound which hybridizes to and modulates the function and/or expression of a long-form thymic stromal lymphopoietin (1fTSLP) polynucleotide in vivo or in vitro as compared to a control oligonucleotide that does not specifically hybridize to the 1fTSLP polynucleotide.

53. The oligonucleotide of embodiment 52, wherein the at least one modification comprises an internucleotide linkage selected from the group consisting of: phosphorothioate, alkylphosphonate, phosphorodithioate, alkylphosphonothioate, phosphoramidate, carbamate, carbonate, phosphate triester, acetamidate, carboxymethyl ester, and combinations thereof.

54. The oligonucleotide of embodiment 53, wherein said oligonucleotide comprises at least one phosphorothioate internucleotide linkage.

55. The oligonucleotide of embodiment 53, wherein said oligonucleotide comprises a backbone of phosphorothioate internucleotide linkages.

56. The oligonucleotide of embodiment 53, wherein the oligonucleotide comprises at least one modified nucleotide, said modified nucleotide selected from: a peptide nucleic acid, a locked nucleic acid (LNA), and an analogue, derivative, and a combination thereof.

57. The oligonucleotide of embodiment 52, wherein the oligonucleotide comprises a plurality of modifications, wherein said modifications comprise modified nucleotides selected from: phosphorothioate, alkylphosphonate, phosphorodithioate, alkylphosphonothioate, phosphoramidate, carbamate, carbonate, phosphate triester, acetamidate, carboxymethyl ester, and a combination thereof.

58. The oligonucleotide of embodiment 52, wherein the oligonucleotide comprises a plurality of modifications, wherein said modifications comprise modified nucleotides selected from: peptide nucleic acids, locked nucleic acids (LNA), and analogues, derivatives, and a combination thereof.

59. The oligonucleotide of embodiment 52, wherein the oligonucleotide comprises at least one modified sugar moiety selected from: a 2'-O-methoxyethyl modified sugar moiety, a 2'-methoxy modified sugar moiety, a 2-O-alkyl modified sugar moiety, a bicyclic sugar moiety, and a combination thereof.

60. The oligonucleotide of embodiment 52, wherein the oligonucleotide comprises a plurality of modifications, wherein said modifications comprise modified sugar moieties selected from: a 2'-O-methoxyethyl modified sugar moiety, a 2-methoxy modified sugar moiety, a 2'-O-alkyl modified sugar moiety, a bicyclic sugar moiety, and a combination thereof.

61. The oligonucleotide of embodiment 52, wherein the oligonucleotide is of at least about 5 to 30 nucleotides in length and hybridizes to an antisense and/or sense strand of a long-form thymic stromal lymphopoietin (1fTSLP) polynucleotide, wherein said oligonucleotide has at least about 20% sequence identity to a complementary sequence of at least about five consecutive nucleic acids of the antisense and/or sense coding and/or noncoding nucleic acid sequences of the long-form thymic stromal lymphopoietin (1fTSLP) polynucleotide.

62. The oligonucleotide of embodiment 52, wherein the oligonucleotide has at least about 80% sequence identity to a complementary sequence of at least about five consecutive nucleic acids of the antisense and or sense coding and/or noncoding nucleic acid sequence of the long-form thymic stromal lymphopoietin (1fTSLP) polynucleotide.

63. The oligonucleotide of embodiment 52, wherein said oligonucleotide hybridizes to and modulates expression and/or function of at least one long-form thymic stromal lymphopoietin (1fTSLP) polynucleotide, in vivo or in vitro, as compared to the control oligonucleotide.

64. The oligonucleotide of embodiment 52, wherein the oligonucleotide comprises the sequence set forth as SEQ ID NO: 14926.

65. The oligonucleotide of any one of embodiments 52-64, wherein the at least one antisense oligonucleotide comprises a sequence selected from SEQ ID NOS: 9971-12561.

66. The oligonucleotide of any one of embodiments 52-64, wherein the at least one antisense oligonucleotide comprises a sequence at least about 80%, 85%, 90%, 95%, or 100% identical to a sequence selected from SEQ ID NOS: 9971-12561.

67. A composition comprising one or more oligonucleotides specific for one or more long-form thymic stromal lymphopoietin (1fTSLP) polynucleotides, said one or more oligonucleotides comprising an antisense sequence, complementary sequence, allele, homolog, isoform, variant, derivative, mutant, or fragment of the 1fTSLP polynucleotide, or a combination thereof.

68. The composition of embodiment 67 wherein the one or more oligonucleotides have at least about 40% sequence identity as compared to the nucleotide sequence set forth as SEQ ID NO: 14926.

69. The composition of embodiment 67 or embodiment 68, wherein the oligonucleotide comprises the nucleotide sequence set forth as SEQ ID NO: 14926.

70. The composition of embodiment 67, wherein the one or more oligonucleotides comprises a sequence selected from SEQ ID NOS: 1-14922.

71. The composition of embodiment 67, wherein the one or more oligonucleotides comprises a sequence at least about 80%, 85%, 90%, 95%, or 100% identical to a sequence selected from SEQ ID NOS: 1-14922.

72. The composition of any of embodiments 67-71, wherein the one or more oligonucleotides comprises one or more modifications or substitutions.

73. The composition of embodiment 72, wherein the one or more modifications are selected from: phosphorothioate, methylphosphonate, peptide nucleic acid, locked nucleic acid (LNA) molecules, and combinations thereof.

74. A method of preventing or treating a disease associated with at least one long-form thymic stromal lymphopoietin (1fTSLP) polynucleotide and/or at least one encoded product thereof, the method comprising: administering to a subject in need thereof a therapeutically effective dose of at least one antisense oligonucleotide that binds to a natural antisense sequence of said at least one long-form thymic stromal lymphopoietin (1fTSLP) polynucleotide and modulates expression of said at least one long-form thymic stromal lymphopoietin (1fTSLP) polynucleotide; thereby preventing or treating the disease associated with the at least one long-form thymic stromal lymphopoietin (1fTSLP) polynucleotide and or at least one encoded product thereof.

75. A method of preventing or treating a disease associated with at least one long-form thymic stromal lymphopoietin (1fTSLP) polynucleotide and/or at least one encoded product thereof, the method comprising: administering to a subject in need thereof a therapeutically effective dose of at least one antisense oligonucleotide that binds to a natural sense sequence of said at least one long-form thymic stromal lymphopoietin (1fTSLP) polynucleotide and modulates expression of said at least one long-form thymic stromal lymphopoietin (1fTSLP) polynucleotide; thereby preventing or treating the disease associated with the at least one long-form thymic stromal lymphopoietin (1fTSLP) polynucleotide and or at least one encoded product thereof.

76. The method of embodiment 74 or embodiment 75, wherein a disease associated with the at least one long-form thymic stromal lymphopoietin (1fTSLP) polynucleotide is selected from: a disease or disorder associated with abnormal function and/or expression of 1fTSLP, inflammation of the nasal passageways, inflammation of the lower airway, a proliferative skin disease or disorder, ichthyosis, a disease or disorder associated with impaired epidermal lipid barrier, a disease or disorder associated with impaired adipocyte differentiation, a disease or disorder associated with impaired keratinocyte differentiation, an inflammatory skin disease or disorder, a cardiovascular disease or disorder, a coronary disease or disorder, myocardial infarction, cancer, glandular neoplasm, epithelial neoplasm, ovarian neoplasm, breast neoplasm, stroke and brain ischemia.

77. The method of embodiment 74 or embodiment 75, wherein the proliferative skin disease or disorder comprises psoriasis, chronic proliferative dermatitis, atopic dermatitis, or a combination thereof.

78. The method of embodiment 74 or embodiment 75, wherein the ichthyosis comprises autosomal recessive congenital ichthyosis (ARCI), collodion baby syndrome, non-bullous congenital ichthyosiform eiythroderma, lamellar ichthyosis, or a combination thereof.

79. The method of embodiment 74 or embodiment 75, wherein the cancer is selected from lung cancer, epidermoid carcinoma, breast cancer, or a combination thereof.

80. A method of identifying and selecting at least one oligonucleotide for in vivo administration comprising: identifying at least one oligonucleotide comprising at least five consecutive nucleotides which are complementary to 1fTSLP or to a polynucleotide that is antisense to 1fTSLP; measuring the thermal melting point of a hybrid of an antisense oligonucleotide and the 1fTSLP or the polynucleotide that is antisense to the 1fTSLP under stringent hybridization conditions; and selecting at least one oligonucleotide for in vivo administration based on the information obtained.

81. A method of treating a disease or condition mediated by TSLP, the method comprising administering to a subject in need thereof an oligonucleotide comprising a sequence at least about 80%, 85%, 90%, 95%, or 100% identical to a sequence selected from SEQ ID NOS: 1-14922.

82. The method of embodiment 81, wherein the oligonucleotide comprises a sequence selected from SEQ ID NOS: 1-14922.

83. The method of embodiment 81 or embodiment 82, wherein the TSLP is 1fTSLP. 84. The method of any of embodiments 81-83, wherein the disease or condition comprises allergic rhinitis (AR), non-allergic rhinitis (NAR), chronic rhinosinusitis (CRS), asthma, COPD and asthma-COPD overlap syndrome (ACOS), or a combination thereof.

85. The method of any of embodiments 81-84, wherein the oligonucleotide comprises dsRNA.

86. The method of embodiment 85, wherein the oligonucleotide comprises a sequence at least about 80%, 85%, 90%, 95%, or 100% identical to a sequence selected from SEQ ID NOS: 1-9970.

87. The method of embodiment 86, wherein the oligonucleotide comprises a sequence at least about 80%, 85%, 90%, 95%, or 100% identical to a sequence selected from SEQ ID NOS: 1-5184.

88. The method of any of embodiments 81-84, wherein the oligonucleotide comprises a sequence at least about 80%, 85%, 90%, 95%, or 100% identical to a sequence selected from SEQ ID NOS: 9971-14922.

89. The method of embodiment 88, wherein the oligonucleotide comprises a sequence at least about 80%, 85%, 90%, 95%, or 100% identical to a sequence selected from SEQ ID NOS: 9971-12561.

EXAMPLES

The following non-limiting examples serve to illustrate selected embodiments. It will be appreciated that variations in proportions and alternatives in elements of the components shown will be apparent to those skilled in the art and are within the scope of embodiments presented herein.

Example 1

Genome-Wide Association Study

Applicants evaluated approximately 30,000,000 imputed and directly genotyped variants in about 350,000 individuals for associations with a range of chronic Th2 or eosinophilic airway diseases and with blood eosinophils counts. One cluster of association was at chromosome 5q22.1, in a region encompassing the thymic stromal lymphopoietin (TSLP) gene.

Figure 2:
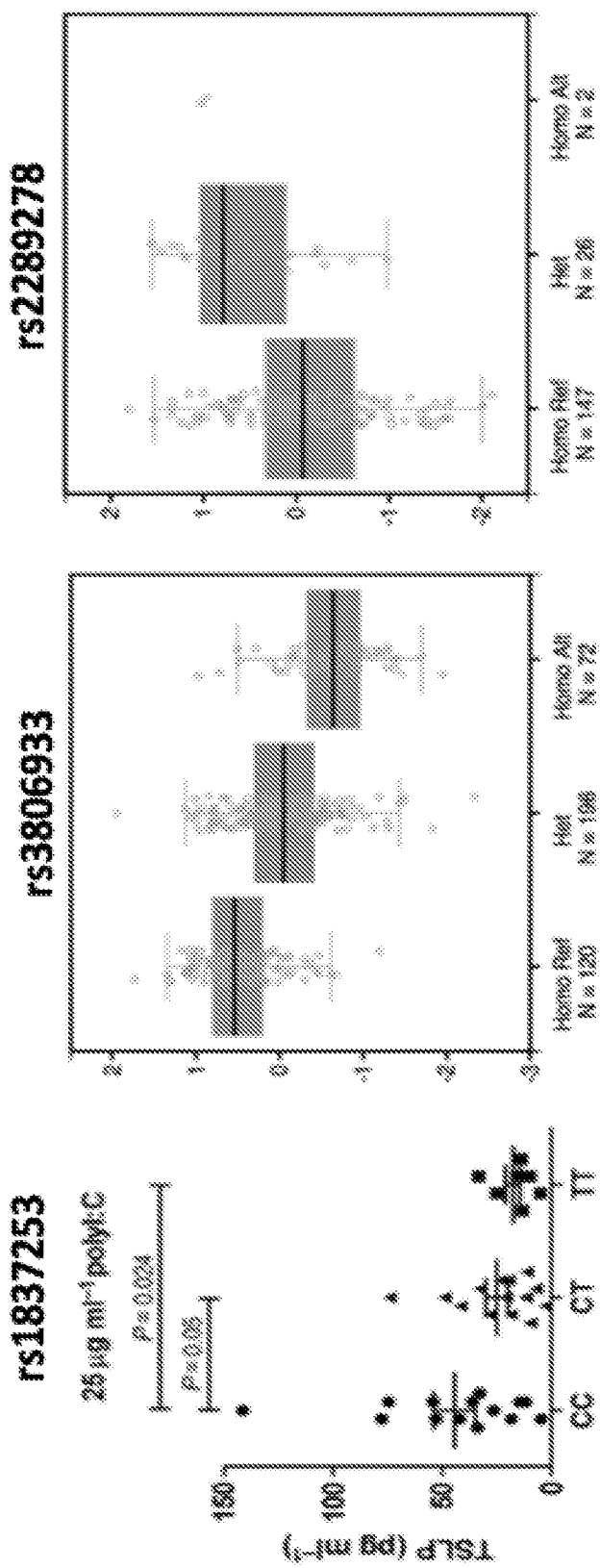
FIG. 2 shows variant rs1837253 (C) is associated with secretion of TSLP from primary nasal epithelial cells, and TSLP variants rs3806933 (C) and rs2289278 (G) are associated with increased expression in most human tissues.
Figure 3:
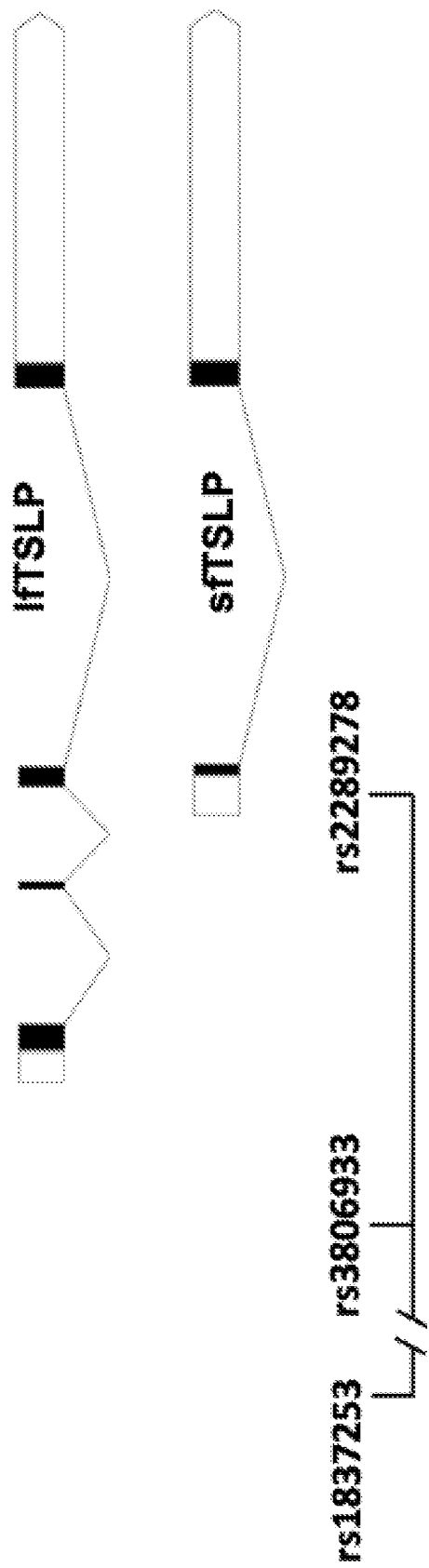
FIG. 3 is a schematic showing the location of variants rs1837253, rs3806933, and rs2289278 with respect to TSLP isoforms.

Applicants identified three independent (r2<0.10) variant clusters at the TSLP gene that are associated with asthma and blood eosinophil levels at genome-wide significance and with nasal polyposis and allergic rhinitis at nominal significance (Table 2). The effect allele of index variant rs1837253 (C) is associated with increased secretion of TSLP from primary nasal epithelial cells (FIG. 2), while the effect alleles of index variants rs3806933 (C) and rs2289278 (G) are associated with increased expression in most human tissues as observed in the Genotype-Tissue Expression (GTEx) project data (FIG. 2). rs1837253 and rs3806933 are located approximately 6 kb and 1 kb upstream of the transcription start site of lfTSLP, respectively, while rs2289278 is located in the 5' UTR and promoter of sfTSLP (FIG. 3).

TABLE 2

| Phenotype | rs1837253 (EAF 0.73) | | rs3806933 (EAF 0.54) | | rs2289278 (EA0.06) | |
| --- | --- | --- | --- | --- | --- | --- |
| | Effect size | P value | Effect size | P value | Effect size | P value |
| Asthma | 1.13 (OR) | 1.13E−42 | 1.06 (OR) | 1.15E−16 | 0.89(OR) | 4.80E−13 |
| Nasal polyps | 1.38 (OR) | 1.47E−31 | 1.10 (OR) | 5.20E−05 | 0.94 (OR) | 1.40E−05 |
| Allergic rhinitis | 1.06 (OR) | 2.80E−07 | 1.08 (OR) | 4.08E−15 | 0.94 (OR) | 2.43R−03 |
| Eosinophil count | 0.005 (beta) | 1.14E−37 | 0.004 (beta) | 3.08E−34 | −0.003 (beta) | 1.11E−04 |

The results in Table 2 demonstrate that the long and short form promoter variants have a different direction of effect in regard to TSLP expression and disease risk. The upstream of long form variants (rs1837253 and rs3806933) are associated with increased TSLP expression and increased disease risk, while the short form promoter variant (rs2289278) is associated with increased TSLP expression and decreased disease risk. A parsimonious explanation for these apparently contradictory results is that the upstream of long form variants (rs1837253 and rs3806933) influence expression of lfTSLP, while the short form promoter variant (rs2289278) influences expression of sfTSLP. This explanation is concordant with the previously described HDM mouse model data, in which increased long form expression is pathogenic while increased short form is protective against allergic airways disease. This novel genetic explanation is supportive of the hypothesis that targeting long form TSLP may be superior to non-specific targeting of TSLP for a broad range of eosinophilic airways disease.

Example 2

RNA Synthesis and Duplex Annealing

1. Oligonucleotide Synthesis:

All oligonucleotides are synthesized on an AKTAoligopilot synthesizer or an ABI 394 synthesizer. Commercially available controlled pore glass solid support (dT-CPG, 500A, Prime Synthesis) and RNA phosphoramidites with standard protecting groups, 5'-O-dimethoxytrityl N6-benzoyl-2'-t-butyldimethylsilyl-adenosine-3'-O—N,N-diisopropyl-2-cyanoethylphosphoramidite, 5'-O-dimethoxytrityl-N4-acetyl-2'-t-butyldimethylsilyl-cytidine-3'-O—N,N'-diisopropyl-2-cyanoethylphosphoramidite, 5'-O-dimethoxytrityl-N2-isobutyryl-2'-t-butyldimethylsilyl-guanosine-3'-O—N,N'-diisopropyl-2-cyanoethylphosphoramidite, and 5'-O-dimethoxytrityl-2'-t-butyldimethylsilyl-uridine-3'-O—N,N-diisopropyl-2-cyanoethylphosphoramidite (Pierce Nucleic Acids Technologies) are used for the oligonucleotide synthesis unless otherwise specified. The 2'-F phosphoramidites, 5'-O-dimethoxytrityl-N4-acetyl-2'-fluro-cytidine-3'-O— N,N'-diisopropyl-2-cyanoethyl-phosphoramidite and 5'-O-dimethoxytrityl-2'-fluro-uridine-3'-O—N,N'-diisopropyl-2-cyanoethyl-phosphoramidite are purchased from (Promega). All phosphoramidites are used at a concentration of 0.2M in acetonitrile (CH3CN) except for guanosine which is used at 0.2M concentration in 10% THF/ANC (v/v). Coupling/recycling time of 16 minutes is used. The activator is 5-ethyl thiotetrazole (0.75M, American International Chemicals), for the PO-oxidation Iodine/Water/Pyridine is used and the PS-oxidation PADS (2%>) in 2,6-lutidine/ACN (1:1 v/v) is used.

2. Deprotection-1 (Nucleobase Deprotection)

After completion of synthesis, the support is transferred to a 100 ml glass bottle (VWR). The oligonucleotide is cleaved from the support with simultaneous deprotection of base and phosphate groups with 80 mL of a mixture of ethanolic ammonia [ammonia: ethanol (3:1)] for 6.5 h at 55° C. The bottle is cooled briefly on ice and then the ethanolic ammonia mixture is filtered into a new 250 ml bottle. The CPG is washed with 2×40 mL portions of ethanol/water (1:1 v/v). The volume of the mixture is then reduced to ~30 ml by roto-vap. The mixture is then frozen on dry ice and dried under vacuum on a speed vac.

3. Deprotection-II (Removal of 2' TBDMS Group)

The dried residue is resuspended in 26 ml of triethylamine, triethylamine trihydro fluoride (TEA.3HF) or pyridine-HF and DMSO (3:4:6) and heated at 60° C. for 90 minutes to remove the tert-butyldimethylsilyl (TBDMS) groups at the 2' position. The reaction is then quenched with 50 ml of 20 mM sodium acetate and pH adjusted to 6.5, and stored in freezer until purification.

4. Analysis

The oligonucleotides are analyzed by high-performance liquid chromatography (HPLC) prior to purification and selection of buffer and column depends on nature of the sequence and or conjugated ligand.

5. HPLC Purification

The ligand conjugated oligonucleotides are purified reverse phase preparative HPLC. The unconjugated oligonucleotides are purified by anion-exchange HPLC on a TSK gel column packed in house. The buffers are 20 mM sodium phosphate (pH 8.5) in 10% CH3CN (buffer A) and 20 mM sodium phosphate (pH 8.5) in 10% CH3CN, 1M NaBr (buffer B). Fractions containing full-length oligonucleotides are pooled, desalted, and lyophilized. Approximately 0.15 OD of desalted oligonucleotides are diluted in water to 150 μl and then pipetted in special vials for CGE and LC/MS analysis.

Compounds are finally analyzed by LC-ESMS and CGE.

6. siRNA Preparation

For the preparation of siRNA, equimolar amounts of sense and antisense strand are heated in 1×PBS at 95° C. for 5 min and slowly cooled to room temperature.

Integrity of the duplex is confirmed by HPLC analysis.

Example 3

Antisense Inhibition of Long and Short-Form TSLP in Primary Normal Human Bronchial Epithelial Cells (NHBEC) and an Immortalized Human Airway Epithelial Cell Line (A549)

In this experiment antisense oligonucleotide inhibition of long and short-form TSLP is performed in primary normal human bronchial epithelial cells (NHBEC) and an immortalized human airway epithelial cell line (A549), to evaluate the percent of knockdown achieved relative to control antisense oligonucleotide.

Adherent NHBECs and A549s actively growing in submerged liquid culture are transfected in a 24-well plate with a scrambled or long-form or short-form targeting antisense oligonucleotide immediately followed by +/− supplementation with poly(I:C) (2.5 µg/mL). The purpose of poly(I:C) supplementation is to induce expression of long and/or short-form TSLP. The long-form targeting antisense oligonucleotide consists of a sequence as follows: 5' mCsmTsmCsmTsmCsdAsdTsdTsdGsdCsdCsd-AsdGsdTsdCsmCsmAsmCsmAsmG 3' (SEQ ID NO: 14926). This antisense oligonucleotide targets nucleotide positions 50-69 of the human TSLP long-form mRNA (GenBank Acc. #NM 033035.5; SEQ ID NO: 14923). The short-form targeting antisense oligonucleotide consists of a sequence as follows: 5' mAsmGsmGsmTsmCsd-AsdGsdGsdGsdTsdTsdGsdAsdGsdTsmAsmGs-mAsmGsmC 3' (SEQ ID NO: 14927). This antisense oligonucleotide targets nucleotide positions 43-62 of the human TSLP short-form mRNA (GenBank Acc. #NM 138551.4; SEQ ID NO: 14924). The non-targeting control antisense oligonucleotide consists of the following sequence: 5' mTsmCsmTsmAsmAsdCsdCsdGsdAsdGsdCsdTsdGsd-AsdTsmGsmGsmAsmCsmT 3' (SEQ ID NO: 14928). The letter "m" before the nucleotide indicates a 2'O-methoxyethyl substitution, the letter "d" indicates a deoxyribonucleotide substitution, and the letter "s" indicates a phosphorothioate linkage. Briefly, transfections are performed using TransIT TKO (Minis) following the manufacturer's recommended protocol. For each well, 1.4 ul antisense oligonucleotide (1 mM stock), 2.5 ul TransIT-TKO, and 50 ul OptiMEM are mixed, incubated at room temperature for 30 minutes, and added dropwise to each well.

At 72 hrs post-transfection, supernatant is collected, cells are trypsinized, and cell lysates prepared using a RIPA buffer. Cell lysates are used to either perform a quantitative PCR (RT-qPCR) or to perform Western blots using a TSLP antibody (Abcam) and a GAPDH antibody (Abcam) as a loading control.

Long-form and short-form TSLP mRNA is quantified using real-time polymerase chain reaction. Total RNA is reverse transcribed to cDNA using a First-Strand III cDNA Synthesis kit (Invitrogen, Carlsbad, Calif.). Then, real-time quantitative polymerase chain reaction (PCR) is performed using the ABI Prism 7900 Sequence Detection System (Applied Biosystems, Foster City, Calif.). Amplification by PCR is performed according to the manufacturer's protocols (Applied Biosystems). Primers and probes for long and short-form TSLP and for β-actin are designed with the assistance of the computer program Primer Express (Applied Biosystems). Searches using a nucleotide basic local alignment search tool (BLASTN) database are conducted to confirm their specificity and the absence of DNA polymorphisms.

Example 4

Comparison of Th2 Inflammatory Response to Isoform Specific Antisense Inhibition of TSLP in NHBECs Differentiated at Air Liquid Interface (ALI)

In this experiment, reverse transfections of antisense oligonucleotide targeting long, short and long+short isoforms of TSLP are performed in NHBECs grown at air liquid interface. Cells are treated with inflammatory stimuli (poly(I:C) or IL13) to compare the effect of long, short, or long+short TSLP inhibition on Th2 cytokine production and mucous production.

Before transfection, precoated inserts are prepared by adding 100 µl of collagen (human placental collagen Type VI, Sigma-Aldrich) to the apical surface of Transwell permeable supports (0.33-cm2 0.4-µm polyester membrane, Costar product no. 3470, Corning, Corning, N.Y.). To prepare for transfection, NHBECs growing on plastic are dissociated with 0.25% trypsin (Life Technologies) and washed with transfection media once.

For each well, 1.4 ul antisense oligonucleotide (1 mM stock), 2.5 ul TransIT-TKO, and 50 ul OptiMEM are mixed, incubated at room temperature for 30 minutes. The long-form targeting antisense oligonucleotide consists of a sequence as follows: 5' mCsmTsmCsmTsmCsd-AsdTsdTsdGsdCsdCsdAsdGsdTsdCsmCsmAsmCsmAsmG 3' (SEQ ID NO: 14926). This antisense oligonucleotide targets nucleotide positions 50-69 of the human TSLP long-form mRNA (GenBank Acc. #NM 033035.5; SEQ ID NO: 14923). The short-form targeting antisense oligonucleotide consists of a sequence as follows: 5' mAsmGsmGsmTsmCsdAsdGsdGsdGsdTsdTsdGsd-AsdGsdTsmAsmGsmAsmGsmC 3' (SEQ ID NO: 14927). This antisense oligonucleotide targets nucleotide positions 43-62 of the human TSLP long-form mRNA (GenBank Acc. #NM 138551.4; SEQ ID NO: 14924). The non-targeting control antisense oligonucleotide consists of the following sequence: 5' mTsmCsmTsmAsmAsdCsdCsdGsd-AsdGsdCsdTsdGsdAsdTsmGsmGsmAsmCsmT 3' (SEQ ID NO: 14928). This transfection mixture is then mixed with 150,000 cells in 150 µl of transfection media and incubated for 4 h at 37° C. in a 5% CO2 incubator. Next, 120 µl of this mixture is added to the apical surface of the insert and incubated for 24 h at 37° C. in a 5% CO2 incubator.

Next, all media are aspirated from the apical surface of the insert and 500 µl of maintenance media is added to the basolateral side of the insert. The apical side of insert is washed three times with fresh media, and finally 20 ul of fresh apical media is added to each insert. Basolateral media is then supplemented with either +/−poly(I:C) (2.5 µg/mL) or +/−IL13 (10 ng/mL). Cells are then maintained for 7 days with 500 ul of basal and 20 ul of apical media, maintaining the indicated concentrations of poly(I:C) and IL13 in the basal media.

Apical supernatant is collected, cells are trypsinized, and cell lysates prepared using a RIPA buffer. The apical supernatant is used to perform a MUC5AC ELISA. Cell lysates are used to perform quantitative PCRs (RT-qPCR) or to perform Western blots using a TSLP antibody (Abcam) and a GAPDH antibody (Abcam) as a loading control.

Long-form and short-form TSLP, IL13, IL4, IL5, and TNF-alpha mRNA is quantified using real-time polymerase chain reaction. Total RNA is reverse transcribed to cDNA using a First-Strand III cDNA Synthesis kit (Invitrogen, Carlsbad, Calif.). Then, real-time quantitative polymerase chain reaction (PCR) is performed using the ABI Prism 7900 Sequence Detection System (Applied Biosystems, Foster City, Calif.). Amplification by PCR is performed according to the manufacturer's protocols (Applied Biosystems). Primers and probes for long and short-form TSLP and for β-actin are designed with the assistance of the computer program Primer Express (Applied Biosystems). Searches using a nucleotide basic local alignment search tool (BLASTN)

database are conducted to confirm their specificity and the absence of DNA polymorphisms.

MUC5AC protein is measured from apical culture supernatants using a semiquantitative sandwich ELISA with two different MUC5AC antibodies, one for coating and one for detection. Briefly, high binding plates are coated with Neomarkers (Fremont, Calif.) MUC5AC antibody (1-13M1) at 1 µg/ml. Neomarker MUC5AC antibody (45M1) labeled with biotin is used at 0.2-0.4 µg/ml for detection. The MUC5AC standard is generated from the apical supernatants of NHBECs under ALI and diluted 1/100 for the high standard followed by serial half dilution. Thus, all results are in relative arbitrary units per ml (AU/ml) and semiquantitative. Samples are studied without dilution or up to 1/4000 dilution depending on sample.

Example 5 siRNA Inhibition of Long and Short-Form TSLP in Primary Normal Human Bronchial Epithelial Cells (NHBEC) and an Immortalized Human Airway Epithelial Cell Line (A549)

In this experiment siRNA inhibition of long and short-form TSLP is performed in primary normal human bronchial epithelial cells (NHBEC) and an immortalized human airway epithelial cell line (A549), to evaluate the percent of knockdown achieved relative to control siRNA.

Adherent NHBECs and A549s actively growing in submerged liquid culture are transfected in a 24-well plate with a scrambled or long-form or short-form targeting siRNA immediately followed by +/−supplementation with poly(I:C) (2.5 µg/mL). The purpose of poly(I:C) supplementation is to induce expression of long and/or short-form TSLP. The long-form TSLP targeting siRNA consists of a double stranded RNA oligonucleotide with sense and antisense sequences as follows: 5'-CUGGUGUUAACUUACGA-CUdTdT-3' (SEQ ID NO: 14929) and 5'-AGU-CGUAAGUUAACACCAGdTdT-3' (SEQ ID NO: 14930). This siRNA targets nucleotide positions 251-279 of the human TSLP transcript variant 1 (NM 033035.5; SEQ ID NO: 14923). The short-form TSLP targeting siRNA consists of a double stranded RNA oligonucleotide with sense and antisense sequences as follows: 5'-CGUAAAC-UUUGCCGCCUAUdTdT-3' (SEQ ID NO: 14931) and 5'-AUAGGCGGCAAAGUUUACGdTdT-3' (SEQ ID NO: 14932). This siRNA targets nucleotide positions 173-191 of the human TSLP transcript variant 2 (NM 138551.4; SEQ ID NO: 14924). The non-targeting (control) siRNA consists of the following sense and antisense sequences: 5'-GUUGUA-CAGCAUGCGGAGAGUdTdT-3' (SEQ ID NO: 14933) and 5'-ACUCUCCGCAUGCUGUACAACdTdT-3' (SEQ ID NO: 14934). The letter d in front of a nucleotide indicates it is a deoxyribonucleotide. Briefly, transfections are performed using TransIT TKO (Mims) following the manufacturer's recommended protocol. For each well, 1.4 ul siRNA (1 mM stock), 2.5 ul TransIT-TKO, and 50 ul OptiMEM are mixed, incubated at room temperature for 30 minutes, and added dropwise to each well.

At 72 hrs post-transfection, supernatant is collected, cells are trypsinized, and cell lysates prepared using a RIPA buffer. Cell lysates are used to either perform a quantitative PCR (RT-qPCR) or to perform Western blots using a TSLP antibody (Abcam) and a GAPDH antibody (Abcam) as a loading control.

Long-form and short-form TSLP mRNA is quantified using real-time polymerase chain reaction. Total RNA is reverse transcribed to cDNA using a First-Strand III cDNA Synthesis kit (Invitrogen, Carlsbad, Calif.). Then, real-time quantitative polymerase chain reaction (PCR) is performed using the ABI Prism 7900 Sequence Detection System (Applied Biosystems, Foster City, Calif.). Amplification by PCR is performed according to the manufacturer's protocols (Applied Biosystems). Primers and probes for long and short-form TSLP and for β-actin are designed with the assistance of the computer program Primer Express (Applied Biosystems). Searches using a nucleotide basic local alignment search tool (BLASTN) database are conducted to confirm their specificity and the absence of DNA polymorphisms.

Example 6

Comparison of Th2 Inflammatory Response to Isoform Specific siRNA Inhibition of TSLP in NHBECs Differentiated at Air Liquid Interface (ALI)

In this experiment, reverse transfections of siRNA targeting long, short and long+short isoforms of TSLP are performed in NHBECs grown at air liquid interface. Cells are treated with inflammatory stimuli (poly(I:C) or IL13) to compare the effect of long, short, or long+short TSLP inhibition on Th2 cytokine production and mucous production.

Before transfection, precoated inserts are prepared by adding 100 µl of collagen (human placental collagen Type VI, Sigma-Aldrich) to the apical surface of Transwell permeable supports (0.33-cm2 0.4-m polyester membrane, Costar product no. 3470, Corning, Corning, N.Y.). To prepare for transfection, NHBECs growing on plastic are dissociated with 0.25% trypsin (Life Technologies) and washed with transfection media once.

For each well, 1.4 ul siRNA (1 mM stock), 2.5 ul TransIT-TKO, and 50 ul OptiMEM are mixed, incubated at room temperature for 30 minutes. The long-form TSLP targeting siRNA consists of a double stranded RNA oligonucleotide with sense and antisense sequences as follows: 5'-CUGGUGUUAACUUACGACUdTdT-3' (SEQ ID NO: 14929) and 5'-AGUCGUAAGUUAACACCAGdTdT-3' (SEQ ID NO: 14930). This siRNA targets nucleotide positions 251-279 of the human TSLP transcript variant 1 (NM 033035.5; SEQ ID NO: 14923). The short-form TSLP targeting siRNA consists of a double stranded RNA oligonucleotide with sense and antisense sequences as follows: 5'-CGUAAACUUUGCCGCCUAUdTdT-3' (SEQ ID NO: 14931) and 5'-AUAGGCGGCAAAGUUUACGdTdT-3' (SEQ ID NO: 14932). This siRNA targets nucleotide positions 173-191 of the human TSLP transcript variant 2 (NM 138551.4; SEQ ID NO: 14924). The scrambled (control) siRNA consists of the following sense and antisense sequences: 5'-GUUGUACAGCAUGCGGAGAGUdTdT-3' (SEQ ID NO: 14933) and 5'-AUAGGCGGCAAAGUUUACGdTdT-3' (SEQ ID NO: 14934). The letter d in front of a nucleotide indicates it is a deoxyribonucleotide. This transfection mixture is then mixed with 150,000 cells in 150 µl of transfection media and incubated for 4 h at 37° C. in a 5% CO2 incubator. Next, 120 µl of this mixture is added to the apical surface of the insert, and incubated for 24 h at 37° C. in a 5% CO2 incubator.

Next, all media are aspirated from the apical surface of the insert and 500 µl of maintenance media is added to the basolateral side of the insert. The apical side of insert is washed three times with fresh media, and finally 20 ul of fresh apical media is added to each insert. Basolateral media is then supplemented with either +/−poly(I:C) (2.5 µg/mL) or +/−IL13 (10 ng/mL). Cells are then maintained for 7 days with 500 ul of basal and 20 ul of apical media, maintaining the indicated concentrations of poly(I:C) and IL13 in the basal media.

Apical supernatant is collected, cells are trypsinized, and cell lysates prepared using a RIPA buffer. The apical supernatant is used to perform a MUCSAC ELISA. Cell lysates are used to perform quantitative PCRs (RT-qPCR) or to perform Western blots using a TSLP antibody (Abcam) and a GAPDH antibody (Abcam) as a loading control.

Long-form and short-form TSLP, IL13, IL4, IL5, and TNF-alpha mRNA is quantified using real-time polymerase chain reaction. Total RNA is reverse transcribed to cDNA using a First-Strand III cDNA Synthesis kit (Invitrogen, Carlsbad, Calif.). Then, real-time quantitative polymerase chain reaction (PCR) is performed using the ABI Prism 7900 Sequence Detection System (Applied Biosystems, Foster City, Calif.). Amplification by PCR is performed according to the manufacturer's protocols (Applied Biosystems). Primers and probes for long and short-form TSLP and for β-actin are designed with the assistance of the computer program Primer Express (Applied Biosystems). Searches using a nucleotide basic local alignment search tool (BLASTN) database are conducted to confirm their specificity and the absence of DNA polymorphisms.

MUCSAC protein is measured from apical culture supernatants using a semiquantitative sandwich ELISA with two different MUCSAC antibodies, one for coating and one for detection. Briefly, high binding plates are coated with Neomarkers (Fremont, Calif.) MUCSAC antibody (1-13M1) at 1 µg/ml. Neomarker MUCSAC antibody (45M1) labeled with biotin is used at 0.2-0.4 µg/ml for detection. The MUCSAC standard is generated from the apical supernatants of NHBECs under ALI and diluted 1/100 for the high standard followed by serial half dilution. Thus, all results are in relative arbitrary units per ml (AU/ml) and semiquantitative. Samples are studied without dilution or up to 1/4000 dilution depending on sample.

Example 7

Bioinformatic Selection of Sequences in Order to Identify Therapeutic siRNAs to Downmodulate Expression of TSLP mRNA Screening sets were defined based on bioinformatic analysis. Therapeutic siRNAs were designed to target human TSLP as well as the TSLP sequence of at least one toxicology-relevant species such as non-human primates (NHP). This type of analysis allowed identification siRNAs specific to 1fTSLP and sfTSLP. Drivers for the design of the screening sets were predicted specificity of the siRNAs against the transcriptome of the relevant species as well as cross-reactivity between species. Predicted specificity in human, rhesus monkey, cynomolgus monkey, mouse and rat was determined for sense (S) and antisense (AS) strands. These were assigned a "specificity score" which considers the likelihood of unintended downregulation of any other transcript by full or partial complementarity of an siRNA strand (up to 4 mismatches within positions 2-18) as well as the number and positions of mismatches. Thus, the predicted most likely off-target(s) for antisense and sense strand of each siRNA were identified. In addition, the number of potential off-targets was used as an additional specificity factor in the specificity score. As identified, siRNAs with high specificity and a low number of predicted off-targets provide a benefit of increased targeting specificity.

In addition to selecting siRNA sequences with high sequence specificity to TSLP mRNA, siRNA sequences within the seed region were analyzed for similarity to seed regions of known miRNAs. siRNAs can function in a miRNA like manner via base-pairing with complementary sequences within the 3'-UTR of mRNA molecules. The complementarity typically encompasses the 5'-bases at positions 2-7 of the miRNA (seed region). In order to circumvent siRNAs to act via functional miRNA binding sites, siRNA strands are avoided that contain natural miRNA seed regions. Seed regions identified in miRNAs from human, mouse, rat, rhesus monkey, dog, rabbit and pig are referred to as "conserved". Combining the "specificity score" with miRNA seed analysis yields the "specificity category". This was divided into categories 1-4, with 1 having the highest specificity and 4 having the lowest specificity. Each strand of the siRNA was assigned to a specificity category.

Species cross-reactivity was assessed for human, cynomolgus monkey, rhesus monkey, mouse, rat and dog. The analysis was based on a canonical siRNA design using 19 bases and 17 bases (without considering positions 1 and 19) for cross-reactivity. Full match as well as single mismatch analyses were included.

Analysis of the human Single Nucleotide Polymorphism (SNP) database (NCBI-DB-SNP) to identify siRNAs targeting regions with known SNPs was also carried out in order to identify siRNAs that may be non-functional in individuals containing the SNP. Information regarding the positions of SNPs within the target sequence as well as minor allele frequency (MAF) in case data was obtained in this analysis.

2,591 siRNAs (sense strand sequences: SEQ ID NOS: 14935-17526; antisense strand sequences: SEQ ID NOS: 26134-28725) were bioinformatically derived from human 1fTSLP mRNA (NM_033035.5, SEQ ID NO. 14923) without consideration of specificity or species cross-reactivity. These siRNAs are prepared by annealing the sense strand of any one of SEQ ID NOS: 14935-17526 with its corresponding antisense strand among SEQ ID NOS: 26134-28725. In addition, "U" may be substituted for "T" in the sense and antisense strands. A subset of these sequences is also cross-reactive with human sfTSLP.

Prioritizing siRNA sequences for target specificity, species cross-reactivity, miRNA seed region sequences and SNPs yielded a set of siRNAs specific for 1fTSLP only (not sfTSLP). This subset included 88 siRNAs with sense strands in accordance with SEQ ID NOS: 14941, 14942, 14947, 14948, 14950, 14957, 14959, 14960, 14961, 14962, 14973, 15004, 15005, 15013, 15035, 15039, 15040, 15041, 15043, 15047, 15048, 15049, 15050, 15051, 15052, 15056, 15057, 15059, 15062, 15082, 15094, 15096, 15097, 15098, 15101, 15102, 15107, 15108, 15111, 15114, 15117, 15123, 15127, 15128, 15164, 15174, 15178, 15184, 15186, 15187, 15188, 15190, 15191, 15194, 15195, 15197, 15230, 15235, 15236, 15238, 15240, 15241, 15246, 15252, 15253, 15260, 15263, 15264, 15272, 15274, 15276, 15278, 15279, 15282, 15283, 15286, 15294, 15302, 15303, 15307, 15310, 15314, 15319, 15320, 15321, 15322, 15324, and 15326; and antisense strands in accordance with SEQ ID NOS: 26140, 26141, 26146, 26147, 26149, 26156, 26158, 26159, 26160, 26161, 26172, 26203, 26204, 26212, 26234, 26238, 26239, 26240, 26242, 26246, 26247, 26248, 26249, 26250, 26251, 26255, 26256, 26258, 26261, 26281, 26293, 26295, 26296, 26297, 26300, 26301, 26306, 26307, 26310, 26313, 26316, 26322, 26326, 26327, 26363, 26373, 26377, 26383, 26385, 26386, 26387, 26389, 26390, 26393, 26394, 26396, 26429, 26434, 26435, 26437, 26439, 26440, 26445, 26451, 26452, 26459, 26462, 26463, 26471, 26473, 26475, 26477, 26478, 26481, 26482, 26485, 26493, 26501, 26502, 26506, 26509, 26513, 26518, 26519, 26520, 26521, 26523, and 26525. These siRNAs tend to target sequences within the first 412 nucleotides of SEQ ID NO: 14923, particularly with nucleotides 8-412 of SEQ ID NO: 14923.

The siRNAs in this subset have the following characteristics:
Cross-reactivity: With 19 mer in human 1fTSLP mRNA
Specificity category: For human: AS2 or better, SS3 or better
miRNA seeds: AS+SS strand: seed region not conserved in human, mouse, and rat and not present in >3 species
Off-target frequency: ≤20 human off-targets matched with 2 mismatches in antisense strand
SNPs: siRNA target sites do not harbor SNPs with a MAF≥1% (pos. 2-18)

195 siRNAs (sense strand sequences: SEQ ID NOS: 22711-22906; antisense strand sequences: SEQ ID NOS: 28726-28921) specific for human sfTSLP mRNA (NM 138551.4, SEQ ID NO. 14924) were bioinformatically derived without consideration of specificity or species cross-reactivity. These siRNAs are prepared by annealing the sense strand of any one of SEQ ID NOS: 22711-22906 with its corresponding antisense strand among SEQ ID NOS: 28726-28921. In addition, "U" may be substituted for "T" in the sense and antisense strands.

Prioritizing siRNA sequences for target specificity, species cross-reactivity, miRNA seed region sequences and SNPs yielded a set of siRNAs specific for sfTSLP only. This subset included 37 siRNAs having sense strands in accordance with SEQ ID NOS: 22734, 22736, 22738, 22746, 22773, 22778, 22780, 22781, 22782, 22783, 22785, 22786, 22787, 22788, 22789, 22790, 22824, 22825, 22827, 22828, 22872, 22873, 22874, 22876, 22877, 22879, 22880, 22881, 22882, 22884, 22885, 22887, 22889, 22890, 22895, 22898, and 22904; and having antisense strands in accordance with SEQ ID NOS: 28749, 28751, 28753, 28761, 28788, 28793, 28795, 28796, 28797, 28798, 28800, 28801, 28802, 28803, 28804, 28805, 28839, 28840, 28842, 28843, 28887, 28888, 28889, 28891, 28892, 28894, 28895, 28896, 28897, 28899, 28900, 28902, 28904, 28905, 28910, 28913, and 28919.

The siRNAs in this subset have the following characteristics:
Cross-reactivity: With 19 mer in human sfTSLP mRNA
Specificity category: For human: AS2 or better, SS3 or better
miRNA seeds: AS+SS strand: seed region not conserved in human, mouse, and rat and not present in >3 species
Off-target frequency: ≤20 human off-targets matched with 2 mismatches in antisense strand
SNPs: siRNA target sites do not harbor SNPs with a MAF≥1% (pos. 2-18)

Example 8

Chemically Modified TSLP siRNAs

The siRNAs targeting 1fTSLP can be synthesized with chemical modifications with the sense strand having modification pattern 1S, and the antisense strand having modification pattern 1AS. "N" can be any nucleoside (for example ribose, deoxyribose, or derivatives thereof), "Nf" is a 2' fluoro-modified nucleoside, "n" is a 2' O-methyl modified nucleoside, and "s" is a phosphorothioate linkage. In addition, adenosine can be placed at position 19 in the sense strand and uridine at position 1 in the antisense strand. Some siRNAs that may include these chemical modifications comprise sequences of any of SEQ ID NOs: 17527-20118 or 28922-31513.

The siRNAs targeting 1fTSLP can also be synthesized with chemical modifications with the sense strand having modification pattern 2S, and the antisense strand having modification pattern 3AS. "N" can be any nucleoside (for example ribose, deoxyribose, or derivatives thereof), "Nf" is a 2' fluoro-modified nucleoside, "n" is a 2' O-methyl modified nucleoside, and "s" is a phosphorothioate linkage. In addition, adenosine can be placed at position 19 in the sense strand and uridine at position 1 in the antisense strand. Some siRNAs that may include these chemical modifications comprise sequences of any of SEQ ID NOs: 20119-22710 or 31514-34105.

The siRNAs targeting sfTSLP can be synthesized with chemical modifications with the sense strand having modification pattern 1S, and the antisense strand having modification pattern 1AS. "N" can be any nucleoside (for example ribose, deoxyribose, or derivatives thereof), "Nf" is a 2' fluoro-modified nucleoside, "n" is a 2' O-methyl modified nucleoside, and "s" is a phosphorothioate linkage. In addition, adenosine can be placed at position 19 in the sense strand and uridine at position 1 in the antisense strand. Some siRNAs that may include these chemical modifications comprise sequences of any of SEQ ID NOs: 22907-23102 or 34106-34301.

The siRNAs targeting sfTSLP can also be synthesized with chemical modifications with the sense strand having modification pattern 2S, and the antisense strand having modification pattern 3AS. "N" can be any nucleoside (for example ribose, deoxyribose, or derivatives thereof), "Nf" is a 2' fluoro-modified nucleoside, "n" is a 2' O-methyl modified nucleoside, and "s" is a phosphorothioate linkage. In addition, adenosine can be placed at position 19 in the sense strand and uridine at position 1 in the antisense strand. Some siRNAs that may include these chemical modifications comprise sequences of any of SEQ ID NOs: 23103-23298 or 34302-34497.

Example 9

Screening TSLP siRNAs for Activity in Cells in Culture

To facilitate screening of TSLP siRNAs, target sequence unique to 1fTSLP (nucleotide positions 1-410 of NM_033035.5 [SEQ ID NO: 14923]) and target sequence unique to sfTSLP (nucleotide positions 1-212 of NM_138551.4 [SEQ ID NO: 14924]) were each cloned as a single fragment into XhoI and NotI sites in a psiCheck-2 plasmid (Promega, Catalog #C8021, GenBank Accession #AY535007). These sequences are located downstream of a stop codon of a gene encoding Renilla luciferase. This way, the activity of the siRNAs could be measured by the degree of reduction of Renilla luciferase activity relative to the activity of the reference firefly luciferase encoded on the same plasmid.

Chemically modified TSLP siRNAs specifically targeting 1fTSLP (sense strand sequences: SEQ ID NOs: 25890-25977; antisense strand sequences: SEQ ID NOs: 26012-26099) or specifically targeting sfTSLP (sense strand sequences: SEQ ID NOs: 25978-26011; antisense strand sequences: SEQ ID NOs: 26100-26133) were assayed for activity. The siRNAs targeting 1fTSLP tend to target sequences within the first 412 nucleotides of SEQ ID NO:

14923, particularly with nucleotides 8-412 of SEQ ID NO: 14923. HEK-293 cells (ATCC No. CRL-1573), a human derived cell line that is easily transfected, were seeded in 96-well tissue culture plates at a cell density of 10,000 cells per well in 90% DMEM supplemented with 10% fetal bovine serum and incubated overnight in a water-jacketed, humidified incubator at 37° C. in an atmosphere of air plus 5% carbon dioxide. PsiCheck-2 plasmids encoding the 1fTSLP and sfTSLP sequences were transfected into cells in triplicate wells at a final concentration of 0.2 ug DNA using 0.3 uL TransIT-2020 (Mims Bio, Catalog #MIR5404). Cells were allowed to recover in a humidified incubator at 37° C. for 4 hours, after which the media was replaced with a fresh 100 uL 90% DMEM supplemented with 10% fetal bovine serum. The TSLP siRNAs were then individually transfected into cells in triplicate wells at a 3 nM final concentration using 0.3 uL Lipofectamine RNAiMax (ThermoFisher, Catalog #13778150) per well. Silencer Select Negative Control #1 (ThermoFisher, Catalog #4390843) and Silencer Select TSLP siRNA s34500 (ThermoFisher, Catalog #4392420) were transfected at a 3 nM final concentration as controls. After incubation for 48 hours at 37° C., cells were lysed and luciferase reporter luminescence developed using the Dual-Luciferase® Reporter Assay System (Promega, Catalog #E1980). Luciferase activity was measured in the GloMax Discover plate reader (Promega, Catalog #GM3000). The ratio of Renilla luciferase activity to reference firefly luciferase activity in each well was calculated. All data was normalized to the Renilla to firefly luminescence ratio in HEK-293 cells transfected only with the psiCheck-2 plasmid encoding the TSLP screening sequence. The data are shown in Table 3. These data show a surprising effect of some siRNAs to specifically knock down 1fTSLP or sfTSLP, in comparison with other siRNAs.

TABLE 3

Knockdown Activity of lfTSLP-Specific and sfTSLP-Specific siRNAs at 3 nM

| siRNA name | Sense Strand (SEQ ID NO) | Antisense Strand (SEQ ID NO) | Relative Knockdown |
|---|---|---|---|
| No siRNA | — | — | 1.00 |
| Silencer Select Negative Control #1 | — | — | 1.12 |
| Silencer Select Positive Control #1 | — | — | 0.47 |
| ETD00001 | 25890 | 26012 | 2.50 |
| ETD00002 | 25891 | 26013 | 0.75 |
| ETD00003 | 25892 | 26014 | 0.89 |
| ETD00004 | 25893 | 26015 | 0.84 |
| ETD00005 | 25894 | 26016 | 0.53 |
| ETD00006 | 25895 | 26017 | 0.69 |
| ETD00007 | 25896 | 26018 | 0.69 |
| ETD00008 | 25897 | 26019 | 1.16 |
| ETD00009 | 25898 | 26020 | 1.27 |
| ETD00010 | 25899 | 26021 | 1.50 |
| ETD00011 | 25900 | 26022 | 1.30 |
| ETD00012 | 25901 | 26023 | 0.73 |
| ETD00013 | 25902 | 26024 | 1.25 |
| ETD00014 | 25903 | 26025 | 1.98 |
| ETD00015 | 25904 | 26026 | 0.85 |
| ETD00016 | 25905 | 26027 | 0.56 |
| ETD00017 | 25906 | 26028 | 0.90 |
| ETD00018 | 25907 | 26029 | 0.37 |
| ETD00019 | 25908 | 26030 | 0.67 |
| ETD00020 | 25909 | 26031 | 0.52 |
| ETD00021 | 25910 | 26032 | 0.13 |
| ETD00022 | 25911 | 26033 | 0.65 |
| ETD00023 | 25912 | 26034 | 0.61 |
| ETD00024 | 25913 | 26035 | 0.37 |
| ETD00025 | 25914 | 26036 | 0.91 |
| ETD00026 | 25915 | 26037 | 1.43 |
| ETD00027 | 25916 | 26038 | 0.83 |
| ETD00028 | 25917 | 26039 | 0.87 |
| ETD00029 | 25918 | 26040 | 3.61 |
| ETD00030 | 25919 | 26041 | 0.38 |
| ETD00031 | 25920 | 26042 | 0.52 |
| ETD00032 | 25921 | 26043 | 0.34 |
| ETD00033 | 25922 | 26044 | 0.54 |
| ETD00034 | 25923 | 26045 | 0.55 |
| ETD00035 | 25924 | 26046 | 0.98 |
| ETD00036 | 25925 | 26047 | 0.55 |
| ETD00037 | 25926 | 26048 | 0.69 |
| ETD00038 | 25927 | 26049 | 0.54 |
| ETD00039 | 25928 | 26050 | 0.48 |
| ETD00040 | 25929 | 26051 | 0.48 |
| ETD00041 | 25930 | 26052 | 4.17 |
| ETD00042 | 25931 | 26053 | 0.35 |
| ETD00043 | 25932 | 26054 | 0.52 |
| ETD00044 | 25933 | 26055 | 0.48 |
| ETD00045 | 25934 | 26056 | 0.75 |
| ETD00046 | 25935 | 26057 | 1.35 |
| ETD00047 | 25936 | 26058 | 1.15 |
| ETD00048 | 25937 | 26059 | 0.51 |
| ETD00049 | 25938 | 26060 | 0.62 |
| ETD00050 | 25939 | 26061 | 0.29 |
| ETD00051 | 25940 | 26062 | 0.50 |
| ETD00052 | 25941 | 26063 | 0.81 |
| ETD00053 | 25942 | 26064 | 0.76 |
| ETD00054 | 25943 | 26065 | 0.31 |
| ETD00055 | 25944 | 26066 | 0.49 |
| ETD00056 | 25945 | 26067 | 1.59 |
| ETD00057 | 25946 | 26068 | 0.34 |
| ETD00058 | 25947 | 26069 | 0.48 |
| ETD00059 | 25948 | 26070 | 0.53 |
| ETD00060 | 25949 | 26071 | 0.25 |
| ETD00061 | 25950 | 26072 | 1.35 |
| ETD00062 | 25951 | 26073 | 0.25 |
| ETD00063 | 25952 | 26074 | 0.65 |
| ETD00064 | 25953 | 26075 | 0.33 |
| ETD00065 | 25954 | 26076 | 1.18 |
| ETD00066 | 25955 | 26077 | 0.88 |
| ETD00067 | 25956 | 26078 | 0.88 |
| ETD00068 | 25957 | 26079 | 1.01 |
| ETD00069 | 25958 | 26080 | 0.34 |
| ETD00070 | 25959 | 26081 | 0.98 |
| ETD00071 | 25960 | 26082 | 0.55 |
| ETD00072 | 25961 | 26083 | 0.46 |
| ETD00073 | 25962 | 26084 | 0.86 |
| ETD00074 | 25963 | 26085 | 1.15 |
| ETD00075 | 25964 | 26086 | 0.74 |
| ETD00076 | 25965 | 26087 | 0.98 |
| ETD00077 | 25966 | 26088 | 0.81 |
| ETD00078 | 25967 | 26089 | 0.50 |
| ETD00079 | 25968 | 26090 | 1.48 |
| ETD00080 | 25969 | 26091 | 0.45 |
| ETD00081 | 25970 | 26092 | 0.94 |
| ETD00082 | 25971 | 26093 | 0.69 |
| ETD00083 | 25972 | 26094 | 1.12 |
| ETD00084 | 25973 | 26095 | 1.02 |
| ETD00085 | 25974 | 26096 | 1.13 |
| ETD00086 | 25975 | 26097 | 0.75 |
| ETD00087 | 25976 | 26098 | 0.55 |
| ETD00088 | 25977 | 26099 | 0.36 |
| ETD00089 | 25978 | 26100 | 0.51 |
| ETD00090 | 25979 | 26101 | 0.64 |
| ETD00091 | 25980 | 26102 | 0.52 |
| ETD00092 | 25981 | 26103 | 0.53 |
| ETD00093 | 25982 | 26104 | 0.46 |
| ETD00094 | 25983 | 26105 | 0.41 |
| ETD00095 | 25984 | 26106 | 0.84 |
| ETD00096 | 25985 | 26107 | 0.97 |
| ETD00098 | 25986 | 26108 | 0.97 |
| ETD00099 | 25987 | 26109 | 0.78 |
| ETD00100 | 25988 | 26110 | 1.28 |

TABLE 3-continued

Knockdown Activity of lfTSLP-Specific and sfTSLP-Specific siRNAs at 3 nM

| siRNA name | Sense Strand (SEQ ID NO) | Antisense Strand (SEQ ID NO) | Relative Knockdown |
|---|---|---|---|
| ETD00101 | 25989 | 26111 | 1.57 |
| ETD00102 | 25990 | 26112 | 0.66 |
| ETD00103 | 25991 | 26113 | 0.90 |
| ETD00104 | 25992 | 26114 | 0.67 |
| ETD00105 | 25993 | 26115 | 0.83 |
| ETD00106 | 25994 | 26116 | 0.86 |
| ETD00107 | 25995 | 26117 | 0.73 |
| ETD00108 | 25996 | 26118 | 0.85 |
| ETD00109 | 25997 | 26119 | 0.82 |
| ETD00110 | 25998 | 26120 | 0.28 |
| ETD00111 | 25999 | 26121 | 0.57 |
| ETD00112 | 26000 | 26122 | 0.57 |
| ETD00113 | 26001 | 26123 | 1.19 |
| ETD00114 | 26002 | 26124 | 0.94 |
| ETD00115 | 26003 | 26125 | 0.64 |
| ETD00116 | 26004 | 26126 | 1.38 |
| ETD00117 | 26005 | 26127 | 0.67 |
| ETD00118 | 26006 | 26128 | 0.91 |
| ETD00119 | 26007 | 26129 | 0.81 |
| ETD00120 | 26008 | 26130 | 0.81 |
| ETD00123 | 26009 | 26131 | 0.93 |
| ETD00124 | 26010 | 26132 | 0.49 |
| ETD00125 | 26011 | 26133 | 0.52 |

The TSLP siRNAs showing the greatest degree of knockdown of TSLP mRNA at 3 nM were tested in a second screen for activity at 10 nM concentration using the transfection procedures as described above. The data are shown in Table 4. These data validate the effectiveness of the siRNAs in the table to specifically knock down 1fTSLP or sfTSLP.

TABLE 4

Knockdown Activity of Some lfTSLP-Specific and sfTSLP-Specific siRNAs at 10 nM

| siRNA name | Sense Strand (SEQ ID NO) | Antisense Strand (SEQ ID NO) | Relative Knockdown |
|---|---|---|---|
| No siRNA | — | — | 1 |
| Silencer Select Negative Control #1 | — | — | 0.85 |
| Silencer Select Positive Control #1 | — | — | 0.32 |
| ETD00018 | 25907 | 26029 | 0.32 |
| ETD00021 | 25910 | 26032 | 0.31 |
| ETD00024 | 25913 | 26035 | 0.46 |
| ETD00030 | 25919 | 26041 | 0.44 |
| ETD00032 | 25921 | 26043 | 0.35 |
| ETD00039 | 25928 | 26050 | 0.59 |
| ETD00040 | 25929 | 26051 | 0.53 |
| ETD00042 | 25931 | 26053 | 0.3 |
| ETD00044 | 25933 | 26055 | 0.4 |
| ETD00050 | 25939 | 26061 | 0.2 |
| ETD00054 | 25943 | 26065 | 0.42 |
| ETD00057 | 25946 | 26068 | 0.21 |
| ETD00058 | 25947 | 26069 | 0.19 |
| ETD00060 | 25949 | 26071 | 0.35 |
| ETD00062 | 25951 | 26073 | 0.47 |
| ETD00064 | 25953 | 26075 | 0.44 |
| ETD00069 | 25958 | 26080 | 0.29 |
| ETD00072 | 25961 | 26083 | 0.37 |
| ETD00080 | 25969 | 26091 | 0.22 |
| ETD00088 | 25977 | 26099 | 0.22 |
| ETD00093 | 25982 | 26104 | 0.24 |
| ETD00094 | 25983 | 26105 | 0.29 |
| ETD00110 | 25998 | 26120 | 0.24 |
| ETD00124 | 26010 | 26132 | 0.54 |

Example 10

Activity of 1fTSLP siRNAs Against Endogenously Expressed TSLP mRNA

To further confirm activity of 1fTSLP siRNAs screened using the psiCheck-2 TSLP luciferase assay, siRNA activity was tested in a human derived cell line LN-18 that expresses TSLP (ATCC No. CRL-2610). Cells were seeded in 96-well tissue culture plates at a cell density of 10,000 cells per well in 95% DMEM supplemented with 5% fetal bovine serum and incubated overnight in a water-jacketed, humidified incubator at 37° C. in an atmosphere composed of air plus 5% carbon dioxide. The TSLP siRNAs were individually transfected into cells in triplicate wells at a 10 nM final concentration using 0.3 uL Lipofectamine RNAiMax (ThermoFisher, Catalog #13778150) per well. Silencer Select Negative Control #1 (ThermoFisher, Catalog #4390843) and Silencer Select TSLP siRNA s34500 (ThermoFisher, Catalog #4392420) were transfected at a 10 nM final concentration as controls. After incubation for 48 hours at 37° C., total RNA was harvested from each well and cDNA prepared using TaqMan® Fast Advanced Cells-to-CT™ Kit (ThermoFisher, Catalog #A35374) according to the manufacturer's instructions. The level of TSLP mRNA from each well was measured in triplicate by real-time qPCR on an Applied Biosystems 7500 Fast Real-Time PCR machine using TaqMan Gene Expression Assay for human TSLP (ThermoFisher, assay #Hs01572934_g1). The level of PPIA mRNA was measured using TaqMan Gene Expression Assay (ThermoFisher, assay #Hs99999904_m1) and used to determine relative TSLP mRNA levels in each well using the delta-delta Ct method. All data was normalized to relative TSLP mRNA levels in untreated LN-18 cells. The data are shown in Table 5. These data show a further surprising effect of some siRNAs to specifically knock down 1fTSLP or sfTSLP, in comparison with other siRNAs, in cells that endogenously express TSLP.

TABLE 5

Knockdown Activity of Select lfTSLP-Specific siRNAs at 10 nM in LN-18 Cells

| siRNA name | Sense Strand (SEQ ID NO) | Antisense Strand (SEQ ID NO) | Relative Knockdown |
|---|---|---|---|
| No siRNA | — | — | 1 |
| Silencer Select Negative Control #1 | — | — | 0.55 |
| Silencer Select Positive Control #1 | — | — | 0.15 |
| ETD00018 | 25907 | 26029 | 1.04 |
| ETD00021 | 25910 | 26032 | 0.52 |
| ETD00024 | 25913 | 26035 | 0.64 |
| ETD00030 | 25919 | 26041 | 0.8 |
| ETD00032 | 25921 | 26043 | 0.54 |
| ETD00039 | 25928 | 26050 | 0.57 |
| ETD00040 | 25929 | 26051 | 0.59 |
| ETD00042 | 25931 | 26053 | 0.37 |
| ETD00044 | 25933 | 26055 | 0.74 |
| ETD00050 | 25939 | 26061 | 1.92 |
| ETD00054 | 25943 | 26065 | 0.21 |
| ETD00057 | 25946 | 26068 | 0.23 |
| ETD00058 | 25947 | 26069 | 0.24 |
| ETD00060 | 25949 | 26071 | 0.2 |
| ETD00062 | 25951 | 26073 | 0.26 |
| ETD00064 | 25953 | 26075 | 0.38 |
| ETD00069 | 25958 | 26080 | 0.4 |
| ETD00072 | 25961 | 26083 | 0.49 |
| ETD00080 | 25969 | 26091 | 0.25 |
| ETD00088 | 25977 | 26099 | 0.3 |

Example 11

Determining the IC50 of 1fTSLP siRNAs

The IC50 values for knockdown of TSLP mRNA by select TSLP siRNAs shown to possess high knockdown in the activity screen will be determined by assaying individual siRNAs at 3 nM, 1 nM, 0.3 nM, 0.1 nM and 0.03 nM. A human derived cell line that expresses TSLP such as LN-18 (ATCC No. CRL-2610) is to be seeded in 96-well tissue culture plates at a cell density of 10,000 cells per well in 95% DMEM supplemented with 5% fetal bovine serum and incubated overnight in a water-jacketed, humidified incubator at 37° C. in an atmosphere composed of air plus 5% carbon dioxide. The TSLP siRNAs will be individually transfected into cells in triplicate wells using 0.3 uL Lipofectamine RNAiMax (ThermoFisher, Catalog #13778150) per well. Silencer Select Negative Control #1 (ThermoFisher, Catalog #4390843) is to be transfected at 3 nM final concentration as a control. After incubation for 48 hours at 37° C., total RNA is harvested from each well and cDNA prepared using TaqMan® Fast Advanced Cells-to-CT™ Kit (ThermoFisher, Catalog #A35374) according to the manufacturer's instructions. The level of TSLP mRNA from each well is measured in triplicate by real-time qPCR on an Applied Biosystems 7500 Fast Real-Time PCR machine using TaqMan Gene Expression Assay for human TSLP (ThermoFisher, assay #Hs01572934 g1). The level of PPIA mRNA is measured using TaqMan Gene Expression Assay (ThermoFisher, assay #Hs99999904 m1) and used to determine relative TSLP mRNA levels in each well using the delta-delta Ct method. All data are normalized to relative TSLP mRNA levels in untreated cells. Curve fit is accomplish using the [inhibitor] vs. response (three parameters) function in GraphPad Prism software.

Example 12

Assessing the Extent of Nuclease Resistance of TSLP siRNAs

TSLP siRNAs that possess high activity and low IC50 values will be tested for resistance to nuclease digestion by incubating the siRNAs in rat liver tritosomes. In addition to these TSLP siRNAs, corresponding versions of these TSLP siRNAs possessing alternative chemical modification patterns will also be tested, for example those corresponding 1fTSLP siRNAs with sense strands having modification pattern 2S and sequences in accordance with SEQ ID NOs: 20125, 20126, 20131, 20132, 20134, 20141, 20143, 20144, 20145, 20146, 20157, 20188, 20189, 20197, 20219, 20223, 20224, 20225, 20227, 20231, 20232, 20233, 20234, 20235, 20236, 20240, 20241, 20243, 20246, 20266, 20278, 20280, 20281, 20282, 20285, 20286, 20291, 20292, 20295, 20298, 20301, 20307, 20311, 20312, 20348, 20358, 20362, 20368, 20370, 20371, 20372, 20374, 20375, 20378, 20379, 20381, 20414, 20419, 20420, 20422, 20424, 20425, 20430, 20436, 20437, 20444, 20447, 20448, 20456, 20458, 20460, 20462, 20463, 20466, 20467, 20470, 20478, 20486, 20487, 20491, 20494, 20498, 20503, 20504, 20505, 20506, 20508, or 20510, and antisense strand having modification pattern 3AS and sequences in accordance with SEQ ID NOs: 31520, 31521, 31526, 31527, 31529, 31536, 31538, 31539, 31540, 31541, 31552, 31583, 31584, 31592, 31614, 31618, 31619, 31620, 31622, 31626, 31627, 31628, 31629, 31630, 31631, 31635, 31636, 31638, 31641, 31661, 31673, 31675, 31676, 31677, 31680, 31681, 31686, 31687, 31690, 31693, 31696, 31702, 31706, 31707, 31743, 31753, 31757, 31763, 31765, 31766, 31767, 31769, 31770, 31773, 31774, 31776, 31809, 31814, 31815, 31817, 31819, 31820, 31825, 31831, 31832, 31839, 31842, 31843, 31851, 31853, 31855, 31857, 31858, 31861, 31862, 31865, 31873, 31881, 31882, 31886, 31889, 31893, 31898, 31899, 31900, 31901, 31903, or 31905; or 1fTSLP siRNAs with sense strands having modification pattern 2S and sequences in accordance with any of SEQ ID NOs: 23103-23298, and antisense strand having Modification Pattern 3AS and sequences in accordance with any of SEQ ID NOs: 34302-34497, including sfTSLP siRNAs with sense strands having Modification Pattern 2S and sequences in accordance with SEQ ID NOs: 23126, 23128, 23130, 23138, 23165, 23170, 23172, 23173, 23174, 23175, 23177, 23178, 23179, 23180, 23181, 23182, 23216, 23217, 23219, 23220, 23264, 23265, 23266, 23268, 23269, 23271, 23272, 23273, 23274, 23276, 23277, 23279, 23281, 23282, 23287, 23290, or 23296, and antisense strand having modification pattern 3AS and sequences in accordance with SEQ ID NOs: 34521, 34523, 34525, 34533, 34560, 34565, 34567, 34568, 34569, 34570, 34572, 34573, 34574, 34575, 34576, 34577, 34611, 34612, 34614, 34615, 34659, 34660, 34661, 34663, 34664, 34666, 34667, 34668, 34669, 34671, 34672, 34674, 34676, 34677, 34682, 34685, or 34691. Each siRNA (14 ng/uL final concentration) will be placed into a PCR tube on ice containing 1× catabolic buffer (Xenotech, Catalog #K5200, Lot #18-1-0698), 0.5× rat tritosomes (Xenotech, Catalog #R0610.LT or Lot #1610405), 0.1 U/uL porcine intestinal heparin (Zageno, Catalog #H3149-10KU) in a total volume of 33 uL. An 10 uL aliquot is to be removed, an equal volume of 50 mM EDTA bill be added and the aliquot is placed at −80° C. This sample is designated as the 0 hr timepoint. The remainder of the reaction is placed in an Eppendorf Mastercycler Gradient and incubated at 37° C. Aliquots are removed after incubation for 4 and 24 hours, placed in an equal volume of 50 mM EDTA and stored at −80° C. until analysis by gel electrophoresis. All samples are then to be thawed on ice and 6×DNA Gel Loading Dye (ThermoFisher Catalog #R0611) is added to 1× final concentration. 10 uL of each sample is loaded onto a 20% polyacrylamide TBE gel (ThermoFisher, Catalog #EC63155BOX). Electrophoresis is carried out at a constant 100V for 75 minutes in an XCell SureLock Mini-Cell Electrophoresis System (ThermoFisher) using 1×TBE (Tris/boric/EDTA) (Fisher, Catalog #FERB52) as the tank buffer. The siRNA is visualized by staining the gel with a 1:10,000 dilution of SYBR Gold (ThermoFisher, Catalog #S-11494) in TBE for 15 minutes at room temperature with rocking. The gel is to be washed with 1×TBE for 15 minutes and then placed on a FotoPrep1 UV transilluminator (Fotodyne). The gel will be imaged using the camera app set on MONO on an iPhone 6s with a yellow gel filter (Neewer) placed over the lens. Band intensity is measured using NIH ImageJ using the "Analyze: Gels" function. The remaining siRNA percent is to be normalized to the value obtained at the 0 hr timepoint for that siRNA. This assay will provide the benefit of helping to determine that some siRNAs are more resistant to nuclease digestion with more remaining intact over time compared with other siRNAs.

Example 13

Screening TSLP Antisense Oligonucleotides (ASOs) for Activity in Cells in Culture Chemically modified TSLP ASOs with nucleoside sequences in accordance with SEQ ID NOs: 23299-25889 may be derived from the ASO sequences with nucleoside sequences in accordance with SEQ ID NOs: 9971-12561 and target human 1fTSLP pre-mRNA sequence (SEQ ID NO: 14923). They may have modification pattern 5'-nsnsnsnsnsdNsdNsdNsdNsdNsdNsdNsdNsdNsdNsnsnsn snsn-3' (SEQ ID NO: 34506) where "dN" is any deoxynucleotide, "n" is a 2'O-methyl or 2'O-methoxyethyl-modified nucleoside, and "s" is a phosphorothioate linkage. These modified ASOs are to be assayed for TSLP mRNA reduction activity in cells in culture. A human derived cell line that expresses TSLP such as LN-18 (ATCC No. CRL-2610) will be seeded in 96-well tissue culture plates at a cell density of 10,000 cells per well in 95% DMEM supplemented with 5% fetal bovine serum and incubated overnight in a water-jacketed, humidified incubator at 37° C. in an atmosphere composed of air plus 5% carbon dioxide. The TSLP ASOs are to be individually transfected into cells in duplicate wells at 1 uM final concentration using 0.3 uL Lipofectamine RNAiMax (ThermoFisher, Catalog #13778150) per well. A negative control ASO (SEQ ID NO: 14928) is also transfected at 1 uM final concentration. After incubation for 48 hours at 37° C., total RNA is harvested from each well and cDNA prepared using TaqMan® Fast Advanced Cells-to-CT™ Kit (ThermoFisher, Catalog #A35374) according to the manufacturer's instructions. The level of TSLP mRNA from each well is measured in triplicate by real-time qPCR on an Applied Biosystems 7500 Fast Real-Time PCR machine using TaqMan Gene Expression Assay for human TSLP (ThermoFisher, assay #Hs01572934 g1). The level of PPIA mRNA is measured using TaqMan Gene Expression Assay (ThermoFisher, assay #Hs99999904_m1) and used to determine relative TSLP mRNA levels in each well using the delta-delta Ct method. All data is normalized to relative TSLP mRNA levels in untreated LN-18 cells.

The TSLP ASOs showing the greatest degree of knockdown of TSLP mRNA at 1 uM will be tested in a second screen for activity at 100 nM concentration using the transfection procedures as described above.

Example 14

Inhibition of 1fTSLP in a Clinical Trial Using siRNA and ASO Specific for 1fTSLP In this study, human subjects with asthma, nasal polyps, allergic rhinitis, and chronic rhinosinusitis are to be used to evaluate the effect of siRNA or single-stranded ASO inhibition of 1fTSLP in the airway. Fifteen groups of subjects will be assessed (n=10/group) in the study: normal control subjects with a control oligonucleotide, normal control subjects with a siRNA oligonucleotide, normal control subjects with a single-stranded ASO oligonucleotide, asthma subjects with a control oligonucleotide, asthma subjects with a siRNA oligonucleotide, asthma subjects with a single-stranded ASO oligonucleotide, nasal polyps subjects with a control oligonucleotide, nasal polyps subjects with a siRNA oligonucleotide, nasal polyps subjects with a single-stranded ASO oligonucleotide, allergic rhinitis subjects with a control oligonucleotide, allergic rhinitis subjects with a siRNA oligonucleotide, allergic rhinitis subjects with a single-stranded ASO oligonucleotide, chronic rhinosinusitis subjects with a control oligonucleotide, chronic rhinosinusitis subjects with a siRNA oligonucleotide, and chronic rhinosinusitis subjects with a ASO oligonucleotide. Each subject will be given 10 biweekly aerosol applications of the control oligonucleotide, the siRNA oligonucleotide, or the single-stranded ASO oligonucleotide to the subject's airway. The siRNA oligonucleotide sequences are chosen from Table 5, and the ASO oligonucleotide sequences are to be chosen from the ASO sequences that show the most inhibition of 1fTSLP in screening assays (Example 13). Subjects' airways will be observed, and blood samples will be collected at baseline and at 3, 6, and 12 weeks of the study, and analyzed for decreases in the size or number of nasal polyps, airway constriction, blood eosinophil numbers, airway inflammation, and serum inflammation markers. In addition, cheek skin samples will be collected for assessment of 1fTSLP mRNA levels.

It is expected that subjects treated with the siRNA and single-stranded ASO oligonucleotides, but not the control oligonucleotide, will have reductions in the size or number of nasal polyps, airway constriction, blood eosinophil numbers, airway inflammation, and serum inflammation markers, compared with baseline measurements and compared with subjects receiving the control oligonucleotide.

While preferred embodiments of the present invention have been shown and described herein, it will be obvious to those skilled in the art that such embodiments are provided by way of example only. Numerous variations, changes, and substitutions will now occur to those skilled in the art without departing from the invention. It should be understood that various alternatives to the embodiments of the invention described herein may be employed in practicing the invention. It is intended that the following claims define the scope of the invention and that methods and structures within the scope of these claims and their equivalents be covered thereby.

---

SEQUENCE LISTING (34511 sequences)

SEQ ID NO: 1 - DNA, 21 bp, Artificial Sequence
  Description of Artificial Sequence: Synthetic oligonucleotide
atcagggagactccaacttaa

SEQ ID NO: 2 - DNA, 21 bp, Artificial Sequence
  Description of Artificial Sequence: Synthetic oligonucleotide
aagttggagtctccctgattt

SEQ ID NO: 3 - DNA, 21 bp, Artificial Sequence
  Description of Artificial Sequence: Synthetic oligonucleotide
tcagggagactccaacttaag

SEQ ID NO: 4 - DNA, 22 bp, Artificial Sequence
  Description of Artificial Sequence: Synthetic oligonucleotide
taagttggagtctccctgatat

SEQ ID NO: 5 - DNA, 21 bp, Artificial Sequence
  Description of Artificial Sequence: Synthetic oligonucleotide
cagggagactccaacttaagg

SEQ ID NO: 6 - DNA, 21 bp, Artificial Sequence
  Description of Artificial Sequence: Synthetic oligonucleotide
ttaagttggagtctccctgat

SEQ ID NO: 7 - DNA, 21 bp, Artificial Sequence
  Description of Artificial Sequence: Synthetic oligonucleotide
agggagactccaacttaaggc

SEQ ID NO: 8 - DNA, 21 bp, Artificial Sequence
  Description of Artificial Sequence: Synthetic oligonucleotide
cttaagttggagtctccctga

SEQ ID NO: 9 - DNA, 21 bp, Artificial Sequence
  Description of Artificial Sequence: Synthetic oligonucleotide
gggagactccaacttaaggca

SEQ ID NO: 10 - DNA, 21 bp, Artificial Sequence
  Description of Artificial Sequence: Synthetic oligonucleotide
ccttaagttggagtctccctg

SEQ ID NO: 11 - DNA, 21 bp, Artificial Sequence
  Description of Artificial Sequence: Synthetic oligonucleotide
ggagactccaacttaaggcaa

SEQ ID NO: 12 - DNA, 21 bp, Artificial Sequence
  Description of Artificial Sequence: Synthetic oligonucleotide
gccttaagttggagtctccct

SEQ ID NO: 13 - DNA, 21 bp, Artificial Sequence
  Description of Artificial Sequence: Synthetic oligonucleotide
gagactccaacttaaggcaac

SEQ ID NO: 14 - DNA, 21 bp, Artificial Sequence
  Description of Artificial Sequence: Synthetic oligonucleotide
tgccttaagttggagtctccc

SEQ ID NO: 15 - DNA, 21 bp, Artificial Sequence
  Description of Artificial Sequence: Synthetic oligonucleotide
agactccaacttaaggcaaca

SEQ ID NO: 16 - DNA, 21 bp, Artificial Sequence
  Description of Artificial Sequence: Synthetic oligonucleotide
ttgccttaagttggagtctcc

SEQ ID NO: 17 - DNA, 21 bp, Artificial Sequence
  Description of Artificial Sequence: Synthetic oligonucleotide
gactccaacttaaggcaacag

SEQ ID NO: 18 - DNA, 21 bp, Artificial Sequence
  Description of Artificial Sequence: Synthetic oligonucleotide
gttgccttaagttggagtctc

SEQ ID NO: 19 - DNA, 21 bp, Artificial Sequence
  Description of Artificial Sequence: Synthetic oligonucleotide
actccaacttaaggcaacagc

SEQ ID NO: 20 - DNA, 21 bp, Artificial Sequence
  Description of Artificial Sequence: Synthetic oligonucleotide
tgttgccttaagttggagtct

SEQ ID NO: 21 - DNA, 21 bp, Artificial Sequence
  Description of Artificial Sequence: Synthetic oligonucleotide
ctccaacttaaggcaacagca

SEQ ID NO: 22 - DNA, 21 bp, Artificial Sequence
  Description of Artificial Sequence: Synthetic oligonucleotide
ctgttgccttaagttggagtc

SEQ ID NO: 23 - DNA, 21 bp, Artificial Sequence
  Description of Artificial Sequence: Synthetic oligonucleotide
tccaacttaaggcaacagcat

SEQ ID NO: 24 - DNA, 21 bp, Artificial Sequence
  Description of Artificial Sequence: Synthetic oligonucleotide
gctgttgccttaagttggagt

SEQ ID NO: 25 - DNA, 21 bp, Artificial Sequence
  Description of Artificial Sequence: Synthetic oligonucleotide
ccaacttaaggcaacagcatg

SEQ ID NO: 26 - DNA, 21 bp, Artificial Sequence
  Description of Artificial Sequence: Synthetic oligonucleotide
tgctgttgccttaagttggag

SEQ ID NO: 27 - DNA, 21 bp, Artificial Sequence
  Description of Artificial Sequence: Synthetic oligonucleotide
caacttaaggcaacagcatgg

SEQ ID NO: 28 - DNA, 21 bp, Artificial Sequence
  Description of Artificial Sequence: Synthetic oligonucleotide
atgctgttgccttaagttgga

SEQ ID NO: 29 - DNA, 21 bp, Artificial Sequence
  Description of Artificial Sequence: Synthetic oligonucleotide
aacttaaggcaacagcatggg

SEQ ID NO: 30 - DNA, 21 bp, Artificial Sequence
  Description of Artificial Sequence: Synthetic oligonucleotide
catgctgttgccttaagttgg

SEQ ID NO: 31 - DNA, 21 bp, Artificial Sequence
  Description of Artificial Sequence: Synthetic oligonucleotide
acttaaggcaacagcatgggt

SEQ ID NO: 32 - DNA, 21 bp, Artificial Sequence
  Description of Artificial Sequence: Synthetic oligonucleotide
ccatgctgttgccttaagttg

SEQ ID NO: 33 - DNA, 21 bp, Artificial Sequence
  Description of Artificial Sequence: Synthetic oligonucleotide
cttaaggcaacagcatgggtg

SEQ ID NO: 34 - DNA, 21 bp, Artificial Sequence
  Description of Artificial Sequence: Synthetic oligonucleotide
cccatgctgttgccttaagtt

SEQ ID NO: 35 - DNA, 21 bp, Artificial Sequence
  Description of Artificial Sequence: Synthetic oligonucleotide
ttaaggcaacagcatgggtga

SEQ ID NO: 36 - DNA, 21 bp, Artificial Sequence
  Description of Artificial Sequence: Synthetic oligonucleotide
acccatgctgttgccttaagt

SEQ ID NO: 37 - DNA, 21 bp, Artificial Sequence
  Description of Artificial Sequence: Synthetic oligonucleotide
taaggcaacagcatgggtgaa

SEQ ID NO: 38 - DNA, 21 bp, Artificial Sequence
  Description of Artificial Sequence: Synthetic oligonucleotide
cacccatgctgttgccttaag

SEQ ID NO: 39 - DNA, 21 bp, Artificial Sequence
  Description of Artificial Sequence: Synthetic oligonucleotide
aaggcaacagcatgggtgaat

SEQ ID NO: 40 - DNA, 21 bp, Artificial Sequence
  Description of Artificial Sequence: Synthetic oligonucleotide
tcacccatgctgttgccttaa

SEQ ID NO: 41 - DNA, 21 bp, Artificial Sequence
  Description of Artificial Sequence: Synthetic oligonucleotide
aggcaacagcatgggtgaata

SEQ ID NO: 42 - DNA, 21 bp, Artificial Sequence
  Description of Artificial Sequence: Synthetic oligonucleotide
ttcacccatgctgttgcctta

SEQ ID NO: 43 - DNA, 21 bp, Artificial Sequence
  Description of Artificial Sequence: Synthetic oligonucleotide
ggcaacagcatgggtgaataa

SEQ ID NO: 44 - DNA, 21 bp, Artificial Sequence
  Description of Artificial Sequence: Synthetic oligonucleotide
attcacccatgctgttgcctt

SEQ ID NO: 45 - DNA, 21 bp, Artificial Sequence
  Description of Artificial Sequence: Synthetic oligonucleotide
gcaacagcatgggtgaataag

SEQ ID NO: 46 - DNA, 21 bp, Artificial Sequence
  Description of Artificial Sequence: Synthetic oligonucleotide
tattcacccatgctgttgcct

SEQ ID NO: 47 - DNA, 21 bp, Artificial Sequence
  Description of Artificial Sequence: Synthetic oligonucleotide
caacagcatgggtgaataagg

SEQ ID NO: 48 - DNA, 21 bp, Artificial Sequence
  Description of Artificial Sequence: Synthetic oligonucleotide
ttattcacccatgctgttgcc

SEQ ID NO: 49 - DNA, 21 bp, Artificial Sequence
  Description of Artificial Sequence: Synthetic oligonucleotide
aacagcatgggtgaataaggg

SEQ ID NO: 50 - DNA, 21 bp, Artificial Sequence
  Description of Artificial Sequence: Synthetic oligonucleotide
cttattcacccatgctgttgc

SEQ ID NO: 51 - DNA, 21 bp, Artificial Sequence
  Description of Artificial Sequence: Synthetic oligonucleotide
acagcatgggtgaataagggc

SEQ ID NO: 52 - DNA, 21 bp, Artificial Sequence
  Description of Artificial Sequence: Synthetic oligonucleotide
ccttattcacccatgctgttg

SEQ ID NO: 53 - DNA, 21 bp, Artificial Sequence
  Description of Artificial Sequence: Synthetic oligonucleotide
cagcatgggtgaataagggct

SEQ ID NO: 54 - DNA, 21 bp, Artificial Sequence
  Description of Artificial Sequence: Synthetic oligonucleotide
cccttattcacccatgctgtt

SEQ ID NO: 55 - DNA, 21 bp, Artificial Sequence
  Description of Artificial Sequence: Synthetic oligonucleotide
agcatgggtgaataagggctt

SEQ ID NO: 56 - DNA, 21 bp, Artificial Sequence
  Description of Artificial Sequence: Synthetic oligonucleotide
gcccttattcacccatgctgt

SEQ ID NO: 57 - DNA, 21 bp, Artificial Sequence
  Description of Artificial Sequence: Synthetic oligonucleotide
gcatgggtgaataagggcttc

SEQ ID NO: 58 - DNA, 21 bp, Artificial Sequence
  Description of Artificial Sequence: Synthetic oligonucleotide
agcccttattcacccatgctg

SEQ ID NO: 59 - DNA, 21 bp, Artificial Sequence
  Description of Artificial Sequence: Synthetic oligonucleotide
catgggtgaataagggcttcc

SEQ ID NO: 60 - DNA, 21 bp, Artificial Sequence
  Description of Artificial Sequence: Synthetic oligonucleotide
aagcccttattcacccatgct

SEQ ID NO: 61 - DNA, 21 bp, Artificial Sequence
  Description of Artificial Sequence: Synthetic oligonucleotide
atgggtgaataagggcttcct

SEQ ID NO: 62 - DNA, 21 bp, Artificial Sequence
  Description of Artificial Sequence: Synthetic oligonucleotide
gaagcccttattcacccatgc

SEQ ID NO: 63 - DNA, 21 bp, Artificial Sequence
  Description of Artificial Sequence: Synthetic oligonucleotide
tgggtgaataagggcttcctg

SEQ ID NO: 64 - DNA, 21 bp, Artificial Sequence
  Description of Artificial Sequence: Synthetic oligonucleotide
ggaagcccttattcacccatg

SEQ ID NO: 65 - DNA, 21 bp, Artificial Sequence
  Description of Artificial Sequence: Synthetic oligonucleotide
gggtgaataagggcttcctgt

SEQ ID NO: 66 - DNA, 21 bp, Artificial Sequence
  Description of Artificial Sequence: Synthetic oligonucleotide
aggaagcccttattcacccat

SEQ ID NO: 67 - DNA, 21 bp, Artificial Sequence
  Description of Artificial Sequence: Synthetic oligonucleotide
ggtgaataagggcttcctgtg

SEQ ID NO: 68 - DNA, 21 bp, Artificial Sequence
  Description of Artificial Sequence: Synthetic oligonucleotide
caggaagcccttattcaccca

SEQ ID NO: 69 - DNA, 21 bp, Artificial Sequence
  Description of Artificial Sequence: Synthetic oligonucleotide
gtgaataagggcttcctgtgg

SEQ ID NO: 70 - DNA, 21 bp, Artificial Sequence
  Description of Artificial Sequence: Synthetic oligonucleotide
acaggaagcccttattcaccc

SEQ ID NO: 71 - DNA, 21 bp, Artificial Sequence
  Description of Artificial Sequence: Synthetic oligonucleotide
tgaataagggcttcctgtgga

SEQ ID NO: 72 - DNA, 21 bp, Artificial Sequence
  Description of Artificial Sequence: Synthetic oligonucleotide
cacaggaagcccttattcacc

SEQ ID NO: 73 - DNA, 21 bp, Artificial Sequence
  Description of Artificial Sequence: Synthetic oligonucleotide
gaataagggcttcctgtggac

SEQ ID NO: 74 - DNA, 21 bp, Artificial Sequence
  Description of Artificial Sequence: Synthetic oligonucleotide
ccacaggaagcccttattcac

SEQ ID NO: 75 - DNA, 21 bp, Artificial Sequence
  Description of Artificial Sequence: Synthetic oligonucleotide
aataagggcttcctgtggact

SEQ ID NO: 76 - DNA, 21 bp, Artificial Sequence
  Description of Artificial Sequence: Synthetic oligonucleotide
tccacaggaagcccttattca

SEQ ID NO: 77 - DNA, 21 bp, Artificial Sequence
  Description of Artificial Sequence: Synthetic oligonucleotide
ataagggcttcctgtggactg

SEQ ID NO: 78 - DNA, 21 bp, Artificial Sequence
  Description of Artificial Sequence: Synthetic oligonucleotide
gtccacaggaagcccttattc

SEQ ID NO: 79 - DNA, 21 bp, Artificial Sequence
  Description of Artificial Sequence: Synthetic oligonucleotide
taagggcttcctgtggactgg

SEQ ID NO: 80 - DNA, 21 bp, Artificial Sequence
  Description of Artificial Sequence: Synthetic oligonucleotide
agtccacaggaagcccttatt

SEQ ID NO: 81 - DNA, 21 bp, Artificial Sequence
  Description of Artificial Sequence: Synthetic oligonucleotide
aagggcttcctgtggactggc

SEQ ID NO: 82 - DNA, 21 bp, Artificial Sequence
  Description of Artificial Sequence: Synthetic oligonucleotide
cagtccacaggaagcccttat

SEQ ID NO: 83 - DNA, 21 bp, Artificial Sequence
  Description of Artificial Sequence: Synthetic oligonucleotide
agggcttcctgtggactggca

SEQ ID NO: 84 - DNA, 21 bp, Artificial Sequence
  Description of Artificial Sequence: Synthetic oligonucleotide
ccagtccacaggaagccctta

SEQ ID NO: 85 - DNA, 21 bp, Artificial Sequence
  Description of Artificial Sequence: Synthetic oligonucleotide
gggcttcctgtggactggcaa

SEQ ID NO: 86 - DNA, 21 bp, Artificial Sequence
  Description of Artificial Sequence: Synthetic oligonucleotide
gccagtccacaggaagccctt

SEQ ID NO: 87 - DNA, 21 bp, Artificial Sequence
  Description of Artificial Sequence: Synthetic oligonucleotide
ggcttcctgtggactggcaat

SEQ ID NO: 88 - DNA, 21 bp, Artificial Sequence
  Description of Artificial Sequence: Synthetic oligonucleotide
tgccagtccacaggaagccct

SEQ ID NO: 89 - DNA, 21 bp, Artificial Sequence
  Description of Artificial Sequence: Synthetic oligonucleotide
gcttcctgtggactggcaatg

SEQ ID NO: 90 - DNA, 21 bp, Artificial Sequence
  Description of Artificial Sequence: Synthetic oligonucleotide
ttgccagtccacaggaagccc

SEQ ID NO: 91 - DNA, 21 bp, Artificial Sequence
  Description of Artificial Sequence: Synthetic oligonucleotide
cttcctgtggactggcaatga

SEQ ID NO: 92 - DNA, 21 bp, Artificial Sequence
  Description of Artificial Sequence: Synthetic oligonucleotide
attgccagtccacaggaagcc

SEQ ID NO: 93 - DNA, 21 bp, Artificial Sequence
  Description of Artificial Sequence: Synthetic oligonucleotide
ttcctgtggactggcaatgag

SEQ ID NO: 94 - DNA, 21 bp, Artificial Sequence
  Description of Artificial Sequence: Synthetic oligonucleotide
cattgccagtccacaggaagc

SEQ ID NO: 95 - DNA, 21 bp, Artificial Sequence
  Description of Artificial Sequence: Synthetic oligonucleotide
tcctgtggactggcaatgaga

SEQ ID NO: 96 - DNA, 21 bp, Artificial Sequence
  Description of Artificial Sequence: Synthetic oligonucleotide
tcattgccagtccacaggaag

SEQ ID NO: 97 - DNA, 21 bp, Artificial Sequence
  Description of Artificial Sequence: Synthetic oligonucleotide
cctgtggactggcaatgagag

SEQ ID NO: 98 - DNA, 21 bp, Artificial Sequence
  Description of Artificial Sequence: Synthetic oligonucleotide
ctcattgccagtccacaggaa

SEQ ID NO: 99 - DNA, 21 bp, Artificial Sequence
  Description of Artificial Sequence: Synthetic oligonucleotide
ctgtggactggcaatgagagg

SEQ ID NO: 100 - DNA, 21 bp, Artificial Sequence
  Description of Artificial Sequence: Synthetic oligonucleotide
tctcattgccagtccacagga

SEQ ID NO: 101 - DNA, 21 bp, Artificial Sequence
  Description of Artificial Sequence: Synthetic oligonucleotide
tgtggactggcaatgagaggc

SEQ ID NO: 102 - DNA, 21 bp, Artificial Sequence
  Description of Artificial Sequence: Synthetic oligonucleotide
ctctcattgccagtccacagg

SEQ ID NO: 103 - DNA, 21 bp, Artificial Sequence
  Description of Artificial Sequence: Synthetic oligonucleotide
gtggactggcaatgagaggca

SEQ ID NO: 104 - DNA, 21 bp, Artificial Sequence
  Description of Artificial Sequence: Synthetic oligonucleotide
cctctcattgccagtccacag

SEQ ID NO: 105 - DNA, 21 bp, Artificial Sequence
  Description of Artificial Sequence: Synthetic oligonucleotide
tggactggcaatgagaggcaa

SEQ ID NO: 106 - DNA, 21 bp, Artificial Sequence
  Description of Artificial Sequence: Synthetic oligonucleotide
gcctctcattgccagtccaca

SEQ ID NO: 107 - DNA, 21 bp, Artificial Sequence
  Description of Artificial Sequence: Synthetic oligonucleotide
ggactggcaatgagaggcaaa

SEQ ID NO: 108 - DNA, 21 bp, Artificial Sequence
  Description of Artificial Sequence: Synthetic oligonucleotide
tgcctctcattgccagtccac

SEQ ID NO: 109 - DNA, 21 bp, Artificial Sequence
  Description of Artificial Sequence: Synthetic oligonucleotide
gactggcaatgagaggcaaaa

SEQ ID NO: 110 - DNA, 21 bp, Artificial Sequence
  Description of Artificial Sequence: Synthetic oligonucleotide
ttgcctctcattgccagtcca

SEQ ID NO: 111 - DNA, 21 bp, Artificial Sequence
  Description of Artificial Sequence: Synthetic oligonucleotide
actggcaatgagaggcaaaac

SEQ ID NO: 112 - DNA, 21 bp, Artificial Sequence
  Description of Artificial Sequence: Synthetic oligonucleotide
tttgcctctcattgccagtcc

SEQ ID NO: 113 - DNA, 21 bp, Artificial Sequence
  Description of Artificial Sequence: Synthetic oligonucleotide
ctggcaatgagaggcaaaacc

SEQ ID NO: 114 - DNA, 21 bp, Artificial Sequence
  Description of Artificial Sequence: Synthetic oligonucleotide
ttttgcctctcattgccagtc

SEQ ID NO: 115 - DNA, 21 bp, Artificial Sequence
  Description of Artificial Sequence: Synthetic oligonucleotide
tggcaatgagaggcaaaacct

SEQ ID NO: 116 - DNA, 21 bp, Artificial Sequence
  Description of Artificial Sequence: Synthetic oligonucleotide
gttttgcctctcattgccagt

SEQ ID NO: 117 - DNA, 21 bp, Artificial Sequence
  Description of Artificial Sequence: Synthetic oligonucleotide
ggcaatgagaggcaaaacctg

SEQ ID NO: 118 - DNA, 21 bp, Artificial Sequence
  Description of Artificial Sequence: Synthetic oligonucleotide
ggttttgcctctcattgccag

SEQ ID NO: 119 - DNA, 21 bp, Artificial Sequence
  Description of Artificial Sequence: Synthetic oligonucleotide
gcaatgagaggcaaaacctgg

SEQ ID NO: 120 - DNA, 21 bp, Artificial Sequence
  Description of Artificial Sequence: Synthetic oligonucleotide
aggttttgcctctcattgcca

SEQ ID NO: 121 - DNA, 21 bp, Artificial Sequence
  Description of Artificial Sequence: Synthetic oligonucleotide
caatgagaggcaaaacctggt

SEQ ID NO: 122 - DNA, 21 bp, Artificial Sequence
  Description of Artificial Sequence: Synthetic oligonucleotide
caggttttgcctctcattgcc

SEQ ID NO: 123 - DNA, 21 bp, Artificial Sequence
  Description of Artificial Sequence: Synthetic oligonucleotide
aatgagaggcaaaacctggtg

SEQ ID NO: 124 - DNA, 21 bp, Artificial Sequence
  Description of Artificial Sequence: Synthetic oligonucleotide
ccaggttttgcctctcattgc

SEQ ID NO: 125 - DNA, 21 bp, Artificial Sequence
  Description of Artificial Sequence: Synthetic oligonucleotide
atgagaggcaaaacctggtgc

SEQ ID NO: 126 - DNA, 21 bp, Artificial Sequence
  Description of Artificial Sequence: Synthetic oligonucleotide
accaggttttgcctctcattg

SEQ ID NO: 127 - DNA, 21 bp, Artificial Sequence
  Description of Artificial Sequence: Synthetic oligonucleotide
tgagaggcaaaacctggtgct

SEQ ID NO: 128 - DNA, 21 bp, Artificial Sequence
  Description of Artificial Sequence: Synthetic oligonucleotide
caccaggttttgcctctcatt

SEQ ID NO: 129 - DNA, 21 bp, Artificial Sequence
  Description of Artificial Sequence: Synthetic oligonucleotide
gagaggcaaaacctggtgctt

SEQ ID NO: 130 - DNA, 21 bp, Artificial Sequence
  Description of Artificial Sequence: Synthetic oligonucleotide
gcaccaggttttgcctctcat

SEQ ID NO: 131 - DNA, 21 bp, Artificial Sequence
  Description of Artificial Sequence: Synthetic oligonucleotide
agaggcaaaacctggtgcttg

SEQ ID NO: 132 - DNA, 21 bp, Artificial Sequence
  Description of Artificial Sequence: Synthetic oligonucleotide
agcaccaggttttgcctctca

SEQ ID NO: 133 - DNA, 21 bp, Artificial Sequence
  Description of Artificial Sequence: Synthetic oligonucleotide
gaggcaaaacctggtgcttga

SEQ ID NO: 134 - DNA, 21 bp, Artificial Sequence
  Description of Artificial Sequence: Synthetic oligonucleotide
aagcaccaggttttgcctctc

SEQ ID NO: 135 - DNA, 21 bp, Artificial Sequence
  Description of Artificial Sequence: Synthetic oligonucleotide
aggcaaaacctggtgcttgag

SEQ ID NO: 136 - DNA, 21 bp, Artificial Sequence
  Description of Artificial Sequence: Synthetic oligonucleotide
caagcaccaggttttgcctct

SEQ ID NO: 137 - DNA, 21 bp, Artificial Sequence
  Description of Artificial Sequence: Synthetic oligonucleotide
ggcaaaacctggtgcttgagc

SEQ ID NO: 138 - DNA, 21 bp, Artificial Sequence
  Description of Artificial Sequence: Synthetic oligonucleotide
tcaagcaccaggttttgcctc

SEQ ID NO: 139 - DNA, 21 bp, Artificial Sequence
  Description of Artificial Sequence: Synthetic oligonucleotide
gcaaaacctggtgcttgagca

SEQ ID NO: 140 - DNA, 21 bp, Artificial Sequence
  Description of Artificial Sequence: Synthetic oligonucleotide
ctcaagcaccaggttttgcct

SEQ ID NO: 141 - DNA, 21 bp, Artificial Sequence
  Description of Artificial Sequence: Synthetic oligonucleotide
caaaacctggtgcttgagcac

SEQ ID NO: 142 - DNA, 21 bp, Artificial Sequence
  Description of Artificial Sequence: Synthetic oligonucleotide
gctcaagcaccaggttttgcc

SEQ ID NO: 143 - DNA, 21 bp, Artificial Sequence
  Description of Artificial Sequence: Synthetic oligonucleotide
aaaacctggtgcttgagcact

SEQ ID NO: 144 - DNA, 21 bp, Artificial Sequence
  Description of Artificial Sequence: Synthetic oligonucleotide
tgctcaagcaccaggttttgc

SEQ ID NO: 145 - DNA, 21 bp, Artificial Sequence
  Description of Artificial Sequence: Synthetic oligonucleotide
aaacctggtgcttgagcactg

SEQ ID NO: 146 - DNA, 21 bp, Artificial Sequence
  Description of Artificial Sequence: Synthetic oligonucleotide
gtgctcaagcaccaggttttg

SEQ ID NO: 147 - DNA, 21 bp, Artificial Sequence
  Description of Artificial Sequence: Synthetic oligonucleotide
aacctggtgcttgagcactgg

SEQ ID NO: 148 - DNA, 21 bp, Artificial Sequence
  Description of Artificial Sequence: Synthetic oligonucleotide
agtgctcaagcaccaggtttt

SEQ ID NO: 149 - DNA, 21 bp, Artificial Sequence
  Description of Artificial Sequence: Synthetic oligonucleotide
acctggtgcttgagcactggc

SEQ ID NO: 150 - DNA, 21 bp, Artificial Sequence
  Description of Artificial Sequence: Synthetic oligonucleotide
cagtgctcaagcaccaggttt

SEQ ID NO: 151 - DNA, 21 bp, Artificial Sequence
  Description of Artificial Sequence: Synthetic oligonucleotide
cctggtgcttgagcactggcc

SEQ ID NO: 152 - DNA, 21 bp, Artificial Sequence
  Description of Artificial Sequence: Synthetic oligonucleotide
ccagtgctcaagcaccaggtt

SEQ ID NO: 153 - DNA, 21 bp, Artificial Sequence
  Description of Artificial Sequence: Synthetic oligonucleotide
ctggtgcttgagcactggccc

SEQ ID NO: 154 - DNA, 21 bp, Artificial Sequence
  Description of Artificial Sequence: Synthetic oligonucleotide
gccagtgctcaagcaccaggt

SEQ ID NO: 155 - DNA, 21 bp, Artificial Sequence
  Description of Artificial Sequence: Synthetic oligonucleotide
tggtgcttgagcactggcccc

SEQ ID NO: 156 - DNA, 21 bp, Artificial Sequence
  Description of Artificial Sequence: Synthetic oligonucleotide
ggccagtgctcaagcaccagg

SEQ ID NO: 157 - DNA, 21 bp, Artificial Sequence
  Description of Artificial Sequence: Synthetic oligonucleotide
ggtgcttgagcactggcccct

SEQ ID NO: 158 - DNA, 21 bp, Artificial Sequence
  Description of Artificial Sequence: Synthetic oligonucleotide
gggccagtgctcaagcaccag

SEQ ID NO: 159 - DNA, 21 bp, Artificial Sequence
  Description of Artificial Sequence: Synthetic oligonucleotide
gtgcttgagcactggccccta

SEQ ID NO: 160 - DNA, 21 bp, Artificial Sequence
  Description of Artificial Sequence: Synthetic oligonucleotide
ggggccagtgctcaagcacca

SEQ ID NO: 161 - DNA, 21 bp, Artificial Sequence
  Description of Artificial Sequence: Synthetic oligonucleotide
tgcttgagcactggcccctaa

SEQ ID NO: 162 - DNA, 21 bp, Artificial Sequence
  Description of Artificial Sequence: Synthetic oligonucleotide
aggggccagtgctcaagcacc

SEQ ID NO: 163 - DNA, 21 bp, Artificial Sequence
  Description of Artificial Sequence: Synthetic oligonucleotide
gcttgagcactggcccctaag

SEQ ID NO: 164 - DNA, 21 bp, Artificial Sequence
  Description of Artificial Sequence: Synthetic oligonucleotide
taggggccagtgctcaagcac

SEQ ID NO: 165 - DNA, 21 bp, Artificial Sequence
  Description of Artificial Sequence: Synthetic oligonucleotide
cttgagcactggcccctaagg

SEQ ID NO: 166 - DNA, 21 bp, Artificial Sequence
  Description of Artificial Sequence: Synthetic oligonucleotide
ttaggggccagtgctcaagca

SEQ ID NO: 167 - DNA, 21 bp, Artificial Sequence
  Description of Artificial Sequence: Synthetic oligonucleotide
ttgagcactggcccctaaggc

SEQ ID NO: 168 - DNA, 21 bp, Artificial Sequence
  Description of Artificial Sequence: Synthetic oligonucleotide
cttaggggccagtgctcaagc

SEQ ID NO: 169 - DNA, 21 bp, Artificial Sequence
  Description of Artificial Sequence: Synthetic oligonucleotide
tgagcactggcccctaaggca

SEQ ID NO: 170 - DNA, 21 bp, Artificial Sequence
  Description of Artificial Sequence: Synthetic oligonucleotide
ccttaggggccagtgctcaag

SEQ ID NO: 171 - DNA, 21 bp, Artificial Sequence
  Description of Artificial Sequence: Synthetic oligonucleotide
gagcactggcccctaaggcag

SEQ ID NO: 172 - DNA, 21 bp, Artificial Sequence
  Description of Artificial Sequence: Synthetic oligonucleotide
gccttaggggccagtgctcaa

SEQ ID NO: 173 - DNA, 21 bp, Artificial Sequence
  Description of Artificial Sequence: Synthetic oligonucleotide
agcactggcccctaaggcagg

SEQ ID NO: 174 - DNA, 21 bp, Artificial Sequence
  Description of Artificial Sequence: Synthetic oligonucleotide
tgccttaggggccagtgctca

SEQ ID NO: 175 - DNA, 21 bp, Artificial Sequence
  Description of Artificial Sequence: Synthetic oligonucleotide
gcactggcccctaaggcaggc

SEQ ID NO: 176 - DNA, 21 bp, Artificial Sequence
  Description of Artificial Sequence: Synthetic oligonucleotide
ctgccttaggggccagtgctc

SEQ ID NO: 177 - DNA, 21 bp, Artificial Sequence
  Description of Artificial Sequence: Synthetic oligonucleotide
cactggcccctaaggcaggcc

SEQ ID NO: 178 - DNA, 21 bp, Artificial Sequence
  Description of Artificial Sequence: Synthetic oligonucleotide
cctgccttaggggccagtgct

SEQ ID NO: 179 - DNA, 21 bp, Artificial Sequence
  Description of Artificial Sequence: Synthetic oligonucleotide
actggcccctaaggcaggcct

SEQ ID NO: 180 - DNA, 21 bp, Artificial Sequence
  Description of Artificial Sequence: Synthetic oligonucleotide
gcctgccttaggggccagtgc

SEQ ID NO: 181 - DNA, 21 bp, Artificial Sequence
  Description of Artificial Sequence: Synthetic oligonucleotide
ctggcccctaaggcaggcctt

SEQ ID NO: 182 - DNA, 21 bp, Artificial Sequence
  Description of Artificial Sequence: Synthetic oligonucleotide
ggcctgccttaggggccagtg

SEQ ID NO: 183 - DNA, 21 bp, Artificial Sequence
  Description of Artificial Sequence: Synthetic oligonucleotide
tggcccctaaggcaggcctta

SEQ ID NO: 184 - DNA, 21 bp, Artificial Sequence
  Description of Artificial Sequence: Synthetic oligonucleotide
aggcctgccttaggggccagt

SEQ ID NO: 185 - DNA, 21 bp, Artificial Sequence
  Description of Artificial Sequence: Synthetic oligonucleotide
ggcccctaaggcaggccttac

SEQ ID NO: 186 - DNA, 21 bp, Artificial Sequence
  Description of Artificial Sequence: Synthetic oligonucleotide
aaggcctgccttaggggccag

SEQ ID NO: 187 - DNA, 21 bp, Artificial Sequence
  Description of Artificial Sequence: Synthetic oligonucleotide
gcccctaaggcaggccttaca

SEQ ID NO: 188 - DNA, 21 bp, Artificial Sequence
  Description of Artificial Sequence: Synthetic oligonucleotide
taaggcctgccttaggggcca

SEQ ID NO: 189 - DNA, 21 bp, Artificial Sequence
  Description of Artificial Sequence: Synthetic oligonucleotide
cccctaaggcaggccttacag

SEQ ID NO: 190 - DNA, 21 bp, Artificial Sequence
  Description of Artificial Sequence: Synthetic oligonucleotide
gtaaggcctgccttaggggcc

SEQ ID NO: 191 - DNA, 21 bp, Artificial Sequence
  Description of Artificial Sequence: Synthetic oligonucleotide
ccctaaggcaggccttacaga

SEQ ID NO: 192 - DNA, 21 bp, Artificial Sequence
  Description of Artificial Sequence: Synthetic oligonucleotide
tgtaaggcctgccttaggggc

SEQ ID NO: 193 - DNA, 21 bp, Artificial Sequence
  Description of Artificial Sequence: Synthetic oligonucleotide
cctaaggcaggccttacagat

SEQ ID NO: 194 - DNA, 21 bp, Artificial Sequence
  Description of Artificial Sequence: Synthetic oligonucleotide
ctgtaaggcctgccttagggg

SEQ ID NO: 195 - DNA, 21 bp, Artificial Sequence
  Description of Artificial Sequence: Synthetic oligonucleotide
ctaaggcaggccttacagatc

SEQ ID NO: 196 - DNA, 21 bp, Artificial Sequence
  Description of Artificial Sequence: Synthetic oligonucleotide
tctgtaaggcctgccttaggg

SEQ ID NO: 197 - DNA, 21 bp, Artificial Sequence
  Description of Artificial Sequence: Synthetic oligonucleotide
taaggcaggccttacagatct

SEQ ID NO: 198 - DNA, 21 bp, Artificial Sequence
  Description of Artificial Sequence: Synthetic oligonucleotide
atctgtaaggcctgccttagg

SEQ ID NO: 199 - DNA, 21 bp, Artificial Sequence
  Description of Artificial Sequence: Synthetic oligonucleotide
aaggcaggccttacagatctc

SEQ ID NO: 200 - DNA, 21 bp, Artificial Sequence
  Description of Artificial Sequence: Synthetic oligonucleotide
gatctgtaaggcctgccttag

SEQ ID NO: 201 - DNA, 21 bp, Artificial Sequence
  Description of Artificial Sequence: Synthetic oligonucleotide
aggcaggccttacagatctct

SEQ ID NO: 202 - DNA, 21 bp, Artificial Sequence
  Description of Artificial Sequence: Synthetic oligonucleotide
agatctgtaaggcctgcctta

SEQ ID NO: 203 - DNA, 21 bp, Artificial Sequence
  Description of Artificial Sequence: Synthetic oligonucleotide
ggcaggccttacagatctctt

SEQ ID NO: 204 - DNA, 21 bp, Artificial Sequence
  Description of Artificial Sequence: Synthetic oligonucleotide
gagatctgtaaggcctgcctt

SEQ ID NO: 205 - DNA, 21 bp, Artificial Sequence
  Description of Artificial Sequence: Synthetic oligonucleotide
gcaggccttacagatctctta

SEQ ID NO: 206 - DNA, 21 bp, Artificial Sequence
  Description of Artificial Sequence: Synthetic oligonucleotide
agagatctgtaaggcctgcct

SEQ ID NO: 207 - DNA, 21 bp, Artificial Sequence
  Description of Artificial Sequence: Synthetic oligonucleotide
caggccttacagatctcttac

SEQ ID NO: 208 - DNA, 21 bp, Artificial Sequence
  Description of Artificial Sequence: Synthetic oligonucleotide
aagagatctgtaaggcctgcc

SEQ ID NO: 209 - DNA, 21 bp, Artificial Sequence
  Description of Artificial Sequence: Synthetic oligonucleotide
aggccttacagatctcttaca

SEQ ID NO: 210 - DNA, 21 bp, Artificial Sequence
  Description of Artificial Sequence: Synthetic oligonucleotide
taagagatctgtaaggcctgc

SEQ ID NO: 211 - DNA, 21 bp, Artificial Sequence
  Description of Artificial Sequence: Synthetic oligonucleotide
ggccttacagatctcttacac

SEQ ID NO: 212 - DNA, 21 bp, Artificial Sequence
  Description of Artificial Sequence: Synthetic oligonucleotide
gtaagagatctgtaaggcctg

SEQ ID NO: 213 - DNA, 21 bp, Artificial Sequence
  Description of Artificial Sequence: Synthetic oligonucleotide
gccttacagatctcttacact

SEQ ID NO: 214 - DNA, 21 bp, Artificial Sequence
  Description of Artificial Sequence: Synthetic oligonucleotide
tgtaagagatctgtaaggcct

SEQ ID NO: 215 - DNA, 21 bp, Artificial Sequence
  Description of Artificial Sequence: Synthetic oligonucleotide
ccttacagatctcttacactc

SEQ ID NO: 216 - DNA, 21 bp, Artificial Sequence
  Description of Artificial Sequence: Synthetic oligonucleotide
gtgtaagagatctgtaaggcc

SEQ ID NO: 217 - DNA, 21 bp, Artificial Sequence
  Description of Artificial Sequence: Synthetic oligonucleotide
cttacagatctcttacactcg

SEQ ID NO: 218 - DNA, 21 bp, Artificial Sequence
  Description of Artificial Sequence: Synthetic oligonucleotide
agtgtaagagatctgtaaggc

SEQ ID NO: 219 - DNA, 21 bp, Artificial Sequence
  Description of Artificial Sequence: Synthetic oligonucleotide
ttacagatctcttacactcgt

SEQ ID NO: 220 - DNA, 21 bp, Artificial Sequence
  Description of Artificial Sequence: Synthetic oligonucleotide
gagtgtaagagatctgtaagg

SEQ ID NO: 221 - DNA, 21 bp, Artificial Sequence
  Description of Artificial Sequence: Synthetic oligonucleotide
tacagatctcttacactcgtg

SEQ ID NO: 222 - DNA, 21 bp, Artificial Sequence
  Description of Artificial Sequence: Synthetic oligonucleotide
cgagtgtaagagatctgtaag

SEQ ID NO: 223 - DNA, 21 bp, Artificial Sequence
  Description of Artificial Sequence: Synthetic oligonucleotide
acagatctcttacactcgtgg

SEQ ID NO: 224 - DNA, 21 bp, Artificial Sequence
  Description of Artificial Sequence: Synthetic oligonucleotide
acgagtgtaagagatctgtaa

SEQ ID NO: 225 - DNA, 21 bp, Artificial Sequence
  Description of Artificial Sequence: Synthetic oligonucleotide
cagatctcttacactcgtggt

SEQ ID NO: 226 - DNA, 21 bp, Artificial Sequence
  Description of Artificial Sequence: Synthetic oligonucleotide
cacgagtgtaagagatctgta

SEQ ID NO: 227 - DNA, 21 bp, Artificial Sequence
  Description of Artificial Sequence: Synthetic oligonucleotide
agatctcttacactcgtggtg

SEQ ID NO: 228 - DNA, 21 bp, Artificial Sequence
  Description of Artificial Sequence: Synthetic oligonucleotide
ccacgagtgtaagagatctgt

SEQ ID NO: 229 - DNA, 21 bp, Artificial Sequence
  Description of Artificial Sequence: Synthetic oligonucleotide
gatctcttacactcgtggtgg

SEQ ID NO: 230 - DNA, 21 bp, Artificial Sequence
  Description of Artificial Sequence: Synthetic oligonucleotide
accacgagtgtaagagatctg

SEQ ID NO: 231 - DNA, 21 bp, Artificial Sequence
  Description of Artificial Sequence: Synthetic oligonucleotide
atctcttacactcgtggtggg

SEQ ID NO: 232 - DNA, 21 bp, Artificial Sequence
  Description of Artificial Sequence: Synthetic oligonucleotide
caccacgagtgtaagagatct

SEQ ID NO: 233 - DNA, 21 bp, Artificial Sequence
  Description of Artificial Sequence: Synthetic oligonucleotide
tctcttacactcgtggtggga

SEQ ID NO: 234 - DNA, 21 bp, Artificial Sequence
  Description of Artificial Sequence: Synthetic oligonucleotide
ccaccacgagtgtaagagatc

SEQ ID NO: 235 - DNA, 21 bp, Artificial Sequence
  Description of Artificial Sequence: Synthetic oligonucleotide
ctcttacactcgtggtgggaa

SEQ ID NO: 236 - DNA, 21 bp, Artificial Sequence
  Description of Artificial Sequence: Synthetic oligonucleotide
cccaccacgagtgtaagagat

SEQ ID NO: 237 - DNA, 21 bp, Artificial Sequence
  Description of Artificial Sequence: Synthetic oligonucleotide
tcttacactcgtggtgggaag

SEQ ID NO: 238 - DNA, 21 bp, Artificial Sequence
  Description of Artificial Sequence: Synthetic oligonucleotide
tcccaccacgagtgtaagaga

SEQ ID NO: 239 - DNA, 21 bp, Artificial Sequence
  Description of Artificial Sequence: Synthetic oligonucleotide
cttacactcgtggtgggaaga

SEQ ID NO: 240 - DNA, 21 bp, Artificial Sequence
  Description of Artificial Sequence: Synthetic oligonucleotide
ttcccaccacgagtgtaagag

SEQ ID NO: 241 - DNA, 21 bp, Artificial Sequence
  Description of Artificial Sequence: Synthetic oligonucleotide
ttacactcgtggtgggaagag

SEQ ID NO: 242 - DNA, 21 bp, Artificial Sequence
  Description of Artificial Sequence: Synthetic oligonucleotide
cttcccaccacgagtgtaaga

SEQ ID NO: 243 - DNA, 21 bp, Artificial Sequence
  Description of Artificial Sequence: Synthetic oligonucleotide
tacactcgtggtgggaagagt

SEQ ID NO: 244 - DNA, 21 bp, Artificial Sequence
  Description of Artificial Sequence: Synthetic oligonucleotide
tcttcccaccacgagtgtaag

SEQ ID NO: 245 - DNA, 21 bp, Artificial Sequence
  Description of Artificial Sequence: Synthetic oligonucleotide
acactcgtggtgggaagagtt

SEQ ID NO: 246 - DNA, 21 bp, Artificial Sequence
  Description of Artificial Sequence: Synthetic oligonucleotide
ctcttcccaccacgagtgtaa

SEQ ID NO: 247 - DNA, 21 bp, Artificial Sequence
  Description of Artificial Sequence: Synthetic oligonucleotide
cactcgtggtgggaagagttt

SEQ ID NO: 248 - DNA, 21 bp, Artificial Sequence
  Description of Artificial Sequence: Synthetic oligonucleotide
actcttcccaccacgagtgta

SEQ ID NO: 249 - DNA, 21 bp, Artificial Sequence
  Description of Artificial Sequence: Synthetic oligonucleotide
actcgtggtgggaagagttta

SEQ ID NO: 250 - DNA, 21 bp, Artificial Sequence
  Description of Artificial Sequence: Synthetic oligonucleotide
aactcttcccaccacgagtgt

SEQ ID NO: 251 - DNA, 21 bp, Artificial Sequence
  Description of Artificial Sequence: Synthetic oligonucleotide
ctcgtggtgggaagagtttag

SEQ ID NO: 252 - DNA, 21 bp, Artificial Sequence
  Description of Artificial Sequence: Synthetic oligonucleotide
aaactcttcccaccacgagtg

SEQ ID NO: 253 - DNA, 21 bp, Artificial Sequence
  Description of Artificial Sequence: Synthetic oligonucleotide
tcgtggtgggaagagtttagt

SEQ ID NO: 254 - DNA, 21 bp, Artificial Sequence
  Description of Artificial Sequence: Synthetic oligonucleotide
taaactcttcccaccacgagt

SEQ ID NO: 255 - DNA, 21 bp, Artificial Sequence
  Description of Artificial Sequence: Synthetic oligonucleotide
cgtggtgggaagagtttagtg

SEQ ID NO: 256 - DNA, 21 bp, Artificial Sequence
  Description of Artificial Sequence: Synthetic oligonucleotide
ctaaactcttcccaccacgag

SEQ ID NO: 257 - DNA, 21 bp, Artificial Sequence
  Description of Artificial Sequence: Synthetic oligonucleotide
gtggtgggaagagtttagtgt

SEQ ID NO: 258 - DNA, 21 bp, Artificial Sequence
  Description of Artificial Sequence: Synthetic oligonucleotide
actaaactcttcccaccacga

SEQ ID NO: 259 - DNA, 21 bp, Artificial Sequence
  Description of Artificial Sequence: Synthetic oligonucleotide
tggtgggaagagtttagtgtg

SEQ ID NO: 260 - DNA, 21 bp, Artificial Sequence
  Description of Artificial Sequence: Synthetic oligonucleotide
cactaaactcttcccaccacg

SEQ ID NO: 261 - DNA, 21 bp, Artificial Sequence
  Description of Artificial Sequence: Synthetic oligonucleotide
ggtgggaagagtttagtgtga

SEQ ID NO: 262 - DNA, 21 bp, Artificial Sequence
  Description of Artificial Sequence: Synthetic oligonucleotide
acactaaactcttcccaccac

SEQ ID NO: 263 - DNA, 21 bp, Artificial Sequence
  Description of Artificial Sequence: Synthetic oligonucleotide
gtgggaagagtttagtgtgaa

SEQ ID NO: 264 - DNA, 21 bp, Artificial Sequence
  Description of Artificial Sequence: Synthetic oligonucleotide
cacactaaactcttcccacca

SEQ ID NO: 265 - DNA, 21 bp, Artificial Sequence
  Description of Artificial Sequence: Synthetic oligonucleotide
tgggaagagtttagtgtgaaa

SEQ ID NO: 266 - DNA, 21 bp, Artificial Sequence
  Description of Artificial Sequence: Synthetic oligonucleotide
tcacactaaactcttcccacc

SEQ ID NO: 267 - DNA, 21 bp, Artificial Sequence
  Description of Artificial Sequence: Synthetic oligonucleotide
gggaagagtttagtgtgaaac

SEQ ID NO: 268 - DNA, 21 bp, Artificial Sequence
  Description of Artificial Sequence: Synthetic oligonucleotide
ttcacactaaactcttcccac

SEQ ID NO: 269 - DNA, 21 bp, Artificial Sequence
  Description of Artificial Sequence: Synthetic oligonucleotide
ggaagagtttagtgtgaaact

SEQ ID NO: 270 - DNA, 21 bp, Artificial Sequence
  Description of Artificial Sequence: Synthetic oligonucleotide
tttcacactaaactcttccca

SEQ ID NO: 271 - DNA, 21 bp, Artificial Sequence
  Description of Artificial Sequence: Synthetic oligonucleotide
gaagagtttagtgtgaaactg

SEQ ID NO: 272 - DNA, 21 bp, Artificial Sequence
  Description of Artificial Sequence: Synthetic oligonucleotide
gtttcacactaaactcttccc

SEQ ID NO: 273 - DNA, 21 bp, Artificial Sequence
  Description of Artificial Sequence: Synthetic oligonucleotide
aagagtttagtgtgaaactgg

SEQ ID NO: 274 - DNA, 21 bp, Artificial Sequence
  Description of Artificial Sequence: Synthetic oligonucleotide
agtttcacactaaactcttcc

SEQ ID NO: 275 - DNA, 21 bp, Artificial Sequence
  Description of Artificial Sequence: Synthetic oligonucleotide
agagtttagtgtgaaactggg

SEQ ID NO: 276 - DNA, 21 bp, Artificial Sequence
  Description of Artificial Sequence: Synthetic oligonucleotide
cagtttcacactaaactcttc

SEQ ID NO: 277 - DNA, 21 bp, Artificial Sequence
  Description of Artificial Sequence: Synthetic oligonucleotide
gagtttagtgtgaaactgggg

SEQ ID NO: 278 - DNA, 21 bp, Artificial Sequence
  Description of Artificial Sequence: Synthetic oligonucleotide
ccagtttcacactaaactctt

SEQ ID NO: 279 - DNA, 21 bp, Artificial Sequence
  Description of Artificial Sequence: Synthetic oligonucleotide
agtttagtgtgaaactggggt

SEQ ID NO: 280 - DNA, 21 bp, Artificial Sequence
  Description of Artificial Sequence: Synthetic oligonucleotide
cccagtttcacactaaactct

SEQ ID NO: 281 - DNA, 21 bp, Artificial Sequence
  Description of Artificial Sequence: Synthetic oligonucleotide
gtttagtgtgaaactggggtg

SEQ ID NO: 282 - DNA, 21 bp, Artificial Sequence
  Description of Artificial Sequence: Synthetic oligonucleotide
ccccagtttcacactaaactc

SEQ ID NO: 283 - DNA, 21 bp, Artificial Sequence
  Description of Artificial Sequence: Synthetic oligonucleotide
tttagtgtgaaactggggtgg

SEQ ID NO: 284 - DNA, 21 bp, Artificial Sequence
  Description of Artificial Sequence: Synthetic oligonucleotide
accccagtttcacactaaact

SEQ ID NO: 285 - DNA, 21 bp, Artificial Sequence
  Description of Artificial Sequence: Synthetic oligonucleotide
ttagtgtgaaactggggtgga

SEQ ID NO: 286 - DNA, 21 bp, Artificial Sequence
  Description of Artificial Sequence: Synthetic oligonucleotide
caccccagtttcacactaaac

SEQ ID NO: 287 - DNA, 21 bp, Artificial Sequence
  Description of Artificial Sequence: Synthetic oligonucleotide
tagtgtgaaactggggtggaa

SEQ ID NO: 288 - DNA, 21 bp, Artificial Sequence
  Description of Artificial Sequence: Synthetic oligonucleotide
ccaccccagtttcacactaaa

SEQ ID NO: 289 - DNA, 21 bp, Artificial Sequence
  Description of Artificial Sequence: Synthetic oligonucleotide
agtgtgaaactggggtggaat

SEQ ID NO: 290 - DNA, 21 bp, Artificial Sequence
  Description of Artificial Sequence: Synthetic oligonucleotide
tccaccccagtttcacactaa

SEQ ID NO: 291 - DNA, 21 bp, Artificial Sequence
  Description of Artificial Sequence: Synthetic oligonucleotide
gtgtgaaactggggtggaatt

SEQ ID NO: 292 - DNA, 21 bp, Artificial Sequence
  Description of Artificial Sequence: Synthetic oligonucleotide
ttccaccccagtttcacacta

SEQ ID NO: 293 - DNA, 21 bp, Artificial Sequence
  Description of Artificial Sequence: Synthetic oligonucleotide
tgtgaaactggggtggaattg

SEQ ID NO: 294 - DNA, 21 bp, Artificial Sequence
  Description of Artificial Sequence: Synthetic oligonucleotide
attccaccccagtttcacact

SEQ ID NO: 295 - DNA, 21 bp, Artificial Sequence
  Description of Artificial Sequence: Synthetic oligonucleotide
gtgaaactggggtggaattgg

SEQ ID NO: 296 - DNA, 21 bp, Artificial Sequence
  Description of Artificial Sequence: Synthetic oligonucleotide
aattccaccccagtttcacac

SEQ ID NO: 297 - DNA, 21 bp, Artificial Sequence
  Description of Artificial Sequence: Synthetic oligonucleotide
tgaaactggggtggaattggg

SEQ ID NO: 298 - DNA, 21 bp, Artificial Sequence
  Description of Artificial Sequence: Synthetic oligonucleotide
caattccaccccagtttcaca

SEQ ID NO: 299 - DNA, 21 bp, Artificial Sequence
  Description of Artificial Sequence: Synthetic oligonucleotide
gaaactggggtggaattgggt

SEQ ID NO: 300 - DNA, 21 bp, Artificial Sequence
  Description of Artificial Sequence: Synthetic oligonucleotide
ccaattccaccccagtttcac

SEQ ID NO: 301 - DNA, 21 bp, Artificial Sequence
  Description of Artificial Sequence: Synthetic oligonucleotide
aaactggggtggaattgggtg

SEQ ID NO: 302 - DNA, 21 bp, Artificial Sequence
  Description of Artificial Sequence: Synthetic oligonucleotide
cccaattccaccccagtttca

SEQ ID NO: 303 - DNA, 21 bp, Artificial Sequence
  Description of Artificial Sequence: Synthetic oligonucleotide
aactggggtggaattgggtgt

SEQ ID NO: 304 - DNA, 21 bp, Artificial Sequence
  Description of Artificial Sequence: Synthetic oligonucleotide
acccaattccaccccagtttc

SEQ ID NO: 305 - DNA, 21 bp, Artificial Sequence
  Description of Artificial Sequence: Synthetic oligonucleotide
actggggtggaattgggtgtc

SEQ ID NO: 306 - DNA, 21 bp, Artificial Sequence
  Description of Artificial Sequence: Synthetic oligonucleotide
cacccaattccaccccagttt

SEQ ID NO: 307 - DNA, 21 bp, Artificial Sequence
  Description of Artificial Sequence: Synthetic oligonucleotide
ctggggtggaattgggtgtcc

SEQ ID NO: 308 - DNA, 21 bp, Artificial Sequence
  Description of Artificial Sequence: Synthetic oligonucleotide
acacccaattccaccccagtt

SEQ ID NO: 309 - DNA, 21 bp, Artificial Sequence
  Description of Artificial Sequence: Synthetic oligonucleotide
tggggtggaattgggtgtcca

SEQ ID NO: 310 - DNA, 21 bp, Artificial Sequence
  Description of Artificial Sequence: Synthetic oligonucleotide
gacacccaattccaccccagt

SEQ ID NO: 311 - DNA, 21 bp, Artificial Sequence
  Description of Artificial Sequence: Synthetic oligonucleotide
ggggtggaattgggtgtccac

SEQ ID NO: 312 - DNA, 21 bp, Artificial Sequence
  Description of Artificial Sequence: Synthetic oligonucleotide
ggacacccaattccaccccag

SEQ ID NO: 313 - DNA, 21 bp, Artificial Sequence
  Description of Artificial Sequence: Synthetic oligonucleotide
gggtggaattgggtgtccacg

SEQ ID NO: 314 - DNA, 21 bp, Artificial Sequence
  Description of Artificial Sequence: Synthetic oligonucleotide
tggacacccaattccacccca

SEQ ID NO: 315 - DNA, 21 bp, Artificial Sequence
  Description of Artificial Sequence: Synthetic oligonucleotide
ggtggaattgggtgtccacgt

SEQ ID NO: 316 - DNA, 21 bp, Artificial Sequence
  Description of Artificial Sequence: Synthetic oligonucleotide
gtggacacccaattccacccc

SEQ ID NO: 317 - DNA, 21 bp, Artificial Sequence
  Description of Artificial Sequence: Synthetic oligonucleotide
gtggaattgggtgtccacgta

SEQ ID NO: 318 - DNA, 21 bp, Artificial Sequence
  Description of Artificial Sequence: Synthetic oligonucleotide
cgtggacacccaattccaccc

SEQ ID NO: 319 - DNA, 21 bp, Artificial Sequence
  Description of Artificial Sequence: Synthetic oligonucleotide
tggaattgggtgtccacgtat

SEQ ID NO: 320 - DNA, 21 bp, Artificial Sequence
  Description of Artificial Sequence: Synthetic oligonucleotide
acgtggacacccaattccacc

SEQ ID NO: 321 - DNA, 21 bp, Artificial Sequence
  Description of Artificial Sequence: Synthetic oligonucleotide
ggaattgggtgtccacgtatg

SEQ ID NO: 322 - DNA, 21 bp, Artificial Sequence
  Description of Artificial Sequence: Synthetic oligonucleotide
tacgtggacacccaattccac

SEQ ID NO: 323 - DNA, 21 bp, Artificial Sequence
  Description of Artificial Sequence: Synthetic oligonucleotide
gaattgggtgtccacgtatgt

SEQ ID NO: 324 - DNA, 21 bp, Artificial Sequence
  Description of Artificial Sequence: Synthetic oligonucleotide
atacgtggacacccaattcca

SEQ ID NO: 325 - DNA, 21 bp, Artificial Sequence
  Description of Artificial Sequence: Synthetic oligonucleotide
aattgggtgtccacgtatgtt

SEQ ID NO: 326 - DNA, 21 bp, Artificial Sequence
  Description of Artificial Sequence: Synthetic oligonucleotide
catacgtggacacccaattcc

SEQ ID NO: 327 - DNA, 21 bp, Artificial Sequence
  Description of Artificial Sequence: Synthetic oligonucleotide
attgggtgtccacgtatgttc

SEQ ID NO: 328 - DNA, 21 bp, Artificial Sequence
  Description of Artificial Sequence: Synthetic oligonucleotide
acatacgtggacacccaattc

SEQ ID NO: 329 - DNA, 21 bp, Artificial Sequence
  Description of Artificial Sequence: Synthetic oligonucleotide
ttgggtgtccacgtatgttcc

SEQ ID NO: 330 - DNA, 21 bp, Artificial Sequence
  Description of Artificial Sequence: Synthetic oligonucleotide
aacatacgtggacacccaatt

SEQ ID NO: 331 - DNA, 21 bp, Artificial Sequence
  Description of Artificial Sequence: Synthetic oligonucleotide
tgggtgtccacgtatgttccc

SEQ ID NO: 332 - DNA, 21 bp, Artificial Sequence
  Description of Artificial Sequence: Synthetic oligonucleotide
gaacatacgtggacacccaat

SEQ ID NO: 333 - DNA, 21 bp, Artificial Sequence
  Description of Artificial Sequence: Synthetic oligonucleotide
gggtgtccacgtatgttccct

SEQ ID NO: 334 - DNA, 21 bp, Artificial Sequence
  Description of Artificial Sequence: Synthetic oligonucleotide
ggaacatacgtggacacccaa

SEQ ID NO: 335 - DNA, 21 bp, Artificial Sequence
  Description of Artificial Sequence: Synthetic oligonucleotide
ggtgtccacgtatgttccctt

SEQ ID NO: 336 - DNA, 21 bp, Artificial Sequence
  Description of Artificial Sequence: Synthetic oligonucleotide
gggaacatacgtggacaccca

SEQ ID NO: 337 - DNA, 21 bp, Artificial Sequence
  Description of Artificial Sequence: Synthetic oligonucleotide
gtgtccacgtatgttcccttt

SEQ ID NO: 338 - DNA, 21 bp, Artificial Sequence
  Description of Artificial Sequence: Synthetic oligonucleotide
agggaacatacgtggacaccc

SEQ ID NO: 339 - DNA, 21 bp, Artificial Sequence
  Description of Artificial Sequence: Synthetic oligonucleotide
tgtccacgtatgttccctttt

SEQ ID NO: 340 - DNA, 21 bp, Artificial Sequence
  Description of Artificial Sequence: Synthetic oligonucleotide
aagggaacatacgtggacacc

SEQ ID NO: 341 - DNA, 21 bp, Artificial Sequence
  Description of Artificial Sequence: Synthetic oligonucleotide
gtccacgtatgttcccttttg

SEQ ID NO: 342 - DNA, 21 bp, Artificial Sequence
  Description of Artificial Sequence: Synthetic oligonucleotide
aaagggaacatacgtggacac

SEQ ID NO: 343 - DNA, 21 bp, Artificial Sequence
  Description of Artificial Sequence: Synthetic oligonucleotide
tccacgtatgttcccttttgc

SEQ ID NO: 344 - DNA, 21 bp, Artificial Sequence
  Description of Artificial Sequence: Synthetic oligonucleotide
aaaagggaacatacgtggaca

SEQ ID NO: 345 - DNA, 21 bp, Artificial Sequence
  Description of Artificial Sequence: Synthetic oligonucleotide
ccacgtatgttcccttttgcc

SEQ ID NO: 346 - DNA, 21 bp, Artificial Sequence
  Description of Artificial Sequence: Synthetic oligonucleotide
caaaagggaacatacgtggac

SEQ ID NO: 347 - DNA, 21 bp, Artificial Sequence
  Description of Artificial Sequence: Synthetic oligonucleotide
cacgtatgttcccttttgcct

SEQ ID NO: 348 - DNA, 21 bp, Artificial Sequence
  Description of Artificial Sequence: Synthetic oligonucleotide
gcaaaagggaacatacgtgga

SEQ ID NO: 349 - DNA, 21 bp, Artificial Sequence
  Description of Artificial Sequence: Synthetic oligonucleotide
acgtatgttcccttttgcctt

SEQ ID NO: 350 - DNA, 21 bp, Artificial Sequence
  Description of Artificial Sequence: Synthetic oligonucleotide
ggcaaaagggaacatacgtgg

SEQ ID NO: 351 - DNA, 21 bp, Artificial Sequence
  Description of Artificial Sequence: Synthetic oligonucleotide
cgtatgttcccttttgcctta

SEQ ID NO: 352 - DNA, 21 bp, Artificial Sequence
  Description of Artificial Sequence: Synthetic oligonucleotide
aggcaaaagggaacatacgtg

SEQ ID NO: 353 - DNA, 21 bp, Artificial Sequence
  Description of Artificial Sequence: Synthetic oligonucleotide
gtatgttcccttttgccttac

SEQ ID NO: 354 - DNA, 21 bp, Artificial Sequence
  Description of Artificial Sequence: Synthetic oligonucleotide
aaggcaaaagggaacatacgt

SEQ ID NO: 355 - DNA, 21 bp, Artificial Sequence
  Description of Artificial Sequence: Synthetic oligonucleotide
tatgttcccttttgccttact

SEQ ID NO: 356 - DNA, 21 bp, Artificial Sequence
  Description of Artificial Sequence: Synthetic oligonucleotide
taaggcaaaagggaacatacg

SEQ ID NO: 357 - DNA, 21 bp, Artificial Sequence
  Description of Artificial Sequence: Synthetic oligonucleotide
atgttcccttttgccttacta

SEQ ID NO: 358 - DNA, 21 bp, Artificial Sequence
  Description of Artificial Sequence: Synthetic oligonucleotide
gtaaggcaaaagggaacatac

SEQ ID NO: 359 - DNA, 21 bp, Artificial Sequence
  Description of Artificial Sequence: Synthetic oligonucleotide
tgttcccttttgccttactat

SEQ ID NO: 360 - DNA, 21 bp, Artificial Sequence
  Description of Artificial Sequence: Synthetic oligonucleotide
agtaaggcaaaagggaacata

SEQ ID NO: 361 - DNA, 21 bp, Artificial Sequence
  Description of Artificial Sequence: Synthetic oligonucleotide
gttcccttttgccttactata

SEQ ID NO: 362 - DNA, 21 bp, Artificial Sequence
  Description of Artificial Sequence: Synthetic oligonucleotide
tagtaaggcaaaagggaacat

SEQ ID NO: 363 - DNA, 21 bp, Artificial Sequence
  Description of Artificial Sequence: Synthetic oligonucleotide
ttcccttttgccttactatat

SEQ ID NO: 364 - DNA, 21 bp, Artificial Sequence
  Description of Artificial Sequence: Synthetic oligonucleotide
atagtaaggcaaaagggaaca

SEQ ID NO: 365 - DNA, 21 bp, Artificial Sequence
  Description of Artificial Sequence: Synthetic oligonucleotide
tcccttttgccttactatatg

SEQ ID NO: 366 - DNA, 21 bp, Artificial Sequence
  Description of Artificial Sequence: Synthetic oligonucleotide
tatagtaaggcaaaagggaac

SEQ ID NO: 367 - DNA, 21 bp, Artificial Sequence
  Description of Artificial Sequence: Synthetic oligonucleotide
cccttttgccttactatatgt

SEQ ID NO: 368 - DNA, 21 bp, Artificial Sequence
  Description of Artificial Sequence: Synthetic oligonucleotide
atatagtaaggcaaaagggaa

SEQ ID NO: 369 - DNA, 21 bp, Artificial Sequence
  Description of Artificial Sequence: Synthetic oligonucleotide
ccttttgccttactatatgtt

SEQ ID NO: 370 - DNA, 21 bp, Artificial Sequence
  Description of Artificial Sequence: Synthetic oligonucleotide
catatagtaaggcaaaaggga

SEQ ID NO: 371 - DNA, 21 bp, Artificial Sequence
  Description of Artificial Sequence: Synthetic oligonucleotide
cttttgccttactatatgttc

SEQ ID NO: 372 - DNA, 21 bp, Artificial Sequence
  Description of Artificial Sequence: Synthetic oligonucleotide
acatatagtaaggcaaaaggg

SEQ ID NO: 373 - DNA, 21 bp, Artificial Sequence
  Description of Artificial Sequence: Synthetic oligonucleotide
ttttgccttactatatgttct

SEQ ID NO: 374 - DNA, 21 bp, Artificial Sequence
  Description of Artificial Sequence: Synthetic oligonucleotide
aacatatagtaaggcaaaagg

SEQ ID NO: 375 - DNA, 21 bp, Artificial Sequence
  Description of Artificial Sequence: Synthetic oligonucleotide
tttgccttactatatgttctg

SEQ ID NO: 376 - DNA, 21 bp, Artificial Sequence
  Description of Artificial Sequence: Synthetic oligonucleotide
gaacatatagtaaggcaaaag

SEQ ID NO: 377 - DNA, 21 bp, Artificial Sequence
  Description of Artificial Sequence: Synthetic oligonucleotide
ttgccttactatatgttctgt

SEQ ID NO: 378 - DNA, 21 bp, Artificial Sequence
  Description of Artificial Sequence: Synthetic oligonucleotide
agaacatatagtaaggcaaaa

SEQ ID NO: 379 - DNA, 21 bp, Artificial Sequence
  Description of Artificial Sequence: Synthetic oligonucleotide
tgccttactatatgttctgtc

SEQ ID NO: 380 - DNA, 21 bp, Artificial Sequence
  Description of Artificial Sequence: Synthetic oligonucleotide
cagaacatatagtaaggcaaa

SEQ ID NO: 381 - DNA, 21 bp, Artificial Sequence
  Description of Artificial Sequence: Synthetic oligonucleotide
gccttactatatgttctgtca

SEQ ID NO: 382 - DNA, 21 bp, Artificial Sequence
  Description of Artificial Sequence: Synthetic oligonucleotide
acagaacatatagtaaggcaa

SEQ ID NO: 383 - DNA, 21 bp, Artificial Sequence
  Description of Artificial Sequence: Synthetic oligonucleotide
ccttactatatgttctgtcag

SEQ ID NO: 384 - DNA, 21 bp, Artificial Sequence
  Description of Artificial Sequence: Synthetic oligonucleotide
gacagaacatatagtaaggca

SEQ ID NO: 385 - DNA, 21 bp, Artificial Sequence
  Description of Artificial Sequence: Synthetic oligonucleotide
cttactatatgttctgtcagt

SEQ ID NO: 386 - DNA, 21 bp, Artificial Sequence
  Description of Artificial Sequence: Synthetic oligonucleotide
tgacagaacatatagtaaggc

SEQ ID NO: 387 - DNA, 21 bp, Artificial Sequence
  Description of Artificial Sequence: Synthetic oligonucleotide
ttactatatgttctgtcagtt

SEQ ID NO: 388 - DNA, 21 bp, Artificial Sequence
  Description of Artificial Sequence: Synthetic oligonucleotide
ctgacagaacatatagtaagg

SEQ ID NO: 389 - DNA, 21 bp, Artificial Sequence
  Description of Artificial Sequence: Synthetic oligonucleotide
tactatatgttctgtcagttt

SEQ ID NO: 390 - DNA, 21 bp, Artificial Sequence
  Description of Artificial Sequence: Synthetic oligonucleotide
actgacagaacatatagtaag

SEQ ID NO: 391 - DNA, 21 bp, Artificial Sequence
  Description of Artificial Sequence: Synthetic oligonucleotide
actatatgttctgtcagtttc

SEQ ID NO: 392 - DNA, 21 bp, Artificial Sequence
  Description of Artificial Sequence: Synthetic oligonucleotide
aactgacagaacatatagtaa

SEQ ID NO: 393 - DNA, 21 bp, Artificial Sequence
  Description of Artificial Sequence: Synthetic oligonucleotide
ctatatgttctgtcagtttct

SEQ ID NO: 394 - DNA, 21 bp, Artificial Sequence
  Description of Artificial Sequence: Synthetic oligonucleotide
aaactgacagaacatatagta

SEQ ID NO: 395 - DNA, 21 bp, Artificial Sequence
  Description of Artificial Sequence: Synthetic oligonucleotide
tatatgttctgtcagtttctt

SEQ ID NO: 396 - DNA, 21 bp, Artificial Sequence
  Description of Artificial Sequence: Synthetic oligonucleotide
gaaactgacagaacatatagt

SEQ ID NO: 397 - DNA, 21 bp, Artificial Sequence
  Description of Artificial Sequence: Synthetic oligonucleotide
atatgttctgtcagtttcttt

SEQ ID NO: 398 - DNA, 21 bp, Artificial Sequence
  Description of Artificial Sequence: Synthetic oligonucleotide
agaaactgacagaacatatag

SEQ ID NO: 399 - DNA, 21 bp, Artificial Sequence
  Description of Artificial Sequence: Synthetic oligonucleotide
tatgttctgtcagtttctttc

SEQ ID NO: 400 - DNA, 21 bp, Artificial Sequence
  Description of Artificial Sequence: Synthetic oligonucleotide
aagaaactgacagaacatata

SEQ ID NO: 401 - DNA, 21 bp, Artificial Sequence
  Description of Artificial Sequence: Synthetic oligonucleotide
atgttctgtcagtttctttca

SEQ ID NO: 402 - DNA, 21 bp, Artificial Sequence
  Description of Artificial Sequence: Synthetic oligonucleotide
aaagaaactgacagaacatat

SEQ ID NO: 403 - DNA, 21 bp, Artificial Sequence
  Description of Artificial Sequence: Synthetic oligonucleotide
tgttctgtcagtttctttcag

SEQ ID NO: 404 - DNA, 21 bp, Artificial Sequence
  Description of Artificial Sequence: Synthetic oligonucleotide
gaaagaaactgacagaacata

SEQ ID NO: 405 - DNA, 21 bp, Artificial Sequence
  Description of Artificial Sequence: Synthetic oligonucleotide
gttctgtcagtttctttcagg

SEQ ID NO: 406 - DNA, 21 bp, Artificial Sequence
  Description of Artificial Sequence: Synthetic oligonucleotide
tgaaagaaactgacagaacat

SEQ ID NO: 407 - DNA, 21 bp, Artificial Sequence
  Description of Artificial Sequence: Synthetic oligonucleotide
ttctgtcagtttctttcagga

SEQ ID NO: 408 - DNA, 21 bp, Artificial Sequence
  Description of Artificial Sequence: Synthetic oligonucleotide
ctgaaagaaactgacagaaca

SEQ ID NO: 409 - DNA, 21 bp, Artificial Sequence
  Description of Artificial Sequence: Synthetic oligonucleotide
tctgtcagtttctttcaggaa

SEQ ID NO: 410 - DNA, 21 bp, Artificial Sequence
  Description of Artificial Sequence: Synthetic oligonucleotide
cctgaaagaaactgacagaac

SEQ ID NO: 411 - DNA, 21 bp, Artificial Sequence
  Description of Artificial Sequence: Synthetic oligonucleotide
ctgtcagtttctttcaggaaa

SEQ ID NO: 412 - DNA, 21 bp, Artificial Sequence
  Description of Artificial Sequence: Synthetic oligonucleotide
tcctgaaagaaactgacagaa

SEQ ID NO: 413 - DNA, 21 bp, Artificial Sequence
  Description of Artificial Sequence: Synthetic oligonucleotide
tgtcagtttctttcaggaaaa

SEQ ID NO: 414 - DNA, 21 bp, Artificial Sequence
  Description of Artificial Sequence: Synthetic oligonucleotide
ttcctgaaagaaactgacaga

SEQ ID NO: 415 - DNA, 21 bp, Artificial Sequence
  Description of Artificial Sequence: Synthetic oligonucleotide
gtcagtttctttcaggaaaat

SEQ ID NO: 416 - DNA, 21 bp, Artificial Sequence
  Description of Artificial Sequence: Synthetic oligonucleotide
tttcctgaaagaaactgacag

SEQ ID NO: 417 - DNA, 21 bp, Artificial Sequence
  Description of Artificial Sequence: Synthetic oligonucleotide
tcagtttctttcaggaaaatc

SEQ ID NO: 418 - DNA, 21 bp, Artificial Sequence
  Description of Artificial Sequence: Synthetic oligonucleotide
ttttcctgaaagaaactgaca

SEQ ID NO: 419 - DNA, 21 bp, Artificial Sequence
  Description of Artificial Sequence: Synthetic oligonucleotide
cagtttctttcaggaaaatct

SEQ ID NO: 420 - DNA, 21 bp, Artificial Sequence
  Description of Artificial Sequence: Synthetic oligonucleotide
attttcctgaaagaaactgac

SEQ ID NO: 421 - DNA, 21 bp, Artificial Sequence
  Description of Artificial Sequence: Synthetic oligonucleotide
agtttctttcaggaaaatctt

SEQ ID NO: 422 - DNA, 21 bp, Artificial Sequence
  Description of Artificial Sequence: Synthetic oligonucleotide
gattttcctgaaagaaactga

SEQ ID NO: 423 - DNA, 21 bp, Artificial Sequence
  Description of Artificial Sequence: Synthetic oligonucleotide
gtttctttcaggaaaatcttc

SEQ ID NO: 424 - DNA, 21 bp, Artificial Sequence
  Description of Artificial Sequence: Synthetic oligonucleotide
agattttcctgaaagaaactg

SEQ ID NO: 425 - DNA, 21 bp, Artificial Sequence
  Description of Artificial Sequence: Synthetic oligonucleotide
tttctttcaggaaaatcttca

SEQ ID NO: 426 - DNA, 21 bp, Artificial Sequence
  Description of Artificial Sequence: Synthetic oligonucleotide
aagattttcctgaaagaaact

SEQ ID NO: 427 - DNA, 21 bp, Artificial Sequence
  Description of Artificial Sequence: Synthetic oligonucleotide
ttctttcaggaaaatcttcat

SEQ ID NO: 428 - DNA, 21 bp, Artificial Sequence
  Description of Artificial Sequence: Synthetic oligonucleotide
gaagattttcctgaaagaaac

SEQ ID NO: 429 - DNA, 21 bp, Artificial Sequence
  Description of Artificial Sequence: Synthetic oligonucleotide
tctttcaggaaaatcttcatc

SEQ ID NO: 430 - DNA, 21 bp, Artificial Sequence
  Description of Artificial Sequence: Synthetic oligonucleotide
tgaagattttcctgaaagaaa

SEQ ID NO: 431 - DNA, 21 bp, Artificial Sequence
  Description of Artificial Sequence: Synthetic oligonucleotide
ctttcaggaaaatcttcatct

SEQ ID NO: 432 - DNA, 21 bp, Artificial Sequence
  Description of Artificial Sequence: Synthetic oligonucleotide
atgaagattttcctgaaagaa

SEQ ID NO: 433 - DNA, 21 bp, Artificial Sequence
  Description of Artificial Sequence: Synthetic oligonucleotide
tttcaggaaaatcttcatctt

SEQ ID NO: 434 - DNA, 21 bp, Artificial Sequence
  Description of Artificial Sequence: Synthetic oligonucleotide
gatgaagattttcctgaaaga

SEQ ID NO: 435 - DNA, 21 bp, Artificial Sequence
  Description of Artificial Sequence: Synthetic oligonucleotide
ttcaggaaaatcttcatctta

SEQ ID NO: 436 - DNA, 21 bp, Artificial Sequence
  Description of Artificial Sequence: Synthetic oligonucleotide
agatgaagattttcctgaaag

SEQ ID NO: 437 - DNA, 21 bp, Artificial Sequence
  Description of Artificial Sequence: Synthetic oligonucleotide
tcaggaaaatcttcatcttac

SEQ ID NO: 438 - DNA, 21 bp, Artificial Sequence
  Description of Artificial Sequence: Synthetic oligonucleotide
aagatgaagattttcctgaaa

SEQ ID NO: 439 - DNA, 21 bp, Artificial Sequence
  Description of Artificial Sequence: Synthetic oligonucleotide
caggaaaatcttcatcttaca

SEQ ID NO: 440 - DNA, 21 bp, Artificial Sequence
  Description of Artificial Sequence: Synthetic oligonucleotide
taagatgaagattttcctgaa

SEQ ID NO: 441 - DNA, 21 bp, Artificial Sequence
  Description of Artificial Sequence: Synthetic oligonucleotide
aggaaaatcttcatcttacaa

SEQ ID NO: 442 - DNA, 21 bp, Artificial Sequence
  Description of Artificial Sequence: Synthetic oligonucleotide
gtaagatgaagattttcctga

SEQ ID NO: 443 - DNA, 21 bp, Artificial Sequence
  Description of Artificial Sequence: Synthetic oligonucleotide
ggaaaatcttcatcttacaac

SEQ ID NO: 444 - DNA, 21 bp, Artificial Sequence
  Description of Artificial Sequence: Synthetic oligonucleotide
tgtaagatgaagattttcctg

SEQ ID NO: 445 - DNA, 21 bp, Artificial Sequence
  Description of Artificial Sequence: Synthetic oligonucleotide
gaaaatcttcatcttacaact

SEQ ID NO: 446 - DNA, 21 bp, Artificial Sequence
  Description of Artificial Sequence: Synthetic oligonucleotide
ttgtaagatgaagattttcct

SEQ ID NO: 447 - DNA, 21 bp, Artificial Sequence
  Description of Artificial Sequence: Synthetic oligonucleotide
aaaatcttcatcttacaactt

SEQ ID NO: 448 - DNA, 21 bp, Artificial Sequence
  Description of Artificial Sequence: Synthetic oligonucleotide
gttgtaagatgaagattttcc

SEQ ID NO: 449 - DNA, 21 bp, Artificial Sequence
  Description of Artificial Sequence: Synthetic oligonucleotide
aaatcttcatcttacaacttg

SEQ ID NO: 450 - DNA, 21 bp, Artificial Sequence
  Description of Artificial Sequence: Synthetic oligonucleotide
agttgtaagatgaagattttc

SEQ ID NO: 451 - DNA, 21 bp, Artificial Sequence
  Description of Artificial Sequence: Synthetic oligonucleotide
aatcttcatcttacaacttgt

SEQ ID NO: 452 - DNA, 21 bp, Artificial Sequence
  Description of Artificial Sequence: Synthetic oligonucleotide
aagttgtaagatgaagatttt

SEQ ID NO: 453 - DNA, 21 bp, Artificial Sequence
  Description of Artificial Sequence: Synthetic oligonucleotide
atcttcatcttacaacttgta

SEQ ID NO: 454 - DNA, 21 bp, Artificial Sequence
  Description of Artificial Sequence: Synthetic oligonucleotide
caagttgtaagatgaagattt

SEQ ID NO: 455 - DNA, 21 bp, Artificial Sequence
  Description of Artificial Sequence: Synthetic oligonucleotide
tcttcatcttacaacttgtag

SEQ ID NO: 456 - DNA, 21 bp, Artificial Sequence
  Description of Artificial Sequence: Synthetic oligonucleotide
acaagttgtaagatgaagatt

SEQ ID NO: 457 - DNA, 21 bp, Artificial Sequence
  Description of Artificial Sequence: Synthetic oligonucleotide
cttcatcttacaacttgtagg

SEQ ID NO: 458 - DNA, 21 bp, Artificial Sequence
  Description of Artificial Sequence: Synthetic oligonucleotide
tacaagttgtaagatgaagat

SEQ ID NO: 459 - DNA, 21 bp, Artificial Sequence
  Description of Artificial Sequence: Synthetic oligonucleotide
ttcatcttacaacttgtaggg

SEQ ID NO: 460 - DNA, 21 bp, Artificial Sequence
  Description of Artificial Sequence: Synthetic oligonucleotide
ctacaagttgtaagatgaaga

SEQ ID NO: 461 - DNA, 21 bp, Artificial Sequence
  Description of Artificial Sequence: Synthetic oligonucleotide
tcatcttacaacttgtagggc

SEQ ID NO: 462 - DNA, 21 bp, Artificial Sequence
  Description of Artificial Sequence: Synthetic oligonucleotide
cctacaagttgtaagatgaag

SEQ ID NO: 463 - DNA, 21 bp, Artificial Sequence
  Description of Artificial Sequence: Synthetic oligonucleotide
catcttacaacttgtagggct

SEQ ID NO: 464 - DNA, 21 bp, Artificial Sequence
  Description of Artificial Sequence: Synthetic oligonucleotide
ccctacaagttgtaagatgaa

SEQ ID NO: 465 - DNA, 21 bp, Artificial Sequence
  Description of Artificial Sequence: Synthetic oligonucleotide
atcttacaacttgtagggctg

SEQ ID NO: 466 - DNA, 21 bp, Artificial Sequence
  Description of Artificial Sequence: Synthetic oligonucleotide
gccctacaagttgtaagatga

SEQ ID NO: 467 - DNA, 21 bp, Artificial Sequence
  Description of Artificial Sequence: Synthetic oligonucleotide
tcttacaacttgtagggctgg

SEQ ID NO: 468 - DNA, 21 bp, Artificial Sequence
  Description of Artificial Sequence: Synthetic oligonucleotide
agccctacaagttgtaagatg

SEQ ID NO: 469 - DNA, 21 bp, Artificial Sequence
  Description of Artificial Sequence: Synthetic oligonucleotide
cttacaacttgtagggctggt

SEQ ID NO: 470 - DNA, 21 bp, Artificial Sequence
  Description of Artificial Sequence: Synthetic oligonucleotide
cagccctacaagttgtaagat

SEQ ID NO: 471 - DNA, 21 bp, Artificial Sequence
  Description of Artificial Sequence: Synthetic oligonucleotide
ttacaacttgtagggctggtg

SEQ ID NO: 472 - DNA, 21 bp, Artificial Sequence
  Description of Artificial Sequence: Synthetic oligonucleotide
ccagccctacaagttgtaaga

SEQ ID NO: 473 - DNA, 21 bp, Artificial Sequence
  Description of Artificial Sequence: Synthetic oligonucleotide
tacaacttgtagggctggtgt

SEQ ID NO: 474 - DNA, 21 bp, Artificial Sequence
  Description of Artificial Sequence: Synthetic oligonucleotide
accagccctacaagttgtaag

SEQ ID NO: 475 - DNA, 21 bp, Artificial Sequence
  Description of Artificial Sequence: Synthetic oligonucleotide
acaacttgtagggctggtgtt

SEQ ID NO: 476 - DNA, 21 bp, Artificial Sequence
  Description of Artificial Sequence: Synthetic oligonucleotide
caccagccctacaagttgtaa

SEQ ID NO: 477 - DNA, 21 bp, Artificial Sequence
  Description of Artificial Sequence: Synthetic oligonucleotide
caacttgtagggctggtgtta

SEQ ID NO: 478 - DNA, 21 bp, Artificial Sequence
  Description of Artificial Sequence: Synthetic oligonucleotide
acaccagccctacaagttgta

SEQ ID NO: 479 - DNA, 21 bp, Artificial Sequence
  Description of Artificial Sequence: Synthetic oligonucleotide
aacttgtagggctggtgttaa

SEQ ID NO: 480 - DNA, 21 bp, Artificial Sequence
  Description of Artificial Sequence: Synthetic oligonucleotide
aacaccagccctacaagttgt

SEQ ID NO: 481 - DNA, 21 bp, Artificial Sequence
  Description of Artificial Sequence: Synthetic oligonucleotide
acttgtagggctggtgttaac

SEQ ID NO: 482 - DNA, 21 bp, Artificial Sequence
  Description of Artificial Sequence: Synthetic oligonucleotide
taacaccagccctacaagttg

SEQ ID NO: 483 - DNA, 21 bp, Artificial Sequence
  Description of Artificial Sequence: Synthetic oligonucleotide
cttgtagggctggtgttaact

SEQ ID NO: 484 - DNA, 21 bp, Artificial Sequence
  Description of Artificial Sequence: Synthetic oligonucleotide
ttaacaccagccctacaagtt

SEQ ID NO: 485 - DNA, 21 bp, Artificial Sequence
  Description of Artificial Sequence: Synthetic oligonucleotide
ttgtagggctggtgttaactt

SEQ ID NO: 486 - DNA, 21 bp, Artificial Sequence
  Description of Artificial Sequence: Synthetic oligonucleotide
gttaacaccagccctacaagt

SEQ ID NO: 487 - DNA, 21 bp, Artificial Sequence
  Description of Artificial Sequence: Synthetic oligonucleotide
tgtagggctggtgttaactta

SEQ ID NO: 488 - DNA, 21 bp, Artificial Sequence
  Description of Artificial Sequence: Synthetic oligonucleotide
agttaacaccagccctacaag

SEQ ID NO: 489 - DNA, 21 bp, Artificial Sequence
  Description of Artificial Sequence: Synthetic oligonucleotide
gtagggctggtgttaacttac

SEQ ID NO: 490 - DNA, 21 bp, Artificial Sequence
  Description of Artificial Sequence: Synthetic oligonucleotide
aagttaacaccagccctacaa

SEQ ID NO: 491 - DNA, 21 bp, Artificial Sequence
  Description of Artificial Sequence: Synthetic oligonucleotide
tagggctggtgttaacttacg

SEQ ID NO: 492 - DNA, 21 bp, Artificial Sequence
  Description of Artificial Sequence: Synthetic oligonucleotide
taagttaacaccagccctaca

SEQ ID NO: 493 - DNA, 21 bp, Artificial Sequence
  Description of Artificial Sequence: Synthetic oligonucleotide
agggctggtgttaacttacga

SEQ ID NO: 494 - DNA, 21 bp, Artificial Sequence
  Description of Artificial Sequence: Synthetic oligonucleotide
gtaagttaacaccagccctac

SEQ ID NO: 495 - DNA, 21 bp, Artificial Sequence
  Description of Artificial Sequence: Synthetic oligonucleotide
gggctggtgttaacttacgac

SEQ ID NO: 496 - DNA, 21 bp, Artificial Sequence
  Description of Artificial Sequence: Synthetic oligonucleotide
cgtaagttaacaccagcccta

SEQ ID NO: 497 - DNA, 21 bp, Artificial Sequence
  Description of Artificial Sequence: Synthetic oligonucleotide
ggctggtgttaacttacgact

SEQ ID NO: 498 - DNA, 21 bp, Artificial Sequence
  Description of Artificial Sequence: Synthetic oligonucleotide
tcgtaagttaacaccagccct

SEQ ID NO: 499 - DNA, 21 bp, Artificial Sequence
  Description of Artificial Sequence: Synthetic oligonucleotide
gctggtgttaacttacgactt

SEQ ID NO: 500 - DNA, 21 bp, Artificial Sequence
  Description of Artificial Sequence: Synthetic oligonucleotide
gtcgtaagttaacaccagccc

SEQ ID NO: 501 - DNA, 21 bp, Artificial Sequence
  Description of Artificial Sequence: Synthetic oligonucleotide
ctggtgttaacttacgacttc

SEQ ID NO: 502 - DNA, 21 bp, Artificial Sequence
  Description of Artificial Sequence: Synthetic oligonucleotide
agtcgtaagttaacaccagcc

SEQ ID NO: 503 - DNA, 21 bp, Artificial Sequence
  Description of Artificial Sequence: Synthetic oligonucleotide
tggtgttaacttacgacttca

SEQ ID NO: 504 - DNA, 21 bp, Artificial Sequence
  Description of Artificial Sequence: Synthetic oligonucleotide
aagtcgtaagttaacaccagc

SEQ ID NO: 505 - DNA, 21 bp, Artificial Sequence
  Description of Artificial Sequence: Synthetic oligonucleotide
ggtgttaacttacgacttcac

SEQ ID NO: 506 - DNA, 21 bp, Artificial Sequence
  Description of Artificial Sequence: Synthetic oligonucleotide
gaagtcgtaagttaacaccag

SEQ ID NO: 507 - DNA, 21 bp, Artificial Sequence
  Description of Artificial Sequence: Synthetic oligonucleotide
gtgttaacttacgacttcact

SEQ ID NO: 508 - DNA, 21 bp, Artificial Sequence
  Description of Artificial Sequence: Synthetic oligonucleotide
tgaagtcgtaagttaacacca

SEQ ID NO: 509 - DNA, 21 bp, Artificial Sequence
  Description of Artificial Sequence: Synthetic oligonucleotide
tgttaacttacgacttcacta

SEQ ID NO: 510 - DNA, 21 bp, Artificial Sequence
  Description of Artificial Sequence: Synthetic oligonucleotide
gtgaagtcgtaagttaacacc

SEQ ID NO: 511 - DNA, 21 bp, Artificial Sequence
  Description of Artificial Sequence: Synthetic oligonucleotide
gttaacttacgacttcactaa

SEQ ID NO: 512 - DNA, 21 bp, Artificial Sequence
  Description of Artificial Sequence: Synthetic oligonucleotide
agtgaagtcgtaagttaacac

SEQ ID NO: 513 - DNA, 21 bp, Artificial Sequence
  Description of Artificial Sequence: Synthetic oligonucleotide
ttaacttacgacttcactaac

SEQ ID NO: 514 - DNA, 21 bp, Artificial Sequence
  Description of Artificial Sequence: Synthetic oligonucleotide
tagtgaagtcgtaagttaaca

SEQ ID NO: 515 - DNA, 21 bp, Artificial Sequence
  Description of Artificial Sequence: Synthetic oligonucleotide
taacttacgacttcactaact

SEQ ID NO: 516 - DNA, 21 bp, Artificial Sequence
  Description of Artificial Sequence: Synthetic oligonucleotide
ttagtgaagtcgtaagttaac

SEQ ID NO: 517 - DNA, 21 bp, Artificial Sequence
  Description of Artificial Sequence: Synthetic oligonucleotide
aacttacgacttcactaactg

SEQ ID NO: 518 - DNA, 21 bp, Artificial Sequence
  Description of Artificial Sequence: Synthetic oligonucleotide
gttagtgaagtcgtaagttaa

SEQ ID NO: 519 - DNA, 21 bp, Artificial Sequence
  Description of Artificial Sequence: Synthetic oligonucleotide
acttacgacttcactaactgt

SEQ ID NO: 520 - DNA, 21 bp, Artificial Sequence
  Description of Artificial Sequence: Synthetic oligonucleotide
agttagtgaagtcgtaagtta

SEQ ID NO: 521 - DNA, 21 bp, Artificial Sequence
  Description of Artificial Sequence: Synthetic oligonucleotide
cttacgacttcactaactgtg

SEQ ID NO: 522 - DNA, 21 bp, Artificial Sequence
  Description of Artificial Sequence: Synthetic oligonucleotide
cagttagtgaagtcgtaagtt

SEQ ID NO: 523 - DNA, 21 bp, Artificial Sequence
  Description of Artificial Sequence: Synthetic oligonucleotide
ttacgacttcactaactgtga

SEQ ID NO: 524 - DNA, 21 bp, Artificial Sequence
  Description of Artificial Sequence: Synthetic oligonucleotide
acagttagtgaagtcgtaagt

SEQ ID NO: 525 - DNA, 21 bp, Artificial Sequence
  Description of Artificial Sequence: Synthetic oligonucleotide
tacgacttcactaactgtgac

SEQ ID NO: 526 - DNA, 21 bp, Artificial Sequence
  Description of Artificial Sequence: Synthetic oligonucleotide
cacagttagtgaagtcgtaag

SEQ ID NO: 527 - DNA, 21 bp, Artificial Sequence
  Description of Artificial Sequence: Synthetic oligonucleotide
acgacttcactaactgtgact

SEQ ID NO: 528 - DNA, 21 bp, Artificial Sequence
  Description of Artificial Sequence: Synthetic oligonucleotide
tcacagttagtgaagtcgtaa

SEQ ID NO: 529 - DNA, 21 bp, Artificial Sequence
  Description of Artificial Sequence: Synthetic oligonucleotide
cgacttcactaactgtgactt

SEQ ID NO: 530 - DNA, 21 bp, Artificial Sequence
  Description of Artificial Sequence: Synthetic oligonucleotide
gtcacagttagtgaagtcgta

SEQ ID NO: 531 - DNA, 21 bp, Artificial Sequence
  Description of Artificial Sequence: Synthetic oligonucleotide
gacttcactaactgtgacttt

SEQ ID NO: 532 - DNA, 21 bp, Artificial Sequence
  Description of Artificial Sequence: Synthetic oligonucleotide
agtcacagttagtgaagtcgt

SEQ ID NO: 533 - DNA, 21 bp, Artificial Sequence
  Description of Artificial Sequence: Synthetic oligonucleotide
acttcactaactgtgactttg

SEQ ID NO: 534 - DNA, 21 bp, Artificial Sequence
  Description of Artificial Sequence: Synthetic oligonucleotide
aagtcacagttagtgaagtcg

SEQ ID NO: 535 - DNA, 21 bp, Artificial Sequence
  Description of Artificial Sequence: Synthetic oligonucleotide
cttcactaactgtgactttga

SEQ ID NO: 536 - DNA, 21 bp, Artificial Sequence
  Description of Artificial Sequence: Synthetic oligonucleotide
aaagtcacagttagtgaagtc

SEQ ID NO: 537 - DNA, 21 bp, Artificial Sequence
  Description of Artificial Sequence: Synthetic oligonucleotide
ttcactaactgtgactttgag

SEQ ID NO: 538 - DNA, 21 bp, Artificial Sequence
  Description of Artificial Sequence: Synthetic oligonucleotide
caaagtcacagttagtgaagt

SEQ ID NO: 539 - DNA, 21 bp, Artificial Sequence
  Description of Artificial Sequence: Synthetic oligonucleotide
tcactaactgtgactttgaga

SEQ ID NO: 540 - DNA, 21 bp, Artificial Sequence
  Description of Artificial Sequence: Synthetic oligonucleotide
tcaaagtcacagttagtgaag

SEQ ID NO: 541 - DNA, 21 bp, Artificial Sequence
  Description of Artificial Sequence: Synthetic oligonucleotide
cactaactgtgactttgagaa

SEQ ID NO: 542 - DNA, 21 bp, Artificial Sequence
  Description of Artificial Sequence: Synthetic oligonucleotide
ctcaaagtcacagttagtgaa

SEQ ID NO: 543 - DNA, 21 bp, Artificial Sequence
  Description of Artificial Sequence: Synthetic oligonucleotide
actaactgtgactttgagaag

SEQ ID NO: 544 - DNA, 21 bp, Artificial Sequence
  Description of Artificial Sequence: Synthetic oligonucleotide
tctcaaagtcacagttagtga

SEQ ID NO: 545 - DNA, 21 bp, Artificial Sequence
  Description of Artificial Sequence: Synthetic oligonucleotide
ctaactgtgactttgagaaga

SEQ ID NO: 546 - DNA, 21 bp, Artificial Sequence
  Description of Artificial Sequence: Synthetic oligonucleotide
ttctcaaagtcacagttagtg

SEQ ID NO: 547 - DNA, 21 bp, Artificial Sequence
  Description of Artificial Sequence: Synthetic oligonucleotide
taactgtgactttgagaagat

SEQ ID NO: 548 - DNA, 21 bp, Artificial Sequence
  Description of Artificial Sequence: Synthetic oligonucleotide
cttctcaaagtcacagttagt

SEQ ID NO: 549 - DNA, 21 bp, Artificial Sequence
  Description of Artificial Sequence: Synthetic oligonucleotide
aactgtgactttgagaagatt

SEQ ID NO: 550 - DNA, 21 bp, Artificial Sequence
  Description of Artificial Sequence: Synthetic oligonucleotide
tcttctcaaagtcacagttag

SEQ ID NO: 551 - DNA, 21 bp, Artificial Sequence
  Description of Artificial Sequence: Synthetic oligonucleotide
actgtgactttgagaagatta

SEQ ID NO: 552 - DNA, 21 bp, Artificial Sequence
  Description of Artificial Sequence: Synthetic oligonucleotide
atcttctcaaagtcacagtta

SEQ ID NO: 553 - DNA, 21 bp, Artificial Sequence
  Description of Artificial Sequence: Synthetic oligonucleotide
ctgtgactttgagaagattaa

SEQ ID NO: 554 - DNA, 21 bp, Artificial Sequence
  Description of Artificial Sequence: Synthetic oligonucleotide
aatcttctcaaagtcacagtt

SEQ ID NO: 555 - DNA, 21 bp, Artificial Sequence
  Description of Artificial Sequence: Synthetic oligonucleotide
tgtgactttgagaagattaaa

SEQ ID NO: 556 - DNA, 21 bp, Artificial Sequence
  Description of Artificial Sequence: Synthetic oligonucleotide
taatcttctcaaagtcacagt

SEQ ID NO: 557 - DNA, 21 bp, Artificial Sequence
  Description of Artificial Sequence: Synthetic oligonucleotide
gtgactttgagaagattaaag

SEQ ID NO: 558 - DNA, 21 bp, Artificial Sequence
  Description of Artificial Sequence: Synthetic oligonucleotide
ttaatcttctcaaagtcacag

SEQ ID NO: 559 - DNA, 21 bp, Artificial Sequence
  Description of Artificial Sequence: Synthetic oligonucleotide
tgactttgagaagattaaagc

SEQ ID NO: 560 - DNA, 21 bp, Artificial Sequence
  Description of Artificial Sequence: Synthetic oligonucleotide
tttaatcttctcaaagtcaca

SEQ ID NO: 561 - DNA, 21 bp, Artificial Sequence
  Description of Artificial Sequence: Synthetic oligonucleotide
gactttgagaagattaaagca

SEQ ID NO: 562 - DNA, 21 bp, Artificial Sequence
  Description of Artificial Sequence: Synthetic oligonucleotide
ctttaatcttctcaaagtcac

SEQ ID NO: 563 - DNA, 21 bp, Artificial Sequence
  Description of Artificial Sequence: Synthetic oligonucleotide
actttgagaagattaaagcag

SEQ ID NO: 564 - DNA, 21 bp, Artificial Sequence
  Description of Artificial Sequence: Synthetic oligonucleotide
gctttaatcttctcaaagtca

SEQ ID NO: 565 - DNA, 21 bp, Artificial Sequence
  Description of Artificial Sequence: Synthetic oligonucleotide
ctttgagaagattaaagcagc

SEQ ID NO: 566 - DNA, 21 bp, Artificial Sequence
  Description of Artificial Sequence: Synthetic oligonucleotide
tgctttaatcttctcaaagtc

SEQ ID NO: 567 - DNA, 21 bp, Artificial Sequence
  Description of Artificial Sequence: Synthetic oligonucleotide
tttgagaagattaaagcagcc

SEQ ID NO: 568 - DNA, 21 bp, Artificial Sequence
  Description of Artificial Sequence: Synthetic oligonucleotide
ctgctttaatcttctcaaagt

SEQ ID NO: 569 - DNA, 21 bp, Artificial Sequence
  Description of Artificial Sequence: Synthetic oligonucleotide
ttgagaagattaaagcagcct

SEQ ID NO: 570 - DNA, 21 bp, Artificial Sequence
  Description of Artificial Sequence: Synthetic oligonucleotide
gctgctttaatcttctcaaag

SEQ ID NO: 571 - DNA, 21 bp, Artificial Sequence
  Description of Artificial Sequence: Synthetic oligonucleotide
tgagaagattaaagcagccta

SEQ ID NO: 572 - DNA, 21 bp, Artificial Sequence
  Description of Artificial Sequence: Synthetic oligonucleotide
ggctgctttaatcttctcaaa

SEQ ID NO: 573 - DNA, 21 bp, Artificial Sequence
  Description of Artificial Sequence: Synthetic oligonucleotide
gagaagattaaagcagcctat

SEQ ID NO: 574 - DNA, 21 bp, Artificial Sequence
  Description of Artificial Sequence: Synthetic oligonucleotide
aggctgctttaatcttctcaa

SEQ ID NO: 575 - DNA, 21 bp, Artificial Sequence
  Description of Artificial Sequence: Synthetic oligonucleotide
agaagattaaagcagcctatc

SEQ ID NO: 576 - DNA, 21 bp, Artificial Sequence
  Description of Artificial Sequence: Synthetic oligonucleotide
taggctgctttaatcttctca

SEQ ID NO: 577 - DNA, 21 bp, Artificial Sequence
  Description of Artificial Sequence: Synthetic oligonucleotide
gaagattaaagcagcctatct

SEQ ID NO: 578 - DNA, 21 bp, Artificial Sequence
  Description of Artificial Sequence: Synthetic oligonucleotide
ataggctgctttaatcttctc

SEQ ID NO: 579 - DNA, 21 bp, Artificial Sequence
  Description of Artificial Sequence: Synthetic oligonucleotide
aagattaaagcagcctatctc

SEQ ID NO: 580 - DNA, 21 bp, Artificial Sequence
  Description of Artificial Sequence: Synthetic oligonucleotide
gataggctgctttaatcttct

SEQ ID NO: 581 - DNA, 21 bp, Artificial Sequence
  Description of Artificial Sequence: Synthetic oligonucleotide
agattaaagcagcctatctca

SEQ ID NO: 582 - DNA, 21 bp, Artificial Sequence
  Description of Artificial Sequence: Synthetic oligonucleotide
agataggctgctttaatcttc

SEQ ID NO: 583 - DNA, 21 bp, Artificial Sequence
  Description of Artificial Sequence: Synthetic oligonucleotide
gattaaagcagcctatctcag

SEQ ID NO: 584 - DNA, 21 bp, Artificial Sequence
  Description of Artificial Sequence: Synthetic oligonucleotide
gagataggctgctttaatctt

SEQ ID NO: 585 - DNA, 21 bp, Artificial Sequence
  Description of Artificial Sequence: Synthetic oligonucleotide
attaaagcagcctatctcagt

SEQ ID NO: 586 - DNA, 21 bp, Artificial Sequence
  Description of Artificial Sequence: Synthetic oligonucleotide
tgagataggctgctttaatct

SEQ ID NO: 587 - DNA, 21 bp, Artificial Sequence
  Description of Artificial Sequence: Synthetic oligonucleotide
ttaaagcagcctatctcagta

SEQ ID NO: 588 - DNA, 21 bp, Artificial Sequence
  Description of Artificial Sequence: Synthetic oligonucleotide
ctgagataggctgctttaatc

SEQ ID NO: 589 - DNA, 21 bp, Artificial Sequence
  Description of Artificial Sequence: Synthetic oligonucleotide
taaagcagcctatctcagtac

SEQ ID NO: 590 - DNA, 21 bp, Artificial Sequence
  Description of Artificial Sequence: Synthetic oligonucleotide
actgagataggctgctttaat

SEQ ID NO: 591 - DNA, 21 bp, Artificial Sequence
  Description of Artificial Sequence: Synthetic oligonucleotide
aaagcagcctatctcagtact

SEQ ID NO: 592 - DNA, 21 bp, Artificial Sequence
  Description of Artificial Sequence: Synthetic oligonucleotide
tactgagataggctgctttaa

SEQ ID NO: 593 - DNA, 21 bp, Artificial Sequence
  Description of Artificial Sequence: Synthetic oligonucleotide
aagcagcctatctcagtacta

SEQ ID NO: 594 - DNA, 21 bp, Artificial Sequence
  Description of Artificial Sequence: Synthetic oligonucleotide
gtactgagataggctgcttta

SEQ ID NO: 595 - DNA, 21 bp, Artificial Sequence
  Description of Artificial Sequence: Synthetic oligonucleotide
agcagcctatctcagtactat

SEQ ID NO: 596 - DNA, 21 bp, Artificial Sequence
  Description of Artificial Sequence: Synthetic oligonucleotide
agtactgagataggctgcttt

SEQ ID NO: 597 - DNA, 21 bp, Artificial Sequence
  Description of Artificial Sequence: Synthetic oligonucleotide
gcagcctatctcagtactatt

SEQ ID NO: 598 - DNA, 21 bp, Artificial Sequence
  Description of Artificial Sequence: Synthetic oligonucleotide
tagtactgagataggctgctt

SEQ ID NO: 599 - DNA, 21 bp, Artificial Sequence
  Description of Artificial Sequence: Synthetic oligonucleotide
cagcctatctcagtactattt

SEQ ID NO: 600 - DNA, 21 bp, Artificial Sequence
  Description of Artificial Sequence: Synthetic oligonucleotide
atagtactgagataggctgct

SEQ ID NO: 601 - DNA, 21 bp, Artificial Sequence
  Description of Artificial Sequence: Synthetic oligonucleotide
agcctatctcagtactatttc

SEQ ID NO: 602 - DNA, 21 bp, Artificial Sequence
  Description of Artificial Sequence: Synthetic oligonucleotide
aatagtactgagataggctgc

SEQ ID NO: 603 - DNA, 21 bp, Artificial Sequence
  Description of Artificial Sequence: Synthetic oligonucleotide
gcctatctcagtactatttct

SEQ ID NO: 604 - DNA, 21 bp, Artificial Sequence
  Description of Artificial Sequence: Synthetic oligonucleotide
aaatagtactgagataggctg

SEQ ID NO: 605 - DNA, 21 bp, Artificial Sequence
  Description of Artificial Sequence: Synthetic oligonucleotide
cctatctcagtactatttcta

SEQ ID NO: 606 - DNA, 21 bp, Artificial Sequence
  Description of Artificial Sequence: Synthetic oligonucleotide
gaaatagtactgagataggct

SEQ ID NO: 607 - DNA, 21 bp, Artificial Sequence
  Description of Artificial Sequence: Synthetic oligonucleotide
ctatctcagtactatttctaa

SEQ ID NO: 608 - DNA, 21 bp, Artificial Sequence
  Description of Artificial Sequence: Synthetic oligonucleotide
agaaatagtactgagataggc

SEQ ID NO: 609 - DNA, 21 bp, Artificial Sequence
  Description of Artificial Sequence: Synthetic oligonucleotide
tatctcagtactatttctaaa

SEQ ID NO: 610 - DNA, 21 bp, Artificial Sequence
  Description of Artificial Sequence: Synthetic oligonucleotide
tagaaatagtactgagatagg

SEQ ID NO: 611 - DNA, 21 bp, Artificial Sequence
  Description of Artificial Sequence: Synthetic oligonucleotide
atctcagtactatttctaaag

SEQ ID NO: 612 - DNA, 21 bp, Artificial Sequence
  Description of Artificial Sequence: Synthetic oligonucleotide
ttagaaatagtactgagatag

SEQ ID NO: 613 - DNA, 21 bp, Artificial Sequence
  Description of Artificial Sequence: Synthetic oligonucleotide
tctcagtactatttctaaaga

SEQ ID NO: 614 - DNA, 21 bp, Artificial Sequence
  Description of Artificial Sequence: Synthetic oligonucleotide
tttagaaatagtactgagata

SEQ ID NO: 615 - DNA, 21 bp, Artificial Sequence
  Description of Artificial Sequence: Synthetic oligonucleotide
ctcagtactatttctaaagac

SEQ ID NO: 616 - DNA, 21 bp, Artificial Sequence
  Description of Artificial Sequence: Synthetic oligonucleotide
ctttagaaatagtactgagat

SEQ ID NO: 617 - DNA, 21 bp, Artificial Sequence
  Description of Artificial Sequence: Synthetic oligonucleotide
tcagtactatttctaaagacc

SEQ ID NO: 618 - DNA, 21 bp, Artificial Sequence
  Description of Artificial Sequence: Synthetic oligonucleotide
tctttagaaatagtactgaga

SEQ ID NO: 619 - DNA, 21 bp, Artificial Sequence
  Description of Artificial Sequence: Synthetic oligonucleotide
cagtactatttctaaagacct

SEQ ID NO: 620 - DNA, 21 bp, Artificial Sequence
  Description of Artificial Sequence: Synthetic oligonucleotide
gtctttagaaatagtactgag

SEQ ID NO: 621 - DNA, 21 bp, Artificial Sequence
  Description of Artificial Sequence: Synthetic oligonucleotide
agtactatttctaaagacctg

SEQ ID NO: 622 - DNA, 21 bp, Artificial Sequence
  Description of Artificial Sequence: Synthetic oligonucleotide
ggtctttagaaatagtactga

SEQ ID NO: 623 - DNA, 21 bp, Artificial Sequence
  Description of Artificial Sequence: Synthetic oligonucleotide
gtactatttctaaagacctga

SEQ ID NO: 624 - DNA, 21 bp, Artificial Sequence
  Description of Artificial Sequence: Synthetic oligonucleotide
aggtctttagaaatagtactg

SEQ ID NO: 625 - DNA, 21 bp, Artificial Sequence
  Description of Artificial Sequence: Synthetic oligonucleotide
tactatttctaaagacctgat

SEQ ID NO: 626 - DNA, 21 bp, Artificial Sequence
  Description of Artificial Sequence: Synthetic oligonucleotide
caggtctttagaaatagtact

SEQ ID NO: 627 - DNA, 21 bp, Artificial Sequence
  Description of Artificial Sequence: Synthetic oligonucleotide
actatttctaaagacctgatt

SEQ ID NO: 628 - DNA, 21 bp, Artificial Sequence
  Description of Artificial Sequence: Synthetic oligonucleotide
tcaggtctttagaaatagtac

SEQ ID NO: 629 - DNA, 21 bp, Artificial Sequence
  Description of Artificial Sequence: Synthetic oligonucleotide
ctatttctaaagacctgatta

SEQ ID NO: 630 - DNA, 21 bp, Artificial Sequence
  Description of Artificial Sequence: Synthetic oligonucleotide
atcaggtctttagaaatagta

SEQ ID NO: 631 - DNA, 21 bp, Artificial Sequence
  Description of Artificial Sequence: Synthetic oligonucleotide
tatttctaaagacctgattac

SEQ ID NO: 632 - DNA, 21 bp, Artificial Sequence
  Description of Artificial Sequence: Synthetic oligonucleotide
aatcaggtctttagaaatagt

SEQ ID NO: 633 - DNA, 21 bp, Artificial Sequence
  Description of Artificial Sequence: Synthetic oligonucleotide
atttctaaagacctgattaca

SEQ ID NO: 634 - DNA, 21 bp, Artificial Sequence
  Description of Artificial Sequence: Synthetic oligonucleotide
taatcaggtctttagaaatag

SEQ ID NO: 635 - DNA, 21 bp, Artificial Sequence
  Description of Artificial Sequence: Synthetic oligonucleotide
tttctaaagacctgattacat

SEQ ID NO: 636 - DNA, 21 bp, Artificial Sequence
  Description of Artificial Sequence: Synthetic oligonucleotide
gtaatcaggtctttagaaata

SEQ ID NO: 637 - DNA, 21 bp, Artificial Sequence
  Description of Artificial Sequence: Synthetic oligonucleotide
ttctaaagacctgattacata

SEQ ID NO: 638 - DNA, 21 bp, Artificial Sequence
  Description of Artificial Sequence: Synthetic oligonucleotide
tgtaatcaggtctttagaaat

SEQ ID NO: 639 - DNA, 21 bp, Artificial Sequence
  Description of Artificial Sequence: Synthetic oligonucleotide
tctaaagacctgattacatat

SEQ ID NO: 640 - DNA, 21 bp, Artificial Sequence
  Description of Artificial Sequence: Synthetic oligonucleotide
atgtaatcaggtctttagaaa

SEQ ID NO: 641 - DNA, 21 bp, Artificial Sequence
  Description of Artificial Sequence: Synthetic oligonucleotide
ctaaagacctgattacatata

SEQ ID NO: 642 - DNA, 21 bp, Artificial Sequence
  Description of Artificial Sequence: Synthetic oligonucleotide
tatgtaatcaggtctttagaa

SEQ ID NO: 643 - DNA, 21 bp, Artificial Sequence
  Description of Artificial Sequence: Synthetic oligonucleotide
taaagacctgattacatatat

SEQ ID NO: 644 - DNA, 21 bp, Artificial Sequence
  Description of Artificial Sequence: Synthetic oligonucleotide
atatgtaatcaggtctttaga

SEQ ID NO: 645 - DNA, 21 bp, Artificial Sequence
  Description of Artificial Sequence: Synthetic oligonucleotide
aaagacctgattacatatatg

SEQ ID NO: 646 - DNA, 21 bp, Artificial Sequence
  Description of Artificial Sequence: Synthetic oligonucleotide
tatatgtaatcaggtctttag

SEQ ID NO: 647 - DNA, 21 bp, Artificial Sequence
  Description of Artificial Sequence: Synthetic oligonucleotide
aagacctgattacatatatga

SEQ ID NO: 648 - DNA, 21 bp, Artificial Sequence
  Description of Artificial Sequence: Synthetic oligonucleotide
atatatgtaatcaggtcttta

SEQ ID NO: 649 - DNA, 21 bp, Artificial Sequence
  Description of Artificial Sequence: Synthetic oligonucleotide
agacctgattacatatatgag

SEQ ID NO: 650 - DNA, 21 bp, Artificial Sequence
  Description of Artificial Sequence: Synthetic oligonucleotide
catatatgtaatcaggtcttt

SEQ ID NO: 651 - DNA, 21 bp, Artificial Sequence
  Description of Artificial Sequence: Synthetic oligonucleotide
gacctgattacatatatgagt

SEQ ID NO: 652 - DNA, 21 bp, Artificial Sequence
  Description of Artificial Sequence: Synthetic oligonucleotide
tcatatatgtaatcaggtctt

SEQ ID NO: 653 - DNA, 21 bp, Artificial Sequence
  Description of Artificial Sequence: Synthetic oligonucleotide
acctgattacatatatgagtg

SEQ ID NO: 654 - DNA, 21 bp, Artificial Sequence
  Description of Artificial Sequence: Synthetic oligonucleotide
ctcatatatgtaatcaggtct

SEQ ID NO: 655 - DNA, 21 bp, Artificial Sequence
  Description of Artificial Sequence: Synthetic oligonucleotide
cctgattacatatatgagtgg

SEQ ID NO: 656 - DNA, 21 bp, Artificial Sequence
  Description of Artificial Sequence: Synthetic oligonucleotide
actcatatatgtaatcaggtc

SEQ ID NO: 657 - DNA, 21 bp, Artificial Sequence
  Description of Artificial Sequence: Synthetic oligonucleotide
ctgattacatatatgagtggg

SEQ ID NO: 658 - DNA, 21 bp, Artificial Sequence
  Description of Artificial Sequence: Synthetic oligonucleotide
cactcatatatgtaatcaggt

SEQ ID NO: 659 - DNA, 21 bp, Artificial Sequence
  Description of Artificial Sequence: Synthetic oligonucleotide
tgattacatatatgagtggga

SEQ ID NO: 660 - DNA, 21 bp, Artificial Sequence
  Description of Artificial Sequence: Synthetic oligonucleotide
ccactcatatatgtaatcagg

SEQ ID NO: 661 - DNA, 21 bp, Artificial Sequence
  Description of Artificial Sequence: Synthetic oligonucleotide
gattacatatatgagtgggac

SEQ ID NO: 662 - DNA, 21 bp, Artificial Sequence
  Description of Artificial Sequence: Synthetic oligonucleotide
cccactcatatatgtaatcag

SEQ ID NO: 663 - DNA, 21 bp, Artificial Sequence
  Description of Artificial Sequence: Synthetic oligonucleotide
attacatatatgagtgggacc

SEQ ID NO: 664 - DNA, 21 bp, Artificial Sequence
  Description of Artificial Sequence: Synthetic oligonucleotide
tcccactcatatatgtaatca

SEQ ID NO: 665 - DNA, 21 bp, Artificial Sequence
  Description of Artificial Sequence: Synthetic oligonucleotide
ttacatatatgagtgggacca

SEQ ID NO: 666 - DNA, 21 bp, Artificial Sequence
  Description of Artificial Sequence: Synthetic oligonucleotide
gtcccactcatatatgtaatc

SEQ ID NO: 667 - DNA, 21 bp, Artificial Sequence
  Description of Artificial Sequence: Synthetic oligonucleotide
tacatatatgagtgggaccaa

SEQ ID NO: 668 - DNA, 21 bp, Artificial Sequence
  Description of Artificial Sequence: Synthetic oligonucleotide
ggtcccactcatatatgtaat

SEQ ID NO: 669 - DNA, 21 bp, Artificial Sequence
  Description of Artificial Sequence: Synthetic oligonucleotide
acatatatgagtgggaccaaa

SEQ ID NO: 670 - DNA, 21 bp, Artificial Sequence
  Description of Artificial Sequence: Synthetic oligonucleotide
tggtcccactcatatatgtaa

SEQ ID NO: 671 - DNA, 21 bp, Artificial Sequence
  Description of Artificial Sequence: Synthetic oligonucleotide
catatatgagtgggaccaaaa

SEQ ID NO: 672 - DNA, 21 bp, Artificial Sequence
  Description of Artificial Sequence: Synthetic oligonucleotide
ttggtcccactcatatatgta

SEQ ID NO: 673 - DNA, 21 bp, Artificial Sequence
  Description of Artificial Sequence: Synthetic oligonucleotide
atatatgagtgggaccaaaag

SEQ ID NO: 674 - DNA, 21 bp, Artificial Sequence
  Description of Artificial Sequence: Synthetic oligonucleotide
tttggtcccactcatatatgt

SEQ ID NO: 675 - DNA, 21 bp, Artificial Sequence
  Description of Artificial Sequence: Synthetic oligonucleotide
tatatgagtgggaccaaaagt

SEQ ID NO: 676 - DNA, 21 bp, Artificial Sequence
  Description of Artificial Sequence: Synthetic oligonucleotide
ttttggtcccactcatatatg

SEQ ID NO: 677 - DNA, 21 bp, Artificial Sequence
  Description of Artificial Sequence: Synthetic oligonucleotide
atatgagtgggaccaaaagta

SEQ ID NO: 678 - DNA, 21 bp, Artificial Sequence
  Description of Artificial Sequence: Synthetic oligonucleotide
cttttggtcccactcatatat

SEQ ID NO: 679 - DNA, 21 bp, Artificial Sequence
  Description of Artificial Sequence: Synthetic oligonucleotide
tatgagtgggaccaaaagtac

SEQ ID NO: 680 - DNA, 21 bp, Artificial Sequence
  Description of Artificial Sequence: Synthetic oligonucleotide
acttttggtcccactcatata

SEQ ID NO: 681 - DNA, 21 bp, Artificial Sequence
  Description of Artificial Sequence: Synthetic oligonucleotide
atgagtgggaccaaaagtacc

SEQ ID NO: 682 - DNA, 21 bp, Artificial Sequence
  Description of Artificial Sequence: Synthetic oligonucleotide
tacttttggtcccactcatat

SEQ ID NO: 683 - DNA, 21 bp, Artificial Sequence
  Description of Artificial Sequence: Synthetic oligonucleotide
tgagtgggaccaaaagtaccg

SEQ ID NO: 684 - DNA, 21 bp, Artificial Sequence
  Description of Artificial Sequence: Synthetic oligonucleotide
gtacttttggtcccactcata

SEQ ID NO: 685 - DNA, 21 bp, Artificial Sequence
  Description of Artificial Sequence: Synthetic oligonucleotide
gagtgggaccaaaagtaccga

SEQ ID NO: 686 - DNA, 21 bp, Artificial Sequence
  Description of Artificial Sequence: Synthetic oligonucleotide
ggtacttttggtcccactcat

SEQ ID NO: 687 - DNA, 21 bp, Artificial Sequence
  Description of Artificial Sequence: Synthetic oligonucleotide
agtgggaccaaaagtaccgag

SEQ ID NO: 688 - DNA, 21 bp, Artificial Sequence
  Description of Artificial Sequence: Synthetic oligonucleotide
cggtacttttggtcccactca

SEQ ID NO: 689 - DNA, 21 bp, Artificial Sequence
  Description of Artificial Sequence: Synthetic oligonucleotide
gtgggaccaaaagtaccgagt

SEQ ID NO: 690 - DNA, 21 bp, Artificial Sequence
  Description of Artificial Sequence: Synthetic oligonucleotide
tcggtacttttggtcccactc

SEQ ID NO: 691 - DNA, 21 bp, Artificial Sequence
  Description of Artificial Sequence: Synthetic oligonucleotide
tgggaccaaaagtaccgagtt

SEQ ID NO: 692 - DNA, 21 bp, Artificial Sequence
  Description of Artificial Sequence: Synthetic oligonucleotide
ctcggtacttttggtcccact

SEQ ID NO: 693 - DNA, 21 bp, Artificial Sequence
  Description of Artificial Sequence: Synthetic oligonucleotide
gggaccaaaagtaccgagttc

SEQ ID NO: 694 - DNA, 21 bp, Artificial Sequence
  Description of Artificial Sequence: Synthetic oligonucleotide
actcggtacttttggtcccac

SEQ ID NO: 695 - DNA, 21 bp, Artificial Sequence
  Description of Artificial Sequence: Synthetic oligonucleotide
ggaccaaaagtaccgagttca

SEQ ID NO: 696 - DNA, 21 bp, Artificial Sequence
  Description of Artificial Sequence: Synthetic oligonucleotide
aactcggtacttttggtccca

SEQ ID NO: 697 - DNA, 21 bp, Artificial Sequence
  Description of Artificial Sequence: Synthetic oligonucleotide
gaccaaaagtaccgagttcaa

SEQ ID NO: 698 - DNA, 21 bp, Artificial Sequence
  Description of Artificial Sequence: Synthetic oligonucleotide
gaactcggtacttttggtccc

SEQ ID NO: 699 - DNA, 21 bp, Artificial Sequence
  Description of Artificial Sequence: Synthetic oligonucleotide
accaaaagtaccgagttcaac

SEQ ID NO: 700 - DNA, 21 bp, Artificial Sequence
  Description of Artificial Sequence: Synthetic oligonucleotide
tgaactcggtacttttggtcc

SEQ ID NO: 701 - DNA, 21 bp, Artificial Sequence
  Description of Artificial Sequence: Synthetic oligonucleotide
ccaaaagtaccgagttcaaca

SEQ ID NO: 702 - DNA, 21 bp, Artificial Sequence
  Description of Artificial Sequence: Synthetic oligonucleotide
ttgaactcggtacttttggtc

SEQ ID NO: 703 - DNA, 21 bp, Artificial Sequence
  Description of Artificial Sequence: Synthetic oligonucleotide
caaaagtaccgagttcaacaa

SEQ ID NO: 704 - DNA, 21 bp, Artificial Sequence
  Description of Artificial Sequence: Synthetic oligonucleotide
gttgaactcggtacttttggt

SEQ ID NO: 705 - DNA, 21 bp, Artificial Sequence
  Description of Artificial Sequence: Synthetic oligonucleotide
aaaagtaccgagttcaacaac

SEQ ID NO: 706 - DNA, 21 bp, Artificial Sequence
  Description of Artificial Sequence: Synthetic oligonucleotide
tgttgaactcggtacttttgg

SEQ ID NO: 707 - DNA, 21 bp, Artificial Sequence
  Description of Artificial Sequence: Synthetic oligonucleotide
aaagtaccgagttcaacaaca

SEQ ID NO: 708 - DNA, 21 bp, Artificial Sequence
  Description of Artificial Sequence: Synthetic oligonucleotide
ttgttgaactcggtacttttg

SEQ ID NO: 709 - DNA, 21 bp, Artificial Sequence
  Description of Artificial Sequence: Synthetic oligonucleotide
aagtaccgagttcaacaacac

SEQ ID NO: 710 - DNA, 21 bp, Artificial Sequence
  Description of Artificial Sequence: Synthetic oligonucleotide
gttgttgaactcggtactttt

SEQ ID NO: 711 - DNA, 21 bp, Artificial Sequence
  Description of Artificial Sequence: Synthetic oligonucleotide
agtaccgagttcaacaacacc

SEQ ID NO: 712 - DNA, 21 bp, Artificial Sequence
  Description of Artificial Sequence: Synthetic oligonucleotide
tgttgttgaactcggtacttt

SEQ ID NO: 713 - DNA, 21 bp, Artificial Sequence
  Description of Artificial Sequence: Synthetic oligonucleotide
gtaccgagttcaacaacaccg

SEQ ID NO: 714 - DNA, 21 bp, Artificial Sequence
  Description of Artificial Sequence: Synthetic oligonucleotide
gtgttgttgaactcggtactt

SEQ ID NO: 715 - DNA, 21 bp, Artificial Sequence
  Description of Artificial Sequence: Synthetic oligonucleotide
taccgagttcaacaacaccgt

SEQ ID NO: 716 - DNA, 21 bp, Artificial Sequence
  Description of Artificial Sequence: Synthetic oligonucleotide
ggtgttgttgaactcggtact

SEQ ID NO: 717 - DNA, 21 bp, Artificial Sequence
  Description of Artificial Sequence: Synthetic oligonucleotide
accgagttcaacaacaccgtc

SEQ ID NO: 718 - DNA, 21 bp, Artificial Sequence
  Description of Artificial Sequence: Synthetic oligonucleotide
cggtgttgttgaactcggtac

SEQ ID NO: 719 - DNA, 21 bp, Artificial Sequence
  Description of Artificial Sequence: Synthetic oligonucleotide
ccgagttcaacaacaccgtct

SEQ ID NO: 720 - DNA, 21 bp, Artificial Sequence
  Description of Artificial Sequence: Synthetic oligonucleotide
acggtgttgttgaactcggta

SEQ ID NO: 721 - DNA, 21 bp, Artificial Sequence
  Description of Artificial Sequence: Synthetic oligonucleotide
cgagttcaacaacaccgtctc

SEQ ID NO: 722 - DNA, 21 bp, Artificial Sequence
  Description of Artificial Sequence: Synthetic oligonucleotide
gacggtgttgttgaactcggt

SEQ ID NO: 723 - DNA, 21 bp, Artificial Sequence
  Description of Artificial Sequence: Synthetic oligonucleotide
gagttcaacaacaccgtctct

SEQ ID NO: 724 - DNA, 21 bp, Artificial Sequence
  Description of Artificial Sequence: Synthetic oligonucleotide
agacggtgttgttgaactcgg

SEQ ID NO: 725 - DNA, 21 bp, Artificial Sequence
  Description of Artificial Sequence: Synthetic oligonucleotide
agttcaacaacaccgtctctt

SEQ ID NO: 726 - DNA, 21 bp, Artificial Sequence
  Description of Artificial Sequence: Synthetic oligonucleotide
gagacggtgttgttgaactcg

SEQ ID NO: 727 - DNA, 21 bp, Artificial Sequence
  Description of Artificial Sequence: Synthetic oligonucleotide
gttcaacaacaccgtctcttg

SEQ ID NO: 728 - DNA, 21 bp, Artificial Sequence
  Description of Artificial Sequence: Synthetic oligonucleotide
agagacggtgttgttgaactc

SEQ ID NO: 729 - DNA, 21 bp, Artificial Sequence
  Description of Artificial Sequence: Synthetic oligonucleotide
ttcaacaacaccgtctcttgt

SEQ ID NO: 730 - DNA, 21 bp, Artificial Sequence
  Description of Artificial Sequence: Synthetic oligonucleotide
aagagacggtgttgttgaact

SEQ ID NO: 731 - DNA, 21 bp, Artificial Sequence
  Description of Artificial Sequence: Synthetic oligonucleotide
tcaacaacaccgtctcttgta

SEQ ID NO: 732 - DNA, 21 bp, Artificial Sequence
  Description of Artificial Sequence: Synthetic oligonucleotide
caagagacggtgttgttgaac

SEQ ID NO: 733 - DNA, 21 bp, Artificial Sequence
  Description of Artificial Sequence: Synthetic oligonucleotide
caacaacaccgtctcttgtag

SEQ ID NO: 734 - DNA, 21 bp, Artificial Sequence
  Description of Artificial Sequence: Synthetic oligonucleotide
acaagagacggtgttgttgaa

SEQ ID NO: 735 - DNA, 21 bp, Artificial Sequence
  Description of Artificial Sequence: Synthetic oligonucleotide
aacaacaccgtctcttgtagc

SEQ ID NO: 736 - DNA, 21 bp, Artificial Sequence
  Description of Artificial Sequence: Synthetic oligonucleotide
tacaagagacggtgttgttga

SEQ ID NO: 737 - DNA, 21 bp, Artificial Sequence
  Description of Artificial Sequence: Synthetic oligonucleotide
acaacaccgtctcttgtagca

SEQ ID NO: 738 - DNA, 21 bp, Artificial Sequence
  Description of Artificial Sequence: Synthetic oligonucleotide
ctacaagagacggtgttgttg

SEQ ID NO: 739 - DNA, 21 bp, Artificial Sequence
  Description of Artificial Sequence: Synthetic oligonucleotide
caacaccgtctcttgtagcaa

SEQ ID NO: 740 - DNA, 21 bp, Artificial Sequence
  Description of Artificial Sequence: Synthetic oligonucleotide
gctacaagagacggtgttgtt

SEQ ID NO: 741 - DNA, 21 bp, Artificial Sequence
  Description of Artificial Sequence: Synthetic oligonucleotide
aacaccgtctcttgtagcaat

SEQ ID NO: 742 - DNA, 21 bp, Artificial Sequence
  Description of Artificial Sequence: Synthetic oligonucleotide
tgctacaagagacggtgttgt

SEQ ID NO: 743 - DNA, 21 bp, Artificial Sequence
  Description of Artificial Sequence: Synthetic oligonucleotide
acaccgtctcttgtagcaatc

SEQ ID NO: 744 - DNA, 21 bp, Artificial Sequence
  Description of Artificial Sequence: Synthetic oligonucleotide
ttgctacaagagacggtgttg

SEQ ID NO: 745 - DNA, 21 bp, Artificial Sequence
  Description of Artificial Sequence: Synthetic oligonucleotide
caccgtctcttgtagcaatcg

SEQ ID NO: 746 - DNA, 21 bp, Artificial Sequence
  Description of Artificial Sequence: Synthetic oligonucleotide
attgctacaagagacggtgtt

SEQ ID NO: 747 - DNA, 21 bp, Artificial Sequence
  Description of Artificial Sequence: Synthetic oligonucleotide
accgtctcttgtagcaatcgg

SEQ ID NO: 748 - DNA, 21 bp, Artificial Sequence
  Description of Artificial Sequence: Synthetic oligonucleotide
gattgctacaagagacggtgt

SEQ ID NO: 749 - DNA, 21 bp, Artificial Sequence
  Description of Artificial Sequence: Synthetic oligonucleotide
ccgtctcttgtagcaatcggc

SEQ ID NO: 750 - DNA, 21 bp, Artificial Sequence
  Description of Artificial Sequence: Synthetic oligonucleotide
cgattgctacaagagacggtg

SEQ ID NO: 751 - DNA, 21 bp, Artificial Sequence
  Description of Artificial Sequence: Synthetic oligonucleotide
cgtctcttgtagcaatcggcc

SEQ ID NO: 752 - DNA, 21 bp, Artificial Sequence
  Description of Artificial Sequence: Synthetic oligonucleotide
ccgattgctacaagagacggt

SEQ ID NO: 753 - DNA, 21 bp, Artificial Sequence
  Description of Artificial Sequence: Synthetic oligonucleotide
gtctcttgtagcaatcggcca

SEQ ID NO: 754 - DNA, 21 bp, Artificial Sequence
  Description of Artificial Sequence: Synthetic oligonucleotide
gccgattgctacaagagacgg

SEQ ID NO: 755 - DNA, 21 bp, Artificial Sequence
  Description of Artificial Sequence: Synthetic oligonucleotide
tctcttgtagcaatcggccac

SEQ ID NO: 756 - DNA, 21 bp, Artificial Sequence
  Description of Artificial Sequence: Synthetic oligonucleotide
ggccgattgctacaagagacg

SEQ ID NO: 757 - DNA, 21 bp, Artificial Sequence
  Description of Artificial Sequence: Synthetic oligonucleotide
ctcttgtagcaatcggccaca

SEQ ID NO: 758 - DNA, 21 bp, Artificial Sequence
  Description of Artificial Sequence: Synthetic oligonucleotide
tggccgattgctacaagagac

SEQ ID NO: 759 - DNA, 21 bp, Artificial Sequence
  Description of Artificial Sequence: Synthetic oligonucleotide
tcttgtagcaatcggccacat

SEQ ID NO: 760 - DNA, 21 bp, Artificial Sequence
  Description of Artificial Sequence: Synthetic oligonucleotide
gtggccgattgctacaagaga

SEQ ID NO: 761 - DNA, 21 bp, Artificial Sequence
  Description of Artificial Sequence: Synthetic oligonucleotide
cttgtagcaatcggccacatt

SEQ ID NO: 762 - DNA, 21 bp, Artificial Sequence
  Description of Artificial Sequence: Synthetic oligonucleotide
tgtggccgattgctacaagag

SEQ ID NO: 763 - DNA, 21 bp, Artificial Sequence
  Description of Artificial Sequence: Synthetic oligonucleotide
ttgtagcaatcggccacattg

SEQ ID NO: 764 - DNA, 21 bp, Artificial Sequence
  Description of Artificial Sequence: Synthetic oligonucleotide
atgtggccgattgctacaaga

SEQ ID NO: 765 - DNA, 21 bp, Artificial Sequence
  Description of Artificial Sequence: Synthetic oligonucleotide
tgtagcaatcggccacattgc

SEQ ID NO: 766 - DNA, 21 bp, Artificial Sequence
  Description of Artificial Sequence: Synthetic oligonucleotide
aatgtggccgattgctacaag

SEQ ID NO: 767 - DNA, 21 bp, Artificial Sequence
  Description of Artificial Sequence: Synthetic oligonucleotide
gtagcaatcggccacattgcc

SEQ ID NO: 768 - DNA, 21 bp, Artificial Sequence
  Description of Artificial Sequence: Synthetic oligonucleotide
caatgtggccgattgctacaa

SEQ ID NO: 769 - DNA, 21 bp, Artificial Sequence
  Description of Artificial Sequence: Synthetic oligonucleotide
tagcaatcggccacattgcct

SEQ ID NO: 770 - DNA, 21 bp, Artificial Sequence
  Description of Artificial Sequence: Synthetic oligonucleotide
gcaatgtggccgattgctaca

SEQ ID NO: 771 - DNA, 21 bp, Artificial Sequence
  Description of Artificial Sequence: Synthetic oligonucleotide
agcaatcggccacattgcctt

SEQ ID NO: 772 - DNA, 21 bp, Artificial Sequence
  Description of Artificial Sequence: Synthetic oligonucleotide
ggcaatgtggccgattgctac

SEQ ID NO: 773 - DNA, 21 bp, Artificial Sequence
  Description of Artificial Sequence: Synthetic oligonucleotide
gcaatcggccacattgcctta

SEQ ID NO: 774 - DNA, 21 bp, Artificial Sequence
  Description of Artificial Sequence: Synthetic oligonucleotide
aggcaatgtggccgattgcta

SEQ ID NO: 775 - DNA, 21 bp, Artificial Sequence
  Description of Artificial Sequence: Synthetic oligonucleotide
caatcggccacattgccttac

SEQ ID NO: 776 - DNA, 21 bp, Artificial Sequence
  Description of Artificial Sequence: Synthetic oligonucleotide
aaggcaatgtggccgattgct

SEQ ID NO: 777 - DNA, 21 bp, Artificial Sequence
  Description of Artificial Sequence: Synthetic oligonucleotide
aatcggccacattgccttact

SEQ ID NO: 778 - DNA, 21 bp, Artificial Sequence
  Description of Artificial Sequence: Synthetic oligonucleotide
taaggcaatgtggccgattgc

SEQ ID NO: 779 - DNA, 21 bp, Artificial Sequence
  Description of Artificial Sequence: Synthetic oligonucleotide
atcggccacattgccttactg

SEQ ID NO: 780 - DNA, 21 bp, Artificial Sequence
  Description of Artificial Sequence: Synthetic oligonucleotide
gtaaggcaatgtggccgattg

SEQ ID NO: 781 - DNA, 21 bp, Artificial Sequence
  Description of Artificial Sequence: Synthetic oligonucleotide
tcggccacattgccttactga

SEQ ID NO: 782 - DNA, 21 bp, Artificial Sequence
  Description of Artificial Sequence: Synthetic oligonucleotide
agtaaggcaatgtggccgatt

SEQ ID NO: 783 - DNA, 21 bp, Artificial Sequence
  Description of Artificial Sequence: Synthetic oligonucleotide
cggccacattgccttactgaa

SEQ ID NO: 784 - DNA, 21 bp, Artificial Sequence
  Description of Artificial Sequence: Synthetic oligonucleotide
cagtaaggcaatgtggccgat

SEQ ID NO: 785 - DNA, 21 bp, Artificial Sequence
  Description of Artificial Sequence: Synthetic oligonucleotide
ggccacattgccttactgaaa

SEQ ID NO: 786 - DNA, 21 bp, Artificial Sequence
  Description of Artificial Sequence: Synthetic oligonucleotide
tcagtaaggcaatgtggccga

SEQ ID NO: 787 - DNA, 21 bp, Artificial Sequence
  Description of Artificial Sequence: Synthetic oligonucleotide
gccacattgccttactgaaat

SEQ ID NO: 788 - DNA, 21 bp, Artificial Sequence
  Description of Artificial Sequence: Synthetic oligonucleotide
ttcagtaaggcaatgtggccg

SEQ ID NO: 789 - DNA, 21 bp, Artificial Sequence
  Description of Artificial Sequence: Synthetic oligonucleotide
ccacattgccttactgaaatc

SEQ ID NO: 790 - DNA, 21 bp, Artificial Sequence
  Description of Artificial Sequence: Synthetic oligonucleotide
tttcagtaaggcaatgtggcc

SEQ ID NO: 791 - DNA, 21 bp, Artificial Sequence
  Description of Artificial Sequence: Synthetic oligonucleotide
cacattgccttactgaaatcc

SEQ ID NO: 792 - DNA, 21 bp, Artificial Sequence
  Description of Artificial Sequence: Synthetic oligonucleotide
atttcagtaaggcaatgtggc

SEQ ID NO: 793 - DNA, 21 bp, Artificial Sequence
  Description of Artificial Sequence: Synthetic oligonucleotide
acattgccttactgaaatcca

SEQ ID NO: 794 - DNA, 21 bp, Artificial Sequence
  Description of Artificial Sequence: Synthetic oligonucleotide
gatttcagtaaggcaatgtgg

SEQ ID NO: 795 - DNA, 21 bp, Artificial Sequence
  Description of Artificial Sequence: Synthetic oligonucleotide
cattgccttactgaaatccag

SEQ ID NO: 796 - DNA, 21 bp, Artificial Sequence
  Description of Artificial Sequence: Synthetic oligonucleotide
ggatttcagtaaggcaatgtg

SEQ ID NO: 797 - DNA, 21 bp, Artificial Sequence
  Description of Artificial Sequence: Synthetic oligonucleotide
attgccttactgaaatccaga

SEQ ID NO: 798 - DNA, 21 bp, Artificial Sequence
  Description of Artificial Sequence: Synthetic oligonucleotide
tggatttcagtaaggcaatgt

SEQ ID NO: 799 - DNA, 21 bp, Artificial Sequence
  Description of Artificial Sequence: Synthetic oligonucleotide
ttgccttactgaaatccagag

SEQ ID NO: 800 - DNA, 21 bp, Artificial Sequence
  Description of Artificial Sequence: Synthetic oligonucleotide
ctggatttcagtaaggcaatg

SEQ ID NO: 801 - DNA, 21 bp, Artificial Sequence
  Description of Artificial Sequence: Synthetic oligonucleotide
tgccttactgaaatccagagc

SEQ ID NO: 802 - DNA, 21 bp, Artificial Sequence
  Description of Artificial Sequence: Synthetic oligonucleotide
tctggatttcagtaaggcaat

SEQ ID NO: 803 - DNA, 21 bp, Artificial Sequence
  Description of Artificial Sequence: Synthetic oligonucleotide
gccttactgaaatccagagcc

SEQ ID NO: 804 - DNA, 21 bp, Artificial Sequence
  Description of Artificial Sequence: Synthetic oligonucleotide
ctctggatttcagtaaggcaa

SEQ ID NO: 805 - DNA, 21 bp, Artificial Sequence
  Description of Artificial Sequence: Synthetic oligonucleotide
ccttactgaaatccagagcct

SEQ ID NO: 806 - DNA, 21 bp, Artificial Sequence
  Description of Artificial Sequence: Synthetic oligonucleotide
gctctggatttcagtaaggca

SEQ ID NO: 807 - DNA, 21 bp, Artificial Sequence
  Description of Artificial Sequence: Synthetic oligonucleotide
cttactgaaatccagagccta

SEQ ID NO: 808 - DNA, 21 bp, Artificial Sequence
  Description of Artificial Sequence: Synthetic oligonucleotide
ggctctggatttcagtaaggc

SEQ ID NO: 809 - DNA, 21 bp, Artificial Sequence
  Description of Artificial Sequence: Synthetic oligonucleotide
ttactgaaatccagagcctaa

SEQ ID NO: 810 - DNA, 21 bp, Artificial Sequence
  Description of Artificial Sequence: Synthetic oligonucleotide
aggctctggatttcagtaagg

SEQ ID NO: 811 - DNA, 21 bp, Artificial Sequence
  Description of Artificial Sequence: Synthetic oligonucleotide
tactgaaatccagagcctaac

SEQ ID NO: 812 - DNA, 21 bp, Artificial Sequence
  Description of Artificial Sequence: Synthetic oligonucleotide
taggctctggatttcagtaag

SEQ ID NO: 813 - DNA, 21 bp, Artificial Sequence
  Description of Artificial Sequence: Synthetic oligonucleotide
actgaaatccagagcctaacc

SEQ ID NO: 814 - DNA, 21 bp, Artificial Sequence
  Description of Artificial Sequence: Synthetic oligonucleotide
ttaggctctggatttcagtaa

SEQ ID NO: 815 - DNA, 21 bp, Artificial Sequence
  Description of Artificial Sequence: Synthetic oligonucleotide
ctgaaatccagagcctaacct

SEQ ID NO: 816 - DNA, 21 bp, Artificial Sequence
  Description of Artificial Sequence: Synthetic oligonucleotide
gttaggctctggatttcagta

SEQ ID NO: 817 - DNA, 21 bp, Artificial Sequence
  Description of Artificial Sequence: Synthetic oligonucleotide
tgaaatccagagcctaacctt

SEQ ID NO: 818 - DNA, 21 bp, Artificial Sequence
  Description of Artificial Sequence: Synthetic oligonucleotide
ggttaggctctggatttcagt

SEQ ID NO: 819 - DNA, 21 bp, Artificial Sequence
  Description of Artificial Sequence: Synthetic oligonucleotide
gaaatccagagcctaaccttc

SEQ ID NO: 820 - DNA, 21 bp, Artificial Sequence
  Description of Artificial Sequence: Synthetic oligonucleotide
aggttaggctctggatttcag

SEQ ID NO: 821 - DNA, 21 bp, Artificial Sequence
  Description of Artificial Sequence: Synthetic oligonucleotide
aaatccagagcctaaccttca

SEQ ID NO: 822 - DNA, 21 bp, Artificial Sequence
  Description of Artificial Sequence: Synthetic oligonucleotide
aaggttaggctctggatttca

SEQ ID NO: 823 - DNA, 21 bp, Artificial Sequence
  Description of Artificial Sequence: Synthetic oligonucleotide
aatccagagcctaaccttcaa

SEQ ID NO: 824 - DNA, 21 bp, Artificial Sequence
  Description of Artificial Sequence: Synthetic oligonucleotide
gaaggttaggctctggatttc

SEQ ID NO: 825 - DNA, 21 bp, Artificial Sequence
  Description of Artificial Sequence: Synthetic oligonucleotide
atccagagcctaaccttcaat

SEQ ID NO: 826 - DNA, 21 bp, Artificial Sequence
  Description of Artificial Sequence: Synthetic oligonucleotide
tgaaggttaggctctggattt

SEQ ID NO: 827 - DNA, 21 bp, Artificial Sequence
  Description of Artificial Sequence: Synthetic oligonucleotide
tccagagcctaaccttcaatc

SEQ ID NO: 828 - DNA, 21 bp, Artificial Sequence
  Description of Artificial Sequence: Synthetic oligonucleotide
ttgaaggttaggctctggatt

SEQ ID NO: 829 - DNA, 21 bp, Artificial Sequence
  Description of Artificial Sequence: Synthetic oligonucleotide
ccagagcctaaccttcaatcc

SEQ ID NO: 830 - DNA, 21 bp, Artificial Sequence
  Description of Artificial Sequence: Synthetic oligonucleotide
attgaaggttaggctctggat

SEQ ID NO: 831 - DNA, 21 bp, Artificial Sequence
  Description of Artificial Sequence: Synthetic oligonucleotide
cagagcctaaccttcaatccc

SEQ ID NO: 832 - DNA, 21 bp, Artificial Sequence
  Description of Artificial Sequence: Synthetic oligonucleotide
gattgaaggttaggctctgga

SEQ ID NO: 833 - DNA, 21 bp, Artificial Sequence
  Description of Artificial Sequence: Synthetic oligonucleotide
agagcctaaccttcaatccca

SEQ ID NO: 834 - DNA, 21 bp, Artificial Sequence
  Description of Artificial Sequence: Synthetic oligonucleotide
ggattgaaggttaggctctgg

SEQ ID NO: 835 - DNA, 21 bp, Artificial Sequence
  Description of Artificial Sequence: Synthetic oligonucleotide
gagcctaaccttcaatcccac

SEQ ID NO: 836 - DNA, 21 bp, Artificial Sequence
  Description of Artificial Sequence: Synthetic oligonucleotide
gggattgaaggttaggctctg

SEQ ID NO: 837 - DNA, 21 bp, Artificial Sequence
  Description of Artificial Sequence: Synthetic oligonucleotide
agcctaaccttcaatcccacc

SEQ ID NO: 838 - DNA, 21 bp, Artificial Sequence
  Description of Artificial Sequence: Synthetic oligonucleotide
tgggattgaaggttaggctct

SEQ ID NO: 839 - DNA, 21 bp, Artificial Sequence
  Description of Artificial Sequence: Synthetic oligonucleotide
gcctaaccttcaatcccaccg

SEQ ID NO: 840 - DNA, 21 bp, Artificial Sequence
  Description of Artificial Sequence: Synthetic oligonucleotide
gtgggattgaaggttaggctc

SEQ ID NO: 841 - DNA, 21 bp, Artificial Sequence
  Description of Artificial Sequence: Synthetic oligonucleotide
cctaaccttcaatcccaccgc

SEQ ID NO: 842 - DNA, 21 bp, Artificial Sequence
  Description of Artificial Sequence: Synthetic oligonucleotide
ggtgggattgaaggttaggct

SEQ ID NO: 843 - DNA, 21 bp, Artificial Sequence
  Description of Artificial Sequence: Synthetic oligonucleotide
ctaaccttcaatcccaccgcc

SEQ ID NO: 844 - DNA, 21 bp, Artificial Sequence
  Description of Artificial Sequence: Synthetic oligonucleotide
cggtgggattgaaggttaggc

SEQ ID NO: 845 - DNA, 21 bp, Artificial Sequence
  Description of Artificial Sequence: Synthetic oligonucleotide
taaccttcaatcccaccgccg

SEQ ID NO: 846 - DNA, 21 bp, Artificial Sequence
  Description of Artificial Sequence: Synthetic oligonucleotide
gcggtgggattgaaggttagg

SEQ ID NO: 847 - DNA, 21 bp, Artificial Sequence
  Description of Artificial Sequence: Synthetic oligonucleotide
aaccttcaatcccaccgccgg

SEQ ID NO: 848 - DNA, 21 bp, Artificial Sequence
  Description of Artificial Sequence: Synthetic oligonucleotide
ggcggtgggattgaaggttag

SEQ ID NO: 849 - DNA, 21 bp, Artificial Sequence
  Description of Artificial Sequence: Synthetic oligonucleotide
accttcaatcccaccgccggc

SEQ ID NO: 850 - DNA, 21 bp, Artificial Sequence
  Description of Artificial Sequence: Synthetic oligonucleotide
cggcggtgggattgaaggtta

SEQ ID NO: 851 - DNA, 21 bp, Artificial Sequence
  Description of Artificial Sequence: Synthetic oligonucleotide
ccttcaatcccaccgccggct

SEQ ID NO: 852 - DNA, 21 bp, Artificial Sequence
  Description of Artificial Sequence: Synthetic oligonucleotide
ccggcggtgggattgaaggtt

SEQ ID NO: 853 - DNA, 21 bp, Artificial Sequence
  Description of Artificial Sequence: Synthetic oligonucleotide
cttcaatcccaccgccggctg

SEQ ID NO: 854 - DNA, 21 bp, Artificial Sequence
  Description of Artificial Sequence: Synthetic oligonucleotide
gccggcggtgggattgaaggt

SEQ ID NO: 855 - DNA, 21 bp, Artificial Sequence
  Description of Artificial Sequence: Synthetic oligonucleotide
ttcaatcccaccgccggctgc

SEQ ID NO: 856 - DNA, 21 bp, Artificial Sequence
  Description of Artificial Sequence: Synthetic oligonucleotide
agccggcggtgggattgaagg

SEQ ID NO: 857 - DNA, 21 bp, Artificial Sequence
  Description of Artificial Sequence: Synthetic oligonucleotide
tcaatcccaccgccggctgcg

SEQ ID NO: 858 - DNA, 21 bp, Artificial Sequence
  Description of Artificial Sequence: Synthetic oligonucleotide
cagccggcggtgggattgaag

SEQ ID NO: 859 - DNA, 21 bp, Artificial Sequence
  Description of Artificial Sequence: Synthetic oligonucleotide
caatcccaccgccggctgcgc

SEQ ID NO: 860 - DNA, 21 bp, Artificial Sequence
  Description of Artificial Sequence: Synthetic oligonucleotide
gcagccggcggtgggattgaa

SEQ ID NO: 861 - DNA, 21 bp, Artificial Sequence
  Description of Artificial Sequence: Synthetic oligonucleotide
aatcccaccgccggctgcgcg

SEQ ID NO: 862 - DNA, 21 bp, Artificial Sequence
  Description of Artificial Sequence: Synthetic oligonucleotide
cgcagccggcggtgggattga

SEQ ID NO: 863 - DNA, 21 bp, Artificial Sequence
  Description of Artificial Sequence: Synthetic oligonucleotide
atcccaccgccggctgcgcgt

SEQ ID NO: 864 - DNA, 21 bp, Artificial Sequence
  Description of Artificial Sequence: Synthetic oligonucleotide
gcgcagccggcggtgggattg

SEQ ID NO: 865 - DNA, 21 bp, Artificial Sequence
  Description of Artificial Sequence: Synthetic oligonucleotide
tcccaccgccggctgcgcgtc

SEQ ID NO: 866 - DNA, 21 bp, Artificial Sequence
  Description of Artificial Sequence: Synthetic oligonucleotide
cgcgcagccggcggtgggatt

SEQ ID NO: 867 - DNA, 21 bp, Artificial Sequence
  Description of Artificial Sequence: Synthetic oligonucleotide
cccaccgccggctgcgcgtcg

SEQ ID NO: 868 - DNA, 21 bp, Artificial Sequence
  Description of Artificial Sequence: Synthetic oligonucleotide
acgcgcagccggcggtgggat

SEQ ID NO: 869 - DNA, 21 bp, Artificial Sequence
  Description of Artificial Sequence: Synthetic oligonucleotide
ccaccgccggctgcgcgtcgc

SEQ ID NO: 870 - DNA, 21 bp, Artificial Sequence
  Description of Artificial Sequence: Synthetic oligonucleotide
gacgcgcagccggcggtggga

SEQ ID NO: 871 - DNA, 21 bp, Artificial Sequence
  Description of Artificial Sequence: Synthetic oligonucleotide
caccgccggctgcgcgtcgct

SEQ ID NO: 872 - DNA, 21 bp, Artificial Sequence
  Description of Artificial Sequence: Synthetic oligonucleotide
cgacgcgcagccggcggtggg

SEQ ID NO: 873 - DNA, 21 bp, Artificial Sequence
  Description of Artificial Sequence: Synthetic oligonucleotide
accgccggctgcgcgtcgctc

SEQ ID NO: 874 - DNA, 21 bp, Artificial Sequence
  Description of Artificial Sequence: Synthetic oligonucleotide
gcgacgcgcagccggcggtgg

SEQ ID NO: 875 - DNA, 21 bp, Artificial Sequence
  Description of Artificial Sequence: Synthetic oligonucleotide
ccgccggctgcgcgtcgctcg

SEQ ID NO: 876 - DNA, 21 bp, Artificial Sequence
  Description of Artificial Sequence: Synthetic oligonucleotide
agcgacgcgcagccggcggtg

SEQ ID NO: 877 - DNA, 21 bp, Artificial Sequence
  Description of Artificial Sequence: Synthetic oligonucleotide
cgccggctgcgcgtcgctcgc

SEQ ID NO: 878 - DNA, 21 bp, Artificial Sequence
  Description of Artificial Sequence: Synthetic oligonucleotide
gagcgacgcgcagccggcggt

SEQ ID NO: 879 - DNA, 21 bp, Artificial Sequence
  Description of Artificial Sequence: Synthetic oligonucleotide
gccggctgcgcgtcgctcgcc

SEQ ID NO: 880 - DNA, 21 bp, Artificial Sequence
  Description of Artificial Sequence: Synthetic oligonucleotide
cgagcgacgcgcagccggcgg

SEQ ID NO: 881 - DNA, 21 bp, Artificial Sequence
  Description of Artificial Sequence: Synthetic oligonucleotide
ccggctgcgcgtcgctcgcca

SEQ ID NO: 882 - DNA, 21 bp, Artificial Sequence
  Description of Artificial Sequence: Synthetic oligonucleotide
gcgagcgacgcgcagccggcg

SEQ ID NO: 883 - DNA, 21 bp, Artificial Sequence
  Description of Artificial Sequence: Synthetic oligonucleotide
cggctgcgcgtcgctcgccaa

SEQ ID NO: 884 - DNA, 21 bp, Artificial Sequence
  Description of Artificial Sequence: Synthetic oligonucleotide
ggcgagcgacgcgcagccggc

SEQ ID NO: 885 - DNA, 21 bp, Artificial Sequence
  Description of Artificial Sequence: Synthetic oligonucleotide
ggctgcgcgtcgctcgccaaa

SEQ ID NO: 886 - DNA, 21 bp, Artificial Sequence
  Description of Artificial Sequence: Synthetic oligonucleotide
tggcgagcgacgcgcagccgg

SEQ ID NO: 887 - DNA, 21 bp, Artificial Sequence
  Description of Artificial Sequence: Synthetic oligonucleotide
gctgcgcgtcgctcgccaaag

SEQ ID NO: 888 - DNA, 21 bp, Artificial Sequence
  Description of Artificial Sequence: Synthetic oligonucleotide
ttggcgagcgacgcgcagccg

SEQ ID NO: 889 - DNA, 21 bp, Artificial Sequence
  Description of Artificial Sequence: Synthetic oligonucleotide
ctgcgcgtcgctcgccaaaga

SEQ ID NO: 890 - DNA, 21 bp, Artificial Sequence
  Description of Artificial Sequence: Synthetic oligonucleotide
tttggcgagcgacgcgcagcc

SEQ ID NO: 891 - DNA, 21 bp, Artificial Sequence
  Description of Artificial Sequence: Synthetic oligonucleotide
tgcgcgtcgctcgccaaagaa

SEQ ID NO: 892 - DNA, 21 bp, Artificial Sequence
  Description of Artificial Sequence: Synthetic oligonucleotide
ctttggcgagcgacgcgcagc

SEQ ID NO: 893 - DNA, 21 bp, Artificial Sequence
  Description of Artificial Sequence: Synthetic oligonucleotide
gcgcgtcgctcgccaaagaaa

SEQ ID NO: 894 - DNA, 21 bp, Artificial Sequence
  Description of Artificial Sequence: Synthetic oligonucleotide
tctttggcgagcgacgcgcag

SEQ ID NO: 895 - DNA, 21 bp, Artificial Sequence
  Description of Artificial Sequence: Synthetic oligonucleotide
cgcgtcgctcgccaaagaaat

SEQ ID NO: 896 - DNA, 21 bp, Artificial Sequence
  Description of Artificial Sequence: Synthetic oligonucleotide
ttctttggcgagcgacgcgca

SEQ ID NO: 897 - DNA, 21 bp, Artificial Sequence
  Description of Artificial Sequence: Synthetic oligonucleotide
gcgtcgctcgccaaagaaatg

SEQ ID NO: 898 - DNA, 21 bp, Artificial Sequence
  Description of Artificial Sequence: Synthetic oligonucleotide
tttctttggcgagcgacgcgc

SEQ ID NO: 899 - DNA, 21 bp, Artificial Sequence
  Description of Artificial Sequence: Synthetic oligonucleotide
cgtcgctcgccaaagaaatgt

SEQ ID NO: 900 - DNA, 21 bp, Artificial Sequence
  Description of Artificial Sequence: Synthetic oligonucleotide
atttctttggcgagcgacgcg

SEQ ID NO: 901 - DNA, 21 bp, Artificial Sequence
  Description of Artificial Sequence: Synthetic oligonucleotide
gtcgctcgccaaagaaatgtt

SEQ ID NO: 902 - DNA, 21 bp, Artificial Sequence
  Description of Artificial Sequence: Synthetic oligonucleotide
catttctttggcgagcgacgc

SEQ ID NO: 903 - DNA, 21 bp, Artificial Sequence
  Description of Artificial Sequence: Synthetic oligonucleotide
tcgctcgccaaagaaatgttc

SEQ ID NO: 904 - DNA, 21 bp, Artificial Sequence
  Description of Artificial Sequence: Synthetic oligonucleotide
acatttctttggcgagcgacg

SEQ ID NO: 905 - DNA, 21 bp, Artificial Sequence
  Description of Artificial Sequence: Synthetic oligonucleotide
cgctcgccaaagaaatgttcg

SEQ ID NO: 906 - DNA, 21 bp, Artificial Sequence
  Description of Artificial Sequence: Synthetic oligonucleotide
aacatttctttggcgagcgac

SEQ ID NO: 907 - DNA, 21 bp, Artificial Sequence
  Description of Artificial Sequence: Synthetic oligonucleotide
gctcgccaaagaaatgttcgc

SEQ ID NO: 908 - DNA, 21 bp, Artificial Sequence
  Description of Artificial Sequence: Synthetic oligonucleotide
gaacatttctttggcgagcga

SEQ ID NO: 909 - DNA, 21 bp, Artificial Sequence
  Description of Artificial Sequence: Synthetic oligonucleotide
ctcgccaaagaaatgttcgcc

SEQ ID NO: 910 - DNA, 21 bp, Artificial Sequence
  Description of Artificial Sequence: Synthetic oligonucleotide
cgaacatttctttggcgagcg

SEQ ID NO: 911 - DNA, 21 bp, Artificial Sequence
  Description of Artificial Sequence: Synthetic oligonucleotide
tcgccaaagaaatgttcgcca

SEQ ID NO: 912 - DNA, 21 bp, Artificial Sequence
  Description of Artificial Sequence: Synthetic oligonucleotide
gcgaacatttctttggcgagc

SEQ ID NO: 913 - DNA, 21 bp, Artificial Sequence
  Description of Artificial Sequence: Synthetic oligonucleotide
cgccaaagaaatgttcgccat

SEQ ID NO: 914 - DNA, 21 bp, Artificial Sequence
  Description of Artificial Sequence: Synthetic oligonucleotide
ggcgaacatttctttggcgag

SEQ ID NO: 915 - DNA, 21 bp, Artificial Sequence
  Description of Artificial Sequence: Synthetic oligonucleotide
gccaaagaaatgttcgccatg

SEQ ID NO: 916 - DNA, 21 bp, Artificial Sequence
  Description of Artificial Sequence: Synthetic oligonucleotide
tggcgaacatttctttggcga

SEQ ID NO: 917 - DNA, 21 bp, Artificial Sequence
  Description of Artificial Sequence: Synthetic oligonucleotide
ccaaagaaatgttcgccatga

SEQ ID NO: 918 - DNA, 21 bp, Artificial Sequence
  Description of Artificial Sequence: Synthetic oligonucleotide
atggcgaacatttctttggcg

SEQ ID NO: 919 - DNA, 21 bp, Artificial Sequence
  Description of Artificial Sequence: Synthetic oligonucleotide
caaagaaatgttcgccatgaa

SEQ ID NO: 920 - DNA, 21 bp, Artificial Sequence
  Description of Artificial Sequence: Synthetic oligonucleotide
catggcgaacatttctttggc

SEQ ID NO: 921 - DNA, 21 bp, Artificial Sequence
  Description of Artificial Sequence: Synthetic oligonucleotide
aaagaaatgttcgccatgaaa

SEQ ID NO: 922 - DNA, 21 bp, Artificial Sequence
  Description of Artificial Sequence: Synthetic oligonucleotide
tcatggcgaacatttctttgg

SEQ ID NO: 923 - DNA, 21 bp, Artificial Sequence
  Description of Artificial Sequence: Synthetic oligonucleotide
aagaaatgttcgccatgaaaa

SEQ ID NO: 924 - DNA, 21 bp, Artificial Sequence
  Description of Artificial Sequence: Synthetic oligonucleotide
ttcatggcgaacatttctttg

SEQ ID NO: 925 - DNA, 21 bp, Artificial Sequence
  Description of Artificial Sequence: Synthetic oligonucleotide
agaaatgttcgccatgaaaac

SEQ ID NO: 926 - DNA, 21 bp, Artificial Sequence
  Description of Artificial Sequence: Synthetic oligonucleotide
tttcatggcgaacatttcttt

SEQ ID NO: 927 - DNA, 21 bp, Artificial Sequence
  Description of Artificial Sequence: Synthetic oligonucleotide
gaaatgttcgccatgaaaact

SEQ ID NO: 928 - DNA, 21 bp, Artificial Sequence
  Description of Artificial Sequence: Synthetic oligonucleotide
ttttcatggcgaacatttctt

SEQ ID NO: 929 - DNA, 21 bp, Artificial Sequence
  Description of Artificial Sequence: Synthetic oligonucleotide
aaatgttcgccatgaaaacta

SEQ ID NO: 930 - DNA, 21 bp, Artificial Sequence
  Description of Artificial Sequence: Synthetic oligonucleotide
gttttcatggcgaacatttct

SEQ ID NO: 931 - DNA, 21 bp, Artificial Sequence
  Description of Artificial Sequence: Synthetic oligonucleotide
aatgttcgccatgaaaactaa

SEQ ID NO: 932 - DNA, 21 bp, Artificial Sequence
  Description of Artificial Sequence: Synthetic oligonucleotide
agttttcatggcgaacatttc

SEQ ID NO: 933 - DNA, 21 bp, Artificial Sequence
  Description of Artificial Sequence: Synthetic oligonucleotide
atgttcgccatgaaaactaag

SEQ ID NO: 934 - DNA, 21 bp, Artificial Sequence
  Description of Artificial Sequence: Synthetic oligonucleotide
tagttttcatggcgaacattt

SEQ ID NO: 935 - DNA, 21 bp, Artificial Sequence
  Description of Artificial Sequence: Synthetic oligonucleotide
tgttcgccatgaaaactaagg

SEQ ID NO: 936 - DNA, 21 bp, Artificial Sequence
  Description of Artificial Sequence: Synthetic oligonucleotide
ttagttttcatggcgaacatt

SEQ ID NO: 937 - DNA, 21 bp, Artificial Sequence
  Description of Artificial Sequence: Synthetic oligonucleotide
gttcgccatgaaaactaaggc

SEQ ID NO: 938 - DNA, 21 bp, Artificial Sequence
  Description of Artificial Sequence: Synthetic oligonucleotide
cttagttttcatggcgaacat

SEQ ID NO: 939 - DNA, 21 bp, Artificial Sequence
  Description of Artificial Sequence: Synthetic oligonucleotide
ttcgccatgaaaactaaggct

SEQ ID NO: 940 - DNA, 21 bp, Artificial Sequence
  Description of Artificial Sequence: Synthetic oligonucleotide
ccttagttttcatggcgaaca

SEQ ID NO: 941 - DNA, 21 bp, Artificial Sequence
  Description of Artificial Sequence: Synthetic oligonucleotide
tcgccatgaaaactaaggctg

SEQ ID NO: 942 - DNA, 21 bp, Artificial Sequence
  Description of Artificial Sequence: Synthetic oligonucleotide
gccttagttttcatggcgaac

SEQ ID NO: 943 - DNA, 21 bp, Artificial Sequence
  Description of Artificial Sequence: Synthetic oligonucleotide
cgccatgaaaactaaggctgc

SEQ ID NO: 944 - DNA, 21 bp, Artificial Sequence
  Description of Artificial Sequence: Synthetic oligonucleotide
agccttagttttcatggcgaa

SEQ ID NO: 945 - DNA, 21 bp, Artificial Sequence
  Description of Artificial Sequence: Synthetic oligonucleotide
gccatgaaaactaaggctgcc

SEQ ID NO: 946 - DNA, 21 bp, Artificial Sequence
  Description of Artificial Sequence: Synthetic oligonucleotide
cagccttagttttcatggcga

SEQ ID NO: 947 - DNA, 21 bp, Artificial Sequence
  Description of Artificial Sequence: Synthetic oligonucleotide
ccatgaaaactaaggctgcct

SEQ ID NO: 948 - DNA, 21 bp, Artificial Sequence
  Description of Artificial Sequence: Synthetic oligonucleotide
gcagccttagttttcatggcg

SEQ ID NO: 949 - DNA, 21 bp, Artificial Sequence
  Description of Artificial Sequence: Synthetic oligonucleotide
catgaaaactaaggctgcctt

SEQ ID NO: 950 - DNA, 21 bp, Artificial Sequence
  Description of Artificial Sequence: Synthetic oligonucleotide
ggcagccttagttttcatggc

SEQ ID NO: 951 - DNA, 21 bp, Artificial Sequence
  Description of Artificial Sequence: Synthetic oligonucleotide
atgaaaactaaggctgcctta

SEQ ID NO: 952 - DNA, 21 bp, Artificial Sequence
  Description of Artificial Sequence: Synthetic oligonucleotide
aggcagccttagttttcatgg

SEQ ID NO: 953 - DNA, 21 bp, Artificial Sequence
  Description of Artificial Sequence: Synthetic oligonucleotide
tgaaaactaaggctgccttag

SEQ ID NO: 954 - DNA, 21 bp, Artificial Sequence
  Description of Artificial Sequence: Synthetic oligonucleotide
aaggcagccttagttttcatg

SEQ ID NO: 955 - DNA, 21 bp, Artificial Sequence
  Description of Artificial Sequence: Synthetic oligonucleotide
gaaaactaaggctgccttagc

SEQ ID NO: 956 - DNA, 21 bp, Artificial Sequence
  Description of Artificial Sequence: Synthetic oligonucleotide
taaggcagccttagttttcat

SEQ ID NO: 957 - DNA, 21 bp, Artificial Sequence
  Description of Artificial Sequence: Synthetic oligonucleotide
aaaactaaggctgccttagct

SEQ ID NO: 958 - DNA, 21 bp, Artificial Sequence
  Description of Artificial Sequence: Synthetic oligonucleotide
ctaaggcagccttagttttca

SEQ ID NO: 959 - DNA, 21 bp, Artificial Sequence
  Description of Artificial Sequence: Synthetic oligonucleotide
aaactaaggctgccttagcta

SEQ ID NO: 960 - DNA, 21 bp, Artificial Sequence
  Description of Artificial Sequence: Synthetic oligonucleotide
gctaaggcagccttagttttc

SEQ ID NO: 961 - DNA, 21 bp, Artificial Sequence
  Description of Artificial Sequence: Synthetic oligonucleotide
aactaaggctgccttagctat

SEQ ID NO: 962 - DNA, 21 bp, Artificial Sequence
  Description of Artificial Sequence: Synthetic oligonucleotide
agctaaggcagccttagtttt

SEQ ID NO: 963 - DNA, 21 bp, Artificial Sequence
  Description of Artificial Sequence: Synthetic oligonucleotide
actaaggctgccttagctatc

SEQ ID NO: 964 - DNA, 21 bp, Artificial Sequence
  Description of Artificial Sequence: Synthetic oligonucleotide
tagctaaggcagccttagttt

SEQ ID NO: 965 - DNA, 21 bp, Artificial Sequence
  Description of Artificial Sequence: Synthetic oligonucleotide
ctaaggctgccttagctatct

SEQ ID NO: 966 - DNA, 21 bp, Artificial Sequence
  Description of Artificial Sequence: Synthetic oligonucleotide
atagctaaggcagccttagtt

SEQ ID NO: 967 - DNA, 21 bp, Artificial Sequence
  Description of Artificial Sequence: Synthetic oligonucleotide
taaggctgccttagctatctg

SEQ ID NO: 968 - DNA, 21 bp, Artificial Sequence
  Description of Artificial Sequence: Synthetic oligonucleotide
gatagctaaggcagccttagt

SEQ ID NO: 969 - DNA, 21 bp, Artificial Sequence
  Description of Artificial Sequence: Synthetic oligonucleotide
aaggctgccttagctatctgg

SEQ ID NO: 970 - DNA, 21 bp, Artificial Sequence
  Description of Artificial Sequence: Synthetic oligonucleotide
agatagctaaggcagccttag

SEQ ID NO: 971 - DNA, 21 bp, Artificial Sequence
  Description of Artificial Sequence: Synthetic oligonucleotide
aggctgccttagctatctggt

SEQ ID NO: 972 - DNA, 21 bp, Artificial Sequence
  Description of Artificial Sequence: Synthetic oligonucleotide
cagatagctaaggcagcctta

SEQ ID NO: 973 - DNA, 21 bp, Artificial Sequence
  Description of Artificial Sequence: Synthetic oligonucleotide
ggctgccttagctatctggtg

SEQ ID NO: 974 - DNA, 21 bp, Artificial Sequence
  Description of Artificial Sequence: Synthetic oligonucleotide
ccagatagctaaggcagcctt

SEQ ID NO: 975 - DNA, 21 bp, Artificial Sequence
  Description of Artificial Sequence: Synthetic oligonucleotide
gctgccttagctatctggtgc

SEQ ID NO: 976 - DNA, 21 bp, Artificial Sequence
  Description of Artificial Sequence: Synthetic oligonucleotide
accagatagctaaggcagcct

SEQ ID NO: 977 - DNA, 21 bp, Artificial Sequence
  Description of Artificial Sequence: Synthetic oligonucleotide
ctgccttagctatctggtgcc

SEQ ID NO: 978 - DNA, 21 bp, Artificial Sequence
  Description of Artificial Sequence: Synthetic oligonucleotide
caccagatagctaaggcagcc

SEQ ID NO: 979 - DNA, 21 bp, Artificial Sequence
  Description of Artificial Sequence: Synthetic oligonucleotide
tgccttagctatctggtgccc

SEQ ID NO: 980 - DNA, 21 bp, Artificial Sequence
  Description of Artificial Sequence: Synthetic oligonucleotide
gcaccagatagctaaggcagc

SEQ ID NO: 981 - DNA, 21 bp, Artificial Sequence
  Description of Artificial Sequence: Synthetic oligonucleotide
gccttagctatctggtgccca

SEQ ID NO: 982 - DNA, 21 bp, Artificial Sequence
  Description of Artificial Sequence: Synthetic oligonucleotide
ggcaccagatagctaaggcag

SEQ ID NO: 983 - DNA, 21 bp, Artificial Sequence
  Description of Artificial Sequence: Synthetic oligonucleotide
ccttagctatctggtgcccag

SEQ ID NO: 984 - DNA, 21 bp, Artificial Sequence
  Description of Artificial Sequence: Synthetic oligonucleotide
gggcaccagatagctaaggca

SEQ ID NO: 985 - DNA, 21 bp, Artificial Sequence
  Description of Artificial Sequence: Synthetic oligonucleotide
cttagctatctggtgcccagg

SEQ ID NO: 986 - DNA, 21 bp, Artificial Sequence
  Description of Artificial Sequence: Synthetic oligonucleotide
tgggcaccagatagctaaggc

SEQ ID NO: 987 - DNA, 21 bp, Artificial Sequence
  Description of Artificial Sequence: Synthetic oligonucleotide
ttagctatctggtgcccaggc

SEQ ID NO: 988 - DNA, 21 bp, Artificial Sequence
  Description of Artificial Sequence: Synthetic oligonucleotide
ctgggcaccagatagctaagg

SEQ ID NO: 989 - DNA, 21 bp, Artificial Sequence
  Description of Artificial Sequence: Synthetic oligonucleotide
tagctatctggtgcccaggct

SEQ ID NO: 990 - DNA, 21 bp, Artificial Sequence
  Description of Artificial Sequence: Synthetic oligonucleotide
cctgggcaccagatagctaag

SEQ ID NO: 991 - DNA, 21 bp, Artificial Sequence
  Description of Artificial Sequence: Synthetic oligonucleotide
agctatctggtgcccaggcta

SEQ ID NO: 992 - DNA, 21 bp, Artificial Sequence
  Description of Artificial Sequence: Synthetic oligonucleotide
gcctgggcaccagatagctaa

SEQ ID NO: 993 - DNA, 21 bp, Artificial Sequence
  Description of Artificial Sequence: Synthetic oligonucleotide
gctatctggtgcccaggctat

SEQ ID NO: 994 - DNA, 21 bp, Artificial Sequence
  Description of Artificial Sequence: Synthetic oligonucleotide
agcctgggcaccagatagcta

SEQ ID NO: 995 - DNA, 21 bp, Artificial Sequence
  Description of Artificial Sequence: Synthetic oligonucleotide
ctatctggtgcccaggctatt

SEQ ID NO: 996 - DNA, 21 bp, Artificial Sequence
  Description of Artificial Sequence: Synthetic oligonucleotide
tagcctgggcaccagatagct

SEQ ID NO: 997 - DNA, 21 bp, Artificial Sequence
  Description of Artificial Sequence: Synthetic oligonucleotide
tatctggtgcccaggctattc

SEQ ID NO: 998 - DNA, 21 bp, Artificial Sequence
  Description of Artificial Sequence: Synthetic oligonucleotide
atagcctgggcaccagatagc

SEQ ID NO: 999 - DNA, 21 bp, Artificial Sequence
  Description of Artificial Sequence: Synthetic oligonucleotide
atctggtgcccaggctattcg

SEQ ID NO: 1000 - DNA, 21 bp, Artificial Sequence
  Description of Artificial Sequence: Synthetic oligonucleotide
aatagcctgggcaccagatag

SEQ ID NO: 1001 - DNA, 21 bp, Artificial Sequence
  Description of Artificial Sequence: Synthetic oligonucleotide
tctggtgcccaggctattcgg

SEQ ID NO: 1002 - DNA, 21 bp, Artificial Sequence
  Description of Artificial Sequence: Synthetic oligonucleotide
gaatagcctgggcaccagata

SEQ ID NO: 1003 - DNA, 21 bp, Artificial Sequence
  Description of Artificial Sequence: Synthetic oligonucleotide
ctggtgcccaggctattcgga

SEQ ID NO: 1004 - DNA, 21 bp, Artificial Sequence
  Description of Artificial Sequence: Synthetic oligonucleotide
cgaatagcctgggcaccagat

SEQ ID NO: 1005 - DNA, 21 bp, Artificial Sequence
  Description of Artificial Sequence: Synthetic oligonucleotide
tggtgcccaggctattcggaa

SEQ ID NO: 1006 - DNA, 21 bp, Artificial Sequence
  Description of Artificial Sequence: Synthetic oligonucleotide
ccgaatagcctgggcaccaga

SEQ ID NO: 1007 - DNA, 21 bp, Artificial Sequence
  Description of Artificial Sequence: Synthetic oligonucleotide
ggtgcccaggctattcggaaa

SEQ ID NO: 1008 - DNA, 21 bp, Artificial Sequence
  Description of Artificial Sequence: Synthetic oligonucleotide
tccgaatagcctgggcaccag

SEQ ID NO: 1009 - DNA, 21 bp, Artificial Sequence
  Description of Artificial Sequence: Synthetic oligonucleotide
gtgcccaggctattcggaaac

SEQ ID NO: 1010 - DNA, 21 bp, Artificial Sequence
  Description of Artificial Sequence: Synthetic oligonucleotide
ttccgaatagcctgggcacca

SEQ ID NO: 1011 - DNA, 21 bp, Artificial Sequence
  Description of Artificial Sequence: Synthetic oligonucleotide
tgcccaggctattcggaaact

SEQ ID NO: 1012 - DNA, 21 bp, Artificial Sequence
  Description of Artificial Sequence: Synthetic oligonucleotide
tttccgaatagcctgggcacc

SEQ ID NO: 1013 - DNA, 21 bp, Artificial Sequence
  Description of Artificial Sequence: Synthetic oligonucleotide
gcccaggctattcggaaactc

SEQ ID NO: 1014 - DNA, 21 bp, Artificial Sequence
  Description of Artificial Sequence: Synthetic oligonucleotide
gtttccgaatagcctgggcac

SEQ ID NO: 1015 - DNA, 21 bp, Artificial Sequence
  Description of Artificial Sequence: Synthetic oligonucleotide
cccaggctattcggaaactca

SEQ ID NO: 1016 - DNA, 21 bp, Artificial Sequence
  Description of Artificial Sequence: Synthetic oligonucleotide
agtttccgaatagcctgggca

SEQ ID NO: 1017 - DNA, 21 bp, Artificial Sequence
  Description of Artificial Sequence: Synthetic oligonucleotide
ccaggctattcggaaactcag

SEQ ID NO: 1018 - DNA, 21 bp, Artificial Sequence
  Description of Artificial Sequence: Synthetic oligonucleotide
gagtttccgaatagcctgggc

SEQ ID NO: 1019 - DNA, 21 bp, Artificial Sequence
  Description of Artificial Sequence: Synthetic oligonucleotide
caggctattcggaaactcaga

SEQ ID NO: 1020 - DNA, 21 bp, Artificial Sequence
  Description of Artificial Sequence: Synthetic oligonucleotide
tgagtttccgaatagcctggg

SEQ ID NO: 1021 - DNA, 21 bp, Artificial Sequence
  Description of Artificial Sequence: Synthetic oligonucleotide
aggctattcggaaactcagat

SEQ ID NO: 1022 - DNA, 21 bp, Artificial Sequence
  Description of Artificial Sequence: Synthetic oligonucleotide
ctgagtttccgaatagcctgg

SEQ ID NO: 1023 - DNA, 21 bp, Artificial Sequence
  Description of Artificial Sequence: Synthetic oligonucleotide
ggctattcggaaactcagata

SEQ ID NO: 1024 - DNA, 21 bp, Artificial Sequence
  Description of Artificial Sequence: Synthetic oligonucleotide
tctgagtttccgaatagcctg

SEQ ID NO: 1025 - DNA, 21 bp, Artificial Sequence
  Description of Artificial Sequence: Synthetic oligonucleotide
gctattcggaaactcagataa

SEQ ID NO: 1026 - DNA, 21 bp, Artificial Sequence
  Description of Artificial Sequence: Synthetic oligonucleotide
atctgagtttccgaatagcct

SEQ ID NO: 1027 - DNA, 21 bp, Artificial Sequence
  Description of Artificial Sequence: Synthetic oligonucleotide
ctattcggaaactcagataaa

SEQ ID NO: 1028 - DNA, 21 bp, Artificial Sequence
  Description of Artificial Sequence: Synthetic oligonucleotide
tatctgagtttccgaatagcc

SEQ ID NO: 1029 - DNA, 21 bp, Artificial Sequence
  Description of Artificial Sequence: Synthetic oligonucleotide
tattcggaaactcagataaat

SEQ ID NO: 1030 - DNA, 21 bp, Artificial Sequence
  Description of Artificial Sequence: Synthetic oligonucleotide
ttatctgagtttccgaatagc

SEQ ID NO: 1031 - DNA, 21 bp, Artificial Sequence
  Description of Artificial Sequence: Synthetic oligonucleotide
attcggaaactcagataaatg

SEQ ID NO: 1032 - DNA, 21 bp, Artificial Sequence
  Description of Artificial Sequence: Synthetic oligonucleotide
tttatctgagtttccgaatag

SEQ ID NO: 1033 - DNA, 21 bp, Artificial Sequence
  Description of Artificial Sequence: Synthetic oligonucleotide
ttcggaaactcagataaatgc

SEQ ID NO: 1034 - DNA, 21 bp, Artificial Sequence
  Description of Artificial Sequence: Synthetic oligonucleotide
atttatctgagtttccgaata

SEQ ID NO: 1035 - DNA, 21 bp, Artificial Sequence
  Description of Artificial Sequence: Synthetic oligonucleotide
tcggaaactcagataaatgct

SEQ ID NO: 1036 - DNA, 21 bp, Artificial Sequence
  Description of Artificial Sequence: Synthetic oligonucleotide
catttatctgagtttccgaat

SEQ ID NO: 1037 - DNA, 21 bp, Artificial Sequence
  Description of Artificial Sequence: Synthetic oligonucleotide
cggaaactcagataaatgcta

SEQ ID NO: 1038 - DNA, 21 bp, Artificial Sequence
  Description of Artificial Sequence: Synthetic oligonucleotide
gcatttatctgagtttccgaa

SEQ ID NO: 1039 - DNA, 21 bp, Artificial Sequence
  Description of Artificial Sequence: Synthetic oligonucleotide
ggaaactcagataaatgctac

SEQ ID NO: 1040 - DNA, 21 bp, Artificial Sequence
  Description of Artificial Sequence: Synthetic oligonucleotide
agcatttatctgagtttccga

SEQ ID NO: 1041 - DNA, 21 bp, Artificial Sequence
  Description of Artificial Sequence: Synthetic oligonucleotide
gaaactcagataaatgctact

SEQ ID NO: 1042 - DNA, 21 bp, Artificial Sequence
  Description of Artificial Sequence: Synthetic oligonucleotide
tagcatttatctgagtttccg

SEQ ID NO: 1043 - DNA, 21 bp, Artificial Sequence
  Description of Artificial Sequence: Synthetic oligonucleotide
aaactcagataaatgctactc

SEQ ID NO: 1044 - DNA, 21 bp, Artificial Sequence
  Description of Artificial Sequence: Synthetic oligonucleotide
gtagcatttatctgagtttcc

SEQ ID NO: 1045 - DNA, 21 bp, Artificial Sequence
  Description of Artificial Sequence: Synthetic oligonucleotide
aactcagataaatgctactca

SEQ ID NO: 1046 - DNA, 21 bp, Artificial Sequence
  Description of Artificial Sequence: Synthetic oligonucleotide
agtagcatttatctgagtttc

SEQ ID NO: 1047 - DNA, 21 bp, Artificial Sequence
  Description of Artificial Sequence: Synthetic oligonucleotide
actcagataaatgctactcag

SEQ ID NO: 1048 - DNA, 21 bp, Artificial Sequence
  Description of Artificial Sequence: Synthetic oligonucleotide
gagtagcatttatctgagttt

SEQ ID NO: 1049 - DNA, 21 bp, Artificial Sequence
  Description of Artificial Sequence: Synthetic oligonucleotide
ctcagataaatgctactcagg

SEQ ID NO: 1050 - DNA, 21 bp, Artificial Sequence
  Description of Artificial Sequence: Synthetic oligonucleotide
tgagtagcatttatctgagtt

SEQ ID NO: 1051 - DNA, 21 bp, Artificial Sequence
  Description of Artificial Sequence: Synthetic oligonucleotide
tcagataaatgctactcaggc

SEQ ID NO: 1052 - DNA, 21 bp, Artificial Sequence
  Description of Artificial Sequence: Synthetic oligonucleotide
ctgagtagcatttatctgagt

SEQ ID NO: 1053 - DNA, 21 bp, Artificial Sequence
  Description of Artificial Sequence: Synthetic oligonucleotide
cagataaatgctactcaggca

SEQ ID NO: 1054 - DNA, 21 bp, Artificial Sequence
  Description of Artificial Sequence: Synthetic oligonucleotide
cctgagtagcatttatctgag

SEQ ID NO: 1055 - DNA, 21 bp, Artificial Sequence
  Description of Artificial Sequence: Synthetic oligonucleotide
agataaatgctactcaggcaa

SEQ ID NO: 1056 - DNA, 21 bp, Artificial Sequence
  Description of Artificial Sequence: Synthetic oligonucleotide
gcctgagtagcatttatctga

SEQ ID NO: 1057 - DNA, 21 bp, Artificial Sequence
  Description of Artificial Sequence: Synthetic oligonucleotide
gataaatgctactcaggcaat

SEQ ID NO: 1058 - DNA, 21 bp, Artificial Sequence
  Description of Artificial Sequence: Synthetic oligonucleotide
tgcctgagtagcatttatctg

SEQ ID NO: 1059 - DNA, 21 bp, Artificial Sequence
  Description of Artificial Sequence: Synthetic oligonucleotide
ataaatgctactcaggcaatg

SEQ ID NO: 1060 - DNA, 21 bp, Artificial Sequence
  Description of Artificial Sequence: Synthetic oligonucleotide
ttgcctgagtagcatttatct

SEQ ID NO: 1061 - DNA, 21 bp, Artificial Sequence
  Description of Artificial Sequence: Synthetic oligonucleotide
taaatgctactcaggcaatga

SEQ ID NO: 1062 - DNA, 21 bp, Artificial Sequence
  Description of Artificial Sequence: Synthetic oligonucleotide
attgcctgagtagcatttatc

SEQ ID NO: 1063 - DNA, 21 bp, Artificial Sequence
  Description of Artificial Sequence: Synthetic oligonucleotide
aaatgctactcaggcaatgaa

SEQ ID NO: 1064 - DNA, 21 bp, Artificial Sequence
  Description of Artificial Sequence: Synthetic oligonucleotide
cattgcctgagtagcatttat

SEQ ID NO: 1065 - DNA, 21 bp, Artificial Sequence
  Description of Artificial Sequence: Synthetic oligonucleotide
aatgctactcaggcaatgaag

SEQ ID NO: 1066 - DNA, 21 bp, Artificial Sequence
  Description of Artificial Sequence: Synthetic oligonucleotide
tcattgcctgagtagcattta

SEQ ID NO: 1067 - DNA, 21 bp, Artificial Sequence
  Description of Artificial Sequence: Synthetic oligonucleotide
atgctactcaggcaatgaaga

SEQ ID NO: 1068 - DNA, 21 bp, Artificial Sequence
  Description of Artificial Sequence: Synthetic oligonucleotide
ttcattgcctgagtagcattt

SEQ ID NO: 1069 - DNA, 21 bp, Artificial Sequence
  Description of Artificial Sequence: Synthetic oligonucleotide
tgctactcaggcaatgaagaa

SEQ ID NO: 1070 - DNA, 21 bp, Artificial Sequence
  Description of Artificial Sequence: Synthetic oligonucleotide
cttcattgcctgagtagcatt

SEQ ID NO: 1071 - DNA, 21 bp, Artificial Sequence
  Description of Artificial Sequence: Synthetic oligonucleotide
gctactcaggcaatgaagaag

SEQ ID NO: 1072 - DNA, 21 bp, Artificial Sequence
  Description of Artificial Sequence: Synthetic oligonucleotide
tcttcattgcctgagtagcat

SEQ ID NO: 1073 - DNA, 21 bp, Artificial Sequence
  Description of Artificial Sequence: Synthetic oligonucleotide
ctactcaggcaatgaagaaga

SEQ ID NO: 1074 - DNA, 21 bp, Artificial Sequence
  Description of Artificial Sequence: Synthetic oligonucleotide
ttcttcattgcctgagtagca

SEQ ID NO: 1075 - DNA, 21 bp, Artificial Sequence
  Description of Artificial Sequence: Synthetic oligonucleotide
tactcaggcaatgaagaagag

SEQ ID NO: 1076 - DNA, 21 bp, Artificial Sequence
  Description of Artificial Sequence: Synthetic oligonucleotide
cttcttcattgcctgagtagc

SEQ ID NO: 1077 - DNA, 21 bp, Artificial Sequence
  Description of Artificial Sequence: Synthetic oligonucleotide
actcaggcaatgaagaagagg

SEQ ID NO: 1078 - DNA, 21 bp, Artificial Sequence
  Description of Artificial Sequence: Synthetic oligonucleotide
tcttcttcattgcctgagtag

SEQ ID NO: 1079 - DNA, 21 bp, Artificial Sequence
  Description of Artificial Sequence: Synthetic oligonucleotide
ctcaggcaatgaagaagagga

SEQ ID NO: 1080 - DNA, 21 bp, Artificial Sequence
  Description of Artificial Sequence: Synthetic oligonucleotide
ctcttcttcattgcctgagta

SEQ ID NO: 1081 - DNA, 21 bp, Artificial Sequence
  Description of Artificial Sequence: Synthetic oligonucleotide
tcaggcaatgaagaagaggag

SEQ ID NO: 1082 - DNA, 21 bp, Artificial Sequence
  Description of Artificial Sequence: Synthetic oligonucleotide
cctcttcttcattgcctgagt

SEQ ID NO: 1083 - DNA, 21 bp, Artificial Sequence
  Description of Artificial Sequence: Synthetic oligonucleotide
caggcaatgaagaagaggaga

SEQ ID NO: 1084 - DNA, 21 bp, Artificial Sequence
  Description of Artificial Sequence: Synthetic oligonucleotide
tcctcttcttcattgcctgag

SEQ ID NO: 1085 - DNA, 21 bp, Artificial Sequence
  Description of Artificial Sequence: Synthetic oligonucleotide
aggcaatgaagaagaggagaa

SEQ ID NO: 1086 - DNA, 21 bp, Artificial Sequence
  Description of Artificial Sequence: Synthetic oligonucleotide
ctcctcttcttcattgcctga

SEQ ID NO: 1087 - DNA, 21 bp, Artificial Sequence
  Description of Artificial Sequence: Synthetic oligonucleotide
ggcaatgaagaagaggagaaa

SEQ ID NO: 1088 - DNA, 21 bp, Artificial Sequence
  Description of Artificial Sequence: Synthetic oligonucleotide
tctcctcttcttcattgcctg

SEQ ID NO: 1089 - DNA, 21 bp, Artificial Sequence
  Description of Artificial Sequence: Synthetic oligonucleotide
gcaatgaagaagaggagaaaa

SEQ ID NO: 1090 - DNA, 21 bp, Artificial Sequence
  Description of Artificial Sequence: Synthetic oligonucleotide
ttctcctcttcttcattgcct

SEQ ID NO: 1091 - DNA, 21 bp, Artificial Sequence
  Description of Artificial Sequence: Synthetic oligonucleotide
caatgaagaagaggagaaaaa

SEQ ID NO: 1092 - DNA, 21 bp, Artificial Sequence
  Description of Artificial Sequence: Synthetic oligonucleotide
tttctcctcttcttcattgcc

SEQ ID NO: 1093 - DNA, 21 bp, Artificial Sequence
  Description of Artificial Sequence: Synthetic oligonucleotide
aatgaagaagaggagaaaaag

SEQ ID NO: 1094 - DNA, 21 bp, Artificial Sequence
  Description of Artificial Sequence: Synthetic oligonucleotide
ttttctcctcttcttcattgc

SEQ ID NO: 1095 - DNA, 21 bp, Artificial Sequence
  Description of Artificial Sequence: Synthetic oligonucleotide
atgaagaagaggagaaaaagg

SEQ ID NO: 1096 - DNA, 21 bp, Artificial Sequence
  Description of Artificial Sequence: Synthetic oligonucleotide
tttttctcctcttcttcattg

SEQ ID NO: 1097 - DNA, 21 bp, Artificial Sequence
  Description of Artificial Sequence: Synthetic oligonucleotide
tgaagaagaggagaaaaagga

SEQ ID NO: 1098 - DNA, 21 bp, Artificial Sequence
  Description of Artificial Sequence: Synthetic oligonucleotide
ctttttctcctcttcttcatt

SEQ ID NO: 1099 - DNA, 21 bp, Artificial Sequence
  Description of Artificial Sequence: Synthetic oligonucleotide
gaagaagaggagaaaaaggaa

SEQ ID NO: 1100 - DNA, 21 bp, Artificial Sequence
  Description of Artificial Sequence: Synthetic oligonucleotide
cctttttctcctcttcttcat

SEQ ID NO: 1101 - DNA, 21 bp, Artificial Sequence
  Description of Artificial Sequence: Synthetic oligonucleotide
aagaagaggagaaaaaggaaa

SEQ ID NO: 1102 - DNA, 21 bp, Artificial Sequence
  Description of Artificial Sequence: Synthetic oligonucleotide
tcctttttctcctcttcttca

SEQ ID NO: 1103 - DNA, 21 bp, Artificial Sequence
  Description of Artificial Sequence: Synthetic oligonucleotide
agaagaggagaaaaaggaaag

SEQ ID NO: 1104 - DNA, 21 bp, Artificial Sequence
  Description of Artificial Sequence: Synthetic oligonucleotide
ttcctttttctcctcttcttc

SEQ ID NO: 1105 - DNA, 21 bp, Artificial Sequence
  Description of Artificial Sequence: Synthetic oligonucleotide
gaagaggagaaaaaggaaagt

SEQ ID NO: 1106 - DNA, 21 bp, Artificial Sequence
  Description of Artificial Sequence: Synthetic oligonucleotide
tttcctttttctcctcttctt

SEQ ID NO: 1107 - DNA, 21 bp, Artificial Sequence
  Description of Artificial Sequence: Synthetic oligonucleotide
aagaggagaaaaaggaaagtc

SEQ ID NO: 1108 - DNA, 21 bp, Artificial Sequence
  Description of Artificial Sequence: Synthetic oligonucleotide
ctttcctttttctcctcttct

SEQ ID NO: 1109 - DNA, 21 bp, Artificial Sequence
  Description of Artificial Sequence: Synthetic oligonucleotide
agaggagaaaaaggaaagtca

SEQ ID NO: 1110 - DNA, 21 bp, Artificial Sequence
  Description of Artificial Sequence: Synthetic oligonucleotide
actttcctttttctcctcttc

SEQ ID NO: 1111 - DNA, 21 bp, Artificial Sequence
  Description of Artificial Sequence: Synthetic oligonucleotide
gaggagaaaaaggaaagtcac

SEQ ID NO: 1112 - DNA, 21 bp, Artificial Sequence
  Description of Artificial Sequence: Synthetic oligonucleotide
gactttcctttttctcctctt

SEQ ID NO: 1113 - DNA, 21 bp, Artificial Sequence
  Description of Artificial Sequence: Synthetic oligonucleotide
aggagaaaaaggaaagtcaca

SEQ ID NO: 1114 - DNA, 21 bp, Artificial Sequence
  Description of Artificial Sequence: Synthetic oligonucleotide
tgactttcctttttctcctct

SEQ ID NO: 1115 - DNA, 21 bp, Artificial Sequence
  Description of Artificial Sequence: Synthetic oligonucleotide
ggagaaaaaggaaagtcacaa

SEQ ID NO: 1116 - DNA, 21 bp, Artificial Sequence
  Description of Artificial Sequence: Synthetic oligonucleotide
gtgactttcctttttctcctc

SEQ ID NO: 1117 - DNA, 21 bp, Artificial Sequence
  Description of Artificial Sequence: Synthetic oligonucleotide
gagaaaaaggaaagtcacaac

SEQ ID NO: 1118 - DNA, 21 bp, Artificial Sequence
  Description of Artificial Sequence: Synthetic oligonucleotide
tgtgactttcctttttctcct

SEQ ID NO: 1119 - DNA, 21 bp, Artificial Sequence
  Description of Artificial Sequence: Synthetic oligonucleotide
agaaaaaggaaagtcacaacc

SEQ ID NO: 1120 - DNA, 21 bp, Artificial Sequence
  Description of Artificial Sequence: Synthetic oligonucleotide
ttgtgactttcctttttctcc

SEQ ID NO: 1121 - DNA, 21 bp, Artificial Sequence
  Description of Artificial Sequence: Synthetic oligonucleotide
gaaaaaggaaagtcacaacca

SEQ ID NO: 1122 - DNA, 21 bp, Artificial Sequence
  Description of Artificial Sequence: Synthetic oligonucleotide
gttgtgactttcctttttctc

SEQ ID NO: 1123 - DNA, 21 bp, Artificial Sequence
  Description of Artificial Sequence: Synthetic oligonucleotide
aaaaaggaaagtcacaaccaa

SEQ ID NO: 1124 - DNA, 21 bp, Artificial Sequence
  Description of Artificial Sequence: Synthetic oligonucleotide
ggttgtgactttcctttttct

SEQ ID NO: 1125 - DNA, 21 bp, Artificial Sequence
  Description of Artificial Sequence: Synthetic oligonucleotide
aaaaggaaagtcacaaccaat

SEQ ID NO: 1126 - DNA, 21 bp, Artificial Sequence
  Description of Artificial Sequence: Synthetic oligonucleotide
tggttgtgactttcctttttc

SEQ ID NO: 1127 - DNA, 21 bp, Artificial Sequence
  Description of Artificial Sequence: Synthetic oligonucleotide
aaaggaaagtcacaaccaata

SEQ ID NO: 1128 - DNA, 21 bp, Artificial Sequence
  Description of Artificial Sequence: Synthetic oligonucleotide
ttggttgtgactttccttttt

SEQ ID NO: 1129 - DNA, 21 bp, Artificial Sequence
  Description of Artificial Sequence: Synthetic oligonucleotide
aaggaaagtcacaaccaataa

SEQ ID NO: 1130 - DNA, 21 bp, Artificial Sequence
  Description of Artificial Sequence: Synthetic oligonucleotide
attggttgtgactttcctttt

SEQ ID NO: 1131 - DNA, 21 bp, Artificial Sequence
  Description of Artificial Sequence: Synthetic oligonucleotide
aggaaagtcacaaccaataaa

SEQ ID NO: 1132 - DNA, 21 bp, Artificial Sequence
  Description of Artificial Sequence: Synthetic oligonucleotide
tattggttgtgactttccttt

SEQ ID NO: 1133 - DNA, 21 bp, Artificial Sequence
  Description of Artificial Sequence: Synthetic oligonucleotide
ggaaagtcacaaccaataaat

SEQ ID NO: 1134 - DNA, 21 bp, Artificial Sequence
  Description of Artificial Sequence: Synthetic oligonucleotide
ttattggttgtgactttcctt

SEQ ID NO: 1135 - DNA, 21 bp, Artificial Sequence
  Description of Artificial Sequence: Synthetic oligonucleotide
gaaagtcacaaccaataaatg

SEQ ID NO: 1136 - DNA, 21 bp, Artificial Sequence
  Description of Artificial Sequence: Synthetic oligonucleotide
tttattggttgtgactttcct

SEQ ID NO: 1137 - DNA, 21 bp, Artificial Sequence
  Description of Artificial Sequence: Synthetic oligonucleotide
aaagtcacaaccaataaatgt

SEQ ID NO: 1138 - DNA, 21 bp, Artificial Sequence
  Description of Artificial Sequence: Synthetic oligonucleotide
atttattggttgtgactttcc

SEQ ID NO: 1139 - DNA, 21 bp, Artificial Sequence
  Description of Artificial Sequence: Synthetic oligonucleotide
aagtcacaaccaataaatgtc

SEQ ID NO: 1140 - DNA, 21 bp, Artificial Sequence
  Description of Artificial Sequence: Synthetic oligonucleotide
catttattggttgtgactttc

SEQ ID NO: 1141 - DNA, 21 bp, Artificial Sequence
  Description of Artificial Sequence: Synthetic oligonucleotide
agtcacaaccaataaatgtct

SEQ ID NO: 1142 - DNA, 21 bp, Artificial Sequence
  Description of Artificial Sequence: Synthetic oligonucleotide
acatttattggttgtgacttt

SEQ ID NO: 1143 - DNA, 21 bp, Artificial Sequence
  Description of Artificial Sequence: Synthetic oligonucleotide
gtcacaaccaataaatgtctg

SEQ ID NO: 1144 - DNA, 21 bp, Artificial Sequence
  Description of Artificial Sequence: Synthetic oligonucleotide
gacatttattggttgtgactt

SEQ ID NO: 1145 - DNA, 21 bp, Artificial Sequence
  Description of Artificial Sequence: Synthetic oligonucleotide
tcacaaccaataaatgtctgg

SEQ ID NO: 1146 - DNA, 21 bp, Artificial Sequence
  Description of Artificial Sequence: Synthetic oligonucleotide
agacatttattggttgtgact

SEQ ID NO: 1147 - DNA, 21 bp, Artificial Sequence
  Description of Artificial Sequence: Synthetic oligonucleotide
cacaaccaataaatgtctgga

SEQ ID NO: 1148 - DNA, 21 bp, Artificial Sequence
  Description of Artificial Sequence: Synthetic oligonucleotide
cagacatttattggttgtgac

SEQ ID NO: 1149 - DNA, 21 bp, Artificial Sequence
  Description of Artificial Sequence: Synthetic oligonucleotide
acaaccaataaatgtctggaa

SEQ ID NO: 1150 - DNA, 21 bp, Artificial Sequence
  Description of Artificial Sequence: Synthetic oligonucleotide
ccagacatttattggttgtga

SEQ ID NO: 1151 - DNA, 21 bp, Artificial Sequence
  Description of Artificial Sequence: Synthetic oligonucleotide
caaccaataaatgtctggaac

SEQ ID NO: 1152 - DNA, 21 bp, Artificial Sequence
  Description of Artificial Sequence: Synthetic oligonucleotide
tccagacatttattggttgtg

SEQ ID NO: 1153 - DNA, 21 bp, Artificial Sequence
  Description of Artificial Sequence: Synthetic oligonucleotide
aaccaataaatgtctggaaca

SEQ ID NO: 1154 - DNA, 21 bp, Artificial Sequence
  Description of Artificial Sequence: Synthetic oligonucleotide
ttccagacatttattggttgt

SEQ ID NO: 1155 - DNA, 21 bp, Artificial Sequence
  Description of Artificial Sequence: Synthetic oligonucleotide
accaataaatgtctggaacaa

SEQ ID NO: 1156 - DNA, 21 bp, Artificial Sequence
  Description of Artificial Sequence: Synthetic oligonucleotide
gttccagacatttattggttg

SEQ ID NO: 1157 - DNA, 21 bp, Artificial Sequence
  Description of Artificial Sequence: Synthetic oligonucleotide
ccaataaatgtctggaacaag

SEQ ID NO: 1158 - DNA, 21 bp, Artificial Sequence
  Description of Artificial Sequence: Synthetic oligonucleotide
tgttccagacatttattggtt

SEQ ID NO: 1159 - DNA, 21 bp, Artificial Sequence
  Description of Artificial Sequence: Synthetic oligonucleotide
caataaatgtctggaacaagt

SEQ ID NO: 1160 - DNA, 21 bp, Artificial Sequence
  Description of Artificial Sequence: Synthetic oligonucleotide
ttgttccagacatttattggt

SEQ ID NO: 1161 - DNA, 21 bp, Artificial Sequence
  Description of Artificial Sequence: Synthetic oligonucleotide
aataaatgtctggaacaagtg

SEQ ID NO: 1162 - DNA, 21 bp, Artificial Sequence
  Description of Artificial Sequence: Synthetic oligonucleotide
cttgttccagacatttattgg

SEQ ID NO: 1163 - DNA, 21 bp, Artificial Sequence
  Description of Artificial Sequence: Synthetic oligonucleotide
ataaatgtctggaacaagtgt

SEQ ID NO: 1164 - DNA, 21 bp, Artificial Sequence
  Description of Artificial Sequence: Synthetic oligonucleotide
acttgttccagacatttattg

SEQ ID NO: 1165 - DNA, 21 bp, Artificial Sequence
  Description of Artificial Sequence: Synthetic oligonucleotide
taaatgtctggaacaagtgtc

SEQ ID NO: 1166 - DNA, 21 bp, Artificial Sequence
  Description of Artificial Sequence: Synthetic oligonucleotide
cacttgttccagacatttatt

SEQ ID NO: 1167 - DNA, 21 bp, Artificial Sequence
  Description of Artificial Sequence: Synthetic oligonucleotide
aaatgtctggaacaagtgtca

SEQ ID NO: 1168 - DNA, 21 bp, Artificial Sequence
  Description of Artificial Sequence: Synthetic oligonucleotide
acacttgttccagacatttat

SEQ ID NO: 1169 - DNA, 21 bp, Artificial Sequence
  Description of Artificial Sequence: Synthetic oligonucleotide
aatgtctggaacaagtgtcac

SEQ ID NO: 1170 - DNA, 21 bp, Artificial Sequence
  Description of Artificial Sequence: Synthetic oligonucleotide
gacacttgttccagacattta

SEQ ID NO: 1171 - DNA, 21 bp, Artificial Sequence
  Description of Artificial Sequence: Synthetic oligonucleotide
atgtctggaacaagtgtcaca

SEQ ID NO: 1172 - DNA, 21 bp, Artificial Sequence
  Description of Artificial Sequence: Synthetic oligonucleotide
tgacacttgttccagacattt

SEQ ID NO: 1173 - DNA, 21 bp, Artificial Sequence
  Description of Artificial Sequence: Synthetic oligonucleotide
tgtctggaacaagtgtcacaa

SEQ ID NO: 1174 - DNA, 21 bp, Artificial Sequence
  Description of Artificial Sequence: Synthetic oligonucleotide
gtgacacttgttccagacatt

SEQ ID NO: 1175 - DNA, 21 bp, Artificial Sequence
  Description of Artificial Sequence: Synthetic oligonucleotide
gtctggaacaagtgtcacaat

SEQ ID NO: 1176 - DNA, 21 bp, Artificial Sequence
  Description of Artificial Sequence: Synthetic oligonucleotide
tgtgacacttgttccagacat

SEQ ID NO: 1177 - DNA, 21 bp, Artificial Sequence
  Description of Artificial Sequence: Synthetic oligonucleotide
tctggaacaagtgtcacaatt

SEQ ID NO: 1178 - DNA, 21 bp, Artificial Sequence
  Description of Artificial Sequence: Synthetic oligonucleotide
ttgtgacacttgttccagaca

SEQ ID NO: 1179 - DNA, 21 bp, Artificial Sequence
  Description of Artificial Sequence: Synthetic oligonucleotide
ctggaacaagtgtcacaatta

SEQ ID NO: 1180 - DNA, 21 bp, Artificial Sequence
  Description of Artificial Sequence: Synthetic oligonucleotide
attgtgacacttgttccagac

SEQ ID NO: 1181 - DNA, 21 bp, Artificial Sequence
  Description of Artificial Sequence: Synthetic oligonucleotide
tggaacaagtgtcacaattac

SEQ ID NO: 1182 - DNA, 21 bp, Artificial Sequence
  Description of Artificial Sequence: Synthetic oligonucleotide
aattgtgacacttgttccaga

SEQ ID NO: 1183 - DNA, 21 bp, Artificial Sequence
  Description of Artificial Sequence: Synthetic oligonucleotide
ggaacaagtgtcacaattaca

SEQ ID NO: 1184 - DNA, 21 bp, Artificial Sequence
  Description of Artificial Sequence: Synthetic oligonucleotide
taattgtgacacttgttccag

SEQ ID NO: 1185 - DNA, 21 bp, Artificial Sequence
  Description of Artificial Sequence: Synthetic oligonucleotide
gaacaagtgtcacaattacaa

SEQ ID NO: 1186 - DNA, 21 bp, Artificial Sequence
  Description of Artificial Sequence: Synthetic oligonucleotide
gtaattgtgacacttgttcca

SEQ ID NO: 1187 - DNA, 21 bp, Artificial Sequence
  Description of Artificial Sequence: Synthetic oligonucleotide
aacaagtgtcacaattacaag

SEQ ID NO: 1188 - DNA, 21 bp, Artificial Sequence
  Description of Artificial Sequence: Synthetic oligonucleotide
tgtaattgtgacacttgttcc

SEQ ID NO: 1189 - DNA, 21 bp, Artificial Sequence
  Description of Artificial Sequence: Synthetic oligonucleotide
acaagtgtcacaattacaagg

SEQ ID NO: 1190 - DNA, 21 bp, Artificial Sequence
  Description of Artificial Sequence: Synthetic oligonucleotide
ttgtaattgtgacacttgttc

SEQ ID NO: 1191 - DNA, 21 bp, Artificial Sequence
  Description of Artificial Sequence: Synthetic oligonucleotide
caagtgtcacaattacaagga

SEQ ID NO: 1192 - DNA, 21 bp, Artificial Sequence
  Description of Artificial Sequence: Synthetic oligonucleotide
cttgtaattgtgacacttgtt

SEQ ID NO: 1193 - DNA, 21 bp, Artificial Sequence
  Description of Artificial Sequence: Synthetic oligonucleotide
aagtgtcacaattacaaggat

SEQ ID NO: 1194 - DNA, 21 bp, Artificial Sequence
  Description of Artificial Sequence: Synthetic oligonucleotide
ccttgtaattgtgacacttgt

SEQ ID NO: 1195 - DNA, 21 bp, Artificial Sequence
  Description of Artificial Sequence: Synthetic oligonucleotide
agtgtcacaattacaaggatt

SEQ ID NO: 1196 - DNA, 21 bp, Artificial Sequence
  Description of Artificial Sequence: Synthetic oligonucleotide
tccttgtaattgtgacacttg

SEQ ID NO: 1197 - DNA, 21 bp, Artificial Sequence
  Description of Artificial Sequence: Synthetic oligonucleotide
gtgtcacaattacaaggattg

SEQ ID NO: 1198 - DNA, 21 bp, Artificial Sequence
  Description of Artificial Sequence: Synthetic oligonucleotide
atccttgtaattgtgacactt

SEQ ID NO: 1199 - DNA, 21 bp, Artificial Sequence
  Description of Artificial Sequence: Synthetic oligonucleotide
tgtcacaattacaaggattgt

SEQ ID NO: 1200 - DNA, 21 bp, Artificial Sequence
  Description of Artificial Sequence: Synthetic oligonucleotide
aatccttgtaattgtgacact

SEQ ID NO: 1201 - DNA, 21 bp, Artificial Sequence
  Description of Artificial Sequence: Synthetic oligonucleotide
gtcacaattacaaggattgtg

SEQ ID NO: 1202 - DNA, 21 bp, Artificial Sequence
  Description of Artificial Sequence: Synthetic oligonucleotide
caatccttgtaattgtgacac

SEQ ID NO: 1203 - DNA, 21 bp, Artificial Sequence
  Description of Artificial Sequence: Synthetic oligonucleotide
tcacaattacaaggattgtgg

SEQ ID NO: 1204 - DNA, 21 bp, Artificial Sequence
  Description of Artificial Sequence: Synthetic oligonucleotide
acaatccttgtaattgtgaca

SEQ ID NO: 1205 - DNA, 21 bp, Artificial Sequence
  Description of Artificial Sequence: Synthetic oligonucleotide
cacaattacaaggattgtggc

SEQ ID NO: 1206 - DNA, 21 bp, Artificial Sequence
  Description of Artificial Sequence: Synthetic oligonucleotide
cacaatccttgtaattgtgac

SEQ ID NO: 1207 - DNA, 21 bp, Artificial Sequence
  Description of Artificial Sequence: Synthetic oligonucleotide
acaattacaaggattgtggcg

SEQ ID NO: 1208 - DNA, 21 bp, Artificial Sequence
  Description of Artificial Sequence: Synthetic oligonucleotide
ccacaatccttgtaattgtga

SEQ ID NO: 1209 - DNA, 21 bp, Artificial Sequence
  Description of Artificial Sequence: Synthetic oligonucleotide
caattacaaggattgtggcgt

SEQ ID NO: 1210 - DNA, 21 bp, Artificial Sequence
  Description of Artificial Sequence: Synthetic oligonucleotide
gccacaatccttgtaattgtg

SEQ ID NO: 1211 - DNA, 21 bp, Artificial Sequence
  Description of Artificial Sequence: Synthetic oligonucleotide
aattacaaggattgtggcgtc

SEQ ID NO: 1212 - DNA, 21 bp, Artificial Sequence
  Description of Artificial Sequence: Synthetic oligonucleotide
cgccacaatccttgtaattgt

SEQ ID NO: 1213 - DNA, 21 bp, Artificial Sequence
  Description of Artificial Sequence: Synthetic oligonucleotide
attacaaggattgtggcgtcg

SEQ ID NO: 1214 - DNA, 21 bp, Artificial Sequence
  Description of Artificial Sequence: Synthetic oligonucleotide
acgccacaatccttgtaattg

SEQ ID NO: 1215 - DNA, 21 bp, Artificial Sequence
  Description of Artificial Sequence: Synthetic oligonucleotide
ttacaaggattgtggcgtcgc

SEQ ID NO: 1216 - DNA, 21 bp, Artificial Sequence
  Description of Artificial Sequence: Synthetic oligonucleotide
gacgccacaatccttgtaatt

SEQ ID NO: 1217 - DNA, 21 bp, Artificial Sequence
  Description of Artificial Sequence: Synthetic oligonucleotide
tacaaggattgtggcgtcgct

SEQ ID NO: 1218 - DNA, 21 bp, Artificial Sequence
  Description of Artificial Sequence: Synthetic oligonucleotide
cgacgccacaatccttgtaat

SEQ ID NO: 1219 - DNA, 21 bp, Artificial Sequence
  Description of Artificial Sequence: Synthetic oligonucleotide
acaaggattgtggcgtcgctt

SEQ ID NO: 1220 - DNA, 21 bp, Artificial Sequence
  Description of Artificial Sequence: Synthetic oligonucleotide
gcgacgccacaatccttgtaa

SEQ ID NO: 1221 - DNA, 21 bp, Artificial Sequence
  Description of Artificial Sequence: Synthetic oligonucleotide
caaggattgtggcgtcgcttc

SEQ ID NO: 1222 - DNA, 21 bp, Artificial Sequence
  Description of Artificial Sequence: Synthetic oligonucleotide
agcgacgccacaatccttgta

SEQ ID NO: 1223 - DNA, 21 bp, Artificial Sequence
  Description of Artificial Sequence: Synthetic oligonucleotide
aaggattgtggcgtcgcttca

SEQ ID NO: 1224 - DNA, 21 bp, Artificial Sequence
  Description of Artificial Sequence: Synthetic oligonucleotide
aagcgacgccacaatccttgt

SEQ ID NO: 1225 - DNA, 21 bp, Artificial Sequence
  Description of Artificial Sequence: Synthetic oligonucleotide
aggattgtggcgtcgcttcaa

SEQ ID NO: 1226 - DNA, 21 bp, Artificial Sequence
  Description of Artificial Sequence: Synthetic oligonucleotide
gaagcgacgccacaatccttg

SEQ ID NO: 1227 - DNA, 21 bp, Artificial Sequence
  Description of Artificial Sequence: Synthetic oligonucleotide
ggattgtggcgtcgcttcaat

SEQ ID NO: 1228 - DNA, 21 bp, Artificial Sequence
  Description of Artificial Sequence: Synthetic oligonucleotide
tgaagcgacgccacaatcctt

SEQ ID NO: 1229 - DNA, 21 bp, Artificial Sequence
  Description of Artificial Sequence: Synthetic oligonucleotide
gattgtggcgtcgcttcaatc

SEQ ID NO: 1230 - DNA, 21 bp, Artificial Sequence
  Description of Artificial Sequence: Synthetic oligonucleotide
ttgaagcgacgccacaatcct

SEQ ID NO: 1231 - DNA, 21 bp, Artificial Sequence
  Description of Artificial Sequence: Synthetic oligonucleotide
attgtggcgtcgcttcaatcg

SEQ ID NO: 1232 - DNA, 21 bp, Artificial Sequence
  Description of Artificial Sequence: Synthetic oligonucleotide
attgaagcgacgccacaatcc

SEQ ID NO: 1233 - DNA, 21 bp, Artificial Sequence
  Description of Artificial Sequence: Synthetic oligonucleotide
ttgtggcgtcgcttcaatcga

SEQ ID NO: 1234 - DNA, 21 bp, Artificial Sequence
  Description of Artificial Sequence: Synthetic oligonucleotide
gattgaagcgacgccacaatc

SEQ ID NO: 1235 - DNA, 21 bp, Artificial Sequence
  Description of Artificial Sequence: Synthetic oligonucleotide
tgtggcgtcgcttcaatcgac

SEQ ID NO: 1236 - DNA, 21 bp, Artificial Sequence
  Description of Artificial Sequence: Synthetic oligonucleotide
cgattgaagcgacgccacaat

SEQ ID NO: 1237 - DNA, 21 bp, Artificial Sequence
  Description of Artificial Sequence: Synthetic oligonucleotide
gtggcgtcgcttcaatcgacc

SEQ ID NO: 1238 - DNA, 21 bp, Artificial Sequence
  Description of Artificial Sequence: Synthetic oligonucleotide
tcgattgaagcgacgccacaa

SEQ ID NO: 1239 - DNA, 21 bp, Artificial Sequence
  Description of Artificial Sequence: Synthetic oligonucleotide
tggcgtcgcttcaatcgacct

SEQ ID NO: 1240 - DNA, 21 bp, Artificial Sequence
  Description of Artificial Sequence: Synthetic oligonucleotide
gtcgattgaagcgacgccaca

SEQ ID NO: 1241 - DNA, 21 bp, Artificial Sequence
  Description of Artificial Sequence: Synthetic oligonucleotide
ggcgtcgcttcaatcgacctt

SEQ ID NO: 1242 - DNA, 21 bp, Artificial Sequence
  Description of Artificial Sequence: Synthetic oligonucleotide
ggtcgattgaagcgacgccac

SEQ ID NO: 1243 - DNA, 21 bp, Artificial Sequence
  Description of Artificial Sequence: Synthetic oligonucleotide
gcgtcgcttcaatcgaccttt

SEQ ID NO: 1244 - DNA, 21 bp, Artificial Sequence
  Description of Artificial Sequence: Synthetic oligonucleotide
aggtcgattgaagcgacgcca

SEQ ID NO: 1245 - DNA, 21 bp, Artificial Sequence
  Description of Artificial Sequence: Synthetic oligonucleotide
cgtcgcttcaatcgaccttta

SEQ ID NO: 1246 - DNA, 21 bp, Artificial Sequence
  Description of Artificial Sequence: Synthetic oligonucleotide
aaggtcgattgaagcgacgcc

SEQ ID NO: 1247 - DNA, 21 bp, Artificial Sequence
  Description of Artificial Sequence: Synthetic oligonucleotide
gtcgcttcaatcgacctttac

SEQ ID NO: 1248 - DNA, 21 bp, Artificial Sequence
  Description of Artificial Sequence: Synthetic oligonucleotide
aaaggtcgattgaagcgacgc

SEQ ID NO: 1249 - DNA, 21 bp, Artificial Sequence
  Description of Artificial Sequence: Synthetic oligonucleotide
tcgcttcaatcgacctttact

SEQ ID NO: 1250 - DNA, 21 bp, Artificial Sequence
  Description of Artificial Sequence: Synthetic oligonucleotide
taaaggtcgattgaagcgacg

SEQ ID NO: 1251 - DNA, 21 bp, Artificial Sequence
  Description of Artificial Sequence: Synthetic oligonucleotide
cgcttcaatcgacctttactg

SEQ ID NO: 1252 - DNA, 21 bp, Artificial Sequence
  Description of Artificial Sequence: Synthetic oligonucleotide
gtaaaggtcgattgaagcgac

SEQ ID NO: 1253 - DNA, 21 bp, Artificial Sequence
  Description of Artificial Sequence: Synthetic oligonucleotide
gcttcaatcgacctttactga

SEQ ID NO: 1254 - DNA, 21 bp, Artificial Sequence
  Description of Artificial Sequence: Synthetic oligonucleotide
agtaaaggtcgattgaagcga

SEQ ID NO: 1255 - DNA, 21 bp, Artificial Sequence
  Description of Artificial Sequence: Synthetic oligonucleotide
cttcaatcgacctttactgaa

SEQ ID NO: 1256 - DNA, 21 bp, Artificial Sequence
  Description of Artificial Sequence: Synthetic oligonucleotide
cagtaaaggtcgattgaagcg

SEQ ID NO: 1257 - DNA, 21 bp, Artificial Sequence
  Description of Artificial Sequence: Synthetic oligonucleotide
ttcaatcgacctttactgaaa

SEQ ID NO: 1258 - DNA, 21 bp, Artificial Sequence
  Description of Artificial Sequence: Synthetic oligonucleotide
tcagtaaaggtcgattgaagc

SEQ ID NO: 1259 - DNA, 21 bp, Artificial Sequence
  Description of Artificial Sequence: Synthetic oligonucleotide
tcaatcgacctttactgaaac

SEQ ID NO: 1260 - DNA, 21 bp, Artificial Sequence
  Description of Artificial Sequence: Synthetic oligonucleotide
ttcagtaaaggtcgattgaag

SEQ ID NO: 1261 - DNA, 21 bp, Artificial Sequence
  Description of Artificial Sequence: Synthetic oligonucleotide
caatcgacctttactgaaaca

SEQ ID NO: 1262 - DNA, 21 bp, Artificial Sequence
  Description of Artificial Sequence: Synthetic oligonucleotide
tttcagtaaaggtcgattgaa

SEQ ID NO: 1263 - DNA, 21 bp, Artificial Sequence
  Description of Artificial Sequence: Synthetic oligonucleotide
aatcgacctttactgaaacaa

SEQ ID NO: 1264 - DNA, 21 bp, Artificial Sequence
  Description of Artificial Sequence: Synthetic oligonucleotide
gtttcagtaaaggtcgattga

SEQ ID NO: 1265 - DNA, 21 bp, Artificial Sequence
  Description of Artificial Sequence: Synthetic oligonucleotide
atcgacctttactgaaacaac

SEQ ID NO: 1266 - DNA, 21 bp, Artificial Sequence
  Description of Artificial Sequence: Synthetic oligonucleotide
tgtttcagtaaaggtcgattg

SEQ ID NO: 1267 - DNA, 21 bp, Artificial Sequence
  Description of Artificial Sequence: Synthetic oligonucleotide
tcgacctttactgaaacaaca

SEQ ID NO: 1268 - DNA, 21 bp, Artificial Sequence
  Description of Artificial Sequence: Synthetic oligonucleotide
ttgtttcagtaaaggtcgatt

SEQ ID NO: 1269 - DNA, 21 bp, Artificial Sequence
  Description of Artificial Sequence: Synthetic oligonucleotide
cgacctttactgaaacaacag

SEQ ID NO: 1270 - DNA, 21 bp, Artificial Sequence
  Description of Artificial Sequence: Synthetic oligonucleotide
gttgtttcagtaaaggtcgat

SEQ ID NO: 1271 - DNA, 21 bp, Artificial Sequence
  Description of Artificial Sequence: Synthetic oligonucleotide
gacctttactgaaacaacagt

SEQ ID NO: 1272 - DNA, 21 bp, Artificial Sequence
  Description of Artificial Sequence: Synthetic oligonucleotide
tgttgtttcagtaaaggtcga

SEQ ID NO: 1273 - DNA, 21 bp, Artificial Sequence
  Description of Artificial Sequence: Synthetic oligonucleotide
acctttactgaaacaacagta

SEQ ID NO: 1274 - DNA, 21 bp, Artificial Sequence
  Description of Artificial Sequence: Synthetic oligonucleotide
ctgttgtttcagtaaaggtcg

SEQ ID NO: 1275 - DNA, 21 bp, Artificial Sequence
  Description of Artificial Sequence: Synthetic oligonucleotide
cctttactgaaacaacagtaa

SEQ ID NO: 1276 - DNA, 21 bp, Artificial Sequence
  Description of Artificial Sequence: Synthetic oligonucleotide
actgttgtttcagtaaaggtc

SEQ ID NO: 1277 - DNA, 21 bp, Artificial Sequence
  Description of Artificial Sequence: Synthetic oligonucleotide
ctttactgaaacaacagtaaa

SEQ ID NO: 1278 - DNA, 21 bp, Artificial Sequence
  Description of Artificial Sequence: Synthetic oligonucleotide
tactgttgtttcagtaaaggt

SEQ ID NO: 1279 - DNA, 21 bp, Artificial Sequence
  Description of Artificial Sequence: Synthetic oligonucleotide
tttactgaaacaacagtaaac

SEQ ID NO: 1280 - DNA, 21 bp, Artificial Sequence
  Description of Artificial Sequence: Synthetic oligonucleotide
ttactgttgtttcagtaaagg

SEQ ID NO: 1281 - DNA, 21 bp, Artificial Sequence
  Description of Artificial Sequence: Synthetic oligonucleotide
ttactgaaacaacagtaaacc

SEQ ID NO: 1282 - DNA, 21 bp, Artificial Sequence
  Description of Artificial Sequence: Synthetic oligonucleotide
tttactgttgtttcagtaaag

SEQ ID NO: 1283 - DNA, 21 bp, Artificial Sequence
  Description of Artificial Sequence: Synthetic oligonucleotide
tactgaaacaacagtaaacca

SEQ ID NO: 1284 - DNA, 21 bp, Artificial Sequence
  Description of Artificial Sequence: Synthetic oligonucleotide
gtttactgttgtttcagtaaa

SEQ ID NO: 1285 - DNA, 21 bp, Artificial Sequence
  Description of Artificial Sequence: Synthetic oligonucleotide
actgaaacaacagtaaaccat

SEQ ID NO: 1286 - DNA, 21 bp, Artificial Sequence
  Description of Artificial Sequence: Synthetic oligonucleotide
ggtttactgttgtttcagtaa

SEQ ID NO: 1287 - DNA, 21 bp, Artificial Sequence
  Description of Artificial Sequence: Synthetic oligonucleotide
ctgaaacaacagtaaaccatc

SEQ ID NO: 1288 - DNA, 21 bp, Artificial Sequence
  Description of Artificial Sequence: Synthetic oligonucleotide
tggtttactgttgtttcagta

SEQ ID NO: 1289 - DNA, 21 bp, Artificial Sequence
  Description of Artificial Sequence: Synthetic oligonucleotide
tgaaacaacagtaaaccatct

SEQ ID NO: 1290 - DNA, 21 bp, Artificial Sequence
  Description of Artificial Sequence: Synthetic oligonucleotide
atggtttactgttgtttcagt

SEQ ID NO: 1291 - DNA, 21 bp, Artificial Sequence
  Description of Artificial Sequence: Synthetic oligonucleotide
gaaacaacagtaaaccatctt

SEQ ID NO: 1292 - DNA, 21 bp, Artificial Sequence
  Description of Artificial Sequence: Synthetic oligonucleotide
gatggtttactgttgtttcag

SEQ ID NO: 1293 - DNA, 21 bp, Artificial Sequence
  Description of Artificial Sequence: Synthetic oligonucleotide
aaacaacagtaaaccatcttt

SEQ ID NO: 1294 - DNA, 21 bp, Artificial Sequence
  Description of Artificial Sequence: Synthetic oligonucleotide
agatggtttactgttgtttca

SEQ ID NO: 1295 - DNA, 21 bp, Artificial Sequence
  Description of Artificial Sequence: Synthetic oligonucleotide
aacaacagtaaaccatcttta

SEQ ID NO: 1296 - DNA, 21 bp, Artificial Sequence
  Description of Artificial Sequence: Synthetic oligonucleotide
aagatggtttactgttgtttc

SEQ ID NO: 1297 - DNA, 21 bp, Artificial Sequence
  Description of Artificial Sequence: Synthetic oligonucleotide
acaacagtaaaccatctttat

SEQ ID NO: 1298 - DNA, 21 bp, Artificial Sequence
  Description of Artificial Sequence: Synthetic oligonucleotide
aaagatggtttactgttgttt

SEQ ID NO: 1299 - DNA, 21 bp, Artificial Sequence
  Description of Artificial Sequence: Synthetic oligonucleotide
caacagtaaaccatctttatt

SEQ ID NO: 1300 - DNA, 21 bp, Artificial Sequence
  Description of Artificial Sequence: Synthetic oligonucleotide
taaagatggtttactgttgtt

SEQ ID NO: 1301 - DNA, 21 bp, Artificial Sequence
  Description of Artificial Sequence: Synthetic oligonucleotide
aacagtaaaccatctttatta

SEQ ID NO: 1302 - DNA, 21 bp, Artificial Sequence
  Description of Artificial Sequence: Synthetic oligonucleotide
ataaagatggtttactgttgt

SEQ ID NO: 1303 - DNA, 21 bp, Artificial Sequence
  Description of Artificial Sequence: Synthetic oligonucleotide
acagtaaaccatctttattat

SEQ ID NO: 1304 - DNA, 21 bp, Artificial Sequence
  Description of Artificial Sequence: Synthetic oligonucleotide
aataaagatggtttactgttg

SEQ ID NO: 1305 - DNA, 21 bp, Artificial Sequence
  Description of Artificial Sequence: Synthetic oligonucleotide
cagtaaaccatctttattatg

SEQ ID NO: 1306 - DNA, 21 bp, Artificial Sequence
  Description of Artificial Sequence: Synthetic oligonucleotide
taataaagatggtttactgtt

SEQ ID NO: 1307 - DNA, 21 bp, Artificial Sequence
  Description of Artificial Sequence: Synthetic oligonucleotide
agtaaaccatctttattatgg

SEQ ID NO: 1308 - DNA, 21 bp, Artificial Sequence
  Description of Artificial Sequence: Synthetic oligonucleotide
ataataaagatggtttactgt

SEQ ID NO: 1309 - DNA, 21 bp, Artificial Sequence
  Description of Artificial Sequence: Synthetic oligonucleotide
gtaaaccatctttattatggt

SEQ ID NO: 1310 - DNA, 21 bp, Artificial Sequence
  Description of Artificial Sequence: Synthetic oligonucleotide
cataataaagatggtttactg

SEQ ID NO: 1311 - DNA, 21 bp, Artificial Sequence
  Description of Artificial Sequence: Synthetic oligonucleotide
taaaccatctttattatggtc

SEQ ID NO: 1312 - DNA, 21 bp, Artificial Sequence
  Description of Artificial Sequence: Synthetic oligonucleotide
ccataataaagatggtttact

SEQ ID NO: 1313 - DNA, 21 bp, Artificial Sequence
  Description of Artificial Sequence: Synthetic oligonucleotide
aaaccatctttattatggtca

SEQ ID NO: 1314 - DNA, 21 bp, Artificial Sequence
  Description of Artificial Sequence: Synthetic oligonucleotide
accataataaagatggtttac

SEQ ID NO: 1315 - DNA, 21 bp, Artificial Sequence
  Description of Artificial Sequence: Synthetic oligonucleotide
aaccatctttattatggtcat

SEQ ID NO: 1316 - DNA, 21 bp, Artificial Sequence
  Description of Artificial Sequence: Synthetic oligonucleotide
gaccataataaagatggttta

SEQ ID NO: 1317 - DNA, 21 bp, Artificial Sequence
  Description of Artificial Sequence: Synthetic oligonucleotide
accatctttattatggtcata

SEQ ID NO: 1318 - DNA, 21 bp, Artificial Sequence
  Description of Artificial Sequence: Synthetic oligonucleotide
tgaccataataaagatggttt

SEQ ID NO: 1319 - DNA, 21 bp, Artificial Sequence
  Description of Artificial Sequence: Synthetic oligonucleotide
ccatctttattatggtcatat

SEQ ID NO: 1320 - DNA, 21 bp, Artificial Sequence
  Description of Artificial Sequence: Synthetic oligonucleotide
atgaccataataaagatggtt

SEQ ID NO: 1321 - DNA, 21 bp, Artificial Sequence
  Description of Artificial Sequence: Synthetic oligonucleotide
catctttattatggtcatatt

SEQ ID NO: 1322 - DNA, 21 bp, Artificial Sequence
  Description of Artificial Sequence: Synthetic oligonucleotide
tatgaccataataaagatggt

SEQ ID NO: 1323 - DNA, 21 bp, Artificial Sequence
  Description of Artificial Sequence: Synthetic oligonucleotide
atctttattatggtcatattt

SEQ ID NO: 1324 - DNA, 21 bp, Artificial Sequence
  Description of Artificial Sequence: Synthetic oligonucleotide
atatgaccataataaagatgg

SEQ ID NO: 1325 - DNA, 21 bp, Artificial Sequence
  Description of Artificial Sequence: Synthetic oligonucleotide
tctttattatggtcatatttc

SEQ ID NO: 1326 - DNA, 21 bp, Artificial Sequence
  Description of Artificial Sequence: Synthetic oligonucleotide
aatatgaccataataaagatg

SEQ ID NO: 1327 - DNA, 21 bp, Artificial Sequence
  Description of Artificial Sequence: Synthetic oligonucleotide
ctttattatggtcatatttca

SEQ ID NO: 1328 - DNA, 21 bp, Artificial Sequence
  Description of Artificial Sequence: Synthetic oligonucleotide
aaatatgaccataataaagat

SEQ ID NO: 1329 - DNA, 21 bp, Artificial Sequence
  Description of Artificial Sequence: Synthetic oligonucleotide
tttattatggtcatatttcac

SEQ ID NO: 1330 - DNA, 21 bp, Artificial Sequence
  Description of Artificial Sequence: Synthetic oligonucleotide
gaaatatgaccataataaaga

SEQ ID NO: 1331 - DNA, 21 bp, Artificial Sequence
  Description of Artificial Sequence: Synthetic oligonucleotide
ttattatggtcatatttcaca

SEQ ID NO: 1332 - DNA, 21 bp, Artificial Sequence
  Description of Artificial Sequence: Synthetic oligonucleotide
tgaaatatgaccataataaag

SEQ ID NO: 1333 - DNA, 21 bp, Artificial Sequence
  Description of Artificial Sequence: Synthetic oligonucleotide
tattatggtcatatttcacag

SEQ ID NO: 1334 - DNA, 21 bp, Artificial Sequence
  Description of Artificial Sequence: Synthetic oligonucleotide
gtgaaatatgaccataataaa

SEQ ID NO: 1335 - DNA, 21 bp, Artificial Sequence
  Description of Artificial Sequence: Synthetic oligonucleotide
attatggtcatatttcacagc

SEQ ID NO: 1336 - DNA, 21 bp, Artificial Sequence
  Description of Artificial Sequence: Synthetic oligonucleotide
tgtgaaatatgaccataataa

SEQ ID NO: 1337 - DNA, 21 bp, Artificial Sequence
  Description of Artificial Sequence: Synthetic oligonucleotide
ttatggtcatatttcacagca

SEQ ID NO: 1338 - DNA, 21 bp, Artificial Sequence
  Description of Artificial Sequence: Synthetic oligonucleotide
ctgtgaaatatgaccataata

SEQ ID NO: 1339 - DNA, 21 bp, Artificial Sequence
  Description of Artificial Sequence: Synthetic oligonucleotide
tatggtcatatttcacagcac

SEQ ID NO: 1340 - DNA, 21 bp, Artificial Sequence
  Description of Artificial Sequence: Synthetic oligonucleotide
gctgtgaaatatgaccataat

SEQ ID NO: 1341 - DNA, 21 bp, Artificial Sequence
  Description of Artificial Sequence: Synthetic oligonucleotide
atggtcatatttcacagcacc

SEQ ID NO: 1342 - DNA, 21 bp, Artificial Sequence
  Description of Artificial Sequence: Synthetic oligonucleotide
tgctgtgaaatatgaccataa

SEQ ID NO: 1343 - DNA, 21 bp, Artificial Sequence
  Description of Artificial Sequence: Synthetic oligonucleotide
tggtcatatttcacagcacca

SEQ ID NO: 1344 - DNA, 21 bp, Artificial Sequence
  Description of Artificial Sequence: Synthetic oligonucleotide
gtgctgtgaaatatgaccata

SEQ ID NO: 1345 - DNA, 21 bp, Artificial Sequence
  Description of Artificial Sequence: Synthetic oligonucleotide
ggtcatatttcacagcaccaa

SEQ ID NO: 1346 - DNA, 21 bp, Artificial Sequence
  Description of Artificial Sequence: Synthetic oligonucleotide
ggtgctgtgaaatatgaccat

SEQ ID NO: 1347 - DNA, 21 bp, Artificial Sequence
  Description of Artificial Sequence: Synthetic oligonucleotide
gtcatatttcacagcaccaaa

SEQ ID NO: 1348 - DNA, 21 bp, Artificial Sequence
  Description of Artificial Sequence: Synthetic oligonucleotide
tggtgctgtgaaatatgacca

SEQ ID NO: 1349 - DNA, 21 bp, Artificial Sequence
  Description of Artificial Sequence: Synthetic oligonucleotide
tcatatttcacagcaccaaaa

SEQ ID NO: 1350 - DNA, 21 bp, Artificial Sequence
  Description of Artificial Sequence: Synthetic oligonucleotide
ttggtgctgtgaaatatgacc

SEQ ID NO: 1351 - DNA, 21 bp, Artificial Sequence
  Description of Artificial Sequence: Synthetic oligonucleotide
catatttcacagcaccaaaat

SEQ ID NO: 1352 - DNA, 21 bp, Artificial Sequence
  Description of Artificial Sequence: Synthetic oligonucleotide
tttggtgctgtgaaatatgac

SEQ ID NO: 1353 - DNA, 21 bp, Artificial Sequence
  Description of Artificial Sequence: Synthetic oligonucleotide
atatttcacagcaccaaaata

SEQ ID NO: 1354 - DNA, 21 bp, Artificial Sequence
  Description of Artificial Sequence: Synthetic oligonucleotide
ttttggtgctgtgaaatatga

SEQ ID NO: 1355 - DNA, 21 bp, Artificial Sequence
  Description of Artificial Sequence: Synthetic oligonucleotide
tatttcacagcaccaaaataa

SEQ ID NO: 1356 - DNA, 21 bp, Artificial Sequence
  Description of Artificial Sequence: Synthetic oligonucleotide
attttggtgctgtgaaatatg

SEQ ID NO: 1357 - DNA, 21 bp, Artificial Sequence
  Description of Artificial Sequence: Synthetic oligonucleotide
atttcacagcaccaaaataaa

SEQ ID NO: 1358 - DNA, 21 bp, Artificial Sequence
  Description of Artificial Sequence: Synthetic oligonucleotide
tattttggtgctgtgaaatat

SEQ ID NO: 1359 - DNA, 21 bp, Artificial Sequence
  Description of Artificial Sequence: Synthetic oligonucleotide
tttcacagcaccaaaataaat

SEQ ID NO: 1360 - DNA, 21 bp, Artificial Sequence
  Description of Artificial Sequence: Synthetic oligonucleotide
ttattttggtgctgtgaaata

SEQ ID NO: 1361 - DNA, 21 bp, Artificial Sequence
  Description of Artificial Sequence: Synthetic oligonucleotide
ttcacagcaccaaaataaatc

SEQ ID NO: 1362 - DNA, 21 bp, Artificial Sequence
  Description of Artificial Sequence: Synthetic oligonucleotide
tttattttggtgctgtgaaat

SEQ ID NO: 1363 - DNA, 21 bp, Artificial Sequence
  Description of Artificial Sequence: Synthetic oligonucleotide
tcacagcaccaaaataaatca

SEQ ID NO: 1364 - DNA, 21 bp, Artificial Sequence
  Description of Artificial Sequence: Synthetic oligonucleotide
atttattttggtgctgtgaaa

SEQ ID NO: 1365 - DNA, 21 bp, Artificial Sequence
  Description of Artificial Sequence: Synthetic oligonucleotide
cacagcaccaaaataaatcat

SEQ ID NO: 1366 - DNA, 21 bp, Artificial Sequence
  Description of Artificial Sequence: Synthetic oligonucleotide
gatttattttggtgctgtgaa

SEQ ID NO: 1367 - DNA, 21 bp, Artificial Sequence
  Description of Artificial Sequence: Synthetic oligonucleotide
acagcaccaaaataaatcatc

SEQ ID NO: 1368 - DNA, 21 bp, Artificial Sequence
  Description of Artificial Sequence: Synthetic oligonucleotide
tgatttattttggtgctgtga

SEQ ID NO: 1369 - DNA, 21 bp, Artificial Sequence
  Description of Artificial Sequence: Synthetic oligonucleotide
cagcaccaaaataaatcatct

SEQ ID NO: 1370 - DNA, 21 bp, Artificial Sequence
  Description of Artificial Sequence: Synthetic oligonucleotide
atgatttattttggtgctgtg

SEQ ID NO: 1371 - DNA, 21 bp, Artificial Sequence
  Description of Artificial Sequence: Synthetic oligonucleotide
agcaccaaaataaatcatctt

SEQ ID NO: 1372 - DNA, 21 bp, Artificial Sequence
  Description of Artificial Sequence: Synthetic oligonucleotide
gatgatttattttggtgctgt

SEQ ID NO: 1373 - DNA, 21 bp, Artificial Sequence
  Description of Artificial Sequence: Synthetic oligonucleotide
gcaccaaaataaatcatcttt

SEQ ID NO: 1374 - DNA, 21 bp, Artificial Sequence
  Description of Artificial Sequence: Synthetic oligonucleotide
agatgatttattttggtgctg

SEQ ID NO: 1375 - DNA, 21 bp, Artificial Sequence
  Description of Artificial Sequence: Synthetic oligonucleotide
caccaaaataaatcatcttta

SEQ ID NO: 1376 - DNA, 21 bp, Artificial Sequence
  Description of Artificial Sequence: Synthetic oligonucleotide
aagatgatttattttggtgct

SEQ ID NO: 1377 - DNA, 21 bp, Artificial Sequence
  Description of Artificial Sequence: Synthetic oligonucleotide
accaaaataaatcatctttat

SEQ ID NO: 1378 - DNA, 21 bp, Artificial Sequence
  Description of Artificial Sequence: Synthetic oligonucleotide
aaagatgatttattttggtgc

SEQ ID NO: 1379 - DNA, 21 bp, Artificial Sequence
  Description of Artificial Sequence: Synthetic oligonucleotide
ccaaaataaatcatctttatt

SEQ ID NO: 1380 - DNA, 21 bp, Artificial Sequence
  Description of Artificial Sequence: Synthetic oligonucleotide
taaagatgatttattttggtg

SEQ ID NO: 1381 - DNA, 21 bp, Artificial Sequence
  Description of Artificial Sequence: Synthetic oligonucleotide
caaaataaatcatctttatta

SEQ ID NO: 1382 - DNA, 21 bp, Artificial Sequence
  Description of Artificial Sequence: Synthetic oligonucleotide
ataaagatgatttattttggt

SEQ ID NO: 1383 - DNA, 21 bp, Artificial Sequence
  Description of Artificial Sequence: Synthetic oligonucleotide
aaaataaatcatctttattaa

SEQ ID NO: 1384 - DNA, 21 bp, Artificial Sequence
  Description of Artificial Sequence: Synthetic oligonucleotide
aataaagatgatttattttgg

SEQ ID NO: 1385 - DNA, 21 bp, Artificial Sequence
  Description of Artificial Sequence: Synthetic oligonucleotide
aaataaatcatctttattaag

SEQ ID NO: 1386 - DNA, 21 bp, Artificial Sequence
  Description of Artificial Sequence: Synthetic oligonucleotide
taataaagatgatttattttg

SEQ ID NO: 1387 - DNA, 21 bp, Artificial Sequence
  Description of Artificial Sequence: Synthetic oligonucleotide
aataaatcatctttattaagt

SEQ ID NO: 1388 - DNA, 21 bp, Artificial Sequence
  Description of Artificial Sequence: Synthetic oligonucleotide
ttaataaagatgatttatttt

SEQ ID NO: 1389 - DNA, 21 bp, Artificial Sequence
  Description of Artificial Sequence: Synthetic oligonucleotide
ataaatcatctttattaagta

SEQ ID NO: 1390 - DNA, 21 bp, Artificial Sequence
  Description of Artificial Sequence: Synthetic oligonucleotide
cttaataaagatgatttattt

SEQ ID NO: 1391 - DNA, 21 bp, Artificial Sequence
  Description of Artificial Sequence: Synthetic oligonucleotide
taaatcatctttattaagtag

SEQ ID NO: 1392 - DNA, 21 bp, Artificial Sequence
  Description of Artificial Sequence: Synthetic oligonucleotide
acttaataaagatgatttatt

SEQ ID NO: 1393 - DNA, 21 bp, Artificial Sequence
  Description of Artificial Sequence: Synthetic oligonucleotide
aaatcatctttattaagtaga

SEQ ID NO: 1394 - DNA, 21 bp, Artificial Sequence
  Description of Artificial Sequence: Synthetic oligonucleotide
tacttaataaagatgatttat

SEQ ID NO: 1395 - DNA, 21 bp, Artificial Sequence
  Description of Artificial Sequence: Synthetic oligonucleotide
aatcatctttattaagtagat

SEQ ID NO: 1396 - DNA, 21 bp, Artificial Sequence
  Description of Artificial Sequence: Synthetic oligonucleotide
ctacttaataaagatgattta

SEQ ID NO: 1397 - DNA, 21 bp, Artificial Sequence
  Description of Artificial Sequence: Synthetic oligonucleotide
atcatctttattaagtagatg

SEQ ID NO: 1398 - DNA, 21 bp, Artificial Sequence
  Description of Artificial Sequence: Synthetic oligonucleotide
tctacttaataaagatgattt

SEQ ID NO: 1399 - DNA, 21 bp, Artificial Sequence
  Description of Artificial Sequence: Synthetic oligonucleotide
tcatctttattaagtagatga

SEQ ID NO: 1400 - DNA, 21 bp, Artificial Sequence
  Description of Artificial Sequence: Synthetic oligonucleotide
atctacttaataaagatgatt

SEQ ID NO: 1401 - DNA, 21 bp, Artificial Sequence
  Description of Artificial Sequence: Synthetic oligonucleotide
catctttattaagtagatgaa

SEQ ID NO: 1402 - DNA, 21 bp, Artificial Sequence
  Description of Artificial Sequence: Synthetic oligonucleotide
catctacttaataaagatgat

SEQ ID NO: 1403 - DNA, 21 bp, Artificial Sequence
  Description of Artificial Sequence: Synthetic oligonucleotide
atctttattaagtagatgaaa

SEQ ID NO: 1404 - DNA, 21 bp, Artificial Sequence
  Description of Artificial Sequence: Synthetic oligonucleotide
tcatctacttaataaagatga

SEQ ID NO: 1405 - DNA, 21 bp, Artificial Sequence
  Description of Artificial Sequence: Synthetic oligonucleotide
tctttattaagtagatgaaac

SEQ ID NO: 1406 - DNA, 21 bp, Artificial Sequence
  Description of Artificial Sequence: Synthetic oligonucleotide
ttcatctacttaataaagatg

SEQ ID NO: 1407 - DNA, 21 bp, Artificial Sequence
  Description of Artificial Sequence: Synthetic oligonucleotide
ctttattaagtagatgaaaca

SEQ ID NO: 1408 - DNA, 21 bp, Artificial Sequence
  Description of Artificial Sequence: Synthetic oligonucleotide
tttcatctacttaataaagat

SEQ ID NO: 1409 - DNA, 21 bp, Artificial Sequence
  Description of Artificial Sequence: Synthetic oligonucleotide
tttattaagtagatgaaacat

SEQ ID NO: 1410 - DNA, 21 bp, Artificial Sequence
  Description of Artificial Sequence: Synthetic oligonucleotide
gtttcatctacttaataaaga

SEQ ID NO: 1411 - DNA, 21 bp, Artificial Sequence
  Description of Artificial Sequence: Synthetic oligonucleotide
ttattaagtagatgaaacatt

SEQ ID NO: 1412 - DNA, 21 bp, Artificial Sequence
  Description of Artificial Sequence: Synthetic oligonucleotide
tgtttcatctacttaataaag

SEQ ID NO: 1413 - DNA, 21 bp, Artificial Sequence
  Description of Artificial Sequence: Synthetic oligonucleotide
tattaagtagatgaaacatta

SEQ ID NO: 1414 - DNA, 21 bp, Artificial Sequence
  Description of Artificial Sequence: Synthetic oligonucleotide
atgtttcatctacttaataaa

SEQ ID NO: 1415 - DNA, 21 bp, Artificial Sequence
  Description of Artificial Sequence: Synthetic oligonucleotide
attaagtagatgaaacattaa

SEQ ID NO: 1416 - DNA, 21 bp, Artificial Sequence
  Description of Artificial Sequence: Synthetic oligonucleotide
aatgtttcatctacttaataa

SEQ ID NO: 1417 - DNA, 21 bp, Artificial Sequence
  Description of Artificial Sequence: Synthetic oligonucleotide
ttaagtagatgaaacattaac

SEQ ID NO: 1418 - DNA, 21 bp, Artificial Sequence
  Description of Artificial Sequence: Synthetic oligonucleotide
taatgtttcatctacttaata

SEQ ID NO: 1419 - DNA, 21 bp, Artificial Sequence
  Description of Artificial Sequence: Synthetic oligonucleotide
taagtagatgaaacattaact

SEQ ID NO: 1420 - DNA, 21 bp, Artificial Sequence
  Description of Artificial Sequence: Synthetic oligonucleotide
ttaatgtttcatctacttaat

SEQ ID NO: 1421 - DNA, 21 bp, Artificial Sequence
  Description of Artificial Sequence: Synthetic oligonucleotide
aagtagatgaaacattaactc

SEQ ID NO: 1422 - DNA, 21 bp, Artificial Sequence
  Description of Artificial Sequence: Synthetic oligonucleotide
gttaatgtttcatctacttaa

SEQ ID NO: 1423 - DNA, 21 bp, Artificial Sequence
  Description of Artificial Sequence: Synthetic oligonucleotide
agtagatgaaacattaactct

SEQ ID NO: 1424 - DNA, 21 bp, Artificial Sequence
  Description of Artificial Sequence: Synthetic oligonucleotide
agttaatgtttcatctactta

SEQ ID NO: 1425 - DNA, 21 bp, Artificial Sequence
  Description of Artificial Sequence: Synthetic oligonucleotide
gtagatgaaacattaactcta

SEQ ID NO: 1426 - DNA, 21 bp, Artificial Sequence
  Description of Artificial Sequence: Synthetic oligonucleotide
gagttaatgtttcatctactt

SEQ ID NO: 1427 - DNA, 21 bp, Artificial Sequence
  Description of Artificial Sequence: Synthetic oligonucleotide
tagatgaaacattaactctaa

SEQ ID NO: 1428 - DNA, 21 bp, Artificial Sequence
  Description of Artificial Sequence: Synthetic oligonucleotide
agagttaatgtttcatctact

SEQ ID NO: 1429 - DNA, 21 bp, Artificial Sequence
  Description of Artificial Sequence: Synthetic oligonucleotide
agatgaaacattaactctaac

SEQ ID NO: 1430 - DNA, 21 bp, Artificial Sequence
  Description of Artificial Sequence: Synthetic oligonucleotide
tagagttaatgtttcatctac

SEQ ID NO: 1431 - DNA, 21 bp, Artificial Sequence
  Description of Artificial Sequence: Synthetic oligonucleotide
gatgaaacattaactctaact

SEQ ID NO: 1432 - DNA, 21 bp, Artificial Sequence
  Description of Artificial Sequence: Synthetic oligonucleotide
ttagagttaatgtttcatcta

SEQ ID NO: 1433 - DNA, 21 bp, Artificial Sequence
  Description of Artificial Sequence: Synthetic oligonucleotide
atgaaacattaactctaactg

SEQ ID NO: 1434 - DNA, 21 bp, Artificial Sequence
  Description of Artificial Sequence: Synthetic oligonucleotide
gttagagttaatgtttcatct

SEQ ID NO: 1435 - DNA, 21 bp, Artificial Sequence
  Description of Artificial Sequence: Synthetic oligonucleotide
tgaaacattaactctaactgt

SEQ ID NO: 1436 - DNA, 21 bp, Artificial Sequence
  Description of Artificial Sequence: Synthetic oligonucleotide
agttagagttaatgtttcatc

SEQ ID NO: 1437 - DNA, 21 bp, Artificial Sequence
  Description of Artificial Sequence: Synthetic oligonucleotide
gaaacattaactctaactgtg

SEQ ID NO: 1438 - DNA, 21 bp, Artificial Sequence
  Description of Artificial Sequence: Synthetic oligonucleotide
cagttagagttaatgtttcat

SEQ ID NO: 1439 - DNA, 21 bp, Artificial Sequence
  Description of Artificial Sequence: Synthetic oligonucleotide
aaacattaactctaactgtga

SEQ ID NO: 1440 - DNA, 21 bp, Artificial Sequence
  Description of Artificial Sequence: Synthetic oligonucleotide
acagttagagttaatgtttca

SEQ ID NO: 1441 - DNA, 21 bp, Artificial Sequence
  Description of Artificial Sequence: Synthetic oligonucleotide
aacattaactctaactgtgac

SEQ ID NO: 1442 - DNA, 21 bp, Artificial Sequence
  Description of Artificial Sequence: Synthetic oligonucleotide
cacagttagagttaatgtttc

SEQ ID NO: 1443 - DNA, 21 bp, Artificial Sequence
  Description of Artificial Sequence: Synthetic oligonucleotide
acattaactctaactgtgaca

SEQ ID NO: 1444 - DNA, 21 bp, Artificial Sequence
  Description of Artificial Sequence: Synthetic oligonucleotide
tcacagttagagttaatgttt

SEQ ID NO: 1445 - DNA, 21 bp, Artificial Sequence
  Description of Artificial Sequence: Synthetic oligonucleotide
cattaactctaactgtgacaa

SEQ ID NO: 1446 - DNA, 21 bp, Artificial Sequence
  Description of Artificial Sequence: Synthetic oligonucleotide
gtcacagttagagttaatgtt

SEQ ID NO: 1447 - DNA, 21 bp, Artificial Sequence
  Description of Artificial Sequence: Synthetic oligonucleotide
attaactctaactgtgacaaa

SEQ ID NO: 1448 - DNA, 21 bp, Artificial Sequence
  Description of Artificial Sequence: Synthetic oligonucleotide
tgtcacagttagagttaatgt

SEQ ID NO: 1449 - DNA, 21 bp, Artificial Sequence
  Description of Artificial Sequence: Synthetic oligonucleotide
ttaactctaactgtgacaaag

SEQ ID NO: 1450 - DNA, 21 bp, Artificial Sequence
  Description of Artificial Sequence: Synthetic oligonucleotide
ttgtcacagttagagttaatg

SEQ ID NO: 1451 - DNA, 21 bp, Artificial Sequence
  Description of Artificial Sequence: Synthetic oligonucleotide
taactctaactgtgacaaaga

SEQ ID NO: 1452 - DNA, 21 bp, Artificial Sequence
  Description of Artificial Sequence: Synthetic oligonucleotide
tttgtcacagttagagttaat

SEQ ID NO: 1453 - DNA, 21 bp, Artificial Sequence
  Description of Artificial Sequence: Synthetic oligonucleotide
aactctaactgtgacaaagaa

SEQ ID NO: 1454 - DNA, 21 bp, Artificial Sequence
  Description of Artificial Sequence: Synthetic oligonucleotide
ctttgtcacagttagagttaa

SEQ ID NO: 1455 - DNA, 21 bp, Artificial Sequence
  Description of Artificial Sequence: Synthetic oligonucleotide
actctaactgtgacaaagaag

SEQ ID NO: 1456 - DNA, 21 bp, Artificial Sequence
  Description of Artificial Sequence: Synthetic oligonucleotide
tctttgtcacagttagagtta

SEQ ID NO: 1457 - DNA, 21 bp, Artificial Sequence
  Description of Artificial Sequence: Synthetic oligonucleotide
ctctaactgtgacaaagaaga

SEQ ID NO: 1458 - DNA, 21 bp, Artificial Sequence
  Description of Artificial Sequence: Synthetic oligonucleotide
ttctttgtcacagttagagtt

SEQ ID NO: 1459 - DNA, 21 bp, Artificial Sequence
  Description of Artificial Sequence: Synthetic oligonucleotide
tctaactgtgacaaagaagac

SEQ ID NO: 1460 - DNA, 21 bp, Artificial Sequence
  Description of Artificial Sequence: Synthetic oligonucleotide
cttctttgtcacagttagagt

SEQ ID NO: 1461 - DNA, 21 bp, Artificial Sequence
  Description of Artificial Sequence: Synthetic oligonucleotide
ctaactgtgacaaagaagacc

SEQ ID NO: 1462 - DNA, 21 bp, Artificial Sequence
  Description of Artificial Sequence: Synthetic oligonucleotide
tcttctttgtcacagttagag

SEQ ID NO: 1463 - DNA, 21 bp, Artificial Sequence
  Description of Artificial Sequence: Synthetic oligonucleotide
taactgtgacaaagaagacca

SEQ ID NO: 1464 - DNA, 21 bp, Artificial Sequence
  Description of Artificial Sequence: Synthetic oligonucleotide
gtcttctttgtcacagttaga

SEQ ID NO: 1465 - DNA, 21 bp, Artificial Sequence
  Description of Artificial Sequence: Synthetic oligonucleotide
aactgtgacaaagaagaccac

SEQ ID NO: 1466 - DNA, 21 bp, Artificial Sequence
  Description of Artificial Sequence: Synthetic oligonucleotide
ggtcttctttgtcacagttag

SEQ ID NO: 1467 - DNA, 21 bp, Artificial Sequence
  Description of Artificial Sequence: Synthetic oligonucleotide
actgtgacaaagaagaccaca

SEQ ID NO: 1468 - DNA, 21 bp, Artificial Sequence
  Description of Artificial Sequence: Synthetic oligonucleotide
tggtcttctttgtcacagtta

SEQ ID NO: 1469 - DNA, 21 bp, Artificial Sequence
  Description of Artificial Sequence: Synthetic oligonucleotide
ctgtgacaaagaagaccacaa

SEQ ID NO: 1470 - DNA, 21 bp, Artificial Sequence
  Description of Artificial Sequence: Synthetic oligonucleotide
gtggtcttctttgtcacagtt

SEQ ID NO: 1471 - DNA, 21 bp, Artificial Sequence
  Description of Artificial Sequence: Synthetic oligonucleotide
tgtgacaaagaagaccacaaa

SEQ ID NO: 1472 - DNA, 21 bp, Artificial Sequence
  Description of Artificial Sequence: Synthetic oligonucleotide
tgtggtcttctttgtcacagt

SEQ ID NO: 1473 - DNA, 21 bp, Artificial Sequence
  Description of Artificial Sequence: Synthetic oligonucleotide
gtgacaaagaagaccacaaat

SEQ ID NO: 1474 - DNA, 21 bp, Artificial Sequence
  Description of Artificial Sequence: Synthetic oligonucleotide
ttgtggtcttctttgtcacag

SEQ ID NO: 1475 - DNA, 21 bp, Artificial Sequence
  Description of Artificial Sequence: Synthetic oligonucleotide
tgacaaagaagaccacaaata

SEQ ID NO: 1476 - DNA, 21 bp, Artificial Sequence
  Description of Artificial Sequence: Synthetic oligonucleotide
tttgtggtcttctttgtcaca

SEQ ID NO: 1477 - DNA, 21 bp, Artificial Sequence
  Description of Artificial Sequence: Synthetic oligonucleotide
gacaaagaagaccacaaatag

SEQ ID NO: 1478 - DNA, 21 bp, Artificial Sequence
  Description of Artificial Sequence: Synthetic oligonucleotide
atttgtggtcttctttgtcac

SEQ ID NO: 1479 - DNA, 21 bp, Artificial Sequence
  Description of Artificial Sequence: Synthetic oligonucleotide
acaaagaagaccacaaatagt

SEQ ID NO: 1480 - DNA, 21 bp, Artificial Sequence
  Description of Artificial Sequence: Synthetic oligonucleotide
tatttgtggtcttctttgtca

SEQ ID NO: 1481 - DNA, 21 bp, Artificial Sequence
  Description of Artificial Sequence: Synthetic oligonucleotide
caaagaagaccacaaatagtt

SEQ ID NO: 1482 - DNA, 21 bp, Artificial Sequence
  Description of Artificial Sequence: Synthetic oligonucleotide
ctatttgtggtcttctttgtc

SEQ ID NO: 1483 - DNA, 21 bp, Artificial Sequence
  Description of Artificial Sequence: Synthetic oligonucleotide
aaagaagaccacaaatagtta

SEQ ID NO: 1484 - DNA, 21 bp, Artificial Sequence
  Description of Artificial Sequence: Synthetic oligonucleotide
actatttgtggtcttctttgt

SEQ ID NO: 1485 - DNA, 21 bp, Artificial Sequence
  Description of Artificial Sequence: Synthetic oligonucleotide
aagaagaccacaaatagttat

SEQ ID NO: 1486 - DNA, 21 bp, Artificial Sequence
  Description of Artificial Sequence: Synthetic oligonucleotide
aactatttgtggtcttctttg

SEQ ID NO: 1487 - DNA, 21 bp, Artificial Sequence
  Description of Artificial Sequence: Synthetic oligonucleotide
agaagaccacaaatagttatc

SEQ ID NO: 1488 - DNA, 21 bp, Artificial Sequence
  Description of Artificial Sequence: Synthetic oligonucleotide
taactatttgtggtcttcttt

SEQ ID NO: 1489 - DNA, 21 bp, Artificial Sequence
  Description of Artificial Sequence: Synthetic oligonucleotide
gaagaccacaaatagttatct

SEQ ID NO: 1490 - DNA, 21 bp, Artificial Sequence
  Description of Artificial Sequence: Synthetic oligonucleotide
ataactatttgtggtcttctt

SEQ ID NO: 1491 - DNA, 21 bp, Artificial Sequence
  Description of Artificial Sequence: Synthetic oligonucleotide
aagaccacaaatagttatctt

SEQ ID NO: 1492 - DNA, 21 bp, Artificial Sequence
  Description of Artificial Sequence: Synthetic oligonucleotide
gataactatttgtggtcttct

SEQ ID NO: 1493 - DNA, 21 bp, Artificial Sequence
  Description of Artificial Sequence: Synthetic oligonucleotide
agaccacaaatagttatcttt

SEQ ID NO: 1494 - DNA, 21 bp, Artificial Sequence
  Description of Artificial Sequence: Synthetic oligonucleotide
agataactatttgtggtcttc

SEQ ID NO: 1495 - DNA, 21 bp, Artificial Sequence
  Description of Artificial Sequence: Synthetic oligonucleotide
gaccacaaatagttatctttt

SEQ ID NO: 1496 - DNA, 21 bp, Artificial Sequence
  Description of Artificial Sequence: Synthetic oligonucleotide
aagataactatttgtggtctt

SEQ ID NO: 1497 - DNA, 21 bp, Artificial Sequence
  Description of Artificial Sequence: Synthetic oligonucleotide
accacaaatagttatctttta

SEQ ID NO: 1498 - DNA, 21 bp, Artificial Sequence
  Description of Artificial Sequence: Synthetic oligonucleotide
aaagataactatttgtggtct

SEQ ID NO: 1499 - DNA, 21 bp, Artificial Sequence
  Description of Artificial Sequence: Synthetic oligonucleotide
ccacaaatagttatcttttaa

SEQ ID NO: 1500 - DNA, 21 bp, Artificial Sequence
  Description of Artificial Sequence: Synthetic oligonucleotide
aaaagataactatttgtggtc

SEQ ID NO: 1501 - DNA, 21 bp, Artificial Sequence
  Description of Artificial Sequence: Synthetic oligonucleotide
cacaaatagttatcttttaat

SEQ ID NO: 1502 - DNA, 21 bp, Artificial Sequence
  Description of Artificial Sequence: Synthetic oligonucleotide
taaaagataactatttgtggt

SEQ ID NO: 1503 - DNA, 21 bp, Artificial Sequence
  Description of Artificial Sequence: Synthetic oligonucleotide
acaaatagttatcttttaatt

SEQ ID NO: 1504 - DNA, 21 bp, Artificial Sequence
  Description of Artificial Sequence: Synthetic oligonucleotide
ttaaaagataactatttgtgg

SEQ ID NO: 1505 - DNA, 21 bp, Artificial Sequence
  Description of Artificial Sequence: Synthetic oligonucleotide
caaatagttatcttttaatta

SEQ ID NO: 1506 - DNA, 21 bp, Artificial Sequence
  Description of Artificial Sequence: Synthetic oligonucleotide
attaaaagataactatttgtg

SEQ ID NO: 1507 - DNA, 21 bp, Artificial Sequence
  Description of Artificial Sequence: Synthetic oligonucleotide
aaatagttatcttttaattac

SEQ ID NO: 1508 - DNA, 21 bp, Artificial Sequence
  Description of Artificial Sequence: Synthetic oligonucleotide
aattaaaagataactatttgt

SEQ ID NO: 1509 - DNA, 21 bp, Artificial Sequence
  Description of Artificial Sequence: Synthetic oligonucleotide
aatagttatcttttaattaca

SEQ ID NO: 1510 - DNA, 21 bp, Artificial Sequence
  Description of Artificial Sequence: Synthetic oligonucleotide
taattaaaagataactatttg

SEQ ID NO: 1511 - DNA, 21 bp, Artificial Sequence
  Description of Artificial Sequence: Synthetic oligonucleotide
atagttatcttttaattacag

SEQ ID NO: 1512 - DNA, 21 bp, Artificial Sequence
  Description of Artificial Sequence: Synthetic oligonucleotide
gtaattaaaagataactattt

SEQ ID NO: 1513 - DNA, 21 bp, Artificial Sequence
  Description of Artificial Sequence: Synthetic oligonucleotide
tagttatcttttaattacaga

SEQ ID NO: 1514 - DNA, 21 bp, Artificial Sequence
  Description of Artificial Sequence: Synthetic oligonucleotide
tgtaattaaaagataactatt

SEQ ID NO: 1515 - DNA, 21 bp, Artificial Sequence
  Description of Artificial Sequence: Synthetic oligonucleotide
agttatcttttaattacagaa

SEQ ID NO: 1516 - DNA, 21 bp, Artificial Sequence
  Description of Artificial Sequence: Synthetic oligonucleotide
ctgtaattaaaagataactat

SEQ ID NO: 1517 - DNA, 21 bp, Artificial Sequence
  Description of Artificial Sequence: Synthetic oligonucleotide
gttatcttttaattacagaag

SEQ ID NO: 1518 - DNA, 21 bp, Artificial Sequence
  Description of Artificial Sequence: Synthetic oligonucleotide
tctgtaattaaaagataacta

SEQ ID NO: 1519 - DNA, 21 bp, Artificial Sequence
  Description of Artificial Sequence: Synthetic oligonucleotide
ttatcttttaattacagaaga

SEQ ID NO: 1520 - DNA, 21 bp, Artificial Sequence
  Description of Artificial Sequence: Synthetic oligonucleotide
ttctgtaattaaaagataact

SEQ ID NO: 1521 - DNA, 21 bp, Artificial Sequence
  Description of Artificial Sequence: Synthetic oligonucleotide
tatcttttaattacagaagag

SEQ ID NO: 1522 - DNA, 21 bp, Artificial Sequence
  Description of Artificial Sequence: Synthetic oligonucleotide
cttctgtaattaaaagataac

SEQ ID NO: 1523 - DNA, 21 bp, Artificial Sequence
  Description of Artificial Sequence: Synthetic oligonucleotide
atcttttaattacagaagagt

SEQ ID NO: 1524 - DNA, 21 bp, Artificial Sequence
  Description of Artificial Sequence: Synthetic oligonucleotide
tcttctgtaattaaaagataa

SEQ ID NO: 1525 - DNA, 21 bp, Artificial Sequence
  Description of Artificial Sequence: Synthetic oligonucleotide
tcttttaattacagaagagtt

SEQ ID NO: 1526 - DNA, 21 bp, Artificial Sequence
  Description of Artificial Sequence: Synthetic oligonucleotide
ctcttctgtaattaaaagata

SEQ ID NO: 1527 - DNA, 21 bp, Artificial Sequence
  Description of Artificial Sequence: Synthetic oligonucleotide
cttttaattacagaagagttt

SEQ ID NO: 1528 - DNA, 21 bp, Artificial Sequence
  Description of Artificial Sequence: Synthetic oligonucleotide
actcttctgtaattaaaagat

SEQ ID NO: 1529 - DNA, 21 bp, Artificial Sequence
  Description of Artificial Sequence: Synthetic oligonucleotide
ttttaattacagaagagtttc

SEQ ID NO: 1530 - DNA, 21 bp, Artificial Sequence
  Description of Artificial Sequence: Synthetic oligonucleotide
aactcttctgtaattaaaaga

SEQ ID NO: 1531 - DNA, 21 bp, Artificial Sequence
  Description of Artificial Sequence: Synthetic oligonucleotide
tttaattacagaagagtttct

SEQ ID NO: 1532 - DNA, 21 bp, Artificial Sequence
  Description of Artificial Sequence: Synthetic oligonucleotide
aaactcttctgtaattaaaag

SEQ ID NO: 1533 - DNA, 21 bp, Artificial Sequence
  Description of Artificial Sequence: Synthetic oligonucleotide
ttaattacagaagagtttctt

SEQ ID NO: 1534 - DNA, 21 bp, Artificial Sequence
  Description of Artificial Sequence: Synthetic oligonucleotide
gaaactcttctgtaattaaaa

SEQ ID NO: 1535 - DNA, 21 bp, Artificial Sequence
  Description of Artificial Sequence: Synthetic oligonucleotide
taattacagaagagtttctta

SEQ ID NO: 1536 - DNA, 21 bp, Artificial Sequence
  Description of Artificial Sequence: Synthetic oligonucleotide
agaaactcttctgtaattaaa

SEQ ID NO: 1537 - DNA, 21 bp, Artificial Sequence
  Description of Artificial Sequence: Synthetic oligonucleotide
aattacagaagagtttcttaa

SEQ ID NO: 1538 - DNA, 21 bp, Artificial Sequence
  Description of Artificial Sequence: Synthetic oligonucleotide
aagaaactcttctgtaattaa

SEQ ID NO: 1539 - DNA, 21 bp, Artificial Sequence
  Description of Artificial Sequence: Synthetic oligonucleotide
attacagaagagtttcttaac

SEQ ID NO: 1540 - DNA, 21 bp, Artificial Sequence
  Description of Artificial Sequence: Synthetic oligonucleotide
taagaaactcttctgtaatta

SEQ ID NO: 1541 - DNA, 21 bp, Artificial Sequence
  Description of Artificial Sequence: Synthetic oligonucleotide
ttacagaagagtttcttaact

SEQ ID NO: 1542 - DNA, 21 bp, Artificial Sequence
  Description of Artificial Sequence: Synthetic oligonucleotide
ttaagaaactcttctgtaatt

SEQ ID NO: 1543 - DNA, 21 bp, Artificial Sequence
  Description of Artificial Sequence: Synthetic oligonucleotide
tacagaagagtttcttaactt

SEQ ID NO: 1544 - DNA, 21 bp, Artificial Sequence
  Description of Artificial Sequence: Synthetic oligonucleotide
gttaagaaactcttctgtaat

SEQ ID NO: 1545 - DNA, 21 bp, Artificial Sequence
  Description of Artificial Sequence: Synthetic oligonucleotide
acagaagagtttcttaactta

SEQ ID NO: 1546 - DNA, 21 bp, Artificial Sequence
  Description of Artificial Sequence: Synthetic oligonucleotide
agttaagaaactcttctgtaa

SEQ ID NO: 1547 - DNA, 21 bp, Artificial Sequence
  Description of Artificial Sequence: Synthetic oligonucleotide
cagaagagtttcttaacttac

SEQ ID NO: 1548 - DNA, 21 bp, Artificial Sequence
  Description of Artificial Sequence: Synthetic oligonucleotide
aagttaagaaactcttctgta

SEQ ID NO: 1549 - DNA, 21 bp, Artificial Sequence
  Description of Artificial Sequence: Synthetic oligonucleotide
agaagagtttcttaacttact

SEQ ID NO: 1550 - DNA, 21 bp, Artificial Sequence
  Description of Artificial Sequence: Synthetic oligonucleotide
taagttaagaaactcttctgt

SEQ ID NO: 1551 - DNA, 21 bp, Artificial Sequence
  Description of Artificial Sequence: Synthetic oligonucleotide
gaagagtttcttaacttactt

SEQ ID NO: 1552 - DNA, 21 bp, Artificial Sequence
  Description of Artificial Sequence: Synthetic oligonucleotide
gtaagttaagaaactcttctg

SEQ ID NO: 1553 - DNA, 21 bp, Artificial Sequence
  Description of Artificial Sequence: Synthetic oligonucleotide
aagagtttcttaacttacttt

SEQ ID NO: 1554 - DNA, 21 bp, Artificial Sequence
  Description of Artificial Sequence: Synthetic oligonucleotide
agtaagttaagaaactcttct

SEQ ID NO: 1555 - DNA, 21 bp, Artificial Sequence
  Description of Artificial Sequence: Synthetic oligonucleotide
agagtttcttaacttactttt

SEQ ID NO: 1556 - DNA, 21 bp, Artificial Sequence
  Description of Artificial Sequence: Synthetic oligonucleotide
aagtaagttaagaaactcttc

SEQ ID NO: 1557 - DNA, 21 bp, Artificial Sequence
  Description of Artificial Sequence: Synthetic oligonucleotide
gagtttcttaacttacttttg

SEQ ID NO: 1558 - DNA, 21 bp, Artificial Sequence
  Description of Artificial Sequence: Synthetic oligonucleotide
aaagtaagttaagaaactctt

SEQ ID NO: 1559 - DNA, 21 bp, Artificial Sequence
  Description of Artificial Sequence: Synthetic oligonucleotide
agtttcttaacttacttttgt

SEQ ID NO: 1560 - DNA, 21 bp, Artificial Sequence
  Description of Artificial Sequence: Synthetic oligonucleotide
aaaagtaagttaagaaactct

SEQ ID NO: 1561 - DNA, 21 bp, Artificial Sequence
  Description of Artificial Sequence: Synthetic oligonucleotide
gtttcttaacttacttttgta

SEQ ID NO: 1562 - DNA, 21 bp, Artificial Sequence
  Description of Artificial Sequence: Synthetic oligonucleotide
caaaagtaagttaagaaactc

SEQ ID NO: 1563 - DNA, 21 bp, Artificial Sequence
  Description of Artificial Sequence: Synthetic oligonucleotide
tttcttaacttacttttgtaa

SEQ ID NO: 1564 - DNA, 21 bp, Artificial Sequence
  Description of Artificial Sequence: Synthetic oligonucleotide
acaaaagtaagttaagaaact

SEQ ID NO: 1565 - DNA, 21 bp, Artificial Sequence
  Description of Artificial Sequence: Synthetic oligonucleotide
ttcttaacttacttttgtaag

SEQ ID NO: 1566 - DNA, 21 bp, Artificial Sequence
  Description of Artificial Sequence: Synthetic oligonucleotide
tacaaaagtaagttaagaaac

SEQ ID NO: 1567 - DNA, 21 bp, Artificial Sequence
  Description of Artificial Sequence: Synthetic oligonucleotide
tcttaacttacttttgtaagt

SEQ ID NO: 1568 - DNA, 21 bp, Artificial Sequence
  Description of Artificial Sequence: Synthetic oligonucleotide
ttacaaaagtaagttaagaaa

SEQ ID NO: 1569 - DNA, 21 bp, Artificial Sequence
  Description of Artificial Sequence: Synthetic oligonucleotide
cttaacttacttttgtaagtt

SEQ ID NO: 1570 - DNA, 21 bp, Artificial Sequence
  Description of Artificial Sequence: Synthetic oligonucleotide
cttacaaaagtaagttaagaa

SEQ ID NO: 1571 - DNA, 21 bp, Artificial Sequence
  Description of Artificial Sequence: Synthetic oligonucleotide
ttaacttacttttgtaagttt

SEQ ID NO: 1572 - DNA, 21 bp, Artificial Sequence
  Description of Artificial Sequence: Synthetic oligonucleotide
acttacaaaagtaagttaaga

SEQ ID NO: 1573 - DNA, 21 bp, Artificial Sequence
  Description of Artificial Sequence: Synthetic oligonucleotide
taacttacttttgtaagtttt

SEQ ID NO: 1574 - DNA, 21 bp, Artificial Sequence
  Description of Artificial Sequence: Synthetic oligonucleotide
aacttacaaaagtaagttaag

SEQ ID NO: 1575 - DNA, 21 bp, Artificial Sequence
  Description of Artificial Sequence: Synthetic oligonucleotide
aacttacttttgtaagttttt

SEQ ID NO: 1576 - DNA, 21 bp, Artificial Sequence
  Description of Artificial Sequence: Synthetic oligonucleotide
aaacttacaaaagtaagttaa

SEQ ID NO: 1577 - DNA, 21 bp, Artificial Sequence
  Description of Artificial Sequence: Synthetic oligonucleotide
acttacttttgtaagttttta

SEQ ID NO: 1578 - DNA, 21 bp, Artificial Sequence
  Description of Artificial Sequence: Synthetic oligonucleotide
aaaacttacaaaagtaagtta

SEQ ID NO: 1579 - DNA, 21 bp, Artificial Sequence
  Description of Artificial Sequence: Synthetic oligonucleotide
cttacttttgtaagtttttat

SEQ ID NO: 1580 - DNA, 21 bp, Artificial Sequence
  Description of Artificial Sequence: Synthetic oligonucleotide
aaaaacttacaaaagtaagtt

SEQ ID NO: 1581 - DNA, 21 bp, Artificial Sequence
  Description of Artificial Sequence: Synthetic oligonucleotide
ttacttttgtaagtttttatt

SEQ ID NO: 1582 - DNA, 21 bp, Artificial Sequence
  Description of Artificial Sequence: Synthetic oligonucleotide
taaaaacttacaaaagtaagt

SEQ ID NO: 1583 - DNA, 21 bp, Artificial Sequence
  Description of Artificial Sequence: Synthetic oligonucleotide
tacttttgtaagtttttattg

SEQ ID NO: 1584 - DNA, 21 bp, Artificial Sequence
  Description of Artificial Sequence: Synthetic oligonucleotide
ataaaaacttacaaaagtaag

SEQ ID NO: 1585 - DNA, 21 bp, Artificial Sequence
  Description of Artificial Sequence: Synthetic oligonucleotide
acttttgtaagtttttattgt

SEQ ID NO: 1586 - DNA, 21 bp, Artificial Sequence
  Description of Artificial Sequence: Synthetic oligonucleotide
aataaaaacttacaaaagtaa

SEQ ID NO: 1587 - DNA, 21 bp, Artificial Sequence
  Description of Artificial Sequence: Synthetic oligonucleotide
cttttgtaagtttttattgtg

SEQ ID NO: 1588 - DNA, 21 bp, Artificial Sequence
  Description of Artificial Sequence: Synthetic oligonucleotide
caataaaaacttacaaaagta

SEQ ID NO: 1589 - DNA, 21 bp, Artificial Sequence
  Description of Artificial Sequence: Synthetic oligonucleotide
ttttgtaagtttttattgtgt

SEQ ID NO: 1590 - DNA, 21 bp, Artificial Sequence
  Description of Artificial Sequence: Synthetic oligonucleotide
acaataaaaacttacaaaagt

SEQ ID NO: 1591 - DNA, 21 bp, Artificial Sequence
  Description of Artificial Sequence: Synthetic oligonucleotide
tttgtaagtttttattgtgta

SEQ ID NO: 1592 - DNA, 21 bp, Artificial Sequence
  Description of Artificial Sequence: Synthetic oligonucleotide
cacaataaaaacttacaaaag

SEQ ID NO: 1593 - DNA, 21 bp, Artificial Sequence
  Description of Artificial Sequence: Synthetic oligonucleotide
ttgtaagtttttattgtgtaa

SEQ ID NO: 1594 - DNA, 21 bp, Artificial Sequence
  Description of Artificial Sequence: Synthetic oligonucleotide
acacaataaaaacttacaaaa

SEQ ID NO: 1595 - DNA, 21 bp, Artificial Sequence
  Description of Artificial Sequence: Synthetic oligonucleotide
tgtaagtttttattgtgtaag

SEQ ID NO: 1596 - DNA, 21 bp, Artificial Sequence
  Description of Artificial Sequence: Synthetic oligonucleotide
tacacaataaaaacttacaaa

SEQ ID NO: 1597 - DNA, 21 bp, Artificial Sequence
  Description of Artificial Sequence: Synthetic oligonucleotide
gtaagtttttattgtgtaagt

SEQ ID NO: 1598 - DNA, 21 bp, Artificial Sequence
  Description of Artificial Sequence: Synthetic oligonucleotide
ttacacaataaaaacttacaa

SEQ ID NO: 1599 - DNA, 21 bp, Artificial Sequence
  Description of Artificial Sequence: Synthetic oligonucleotide
taagtttttattgtgtaagtt

SEQ ID NO: 1600 - DNA, 21 bp, Artificial Sequence
  Description of Artificial Sequence: Synthetic oligonucleotide
cttacacaataaaaacttaca

SEQ ID NO: 1601 - DNA, 21 bp, Artificial Sequence
  Description of Artificial Sequence: Synthetic oligonucleotide
aagtttttattgtgtaagttt

SEQ ID NO: 1602 - DNA, 21 bp, Artificial Sequence
  Description of Artificial Sequence: Synthetic oligonucleotide
acttacacaataaaaacttac

SEQ ID NO: 1603 - DNA, 21 bp, Artificial Sequence
  Description of Artificial Sequence: Synthetic oligonucleotide
agtttttattgtgtaagttta

SEQ ID NO: 1604 - DNA, 21 bp, Artificial Sequence
  Description of Artificial Sequence: Synthetic oligonucleotide
aacttacacaataaaaactta

SEQ ID NO: 1605 - DNA, 21 bp, Artificial Sequence
  Description of Artificial Sequence: Synthetic oligonucleotide
gtttttattgtgtaagtttat

SEQ ID NO: 1606 - DNA, 21 bp, Artificial Sequence
  Description of Artificial Sequence: Synthetic oligonucleotide
aaacttacacaataaaaactt

SEQ ID NO: 1607 - DNA, 21 bp, Artificial Sequence
  Description of Artificial Sequence: Synthetic oligonucleotide
tttttattgtgtaagtttata

SEQ ID NO: 1608 - DNA, 21 bp, Artificial Sequence
  Description of Artificial Sequence: Synthetic oligonucleotide
taaacttacacaataaaaact

SEQ ID NO: 1609 - DNA, 21 bp, Artificial Sequence
  Description of Artificial Sequence: Synthetic oligonucleotide
ttttattgtgtaagtttataa

SEQ ID NO: 1610 - DNA, 21 bp, Artificial Sequence
  Description of Artificial Sequence: Synthetic oligonucleotide
ataaacttacacaataaaaac

SEQ ID NO: 1611 - DNA, 21 bp, Artificial Sequence
  Description of Artificial Sequence: Synthetic oligonucleotide
tttattgtgtaagtttataat

SEQ ID NO: 1612 - DNA, 21 bp, Artificial Sequence
  Description of Artificial Sequence: Synthetic oligonucleotide
tataaacttacacaataaaaa

SEQ ID NO: 1613 - DNA, 21 bp, Artificial Sequence
  Description of Artificial Sequence: Synthetic oligonucleotide
ttattgtgtaagtttataatg

SEQ ID NO: 1614 - DNA, 21 bp, Artificial Sequence
  Description of Artificial Sequence: Synthetic oligonucleotide
ttataaacttacacaataaaa

SEQ ID NO: 1615 - DNA, 21 bp, Artificial Sequence
  Description of Artificial Sequence: Synthetic oligonucleotide
tattgtgtaagtttataatgc

SEQ ID NO: 1616 - DNA, 21 bp, Artificial Sequence
  Description of Artificial Sequence: Synthetic oligonucleotide
attataaacttacacaataaa

SEQ ID NO: 1617 - DNA, 21 bp, Artificial Sequence
  Description of Artificial Sequence: Synthetic oligonucleotide
attgtgtaagtttataatgca

SEQ ID NO: 1618 - DNA, 21 bp, Artificial Sequence
  Description of Artificial Sequence: Synthetic oligonucleotide
cattataaacttacacaataa

SEQ ID NO: 1619 - DNA, 21 bp, Artificial Sequence
  Description of Artificial Sequence: Synthetic oligonucleotide
ttgtgtaagtttataatgcag

SEQ ID NO: 1620 - DNA, 21 bp, Artificial Sequence
  Description of Artificial Sequence: Synthetic oligonucleotide
gcattataaacttacacaata

SEQ ID NO: 1621 - DNA, 21 bp, Artificial Sequence
  Description of Artificial Sequence: Synthetic oligonucleotide
tgtgtaagtttataatgcagg

SEQ ID NO: 1622 - DNA, 21 bp, Artificial Sequence
  Description of Artificial Sequence: Synthetic oligonucleotide
tgcattataaacttacacaat

SEQ ID NO: 1623 - DNA, 21 bp, Artificial Sequence
  Description of Artificial Sequence: Synthetic oligonucleotide
gtgtaagtttataatgcaggg

SEQ ID NO: 1624 - DNA, 21 bp, Artificial Sequence
  Description of Artificial Sequence: Synthetic oligonucleotide
ctgcattataaacttacacaa

SEQ ID NO: 1625 - DNA, 21 bp, Artificial Sequence
  Description of Artificial Sequence: Synthetic oligonucleotide
tgtaagtttataatgcagggg

SEQ ID NO: 1626 - DNA, 21 bp, Artificial Sequence
  Description of Artificial Sequence: Synthetic oligonucleotide
cctgcattataaacttacaca

SEQ ID NO: 1627 - DNA, 21 bp, Artificial Sequence
  Description of Artificial Sequence: Synthetic oligonucleotide
gtaagtttataatgcagggga

SEQ ID NO: 1628 - DNA, 21 bp, Artificial Sequence
  Description of Artificial Sequence: Synthetic oligonucleotide
ccctgcattataaacttacac

SEQ ID NO: 1629 - DNA, 21 bp, Artificial Sequence
  Description of Artificial Sequence: Synthetic oligonucleotide
taagtttataatgcaggggaa

SEQ ID NO: 1630 - DNA, 21 bp, Artificial Sequence
  Description of Artificial Sequence: Synthetic oligonucleotide
cccctgcattataaacttaca

SEQ ID NO: 1631 - DNA, 21 bp, Artificial Sequence
  Description of Artificial Sequence: Synthetic oligonucleotide
aagtttataatgcaggggaag

SEQ ID NO: 1632 - DNA, 21 bp, Artificial Sequence
  Description of Artificial Sequence: Synthetic oligonucleotide
tcccctgcattataaacttac

SEQ ID NO: 1633 - DNA, 21 bp, Artificial Sequence
  Description of Artificial Sequence: Synthetic oligonucleotide
agtttataatgcaggggaagt

SEQ ID NO: 1634 - DNA, 21 bp, Artificial Sequence
  Description of Artificial Sequence: Synthetic oligonucleotide
ttcccctgcattataaactta

SEQ ID NO: 1635 - DNA, 21 bp, Artificial Sequence
  Description of Artificial Sequence: Synthetic oligonucleotide
gtttataatgcaggggaagta

SEQ ID NO: 1636 - DNA, 21 bp, Artificial Sequence
  Description of Artificial Sequence: Synthetic oligonucleotide
cttcccctgcattataaactt

SEQ ID NO: 1637 - DNA, 21 bp, Artificial Sequence
  Description of Artificial Sequence: Synthetic oligonucleotide
tttataatgcaggggaagtac

SEQ ID NO: 1638 - DNA, 21 bp, Artificial Sequence
  Description of Artificial Sequence: Synthetic oligonucleotide
acttcccctgcattataaact

SEQ ID NO: 1639 - DNA, 21 bp, Artificial Sequence
  Description of Artificial Sequence: Synthetic oligonucleotide
ttataatgcaggggaagtact

SEQ ID NO: 1640 - DNA, 21 bp, Artificial Sequence
  Description of Artificial Sequence: Synthetic oligonucleotide
tacttcccctgcattataaac

SEQ ID NO: 1641 - DNA, 21 bp, Artificial Sequence
  Description of Artificial Sequence: Synthetic oligonucleotide
tataatgcaggggaagtacta

SEQ ID NO: 1642 - DNA, 21 bp, Artificial Sequence
  Description of Artificial Sequence: Synthetic oligonucleotide
gtacttcccctgcattataaa

SEQ ID NO: 1643 - DNA, 21 bp, Artificial Sequence
  Description of Artificial Sequence: Synthetic oligonucleotide
ataatgcaggggaagtactac

SEQ ID NO: 1644 - DNA, 21 bp, Artificial Sequence
  Description of Artificial Sequence: Synthetic oligonucleotide
agtacttcccctgcattataa

SEQ ID NO: 1645 - DNA, 21 bp, Artificial Sequence
  Description of Artificial Sequence: Synthetic oligonucleotide
taatgcaggggaagtactact

SEQ ID NO: 1646 - DNA, 21 bp, Artificial Sequence
  Description of Artificial Sequence: Synthetic oligonucleotide
tagtacttcccctgcattata

SEQ ID NO: 1647 - DNA, 21 bp, Artificial Sequence
  Description of Artificial Sequence: Synthetic oligonucleotide
aatgcaggggaagtactactc

SEQ ID NO: 1648 - DNA, 21 bp, Artificial Sequence
  Description of Artificial Sequence: Synthetic oligonucleotide
gtagtacttcccctgcattat

SEQ ID NO: 1649 - DNA, 21 bp, Artificial Sequence
  Description of Artificial Sequence: Synthetic oligonucleotide
atgcaggggaagtactactcc

SEQ ID NO: 1650 - DNA, 21 bp, Artificial Sequence
  Description of Artificial Sequence: Synthetic oligonucleotide
agtagtacttcccctgcatta

SEQ ID NO: 1651 - DNA, 21 bp, Artificial Sequence
  Description of Artificial Sequence: Synthetic oligonucleotide
tgcaggggaagtactactcct

SEQ ID NO: 1652 - DNA, 21 bp, Artificial Sequence
  Description of Artificial Sequence: Synthetic oligonucleotide
gagtagtacttcccctgcatt

SEQ ID NO: 1653 - DNA, 21 bp, Artificial Sequence
  Description of Artificial Sequence: Synthetic oligonucleotide
gcaggggaagtactactcctc

SEQ ID NO: 1654 - DNA, 21 bp, Artificial Sequence
  Description of Artificial Sequence: Synthetic oligonucleotide
ggagtagtacttcccctgcat

SEQ ID NO: 1655 - DNA, 21 bp, Artificial Sequence
  Description of Artificial Sequence: Synthetic oligonucleotide
caggggaagtactactcctca

SEQ ID NO: 1656 - DNA, 21 bp, Artificial Sequence
  Description of Artificial Sequence: Synthetic oligonucleotide
aggagtagtacttcccctgca

SEQ ID NO: 1657 - DNA, 21 bp, Artificial Sequence
  Description of Artificial Sequence: Synthetic oligonucleotide
aggggaagtactactcctcaa

SEQ ID NO: 1658 - DNA, 21 bp, Artificial Sequence
  Description of Artificial Sequence: Synthetic oligonucleotide
gaggagtagtacttcccctgc

SEQ ID NO: 1659 - DNA, 21 bp, Artificial Sequence
  Description of Artificial Sequence: Synthetic oligonucleotide
ggggaagtactactcctcaaa

SEQ ID NO: 1660 - DNA, 21 bp, Artificial Sequence
  Description of Artificial Sequence: Synthetic oligonucleotide
tgaggagtagtacttcccctg

SEQ ID NO: 1661 - DNA, 21 bp, Artificial Sequence
  Description of Artificial Sequence: Synthetic oligonucleotide
gggaagtactactcctcaaat

SEQ ID NO: 1662 - DNA, 21 bp, Artificial Sequence
  Description of Artificial Sequence: Synthetic oligonucleotide
ttgaggagtagtacttcccct

SEQ ID NO: 1663 - DNA, 21 bp, Artificial Sequence
  Description of Artificial Sequence: Synthetic oligonucleotide
ggaagtactactcctcaaatg

SEQ ID NO: 1664 - DNA, 21 bp, Artificial Sequence
  Description of Artificial Sequence: Synthetic oligonucleotide
tttgaggagtagtacttcccc

SEQ ID NO: 1665 - DNA, 21 bp, Artificial Sequence
  Description of Artificial Sequence: Synthetic oligonucleotide
gaagtactactcctcaaatgt

SEQ ID NO: 1666 - DNA, 21 bp, Artificial Sequence
  Description of Artificial Sequence: Synthetic oligonucleotide
atttgaggagtagtacttccc

SEQ ID NO: 1667 - DNA, 21 bp, Artificial Sequence
  Description of Artificial Sequence: Synthetic oligonucleotide
aagtactactcctcaaatgtt

SEQ ID NO: 1668 - DNA, 21 bp, Artificial Sequence
  Description of Artificial Sequence: Synthetic oligonucleotide
catttgaggagtagtacttcc

SEQ ID NO: 1669 - DNA, 21 bp, Artificial Sequence
  Description of Artificial Sequence: Synthetic oligonucleotide
agtactactcctcaaatgttg

SEQ ID NO: 1670 - DNA, 21 bp, Artificial Sequence
  Description of Artificial Sequence: Synthetic oligonucleotide
acatttgaggagtagtacttc

SEQ ID NO: 1671 - DNA, 21 bp, Artificial Sequence
  Description of Artificial Sequence: Synthetic oligonucleotide
gtactactcctcaaatgttga

SEQ ID NO: 1672 - DNA, 21 bp, Artificial Sequence
  Description of Artificial Sequence: Synthetic oligonucleotide
aacatttgaggagtagtactt

SEQ ID NO: 1673 - DNA, 21 bp, Artificial Sequence
  Description of Artificial Sequence: Synthetic oligonucleotide
tactactcctcaaatgttgag

SEQ ID NO: 1674 - DNA, 21 bp, Artificial Sequence
  Description of Artificial Sequence: Synthetic oligonucleotide
caacatttgaggagtagtact

SEQ ID NO: 1675 - DNA, 21 bp, Artificial Sequence
  Description of Artificial Sequence: Synthetic oligonucleotide
actactcctcaaatgttgagg

SEQ ID NO: 1676 - DNA, 21 bp, Artificial Sequence
  Description of Artificial Sequence: Synthetic oligonucleotide
tcaacatttgaggagtagtac

SEQ ID NO: 1677 - DNA, 21 bp, Artificial Sequence
  Description of Artificial Sequence: Synthetic oligonucleotide
ctactcctcaaatgttgaggg

SEQ ID NO: 1678 - DNA, 21 bp, Artificial Sequence
  Description of Artificial Sequence: Synthetic oligonucleotide
ctcaacatttgaggagtagta

SEQ ID NO: 1679 - DNA, 21 bp, Artificial Sequence
  Description of Artificial Sequence: Synthetic oligonucleotide
tactcctcaaatgttgaggga

SEQ ID NO: 1680 - DNA, 21 bp, Artificial Sequence
  Description of Artificial Sequence: Synthetic oligonucleotide
cctcaacatttgaggagtagt

SEQ ID NO: 1681 - DNA, 21 bp, Artificial Sequence
  Description of Artificial Sequence: Synthetic oligonucleotide
actcctcaaatgttgagggaa

SEQ ID NO: 1682 - DNA, 21 bp, Artificial Sequence
  Description of Artificial Sequence: Synthetic oligonucleotide
ccctcaacatttgaggagtag

SEQ ID NO: 1683 - DNA, 21 bp, Artificial Sequence
  Description of Artificial Sequence: Synthetic oligonucleotide
ctcctcaaatgttgagggaag

SEQ ID NO: 1684 - DNA, 21 bp, Artificial Sequence
  Description of Artificial Sequence: Synthetic oligonucleotide
tccctcaacatttgaggagta

SEQ ID NO: 1685 - DNA, 21 bp, Artificial Sequence
  Description of Artificial Sequence: Synthetic oligonucleotide
tcctcaaatgttgagggaagc

SEQ ID NO: 1686 - DNA, 21 bp, Artificial Sequence
  Description of Artificial Sequence: Synthetic oligonucleotide
ttccctcaacatttgaggagt

SEQ ID NO: 1687 - DNA, 21 bp, Artificial Sequence
  Description of Artificial Sequence: Synthetic oligonucleotide
cctcaaatgttgagggaagct

SEQ ID NO: 1688 - DNA, 21 bp, Artificial Sequence
  Description of Artificial Sequence: Synthetic oligonucleotide
cttccctcaacatttgaggag

SEQ ID NO: 1689 - DNA, 21 bp, Artificial Sequence
  Description of Artificial Sequence: Synthetic oligonucleotide
ctcaaatgttgagggaagctt

SEQ ID NO: 1690 - DNA, 21 bp, Artificial Sequence
  Description of Artificial Sequence: Synthetic oligonucleotide
gcttccctcaacatttgagga

SEQ ID NO: 1691 - DNA, 21 bp, Artificial Sequence
  Description of Artificial Sequence: Synthetic oligonucleotide
tcaaatgttgagggaagcttc

SEQ ID NO: 1692 - DNA, 21 bp, Artificial Sequence
  Description of Artificial Sequence: Synthetic oligonucleotide
agcttccctcaacatttgagg

SEQ ID NO: 1693 - DNA, 21 bp, Artificial Sequence
  Description of Artificial Sequence: Synthetic oligonucleotide
caaatgttgagggaagcttcc

SEQ ID NO: 1694 - DNA, 21 bp, Artificial Sequence
  Description of Artificial Sequence: Synthetic oligonucleotide
aagcttccctcaacatttgag

SEQ ID NO: 1695 - DNA, 21 bp, Artificial Sequence
  Description of Artificial Sequence: Synthetic oligonucleotide
aaatgttgagggaagcttcca

SEQ ID NO: 1696 - DNA, 21 bp, Artificial Sequence
  Description of Artificial Sequence: Synthetic oligonucleotide
gaagcttccctcaacatttga

SEQ ID NO: 1697 - DNA, 21 bp, Artificial Sequence
  Description of Artificial Sequence: Synthetic oligonucleotide
aatgttgagggaagcttccat

SEQ ID NO: 1698 - DNA, 21 bp, Artificial Sequence
  Description of Artificial Sequence: Synthetic oligonucleotide
ggaagcttccctcaacatttg

SEQ ID NO: 1699 - DNA, 21 bp, Artificial Sequence
  Description of Artificial Sequence: Synthetic oligonucleotide
atgttgagggaagcttccata

SEQ ID NO: 1700 - DNA, 21 bp, Artificial Sequence
  Description of Artificial Sequence: Synthetic oligonucleotide
tggaagcttccctcaacattt

SEQ ID NO: 1701 - DNA, 21 bp, Artificial Sequence
  Description of Artificial Sequence: Synthetic oligonucleotide
tgttgagggaagcttccataa

SEQ ID NO: 1702 - DNA, 21 bp, Artificial Sequence
  Description of Artificial Sequence: Synthetic oligonucleotide
atggaagcttccctcaacatt

SEQ ID NO: 1703 - DNA, 21 bp, Artificial Sequence
  Description of Artificial Sequence: Synthetic oligonucleotide
gttgagggaagcttccataac

SEQ ID NO: 1704 - DNA, 21 bp, Artificial Sequence
  Description of Artificial Sequence: Synthetic oligonucleotide
tatggaagcttccctcaacat

SEQ ID NO: 1705 - DNA, 21 bp, Artificial Sequence
  Description of Artificial Sequence: Synthetic oligonucleotide
ttgagggaagcttccataaca

SEQ ID NO: 1706 - DNA, 21 bp, Artificial Sequence
  Description of Artificial Sequence: Synthetic oligonucleotide
ttatggaagcttccctcaaca

SEQ ID NO: 1707 - DNA, 21 bp, Artificial Sequence
  Description of Artificial Sequence: Synthetic oligonucleotide
tgagggaagcttccataacat

SEQ ID NO: 1708 - DNA, 21 bp, Artificial Sequence
  Description of Artificial Sequence: Synthetic oligonucleotide
gttatggaagcttccctcaac

SEQ ID NO: 1709 - DNA, 21 bp, Artificial Sequence
  Description of Artificial Sequence: Synthetic oligonucleotide
gagggaagcttccataacatt

SEQ ID NO: 1710 - DNA, 21 bp, Artificial Sequence
  Description of Artificial Sequence: Synthetic oligonucleotide
tgttatggaagcttccctcaa

SEQ ID NO: 1711 - DNA, 21 bp, Artificial Sequence
  Description of Artificial Sequence: Synthetic oligonucleotide
agggaagcttccataacattg

SEQ ID NO: 1712 - DNA, 21 bp, Artificial Sequence
  Description of Artificial Sequence: Synthetic oligonucleotide
atgttatggaagcttccctca

SEQ ID NO: 1713 - DNA, 21 bp, Artificial Sequence
  Description of Artificial Sequence: Synthetic oligonucleotide
gggaagcttccataacattga

SEQ ID NO: 1714 - DNA, 21 bp, Artificial Sequence
  Description of Artificial Sequence: Synthetic oligonucleotide
aatgttatggaagcttccctc

SEQ ID NO: 1715 - DNA, 21 bp, Artificial Sequence
  Description of Artificial Sequence: Synthetic oligonucleotide
ggaagcttccataacattgat

SEQ ID NO: 1716 - DNA, 21 bp, Artificial Sequence
  Description of Artificial Sequence: Synthetic oligonucleotide
caatgttatggaagcttccct

SEQ ID NO: 1717 - DNA, 21 bp, Artificial Sequence
  Description of Artificial Sequence: Synthetic oligonucleotide
gaagcttccataacattgatg

SEQ ID NO: 1718 - DNA, 21 bp, Artificial Sequence
  Description of Artificial Sequence: Synthetic oligonucleotide
tcaatgttatggaagcttccc

SEQ ID NO: 1719 - DNA, 21 bp, Artificial Sequence
  Description of Artificial Sequence: Synthetic oligonucleotide
aagcttccataacattgatga

SEQ ID NO: 1720 - DNA, 21 bp, Artificial Sequence
  Description of Artificial Sequence: Synthetic oligonucleotide
atcaatgttatggaagcttcc

SEQ ID NO: 1721 - DNA, 21 bp, Artificial Sequence
  Description of Artificial Sequence: Synthetic oligonucleotide
agcttccataacattgatgac

SEQ ID NO: 1722 - DNA, 21 bp, Artificial Sequence
  Description of Artificial Sequence: Synthetic oligonucleotide
catcaatgttatggaagcttc

SEQ ID NO: 1723 - DNA, 21 bp, Artificial Sequence
  Description of Artificial Sequence: Synthetic oligonucleotide
gcttccataacattgatgact

SEQ ID NO: 1724 - DNA, 21 bp, Artificial Sequence
  Description of Artificial Sequence: Synthetic oligonucleotide
tcatcaatgttatggaagctt

SEQ ID NO: 1725 - DNA, 21 bp, Artificial Sequence
  Description of Artificial Sequence: Synthetic oligonucleotide
cttccataacattgatgactg

SEQ ID NO: 1726 - DNA, 21 bp, Artificial Sequence
  Description of Artificial Sequence: Synthetic oligonucleotide
gtcatcaatgttatggaagct

SEQ ID NO: 1727 - DNA, 21 bp, Artificial Sequence
  Description of Artificial Sequence: Synthetic oligonucleotide
ttccataacattgatgactgg

SEQ ID NO: 1728 - DNA, 21 bp, Artificial Sequence
  Description of Artificial Sequence: Synthetic oligonucleotide
agtcatcaatgttatggaagc

SEQ ID NO: 1729 - DNA, 21 bp, Artificial Sequence
  Description of Artificial Sequence: Synthetic oligonucleotide
tccataacattgatgactggc

SEQ ID NO: 1730 - DNA, 21 bp, Artificial Sequence
  Description of Artificial Sequence: Synthetic oligonucleotide
cagtcatcaatgttatggaag

SEQ ID NO: 1731 - DNA, 21 bp, Artificial Sequence
  Description of Artificial Sequence: Synthetic oligonucleotide
ccataacattgatgactggct

SEQ ID NO: 1732 - DNA, 21 bp, Artificial Sequence
  Description of Artificial Sequence: Synthetic oligonucleotide
ccagtcatcaatgttatggaa

SEQ ID NO: 1733 - DNA, 21 bp, Artificial Sequence
  Description of Artificial Sequence: Synthetic oligonucleotide
cataacattgatgactggctt

SEQ ID NO: 1734 - DNA, 21 bp, Artificial Sequence
  Description of Artificial Sequence: Synthetic oligonucleotide
gccagtcatcaatgttatgga

SEQ ID NO: 1735 - DNA, 21 bp, Artificial Sequence
  Description of Artificial Sequence: Synthetic oligonucleotide
ataacattgatgactggcttc

SEQ ID NO: 1736 - DNA, 21 bp, Artificial Sequence
  Description of Artificial Sequence: Synthetic oligonucleotide
agccagtcatcaatgttatgg

SEQ ID NO: 1737 - DNA, 21 bp, Artificial Sequence
  Description of Artificial Sequence: Synthetic oligonucleotide
taacattgatgactggcttca

SEQ ID NO: 1738 - DNA, 21 bp, Artificial Sequence
  Description of Artificial Sequence: Synthetic oligonucleotide
aagccagtcatcaatgttatg

SEQ ID NO: 1739 - DNA, 21 bp, Artificial Sequence
  Description of Artificial Sequence: Synthetic oligonucleotide
aacattgatgactggcttcat

SEQ ID NO: 1740 - DNA, 21 bp, Artificial Sequence
  Description of Artificial Sequence: Synthetic oligonucleotide
gaagccagtcatcaatgttat

SEQ ID NO: 1741 - DNA, 21 bp, Artificial Sequence
  Description of Artificial Sequence: Synthetic oligonucleotide
acattgatgactggcttcatg

SEQ ID NO: 1742 - DNA, 21 bp, Artificial Sequence
  Description of Artificial Sequence: Synthetic oligonucleotide
tgaagccagtcatcaatgtta

SEQ ID NO: 1743 - DNA, 21 bp, Artificial Sequence
  Description of Artificial Sequence: Synthetic oligonucleotide
cattgatgactggcttcatgg

SEQ ID NO: 1744 - DNA, 21 bp, Artificial Sequence
  Description of Artificial Sequence: Synthetic oligonucleotide
atgaagccagtcatcaatgtt

SEQ ID NO: 1745 - DNA, 21 bp, Artificial Sequence
  Description of Artificial Sequence: Synthetic oligonucleotide
attgatgactggcttcatggc

SEQ ID NO: 1746 - DNA, 21 bp, Artificial Sequence
  Description of Artificial Sequence: Synthetic oligonucleotide
catgaagccagtcatcaatgt

SEQ ID NO: 1747 - DNA, 21 bp, Artificial Sequence
  Description of Artificial Sequence: Synthetic oligonucleotide
ttgatgactggcttcatggca

SEQ ID NO: 1748 - DNA, 21 bp, Artificial Sequence
  Description of Artificial Sequence: Synthetic oligonucleotide
ccatgaagccagtcatcaatg

SEQ ID NO: 1749 - DNA, 21 bp, Artificial Sequence
  Description of Artificial Sequence: Synthetic oligonucleotide
tgatgactggcttcatggcag

SEQ ID NO: 1750 - DNA, 21 bp, Artificial Sequence
  Description of Artificial Sequence: Synthetic oligonucleotide
gccatgaagccagtcatcaat

SEQ ID NO: 1751 - DNA, 21 bp, Artificial Sequence
  Description of Artificial Sequence: Synthetic oligonucleotide
gatgactggcttcatggcagt

SEQ ID NO: 1752 - DNA, 21 bp, Artificial Sequence
  Description of Artificial Sequence: Synthetic oligonucleotide
tgccatgaagccagtcatcaa

SEQ ID NO: 1753 - DNA, 21 bp, Artificial Sequence
  Description of Artificial Sequence: Synthetic oligonucleotide
atgactggcttcatggcagta

SEQ ID NO: 1754 - DNA, 21 bp, Artificial Sequence
  Description of Artificial Sequence: Synthetic oligonucleotide
ctgccatgaagccagtcatca

SEQ ID NO: 1755 - DNA, 21 bp, Artificial Sequence
  Description of Artificial Sequence: Synthetic oligonucleotide
tgactggcttcatggcagtaa

SEQ ID NO: 1756 - DNA, 21 bp, Artificial Sequence
  Description of Artificial Sequence: Synthetic oligonucleotide
actgccatgaagccagtcatc

SEQ ID NO: 1757 - DNA, 21 bp, Artificial Sequence
  Description of Artificial Sequence: Synthetic oligonucleotide
gactggcttcatggcagtaat

SEQ ID NO: 1758 - DNA, 21 bp, Artificial Sequence
  Description of Artificial Sequence: Synthetic oligonucleotide
tactgccatgaagccagtcat

SEQ ID NO: 1759 - DNA, 21 bp, Artificial Sequence
  Description of Artificial Sequence: Synthetic oligonucleotide
actggcttcatggcagtaatt

SEQ ID NO: 1760 - DNA, 21 bp, Artificial Sequence
  Description of Artificial Sequence: Synthetic oligonucleotide
ttactgccatgaagccagtca

SEQ ID NO: 1761 - DNA, 21 bp, Artificial Sequence
  Description of Artificial Sequence: Synthetic oligonucleotide
ctggcttcatggcagtaattc

SEQ ID NO: 1762 - DNA, 21 bp, Artificial Sequence
  Description of Artificial Sequence: Synthetic oligonucleotide
attactgccatgaagccagtc

SEQ ID NO: 1763 - DNA, 21 bp, Artificial Sequence
  Description of Artificial Sequence: Synthetic oligonucleotide
tggcttcatggcagtaattct

SEQ ID NO: 1764 - DNA, 21 bp, Artificial Sequence
  Description of Artificial Sequence: Synthetic oligonucleotide
aattactgccatgaagccagt

SEQ ID NO: 1765 - DNA, 21 bp, Artificial Sequence
  Description of Artificial Sequence: Synthetic oligonucleotide
ggcttcatggcagtaattctc

SEQ ID NO: 1766 - DNA, 21 bp, Artificial Sequence
  Description of Artificial Sequence: Synthetic oligonucleotide
gaattactgccatgaagccag

SEQ ID NO: 1767 - DNA, 21 bp, Artificial Sequence
  Description of Artificial Sequence: Synthetic oligonucleotide
gcttcatggcagtaattctcg

SEQ ID NO: 1768 - DNA, 21 bp, Artificial Sequence
  Description of Artificial Sequence: Synthetic oligonucleotide
agaattactgccatgaagcca

SEQ ID NO: 1769 - DNA, 21 bp, Artificial Sequence
  Description of Artificial Sequence: Synthetic oligonucleotide
cttcatggcagtaattctcgg

SEQ ID NO: 1770 - DNA, 21 bp, Artificial Sequence
  Description of Artificial Sequence: Synthetic oligonucleotide
gagaattactgccatgaagcc

SEQ ID NO: 1771 - DNA, 21 bp, Artificial Sequence
  Description of Artificial Sequence: Synthetic oligonucleotide
ttcatggcagtaattctcggc

SEQ ID NO: 1772 - DNA, 21 bp, Artificial Sequence
  Description of Artificial Sequence: Synthetic oligonucleotide
cgagaattactgccatgaagc

SEQ ID NO: 1773 - DNA, 21 bp, Artificial Sequence
  Description of Artificial Sequence: Synthetic oligonucleotide
tcatggcagtaattctcggct

SEQ ID NO: 1774 - DNA, 21 bp, Artificial Sequence
  Description of Artificial Sequence: Synthetic oligonucleotide
ccgagaattactgccatgaag

SEQ ID NO: 1775 - DNA, 21 bp, Artificial Sequence
  Description of Artificial Sequence: Synthetic oligonucleotide
catggcagtaattctcggctg

SEQ ID NO: 1776 - DNA, 21 bp, Artificial Sequence
  Description of Artificial Sequence: Synthetic oligonucleotide
gccgagaattactgccatgaa

SEQ ID NO: 1777 - DNA, 21 bp, Artificial Sequence
  Description of Artificial Sequence: Synthetic oligonucleotide
atggcagtaattctcggctgt

SEQ ID NO: 1778 - DNA, 21 bp, Artificial Sequence
  Description of Artificial Sequence: Synthetic oligonucleotide
agccgagaattactgccatga

SEQ ID NO: 1779 - DNA, 21 bp, Artificial Sequence
  Description of Artificial Sequence: Synthetic oligonucleotide
tggcagtaattctcggctgta

SEQ ID NO: 1780 - DNA, 21 bp, Artificial Sequence
  Description of Artificial Sequence: Synthetic oligonucleotide
cagccgagaattactgccatg

SEQ ID NO: 1781 - DNA, 21 bp, Artificial Sequence
  Description of Artificial Sequence: Synthetic oligonucleotide
ggcagtaattctcggctgtag

SEQ ID NO: 1782 - DNA, 21 bp, Artificial Sequence
  Description of Artificial Sequence: Synthetic oligonucleotide
acagccgagaattactgccat

SEQ ID NO: 1783 - DNA, 21 bp, Artificial Sequence
  Description of Artificial Sequence: Synthetic oligonucleotide
gcagtaattctcggctgtagt

SEQ ID NO: 1784 - DNA, 21 bp, Artificial Sequence
  Description of Artificial Sequence: Synthetic oligonucleotide
tacagccgagaattactgcca

SEQ ID NO: 1785 - DNA, 21 bp, Artificial Sequence
  Description of Artificial Sequence: Synthetic oligonucleotide
cagtaattctcggctgtagtt

SEQ ID NO: 1786 - DNA, 21 bp, Artificial Sequence
  Description of Artificial Sequence: Synthetic oligonucleotide
ctacagccgagaattactgcc

SEQ ID NO: 1787 - DNA, 21 bp, Artificial Sequence
  Description of Artificial Sequence: Synthetic oligonucleotide
agtaattctcggctgtagttg

SEQ ID NO: 1788 - DNA, 21 bp, Artificial Sequence
  Description of Artificial Sequence: Synthetic oligonucleotide
actacagccgagaattactgc

SEQ ID NO: 1789 - DNA, 21 bp, Artificial Sequence
  Description of Artificial Sequence: Synthetic oligonucleotide
gtaattctcggctgtagttgc

SEQ ID NO: 1790 - DNA, 21 bp, Artificial Sequence
  Description of Artificial Sequence: Synthetic oligonucleotide
aactacagccgagaattactg

SEQ ID NO: 1791 - DNA, 21 bp, Artificial Sequence
  Description of Artificial Sequence: Synthetic oligonucleotide
taattctcggctgtagttgca

SEQ ID NO: 1792 - DNA, 21 bp, Artificial Sequence
  Description of Artificial Sequence: Synthetic oligonucleotide
caactacagccgagaattact

SEQ ID NO: 1793 - DNA, 21 bp, Artificial Sequence
  Description of Artificial Sequence: Synthetic oligonucleotide
aattctcggctgtagttgcat

SEQ ID NO: 1794 - DNA, 21 bp, Artificial Sequence
  Description of Artificial Sequence: Synthetic oligonucleotide
gcaactacagccgagaattac

SEQ ID NO: 1795 - DNA, 21 bp, Artificial Sequence
  Description of Artificial Sequence: Synthetic oligonucleotide
attctcggctgtagttgcata

SEQ ID NO: 1796 - DNA, 21 bp, Artificial Sequence
  Description of Artificial Sequence: Synthetic oligonucleotide
tgcaactacagccgagaatta

SEQ ID NO: 1797 - DNA, 21 bp, Artificial Sequence
  Description of Artificial Sequence: Synthetic oligonucleotide
ttctcggctgtagttgcataa

SEQ ID NO: 1798 - DNA, 21 bp, Artificial Sequence
  Description of Artificial Sequence: Synthetic oligonucleotide
atgcaactacagccgagaatt

SEQ ID NO: 1799 - DNA, 21 bp, Artificial Sequence
  Description of Artificial Sequence: Synthetic oligonucleotide
tctcggctgtagttgcataag

SEQ ID NO: 1800 - DNA, 21 bp, Artificial Sequence
  Description of Artificial Sequence: Synthetic oligonucleotide
tatgcaactacagccgagaat

SEQ ID NO: 1801 - DNA, 21 bp, Artificial Sequence
  Description of Artificial Sequence: Synthetic oligonucleotide
ctcggctgtagttgcataagc

SEQ ID NO: 1802 - DNA, 21 bp, Artificial Sequence
  Description of Artificial Sequence: Synthetic oligonucleotide
ttatgcaactacagccgagaa

SEQ ID NO: 1803 - DNA, 21 bp, Artificial Sequence
  Description of Artificial Sequence: Synthetic oligonucleotide
tcggctgtagttgcataagca

SEQ ID NO: 1804 - DNA, 21 bp, Artificial Sequence
  Description of Artificial Sequence: Synthetic oligonucleotide
cttatgcaactacagccgaga

SEQ ID NO: 1805 - DNA, 21 bp, Artificial Sequence
  Description of Artificial Sequence: Synthetic oligonucleotide
cggctgtagttgcataagcat

SEQ ID NO: 1806 - DNA, 21 bp, Artificial Sequence
  Description of Artificial Sequence: Synthetic oligonucleotide
gcttatgcaactacagccgag

SEQ ID NO: 1807 - DNA, 21 bp, Artificial Sequence
  Description of Artificial Sequence: Synthetic oligonucleotide
ggctgtagttgcataagcatt

SEQ ID NO: 1808 - DNA, 21 bp, Artificial Sequence
  Description of Artificial Sequence: Synthetic oligonucleotide
tgcttatgcaactacagccga

SEQ ID NO: 1809 - DNA, 21 bp, Artificial Sequence
  Description of Artificial Sequence: Synthetic oligonucleotide
gctgtagttgcataagcattg

SEQ ID NO: 1810 - DNA, 21 bp, Artificial Sequence
  Description of Artificial Sequence: Synthetic oligonucleotide
atgcttatgcaactacagccg

SEQ ID NO: 1811 - DNA, 21 bp, Artificial Sequence
  Description of Artificial Sequence: Synthetic oligonucleotide
ctgtagttgcataagcattgc

SEQ ID NO: 1812 - DNA, 21 bp, Artificial Sequence
  Description of Artificial Sequence: Synthetic oligonucleotide
aatgcttatgcaactacagcc

SEQ ID NO: 1813 - DNA, 21 bp, Artificial Sequence
  Description of Artificial Sequence: Synthetic oligonucleotide
tgtagttgcataagcattgct

SEQ ID NO: 1814 - DNA, 21 bp, Artificial Sequence
  Description of Artificial Sequence: Synthetic oligonucleotide
caatgcttatgcaactacagc

SEQ ID NO: 1815 - DNA, 21 bp, Artificial Sequence
  Description of Artificial Sequence: Synthetic oligonucleotide
gtagttgcataagcattgctc

SEQ ID NO: 1816 - DNA, 21 bp, Artificial Sequence
  Description of Artificial Sequence: Synthetic oligonucleotide
gcaatgcttatgcaactacag

SEQ ID NO: 1817 - DNA, 21 bp, Artificial Sequence
  Description of Artificial Sequence: Synthetic oligonucleotide
tagttgcataagcattgctca

SEQ ID NO: 1818 - DNA, 21 bp, Artificial Sequence
  Description of Artificial Sequence: Synthetic oligonucleotide
agcaatgcttatgcaactaca

SEQ ID NO: 1819 - DNA, 21 bp, Artificial Sequence
  Description of Artificial Sequence: Synthetic oligonucleotide
agttgcataagcattgctcaa

SEQ ID NO: 1820 - DNA, 21 bp, Artificial Sequence
  Description of Artificial Sequence: Synthetic oligonucleotide
gagcaatgcttatgcaactac

SEQ ID NO: 1821 - DNA, 21 bp, Artificial Sequence
  Description of Artificial Sequence: Synthetic oligonucleotide
gttgcataagcattgctcaag

SEQ ID NO: 1822 - DNA, 21 bp, Artificial Sequence
  Description of Artificial Sequence: Synthetic oligonucleotide
tgagcaatgcttatgcaacta

SEQ ID NO: 1823 - DNA, 21 bp, Artificial Sequence
  Description of Artificial Sequence: Synthetic oligonucleotide
ttgcataagcattgctcaaga

SEQ ID NO: 1824 - DNA, 21 bp, Artificial Sequence
  Description of Artificial Sequence: Synthetic oligonucleotide
ttgagcaatgcttatgcaact

SEQ ID NO: 1825 - DNA, 21 bp, Artificial Sequence
  Description of Artificial Sequence: Synthetic oligonucleotide
tgcataagcattgctcaagag

SEQ ID NO: 1826 - DNA, 21 bp, Artificial Sequence
  Description of Artificial Sequence: Synthetic oligonucleotide
cttgagcaatgcttatgcaac

SEQ ID NO: 1827 - DNA, 21 bp, Artificial Sequence
  Description of Artificial Sequence: Synthetic oligonucleotide
gcataagcattgctcaagagg

SEQ ID NO: 1828 - DNA, 21 bp, Artificial Sequence
  Description of Artificial Sequence: Synthetic oligonucleotide
tcttgagcaatgcttatgcaa

SEQ ID NO: 1829 - DNA, 21 bp, Artificial Sequence
  Description of Artificial Sequence: Synthetic oligonucleotide
cataagcattgctcaagagga

SEQ ID NO: 1830 - DNA, 21 bp, Artificial Sequence
  Description of Artificial Sequence: Synthetic oligonucleotide
ctcttgagcaatgcttatgca

SEQ ID NO: 1831 - DNA, 21 bp, Artificial Sequence
  Description of Artificial Sequence: Synthetic oligonucleotide
ataagcattgctcaagaggaa

SEQ ID NO: 1832 - DNA, 21 bp, Artificial Sequence
  Description of Artificial Sequence: Synthetic oligonucleotide
cctcttgagcaatgcttatgc

SEQ ID NO: 1833 - DNA, 21 bp, Artificial Sequence
  Description of Artificial Sequence: Synthetic oligonucleotide
taagcattgctcaagaggaaa

SEQ ID NO: 1834 - DNA, 21 bp, Artificial Sequence
  Description of Artificial Sequence: Synthetic oligonucleotide
tcctcttgagcaatgcttatg

SEQ ID NO: 1835 - DNA, 21 bp, Artificial Sequence
  Description of Artificial Sequence: Synthetic oligonucleotide
aagcattgctcaagaggaaaa

SEQ ID NO: 1836 - DNA, 21 bp, Artificial Sequence
  Description of Artificial Sequence: Synthetic oligonucleotide
ttcctcttgagcaatgcttat

SEQ ID NO: 1837 - DNA, 21 bp, Artificial Sequence
  Description of Artificial Sequence: Synthetic oligonucleotide
agcattgctcaagaggaaaat

SEQ ID NO: 1838 - DNA, 21 bp, Artificial Sequence
  Description of Artificial Sequence: Synthetic oligonucleotide
tttcctcttgagcaatgctta

SEQ ID NO: 1839 - DNA, 21 bp, Artificial Sequence
  Description of Artificial Sequence: Synthetic oligonucleotide
gcattgctcaagaggaaaatc

SEQ ID NO: 1840 - DNA, 21 bp, Artificial Sequence
  Description of Artificial Sequence: Synthetic oligonucleotide
ttttcctcttgagcaatgctt

SEQ ID NO: 1841 - DNA, 21 bp, Artificial Sequence
  Description of Artificial Sequence: Synthetic oligonucleotide
cattgctcaagaggaaaatcc

SEQ ID NO: 1842 - DNA, 21 bp, Artificial Sequence
  Description of Artificial Sequence: Synthetic oligonucleotide
attttcctcttgagcaatgct

SEQ ID NO: 1843 - DNA, 21 bp, Artificial Sequence
  Description of Artificial Sequence: Synthetic oligonucleotide
attgctcaagaggaaaatcca

SEQ ID NO: 1844 - DNA, 21 bp, Artificial Sequence
  Description of Artificial Sequence: Synthetic oligonucleotide
gattttcctcttgagcaatgc

SEQ ID NO: 1845 - DNA, 21 bp, Artificial Sequence
  Description of Artificial Sequence: Synthetic oligonucleotide
ttgctcaagaggaaaatccaa

SEQ ID NO: 1846 - DNA, 21 bp, Artificial Sequence
  Description of Artificial Sequence: Synthetic oligonucleotide
ggattttcctcttgagcaatg

SEQ ID NO: 1847 - DNA, 21 bp, Artificial Sequence
  Description of Artificial Sequence: Synthetic oligonucleotide
tgctcaagaggaaaatccaaa

SEQ ID NO: 1848 - DNA, 21 bp, Artificial Sequence
  Description of Artificial Sequence: Synthetic oligonucleotide
tggattttcctcttgagcaat

SEQ ID NO: 1849 - DNA, 21 bp, Artificial Sequence
  Description of Artificial Sequence: Synthetic oligonucleotide
gctcaagaggaaaatccaaaa

SEQ ID NO: 1850 - DNA, 21 bp, Artificial Sequence
  Description of Artificial Sequence: Synthetic oligonucleotide
ttggattttcctcttgagcaa

SEQ ID NO: 1851 - DNA, 21 bp, Artificial Sequence
  Description of Artificial Sequence: Synthetic oligonucleotide
ctcaagaggaaaatccaaaag

SEQ ID NO: 1852 - DNA, 21 bp, Artificial Sequence
  Description of Artificial Sequence: Synthetic oligonucleotide
tttggattttcctcttgagca

SEQ ID NO: 1853 - DNA, 21 bp, Artificial Sequence
  Description of Artificial Sequence: Synthetic oligonucleotide
tcaagaggaaaatccaaaagt

SEQ ID NO: 1854 - DNA, 21 bp, Artificial Sequence
  Description of Artificial Sequence: Synthetic oligonucleotide
ttttggattttcctcttgagc

SEQ ID NO: 1855 - DNA, 21 bp, Artificial Sequence
  Description of Artificial Sequence: Synthetic oligonucleotide
caagaggaaaatccaaaagtg

SEQ ID NO: 1856 - DNA, 21 bp, Artificial Sequence
  Description of Artificial Sequence: Synthetic oligonucleotide
cttttggattttcctcttgag

SEQ ID NO: 1857 - DNA, 21 bp, Artificial Sequence
  Description of Artificial Sequence: Synthetic oligonucleotide
aagaggaaaatccaaaagtgc

SEQ ID NO: 1858 - DNA, 21 bp, Artificial Sequence
  Description of Artificial Sequence: Synthetic oligonucleotide
acttttggattttcctcttga

SEQ ID NO: 1859 - DNA, 21 bp, Artificial Sequence
  Description of Artificial Sequence: Synthetic oligonucleotide
agaggaaaatccaaaagtgca

SEQ ID NO: 1860 - DNA, 21 bp, Artificial Sequence
  Description of Artificial Sequence: Synthetic oligonucleotide
cacttttggattttcctcttg

SEQ ID NO: 1861 - DNA, 21 bp, Artificial Sequence
  Description of Artificial Sequence: Synthetic oligonucleotide
gaggaaaatccaaaagtgcag

SEQ ID NO: 1862 - DNA, 21 bp, Artificial Sequence
  Description of Artificial Sequence: Synthetic oligonucleotide
gcacttttggattttcctctt

SEQ ID NO: 1863 - DNA, 21 bp, Artificial Sequence
  Description of Artificial Sequence: Synthetic oligonucleotide
aggaaaatccaaaagtgcagc

SEQ ID NO: 1864 - DNA, 21 bp, Artificial Sequence
  Description of Artificial Sequence: Synthetic oligonucleotide
tgcacttttggattttcctct

SEQ ID NO: 1865 - DNA, 21 bp, Artificial Sequence
  Description of Artificial Sequence: Synthetic oligonucleotide
ggaaaatccaaaagtgcagca

SEQ ID NO: 1866 - DNA, 21 bp, Artificial Sequence
  Description of Artificial Sequence: Synthetic oligonucleotide
ctgcacttttggattttcctc

SEQ ID NO: 1867 - DNA, 21 bp, Artificial Sequence
  Description of Artificial Sequence: Synthetic oligonucleotide
gaaaatccaaaagtgcagcag

SEQ ID NO: 1868 - DNA, 21 bp, Artificial Sequence
  Description of Artificial Sequence: Synthetic oligonucleotide
gctgcacttttggattttcct

SEQ ID NO: 1869 - DNA, 21 bp, Artificial Sequence
  Description of Artificial Sequence: Synthetic oligonucleotide
aaaatccaaaagtgcagcagg

SEQ ID NO: 1870 - DNA, 21 bp, Artificial Sequence
  Description of Artificial Sequence: Synthetic oligonucleotide
tgctgcacttttggattttcc

SEQ ID NO: 1871 - DNA, 21 bp, Artificial Sequence
  Description of Artificial Sequence: Synthetic oligonucleotide
aaatccaaaagtgcagcagga

SEQ ID NO: 1872 - DNA, 21 bp, Artificial Sequence
  Description of Artificial Sequence: Synthetic oligonucleotide
ctgctgcacttttggattttc

SEQ ID NO: 1873 - DNA, 21 bp, Artificial Sequence
  Description of Artificial Sequence: Synthetic oligonucleotide
aatccaaaagtgcagcaggag

SEQ ID NO: 1874 - DNA, 21 bp, Artificial Sequence
  Description of Artificial Sequence: Synthetic oligonucleotide
cctgctgcacttttggatttt

SEQ ID NO: 1875 - DNA, 21 bp, Artificial Sequence
  Description of Artificial Sequence: Synthetic oligonucleotide
atccaaaagtgcagcaggaga

SEQ ID NO: 1876 - DNA, 21 bp, Artificial Sequence
  Description of Artificial Sequence: Synthetic oligonucleotide
tcctgctgcacttttggattt

SEQ ID NO: 1877 - DNA, 21 bp, Artificial Sequence
  Description of Artificial Sequence: Synthetic oligonucleotide
tccaaaagtgcagcaggagaa

SEQ ID NO: 1878 - DNA, 21 bp, Artificial Sequence
  Description of Artificial Sequence: Synthetic oligonucleotide
ctcctgctgcacttttggatt

SEQ ID NO: 1879 - DNA, 21 bp, Artificial Sequence
  Description of Artificial Sequence: Synthetic oligonucleotide
ccaaaagtgcagcaggagaac

SEQ ID NO: 1880 - DNA, 21 bp, Artificial Sequence
  Description of Artificial Sequence: Synthetic oligonucleotide
tctcctgctgcacttttggat

SEQ ID NO: 1881 - DNA, 21 bp, Artificial Sequence
  Description of Artificial Sequence: Synthetic oligonucleotide
caaaagtgcagcaggagaact

SEQ ID NO: 1882 - DNA, 21 bp, Artificial Sequence
  Description of Artificial Sequence: Synthetic oligonucleotide
ttctcctgctgcacttttgga

SEQ ID NO: 1883 - DNA, 21 bp, Artificial Sequence
  Description of Artificial Sequence: Synthetic oligonucleotide
aaaagtgcagcaggagaactc

SEQ ID NO: 1884 - DNA, 21 bp, Artificial Sequence
  Description of Artificial Sequence: Synthetic oligonucleotide
gttctcctgctgcacttttgg

SEQ ID NO: 1885 - DNA, 21 bp, Artificial Sequence
  Description of Artificial Sequence: Synthetic oligonucleotide
aaagtgcagcaggagaactct

SEQ ID NO: 1886 - DNA, 21 bp, Artificial Sequence
  Description of Artificial Sequence: Synthetic oligonucleotide
agttctcctgctgcacttttg

SEQ ID NO: 1887 - DNA, 21 bp, Artificial Sequence
  Description of Artificial Sequence: Synthetic oligonucleotide
aagtgcagcaggagaactctt

SEQ ID NO: 1888 - DNA, 21 bp, Artificial Sequence
  Description of Artificial Sequence: Synthetic oligonucleotide
gagttctcctgctgcactttt

SEQ ID NO: 1889 - DNA, 21 bp, Artificial Sequence
  Description of Artificial Sequence: Synthetic oligonucleotide
agtgcagcaggagaactcttt

SEQ ID NO: 1890 - DNA, 21 bp, Artificial Sequence
  Description of Artificial Sequence: Synthetic oligonucleotide
agagttctcctgctgcacttt

SEQ ID NO: 1891 - DNA, 21 bp, Artificial Sequence
  Description of Artificial Sequence: Synthetic oligonucleotide
gtgcagcaggagaactctttt

SEQ ID NO: 1892 - DNA, 21 bp, Artificial Sequence
  Description of Artificial Sequence: Synthetic oligonucleotide
aagagttctcctgctgcactt

SEQ ID NO: 1893 - DNA, 21 bp, Artificial Sequence
  Description of Artificial Sequence: Synthetic oligonucleotide
tgcagcaggagaactcttttc

SEQ ID NO: 1894 - DNA, 21 bp, Artificial Sequence
  Description of Artificial Sequence: Synthetic oligonucleotide
aaagagttctcctgctgcact

SEQ ID NO: 1895 - DNA, 21 bp, Artificial Sequence
  Description of Artificial Sequence: Synthetic oligonucleotide
gcagcaggagaactcttttcc

SEQ ID NO: 1896 - DNA, 21 bp, Artificial Sequence
  Description of Artificial Sequence: Synthetic oligonucleotide
aaaagagttctcctgctgcac

SEQ ID NO: 1897 - DNA, 21 bp, Artificial Sequence
  Description of Artificial Sequence: Synthetic oligonucleotide
cagcaggagaactcttttccc

SEQ ID NO: 1898 - DNA, 21 bp, Artificial Sequence
  Description of Artificial Sequence: Synthetic oligonucleotide
gaaaagagttctcctgctgca

SEQ ID NO: 1899 - DNA, 21 bp, Artificial Sequence
  Description of Artificial Sequence: Synthetic oligonucleotide
agcaggagaactcttttccct

SEQ ID NO: 1900 - DNA, 21 bp, Artificial Sequence
  Description of Artificial Sequence: Synthetic oligonucleotide
ggaaaagagttctcctgctgc

SEQ ID NO: 1901 - DNA, 21 bp, Artificial Sequence
  Description of Artificial Sequence: Synthetic oligonucleotide
gcaggagaactcttttccctg

SEQ ID NO: 1902 - DNA, 21 bp, Artificial Sequence
  Description of Artificial Sequence: Synthetic oligonucleotide
gggaaaagagttctcctgctg

SEQ ID NO: 1903 - DNA, 21 bp, Artificial Sequence
  Description of Artificial Sequence: Synthetic oligonucleotide
caggagaactcttttccctga

SEQ ID NO: 1904 - DNA, 21 bp, Artificial Sequence
  Description of Artificial Sequence: Synthetic oligonucleotide
agggaaaagagttctcctgct

SEQ ID NO: 1905 - DNA, 21 bp, Artificial Sequence
  Description of Artificial Sequence: Synthetic oligonucleotide
aggagaactcttttccctgaa

SEQ ID NO: 1906 - DNA, 21 bp, Artificial Sequence
  Description of Artificial Sequence: Synthetic oligonucleotide
cagggaaaagagttctcctgc

SEQ ID NO: 1907 - DNA, 21 bp, Artificial Sequence
  Description of Artificial Sequence: Synthetic oligonucleotide
ggagaactcttttccctgaaa

SEQ ID NO: 1908 - DNA, 21 bp, Artificial Sequence
  Description of Artificial Sequence: Synthetic oligonucleotide
tcagggaaaagagttctcctg

SEQ ID NO: 1909 - DNA, 21 bp, Artificial Sequence
  Description of Artificial Sequence: Synthetic oligonucleotide
gagaactcttttccctgaaaa

SEQ ID NO: 1910 - DNA, 21 bp, Artificial Sequence
  Description of Artificial Sequence: Synthetic oligonucleotide
ttcagggaaaagagttctcct

SEQ ID NO: 1911 - DNA, 21 bp, Artificial Sequence
  Description of Artificial Sequence: Synthetic oligonucleotide
agaactcttttccctgaaaaa

SEQ ID NO: 1912 - DNA, 21 bp, Artificial Sequence
  Description of Artificial Sequence: Synthetic oligonucleotide
tttcagggaaaagagttctcc

SEQ ID NO: 1913 - DNA, 21 bp, Artificial Sequence
  Description of Artificial Sequence: Synthetic oligonucleotide
gaactcttttccctgaaaaag

SEQ ID NO: 1914 - DNA, 21 bp, Artificial Sequence
  Description of Artificial Sequence: Synthetic oligonucleotide
ttttcagggaaaagagttctc

SEQ ID NO: 1915 - DNA, 21 bp, Artificial Sequence
  Description of Artificial Sequence: Synthetic oligonucleotide
aactcttttccctgaaaaagg

SEQ ID NO: 1916 - DNA, 21 bp, Artificial Sequence
  Description of Artificial Sequence: Synthetic oligonucleotide
tttttcagggaaaagagttct

SEQ ID NO: 1917 - DNA, 21 bp, Artificial Sequence
  Description of Artificial Sequence: Synthetic oligonucleotide
actcttttccctgaaaaagga

SEQ ID NO: 1918 - DNA, 21 bp, Artificial Sequence
  Description of Artificial Sequence: Synthetic oligonucleotide
ctttttcagggaaaagagttc

SEQ ID NO: 1919 - DNA, 21 bp, Artificial Sequence
  Description of Artificial Sequence: Synthetic oligonucleotide
ctcttttccctgaaaaaggaa

SEQ ID NO: 1920 - DNA, 21 bp, Artificial Sequence
  Description of Artificial Sequence: Synthetic oligonucleotide
cctttttcagggaaaagagtt

SEQ ID NO: 1921 - DNA, 21 bp, Artificial Sequence
  Description of Artificial Sequence: Synthetic oligonucleotide
tcttttccctgaaaaaggaaa

SEQ ID NO: 1922 - DNA, 21 bp, Artificial Sequence
  Description of Artificial Sequence: Synthetic oligonucleotide
tcctttttcagggaaaagagt

SEQ ID NO: 1923 - DNA, 21 bp, Artificial Sequence
  Description of Artificial Sequence: Synthetic oligonucleotide
cttttccctgaaaaaggaaaa

SEQ ID NO: 1924 - DNA, 21 bp, Artificial Sequence
  Description of Artificial Sequence: Synthetic oligonucleotide
ttcctttttcagggaaaagag

SEQ ID NO: 1925 - DNA, 21 bp, Artificial Sequence
  Description of Artificial Sequence: Synthetic oligonucleotide
ttttccctgaaaaaggaaaaa

SEQ ID NO: 1926 - DNA, 21 bp, Artificial Sequence
  Description of Artificial Sequence: Synthetic oligonucleotide
tttcctttttcagggaaaaga

SEQ ID NO: 1927 - DNA, 21 bp, Artificial Sequence
  Description of Artificial Sequence: Synthetic oligonucleotide
tttccctgaaaaaggaaaaat

SEQ ID NO: 1928 - DNA, 21 bp, Artificial Sequence
  Description of Artificial Sequence: Synthetic oligonucleotide
ttttcctttttcagggaaaag

SEQ ID NO: 1929 - DNA, 21 bp, Artificial Sequence
  Description of Artificial Sequence: Synthetic oligonucleotide
ttccctgaaaaaggaaaaata

SEQ ID NO: 1930 - DNA, 21 bp, Artificial Sequence
  Description of Artificial Sequence: Synthetic oligonucleotide
tttttcctttttcagggaaaa

SEQ ID NO: 1931 - DNA, 21 bp, Artificial Sequence
  Description of Artificial Sequence: Synthetic oligonucleotide
tccctgaaaaaggaaaaatat

SEQ ID NO: 1932 - DNA, 21 bp, Artificial Sequence
  Description of Artificial Sequence: Synthetic oligonucleotide
atttttcctttttcagggaaa

SEQ ID NO: 1933 - DNA, 21 bp, Artificial Sequence
  Description of Artificial Sequence: Synthetic oligonucleotide
ccctgaaaaaggaaaaatatt

SEQ ID NO: 1934 - DNA, 21 bp, Artificial Sequence
  Description of Artificial Sequence: Synthetic oligonucleotide
tatttttcctttttcagggaa

SEQ ID NO: 1935 - DNA, 21 bp, Artificial Sequence
  Description of Artificial Sequence: Synthetic oligonucleotide
cctgaaaaaggaaaaatattg

SEQ ID NO: 1936 - DNA, 21 bp, Artificial Sequence
  Description of Artificial Sequence: Synthetic oligonucleotide
atatttttcctttttcaggga

SEQ ID NO: 1937 - DNA, 21 bp, Artificial Sequence
  Description of Artificial Sequence: Synthetic oligonucleotide
ctgaaaaaggaaaaatattga

SEQ ID NO: 1938 - DNA, 21 bp, Artificial Sequence
  Description of Artificial Sequence: Synthetic oligonucleotide
aatatttttcctttttcaggg

SEQ ID NO: 1939 - DNA, 21 bp, Artificial Sequence
  Description of Artificial Sequence: Synthetic oligonucleotide
tgaaaaaggaaaaatattgaa

SEQ ID NO: 1940 - DNA, 21 bp, Artificial Sequence
  Description of Artificial Sequence: Synthetic oligonucleotide
caatatttttcctttttcagg

SEQ ID NO: 1941 - DNA, 21 bp, Artificial Sequence
  Description of Artificial Sequence: Synthetic oligonucleotide
gaaaaaggaaaaatattgaac

SEQ ID NO: 1942 - DNA, 21 bp, Artificial Sequence
  Description of Artificial Sequence: Synthetic oligonucleotide
tcaatatttttcctttttcag

SEQ ID NO: 1943 - DNA, 21 bp, Artificial Sequence
  Description of Artificial Sequence: Synthetic oligonucleotide
aaaaaggaaaaatattgaact

SEQ ID NO: 1944 - DNA, 21 bp, Artificial Sequence
  Description of Artificial Sequence: Synthetic oligonucleotide
ttcaatatttttcctttttca

SEQ ID NO: 1945 - DNA, 21 bp, Artificial Sequence
  Description of Artificial Sequence: Synthetic oligonucleotide
aaaaggaaaaatattgaactc

SEQ ID NO: 1946 - DNA, 21 bp, Artificial Sequence
  Description of Artificial Sequence: Synthetic oligonucleotide
gttcaatatttttcctttttc

SEQ ID NO: 1947 - DNA, 21 bp, Artificial Sequence
  Description of Artificial Sequence: Synthetic oligonucleotide
aaaggaaaaatattgaactca

SEQ ID NO: 1948 - DNA, 21 bp, Artificial Sequence
  Description of Artificial Sequence: Synthetic oligonucleotide
agttcaatatttttccttttt

SEQ ID NO: 1949 - DNA, 21 bp, Artificial Sequence
  Description of Artificial Sequence: Synthetic oligonucleotide
aaggaaaaatattgaactcaa

SEQ ID NO: 1950 - DNA, 21 bp, Artificial Sequence
  Description of Artificial Sequence: Synthetic oligonucleotide
gagttcaatatttttcctttt

SEQ ID NO: 1951 - DNA, 21 bp, Artificial Sequence
  Description of Artificial Sequence: Synthetic oligonucleotide
aggaaaaatattgaactcaat

SEQ ID NO: 1952 - DNA, 21 bp, Artificial Sequence
  Description of Artificial Sequence: Synthetic oligonucleotide
tgagttcaatatttttccttt

SEQ ID NO: 1953 - DNA, 21 bp, Artificial Sequence
  Description of Artificial Sequence: Synthetic oligonucleotide
ggaaaaatattgaactcaatg

SEQ ID NO: 1954 - DNA, 21 bp, Artificial Sequence
  Description of Artificial Sequence: Synthetic oligonucleotide
ttgagttcaatatttttcctt

SEQ ID NO: 1955 - DNA, 21 bp, Artificial Sequence
  Description of Artificial Sequence: Synthetic oligonucleotide
gaaaaatattgaactcaatga

SEQ ID NO: 1956 - DNA, 21 bp, Artificial Sequence
  Description of Artificial Sequence: Synthetic oligonucleotide
attgagttcaatatttttcct

SEQ ID NO: 1957 - DNA, 21 bp, Artificial Sequence
  Description of Artificial Sequence: Synthetic oligonucleotide
aaaaatattgaactcaatgat

SEQ ID NO: 1958 - DNA, 21 bp, Artificial Sequence
  Description of Artificial Sequence: Synthetic oligonucleotide
cattgagttcaatatttttcc

SEQ ID NO: 1959 - DNA, 21 bp, Artificial Sequence
  Description of Artificial Sequence: Synthetic oligonucleotide
aaaatattgaactcaatgata

SEQ ID NO: 1960 - DNA, 21 bp, Artificial Sequence
  Description of Artificial Sequence: Synthetic oligonucleotide
tcattgagttcaatatttttc

SEQ ID NO: 1961 - DNA, 21 bp, Artificial Sequence
  Description of Artificial Sequence: Synthetic oligonucleotide
aaatattgaactcaatgatag

SEQ ID NO: 1962 - DNA, 21 bp, Artificial Sequence
  Description of Artificial Sequence: Synthetic oligonucleotide
atcattgagttcaatattttt

SEQ ID NO: 1963 - DNA, 21 bp, Artificial Sequence
  Description of Artificial Sequence: Synthetic oligonucleotide
aatattgaactcaatgatagc

SEQ ID NO: 1964 - DNA, 21 bp, Artificial Sequence
  Description of Artificial Sequence: Synthetic oligonucleotide
tatcattgagttcaatatttt

SEQ ID NO: 1965 - DNA, 21 bp, Artificial Sequence
  Description of Artificial Sequence: Synthetic oligonucleotide
atattgaactcaatgatagca

SEQ ID NO: 1966 - DNA, 21 bp, Artificial Sequence
  Description of Artificial Sequence: Synthetic oligonucleotide
ctatcattgagttcaatattt

SEQ ID NO: 1967 - DNA, 21 bp, Artificial Sequence
  Description of Artificial Sequence: Synthetic oligonucleotide
tattgaactcaatgatagcac

SEQ ID NO: 1968 - DNA, 21 bp, Artificial Sequence
  Description of Artificial Sequence: Synthetic oligonucleotide
gctatcattgagttcaatatt

SEQ ID NO: 1969 - DNA, 21 bp, Artificial Sequence
  Description of Artificial Sequence: Synthetic oligonucleotide
attgaactcaatgatagcacc

SEQ ID NO: 1970 - DNA, 21 bp, Artificial Sequence
  Description of Artificial Sequence: Synthetic oligonucleotide
tgctatcattgagttcaatat

SEQ ID NO: 1971 - DNA, 21 bp, Artificial Sequence
  Description of Artificial Sequence: Synthetic oligonucleotide
ttgaactcaatgatagcacct

SEQ ID NO: 1972 - DNA, 21 bp, Artificial Sequence
  Description of Artificial Sequence: Synthetic oligonucleotide
gtgctatcattgagttcaata

SEQ ID NO: 1973 - DNA, 21 bp, Artificial Sequence
  Description of Artificial Sequence: Synthetic oligonucleotide
tgaactcaatgatagcaccta

SEQ ID NO: 1974 - DNA, 21 bp, Artificial Sequence
  Description of Artificial Sequence: Synthetic oligonucleotide
ggtgctatcattgagttcaat

SEQ ID NO: 1975 - DNA, 21 bp, Artificial Sequence
  Description of Artificial Sequence: Synthetic oligonucleotide
gaactcaatgatagcacctaa

SEQ ID NO: 1976 - DNA, 21 bp, Artificial Sequence
  Description of Artificial Sequence: Synthetic oligonucleotide
aggtgctatcattgagttcaa

SEQ ID NO: 1977 - DNA, 21 bp, Artificial Sequence
  Description of Artificial Sequence: Synthetic oligonucleotide
aactcaatgatagcacctaaa

SEQ ID NO: 1978 - DNA, 21 bp, Artificial Sequence
  Description of Artificial Sequence: Synthetic oligonucleotide
taggtgctatcattgagttca

SEQ ID NO: 1979 - DNA, 21 bp, Artificial Sequence
  Description of Artificial Sequence: Synthetic oligonucleotide
actcaatgatagcacctaaac

SEQ ID NO: 1980 - DNA, 21 bp, Artificial Sequence
  Description of Artificial Sequence: Synthetic oligonucleotide
ttaggtgctatcattgagttc

SEQ ID NO: 1981 - DNA, 21 bp, Artificial Sequence
  Description of Artificial Sequence: Synthetic oligonucleotide
ctcaatgatagcacctaaact

SEQ ID NO: 1982 - DNA, 21 bp, Artificial Sequence
  Description of Artificial Sequence: Synthetic oligonucleotide
tttaggtgctatcattgagtt

SEQ ID NO: 1983 - DNA, 21 bp, Artificial Sequence
  Description of Artificial Sequence: Synthetic oligonucleotide
tcaatgatagcacctaaactt

SEQ ID NO: 1984 - DNA, 21 bp, Artificial Sequence
  Description of Artificial Sequence: Synthetic oligonucleotide
gtttaggtgctatcattgagt

SEQ ID NO: 1985 - DNA, 21 bp, Artificial Sequence
  Description of Artificial Sequence: Synthetic oligonucleotide
caatgatagcacctaaactta

SEQ ID NO: 1986 - DNA, 21 bp, Artificial Sequence
  Description of Artificial Sequence: Synthetic oligonucleotide
agtttaggtgctatcattgag

SEQ ID NO: 1987 - DNA, 21 bp, Artificial Sequence
  Description of Artificial Sequence: Synthetic oligonucleotide
aatgatagcacctaaacttac

SEQ ID NO: 1988 - DNA, 21 bp, Artificial Sequence
  Description of Artificial Sequence: Synthetic oligonucleotide
aagtttaggtgctatcattga

SEQ ID NO: 1989 - DNA, 21 bp, Artificial Sequence
  Description of Artificial Sequence: Synthetic oligonucleotide
atgatagcacctaaacttaca

SEQ ID NO: 1990 - DNA, 21 bp, Artificial Sequence
  Description of Artificial Sequence: Synthetic oligonucleotide
taagtttaggtgctatcattg

SEQ ID NO: 1991 - DNA, 21 bp, Artificial Sequence
  Description of Artificial Sequence: Synthetic oligonucleotide
tgatagcacctaaacttacat

SEQ ID NO: 1992 - DNA, 21 bp, Artificial Sequence
  Description of Artificial Sequence: Synthetic oligonucleotide
gtaagtttaggtgctatcatt

SEQ ID NO: 1993 - DNA, 21 bp, Artificial Sequence
  Description of Artificial Sequence: Synthetic oligonucleotide
gatagcacctaaacttacatt

SEQ ID NO: 1994 - DNA, 21 bp, Artificial Sequence
  Description of Artificial Sequence: Synthetic oligonucleotide
tgtaagtttaggtgctatcat

SEQ ID NO: 1995 - DNA, 21 bp, Artificial Sequence
  Description of Artificial Sequence: Synthetic oligonucleotide
atagcacctaaacttacattt

SEQ ID NO: 1996 - DNA, 21 bp, Artificial Sequence
  Description of Artificial Sequence: Synthetic oligonucleotide
atgtaagtttaggtgctatca

SEQ ID NO: 1997 - DNA, 21 bp, Artificial Sequence
  Description of Artificial Sequence: Synthetic oligonucleotide
tagcacctaaacttacattta

SEQ ID NO: 1998 - DNA, 21 bp, Artificial Sequence
  Description of Artificial Sequence: Synthetic oligonucleotide
aatgtaagtttaggtgctatc

SEQ ID NO: 1999 - DNA, 21 bp, Artificial Sequence
  Description of Artificial Sequence: Synthetic oligonucleotide
agcacctaaacttacatttaa

SEQ ID NO: 2000 - DNA, 21 bp, Artificial Sequence
  Description of Artificial Sequence: Synthetic oligonucleotide
aaatgtaagtttaggtgctat

SEQ ID NO: 2001 - DNA, 21 bp, Artificial Sequence
  Description of Artificial Sequence: Synthetic oligonucleotide
gcacctaaacttacatttaaa

SEQ ID NO: 2002 - DNA, 21 bp, Artificial Sequence
  Description of Artificial Sequence: Synthetic oligonucleotide
taaatgtaagtttaggtgcta

SEQ ID NO: 2003 - DNA, 21 bp, Artificial Sequence
  Description of Artificial Sequence: Synthetic oligonucleotide
cacctaaacttacatttaaaa

SEQ ID NO: 2004 - DNA, 21 bp, Artificial Sequence
  Description of Artificial Sequence: Synthetic oligonucleotide
ttaaatgtaagtttaggtgct

SEQ ID NO: 2005 - DNA, 21 bp, Artificial Sequence
  Description of Artificial Sequence: Synthetic oligonucleotide
acctaaacttacatttaaaag

SEQ ID NO: 2006 - DNA, 21 bp, Artificial Sequence
  Description of Artificial Sequence: Synthetic oligonucleotide
tttaaatgtaagtttaggtgc

SEQ ID NO: 2007 - DNA, 21 bp, Artificial Sequence
  Description of Artificial Sequence: Synthetic oligonucleotide
cctaaacttacatttaaaaga

SEQ ID NO: 2008 - DNA, 21 bp, Artificial Sequence
  Description of Artificial Sequence: Synthetic oligonucleotide
ttttaaatgtaagtttaggtg

SEQ ID NO: 2009 - DNA, 21 bp, Artificial Sequence
  Description of Artificial Sequence: Synthetic oligonucleotide
ctaaacttacatttaaaagac

SEQ ID NO: 2010 - DNA, 21 bp, Artificial Sequence
  Description of Artificial Sequence: Synthetic oligonucleotide
cttttaaatgtaagtttaggt

SEQ ID NO: 2011 - DNA, 21 bp, Artificial Sequence
  Description of Artificial Sequence: Synthetic oligonucleotide
taaacttacatttaaaagaca

SEQ ID NO: 2012 - DNA, 21 bp, Artificial Sequence
  Description of Artificial Sequence: Synthetic oligonucleotide
tcttttaaatgtaagtttagg

SEQ ID NO: 2013 - DNA, 21 bp, Artificial Sequence
  Description of Artificial Sequence: Synthetic oligonucleotide
aaacttacatttaaaagacag

SEQ ID NO: 2014 - DNA, 21 bp, Artificial Sequence
  Description of Artificial Sequence: Synthetic oligonucleotide
gtcttttaaatgtaagtttag

SEQ ID NO: 2015 - DNA, 21 bp, Artificial Sequence
  Description of Artificial Sequence: Synthetic oligonucleotide
aacttacatttaaaagacaga

SEQ ID NO: 2016 - DNA, 21 bp, Artificial Sequence
  Description of Artificial Sequence: Synthetic oligonucleotide
tgtcttttaaatgtaagttta

SEQ ID NO: 2017 - DNA, 21 bp, Artificial Sequence
  Description of Artificial Sequence: Synthetic oligonucleotide
acttacatttaaaagacagac

SEQ ID NO: 2018 - DNA, 21 bp, Artificial Sequence
  Description of Artificial Sequence: Synthetic oligonucleotide
ctgtcttttaaatgtaagttt

SEQ ID NO: 2019 - DNA, 21 bp, Artificial Sequence
  Description of Artificial Sequence: Synthetic oligonucleotide
cttacatttaaaagacagaca

SEQ ID NO: 2020 - DNA, 21 bp, Artificial Sequence
  Description of Artificial Sequence: Synthetic oligonucleotide
tctgtcttttaaatgtaagtt

SEQ ID NO: 2021 - DNA, 21 bp, Artificial Sequence
  Description of Artificial Sequence: Synthetic oligonucleotide
ttacatttaaaagacagacat

SEQ ID NO: 2022 - DNA, 21 bp, Artificial Sequence
  Description of Artificial Sequence: Synthetic oligonucleotide
gtctgtcttttaaatgtaagt

SEQ ID NO: 2023 - DNA, 21 bp, Artificial Sequence
  Description of Artificial Sequence: Synthetic oligonucleotide
tacatttaaaagacagacatt

SEQ ID NO: 2024 - DNA, 21 bp, Artificial Sequence
  Description of Artificial Sequence: Synthetic oligonucleotide
tgtctgtcttttaaatgtaag

SEQ ID NO: 2025 - DNA, 21 bp, Artificial Sequence
  Description of Artificial Sequence: Synthetic oligonucleotide
acatttaaaagacagacattc

SEQ ID NO: 2026 - DNA, 21 bp, Artificial Sequence
  Description of Artificial Sequence: Synthetic oligonucleotide
atgtctgtcttttaaatgtaa

SEQ ID NO: 2027 - DNA, 21 bp, Artificial Sequence
  Description of Artificial Sequence: Synthetic oligonucleotide
catttaaaagacagacattcc

SEQ ID NO: 2028 - DNA, 21 bp, Artificial Sequence
  Description of Artificial Sequence: Synthetic oligonucleotide
aatgtctgtcttttaaatgta

SEQ ID NO: 2029 - DNA, 21 bp, Artificial Sequence
  Description of Artificial Sequence: Synthetic oligonucleotide
atttaaaagacagacattcct

SEQ ID NO: 2030 - DNA, 21 bp, Artificial Sequence
  Description of Artificial Sequence: Synthetic oligonucleotide
gaatgtctgtcttttaaatgt

SEQ ID NO: 2031 - DNA, 21 bp, Artificial Sequence
  Description of Artificial Sequence: Synthetic oligonucleotide
tttaaaagacagacattcctt

SEQ ID NO: 2032 - DNA, 21 bp, Artificial Sequence
  Description of Artificial Sequence: Synthetic oligonucleotide
ggaatgtctgtcttttaaatg

SEQ ID NO: 2033 - DNA, 21 bp, Artificial Sequence
  Description of Artificial Sequence: Synthetic oligonucleotide
ttaaaagacagacattccttc

SEQ ID NO: 2034 - DNA, 21 bp, Artificial Sequence
  Description of Artificial Sequence: Synthetic oligonucleotide
aggaatgtctgtcttttaaat

SEQ ID NO: 2035 - DNA, 21 bp, Artificial Sequence
  Description of Artificial Sequence: Synthetic oligonucleotide
taaaagacagacattccttct

SEQ ID NO: 2036 - DNA, 21 bp, Artificial Sequence
  Description of Artificial Sequence: Synthetic oligonucleotide
aaggaatgtctgtcttttaaa

SEQ ID NO: 2037 - DNA, 21 bp, Artificial Sequence
  Description of Artificial Sequence: Synthetic oligonucleotide
aaaagacagacattccttcta

SEQ ID NO: 2038 - DNA, 21 bp, Artificial Sequence
  Description of Artificial Sequence: Synthetic oligonucleotide
gaaggaatgtctgtcttttaa

SEQ ID NO: 2039 - DNA, 21 bp, Artificial Sequence
  Description of Artificial Sequence: Synthetic oligonucleotide
aaagacagacattccttctac

SEQ ID NO: 2040 - DNA, 21 bp, Artificial Sequence
  Description of Artificial Sequence: Synthetic oligonucleotide
agaaggaatgtctgtctttta

SEQ ID NO: 2041 - DNA, 21 bp, Artificial Sequence
  Description of Artificial Sequence: Synthetic oligonucleotide
aagacagacattccttctaca

SEQ ID NO: 2042 - DNA, 21 bp, Artificial Sequence
  Description of Artificial Sequence: Synthetic oligonucleotide
tagaaggaatgtctgtctttt

SEQ ID NO: 2043 - DNA, 21 bp, Artificial Sequence
  Description of Artificial Sequence: Synthetic oligonucleotide
agacagacattccttctacat

SEQ ID NO: 2044 - DNA, 21 bp, Artificial Sequence
  Description of Artificial Sequence: Synthetic oligonucleotide
gtagaaggaatgtctgtcttt

SEQ ID NO: 2045 - DNA, 21 bp, Artificial Sequence
  Description of Artificial Sequence: Synthetic oligonucleotide
gacagacattccttctacatg

SEQ ID NO: 2046 - DNA, 21 bp, Artificial Sequence
  Description of Artificial Sequence: Synthetic oligonucleotide
tgtagaaggaatgtctgtctt

SEQ ID NO: 2047 - DNA, 21 bp, Artificial Sequence
  Description of Artificial Sequence: Synthetic oligonucleotide
acagacattccttctacatgt

SEQ ID NO: 2048 - DNA, 21 bp, Artificial Sequence
  Description of Artificial Sequence: Synthetic oligonucleotide
atgtagaaggaatgtctgtct

SEQ ID NO: 2049 - DNA, 21 bp, Artificial Sequence
  Description of Artificial Sequence: Synthetic oligonucleotide
cagacattccttctacatgta

SEQ ID NO: 2050 - DNA, 21 bp, Artificial Sequence
  Description of Artificial Sequence: Synthetic oligonucleotide
catgtagaaggaatgtctgtc

SEQ ID NO: 2051 - DNA, 21 bp, Artificial Sequence
  Description of Artificial Sequence: Synthetic oligonucleotide
agacattccttctacatgtaa

SEQ ID NO: 2052 - DNA, 21 bp, Artificial Sequence
  Description of Artificial Sequence: Synthetic oligonucleotide
acatgtagaaggaatgtctgt

SEQ ID NO: 2053 - DNA, 21 bp, Artificial Sequence
  Description of Artificial Sequence: Synthetic oligonucleotide
gacattccttctacatgtaat

SEQ ID NO: 2054 - DNA, 21 bp, Artificial Sequence
  Description of Artificial Sequence: Synthetic oligonucleotide
tacatgtagaaggaatgtctg

SEQ ID NO: 2055 - DNA, 21 bp, Artificial Sequence
  Description of Artificial Sequence: Synthetic oligonucleotide
acattccttctacatgtaatg

SEQ ID NO: 2056 - DNA, 21 bp, Artificial Sequence
  Description of Artificial Sequence: Synthetic oligonucleotide
ttacatgtagaaggaatgtct

SEQ ID NO: 2057 - DNA, 21 bp, Artificial Sequence
  Description of Artificial Sequence: Synthetic oligonucleotide
cattccttctacatgtaatga

SEQ ID NO: 2058 - DNA, 21 bp, Artificial Sequence
  Description of Artificial Sequence: Synthetic oligonucleotide
attacatgtagaaggaatgtc

SEQ ID NO: 2059 - DNA, 21 bp, Artificial Sequence
  Description of Artificial Sequence: Synthetic oligonucleotide
attccttctacatgtaatgac

SEQ ID NO: 2060 - DNA, 21 bp, Artificial Sequence
  Description of Artificial Sequence: Synthetic oligonucleotide
cattacatgtagaaggaatgt

SEQ ID NO: 2061 - DNA, 21 bp, Artificial Sequence
  Description of Artificial Sequence: Synthetic oligonucleotide
ttccttctacatgtaatgaca

SEQ ID NO: 2062 - DNA, 21 bp, Artificial Sequence
  Description of Artificial Sequence: Synthetic oligonucleotide
tcattacatgtagaaggaatg

SEQ ID NO: 2063 - DNA, 21 bp, Artificial Sequence
  Description of Artificial Sequence: Synthetic oligonucleotide
tccttctacatgtaatgacac

SEQ ID NO: 2064 - DNA, 21 bp, Artificial Sequence
  Description of Artificial Sequence: Synthetic oligonucleotide
gtcattacatgtagaaggaat

SEQ ID NO: 2065 - DNA, 21 bp, Artificial Sequence
  Description of Artificial Sequence: Synthetic oligonucleotide
ccttctacatgtaatgacact

SEQ ID NO: 2066 - DNA, 21 bp, Artificial Sequence
  Description of Artificial Sequence: Synthetic oligonucleotide
tgtcattacatgtagaaggaa

SEQ ID NO: 2067 - DNA, 21 bp, Artificial Sequence
  Description of Artificial Sequence: Synthetic oligonucleotide
cttctacatgtaatgacactt

SEQ ID NO: 2068 - DNA, 21 bp, Artificial Sequence
  Description of Artificial Sequence: Synthetic oligonucleotide
gtgtcattacatgtagaagga

SEQ ID NO: 2069 - DNA, 21 bp, Artificial Sequence
  Description of Artificial Sequence: Synthetic oligonucleotide
ttctacatgtaatgacacttc

SEQ ID NO: 2070 - DNA, 21 bp, Artificial Sequence
  Description of Artificial Sequence: Synthetic oligonucleotide
agtgtcattacatgtagaagg

SEQ ID NO: 2071 - DNA, 21 bp, Artificial Sequence
  Description of Artificial Sequence: Synthetic oligonucleotide
tctacatgtaatgacacttct

SEQ ID NO: 2072 - DNA, 21 bp, Artificial Sequence
  Description of Artificial Sequence: Synthetic oligonucleotide
aagtgtcattacatgtagaag

SEQ ID NO: 2073 - DNA, 21 bp, Artificial Sequence
  Description of Artificial Sequence: Synthetic oligonucleotide
ctacatgtaatgacacttctt

SEQ ID NO: 2074 - DNA, 21 bp, Artificial Sequence
  Description of Artificial Sequence: Synthetic oligonucleotide
gaagtgtcattacatgtagaa

SEQ ID NO: 2075 - DNA, 21 bp, Artificial Sequence
  Description of Artificial Sequence: Synthetic oligonucleotide
tacatgtaatgacacttcttg

SEQ ID NO: 2076 - DNA, 21 bp, Artificial Sequence
  Description of Artificial Sequence: Synthetic oligonucleotide
agaagtgtcattacatgtaga

SEQ ID NO: 2077 - DNA, 21 bp, Artificial Sequence
  Description of Artificial Sequence: Synthetic oligonucleotide
acatgtaatgacacttcttgt

SEQ ID NO: 2078 - DNA, 21 bp, Artificial Sequence
  Description of Artificial Sequence: Synthetic oligonucleotide
aagaagtgtcattacatgtag

SEQ ID NO: 2079 - DNA, 21 bp, Artificial Sequence
  Description of Artificial Sequence: Synthetic oligonucleotide
catgtaatgacacttcttgtg

SEQ ID NO: 2080 - DNA, 21 bp, Artificial Sequence
  Description of Artificial Sequence: Synthetic oligonucleotide
caagaagtgtcattacatgta

SEQ ID NO: 2081 - DNA, 21 bp, Artificial Sequence
  Description of Artificial Sequence: Synthetic oligonucleotide
atgtaatgacacttcttgtgt

SEQ ID NO: 2082 - DNA, 21 bp, Artificial Sequence
  Description of Artificial Sequence: Synthetic oligonucleotide
acaagaagtgtcattacatgt

SEQ ID NO: 2083 - DNA, 21 bp, Artificial Sequence
  Description of Artificial Sequence: Synthetic oligonucleotide
tgtaatgacacttcttgtgtt

SEQ ID NO: 2084 - DNA, 21 bp, Artificial Sequence
  Description of Artificial Sequence: Synthetic oligonucleotide
cacaagaagtgtcattacatg

SEQ ID NO: 2085 - DNA, 21 bp, Artificial Sequence
  Description of Artificial Sequence: Synthetic oligonucleotide
gtaatgacacttcttgtgtta

SEQ ID NO: 2086 - DNA, 21 bp, Artificial Sequence
  Description of Artificial Sequence: Synthetic oligonucleotide
acacaagaagtgtcattacat

SEQ ID NO: 2087 - DNA, 21 bp, Artificial Sequence
  Description of Artificial Sequence: Synthetic oligonucleotide
taatgacacttcttgtgttaa

SEQ ID NO: 2088 - DNA, 21 bp, Artificial Sequence
  Description of Artificial Sequence: Synthetic oligonucleotide
aacacaagaagtgtcattaca

SEQ ID NO: 2089 - DNA, 21 bp, Artificial Sequence
  Description of Artificial Sequence: Synthetic oligonucleotide
aatgacacttcttgtgttaaa

SEQ ID NO: 2090 - DNA, 21 bp, Artificial Sequence
  Description of Artificial Sequence: Synthetic oligonucleotide
taacacaagaagtgtcattac

SEQ ID NO: 2091 - DNA, 21 bp, Artificial Sequence
  Description of Artificial Sequence: Synthetic oligonucleotide
atgacacttcttgtgttaaac

SEQ ID NO: 2092 - DNA, 21 bp, Artificial Sequence
  Description of Artificial Sequence: Synthetic oligonucleotide
ttaacacaagaagtgtcatta

SEQ ID NO: 2093 - DNA, 21 bp, Artificial Sequence
  Description of Artificial Sequence: Synthetic oligonucleotide
tgacacttcttgtgttaaact

SEQ ID NO: 2094 - DNA, 21 bp, Artificial Sequence
  Description of Artificial Sequence: Synthetic oligonucleotide
tttaacacaagaagtgtcatt

SEQ ID NO: 2095 - DNA, 21 bp, Artificial Sequence
  Description of Artificial Sequence: Synthetic oligonucleotide
gacacttcttgtgttaaacta

SEQ ID NO: 2096 - DNA, 21 bp, Artificial Sequence
  Description of Artificial Sequence: Synthetic oligonucleotide
gtttaacacaagaagtgtcat

SEQ ID NO: 2097 - DNA, 21 bp, Artificial Sequence
  Description of Artificial Sequence: Synthetic oligonucleotide
acacttcttgtgttaaactaa

SEQ ID NO: 2098 - DNA, 21 bp, Artificial Sequence
  Description of Artificial Sequence: Synthetic oligonucleotide
agtttaacacaagaagtgtca

SEQ ID NO: 2099 - DNA, 21 bp, Artificial Sequence
  Description of Artificial Sequence: Synthetic oligonucleotide
cacttcttgtgttaaactaaa

SEQ ID NO: 2100 - DNA, 21 bp, Artificial Sequence
  Description of Artificial Sequence: Synthetic oligonucleotide
tagtttaacacaagaagtgtc

SEQ ID NO: 2101 - DNA, 21 bp, Artificial Sequence
  Description of Artificial Sequence: Synthetic oligonucleotide
acttcttgtgttaaactaaaa

SEQ ID NO: 2102 - DNA, 21 bp, Artificial Sequence
  Description of Artificial Sequence: Synthetic oligonucleotide
ttagtttaacacaagaagtgt

SEQ ID NO: 2103 - DNA, 21 bp, Artificial Sequence
  Description of Artificial Sequence: Synthetic oligonucleotide
cttcttgtgttaaactaaaaa

SEQ ID NO: 2104 - DNA, 21 bp, Artificial Sequence
  Description of Artificial Sequence: Synthetic oligonucleotide
tttagtttaacacaagaagtg

SEQ ID NO: 2105 - DNA, 21 bp, Artificial Sequence
  Description of Artificial Sequence: Synthetic oligonucleotide
ttcttgtgttaaactaaaaat

SEQ ID NO: 2106 - DNA, 21 bp, Artificial Sequence
  Description of Artificial Sequence: Synthetic oligonucleotide
ttttagtttaacacaagaagt

SEQ ID NO: 2107 - DNA, 21 bp, Artificial Sequence
  Description of Artificial Sequence: Synthetic oligonucleotide
tcttgtgttaaactaaaaatt

SEQ ID NO: 2108 - DNA, 21 bp, Artificial Sequence
  Description of Artificial Sequence: Synthetic oligonucleotide
tttttagtttaacacaagaag

SEQ ID NO: 2109 - DNA, 21 bp, Artificial Sequence
  Description of Artificial Sequence: Synthetic oligonucleotide
cttgtgttaaactaaaaattt

SEQ ID NO: 2110 - DNA, 21 bp, Artificial Sequence
  Description of Artificial Sequence: Synthetic oligonucleotide
atttttagtttaacacaagaa

SEQ ID NO: 2111 - DNA, 21 bp, Artificial Sequence
  Description of Artificial Sequence: Synthetic oligonucleotide
ttgtgttaaactaaaaattta

SEQ ID NO: 2112 - DNA, 21 bp, Artificial Sequence
  Description of Artificial Sequence: Synthetic oligonucleotide
aatttttagtttaacacaaga

SEQ ID NO: 2113 - DNA, 21 bp, Artificial Sequence
  Description of Artificial Sequence: Synthetic oligonucleotide
tgtgttaaactaaaaatttac

SEQ ID NO: 2114 - DNA, 21 bp, Artificial Sequence
  Description of Artificial Sequence: Synthetic oligonucleotide
aaatttttagtttaacacaag

SEQ ID NO: 2115 - DNA, 21 bp, Artificial Sequence
  Description of Artificial Sequence: Synthetic oligonucleotide
gtgttaaactaaaaatttaca

SEQ ID NO: 2116 - DNA, 21 bp, Artificial Sequence
  Description of Artificial Sequence: Synthetic oligonucleotide
taaatttttagtttaacacaa

SEQ ID NO: 2117 - DNA, 21 bp, Artificial Sequence
  Description of Artificial Sequence: Synthetic oligonucleotide
tgttaaactaaaaatttacaa

SEQ ID NO: 2118 - DNA, 21 bp, Artificial Sequence
  Description of Artificial Sequence: Synthetic oligonucleotide
gtaaatttttagtttaacaca

SEQ ID NO: 2119 - DNA, 21 bp, Artificial Sequence
  Description of Artificial Sequence: Synthetic oligonucleotide
gttaaactaaaaatttacaag

SEQ ID NO: 2120 - DNA, 21 bp, Artificial Sequence
  Description of Artificial Sequence: Synthetic oligonucleotide
tgtaaatttttagtttaacac

SEQ ID NO: 2121 - DNA, 21 bp, Artificial Sequence
  Description of Artificial Sequence: Synthetic oligonucleotide
ttaaactaaaaatttacaaga

SEQ ID NO: 2122 - DNA, 21 bp, Artificial Sequence
  Description of Artificial Sequence: Synthetic oligonucleotide
ttgtaaatttttagtttaaca

SEQ ID NO: 2123 - DNA, 21 bp, Artificial Sequence
  Description of Artificial Sequence: Synthetic oligonucleotide
taaactaaaaatttacaagag

SEQ ID NO: 2124 - DNA, 21 bp, Artificial Sequence
  Description of Artificial Sequence: Synthetic oligonucleotide
cttgtaaatttttagtttaac

SEQ ID NO: 2125 - DNA, 21 bp, Artificial Sequence
  Description of Artificial Sequence: Synthetic oligonucleotide
aaactaaaaatttacaagaga

SEQ ID NO: 2126 - DNA, 21 bp, Artificial Sequence
  Description of Artificial Sequence: Synthetic oligonucleotide
tcttgtaaatttttagtttaa

SEQ ID NO: 2127 - DNA, 21 bp, Artificial Sequence
  Description of Artificial Sequence: Synthetic oligonucleotide
aactaaaaatttacaagagaa

SEQ ID NO: 2128 - DNA, 21 bp, Artificial Sequence
  Description of Artificial Sequence: Synthetic oligonucleotide
ctcttgtaaatttttagttta

SEQ ID NO: 2129 - DNA, 21 bp, Artificial Sequence
  Description of Artificial Sequence: Synthetic oligonucleotide
actaaaaatttacaagagaag

SEQ ID NO: 2130 - DNA, 21 bp, Artificial Sequence
  Description of Artificial Sequence: Synthetic oligonucleotide
tctcttgtaaatttttagttt

SEQ ID NO: 2131 - DNA, 21 bp, Artificial Sequence
  Description of Artificial Sequence: Synthetic oligonucleotide
ctaaaaatttacaagagaaga

SEQ ID NO: 2132 - DNA, 21 bp, Artificial Sequence
  Description of Artificial Sequence: Synthetic oligonucleotide
ttctcttgtaaatttttagtt

SEQ ID NO: 2133 - DNA, 21 bp, Artificial Sequence
  Description of Artificial Sequence: Synthetic oligonucleotide
taaaaatttacaagagaagaa

SEQ ID NO: 2134 - DNA, 21 bp, Artificial Sequence
  Description of Artificial Sequence: Synthetic oligonucleotide
cttctcttgtaaatttttagt

SEQ ID NO: 2135 - DNA, 21 bp, Artificial Sequence
  Description of Artificial Sequence: Synthetic oligonucleotide
aaaaatttacaagagaagaaa

SEQ ID NO: 2136 - DNA, 21 bp, Artificial Sequence
  Description of Artificial Sequence: Synthetic oligonucleotide
tcttctcttgtaaatttttag

SEQ ID NO: 2137 - DNA, 21 bp, Artificial Sequence
  Description of Artificial Sequence: Synthetic oligonucleotide
aaaatttacaagagaagaaag

SEQ ID NO: 2138 - DNA, 21 bp, Artificial Sequence
  Description of Artificial Sequence: Synthetic oligonucleotide
ttcttctcttgtaaattttta

SEQ ID NO: 2139 - DNA, 21 bp, Artificial Sequence
  Description of Artificial Sequence: Synthetic oligonucleotide
aaatttacaagagaagaaagt

SEQ ID NO: 2140 - DNA, 21 bp, Artificial Sequence
  Description of Artificial Sequence: Synthetic oligonucleotide
tttcttctcttgtaaattttt

SEQ ID NO: 2141 - DNA, 21 bp, Artificial Sequence
  Description of Artificial Sequence: Synthetic oligonucleotide
aatttacaagagaagaaagtg

SEQ ID NO: 2142 - DNA, 21 bp, Artificial Sequence
  Description of Artificial Sequence: Synthetic oligonucleotide
ctttcttctcttgtaaatttt

SEQ ID NO: 2143 - DNA, 21 bp, Artificial Sequence
  Description of Artificial Sequence: Synthetic oligonucleotide
atttacaagagaagaaagtga

SEQ ID NO: 2144 - DNA, 21 bp, Artificial Sequence
  Description of Artificial Sequence: Synthetic oligonucleotide
actttcttctcttgtaaattt

SEQ ID NO: 2145 - DNA, 21 bp, Artificial Sequence
  Description of Artificial Sequence: Synthetic oligonucleotide
tttacaagagaagaaagtgaa

SEQ ID NO: 2146 - DNA, 21 bp, Artificial Sequence
  Description of Artificial Sequence: Synthetic oligonucleotide
cactttcttctcttgtaaatt

SEQ ID NO: 2147 - DNA, 21 bp, Artificial Sequence
  Description of Artificial Sequence: Synthetic oligonucleotide
ttacaagagaagaaagtgaaa

SEQ ID NO: 2148 - DNA, 21 bp, Artificial Sequence
  Description of Artificial Sequence: Synthetic oligonucleotide
tcactttcttctcttgtaaat

SEQ ID NO: 2149 - DNA, 21 bp, Artificial Sequence
  Description of Artificial Sequence: Synthetic oligonucleotide
tacaagagaagaaagtgaaag

SEQ ID NO: 2150 - DNA, 21 bp, Artificial Sequence
  Description of Artificial Sequence: Synthetic oligonucleotide
ttcactttcttctcttgtaaa

SEQ ID NO: 2151 - DNA, 21 bp, Artificial Sequence
  Description of Artificial Sequence: Synthetic oligonucleotide
acaagagaagaaagtgaaagc

SEQ ID NO: 2152 - DNA, 21 bp, Artificial Sequence
  Description of Artificial Sequence: Synthetic oligonucleotide
tttcactttcttctcttgtaa

SEQ ID NO: 2153 - DNA, 21 bp, Artificial Sequence
  Description of Artificial Sequence: Synthetic oligonucleotide
caagagaagaaagtgaaagca

SEQ ID NO: 2154 - DNA, 21 bp, Artificial Sequence
  Description of Artificial Sequence: Synthetic oligonucleotide
ctttcactttcttctcttgta

SEQ ID NO: 2155 - DNA, 21 bp, Artificial Sequence
  Description of Artificial Sequence: Synthetic oligonucleotide
aagagaagaaagtgaaagcaa

SEQ ID NO: 2156 - DNA, 21 bp, Artificial Sequence
  Description of Artificial Sequence: Synthetic oligonucleotide
gctttcactttcttctcttgt

SEQ ID NO: 2157 - DNA, 21 bp, Artificial Sequence
  Description of Artificial Sequence: Synthetic oligonucleotide
agagaagaaagtgaaagcaaa

SEQ ID NO: 2158 - DNA, 21 bp, Artificial Sequence
  Description of Artificial Sequence: Synthetic oligonucleotide
tgctttcactttcttctcttg

SEQ ID NO: 2159 - DNA, 21 bp, Artificial Sequence
  Description of Artificial Sequence: Synthetic oligonucleotide
gagaagaaagtgaaagcaaat

SEQ ID NO: 2160 - DNA, 21 bp, Artificial Sequence
  Description of Artificial Sequence: Synthetic oligonucleotide
ttgctttcactttcttctctt

SEQ ID NO: 2161 - DNA, 21 bp, Artificial Sequence
  Description of Artificial Sequence: Synthetic oligonucleotide
agaagaaagtgaaagcaaatg

SEQ ID NO: 2162 - DNA, 21 bp, Artificial Sequence
  Description of Artificial Sequence: Synthetic oligonucleotide
tttgctttcactttcttctct

SEQ ID NO: 2163 - DNA, 21 bp, Artificial Sequence
  Description of Artificial Sequence: Synthetic oligonucleotide
gaagaaagtgaaagcaaatgg

SEQ ID NO: 2164 - DNA, 21 bp, Artificial Sequence
  Description of Artificial Sequence: Synthetic oligonucleotide
atttgctttcactttcttctc

SEQ ID NO: 2165 - DNA, 21 bp, Artificial Sequence
  Description of Artificial Sequence: Synthetic oligonucleotide
aagaaagtgaaagcaaatggg

SEQ ID NO: 2166 - DNA, 21 bp, Artificial Sequence
  Description of Artificial Sequence: Synthetic oligonucleotide
catttgctttcactttcttct

SEQ ID NO: 2167 - DNA, 21 bp, Artificial Sequence
  Description of Artificial Sequence: Synthetic oligonucleotide
agaaagtgaaagcaaatgggg

SEQ ID NO: 2168 - DNA, 21 bp, Artificial Sequence
  Description of Artificial Sequence: Synthetic oligonucleotide
ccatttgctttcactttcttc

SEQ ID NO: 2169 - DNA, 21 bp, Artificial Sequence
  Description of Artificial Sequence: Synthetic oligonucleotide
gaaagtgaaagcaaatggggt

SEQ ID NO: 2170 - DNA, 21 bp, Artificial Sequence
  Description of Artificial Sequence: Synthetic oligonucleotide
cccatttgctttcactttctt

SEQ ID NO: 2171 - DNA, 21 bp, Artificial Sequence
  Description of Artificial Sequence: Synthetic oligonucleotide
aaagtgaaagcaaatggggtt

SEQ ID NO: 2172 - DNA, 21 bp, Artificial Sequence
  Description of Artificial Sequence: Synthetic oligonucleotide
ccccatttgctttcactttct

SEQ ID NO: 2173 - DNA, 21 bp, Artificial Sequence
  Description of Artificial Sequence: Synthetic oligonucleotide
aagtgaaagcaaatggggttt

SEQ ID NO: 2174 - DNA, 21 bp, Artificial Sequence
  Description of Artificial Sequence: Synthetic oligonucleotide
accccatttgctttcactttc

SEQ ID NO: 2175 - DNA, 21 bp, Artificial Sequence
  Description of Artificial Sequence: Synthetic oligonucleotide
agtgaaagcaaatggggtttc

SEQ ID NO: 2176 - DNA, 21 bp, Artificial Sequence
  Description of Artificial Sequence: Synthetic oligonucleotide
aaccccatttgctttcacttt

SEQ ID NO: 2177 - DNA, 21 bp, Artificial Sequence
  Description of Artificial Sequence: Synthetic oligonucleotide
gtgaaagcaaatggggtttca

SEQ ID NO: 2178 - DNA, 21 bp, Artificial Sequence
  Description of Artificial Sequence: Synthetic oligonucleotide
aaaccccatttgctttcactt

SEQ ID NO: 2179 - DNA, 21 bp, Artificial Sequence
  Description of Artificial Sequence: Synthetic oligonucleotide
tgaaagcaaatggggtttcac

SEQ ID NO: 2180 - DNA, 21 bp, Artificial Sequence
  Description of Artificial Sequence: Synthetic oligonucleotide
gaaaccccatttgctttcact

SEQ ID NO: 2181 - DNA, 21 bp, Artificial Sequence
  Description of Artificial Sequence: Synthetic oligonucleotide
gaaagcaaatggggtttcaca

SEQ ID NO: 2182 - DNA, 21 bp, Artificial Sequence
  Description of Artificial Sequence: Synthetic oligonucleotide
tgaaaccccatttgctttcac

SEQ ID NO: 2183 - DNA, 21 bp, Artificial Sequence
  Description of Artificial Sequence: Synthetic oligonucleotide
aaagcaaatggggtttcacaa

SEQ ID NO: 2184 - DNA, 21 bp, Artificial Sequence
  Description of Artificial Sequence: Synthetic oligonucleotide
gtgaaaccccatttgctttca

SEQ ID NO: 2185 - DNA, 21 bp, Artificial Sequence
  Description of Artificial Sequence: Synthetic oligonucleotide
aagcaaatggggtttcacaaa

SEQ ID NO: 2186 - DNA, 21 bp, Artificial Sequence
  Description of Artificial Sequence: Synthetic oligonucleotide
tgtgaaaccccatttgctttc

SEQ ID NO: 2187 - DNA, 21 bp, Artificial Sequence
  Description of Artificial Sequence: Synthetic oligonucleotide
agcaaatggggtttcacaaat

SEQ ID NO: 2188 - DNA, 21 bp, Artificial Sequence
  Description of Artificial Sequence: Synthetic oligonucleotide
ttgtgaaaccccatttgcttt

SEQ ID NO: 2189 - DNA, 21 bp, Artificial Sequence
  Description of Artificial Sequence: Synthetic oligonucleotide
gcaaatggggtttcacaaata

SEQ ID NO: 2190 - DNA, 21 bp, Artificial Sequence
  Description of Artificial Sequence: Synthetic oligonucleotide
tttgtgaaaccccatttgctt

SEQ ID NO: 2191 - DNA, 21 bp, Artificial Sequence
  Description of Artificial Sequence: Synthetic oligonucleotide
caaatggggtttcacaaatag

SEQ ID NO: 2192 - DNA, 21 bp, Artificial Sequence
  Description of Artificial Sequence: Synthetic oligonucleotide
atttgtgaaaccccatttgct

SEQ ID NO: 2193 - DNA, 21 bp, Artificial Sequence
  Description of Artificial Sequence: Synthetic oligonucleotide
aaatggggtttcacaaatagt

SEQ ID NO: 2194 - DNA, 21 bp, Artificial Sequence
  Description of Artificial Sequence: Synthetic oligonucleotide
tatttgtgaaaccccatttgc

SEQ ID NO: 2195 - DNA, 21 bp, Artificial Sequence
  Description of Artificial Sequence: Synthetic oligonucleotide
aatggggtttcacaaatagtt

SEQ ID NO: 2196 - DNA, 21 bp, Artificial Sequence
  Description of Artificial Sequence: Synthetic oligonucleotide
ctatttgtgaaaccccatttg

SEQ ID NO: 2197 - DNA, 21 bp, Artificial Sequence
  Description of Artificial Sequence: Synthetic oligonucleotide
atggggtttcacaaatagttg

SEQ ID NO: 2198 - DNA, 21 bp, Artificial Sequence
  Description of Artificial Sequence: Synthetic oligonucleotide
actatttgtgaaaccccattt

SEQ ID NO: 2199 - DNA, 21 bp, Artificial Sequence
  Description of Artificial Sequence: Synthetic oligonucleotide
tggggtttcacaaatagttgt

SEQ ID NO: 2200 - DNA, 21 bp, Artificial Sequence
  Description of Artificial Sequence: Synthetic oligonucleotide
aactatttgtgaaaccccatt

SEQ ID NO: 2201 - DNA, 21 bp, Artificial Sequence
  Description of Artificial Sequence: Synthetic oligonucleotide
ggggtttcacaaatagttgta

SEQ ID NO: 2202 - DNA, 21 bp, Artificial Sequence
  Description of Artificial Sequence: Synthetic oligonucleotide
caactatttgtgaaaccccat

SEQ ID NO: 2203 - DNA, 21 bp, Artificial Sequence
  Description of Artificial Sequence: Synthetic oligonucleotide
gggtttcacaaatagttgtaa

SEQ ID NO: 2204 - DNA, 21 bp, Artificial Sequence
  Description of Artificial Sequence: Synthetic oligonucleotide
acaactatttgtgaaacccca

SEQ ID NO: 2205 - DNA, 21 bp, Artificial Sequence
  Description of Artificial Sequence: Synthetic oligonucleotide
ggtttcacaaatagttgtaaa

SEQ ID NO: 2206 - DNA, 21 bp, Artificial Sequence
  Description of Artificial Sequence: Synthetic oligonucleotide
tacaactatttgtgaaacccc

SEQ ID NO: 2207 - DNA, 21 bp, Artificial Sequence
  Description of Artificial Sequence: Synthetic oligonucleotide
gtttcacaaatagttgtaaat

SEQ ID NO: 2208 - DNA, 21 bp, Artificial Sequence
  Description of Artificial Sequence: Synthetic oligonucleotide
ttacaactatttgtgaaaccc

SEQ ID NO: 2209 - DNA, 21 bp, Artificial Sequence
  Description of Artificial Sequence: Synthetic oligonucleotide
tttcacaaatagttgtaaata

SEQ ID NO: 2210 - DNA, 21 bp, Artificial Sequence
  Description of Artificial Sequence: Synthetic oligonucleotide
tttacaactatttgtgaaacc

SEQ ID NO: 2211 - DNA, 21 bp, Artificial Sequence
  Description of Artificial Sequence: Synthetic oligonucleotide
ttcacaaatagttgtaaatat

SEQ ID NO: 2212 - DNA, 21 bp, Artificial Sequence
  Description of Artificial Sequence: Synthetic oligonucleotide
atttacaactatttgtgaaac

SEQ ID NO: 2213 - DNA, 21 bp, Artificial Sequence
  Description of Artificial Sequence: Synthetic oligonucleotide
tcacaaatagttgtaaatata

SEQ ID NO: 2214 - DNA, 21 bp, Artificial Sequence
  Description of Artificial Sequence: Synthetic oligonucleotide
tatttacaactatttgtgaaa

SEQ ID NO: 2215 - DNA, 21 bp, Artificial Sequence
  Description of Artificial Sequence: Synthetic oligonucleotide
cacaaatagttgtaaatatag

SEQ ID NO: 2216 - DNA, 21 bp, Artificial Sequence
  Description of Artificial Sequence: Synthetic oligonucleotide
atatttacaactatttgtgaa

SEQ ID NO: 2217 - DNA, 21 bp, Artificial Sequence
  Description of Artificial Sequence: Synthetic oligonucleotide
acaaatagttgtaaatatagt

SEQ ID NO: 2218 - DNA, 21 bp, Artificial Sequence
  Description of Artificial Sequence: Synthetic oligonucleotide
tatatttacaactatttgtga

SEQ ID NO: 2219 - DNA, 21 bp, Artificial Sequence
  Description of Artificial Sequence: Synthetic oligonucleotide
caaatagttgtaaatatagtg

SEQ ID NO: 2220 - DNA, 21 bp, Artificial Sequence
  Description of Artificial Sequence: Synthetic oligonucleotide
ctatatttacaactatttgtg

SEQ ID NO: 2221 - DNA, 21 bp, Artificial Sequence
  Description of Artificial Sequence: Synthetic oligonucleotide
aaatagttgtaaatatagtga

SEQ ID NO: 2222 - DNA, 21 bp, Artificial Sequence
  Description of Artificial Sequence: Synthetic oligonucleotide
actatatttacaactatttgt

SEQ ID NO: 2223 - DNA, 21 bp, Artificial Sequence
  Description of Artificial Sequence: Synthetic oligonucleotide
aatagttgtaaatatagtgaa

SEQ ID NO: 2224 - DNA, 21 bp, Artificial Sequence
  Description of Artificial Sequence: Synthetic oligonucleotide
cactatatttacaactatttg

SEQ ID NO: 2225 - DNA, 21 bp, Artificial Sequence
  Description of Artificial Sequence: Synthetic oligonucleotide
atagttgtaaatatagtgaag

SEQ ID NO: 2226 - DNA, 21 bp, Artificial Sequence
  Description of Artificial Sequence: Synthetic oligonucleotide
tcactatatttacaactattt

SEQ ID NO: 2227 - DNA, 21 bp, Artificial Sequence
  Description of Artificial Sequence: Synthetic oligonucleotide
tagttgtaaatatagtgaagc

SEQ ID NO: 2228 - DNA, 21 bp, Artificial Sequence
  Description of Artificial Sequence: Synthetic oligonucleotide
ttcactatatttacaactatt

SEQ ID NO: 2229 - DNA, 21 bp, Artificial Sequence
  Description of Artificial Sequence: Synthetic oligonucleotide
agttgtaaatatagtgaagca

SEQ ID NO: 2230 - DNA, 21 bp, Artificial Sequence
  Description of Artificial Sequence: Synthetic oligonucleotide
cttcactatatttacaactat

SEQ ID NO: 2231 - DNA, 21 bp, Artificial Sequence
  Description of Artificial Sequence: Synthetic oligonucleotide
gttgtaaatatagtgaagcaa

SEQ ID NO: 2232 - DNA, 21 bp, Artificial Sequence
  Description of Artificial Sequence: Synthetic oligonucleotide
gcttcactatatttacaacta

SEQ ID NO: 2233 - DNA, 21 bp, Artificial Sequence
  Description of Artificial Sequence: Synthetic oligonucleotide
ttgtaaatatagtgaagcaat

SEQ ID NO: 2234 - DNA, 21 bp, Artificial Sequence
  Description of Artificial Sequence: Synthetic oligonucleotide
tgcttcactatatttacaact

SEQ ID NO: 2235 - DNA, 21 bp, Artificial Sequence
  Description of Artificial Sequence: Synthetic oligonucleotide
tgtaaatatagtgaagcaatt

SEQ ID NO: 2236 - DNA, 21 bp, Artificial Sequence
  Description of Artificial Sequence: Synthetic oligonucleotide
ttgcttcactatatttacaac

SEQ ID NO: 2237 - DNA, 21 bp, Artificial Sequence
  Description of Artificial Sequence: Synthetic oligonucleotide
gtaaatatagtgaagcaattt

SEQ ID NO: 2238 - DNA, 21 bp, Artificial Sequence
  Description of Artificial Sequence: Synthetic oligonucleotide
attgcttcactatatttacaa

SEQ ID NO: 2239 - DNA, 21 bp, Artificial Sequence
  Description of Artificial Sequence: Synthetic oligonucleotide
taaatatagtgaagcaatttg

SEQ ID NO: 2240 - DNA, 21 bp, Artificial Sequence
  Description of Artificial Sequence: Synthetic oligonucleotide
aattgcttcactatatttaca

SEQ ID NO: 2241 - DNA, 21 bp, Artificial Sequence
  Description of Artificial Sequence: Synthetic oligonucleotide
aaatatagtgaagcaatttga

SEQ ID NO: 2242 - DNA, 21 bp, Artificial Sequence
  Description of Artificial Sequence: Synthetic oligonucleotide
aaattgcttcactatatttac

SEQ ID NO: 2243 - DNA, 21 bp, Artificial Sequence
  Description of Artificial Sequence: Synthetic oligonucleotide
aatatagtgaagcaatttgaa

SEQ ID NO: 2244 - DNA, 21 bp, Artificial Sequence
  Description of Artificial Sequence: Synthetic oligonucleotide
caaattgcttcactatattta

SEQ ID NO: 2245 - DNA, 21 bp, Artificial Sequence
  Description of Artificial Sequence: Synthetic oligonucleotide
atatagtgaagcaatttgaaa

SEQ ID NO: 2246 - DNA, 21 bp, Artificial Sequence
  Description of Artificial Sequence: Synthetic oligonucleotide
tcaaattgcttcactatattt

SEQ ID NO: 2247 - DNA, 21 bp, Artificial Sequence
  Description of Artificial Sequence: Synthetic oligonucleotide
tatagtgaagcaatttgaaat

SEQ ID NO: 2248 - DNA, 21 bp, Artificial Sequence
  Description of Artificial Sequence: Synthetic oligonucleotide
ttcaaattgcttcactatatt

SEQ ID NO: 2249 - DNA, 21 bp, Artificial Sequence
  Description of Artificial Sequence: Synthetic oligonucleotide
atagtgaagcaatttgaaata

SEQ ID NO: 2250 - DNA, 21 bp, Artificial Sequence
  Description of Artificial Sequence: Synthetic oligonucleotide
tttcaaattgcttcactatat

SEQ ID NO: 2251 - DNA, 21 bp, Artificial Sequence
  Description of Artificial Sequence: Synthetic oligonucleotide
tagtgaagcaatttgaaataa

SEQ ID NO: 2252 - DNA, 21 bp, Artificial Sequence
  Description of Artificial Sequence: Synthetic oligonucleotide
atttcaaattgcttcactata

SEQ ID NO: 2253 - DNA, 21 bp, Artificial Sequence
  Description of Artificial Sequence: Synthetic oligonucleotide
agtgaagcaatttgaaataat

SEQ ID NO: 2254 - DNA, 21 bp, Artificial Sequence
  Description of Artificial Sequence: Synthetic oligonucleotide
tatttcaaattgcttcactat

SEQ ID NO: 2255 - DNA, 21 bp, Artificial Sequence
  Description of Artificial Sequence: Synthetic oligonucleotide
gtgaagcaatttgaaataatt

SEQ ID NO: 2256 - DNA, 21 bp, Artificial Sequence
  Description of Artificial Sequence: Synthetic oligonucleotide
ttatttcaaattgcttcacta

SEQ ID NO: 2257 - DNA, 21 bp, Artificial Sequence
  Description of Artificial Sequence: Synthetic oligonucleotide
tgaagcaatttgaaataattt

SEQ ID NO: 2258 - DNA, 21 bp, Artificial Sequence
  Description of Artificial Sequence: Synthetic oligonucleotide
attatttcaaattgcttcact

SEQ ID NO: 2259 - DNA, 21 bp, Artificial Sequence
  Description of Artificial Sequence: Synthetic oligonucleotide
gaagcaatttgaaataatttt

SEQ ID NO: 2260 - DNA, 21 bp, Artificial Sequence
  Description of Artificial Sequence: Synthetic oligonucleotide
aattatttcaaattgcttcac

SEQ ID NO: 2261 - DNA, 21 bp, Artificial Sequence
  Description of Artificial Sequence: Synthetic oligonucleotide
aagcaatttgaaataattttc

SEQ ID NO: 2262 - DNA, 21 bp, Artificial Sequence
  Description of Artificial Sequence: Synthetic oligonucleotide
aaattatttcaaattgcttca

SEQ ID NO: 2263 - DNA, 21 bp, Artificial Sequence
  Description of Artificial Sequence: Synthetic oligonucleotide
agcaatttgaaataattttca

SEQ ID NO: 2264 - DNA, 21 bp, Artificial Sequence
  Description of Artificial Sequence: Synthetic oligonucleotide
aaaattatttcaaattgcttc

SEQ ID NO: 2265 - DNA, 21 bp, Artificial Sequence
  Description of Artificial Sequence: Synthetic oligonucleotide
gcaatttgaaataattttcaa

SEQ ID NO: 2266 - DNA, 21 bp, Artificial Sequence
  Description of Artificial Sequence: Synthetic oligonucleotide
gaaaattatttcaaattgctt

SEQ ID NO: 2267 - DNA, 21 bp, Artificial Sequence
  Description of Artificial Sequence: Synthetic oligonucleotide
caatttgaaataattttcaag

SEQ ID NO: 2268 - DNA, 21 bp, Artificial Sequence
  Description of Artificial Sequence: Synthetic oligonucleotide
tgaaaattatttcaaattgct

SEQ ID NO: 2269 - DNA, 21 bp, Artificial Sequence
  Description of Artificial Sequence: Synthetic oligonucleotide
aatttgaaataattttcaagc

SEQ ID NO: 2270 - DNA, 21 bp, Artificial Sequence
  Description of Artificial Sequence: Synthetic oligonucleotide
ttgaaaattatttcaaattgc

SEQ ID NO: 2271 - DNA, 21 bp, Artificial Sequence
  Description of Artificial Sequence: Synthetic oligonucleotide
atttgaaataattttcaagca

SEQ ID NO: 2272 - DNA, 21 bp, Artificial Sequence
  Description of Artificial Sequence: Synthetic oligonucleotide
cttgaaaattatttcaaattg

SEQ ID NO: 2273 - DNA, 21 bp, Artificial Sequence
  Description of Artificial Sequence: Synthetic oligonucleotide
tttgaaataattttcaagcaa

SEQ ID NO: 2274 - DNA, 21 bp, Artificial Sequence
  Description of Artificial Sequence: Synthetic oligonucleotide
gcttgaaaattatttcaaatt

SEQ ID NO: 2275 - DNA, 21 bp, Artificial Sequence
  Description of Artificial Sequence: Synthetic oligonucleotide
ttgaaataattttcaagcaaa

SEQ ID NO: 2276 - DNA, 21 bp, Artificial Sequence
  Description of Artificial Sequence: Synthetic oligonucleotide
tgcttgaaaattatttcaaat

SEQ ID NO: 2277 - DNA, 21 bp, Artificial Sequence
  Description of Artificial Sequence: Synthetic oligonucleotide
tgaaataattttcaagcaaag

SEQ ID NO: 2278 - DNA, 21 bp, Artificial Sequence
  Description of Artificial Sequence: Synthetic oligonucleotide
ttgcttgaaaattatttcaaa

SEQ ID NO: 2279 - DNA, 21 bp, Artificial Sequence
  Description of Artificial Sequence: Synthetic oligonucleotide
gaaataattttcaagcaaagt

SEQ ID NO: 2280 - DNA, 21 bp, Artificial Sequence
  Description of Artificial Sequence: Synthetic oligonucleotide
tttgcttgaaaattatttcaa

SEQ ID NO: 2281 - DNA, 21 bp, Artificial Sequence
  Description of Artificial Sequence: Synthetic oligonucleotide
aaataattttcaagcaaagta

SEQ ID NO: 2282 - DNA, 21 bp, Artificial Sequence
  Description of Artificial Sequence: Synthetic oligonucleotide
ctttgcttgaaaattatttca

SEQ ID NO: 2283 - DNA, 21 bp, Artificial Sequence
  Description of Artificial Sequence: Synthetic oligonucleotide
aataattttcaagcaaagtat

SEQ ID NO: 2284 - DNA, 21 bp, Artificial Sequence
  Description of Artificial Sequence: Synthetic oligonucleotide
actttgcttgaaaattatttc

SEQ ID NO: 2285 - DNA, 21 bp, Artificial Sequence
  Description of Artificial Sequence: Synthetic oligonucleotide
ataattttcaagcaaagtatt

SEQ ID NO: 2286 - DNA, 21 bp, Artificial Sequence
  Description of Artificial Sequence: Synthetic oligonucleotide
tactttgcttgaaaattattt

SEQ ID NO: 2287 - DNA, 21 bp, Artificial Sequence
  Description of Artificial Sequence: Synthetic oligonucleotide
taattttcaagcaaagtattg

SEQ ID NO: 2288 - DNA, 21 bp, Artificial Sequence
  Description of Artificial Sequence: Synthetic oligonucleotide
atactttgcttgaaaattatt

SEQ ID NO: 2289 - DNA, 21 bp, Artificial Sequence
  Description of Artificial Sequence: Synthetic oligonucleotide
aattttcaagcaaagtattgt

SEQ ID NO: 2290 - DNA, 21 bp, Artificial Sequence
  Description of Artificial Sequence: Synthetic oligonucleotide
aatactttgcttgaaaattat

SEQ ID NO: 2291 - DNA, 21 bp, Artificial Sequence
  Description of Artificial Sequence: Synthetic oligonucleotide
attttcaagcaaagtattgtg

SEQ ID NO: 2292 - DNA, 21 bp, Artificial Sequence
  Description of Artificial Sequence: Synthetic oligonucleotide
caatactttgcttgaaaatta

SEQ ID NO: 2293 - DNA, 21 bp, Artificial Sequence
  Description of Artificial Sequence: Synthetic oligonucleotide
ttttcaagcaaagtattgtga

SEQ ID NO: 2294 - DNA, 21 bp, Artificial Sequence
  Description of Artificial Sequence: Synthetic oligonucleotide
acaatactttgcttgaaaatt

SEQ ID NO: 2295 - DNA, 21 bp, Artificial Sequence
  Description of Artificial Sequence: Synthetic oligonucleotide
tttcaagcaaagtattgtgaa

SEQ ID NO: 2296 - DNA, 21 bp, Artificial Sequence
  Description of Artificial Sequence: Synthetic oligonucleotide
cacaatactttgcttgaaaat

SEQ ID NO: 2297 - DNA, 21 bp, Artificial Sequence
  Description of Artificial Sequence: Synthetic oligonucleotide
ttcaagcaaagtattgtgaaa

SEQ ID NO: 2298 - DNA, 21 bp, Artificial Sequence
  Description of Artificial Sequence: Synthetic oligonucleotide
tcacaatactttgcttgaaaa

SEQ ID NO: 2299 - DNA, 21 bp, Artificial Sequence
  Description of Artificial Sequence: Synthetic oligonucleotide
tcaagcaaagtattgtgaaag

SEQ ID NO: 2300 - DNA, 21 bp, Artificial Sequence
  Description of Artificial Sequence: Synthetic oligonucleotide
ttcacaatactttgcttgaaa

SEQ ID NO: 2301 - DNA, 21 bp, Artificial Sequence
  Description of Artificial Sequence: Synthetic oligonucleotide
caagcaaagtattgtgaaagt

SEQ ID NO: 2302 - DNA, 21 bp, Artificial Sequence
  Description of Artificial Sequence: Synthetic oligonucleotide
tttcacaatactttgcttgaa

SEQ ID NO: 2303 - DNA, 21 bp, Artificial Sequence
  Description of Artificial Sequence: Synthetic oligonucleotide
aagcaaagtattgtgaaagta

SEQ ID NO: 2304 - DNA, 21 bp, Artificial Sequence
  Description of Artificial Sequence: Synthetic oligonucleotide
ctttcacaatactttgcttga

SEQ ID NO: 2305 - DNA, 21 bp, Artificial Sequence
  Description of Artificial Sequence: Synthetic oligonucleotide
agcaaagtattgtgaaagtat

SEQ ID NO: 2306 - DNA, 21 bp, Artificial Sequence
  Description of Artificial Sequence: Synthetic oligonucleotide
actttcacaatactttgcttg

SEQ ID NO: 2307 - DNA, 21 bp, Artificial Sequence
  Description of Artificial Sequence: Synthetic oligonucleotide
gcaaagtattgtgaaagtatt

SEQ ID NO: 2308 - DNA, 21 bp, Artificial Sequence
  Description of Artificial Sequence: Synthetic oligonucleotide
tactttcacaatactttgctt

SEQ ID NO: 2309 - DNA, 21 bp, Artificial Sequence
  Description of Artificial Sequence: Synthetic oligonucleotide
caaagtattgtgaaagtattc

SEQ ID NO: 2310 - DNA, 21 bp, Artificial Sequence
  Description of Artificial Sequence: Synthetic oligonucleotide
atactttcacaatactttgct

SEQ ID NO: 2311 - DNA, 21 bp, Artificial Sequence
  Description of Artificial Sequence: Synthetic oligonucleotide
aaagtattgtgaaagtattct

SEQ ID NO: 2312 - DNA, 21 bp, Artificial Sequence
  Description of Artificial Sequence: Synthetic oligonucleotide
aatactttcacaatactttgc

SEQ ID NO: 2313 - DNA, 21 bp, Artificial Sequence
  Description of Artificial Sequence: Synthetic oligonucleotide
aagtattgtgaaagtattcta

SEQ ID NO: 2314 - DNA, 21 bp, Artificial Sequence
  Description of Artificial Sequence: Synthetic oligonucleotide
gaatactttcacaatactttg

SEQ ID NO: 2315 - DNA, 21 bp, Artificial Sequence
  Description of Artificial Sequence: Synthetic oligonucleotide
agtattgtgaaagtattctaa

SEQ ID NO: 2316 - DNA, 21 bp, Artificial Sequence
  Description of Artificial Sequence: Synthetic oligonucleotide
agaatactttcacaatacttt

SEQ ID NO: 2317 - DNA, 21 bp, Artificial Sequence
  Description of Artificial Sequence: Synthetic oligonucleotide
gtattgtgaaagtattctaag

SEQ ID NO: 2318 - DNA, 21 bp, Artificial Sequence
  Description of Artificial Sequence: Synthetic oligonucleotide
tagaatactttcacaatactt

SEQ ID NO: 2319 - DNA, 21 bp, Artificial Sequence
  Description of Artificial Sequence: Synthetic oligonucleotide
tattgtgaaagtattctaagc

SEQ ID NO: 2320 - DNA, 21 bp, Artificial Sequence
  Description of Artificial Sequence: Synthetic oligonucleotide
ttagaatactttcacaatact

SEQ ID NO: 2321 - DNA, 21 bp, Artificial Sequence
  Description of Artificial Sequence: Synthetic oligonucleotide
attgtgaaagtattctaagcc

SEQ ID NO: 2322 - DNA, 21 bp, Artificial Sequence
  Description of Artificial Sequence: Synthetic oligonucleotide
cttagaatactttcacaatac

SEQ ID NO: 2323 - DNA, 21 bp, Artificial Sequence
  Description of Artificial Sequence: Synthetic oligonucleotide
ttgtgaaagtattctaagcca

SEQ ID NO: 2324 - DNA, 21 bp, Artificial Sequence
  Description of Artificial Sequence: Synthetic oligonucleotide
gcttagaatactttcacaata

SEQ ID NO: 2325 - DNA, 21 bp, Artificial Sequence
  Description of Artificial Sequence: Synthetic oligonucleotide
tgtgaaagtattctaagccaa

SEQ ID NO: 2326 - DNA, 21 bp, Artificial Sequence
  Description of Artificial Sequence: Synthetic oligonucleotide
ggcttagaatactttcacaat

SEQ ID NO: 2327 - DNA, 21 bp, Artificial Sequence
  Description of Artificial Sequence: Synthetic oligonucleotide
gtgaaagtattctaagccaag

SEQ ID NO: 2328 - DNA, 21 bp, Artificial Sequence
  Description of Artificial Sequence: Synthetic oligonucleotide
tggcttagaatactttcacaa

SEQ ID NO: 2329 - DNA, 21 bp, Artificial Sequence
  Description of Artificial Sequence: Synthetic oligonucleotide
tgaaagtattctaagccaagt

SEQ ID NO: 2330 - DNA, 21 bp, Artificial Sequence
  Description of Artificial Sequence: Synthetic oligonucleotide
ttggcttagaatactttcaca

SEQ ID NO: 2331 - DNA, 21 bp, Artificial Sequence
  Description of Artificial Sequence: Synthetic oligonucleotide
gaaagtattctaagccaagtt

SEQ ID NO: 2332 - DNA, 21 bp, Artificial Sequence
  Description of Artificial Sequence: Synthetic oligonucleotide
cttggcttagaatactttcac

SEQ ID NO: 2333 - DNA, 21 bp, Artificial Sequence
  Description of Artificial Sequence: Synthetic oligonucleotide
aaagtattctaagccaagttt

SEQ ID NO: 2334 - DNA, 21 bp, Artificial Sequence
  Description of Artificial Sequence: Synthetic oligonucleotide
acttggcttagaatactttca

SEQ ID NO: 2335 - DNA, 21 bp, Artificial Sequence
  Description of Artificial Sequence: Synthetic oligonucleotide
aagtattctaagccaagtttt

SEQ ID NO: 2336 - DNA, 21 bp, Artificial Sequence
  Description of Artificial Sequence: Synthetic oligonucleotide
aacttggcttagaatactttc

SEQ ID NO: 2337 - DNA, 21 bp, Artificial Sequence
  Description of Artificial Sequence: Synthetic oligonucleotide
agtattctaagccaagtttta

SEQ ID NO: 2338 - DNA, 21 bp, Artificial Sequence
  Description of Artificial Sequence: Synthetic oligonucleotide
aaacttggcttagaatacttt

SEQ ID NO: 2339 - DNA, 21 bp, Artificial Sequence
  Description of Artificial Sequence: Synthetic oligonucleotide
gtattctaagccaagttttaa

SEQ ID NO: 2340 - DNA, 21 bp, Artificial Sequence
  Description of Artificial Sequence: Synthetic oligonucleotide
aaaacttggcttagaatactt

SEQ ID NO: 2341 - DNA, 21 bp, Artificial Sequence
  Description of Artificial Sequence: Synthetic oligonucleotide
tattctaagccaagttttaaa

SEQ ID NO: 2342 - DNA, 21 bp, Artificial Sequence
  Description of Artificial Sequence: Synthetic oligonucleotide
taaaacttggcttagaatact

SEQ ID NO: 2343 - DNA, 21 bp, Artificial Sequence
  Description of Artificial Sequence: Synthetic oligonucleotide
attctaagccaagttttaaat

SEQ ID NO: 2344 - DNA, 21 bp, Artificial Sequence
  Description of Artificial Sequence: Synthetic oligonucleotide
ttaaaacttggcttagaatac

SEQ ID NO: 2345 - DNA, 21 bp, Artificial Sequence
  Description of Artificial Sequence: Synthetic oligonucleotide
ttctaagccaagttttaaata

SEQ ID NO: 2346 - DNA, 21 bp, Artificial Sequence
  Description of Artificial Sequence: Synthetic oligonucleotide
tttaaaacttggcttagaata

SEQ ID NO: 2347 - DNA, 21 bp, Artificial Sequence
  Description of Artificial Sequence: Synthetic oligonucleotide
tctaagccaagttttaaatat

SEQ ID NO: 2348 - DNA, 21 bp, Artificial Sequence
  Description of Artificial Sequence: Synthetic oligonucleotide
atttaaaacttggcttagaat

SEQ ID NO: 2349 - DNA, 21 bp, Artificial Sequence
  Description of Artificial Sequence: Synthetic oligonucleotide
ctaagccaagttttaaatatt

SEQ ID NO: 2350 - DNA, 21 bp, Artificial Sequence
  Description of Artificial Sequence: Synthetic oligonucleotide
tatttaaaacttggcttagaa

SEQ ID NO: 2351 - DNA, 21 bp, Artificial Sequence
  Description of Artificial Sequence: Synthetic oligonucleotide
taagccaagttttaaatatta

SEQ ID NO: 2352 - DNA, 21 bp, Artificial Sequence
  Description of Artificial Sequence: Synthetic oligonucleotide
atatttaaaacttggcttaga

SEQ ID NO: 2353 - DNA, 21 bp, Artificial Sequence
  Description of Artificial Sequence: Synthetic oligonucleotide
aagccaagttttaaatattat

SEQ ID NO: 2354 - DNA, 21 bp, Artificial Sequence
  Description of Artificial Sequence: Synthetic oligonucleotide
aatatttaaaacttggcttag

SEQ ID NO: 2355 - DNA, 21 bp, Artificial Sequence
  Description of Artificial Sequence: Synthetic oligonucleotide
agccaagttttaaatattatc

SEQ ID NO: 2356 - DNA, 21 bp, Artificial Sequence
  Description of Artificial Sequence: Synthetic oligonucleotide
taatatttaaaacttggctta

SEQ ID NO: 2357 - DNA, 21 bp, Artificial Sequence
  Description of Artificial Sequence: Synthetic oligonucleotide
gccaagttttaaatattatct

SEQ ID NO: 2358 - DNA, 21 bp, Artificial Sequence
  Description of Artificial Sequence: Synthetic oligonucleotide
ataatatttaaaacttggctt

SEQ ID NO: 2359 - DNA, 21 bp, Artificial Sequence
  Description of Artificial Sequence: Synthetic oligonucleotide
ccaagttttaaatattatcta

SEQ ID NO: 2360 - DNA, 21 bp, Artificial Sequence
  Description of Artificial Sequence: Synthetic oligonucleotide
gataatatttaaaacttggct

SEQ ID NO: 2361 - DNA, 21 bp, Artificial Sequence
  Description of Artificial Sequence: Synthetic oligonucleotide
caagttttaaatattatctaa

SEQ ID NO: 2362 - DNA, 21 bp, Artificial Sequence
  Description of Artificial Sequence: Synthetic oligonucleotide
agataatatttaaaacttggc

SEQ ID NO: 2363 - DNA, 21 bp, Artificial Sequence
  Description of Artificial Sequence: Synthetic oligonucleotide
aagttttaaatattatctaac

SEQ ID NO: 2364 - DNA, 21 bp, Artificial Sequence
  Description of Artificial Sequence: Synthetic oligonucleotide
tagataatatttaaaacttgg

SEQ ID NO: 2365 - DNA, 21 bp, Artificial Sequence
  Description of Artificial Sequence: Synthetic oligonucleotide
agttttaaatattatctaaca

SEQ ID NO: 2366 - DNA, 21 bp, Artificial Sequence
  Description of Artificial Sequence: Synthetic oligonucleotide
ttagataatatttaaaacttg

SEQ ID NO: 2367 - DNA, 21 bp, Artificial Sequence
  Description of Artificial Sequence: Synthetic oligonucleotide
gttttaaatattatctaacag

SEQ ID NO: 2368 - DNA, 21 bp, Artificial Sequence
  Description of Artificial Sequence: Synthetic oligonucleotide
gttagataatatttaaaactt

SEQ ID NO: 2369 - DNA, 21 bp, Artificial Sequence
  Description of Artificial Sequence: Synthetic oligonucleotide
ttttaaatattatctaacaga

SEQ ID NO: 2370 - DNA, 21 bp, Artificial Sequence
  Description of Artificial Sequence: Synthetic oligonucleotide
tgttagataatatttaaaact

SEQ ID NO: 2371 - DNA, 21 bp, Artificial Sequence
  Description of Artificial Sequence: Synthetic oligonucleotide
tttaaatattatctaacagac

SEQ ID NO: 2372 - DNA, 21 bp, Artificial Sequence
  Description of Artificial Sequence: Synthetic oligonucleotide
ctgttagataatatttaaaac

SEQ ID NO: 2373 - DNA, 21 bp, Artificial Sequence
  Description of Artificial Sequence: Synthetic oligonucleotide
ttaaatattatctaacagaca

SEQ ID NO: 2374 - DNA, 21 bp, Artificial Sequence
  Description of Artificial Sequence: Synthetic oligonucleotide
tctgttagataatatttaaaa

SEQ ID NO: 2375 - DNA, 21 bp, Artificial Sequence
  Description of Artificial Sequence: Synthetic oligonucleotide
taaatattatctaacagacaa

SEQ ID NO: 2376 - DNA, 21 bp, Artificial Sequence
  Description of Artificial Sequence: Synthetic oligonucleotide
gtctgttagataatatttaaa

SEQ ID NO: 2377 - DNA, 21 bp, Artificial Sequence
  Description of Artificial Sequence: Synthetic oligonucleotide
aaatattatctaacagacaag

SEQ ID NO: 2378 - DNA, 21 bp, Artificial Sequence
  Description of Artificial Sequence: Synthetic oligonucleotide
tgtctgttagataatatttaa

SEQ ID NO: 2379 - DNA, 21 bp, Artificial Sequence
  Description of Artificial Sequence: Synthetic oligonucleotide
aatattatctaacagacaaga

SEQ ID NO: 2380 - DNA, 21 bp, Artificial Sequence
  Description of Artificial Sequence: Synthetic oligonucleotide
ttgtctgttagataatattta

SEQ ID NO: 2381 - DNA, 21 bp, Artificial Sequence
  Description of Artificial Sequence: Synthetic oligonucleotide
atattatctaacagacaagag

SEQ ID NO: 2382 - DNA, 21 bp, Artificial Sequence
  Description of Artificial Sequence: Synthetic oligonucleotide
cttgtctgttagataatattt

SEQ ID NO: 2383 - DNA, 21 bp, Artificial Sequence
  Description of Artificial Sequence: Synthetic oligonucleotide
tattatctaacagacaagagt

SEQ ID NO: 2384 - DNA, 21 bp, Artificial Sequence
  Description of Artificial Sequence: Synthetic oligonucleotide
tcttgtctgttagataatatt

SEQ ID NO: 2385 - DNA, 21 bp, Artificial Sequence
  Description of Artificial Sequence: Synthetic oligonucleotide
attatctaacagacaagagtg

SEQ ID NO: 2386 - DNA, 21 bp, Artificial Sequence
  Description of Artificial Sequence: Synthetic oligonucleotide
ctcttgtctgttagataatat

SEQ ID NO: 2387 - DNA, 21 bp, Artificial Sequence
  Description of Artificial Sequence: Synthetic oligonucleotide
ttatctaacagacaagagtgg

SEQ ID NO: 2388 - DNA, 21 bp, Artificial Sequence
  Description of Artificial Sequence: Synthetic oligonucleotide
actcttgtctgttagataata

SEQ ID NO: 2389 - DNA, 21 bp, Artificial Sequence
  Description of Artificial Sequence: Synthetic oligonucleotide
tatctaacagacaagagtggt

SEQ ID NO: 2390 - DNA, 21 bp, Artificial Sequence
  Description of Artificial Sequence: Synthetic oligonucleotide
cactcttgtctgttagataat

SEQ ID NO: 2391 - DNA, 21 bp, Artificial Sequence
  Description of Artificial Sequence: Synthetic oligonucleotide
atctaacagacaagagtggta

SEQ ID NO: 2392 - DNA, 21 bp, Artificial Sequence
  Description of Artificial Sequence: Synthetic oligonucleotide
ccactcttgtctgttagataa

SEQ ID NO: 2393 - DNA, 21 bp, Artificial Sequence
  Description of Artificial Sequence: Synthetic oligonucleotide
tctaacagacaagagtggtat

SEQ ID NO: 2394 - DNA, 21 bp, Artificial Sequence
  Description of Artificial Sequence: Synthetic oligonucleotide
accactcttgtctgttagata

SEQ ID NO: 2395 - DNA, 21 bp, Artificial Sequence
  Description of Artificial Sequence: Synthetic oligonucleotide
ctaacagacaagagtggtata

SEQ ID NO: 2396 - DNA, 21 bp, Artificial Sequence
  Description of Artificial Sequence: Synthetic oligonucleotide
taccactcttgtctgttagat

SEQ ID NO: 2397 - DNA, 21 bp, Artificial Sequence
  Description of Artificial Sequence: Synthetic oligonucleotide
taacagacaagagtggtatat

SEQ ID NO: 2398 - DNA, 21 bp, Artificial Sequence
  Description of Artificial Sequence: Synthetic oligonucleotide
ataccactcttgtctgttaga

SEQ ID NO: 2399 - DNA, 21 bp, Artificial Sequence
  Description of Artificial Sequence: Synthetic oligonucleotide
aacagacaagagtggtatata

SEQ ID NO: 2400 - DNA, 21 bp, Artificial Sequence
  Description of Artificial Sequence: Synthetic oligonucleotide
tataccactcttgtctgttag

SEQ ID NO: 2401 - DNA, 21 bp, Artificial Sequence
  Description of Artificial Sequence: Synthetic oligonucleotide
acagacaagagtggtatatac

SEQ ID NO: 2402 - DNA, 21 bp, Artificial Sequence
  Description of Artificial Sequence: Synthetic oligonucleotide
atataccactcttgtctgtta

SEQ ID NO: 2403 - DNA, 21 bp, Artificial Sequence
  Description of Artificial Sequence: Synthetic oligonucleotide
cagacaagagtggtatataca

SEQ ID NO: 2404 - DNA, 21 bp, Artificial Sequence
  Description of Artificial Sequence: Synthetic oligonucleotide
tatataccactcttgtctgtt

SEQ ID NO: 2405 - DNA, 21 bp, Artificial Sequence
  Description of Artificial Sequence: Synthetic oligonucleotide
agacaagagtggtatatacaa

SEQ ID NO: 2406 - DNA, 21 bp, Artificial Sequence
  Description of Artificial Sequence: Synthetic oligonucleotide
gtatataccactcttgtctgt

SEQ ID NO: 2407 - DNA, 21 bp, Artificial Sequence
  Description of Artificial Sequence: Synthetic oligonucleotide
gacaagagtggtatatacaag

SEQ ID NO: 2408 - DNA, 21 bp, Artificial Sequence
  Description of Artificial Sequence: Synthetic oligonucleotide
tgtatataccactcttgtctg

SEQ ID NO: 2409 - DNA, 21 bp, Artificial Sequence
  Description of Artificial Sequence: Synthetic oligonucleotide
acaagagtggtatatacaagt

SEQ ID NO: 2410 - DNA, 21 bp, Artificial Sequence
  Description of Artificial Sequence: Synthetic oligonucleotide
ttgtatataccactcttgtct

SEQ ID NO: 2411 - DNA, 21 bp, Artificial Sequence
  Description of Artificial Sequence: Synthetic oligonucleotide
caagagtggtatatacaagta

SEQ ID NO: 2412 - DNA, 21 bp, Artificial Sequence
  Description of Artificial Sequence: Synthetic oligonucleotide
cttgtatataccactcttgtc

SEQ ID NO: 2413 - DNA, 21 bp, Artificial Sequence
  Description of Artificial Sequence: Synthetic oligonucleotide
aagagtggtatatacaagtag

SEQ ID NO: 2414 - DNA, 21 bp, Artificial Sequence
  Description of Artificial Sequence: Synthetic oligonucleotide
acttgtatataccactcttgt

SEQ ID NO: 2415 - DNA, 21 bp, Artificial Sequence
  Description of Artificial Sequence: Synthetic oligonucleotide
agagtggtatatacaagtaga

SEQ ID NO: 2416 - DNA, 21 bp, Artificial Sequence
  Description of Artificial Sequence: Synthetic oligonucleotide
tacttgtatataccactcttg

SEQ ID NO: 2417 - DNA, 21 bp, Artificial Sequence
  Description of Artificial Sequence: Synthetic oligonucleotide
gagtggtatatacaagtagat

SEQ ID NO: 2418 - DNA, 21 bp, Artificial Sequence
  Description of Artificial Sequence: Synthetic oligonucleotide
ctacttgtatataccactctt

SEQ ID NO: 2419 - DNA, 21 bp, Artificial Sequence
  Description of Artificial Sequence: Synthetic oligonucleotide
agtggtatatacaagtagatc

SEQ ID NO: 2420 - DNA, 21 bp, Artificial Sequence
  Description of Artificial Sequence: Synthetic oligonucleotide
tctacttgtatataccactct

SEQ ID NO: 2421 - DNA, 21 bp, Artificial Sequence
  Description of Artificial Sequence: Synthetic oligonucleotide
gtggtatatacaagtagatcc

SEQ ID NO: 2422 - DNA, 21 bp, Artificial Sequence
  Description of Artificial Sequence: Synthetic oligonucleotide
atctacttgtatataccactc

SEQ ID NO: 2423 - DNA, 21 bp, Artificial Sequence
  Description of Artificial Sequence: Synthetic oligonucleotide
tggtatatacaagtagatcct

SEQ ID NO: 2424 - DNA, 21 bp, Artificial Sequence
  Description of Artificial Sequence: Synthetic oligonucleotide
gatctacttgtatataccact

SEQ ID NO: 2425 - DNA, 21 bp, Artificial Sequence
  Description of Artificial Sequence: Synthetic oligonucleotide
ggtatatacaagtagatcctg

SEQ ID NO: 2426 - DNA, 21 bp, Artificial Sequence
  Description of Artificial Sequence: Synthetic oligonucleotide
ggatctacttgtatataccac

SEQ ID NO: 2427 - DNA, 21 bp, Artificial Sequence
  Description of Artificial Sequence: Synthetic oligonucleotide
gtatatacaagtagatcctga

SEQ ID NO: 2428 - DNA, 21 bp, Artificial Sequence
  Description of Artificial Sequence: Synthetic oligonucleotide
aggatctacttgtatatacca

SEQ ID NO: 2429 - DNA, 21 bp, Artificial Sequence
  Description of Artificial Sequence: Synthetic oligonucleotide
tatatacaagtagatcctgag

SEQ ID NO: 2430 - DNA, 21 bp, Artificial Sequence
  Description of Artificial Sequence: Synthetic oligonucleotide
caggatctacttgtatatacc

SEQ ID NO: 2431 - DNA, 21 bp, Artificial Sequence
  Description of Artificial Sequence: Synthetic oligonucleotide
atatacaagtagatcctgaga

SEQ ID NO: 2432 - DNA, 21 bp, Artificial Sequence
  Description of Artificial Sequence: Synthetic oligonucleotide
tcaggatctacttgtatatac

SEQ ID NO: 2433 - DNA, 21 bp, Artificial Sequence
  Description of Artificial Sequence: Synthetic oligonucleotide
tatacaagtagatcctgagaa

SEQ ID NO: 2434 - DNA, 21 bp, Artificial Sequence
  Description of Artificial Sequence: Synthetic oligonucleotide
ctcaggatctacttgtatata

SEQ ID NO: 2435 - DNA, 21 bp, Artificial Sequence
  Description of Artificial Sequence: Synthetic oligonucleotide
atacaagtagatcctgagaag

SEQ ID NO: 2436 - DNA, 21 bp, Artificial Sequence
  Description of Artificial Sequence: Synthetic oligonucleotide
tctcaggatctacttgtatat

SEQ ID NO: 2437 - DNA, 21 bp, Artificial Sequence
  Description of Artificial Sequence: Synthetic oligonucleotide
tacaagtagatcctgagaagt

SEQ ID NO: 2438 - DNA, 21 bp, Artificial Sequence
  Description of Artificial Sequence: Synthetic oligonucleotide
ttctcaggatctacttgtata

SEQ ID NO: 2439 - DNA, 21 bp, Artificial Sequence
  Description of Artificial Sequence: Synthetic oligonucleotide
acaagtagatcctgagaagta

SEQ ID NO: 2440 - DNA, 21 bp, Artificial Sequence
  Description of Artificial Sequence: Synthetic oligonucleotide
cttctcaggatctacttgtat

SEQ ID NO: 2441 - DNA, 21 bp, Artificial Sequence
  Description of Artificial Sequence: Synthetic oligonucleotide
caagtagatcctgagaagtac

SEQ ID NO: 2442 - DNA, 21 bp, Artificial Sequence
  Description of Artificial Sequence: Synthetic oligonucleotide
acttctcaggatctacttgta

SEQ ID NO: 2443 - DNA, 21 bp, Artificial Sequence
  Description of Artificial Sequence: Synthetic oligonucleotide
aagtagatcctgagaagtacc

SEQ ID NO: 2444 - DNA, 21 bp, Artificial Sequence
  Description of Artificial Sequence: Synthetic oligonucleotide
tacttctcaggatctacttgt

SEQ ID NO: 2445 - DNA, 21 bp, Artificial Sequence
  Description of Artificial Sequence: Synthetic oligonucleotide
agtagatcctgagaagtacct

SEQ ID NO: 2446 - DNA, 21 bp, Artificial Sequence
  Description of Artificial Sequence: Synthetic oligonucleotide
gtacttctcaggatctacttg

SEQ ID NO: 2447 - DNA, 21 bp, Artificial Sequence
  Description of Artificial Sequence: Synthetic oligonucleotide
gtagatcctgagaagtacctt

SEQ ID NO: 2448 - DNA, 21 bp, Artificial Sequence
  Description of Artificial Sequence: Synthetic oligonucleotide
ggtacttctcaggatctactt

SEQ ID NO: 2449 - DNA, 21 bp, Artificial Sequence
  Description of Artificial Sequence: Synthetic oligonucleotide
tagatcctgagaagtaccttt

SEQ ID NO: 2450 - DNA, 21 bp, Artificial Sequence
  Description of Artificial Sequence: Synthetic oligonucleotide
aggtacttctcaggatctact

SEQ ID NO: 2451 - DNA, 21 bp, Artificial Sequence
  Description of Artificial Sequence: Synthetic oligonucleotide
agatcctgagaagtacctttg

SEQ ID NO: 2452 - DNA, 21 bp, Artificial Sequence
  Description of Artificial Sequence: Synthetic oligonucleotide
aaggtacttctcaggatctac

SEQ ID NO: 2453 - DNA, 21 bp, Artificial Sequence
  Description of Artificial Sequence: Synthetic oligonucleotide
gatcctgagaagtacctttgt

SEQ ID NO: 2454 - DNA, 21 bp, Artificial Sequence
  Description of Artificial Sequence: Synthetic oligonucleotide
aaaggtacttctcaggatcta

SEQ ID NO: 2455 - DNA, 21 bp, Artificial Sequence
  Description of Artificial Sequence: Synthetic oligonucleotide
atcctgagaagtacctttgtt

SEQ ID NO: 2456 - DNA, 21 bp, Artificial Sequence
  Description of Artificial Sequence: Synthetic oligonucleotide
caaaggtacttctcaggatct

SEQ ID NO: 2457 - DNA, 21 bp, Artificial Sequence
  Description of Artificial Sequence: Synthetic oligonucleotide
tcctgagaagtacctttgtta

SEQ ID NO: 2458 - DNA, 21 bp, Artificial Sequence
  Description of Artificial Sequence: Synthetic oligonucleotide
acaaaggtacttctcaggatc

SEQ ID NO: 2459 - DNA, 21 bp, Artificial Sequence
  Description of Artificial Sequence: Synthetic oligonucleotide
cctgagaagtacctttgttac

SEQ ID NO: 2460 - DNA, 21 bp, Artificial Sequence
  Description of Artificial Sequence: Synthetic oligonucleotide
aacaaaggtacttctcaggat

SEQ ID NO: 2461 - DNA, 21 bp, Artificial Sequence
  Description of Artificial Sequence: Synthetic oligonucleotide
ctgagaagtacctttgttaca

SEQ ID NO: 2462 - DNA, 21 bp, Artificial Sequence
  Description of Artificial Sequence: Synthetic oligonucleotide
taacaaaggtacttctcagga

SEQ ID NO: 2463 - DNA, 21 bp, Artificial Sequence
  Description of Artificial Sequence: Synthetic oligonucleotide
tgagaagtacctttgttacag

SEQ ID NO: 2464 - DNA, 21 bp, Artificial Sequence
  Description of Artificial Sequence: Synthetic oligonucleotide
gtaacaaaggtacttctcagg

SEQ ID NO: 2465 - DNA, 21 bp, Artificial Sequence
  Description of Artificial Sequence: Synthetic oligonucleotide
gagaagtacctttgttacagc

SEQ ID NO: 2466 - DNA, 21 bp, Artificial Sequence
  Description of Artificial Sequence: Synthetic oligonucleotide
tgtaacaaaggtacttctcag

SEQ ID NO: 2467 - DNA, 21 bp, Artificial Sequence
  Description of Artificial Sequence: Synthetic oligonucleotide
agaagtacctttgttacagct

SEQ ID NO: 2468 - DNA, 21 bp, Artificial Sequence
  Description of Artificial Sequence: Synthetic oligonucleotide
ctgtaacaaaggtacttctca

SEQ ID NO: 2469 - DNA, 21 bp, Artificial Sequence
  Description of Artificial Sequence: Synthetic oligonucleotide
gaagtacctttgttacagcta

SEQ ID NO: 2470 - DNA, 21 bp, Artificial Sequence
  Description of Artificial Sequence: Synthetic oligonucleotide
gctgtaacaaaggtacttctc

SEQ ID NO: 2471 - DNA, 21 bp, Artificial Sequence
  Description of Artificial Sequence: Synthetic oligonucleotide
aagtacctttgttacagctac

SEQ ID NO: 2472 - DNA, 21 bp, Artificial Sequence
  Description of Artificial Sequence: Synthetic oligonucleotide
agctgtaacaaaggtacttct

SEQ ID NO: 2473 - DNA, 21 bp, Artificial Sequence
  Description of Artificial Sequence: Synthetic oligonucleotide
agtacctttgttacagctact

SEQ ID NO: 2474 - DNA, 21 bp, Artificial Sequence
  Description of Artificial Sequence: Synthetic oligonucleotide
tagctgtaacaaaggtacttc

SEQ ID NO: 2475 - DNA, 21 bp, Artificial Sequence
  Description of Artificial Sequence: Synthetic oligonucleotide
gtacctttgttacagctacta

SEQ ID NO: 2476 - DNA, 21 bp, Artificial Sequence
  Description of Artificial Sequence: Synthetic oligonucleotide
gtagctgtaacaaaggtactt

SEQ ID NO: 2477 - DNA, 21 bp, Artificial Sequence
  Description of Artificial Sequence: Synthetic oligonucleotide
tacctttgttacagctactat

SEQ ID NO: 2478 - DNA, 21 bp, Artificial Sequence
  Description of Artificial Sequence: Synthetic oligonucleotide
agtagctgtaacaaaggtact

SEQ ID NO: 2479 - DNA, 21 bp, Artificial Sequence
  Description of Artificial Sequence: Synthetic oligonucleotide
acctttgttacagctactata

SEQ ID NO: 2480 - DNA, 21 bp, Artificial Sequence
  Description of Artificial Sequence: Synthetic oligonucleotide
tagtagctgtaacaaaggtac

SEQ ID NO: 2481 - DNA, 21 bp, Artificial Sequence
  Description of Artificial Sequence: Synthetic oligonucleotide
cctttgttacagctactataa

SEQ ID NO: 2482 - DNA, 21 bp, Artificial Sequence
  Description of Artificial Sequence: Synthetic oligonucleotide
atagtagctgtaacaaaggta

SEQ ID NO: 2483 - DNA, 21 bp, Artificial Sequence
  Description of Artificial Sequence: Synthetic oligonucleotide
ctttgttacagctactataaa

SEQ ID NO: 2484 - DNA, 21 bp, Artificial Sequence
  Description of Artificial Sequence: Synthetic oligonucleotide
tatagtagctgtaacaaaggt

SEQ ID NO: 2485 - DNA, 21 bp, Artificial Sequence
  Description of Artificial Sequence: Synthetic oligonucleotide
tttgttacagctactataaat

SEQ ID NO: 2486 - DNA, 21 bp, Artificial Sequence
  Description of Artificial Sequence: Synthetic oligonucleotide
ttatagtagctgtaacaaagg

SEQ ID NO: 2487 - DNA, 21 bp, Artificial Sequence
  Description of Artificial Sequence: Synthetic oligonucleotide
ttgttacagctactataaata

SEQ ID NO: 2488 - DNA, 21 bp, Artificial Sequence
  Description of Artificial Sequence: Synthetic oligonucleotide
tttatagtagctgtaacaaag

SEQ ID NO: 2489 - DNA, 21 bp, Artificial Sequence
  Description of Artificial Sequence: Synthetic oligonucleotide
tgttacagctactataaatat

SEQ ID NO: 2490 - DNA, 21 bp, Artificial Sequence
  Description of Artificial Sequence: Synthetic oligonucleotide
atttatagtagctgtaacaaa

SEQ ID NO: 2491 - DNA, 21 bp, Artificial Sequence
  Description of Artificial Sequence: Synthetic oligonucleotide
gttacagctactataaatata

SEQ ID NO: 2492 - DNA, 21 bp, Artificial Sequence
  Description of Artificial Sequence: Synthetic oligonucleotide
tatttatagtagctgtaacaa

SEQ ID NO: 2493 - DNA, 21 bp, Artificial Sequence
  Description of Artificial Sequence: Synthetic oligonucleotide
ttacagctactataaatatac

SEQ ID NO: 2494 - DNA, 21 bp, Artificial Sequence
  Description of Artificial Sequence: Synthetic oligonucleotide
atatttatagtagctgtaaca

SEQ ID NO: 2495 - DNA, 21 bp, Artificial Sequence
  Description of Artificial Sequence: Synthetic oligonucleotide
tacagctactataaatataca

SEQ ID NO: 2496 - DNA, 21 bp, Artificial Sequence
  Description of Artificial Sequence: Synthetic oligonucleotide
tatatttatagtagctgtaac

SEQ ID NO: 2497 - DNA, 21 bp, Artificial Sequence
  Description of Artificial Sequence: Synthetic oligonucleotide
acagctactataaatatacat

SEQ ID NO: 2498 - DNA, 21 bp, Artificial Sequence
  Description of Artificial Sequence: Synthetic oligonucleotide
gtatatttatagtagctgtaa

SEQ ID NO: 2499 - DNA, 21 bp, Artificial Sequence
  Description of Artificial Sequence: Synthetic oligonucleotide
cagctactataaatatacata

SEQ ID NO: 2500 - DNA, 21 bp, Artificial Sequence
  Description of Artificial Sequence: Synthetic oligonucleotide
tgtatatttatagtagctgta

SEQ ID NO: 2501 - DNA, 21 bp, Artificial Sequence
  Description of Artificial Sequence: Synthetic oligonucleotide
agctactataaatatacatat

SEQ ID NO: 2502 - DNA, 21 bp, Artificial Sequence
  Description of Artificial Sequence: Synthetic oligonucleotide
atgtatatttatagtagctgt

SEQ ID NO: 2503 - DNA, 21 bp, Artificial Sequence
  Description of Artificial Sequence: Synthetic oligonucleotide
gctactataaatatacatata

SEQ ID NO: 2504 - DNA, 21 bp, Artificial Sequence
  Description of Artificial Sequence: Synthetic oligonucleotide
tatgtatatttatagtagctg

SEQ ID NO: 2505 - DNA, 21 bp, Artificial Sequence
  Description of Artificial Sequence: Synthetic oligonucleotide
ctactataaatatacatataa

SEQ ID NO: 2506 - DNA, 21 bp, Artificial Sequence
  Description of Artificial Sequence: Synthetic oligonucleotide
atatgtatatttatagtagct

SEQ ID NO: 2507 - DNA, 21 bp, Artificial Sequence
  Description of Artificial Sequence: Synthetic oligonucleotide
tactataaatatacatataaa

SEQ ID NO: 2508 - DNA, 21 bp, Artificial Sequence
  Description of Artificial Sequence: Synthetic oligonucleotide
tatatgtatatttatagtagc

SEQ ID NO: 2509 - DNA, 21 bp, Artificial Sequence
  Description of Artificial Sequence: Synthetic oligonucleotide
actataaatatacatataaat

SEQ ID NO: 2510 - DNA, 21 bp, Artificial Sequence
  Description of Artificial Sequence: Synthetic oligonucleotide
ttatatgtatatttatagtag

SEQ ID NO: 2511 - DNA, 21 bp, Artificial Sequence
  Description of Artificial Sequence: Synthetic oligonucleotide
ctataaatatacatataaatt

SEQ ID NO: 2512 - DNA, 21 bp, Artificial Sequence
  Description of Artificial Sequence: Synthetic oligonucleotide
tttatatgtatatttatagta

SEQ ID NO: 2513 - DNA, 21 bp, Artificial Sequence
  Description of Artificial Sequence: Synthetic oligonucleotide
tataaatatacatataaatta

SEQ ID NO: 2514 - DNA, 21 bp, Artificial Sequence
  Description of Artificial Sequence: Synthetic oligonucleotide
atttatatgtatatttatagt

SEQ ID NO: 2515 - DNA, 21 bp, Artificial Sequence
  Description of Artificial Sequence: Synthetic oligonucleotide
ataaatatacatataaattat

SEQ ID NO: 2516 - DNA, 21 bp, Artificial Sequence
  Description of Artificial Sequence: Synthetic oligonucleotide
aatttatatgtatatttatag

SEQ ID NO: 2517 - DNA, 21 bp, Artificial Sequence
  Description of Artificial Sequence: Synthetic oligonucleotide
taaatatacatataaattata

SEQ ID NO: 2518 - DNA, 21 bp, Artificial Sequence
  Description of Artificial Sequence: Synthetic oligonucleotide
taatttatatgtatatttata

SEQ ID NO: 2519 - DNA, 21 bp, Artificial Sequence
  Description of Artificial Sequence: Synthetic oligonucleotide
aaatatacatataaattatag

SEQ ID NO: 2520 - DNA, 21 bp, Artificial Sequence
  Description of Artificial Sequence: Synthetic oligonucleotide
ataatttatatgtatatttat

SEQ ID NO: 2521 - DNA, 21 bp, Artificial Sequence
  Description of Artificial Sequence: Synthetic oligonucleotide
aatatacatataaattataga

SEQ ID NO: 2522 - DNA, 21 bp, Artificial Sequence
  Description of Artificial Sequence: Synthetic oligonucleotide
tataatttatatgtatattta

SEQ ID NO: 2523 - DNA, 21 bp, Artificial Sequence
  Description of Artificial Sequence: Synthetic oligonucleotide
atatacatataaattatagaa

SEQ ID NO: 2524 - DNA, 21 bp, Artificial Sequence
  Description of Artificial Sequence: Synthetic oligonucleotide
ctataatttatatgtatattt

SEQ ID NO: 2525 - DNA, 21 bp, Artificial Sequence
  Description of Artificial Sequence: Synthetic oligonucleotide
tatacatataaattatagaat

SEQ ID NO: 2526 - DNA, 21 bp, Artificial Sequence
  Description of Artificial Sequence: Synthetic oligonucleotide
tctataatttatatgtatatt

SEQ ID NO: 2527 - DNA, 21 bp, Artificial Sequence
  Description of Artificial Sequence: Synthetic oligonucleotide
atacatataaattatagaatc

SEQ ID NO: 2528 - DNA, 21 bp, Artificial Sequence
  Description of Artificial Sequence: Synthetic oligonucleotide
ttctataatttatatgtatat

SEQ ID NO: 2529 - DNA, 21 bp, Artificial Sequence
  Description of Artificial Sequence: Synthetic oligonucleotide
tacatataaattatagaatct

SEQ ID NO: 2530 - DNA, 21 bp, Artificial Sequence
  Description of Artificial Sequence: Synthetic oligonucleotide
attctataatttatatgtata

SEQ ID NO: 2531 - DNA, 21 bp, Artificial Sequence
  Description of Artificial Sequence: Synthetic oligonucleotide
acatataaattatagaatcta

SEQ ID NO: 2532 - DNA, 21 bp, Artificial Sequence
  Description of Artificial Sequence: Synthetic oligonucleotide
gattctataatttatatgtat

SEQ ID NO: 2533 - DNA, 21 bp, Artificial Sequence
  Description of Artificial Sequence: Synthetic oligonucleotide
catataaattatagaatctac

SEQ ID NO: 2534 - DNA, 21 bp, Artificial Sequence
  Description of Artificial Sequence: Synthetic oligonucleotide
agattctataatttatatgta

SEQ ID NO: 2535 - DNA, 21 bp, Artificial Sequence
  Description of Artificial Sequence: Synthetic oligonucleotide
atataaattatagaatctact

SEQ ID NO: 2536 - DNA, 21 bp, Artificial Sequence
  Description of Artificial Sequence: Synthetic oligonucleotide
tagattctataatttatatgt

SEQ ID NO: 2537 - DNA, 21 bp, Artificial Sequence
  Description of Artificial Sequence: Synthetic oligonucleotide
tataaattatagaatctactt

SEQ ID NO: 2538 - DNA, 21 bp, Artificial Sequence
  Description of Artificial Sequence: Synthetic oligonucleotide
gtagattctataatttatatg

SEQ ID NO: 2539 - DNA, 21 bp, Artificial Sequence
  Description of Artificial Sequence: Synthetic oligonucleotide
ataaattatagaatctacttt

SEQ ID NO: 2540 - DNA, 21 bp, Artificial Sequence
  Description of Artificial Sequence: Synthetic oligonucleotide
agtagattctataatttatat

SEQ ID NO: 2541 - DNA, 21 bp, Artificial Sequence
  Description of Artificial Sequence: Synthetic oligonucleotide
taaattatagaatctacttta

SEQ ID NO: 2542 - DNA, 21 bp, Artificial Sequence
  Description of Artificial Sequence: Synthetic oligonucleotide
aagtagattctataatttata

SEQ ID NO: 2543 - DNA, 21 bp, Artificial Sequence
  Description of Artificial Sequence: Synthetic oligonucleotide
aaattatagaatctactttaa

SEQ ID NO: 2544 - DNA, 21 bp, Artificial Sequence
  Description of Artificial Sequence: Synthetic oligonucleotide
aaagtagattctataatttat

SEQ ID NO: 2545 - DNA, 21 bp, Artificial Sequence
  Description of Artificial Sequence: Synthetic oligonucleotide
aattatagaatctactttaat

SEQ ID NO: 2546 - DNA, 21 bp, Artificial Sequence
  Description of Artificial Sequence: Synthetic oligonucleotide
taaagtagattctataattta

SEQ ID NO: 2547 - DNA, 21 bp, Artificial Sequence
  Description of Artificial Sequence: Synthetic oligonucleotide
attatagaatctactttaatt

SEQ ID NO: 2548 - DNA, 21 bp, Artificial Sequence
  Description of Artificial Sequence: Synthetic oligonucleotide
ttaaagtagattctataattt

SEQ ID NO: 2549 - DNA, 21 bp, Artificial Sequence
  Description of Artificial Sequence: Synthetic oligonucleotide
ttatagaatctactttaattt

SEQ ID NO: 2550 - DNA, 21 bp, Artificial Sequence
  Description of Artificial Sequence: Synthetic oligonucleotide
attaaagtagattctataatt

SEQ ID NO: 2551 - DNA, 21 bp, Artificial Sequence
  Description of Artificial Sequence: Synthetic oligonucleotide
tatagaatctactttaattta

SEQ ID NO: 2552 - DNA, 21 bp, Artificial Sequence
  Description of Artificial Sequence: Synthetic oligonucleotide
aattaaagtagattctataat

SEQ ID NO: 2553 - DNA, 21 bp, Artificial Sequence
  Description of Artificial Sequence: Synthetic oligonucleotide
atagaatctactttaatttat

SEQ ID NO: 2554 - DNA, 21 bp, Artificial Sequence
  Description of Artificial Sequence: Synthetic oligonucleotide
aaattaaagtagattctataa

SEQ ID NO: 2555 - DNA, 21 bp, Artificial Sequence
  Description of Artificial Sequence: Synthetic oligonucleotide
tagaatctactttaatttatt

SEQ ID NO: 2556 - DNA, 21 bp, Artificial Sequence
  Description of Artificial Sequence: Synthetic oligonucleotide
taaattaaagtagattctata

SEQ ID NO: 2557 - DNA, 21 bp, Artificial Sequence
  Description of Artificial Sequence: Synthetic oligonucleotide
agaatctactttaatttattt

SEQ ID NO: 2558 - DNA, 21 bp, Artificial Sequence
  Description of Artificial Sequence: Synthetic oligonucleotide
ataaattaaagtagattctat

SEQ ID NO: 2559 - DNA, 21 bp, Artificial Sequence
  Description of Artificial Sequence: Synthetic oligonucleotide
gaatctactttaatttatttt

SEQ ID NO: 2560 - DNA, 21 bp, Artificial Sequence
  Description of Artificial Sequence: Synthetic oligonucleotide
aataaattaaagtagattcta

SEQ ID NO: 2561 - DNA, 21 bp, Artificial Sequence
  Description of Artificial Sequence: Synthetic oligonucleotide
aatctactttaatttattttg

SEQ ID NO: 2562 - DNA, 21 bp, Artificial Sequence
  Description of Artificial Sequence: Synthetic oligonucleotide
aaataaattaaagtagattct

SEQ ID NO: 2563 - DNA, 21 bp, Artificial Sequence
  Description of Artificial Sequence: Synthetic oligonucleotide
atctactttaatttattttgt

SEQ ID NO: 2564 - DNA, 21 bp, Artificial Sequence
  Description of Artificial Sequence: Synthetic oligonucleotide
aaaataaattaaagtagattc

SEQ ID NO: 2565 - DNA, 21 bp, Artificial Sequence
  Description of Artificial Sequence: Synthetic oligonucleotide
tctactttaatttattttgtg

SEQ ID NO: 2566 - DNA, 21 bp, Artificial Sequence
  Description of Artificial Sequence: Synthetic oligonucleotide
caaaataaattaaagtagatt

SEQ ID NO: 2567 - DNA, 21 bp, Artificial Sequence
  Description of Artificial Sequence: Synthetic oligonucleotide
ctactttaatttattttgtga

SEQ ID NO: 2568 - DNA, 21 bp, Artificial Sequence
  Description of Artificial Sequence: Synthetic oligonucleotide
acaaaataaattaaagtagat

SEQ ID NO: 2569 - DNA, 21 bp, Artificial Sequence
  Description of Artificial Sequence: Synthetic oligonucleotide
tactttaatttattttgtgaa

SEQ ID NO: 2570 - DNA, 21 bp, Artificial Sequence
  Description of Artificial Sequence: Synthetic oligonucleotide
cacaaaataaattaaagtaga

SEQ ID NO: 2571 - DNA, 21 bp, Artificial Sequence
  Description of Artificial Sequence: Synthetic oligonucleotide
actttaatttattttgtgaac

SEQ ID NO: 2572 - DNA, 21 bp, Artificial Sequence
  Description of Artificial Sequence: Synthetic oligonucleotide
tcacaaaataaattaaagtag

SEQ ID NO: 2573 - DNA, 21 bp, Artificial Sequence
  Description of Artificial Sequence: Synthetic oligonucleotide
ctttaatttattttgtgaaca

SEQ ID NO: 2574 - DNA, 21 bp, Artificial Sequence
  Description of Artificial Sequence: Synthetic oligonucleotide
ttcacaaaataaattaaagta

SEQ ID NO: 2575 - DNA, 21 bp, Artificial Sequence
  Description of Artificial Sequence: Synthetic oligonucleotide
tttaatttattttgtgaacac

SEQ ID NO: 2576 - DNA, 21 bp, Artificial Sequence
  Description of Artificial Sequence: Synthetic oligonucleotide
gttcacaaaataaattaaagt

SEQ ID NO: 2577 - DNA, 21 bp, Artificial Sequence
  Description of Artificial Sequence: Synthetic oligonucleotide
ttaatttattttgtgaacact

SEQ ID NO: 2578 - DNA, 21 bp, Artificial Sequence
  Description of Artificial Sequence: Synthetic oligonucleotide
tgttcacaaaataaattaaag

SEQ ID NO: 2579 - DNA, 21 bp, Artificial Sequence
  Description of Artificial Sequence: Synthetic oligonucleotide
taatttattttgtgaacactt

SEQ ID NO: 2580 - DNA, 21 bp, Artificial Sequence
  Description of Artificial Sequence: Synthetic oligonucleotide
gtgttcacaaaataaattaaa

SEQ ID NO: 2581 - DNA, 21 bp, Artificial Sequence
  Description of Artificial Sequence: Synthetic oligonucleotide
aatttattttgtgaacacttt

SEQ ID NO: 2582 - DNA, 21 bp, Artificial Sequence
  Description of Artificial Sequence: Synthetic oligonucleotide
agtgttcacaaaataaattaa

SEQ ID NO: 2583 - DNA, 21 bp, Artificial Sequence
  Description of Artificial Sequence: Synthetic oligonucleotide
atttattttgtgaacactttt

SEQ ID NO: 2584 - DNA, 21 bp, Artificial Sequence
  Description of Artificial Sequence: Synthetic oligonucleotide
aagtgttcacaaaataaatta

SEQ ID NO: 2585 - DNA, 21 bp, Artificial Sequence
  Description of Artificial Sequence: Synthetic oligonucleotide
tttattttgtgaacacttttg

SEQ ID NO: 2586 - DNA, 21 bp, Artificial Sequence
  Description of Artificial Sequence: Synthetic oligonucleotide
aaagtgttcacaaaataaatt

SEQ ID NO: 2587 - DNA, 21 bp, Artificial Sequence
  Description of Artificial Sequence: Synthetic oligonucleotide
ttattttgtgaacacttttga

SEQ ID NO: 2588 - DNA, 21 bp, Artificial Sequence
  Description of Artificial Sequence: Synthetic oligonucleotide
aaaagtgttcacaaaataaat

SEQ ID NO: 2589 - DNA, 21 bp, Artificial Sequence
  Description of Artificial Sequence: Synthetic oligonucleotide
tattttgtgaacacttttgaa

SEQ ID NO: 2590 - DNA, 21 bp, Artificial Sequence
  Description of Artificial Sequence: Synthetic oligonucleotide
caaaagtgttcacaaaataaa

SEQ ID NO: 2591 - DNA, 21 bp, Artificial Sequence
  Description of Artificial Sequence: Synthetic oligonucleotide
attttgtgaacacttttgaaa

SEQ ID NO: 2592 - DNA, 21 bp, Artificial Sequence
  Description of Artificial Sequence: Synthetic oligonucleotide
tcaaaagtgttcacaaaataa

SEQ ID NO: 2593 - DNA, 21 bp, Artificial Sequence
  Description of Artificial Sequence: Synthetic oligonucleotide
ttttgtgaacacttttgaaaa

SEQ ID NO: 2594 - DNA, 21 bp, Artificial Sequence
  Description of Artificial Sequence: Synthetic oligonucleotide
ttcaaaagtgttcacaaaata

SEQ ID NO: 2595 - DNA, 21 bp, Artificial Sequence
  Description of Artificial Sequence: Synthetic oligonucleotide
tttgtgaacacttttgaaaat

SEQ ID NO: 2596 - DNA, 21 bp, Artificial Sequence
  Description of Artificial Sequence: Synthetic oligonucleotide
tttcaaaagtgttcacaaaat

SEQ ID NO: 2597 - DNA, 21 bp, Artificial Sequence
  Description of Artificial Sequence: Synthetic oligonucleotide
ttgtgaacacttttgaaaatg

SEQ ID NO: 2598 - DNA, 21 bp, Artificial Sequence
  Description of Artificial Sequence: Synthetic oligonucleotide
ttttcaaaagtgttcacaaaa

SEQ ID NO: 2599 - DNA, 21 bp, Artificial Sequence
  Description of Artificial Sequence: Synthetic oligonucleotide
tgtgaacacttttgaaaatgt

SEQ ID NO: 2600 - DNA, 21 bp, Artificial Sequence
  Description of Artificial Sequence: Synthetic oligonucleotide
attttcaaaagtgttcacaaa

SEQ ID NO: 2601 - DNA, 21 bp, Artificial Sequence
  Description of Artificial Sequence: Synthetic oligonucleotide
gtgaacacttttgaaaatgta

SEQ ID NO: 2602 - DNA, 21 bp, Artificial Sequence
  Description of Artificial Sequence: Synthetic oligonucleotide
cattttcaaaagtgttcacaa

SEQ ID NO: 2603 - DNA, 21 bp, Artificial Sequence
  Description of Artificial Sequence: Synthetic oligonucleotide
tgaacacttttgaaaatgtac

SEQ ID NO: 2604 - DNA, 21 bp, Artificial Sequence
  Description of Artificial Sequence: Synthetic oligonucleotide
acattttcaaaagtgttcaca

SEQ ID NO: 2605 - DNA, 21 bp, Artificial Sequence
  Description of Artificial Sequence: Synthetic oligonucleotide
gaacacttttgaaaatgtaca

SEQ ID NO: 2606 - DNA, 21 bp, Artificial Sequence
  Description of Artificial Sequence: Synthetic oligonucleotide
tacattttcaaaagtgttcac

SEQ ID NO: 2607 - DNA, 21 bp, Artificial Sequence
  Description of Artificial Sequence: Synthetic oligonucleotide
aacacttttgaaaatgtacat

SEQ ID NO: 2608 - DNA, 21 bp, Artificial Sequence
  Description of Artificial Sequence: Synthetic oligonucleotide
gtacattttcaaaagtgttca

SEQ ID NO: 2609 - DNA, 21 bp, Artificial Sequence
  Description of Artificial Sequence: Synthetic oligonucleotide
acacttttgaaaatgtacatg

SEQ ID NO: 2610 - DNA, 21 bp, Artificial Sequence
  Description of Artificial Sequence: Synthetic oligonucleotide
tgtacattttcaaaagtgttc

SEQ ID NO: 2611 - DNA, 21 bp, Artificial Sequence
  Description of Artificial Sequence: Synthetic oligonucleotide
cacttttgaaaatgtacatgt

SEQ ID NO: 2612 - DNA, 21 bp, Artificial Sequence
  Description of Artificial Sequence: Synthetic oligonucleotide
atgtacattttcaaaagtgtt

SEQ ID NO: 2613 - DNA, 21 bp, Artificial Sequence
  Description of Artificial Sequence: Synthetic oligonucleotide
acttttgaaaatgtacatgtt

SEQ ID NO: 2614 - DNA, 21 bp, Artificial Sequence
  Description of Artificial Sequence: Synthetic oligonucleotide
catgtacattttcaaaagtgt

SEQ ID NO: 2615 - DNA, 21 bp, Artificial Sequence
  Description of Artificial Sequence: Synthetic oligonucleotide
cttttgaaaatgtacatgttc

SEQ ID NO: 2616 - DNA, 21 bp, Artificial Sequence
  Description of Artificial Sequence: Synthetic oligonucleotide
acatgtacattttcaaaagtg

SEQ ID NO: 2617 - DNA, 21 bp, Artificial Sequence
  Description of Artificial Sequence: Synthetic oligonucleotide
ttttgaaaatgtacatgttcc

SEQ ID NO: 2618 - DNA, 21 bp, Artificial Sequence
  Description of Artificial Sequence: Synthetic oligonucleotide
aacatgtacattttcaaaagt

SEQ ID NO: 2619 - DNA, 21 bp, Artificial Sequence
  Description of Artificial Sequence: Synthetic oligonucleotide
tttgaaaatgtacatgttcct

SEQ ID NO: 2620 - DNA, 21 bp, Artificial Sequence
  Description of Artificial Sequence: Synthetic oligonucleotide
gaacatgtacattttcaaaag

SEQ ID NO: 2621 - DNA, 21 bp, Artificial Sequence
  Description of Artificial Sequence: Synthetic oligonucleotide
ttgaaaatgtacatgttcctt

SEQ ID NO: 2622 - DNA, 21 bp, Artificial Sequence
  Description of Artificial Sequence: Synthetic oligonucleotide
ggaacatgtacattttcaaaa

SEQ ID NO: 2623 - DNA, 21 bp, Artificial Sequence
  Description of Artificial Sequence: Synthetic oligonucleotide
tgaaaatgtacatgttccttt

SEQ ID NO: 2624 - DNA, 21 bp, Artificial Sequence
  Description of Artificial Sequence: Synthetic oligonucleotide
aggaacatgtacattttcaaa

SEQ ID NO: 2625 - DNA, 21 bp, Artificial Sequence
  Description of Artificial Sequence: Synthetic oligonucleotide
gaaaatgtacatgttcctttg

SEQ ID NO: 2626 - DNA, 21 bp, Artificial Sequence
  Description of Artificial Sequence: Synthetic oligonucleotide
aaggaacatgtacattttcaa

SEQ ID NO: 2627 - DNA, 21 bp, Artificial Sequence
  Description of Artificial Sequence: Synthetic oligonucleotide
aaaatgtacatgttcctttgt

SEQ ID NO: 2628 - DNA, 21 bp, Artificial Sequence
  Description of Artificial Sequence: Synthetic oligonucleotide
aaaggaacatgtacattttca

SEQ ID NO: 2629 - DNA, 21 bp, Artificial Sequence
  Description of Artificial Sequence: Synthetic oligonucleotide
aaatgtacatgttcctttgta

SEQ ID NO: 2630 - DNA, 21 bp, Artificial Sequence
  Description of Artificial Sequence: Synthetic oligonucleotide
caaaggaacatgtacattttc

SEQ ID NO: 2631 - DNA, 21 bp, Artificial Sequence
  Description of Artificial Sequence: Synthetic oligonucleotide
aatgtacatgttcctttgtaa

SEQ ID NO: 2632 - DNA, 21 bp, Artificial Sequence
  Description of Artificial Sequence: Synthetic oligonucleotide
acaaaggaacatgtacatttt

SEQ ID NO: 2633 - DNA, 21 bp, Artificial Sequence
  Description of Artificial Sequence: Synthetic oligonucleotide
atgtacatgttcctttgtaat

SEQ ID NO: 2634 - DNA, 21 bp, Artificial Sequence
  Description of Artificial Sequence: Synthetic oligonucleotide
tacaaaggaacatgtacattt

SEQ ID NO: 2635 - DNA, 21 bp, Artificial Sequence
  Description of Artificial Sequence: Synthetic oligonucleotide
tgtacatgttcctttgtaatt

SEQ ID NO: 2636 - DNA, 21 bp, Artificial Sequence
  Description of Artificial Sequence: Synthetic oligonucleotide
ttacaaaggaacatgtacatt

SEQ ID NO: 2637 - DNA, 21 bp, Artificial Sequence
  Description of Artificial Sequence: Synthetic oligonucleotide
gtacatgttcctttgtaattg

SEQ ID NO: 2638 - DNA, 21 bp, Artificial Sequence
  Description of Artificial Sequence: Synthetic oligonucleotide
attacaaaggaacatgtacat

SEQ ID NO: 2639 - DNA, 21 bp, Artificial Sequence
  Description of Artificial Sequence: Synthetic oligonucleotide
tacatgttcctttgtaattga

SEQ ID NO: 2640 - DNA, 21 bp, Artificial Sequence
  Description of Artificial Sequence: Synthetic oligonucleotide
aattacaaaggaacatgtaca

SEQ ID NO: 2641 - DNA, 21 bp, Artificial Sequence
  Description of Artificial Sequence: Synthetic oligonucleotide
acatgttcctttgtaattgac

SEQ ID NO: 2642 - DNA, 21 bp, Artificial Sequence
  Description of Artificial Sequence: Synthetic oligonucleotide
caattacaaaggaacatgtac

SEQ ID NO: 2643 - DNA, 21 bp, Artificial Sequence
  Description of Artificial Sequence: Synthetic oligonucleotide
catgttcctttgtaattgaca

SEQ ID NO: 2644 - DNA, 21 bp, Artificial Sequence
  Description of Artificial Sequence: Synthetic oligonucleotide
tcaattacaaaggaacatgta

SEQ ID NO: 2645 - DNA, 21 bp, Artificial Sequence
  Description of Artificial Sequence: Synthetic oligonucleotide
atgttcctttgtaattgacac

SEQ ID NO: 2646 - DNA, 21 bp, Artificial Sequence
  Description of Artificial Sequence: Synthetic oligonucleotide
gtcaattacaaaggaacatgt

SEQ ID NO: 2647 - DNA, 21 bp, Artificial Sequence
  Description of Artificial Sequence: Synthetic oligonucleotide
tgttcctttgtaattgacact

SEQ ID NO: 2648 - DNA, 21 bp, Artificial Sequence
  Description of Artificial Sequence: Synthetic oligonucleotide
tgtcaattacaaaggaacatg

SEQ ID NO: 2649 - DNA, 21 bp, Artificial Sequence
  Description of Artificial Sequence: Synthetic oligonucleotide
gttcctttgtaattgacacta

SEQ ID NO: 2650 - DNA, 21 bp, Artificial Sequence
  Description of Artificial Sequence: Synthetic oligonucleotide
gtgtcaattacaaaggaacat

SEQ ID NO: 2651 - DNA, 21 bp, Artificial Sequence
  Description of Artificial Sequence: Synthetic oligonucleotide
ttcctttgtaattgacactat

SEQ ID NO: 2652 - DNA, 21 bp, Artificial Sequence
  Description of Artificial Sequence: Synthetic oligonucleotide
agtgtcaattacaaaggaaca

SEQ ID NO: 2653 - DNA, 21 bp, Artificial Sequence
  Description of Artificial Sequence: Synthetic oligonucleotide
tcctttgtaattgacactata

SEQ ID NO: 2654 - DNA, 21 bp, Artificial Sequence
  Description of Artificial Sequence: Synthetic oligonucleotide
tagtgtcaattacaaaggaac

SEQ ID NO: 2655 - DNA, 21 bp, Artificial Sequence
  Description of Artificial Sequence: Synthetic oligonucleotide
cctttgtaattgacactatat

SEQ ID NO: 2656 - DNA, 21 bp, Artificial Sequence
  Description of Artificial Sequence: Synthetic oligonucleotide
atagtgtcaattacaaaggaa

SEQ ID NO: 2657 - DNA, 21 bp, Artificial Sequence
  Description of Artificial Sequence: Synthetic oligonucleotide
ctttgtaattgacactatata

SEQ ID NO: 2658 - DNA, 21 bp, Artificial Sequence
  Description of Artificial Sequence: Synthetic oligonucleotide
tatagtgtcaattacaaagga

SEQ ID NO: 2659 - DNA, 21 bp, Artificial Sequence
  Description of Artificial Sequence: Synthetic oligonucleotide
tttgtaattgacactatatat

SEQ ID NO: 2660 - DNA, 21 bp, Artificial Sequence
  Description of Artificial Sequence: Synthetic oligonucleotide
atatagtgtcaattacaaagg

SEQ ID NO: 2661 - DNA, 21 bp, Artificial Sequence
  Description of Artificial Sequence: Synthetic oligonucleotide
ttgtaattgacactatatatt

SEQ ID NO: 2662 - DNA, 21 bp, Artificial Sequence
  Description of Artificial Sequence: Synthetic oligonucleotide
tatatagtgtcaattacaaag

SEQ ID NO: 2663 - DNA, 21 bp, Artificial Sequence
  Description of Artificial Sequence: Synthetic oligonucleotide
tgtaattgacactatatattt

SEQ ID NO: 2664 - DNA, 21 bp, Artificial Sequence
  Description of Artificial Sequence: Synthetic oligonucleotide
atatatagtgtcaattacaaa

SEQ ID NO: 2665 - DNA, 21 bp, Artificial Sequence
  Description of Artificial Sequence: Synthetic oligonucleotide
gtaattgacactatatatttc

SEQ ID NO: 2666 - DNA, 21 bp, Artificial Sequence
  Description of Artificial Sequence: Synthetic oligonucleotide
aatatatagtgtcaattacaa

SEQ ID NO: 2667 - DNA, 21 bp, Artificial Sequence
  Description of Artificial Sequence: Synthetic oligonucleotide
taattgacactatatatttct

SEQ ID NO: 2668 - DNA, 21 bp, Artificial Sequence
  Description of Artificial Sequence: Synthetic oligonucleotide
aaatatatagtgtcaattaca

SEQ ID NO: 2669 - DNA, 21 bp, Artificial Sequence
  Description of Artificial Sequence: Synthetic oligonucleotide
aattgacactatatatttctt

SEQ ID NO: 2670 - DNA, 21 bp, Artificial Sequence
  Description of Artificial Sequence: Synthetic oligonucleotide
gaaatatatagtgtcaattac

SEQ ID NO: 2671 - DNA, 21 bp, Artificial Sequence
  Description of Artificial Sequence: Synthetic oligonucleotide
attgacactatatatttctta

SEQ ID NO: 2672 - DNA, 21 bp, Artificial Sequence
  Description of Artificial Sequence: Synthetic oligonucleotide
agaaatatatagtgtcaatta

SEQ ID NO: 2673 - DNA, 21 bp, Artificial Sequence
  Description of Artificial Sequence: Synthetic oligonucleotide
ttgacactatatatttcttaa

SEQ ID NO: 2674 - DNA, 21 bp, Artificial Sequence
  Description of Artificial Sequence: Synthetic oligonucleotide
aagaaatatatagtgtcaatt

SEQ ID NO: 2675 - DNA, 21 bp, Artificial Sequence
  Description of Artificial Sequence: Synthetic oligonucleotide
tgacactatatatttcttaat

SEQ ID NO: 2676 - DNA, 21 bp, Artificial Sequence
  Description of Artificial Sequence: Synthetic oligonucleotide
taagaaatatatagtgtcaat

SEQ ID NO: 2677 - DNA, 21 bp, Artificial Sequence
  Description of Artificial Sequence: Synthetic oligonucleotide
gacactatatatttcttaata

SEQ ID NO: 2678 - DNA, 21 bp, Artificial Sequence
  Description of Artificial Sequence: Synthetic oligonucleotide
ttaagaaatatatagtgtcaa

SEQ ID NO: 2679 - DNA, 21 bp, Artificial Sequence
  Description of Artificial Sequence: Synthetic oligonucleotide
acactatatatttcttaataa

SEQ ID NO: 2680 - DNA, 21 bp, Artificial Sequence
  Description of Artificial Sequence: Synthetic oligonucleotide
attaagaaatatatagtgtca

SEQ ID NO: 2681 - DNA, 21 bp, Artificial Sequence
  Description of Artificial Sequence: Synthetic oligonucleotide
cactatatatttcttaataaa

SEQ ID NO: 2682 - DNA, 21 bp, Artificial Sequence
  Description of Artificial Sequence: Synthetic oligonucleotide
tattaagaaatatatagtgtc

SEQ ID NO: 2683 - DNA, 21 bp, Artificial Sequence
  Description of Artificial Sequence: Synthetic oligonucleotide
actatatatttcttaataaaa

SEQ ID NO: 2684 - DNA, 21 bp, Artificial Sequence
  Description of Artificial Sequence: Synthetic oligonucleotide
ttattaagaaatatatagtgt

SEQ ID NO: 2685 - DNA, 21 bp, Artificial Sequence
  Description of Artificial Sequence: Synthetic oligonucleotide
ctatatatttcttaataaaat

SEQ ID NO: 2686 - DNA, 21 bp, Artificial Sequence
  Description of Artificial Sequence: Synthetic oligonucleotide
tttattaagaaatatatagtg

SEQ ID NO: 2687 - DNA, 21 bp, Artificial Sequence
  Description of Artificial Sequence: Synthetic oligonucleotide
tatatatttcttaataaaata

SEQ ID NO: 2688 - DNA, 21 bp, Artificial Sequence
  Description of Artificial Sequence: Synthetic oligonucleotide
ttttattaagaaatatatagt

SEQ ID NO: 2689 - DNA, 21 bp, Artificial Sequence
  Description of Artificial Sequence: Synthetic oligonucleotide
atatatttcttaataaaataa

SEQ ID NO: 2690 - DNA, 21 bp, Artificial Sequence
  Description of Artificial Sequence: Synthetic oligonucleotide
attttattaagaaatatatag

SEQ ID NO: 2691 - DNA, 21 bp, Artificial Sequence
  Description of Artificial Sequence: Synthetic oligonucleotide
tatatttcttaataaaataat

SEQ ID NO: 2692 - DNA, 21 bp, Artificial Sequence
  Description of Artificial Sequence: Synthetic oligonucleotide
tattttattaagaaatatata

SEQ ID NO: 2693 - DNA, 21 bp, Artificial Sequence
  Description of Artificial Sequence: Synthetic oligonucleotide
atatttcttaataaaataatt

SEQ ID NO: 2694 - DNA, 21 bp, Artificial Sequence
  Description of Artificial Sequence: Synthetic oligonucleotide
ttattttattaagaaatatat

SEQ ID NO: 2695 - DNA, 21 bp, Artificial Sequence
  Description of Artificial Sequence: Synthetic oligonucleotide
tatttcttaataaaataattc

SEQ ID NO: 2696 - DNA, 21 bp, Artificial Sequence
  Description of Artificial Sequence: Synthetic oligonucleotide
attattttattaagaaatata

SEQ ID NO: 2697 - DNA, 21 bp, Artificial Sequence
  Description of Artificial Sequence: Synthetic oligonucleotide
atttcttaataaaataattct

SEQ ID NO: 2698 - DNA, 21 bp, Artificial Sequence
  Description of Artificial Sequence: Synthetic oligonucleotide
aattattttattaagaaatat

SEQ ID NO: 2699 - DNA, 21 bp, Artificial Sequence
  Description of Artificial Sequence: Synthetic oligonucleotide
tttcttaataaaataattctc

SEQ ID NO: 2700 - DNA, 21 bp, Artificial Sequence
  Description of Artificial Sequence: Synthetic oligonucleotide
gaattattttattaagaaata

SEQ ID NO: 2701 - DNA, 21 bp, Artificial Sequence
  Description of Artificial Sequence: Synthetic oligonucleotide
ttcttaataaaataattctca

SEQ ID NO: 2702 - DNA, 21 bp, Artificial Sequence
  Description of Artificial Sequence: Synthetic oligonucleotide
agaattattttattaagaaat

SEQ ID NO: 2703 - DNA, 21 bp, Artificial Sequence
  Description of Artificial Sequence: Synthetic oligonucleotide
tcttaataaaataattctcaa

SEQ ID NO: 2704 - DNA, 21 bp, Artificial Sequence
  Description of Artificial Sequence: Synthetic oligonucleotide
gagaattattttattaagaaa

SEQ ID NO: 2705 - DNA, 21 bp, Artificial Sequence
  Description of Artificial Sequence: Synthetic oligonucleotide
cttaataaaataattctcaaa

SEQ ID NO: 2706 - DNA, 21 bp, Artificial Sequence
  Description of Artificial Sequence: Synthetic oligonucleotide
tgagaattattttattaagaa

SEQ ID NO: 2707 - DNA, 21 bp, Artificial Sequence
  Description of Artificial Sequence: Synthetic oligonucleotide
ttaataaaataattctcaaat

SEQ ID NO: 2708 - DNA, 21 bp, Artificial Sequence
  Description of Artificial Sequence: Synthetic oligonucleotide
ttgagaattattttattaaga

SEQ ID NO: 2709 - DNA, 21 bp, Artificial Sequence
  Description of Artificial Sequence: Synthetic oligonucleotide
taataaaataattctcaaatt

SEQ ID NO: 2710 - DNA, 21 bp, Artificial Sequence
  Description of Artificial Sequence: Synthetic oligonucleotide
tttgagaattattttattaag

SEQ ID NO: 2711 - DNA, 21 bp, Artificial Sequence
  Description of Artificial Sequence: Synthetic oligonucleotide
aataaaataattctcaaattt

SEQ ID NO: 2712 - DNA, 21 bp, Artificial Sequence
  Description of Artificial Sequence: Synthetic oligonucleotide
atttgagaattattttattaa

SEQ ID NO: 2713 - DNA, 21 bp, Artificial Sequence
  Description of Artificial Sequence: Synthetic oligonucleotide
ataaaataattctcaaatttg

SEQ ID NO: 2714 - DNA, 21 bp, Artificial Sequence
  Description of Artificial Sequence: Synthetic oligonucleotide
aatttgagaattattttatta

SEQ ID NO: 2715 - DNA, 21 bp, Artificial Sequence
  Description of Artificial Sequence: Synthetic oligonucleotide
taaaataattctcaaatttgt

SEQ ID NO: 2716 - DNA, 21 bp, Artificial Sequence
  Description of Artificial Sequence: Synthetic oligonucleotide
aaatttgagaattattttatt

SEQ ID NO: 2717 - DNA, 21 bp, Artificial Sequence
  Description of Artificial Sequence: Synthetic oligonucleotide
aaaataattctcaaatttgtt

SEQ ID NO: 2718 - DNA, 21 bp, Artificial Sequence
  Description of Artificial Sequence: Synthetic oligonucleotide
caaatttgagaattattttat

SEQ ID NO: 2719 - DNA, 21 bp, Artificial Sequence
  Description of Artificial Sequence: Synthetic oligonucleotide
aaataattctcaaatttgttt

SEQ ID NO: 2720 - DNA, 21 bp, Artificial Sequence
  Description of Artificial Sequence: Synthetic oligonucleotide
acaaatttgagaattatttta

SEQ ID NO: 2721 - DNA, 21 bp, Artificial Sequence
  Description of Artificial Sequence: Synthetic oligonucleotide
aataattctcaaatttgtttc

SEQ ID NO: 2722 - DNA, 21 bp, Artificial Sequence
  Description of Artificial Sequence: Synthetic oligonucleotide
aacaaatttgagaattatttt

SEQ ID NO: 2723 - DNA, 21 bp, Artificial Sequence
  Description of Artificial Sequence: Synthetic oligonucleotide
ataattctcaaatttgtttct

SEQ ID NO: 2724 - DNA, 21 bp, Artificial Sequence
  Description of Artificial Sequence: Synthetic oligonucleotide
aaacaaatttgagaattattt

SEQ ID NO: 2725 - DNA, 21 bp, Artificial Sequence
  Description of Artificial Sequence: Synthetic oligonucleotide
taattctcaaatttgtttctt

SEQ ID NO: 2726 - DNA, 21 bp, Artificial Sequence
  Description of Artificial Sequence: Synthetic oligonucleotide
gaaacaaatttgagaattatt

SEQ ID NO: 2727 - DNA, 21 bp, Artificial Sequence
  Description of Artificial Sequence: Synthetic oligonucleotide
aattctcaaatttgtttctta

SEQ ID NO: 2728 - DNA, 21 bp, Artificial Sequence
  Description of Artificial Sequence: Synthetic oligonucleotide
agaaacaaatttgagaattat

SEQ ID NO: 2729 - DNA, 21 bp, Artificial Sequence
  Description of Artificial Sequence: Synthetic oligonucleotide
attctcaaatttgtttcttat

SEQ ID NO: 2730 - DNA, 21 bp, Artificial Sequence
  Description of Artificial Sequence: Synthetic oligonucleotide
aagaaacaaatttgagaatta

SEQ ID NO: 2731 - DNA, 21 bp, Artificial Sequence
  Description of Artificial Sequence: Synthetic oligonucleotide
ttctcaaatttgtttcttatg

SEQ ID NO: 2732 - DNA, 21 bp, Artificial Sequence
  Description of Artificial Sequence: Synthetic oligonucleotide
taagaaacaaatttgagaatt

SEQ ID NO: 2733 - DNA, 21 bp, Artificial Sequence
  Description of Artificial Sequence: Synthetic oligonucleotide
tctcaaatttgtttcttatga

SEQ ID NO: 2734 - DNA, 21 bp, Artificial Sequence
  Description of Artificial Sequence: Synthetic oligonucleotide
ataagaaacaaatttgagaat

SEQ ID NO: 2735 - DNA, 21 bp, Artificial Sequence
  Description of Artificial Sequence: Synthetic oligonucleotide
ctcaaatttgtttcttatgaa

SEQ ID NO: 2736 - DNA, 21 bp, Artificial Sequence
  Description of Artificial Sequence: Synthetic oligonucleotide
cataagaaacaaatttgagaa

SEQ ID NO: 2737 - DNA, 21 bp, Artificial Sequence
  Description of Artificial Sequence: Synthetic oligonucleotide
tcaaatttgtttcttatgaat

SEQ ID NO: 2738 - DNA, 21 bp, Artificial Sequence
  Description of Artificial Sequence: Synthetic oligonucleotide
tcataagaaacaaatttgaga

SEQ ID NO: 2739 - DNA, 21 bp, Artificial Sequence
  Description of Artificial Sequence: Synthetic oligonucleotide
caaatttgtttcttatgaatc

SEQ ID NO: 2740 - DNA, 21 bp, Artificial Sequence
  Description of Artificial Sequence: Synthetic oligonucleotide
ttcataagaaacaaatttgag

SEQ ID NO: 2741 - DNA, 21 bp, Artificial Sequence
  Description of Artificial Sequence: Synthetic oligonucleotide
aaatttgtttcttatgaatca

SEQ ID NO: 2742 - DNA, 21 bp, Artificial Sequence
  Description of Artificial Sequence: Synthetic oligonucleotide
attcataagaaacaaatttga

SEQ ID NO: 2743 - DNA, 21 bp, Artificial Sequence
  Description of Artificial Sequence: Synthetic oligonucleotide
aatttgtttcttatgaatcat

SEQ ID NO: 2744 - DNA, 21 bp, Artificial Sequence
  Description of Artificial Sequence: Synthetic oligonucleotide
gattcataagaaacaaatttg

SEQ ID NO: 2745 - DNA, 21 bp, Artificial Sequence
  Description of Artificial Sequence: Synthetic oligonucleotide
atttgtttcttatgaatcatc

SEQ ID NO: 2746 - DNA, 21 bp, Artificial Sequence
  Description of Artificial Sequence: Synthetic oligonucleotide
tgattcataagaaacaaattt

SEQ ID NO: 2747 - DNA, 21 bp, Artificial Sequence
  Description of Artificial Sequence: Synthetic oligonucleotide
tttgtttcttatgaatcatct

SEQ ID NO: 2748 - DNA, 21 bp, Artificial Sequence
  Description of Artificial Sequence: Synthetic oligonucleotide
atgattcataagaaacaaatt

SEQ ID NO: 2749 - DNA, 21 bp, Artificial Sequence
  Description of Artificial Sequence: Synthetic oligonucleotide
ttgtttcttatgaatcatctc

SEQ ID NO: 2750 - DNA, 21 bp, Artificial Sequence
  Description of Artificial Sequence: Synthetic oligonucleotide
gatgattcataagaaacaaat

SEQ ID NO: 2751 - DNA, 21 bp, Artificial Sequence
  Description of Artificial Sequence: Synthetic oligonucleotide
tgtttcttatgaatcatctct

SEQ ID NO: 2752 - DNA, 21 bp, Artificial Sequence
  Description of Artificial Sequence: Synthetic oligonucleotide
agatgattcataagaaacaaa

SEQ ID NO: 2753 - DNA, 21 bp, Artificial Sequence
  Description of Artificial Sequence: Synthetic oligonucleotide
gtttcttatgaatcatctctc

SEQ ID NO: 2754 - DNA, 21 bp, Artificial Sequence
  Description of Artificial Sequence: Synthetic oligonucleotide
gagatgattcataagaaacaa

SEQ ID NO: 2755 - DNA, 21 bp, Artificial Sequence
  Description of Artificial Sequence: Synthetic oligonucleotide
tttcttatgaatcatctctca

SEQ ID NO: 2756 - DNA, 21 bp, Artificial Sequence
  Description of Artificial Sequence: Synthetic oligonucleotide
agagatgattcataagaaaca

SEQ ID NO: 2757 - DNA, 21 bp, Artificial Sequence
  Description of Artificial Sequence: Synthetic oligonucleotide
ttcttatgaatcatctctcaa

SEQ ID NO: 2758 - DNA, 21 bp, Artificial Sequence
  Description of Artificial Sequence: Synthetic oligonucleotide
gagagatgattcataagaaac

SEQ ID NO: 2759 - DNA, 21 bp, Artificial Sequence
  Description of Artificial Sequence: Synthetic oligonucleotide
tcttatgaatcatctctcaaa

SEQ ID NO: 2760 - DNA, 21 bp, Artificial Sequence
  Description of Artificial Sequence: Synthetic oligonucleotide
tgagagatgattcataagaaa

SEQ ID NO: 2761 - DNA, 21 bp, Artificial Sequence
  Description of Artificial Sequence: Synthetic oligonucleotide
cttatgaatcatctctcaaat

SEQ ID NO: 2762 - DNA, 21 bp, Artificial Sequence
  Description of Artificial Sequence: Synthetic oligonucleotide
ttgagagatgattcataagaa

SEQ ID NO: 2763 - DNA, 21 bp, Artificial Sequence
  Description of Artificial Sequence: Synthetic oligonucleotide
ttatgaatcatctctcaaatc

SEQ ID NO: 2764 - DNA, 21 bp, Artificial Sequence
  Description of Artificial Sequence: Synthetic oligonucleotide
tttgagagatgattcataaga

SEQ ID NO: 2765 - DNA, 21 bp, Artificial Sequence
  Description of Artificial Sequence: Synthetic oligonucleotide
tatgaatcatctctcaaatct

SEQ ID NO: 2766 - DNA, 21 bp, Artificial Sequence
  Description of Artificial Sequence: Synthetic oligonucleotide
atttgagagatgattcataag

SEQ ID NO: 2767 - DNA, 21 bp, Artificial Sequence
  Description of Artificial Sequence: Synthetic oligonucleotide
atgaatcatctctcaaatcta

SEQ ID NO: 2768 - DNA, 21 bp, Artificial Sequence
  Description of Artificial Sequence: Synthetic oligonucleotide
gatttgagagatgattcataa

SEQ ID NO: 2769 - DNA, 21 bp, Artificial Sequence
  Description of Artificial Sequence: Synthetic oligonucleotide
tgaatcatctctcaaatctag

SEQ ID NO: 2770 - DNA, 21 bp, Artificial Sequence
  Description of Artificial Sequence: Synthetic oligonucleotide
agatttgagagatgattcata

SEQ ID NO: 2771 - DNA, 21 bp, Artificial Sequence
  Description of Artificial Sequence: Synthetic oligonucleotide
gaatcatctctcaaatctagt

SEQ ID NO: 2772 - DNA, 21 bp, Artificial Sequence
  Description of Artificial Sequence: Synthetic oligonucleotide
tagatttgagagatgattcat

SEQ ID NO: 2773 - DNA, 21 bp, Artificial Sequence
  Description of Artificial Sequence: Synthetic oligonucleotide
aatcatctctcaaatctagtt

SEQ ID NO: 2774 - DNA, 21 bp, Artificial Sequence
  Description of Artificial Sequence: Synthetic oligonucleotide
ctagatttgagagatgattca

SEQ ID NO: 2775 - DNA, 21 bp, Artificial Sequence
  Description of Artificial Sequence: Synthetic oligonucleotide
atcatctctcaaatctagtta

SEQ ID NO: 2776 - DNA, 21 bp, Artificial Sequence
  Description of Artificial Sequence: Synthetic oligonucleotide
actagatttgagagatgattc

SEQ ID NO: 2777 - DNA, 21 bp, Artificial Sequence
  Description of Artificial Sequence: Synthetic oligonucleotide
tcatctctcaaatctagttag

SEQ ID NO: 2778 - DNA, 21 bp, Artificial Sequence
  Description of Artificial Sequence: Synthetic oligonucleotide
aactagatttgagagatgatt

SEQ ID NO: 2779 - DNA, 21 bp, Artificial Sequence
  Description of Artificial Sequence: Synthetic oligonucleotide
catctctcaaatctagttaga

SEQ ID NO: 2780 - DNA, 21 bp, Artificial Sequence
  Description of Artificial Sequence: Synthetic oligonucleotide
taactagatttgagagatgat

SEQ ID NO: 2781 - DNA, 21 bp, Artificial Sequence
  Description of Artificial Sequence: Synthetic oligonucleotide
atctctcaaatctagttagac

SEQ ID NO: 2782 - DNA, 21 bp, Artificial Sequence
  Description of Artificial Sequence: Synthetic oligonucleotide
ctaactagatttgagagatga

SEQ ID NO: 2783 - DNA, 21 bp, Artificial Sequence
  Description of Artificial Sequence: Synthetic oligonucleotide
tctctcaaatctagttagaca

SEQ ID NO: 2784 - DNA, 21 bp, Artificial Sequence
  Description of Artificial Sequence: Synthetic oligonucleotide
tctaactagatttgagagatg

SEQ ID NO: 2785 - DNA, 21 bp, Artificial Sequence
  Description of Artificial Sequence: Synthetic oligonucleotide
ctctcaaatctagttagacaa

SEQ ID NO: 2786 - DNA, 21 bp, Artificial Sequence
  Description of Artificial Sequence: Synthetic oligonucleotide
gtctaactagatttgagagat

SEQ ID NO: 2787 - DNA, 21 bp, Artificial Sequence
  Description of Artificial Sequence: Synthetic oligonucleotide
tctcaaatctagttagacaat

SEQ ID NO: 2788 - DNA, 21 bp, Artificial Sequence
  Description of Artificial Sequence: Synthetic oligonucleotide
tgtctaactagatttgagaga

SEQ ID NO: 2789 - DNA, 21 bp, Artificial Sequence
  Description of Artificial Sequence: Synthetic oligonucleotide
ctcaaatctagttagacaatt

SEQ ID NO: 2790 - DNA, 21 bp, Artificial Sequence
  Description of Artificial Sequence: Synthetic oligonucleotide
ttgtctaactagatttgagag

SEQ ID NO: 2791 - DNA, 21 bp, Artificial Sequence
  Description of Artificial Sequence: Synthetic oligonucleotide
tcaaatctagttagacaattt

SEQ ID NO: 2792 - DNA, 21 bp, Artificial Sequence
  Description of Artificial Sequence: Synthetic oligonucleotide
attgtctaactagatttgaga

SEQ ID NO: 2793 - DNA, 21 bp, Artificial Sequence
  Description of Artificial Sequence: Synthetic oligonucleotide
caaatctagttagacaatttg

SEQ ID NO: 2794 - DNA, 21 bp, Artificial Sequence
  Description of Artificial Sequence: Synthetic oligonucleotide
aattgtctaactagatttgag

SEQ ID NO: 2795 - DNA, 21 bp, Artificial Sequence
  Description of Artificial Sequence: Synthetic oligonucleotide
aaatctagttagacaatttgc

SEQ ID NO: 2796 - DNA, 21 bp, Artificial Sequence
  Description of Artificial Sequence: Synthetic oligonucleotide
aaattgtctaactagatttga

SEQ ID NO: 2797 - DNA, 21 bp, Artificial Sequence
  Description of Artificial Sequence: Synthetic oligonucleotide
aatctagttagacaatttgca

SEQ ID NO: 2798 - DNA, 21 bp, Artificial Sequence
  Description of Artificial Sequence: Synthetic oligonucleotide
caaattgtctaactagatttg

SEQ ID NO: 2799 - DNA, 21 bp, Artificial Sequence
  Description of Artificial Sequence: Synthetic oligonucleotide
atctagttagacaatttgcac

SEQ ID NO: 2800 - DNA, 21 bp, Artificial Sequence
  Description of Artificial Sequence: Synthetic oligonucleotide
gcaaattgtctaactagattt

SEQ ID NO: 2801 - DNA, 21 bp, Artificial Sequence
  Description of Artificial Sequence: Synthetic oligonucleotide
tctagttagacaatttgcaca

SEQ ID NO: 2802 - DNA, 21 bp, Artificial Sequence
  Description of Artificial Sequence: Synthetic oligonucleotide
tgcaaattgtctaactagatt

SEQ ID NO: 2803 - DNA, 21 bp, Artificial Sequence
  Description of Artificial Sequence: Synthetic oligonucleotide
ctagttagacaatttgcacac

SEQ ID NO: 2804 - DNA, 21 bp, Artificial Sequence
  Description of Artificial Sequence: Synthetic oligonucleotide
gtgcaaattgtctaactagat

SEQ ID NO: 2805 - DNA, 21 bp, Artificial Sequence
  Description of Artificial Sequence: Synthetic oligonucleotide
tagttagacaatttgcacaca

SEQ ID NO: 2806 - DNA, 21 bp, Artificial Sequence
  Description of Artificial Sequence: Synthetic oligonucleotide
tgtgcaaattgtctaactaga

SEQ ID NO: 2807 - DNA, 21 bp, Artificial Sequence
  Description of Artificial Sequence: Synthetic oligonucleotide
agttagacaatttgcacacat

SEQ ID NO: 2808 - DNA, 21 bp, Artificial Sequence
  Description of Artificial Sequence: Synthetic oligonucleotide
gtgtgcaaattgtctaactag

SEQ ID NO: 2809 - DNA, 21 bp, Artificial Sequence
  Description of Artificial Sequence: Synthetic oligonucleotide
gttagacaatttgcacacata

SEQ ID NO: 2810 - DNA, 21 bp, Artificial Sequence
  Description of Artificial Sequence: Synthetic oligonucleotide
tgtgtgcaaattgtctaacta

SEQ ID NO: 2811 - DNA, 21 bp, Artificial Sequence
  Description of Artificial Sequence: Synthetic oligonucleotide
ttagacaatttgcacacatac

SEQ ID NO: 2812 - DNA, 21 bp, Artificial Sequence
  Description of Artificial Sequence: Synthetic oligonucleotide
atgtgtgcaaattgtctaact

SEQ ID NO: 2813 - DNA, 21 bp, Artificial Sequence
  Description of Artificial Sequence: Synthetic oligonucleotide
tagacaatttgcacacatact

SEQ ID NO: 2814 - DNA, 21 bp, Artificial Sequence
  Description of Artificial Sequence: Synthetic oligonucleotide
tatgtgtgcaaattgtctaac

SEQ ID NO: 2815 - DNA, 21 bp, Artificial Sequence
  Description of Artificial Sequence: Synthetic oligonucleotide
agacaatttgcacacatactt

SEQ ID NO: 2816 - DNA, 21 bp, Artificial Sequence
  Description of Artificial Sequence: Synthetic oligonucleotide
gtatgtgtgcaaattgtctaa

SEQ ID NO: 2817 - DNA, 21 bp, Artificial Sequence
  Description of Artificial Sequence: Synthetic oligonucleotide
gacaatttgcacacatacttt

SEQ ID NO: 2818 - DNA, 21 bp, Artificial Sequence
  Description of Artificial Sequence: Synthetic oligonucleotide
agtatgtgtgcaaattgtcta

SEQ ID NO: 2819 - DNA, 21 bp, Artificial Sequence
  Description of Artificial Sequence: Synthetic oligonucleotide
acaatttgcacacatactttt

SEQ ID NO: 2820 - DNA, 21 bp, Artificial Sequence
  Description of Artificial Sequence: Synthetic oligonucleotide
aagtatgtgtgcaaattgtct

SEQ ID NO: 2821 - DNA, 21 bp, Artificial Sequence
  Description of Artificial Sequence: Synthetic oligonucleotide
caatttgcacacatacttttc

SEQ ID NO: 2822 - DNA, 21 bp, Artificial Sequence
  Description of Artificial Sequence: Synthetic oligonucleotide
aaagtatgtgtgcaaattgtc

SEQ ID NO: 2823 - DNA, 21 bp, Artificial Sequence
  Description of Artificial Sequence: Synthetic oligonucleotide
aatttgcacacatacttttct

SEQ ID NO: 2824 - DNA, 21 bp, Artificial Sequence
  Description of Artificial Sequence: Synthetic oligonucleotide
aaaagtatgtgtgcaaattgt

SEQ ID NO: 2825 - DNA, 21 bp, Artificial Sequence
  Description of Artificial Sequence: Synthetic oligonucleotide
atttgcacacatacttttcta

SEQ ID NO: 2826 - DNA, 21 bp, Artificial Sequence
  Description of Artificial Sequence: Synthetic oligonucleotide
gaaaagtatgtgtgcaaattg

SEQ ID NO: 2827 - DNA, 21 bp, Artificial Sequence
  Description of Artificial Sequence: Synthetic oligonucleotide
tttgcacacatacttttctaa

SEQ ID NO: 2828 - DNA, 21 bp, Artificial Sequence
  Description of Artificial Sequence: Synthetic oligonucleotide
agaaaagtatgtgtgcaaatt

SEQ ID NO: 2829 - DNA, 21 bp, Artificial Sequence
  Description of Artificial Sequence: Synthetic oligonucleotide
ttgcacacatacttttctaag

SEQ ID NO: 2830 - DNA, 21 bp, Artificial Sequence
  Description of Artificial Sequence: Synthetic oligonucleotide
tagaaaagtatgtgtgcaaat

SEQ ID NO: 2831 - DNA, 21 bp, Artificial Sequence
  Description of Artificial Sequence: Synthetic oligonucleotide
tgcacacatacttttctaagg

SEQ ID NO: 2832 - DNA, 21 bp, Artificial Sequence
  Description of Artificial Sequence: Synthetic oligonucleotide
ttagaaaagtatgtgtgcaaa

SEQ ID NO: 2833 - DNA, 21 bp, Artificial Sequence
  Description of Artificial Sequence: Synthetic oligonucleotide
gcacacatacttttctaaggg

SEQ ID NO: 2834 - DNA, 21 bp, Artificial Sequence
  Description of Artificial Sequence: Synthetic oligonucleotide
cttagaaaagtatgtgtgcaa

SEQ ID NO: 2835 - DNA, 21 bp, Artificial Sequence
  Description of Artificial Sequence: Synthetic oligonucleotide
cacacatacttttctaaggga

SEQ ID NO: 2836 - DNA, 21 bp, Artificial Sequence
  Description of Artificial Sequence: Synthetic oligonucleotide
ccttagaaaagtatgtgtgca

SEQ ID NO: 2837 - DNA, 21 bp, Artificial Sequence
  Description of Artificial Sequence: Synthetic oligonucleotide
acacatacttttctaagggac

SEQ ID NO: 2838 - DNA, 21 bp, Artificial Sequence
  Description of Artificial Sequence: Synthetic oligonucleotide
cccttagaaaagtatgtgtgc

SEQ ID NO: 2839 - DNA, 21 bp, Artificial Sequence
  Description of Artificial Sequence: Synthetic oligonucleotide
cacatacttttctaagggaca

SEQ ID NO: 2840 - DNA, 21 bp, Artificial Sequence
  Description of Artificial Sequence: Synthetic oligonucleotide
tcccttagaaaagtatgtgtg

SEQ ID NO: 2841 - DNA, 21 bp, Artificial Sequence
  Description of Artificial Sequence: Synthetic oligonucleotide
acatacttttctaagggacat

SEQ ID NO: 2842 - DNA, 21 bp, Artificial Sequence
  Description of Artificial Sequence: Synthetic oligonucleotide
gtcccttagaaaagtatgtgt

SEQ ID NO: 2843 - DNA, 21 bp, Artificial Sequence
  Description of Artificial Sequence: Synthetic oligonucleotide
catacttttctaagggacatt

SEQ ID NO: 2844 - DNA, 21 bp, Artificial Sequence
  Description of Artificial Sequence: Synthetic oligonucleotide
tgtcccttagaaaagtatgtg

SEQ ID NO: 2845 - DNA, 21 bp, Artificial Sequence
  Description of Artificial Sequence: Synthetic oligonucleotide
atacttttctaagggacatta

SEQ ID NO: 2846 - DNA, 21 bp, Artificial Sequence
  Description of Artificial Sequence: Synthetic oligonucleotide
atgtcccttagaaaagtatgt

SEQ ID NO: 2847 - DNA, 21 bp, Artificial Sequence
  Description of Artificial Sequence: Synthetic oligonucleotide
tacttttctaagggacattat

SEQ ID NO: 2848 - DNA, 21 bp, Artificial Sequence
  Description of Artificial Sequence: Synthetic oligonucleotide
aatgtcccttagaaaagtatg

SEQ ID NO: 2849 - DNA, 21 bp, Artificial Sequence
  Description of Artificial Sequence: Synthetic oligonucleotide
acttttctaagggacattatc

SEQ ID NO: 2850 - DNA, 21 bp, Artificial Sequence
  Description of Artificial Sequence: Synthetic oligonucleotide
taatgtcccttagaaaagtat

SEQ ID NO: 2851 - DNA, 21 bp, Artificial Sequence
  Description of Artificial Sequence: Synthetic oligonucleotide
cttttctaagggacattatct

SEQ ID NO: 2852 - DNA, 21 bp, Artificial Sequence
  Description of Artificial Sequence: Synthetic oligonucleotide
ataatgtcccttagaaaagta

SEQ ID NO: 2853 - DNA, 21 bp, Artificial Sequence
  Description of Artificial Sequence: Synthetic oligonucleotide
ttttctaagggacattatctt

SEQ ID NO: 2854 - DNA, 21 bp, Artificial Sequence
  Description of Artificial Sequence: Synthetic oligonucleotide
gataatgtcccttagaaaagt

SEQ ID NO: 2855 - DNA, 21 bp, Artificial Sequence
  Description of Artificial Sequence: Synthetic oligonucleotide
tttctaagggacattatcttc

SEQ ID NO: 2856 - DNA, 21 bp, Artificial Sequence
  Description of Artificial Sequence: Synthetic oligonucleotide
agataatgtcccttagaaaag

SEQ ID NO: 2857 - DNA, 21 bp, Artificial Sequence
  Description of Artificial Sequence: Synthetic oligonucleotide
ttctaagggacattatcttcc

SEQ ID NO: 2858 - DNA, 21 bp, Artificial Sequence
  Description of Artificial Sequence: Synthetic oligonucleotide
aagataatgtcccttagaaaa

SEQ ID NO: 2859 - DNA, 21 bp, Artificial Sequence
  Description of Artificial Sequence: Synthetic oligonucleotide
tctaagggacattatcttcct

SEQ ID NO: 2860 - DNA, 21 bp, Artificial Sequence
  Description of Artificial Sequence: Synthetic oligonucleotide
gaagataatgtcccttagaaa

SEQ ID NO: 2861 - DNA, 21 bp, Artificial Sequence
  Description of Artificial Sequence: Synthetic oligonucleotide
ctaagggacattatcttcctt

SEQ ID NO: 2862 - DNA, 21 bp, Artificial Sequence
  Description of Artificial Sequence: Synthetic oligonucleotide
ggaagataatgtcccttagaa

SEQ ID NO: 2863 - DNA, 21 bp, Artificial Sequence
  Description of Artificial Sequence: Synthetic oligonucleotide
taagggacattatcttccttc

SEQ ID NO: 2864 - DNA, 21 bp, Artificial Sequence
  Description of Artificial Sequence: Synthetic oligonucleotide
aggaagataatgtcccttaga

SEQ ID NO: 2865 - DNA, 21 bp, Artificial Sequence
  Description of Artificial Sequence: Synthetic oligonucleotide
aagggacattatcttccttca

SEQ ID NO: 2866 - DNA, 21 bp, Artificial Sequence
  Description of Artificial Sequence: Synthetic oligonucleotide
aaggaagataatgtcccttag

SEQ ID NO: 2867 - DNA, 21 bp, Artificial Sequence
  Description of Artificial Sequence: Synthetic oligonucleotide
agggacattatcttccttcag

SEQ ID NO: 2868 - DNA, 21 bp, Artificial Sequence
  Description of Artificial Sequence: Synthetic oligonucleotide
gaaggaagataatgtccctta

SEQ ID NO: 2869 - DNA, 21 bp, Artificial Sequence
  Description of Artificial Sequence: Synthetic oligonucleotide
gggacattatcttccttcagg

SEQ ID NO: 2870 - DNA, 21 bp, Artificial Sequence
  Description of Artificial Sequence: Synthetic oligonucleotide
tgaaggaagataatgtccctt

SEQ ID NO: 2871 - DNA, 21 bp, Artificial Sequence
  Description of Artificial Sequence: Synthetic oligonucleotide
ggacattatcttccttcaggt

SEQ ID NO: 2872 - DNA, 21 bp, Artificial Sequence
  Description of Artificial Sequence: Synthetic oligonucleotide
ctgaaggaagataatgtccct

SEQ ID NO: 2873 - DNA, 21 bp, Artificial Sequence
  Description of Artificial Sequence: Synthetic oligonucleotide
gacattatcttccttcaggtt

SEQ ID NO: 2874 - DNA, 21 bp, Artificial Sequence
  Description of Artificial Sequence: Synthetic oligonucleotide
cctgaaggaagataatgtccc

SEQ ID NO: 2875 - DNA, 21 bp, Artificial Sequence
  Description of Artificial Sequence: Synthetic oligonucleotide
acattatcttccttcaggttt

SEQ ID NO: 2876 - DNA, 21 bp, Artificial Sequence
  Description of Artificial Sequence: Synthetic oligonucleotide
acctgaaggaagataatgtcc

SEQ ID NO: 2877 - DNA, 21 bp, Artificial Sequence
  Description of Artificial Sequence: Synthetic oligonucleotide
cattatcttccttcaggtttt

SEQ ID NO: 2878 - DNA, 21 bp, Artificial Sequence
  Description of Artificial Sequence: Synthetic oligonucleotide
aacctgaaggaagataatgtc

SEQ ID NO: 2879 - DNA, 21 bp, Artificial Sequence
  Description of Artificial Sequence: Synthetic oligonucleotide
attatcttccttcaggttttt

SEQ ID NO: 2880 - DNA, 21 bp, Artificial Sequence
  Description of Artificial Sequence: Synthetic oligonucleotide
aaacctgaaggaagataatgt

SEQ ID NO: 2881 - DNA, 21 bp, Artificial Sequence
  Description of Artificial Sequence: Synthetic oligonucleotide
ttatcttccttcaggttttta

SEQ ID NO: 2882 - DNA, 21 bp, Artificial Sequence
  Description of Artificial Sequence: Synthetic oligonucleotide
aaaacctgaaggaagataatg

SEQ ID NO: 2883 - DNA, 21 bp, Artificial Sequence
  Description of Artificial Sequence: Synthetic oligonucleotide
tatcttccttcaggtttttac

SEQ ID NO: 2884 - DNA, 21 bp, Artificial Sequence
  Description of Artificial Sequence: Synthetic oligonucleotide
aaaaacctgaaggaagataat

SEQ ID NO: 2885 - DNA, 21 bp, Artificial Sequence
  Description of Artificial Sequence: Synthetic oligonucleotide
atcttccttcaggtttttacc

SEQ ID NO: 2886 - DNA, 21 bp, Artificial Sequence
  Description of Artificial Sequence: Synthetic oligonucleotide
taaaaacctgaaggaagataa

SEQ ID NO: 2887 - DNA, 21 bp, Artificial Sequence
  Description of Artificial Sequence: Synthetic oligonucleotide
tcttccttcaggtttttacct

SEQ ID NO: 2888 - DNA, 21 bp, Artificial Sequence
  Description of Artificial Sequence: Synthetic oligonucleotide
gtaaaaacctgaaggaagata

SEQ ID NO: 2889 - DNA, 21 bp, Artificial Sequence
  Description of Artificial Sequence: Synthetic oligonucleotide
cttccttcaggtttttacctc

SEQ ID NO: 2890 - DNA, 21 bp, Artificial Sequence
  Description of Artificial Sequence: Synthetic oligonucleotide
ggtaaaaacctgaaggaagat

SEQ ID NO: 2891 - DNA, 21 bp, Artificial Sequence
  Description of Artificial Sequence: Synthetic oligonucleotide
ttccttcaggtttttacctcc

SEQ ID NO: 2892 - DNA, 21 bp, Artificial Sequence
  Description of Artificial Sequence: Synthetic oligonucleotide
aggtaaaaacctgaaggaaga

SEQ ID NO: 2893 - DNA, 21 bp, Artificial Sequence
  Description of Artificial Sequence: Synthetic oligonucleotide
tccttcaggtttttacctcca

SEQ ID NO: 2894 - DNA, 21 bp, Artificial Sequence
  Description of Artificial Sequence: Synthetic oligonucleotide
gaggtaaaaacctgaaggaag

SEQ ID NO: 2895 - DNA, 21 bp, Artificial Sequence
  Description of Artificial Sequence: Synthetic oligonucleotide
ccttcaggtttttacctccac

SEQ ID NO: 2896 - DNA, 21 bp, Artificial Sequence
  Description of Artificial Sequence: Synthetic oligonucleotide
ggaggtaaaaacctgaaggaa

SEQ ID NO: 2897 - DNA, 21 bp, Artificial Sequence
  Description of Artificial Sequence: Synthetic oligonucleotide
cttcaggtttttacctccact

SEQ ID NO: 2898 - DNA, 21 bp, Artificial Sequence
  Description of Artificial Sequence: Synthetic oligonucleotide
tggaggtaaaaacctgaagga

SEQ ID NO: 2899 - DNA, 21 bp, Artificial Sequence
  Description of Artificial Sequence: Synthetic oligonucleotide
ttcaggtttttacctccactc

SEQ ID NO: 2900 - DNA, 21 bp, Artificial Sequence
  Description of Artificial Sequence: Synthetic oligonucleotide
gtggaggtaaaaacctgaagg

SEQ ID NO: 2901 - DNA, 21 bp, Artificial Sequence
  Description of Artificial Sequence: Synthetic oligonucleotide
tcaggtttttacctccactca

SEQ ID NO: 2902 - DNA, 21 bp, Artificial Sequence
  Description of Artificial Sequence: Synthetic oligonucleotide
agtggaggtaaaaacctgaag

SEQ ID NO: 2903 - DNA, 21 bp, Artificial Sequence
  Description of Artificial Sequence: Synthetic oligonucleotide
caggtttttacctccactcat

SEQ ID NO: 2904 - DNA, 21 bp, Artificial Sequence
  Description of Artificial Sequence: Synthetic oligonucleotide
gagtggaggtaaaaacctgaa

SEQ ID NO: 2905 - DNA, 21 bp, Artificial Sequence
  Description of Artificial Sequence: Synthetic oligonucleotide
aggtttttacctccactcatc

SEQ ID NO: 2906 - DNA, 21 bp, Artificial Sequence
  Description of Artificial Sequence: Synthetic oligonucleotide
tgagtggaggtaaaaacctga

SEQ ID NO: 2907 - DNA, 21 bp, Artificial Sequence
  Description of Artificial Sequence: Synthetic oligonucleotide
ggtttttacctccactcatcc

SEQ ID NO: 2908 - DNA, 21 bp, Artificial Sequence
  Description of Artificial Sequence: Synthetic oligonucleotide
atgagtggaggtaaaaacctg

SEQ ID NO: 2909 - DNA, 21 bp, Artificial Sequence
  Description of Artificial Sequence: Synthetic oligonucleotide
gtttttacctccactcatcct

SEQ ID NO: 2910 - DNA, 21 bp, Artificial Sequence
  Description of Artificial Sequence: Synthetic oligonucleotide
gatgagtggaggtaaaaacct

SEQ ID NO: 2911 - DNA, 21 bp, Artificial Sequence
  Description of Artificial Sequence: Synthetic oligonucleotide
tttttacctccactcatcctt

SEQ ID NO: 2912 - DNA, 21 bp, Artificial Sequence
  Description of Artificial Sequence: Synthetic oligonucleotide
ggatgagtggaggtaaaaacc

SEQ ID NO: 2913 - DNA, 21 bp, Artificial Sequence
  Description of Artificial Sequence: Synthetic oligonucleotide
ttttacctccactcatcctta

SEQ ID NO: 2914 - DNA, 21 bp, Artificial Sequence
  Description of Artificial Sequence: Synthetic oligonucleotide
aggatgagtggaggtaaaaac

SEQ ID NO: 2915 - DNA, 21 bp, Artificial Sequence
  Description of Artificial Sequence: Synthetic oligonucleotide
tttacctccactcatccttag

SEQ ID NO: 2916 - DNA, 21 bp, Artificial Sequence
  Description of Artificial Sequence: Synthetic oligonucleotide
aaggatgagtggaggtaaaaa

SEQ ID NO: 2917 - DNA, 21 bp, Artificial Sequence
  Description of Artificial Sequence: Synthetic oligonucleotide
ttacctccactcatccttaga

SEQ ID NO: 2918 - DNA, 21 bp, Artificial Sequence
  Description of Artificial Sequence: Synthetic oligonucleotide
taaggatgagtggaggtaaaa

SEQ ID NO: 2919 - DNA, 21 bp, Artificial Sequence
  Description of Artificial Sequence: Synthetic oligonucleotide
tacctccactcatccttagag

SEQ ID NO: 2920 - DNA, 21 bp, Artificial Sequence
  Description of Artificial Sequence: Synthetic oligonucleotide
ctaaggatgagtggaggtaaa

SEQ ID NO: 2921 - DNA, 21 bp, Artificial Sequence
  Description of Artificial Sequence: Synthetic oligonucleotide
acctccactcatccttagagc

SEQ ID NO: 2922 - DNA, 21 bp, Artificial Sequence
  Description of Artificial Sequence: Synthetic oligonucleotide
tctaaggatgagtggaggtaa

SEQ ID NO: 2923 - DNA, 21 bp, Artificial Sequence
  Description of Artificial Sequence: Synthetic oligonucleotide
cctccactcatccttagagcc

SEQ ID NO: 2924 - DNA, 21 bp, Artificial Sequence
  Description of Artificial Sequence: Synthetic oligonucleotide
ctctaaggatgagtggaggta

SEQ ID NO: 2925 - DNA, 21 bp, Artificial Sequence
  Description of Artificial Sequence: Synthetic oligonucleotide
ctccactcatccttagagccc

SEQ ID NO: 2926 - DNA, 21 bp, Artificial Sequence
  Description of Artificial Sequence: Synthetic oligonucleotide
gctctaaggatgagtggaggt

SEQ ID NO: 2927 - DNA, 21 bp, Artificial Sequence
  Description of Artificial Sequence: Synthetic oligonucleotide
tccactcatccttagagccca

SEQ ID NO: 2928 - DNA, 21 bp, Artificial Sequence
  Description of Artificial Sequence: Synthetic oligonucleotide
ggctctaaggatgagtggagg

SEQ ID NO: 2929 - DNA, 21 bp, Artificial Sequence
  Description of Artificial Sequence: Synthetic oligonucleotide
ccactcatccttagagcccac

SEQ ID NO: 2930 - DNA, 21 bp, Artificial Sequence
  Description of Artificial Sequence: Synthetic oligonucleotide
gggctctaaggatgagtggag

SEQ ID NO: 2931 - DNA, 21 bp, Artificial Sequence
  Description of Artificial Sequence: Synthetic oligonucleotide
cactcatccttagagcccact

SEQ ID NO: 2932 - DNA, 21 bp, Artificial Sequence
  Description of Artificial Sequence: Synthetic oligonucleotide
tgggctctaaggatgagtgga

SEQ ID NO: 2933 - DNA, 21 bp, Artificial Sequence
  Description of Artificial Sequence: Synthetic oligonucleotide
actcatccttagagcccactg

SEQ ID NO: 2934 - DNA, 21 bp, Artificial Sequence
  Description of Artificial Sequence: Synthetic oligonucleotide
gtgggctctaaggatgagtgg

SEQ ID NO: 2935 - DNA, 21 bp, Artificial Sequence
  Description of Artificial Sequence: Synthetic oligonucleotide
ctcatccttagagcccactga

SEQ ID NO: 2936 - DNA, 21 bp, Artificial Sequence
  Description of Artificial Sequence: Synthetic oligonucleotide
agtgggctctaaggatgagtg

SEQ ID NO: 2937 - DNA, 21 bp, Artificial Sequence
  Description of Artificial Sequence: Synthetic oligonucleotide
tcatccttagagcccactgac

SEQ ID NO: 2938 - DNA, 21 bp, Artificial Sequence
  Description of Artificial Sequence: Synthetic oligonucleotide
cagtgggctctaaggatgagt

SEQ ID NO: 2939 - DNA, 21 bp, Artificial Sequence
  Description of Artificial Sequence: Synthetic oligonucleotide
catccttagagcccactgact

SEQ ID NO: 2940 - DNA, 21 bp, Artificial Sequence
  Description of Artificial Sequence: Synthetic oligonucleotide
tcagtgggctctaaggatgag

SEQ ID NO: 2941 - DNA, 21 bp, Artificial Sequence
  Description of Artificial Sequence: Synthetic oligonucleotide
atccttagagcccactgactg

SEQ ID NO: 2942 - DNA, 21 bp, Artificial Sequence
  Description of Artificial Sequence: Synthetic oligonucleotide
gtcagtgggctctaaggatga

SEQ ID NO: 2943 - DNA, 21 bp, Artificial Sequence
  Description of Artificial Sequence: Synthetic oligonucleotide
tccttagagcccactgactgc

SEQ ID NO: 2944 - DNA, 21 bp, Artificial Sequence
  Description of Artificial Sequence: Synthetic oligonucleotide
agtcagtgggctctaaggatg

SEQ ID NO: 2945 - DNA, 21 bp, Artificial Sequence
  Description of Artificial Sequence: Synthetic oligonucleotide
ccttagagcccactgactgct

SEQ ID NO: 2946 - DNA, 21 bp, Artificial Sequence
  Description of Artificial Sequence: Synthetic oligonucleotide
cagtcagtgggctctaaggat

SEQ ID NO: 2947 - DNA, 21 bp, Artificial Sequence
  Description of Artificial Sequence: Synthetic oligonucleotide
cttagagcccactgactgctc

SEQ ID NO: 2948 - DNA, 21 bp, Artificial Sequence
  Description of Artificial Sequence: Synthetic oligonucleotide
gcagtcagtgggctctaagga

SEQ ID NO: 2949 - DNA, 21 bp, Artificial Sequence
  Description of Artificial Sequence: Synthetic oligonucleotide
ttagagcccactgactgctcc

SEQ ID NO: 2950 - DNA, 21 bp, Artificial Sequence
  Description of Artificial Sequence: Synthetic oligonucleotide
agcagtcagtgggctctaagg

SEQ ID NO: 2951 - DNA, 21 bp, Artificial Sequence
  Description of Artificial Sequence: Synthetic oligonucleotide
tagagcccactgactgctccc

SEQ ID NO: 2952 - DNA, 21 bp, Artificial Sequence
  Description of Artificial Sequence: Synthetic oligonucleotide
gagcagtcagtgggctctaag

SEQ ID NO: 2953 - DNA, 21 bp, Artificial Sequence
  Description of Artificial Sequence: Synthetic oligonucleotide
agagcccactgactgctcccc

SEQ ID NO: 2954 - DNA, 21 bp, Artificial Sequence
  Description of Artificial Sequence: Synthetic oligonucleotide
ggagcagtcagtgggctctaa

SEQ ID NO: 2955 - DNA, 21 bp, Artificial Sequence
  Description of Artificial Sequence: Synthetic oligonucleotide
gagcccactgactgctcccct

SEQ ID NO: 2956 - DNA, 21 bp, Artificial Sequence
  Description of Artificial Sequence: Synthetic oligonucleotide
gggagcagtcagtgggctcta

SEQ ID NO: 2957 - DNA, 21 bp, Artificial Sequence
  Description of Artificial Sequence: Synthetic oligonucleotide
agcccactgactgctcccctt

SEQ ID NO: 2958 - DNA, 21 bp, Artificial Sequence
  Description of Artificial Sequence: Synthetic oligonucleotide
ggggagcagtcagtgggctct

SEQ ID NO: 2959 - DNA, 21 bp, Artificial Sequence
  Description of Artificial Sequence: Synthetic oligonucleotide
gcccactgactgctccccttt

SEQ ID NO: 2960 - DNA, 21 bp, Artificial Sequence
  Description of Artificial Sequence: Synthetic oligonucleotide
aggggagcagtcagtgggctc

SEQ ID NO: 2961 - DNA, 21 bp, Artificial Sequence
  Description of Artificial Sequence: Synthetic oligonucleotide
cccactgactgctccccttta

SEQ ID NO: 2962 - DNA, 21 bp, Artificial Sequence
  Description of Artificial Sequence: Synthetic oligonucleotide
aaggggagcagtcagtgggct

SEQ ID NO: 2963 - DNA, 21 bp, Artificial Sequence
  Description of Artificial Sequence: Synthetic oligonucleotide
ccactgactgctcccctttat

SEQ ID NO: 2964 - DNA, 21 bp, Artificial Sequence
  Description of Artificial Sequence: Synthetic oligonucleotide
aaaggggagcagtcagtgggc

SEQ ID NO: 2965 - DNA, 21 bp, Artificial Sequence
  Description of Artificial Sequence: Synthetic oligonucleotide
cactgactgctcccctttata

SEQ ID NO: 2966 - DNA, 21 bp, Artificial Sequence
  Description of Artificial Sequence: Synthetic oligonucleotide
taaaggggagcagtcagtggg

SEQ ID NO: 2967 - DNA, 21 bp, Artificial Sequence
  Description of Artificial Sequence: Synthetic oligonucleotide
actgactgctcccctttatac

SEQ ID NO: 2968 - DNA, 21 bp, Artificial Sequence
  Description of Artificial Sequence: Synthetic oligonucleotide
ataaaggggagcagtcagtgg

SEQ ID NO: 2969 - DNA, 21 bp, Artificial Sequence
  Description of Artificial Sequence: Synthetic oligonucleotide
ctgactgctcccctttatacc

SEQ ID NO: 2970 - DNA, 21 bp, Artificial Sequence
  Description of Artificial Sequence: Synthetic oligonucleotide
tataaaggggagcagtcagtg

SEQ ID NO: 2971 - DNA, 21 bp, Artificial Sequence
  Description of Artificial Sequence: Synthetic oligonucleotide
tgactgctcccctttatacct

SEQ ID NO: 2972 - DNA, 21 bp, Artificial Sequence
  Description of Artificial Sequence: Synthetic oligonucleotide
gtataaaggggagcagtcagt

SEQ ID NO: 2973 - DNA, 21 bp, Artificial Sequence
  Description of Artificial Sequence: Synthetic oligonucleotide
gactgctcccctttatacctg

SEQ ID NO: 2974 - DNA, 21 bp, Artificial Sequence
  Description of Artificial Sequence: Synthetic oligonucleotide
ggtataaaggggagcagtcag

SEQ ID NO: 2975 - DNA, 21 bp, Artificial Sequence
  Description of Artificial Sequence: Synthetic oligonucleotide
actgctcccctttatacctgt

SEQ ID NO: 2976 - DNA, 21 bp, Artificial Sequence
  Description of Artificial Sequence: Synthetic oligonucleotide
aggtataaaggggagcagtca

SEQ ID NO: 2977 - DNA, 21 bp, Artificial Sequence
  Description of Artificial Sequence: Synthetic oligonucleotide
ctgctcccctttatacctgtt

SEQ ID NO: 2978 - DNA, 21 bp, Artificial Sequence
  Description of Artificial Sequence: Synthetic oligonucleotide
caggtataaaggggagcagtc

SEQ ID NO: 2979 - DNA, 21 bp, Artificial Sequence
  Description of Artificial Sequence: Synthetic oligonucleotide
tgctcccctttatacctgttg

SEQ ID NO: 2980 - DNA, 21 bp, Artificial Sequence
  Description of Artificial Sequence: Synthetic oligonucleotide
acaggtataaaggggagcagt

SEQ ID NO: 2981 - DNA, 21 bp, Artificial Sequence
  Description of Artificial Sequence: Synthetic oligonucleotide
gctcccctttatacctgttgg

SEQ ID NO: 2982 - DNA, 21 bp, Artificial Sequence
  Description of Artificial Sequence: Synthetic oligonucleotide
aacaggtataaaggggagcag

SEQ ID NO: 2983 - DNA, 21 bp, Artificial Sequence
  Description of Artificial Sequence: Synthetic oligonucleotide
ctcccctttatacctgttggc

SEQ ID NO: 2984 - DNA, 21 bp, Artificial Sequence
  Description of Artificial Sequence: Synthetic oligonucleotide
caacaggtataaaggggagca

SEQ ID NO: 2985 - DNA, 21 bp, Artificial Sequence
  Description of Artificial Sequence: Synthetic oligonucleotide
tcccctttatacctgttggcc

SEQ ID NO: 2986 - DNA, 21 bp, Artificial Sequence
  Description of Artificial Sequence: Synthetic oligonucleotide
ccaacaggtataaaggggagc

SEQ ID NO: 2987 - DNA, 21 bp, Artificial Sequence
  Description of Artificial Sequence: Synthetic oligonucleotide
cccctttatacctgttggccc

SEQ ID NO: 2988 - DNA, 21 bp, Artificial Sequence
  Description of Artificial Sequence: Synthetic oligonucleotide
gccaacaggtataaaggggag

SEQ ID NO: 2989 - DNA, 21 bp, Artificial Sequence
  Description of Artificial Sequence: Synthetic oligonucleotide
ccctttatacctgttggccct

SEQ ID NO: 2990 - DNA, 21 bp, Artificial Sequence
  Description of Artificial Sequence: Synthetic oligonucleotide
ggccaacaggtataaagggga

SEQ ID NO: 2991 - DNA, 21 bp, Artificial Sequence
  Description of Artificial Sequence: Synthetic oligonucleotide
cctttatacctgttggccctg

SEQ ID NO: 2992 - DNA, 21 bp, Artificial Sequence
  Description of Artificial Sequence: Synthetic oligonucleotide
gggccaacaggtataaagggg

SEQ ID NO: 2993 - DNA, 21 bp, Artificial Sequence
  Description of Artificial Sequence: Synthetic oligonucleotide
ctttatacctgttggccctgc

SEQ ID NO: 2994 - DNA, 21 bp, Artificial Sequence
  Description of Artificial Sequence: Synthetic oligonucleotide
agggccaacaggtataaaggg

SEQ ID NO: 2995 - DNA, 21 bp, Artificial Sequence
  Description of Artificial Sequence: Synthetic oligonucleotide
tttatacctgttggccctgcc

SEQ ID NO: 2996 - DNA, 21 bp, Artificial Sequence
  Description of Artificial Sequence: Synthetic oligonucleotide
cagggccaacaggtataaagg

SEQ ID NO: 2997 - DNA, 21 bp, Artificial Sequence
  Description of Artificial Sequence: Synthetic oligonucleotide
ttatacctgttggccctgcct

SEQ ID NO: 2998 - DNA, 21 bp, Artificial Sequence
  Description of Artificial Sequence: Synthetic oligonucleotide
gcagggccaacaggtataaag

SEQ ID NO: 2999 - DNA, 21 bp, Artificial Sequence
  Description of Artificial Sequence: Synthetic oligonucleotide
tatacctgttggccctgccta

SEQ ID NO: 3000 - DNA, 21 bp, Artificial Sequence
  Description of Artificial Sequence: Synthetic oligonucleotide
ggcagggccaacaggtataaa

SEQ ID NO: 3001 - DNA, 21 bp, Artificial Sequence
  Description of Artificial Sequence: Synthetic oligonucleotide
atacctgttggccctgcctat

SEQ ID NO: 3002 - DNA, 21 bp, Artificial Sequence
  Description of Artificial Sequence: Synthetic oligonucleotide
aggcagggccaacaggtataa

SEQ ID NO: 3003 - DNA, 21 bp, Artificial Sequence
  Description of Artificial Sequence: Synthetic oligonucleotide
tacctgttggccctgcctata

SEQ ID NO: 3004 - DNA, 21 bp, Artificial Sequence
  Description of Artificial Sequence: Synthetic oligonucleotide
taggcagggccaacaggtata

SEQ ID NO: 3005 - DNA, 21 bp, Artificial Sequence
  Description of Artificial Sequence: Synthetic oligonucleotide
acctgttggccctgcctatag

SEQ ID NO: 3006 - DNA, 21 bp, Artificial Sequence
  Description of Artificial Sequence: Synthetic oligonucleotide
ataggcagggccaacaggtat

SEQ ID NO: 3007 - DNA, 21 bp, Artificial Sequence
  Description of Artificial Sequence: Synthetic oligonucleotide
cctgttggccctgcctatagg

SEQ ID NO: 3008 - DNA, 21 bp, Artificial Sequence
  Description of Artificial Sequence: Synthetic oligonucleotide
tataggcagggccaacaggta

SEQ ID NO: 3009 - DNA, 21 bp, Artificial Sequence
  Description of Artificial Sequence: Synthetic oligonucleotide
ctgttggccctgcctatagga

SEQ ID NO: 3010 - DNA, 21 bp, Artificial Sequence
  Description of Artificial Sequence: Synthetic oligonucleotide
ctataggcagggccaacaggt

SEQ ID NO: 3011 - DNA, 21 bp, Artificial Sequence
  Description of Artificial Sequence: Synthetic oligonucleotide
tgttggccctgcctataggag

SEQ ID NO: 3012 - DNA, 21 bp, Artificial Sequence
  Description of Artificial Sequence: Synthetic oligonucleotide
cctataggcagggccaacagg

SEQ ID NO: 3013 - DNA, 21 bp, Artificial Sequence
  Description of Artificial Sequence: Synthetic oligonucleotide
gttggccctgcctataggaga

SEQ ID NO: 3014 - DNA, 21 bp, Artificial Sequence
  Description of Artificial Sequence: Synthetic oligonucleotide
tcctataggcagggccaacag

SEQ ID NO: 3015 - DNA, 21 bp, Artificial Sequence
  Description of Artificial Sequence: Synthetic oligonucleotide
ttggccctgcctataggagag

SEQ ID NO: 3016 - DNA, 21 bp, Artificial Sequence
  Description of Artificial Sequence: Synthetic oligonucleotide
ctcctataggcagggccaaca

SEQ ID NO: 3017 - DNA, 21 bp, Artificial Sequence
  Description of Artificial Sequence: Synthetic oligonucleotide
tggccctgcctataggagaga

SEQ ID NO: 3018 - DNA, 21 bp, Artificial Sequence
  Description of Artificial Sequence: Synthetic oligonucleotide
tctcctataggcagggccaac

SEQ ID NO: 3019 - DNA, 21 bp, Artificial Sequence
  Description of Artificial Sequence: Synthetic oligonucleotide
ggccctgcctataggagagaa

SEQ ID NO: 3020 - DNA, 21 bp, Artificial Sequence
  Description of Artificial Sequence: Synthetic oligonucleotide
ctctcctataggcagggccaa

SEQ ID NO: 3021 - DNA, 21 bp, Artificial Sequence
  Description of Artificial Sequence: Synthetic oligonucleotide
gccctgcctataggagagaat

SEQ ID NO: 3022 - DNA, 21 bp, Artificial Sequence
  Description of Artificial Sequence: Synthetic oligonucleotide
tctctcctataggcagggcca

SEQ ID NO: 3023 - DNA, 21 bp, Artificial Sequence
  Description of Artificial Sequence: Synthetic oligonucleotide
ccctgcctataggagagaata

SEQ ID NO: 3024 - DNA, 21 bp, Artificial Sequence
  Description of Artificial Sequence: Synthetic oligonucleotide
ttctctcctataggcagggcc

SEQ ID NO: 3025 - DNA, 21 bp, Artificial Sequence
  Description of Artificial Sequence: Synthetic oligonucleotide
cctgcctataggagagaatat

SEQ ID NO: 3026 - DNA, 21 bp, Artificial Sequence
  Description of Artificial Sequence: Synthetic oligonucleotide
attctctcctataggcagggc

SEQ ID NO: 3027 - DNA, 21 bp, Artificial Sequence
  Description of Artificial Sequence: Synthetic oligonucleotide
ctgcctataggagagaatatt

SEQ ID NO: 3028 - DNA, 21 bp, Artificial Sequence
  Description of Artificial Sequence: Synthetic oligonucleotide
tattctctcctataggcaggg

SEQ ID NO: 3029 - DNA, 21 bp, Artificial Sequence
  Description of Artificial Sequence: Synthetic oligonucleotide
tgcctataggagagaatattt

SEQ ID NO: 3030 - DNA, 21 bp, Artificial Sequence
  Description of Artificial Sequence: Synthetic oligonucleotide
atattctctcctataggcagg

SEQ ID NO: 3031 - DNA, 21 bp, Artificial Sequence
  Description of Artificial Sequence: Synthetic oligonucleotide
gcctataggagagaatatttg

SEQ ID NO: 3032 - DNA, 21 bp, Artificial Sequence
  Description of Artificial Sequence: Synthetic oligonucleotide
aatattctctcctataggcag

SEQ ID NO: 3033 - DNA, 21 bp, Artificial Sequence
  Description of Artificial Sequence: Synthetic oligonucleotide
cctataggagagaatatttgg

SEQ ID NO: 3034 - DNA, 21 bp, Artificial Sequence
  Description of Artificial Sequence: Synthetic oligonucleotide
aaatattctctcctataggca

SEQ ID NO: 3035 - DNA, 21 bp, Artificial Sequence
  Description of Artificial Sequence: Synthetic oligonucleotide
ctataggagagaatatttgga

SEQ ID NO: 3036 - DNA, 21 bp, Artificial Sequence
  Description of Artificial Sequence: Synthetic oligonucleotide
caaatattctctcctataggc

SEQ ID NO: 3037 - DNA, 21 bp, Artificial Sequence
  Description of Artificial Sequence: Synthetic oligonucleotide
tataggagagaatatttggag

SEQ ID NO: 3038 - DNA, 21 bp, Artificial Sequence
  Description of Artificial Sequence: Synthetic oligonucleotide
ccaaatattctctcctatagg

SEQ ID NO: 3039 - DNA, 21 bp, Artificial Sequence
  Description of Artificial Sequence: Synthetic oligonucleotide
ataggagagaatatttggaga

SEQ ID NO: 3040 - DNA, 21 bp, Artificial Sequence
  Description of Artificial Sequence: Synthetic oligonucleotide
tccaaatattctctcctatag

SEQ ID NO: 3041 - DNA, 21 bp, Artificial Sequence
  Description of Artificial Sequence: Synthetic oligonucleotide
taggagagaatatttggagat

SEQ ID NO: 3042 - DNA, 21 bp, Artificial Sequence
  Description of Artificial Sequence: Synthetic oligonucleotide
ctccaaatattctctcctata

SEQ ID NO: 3043 - DNA, 21 bp, Artificial Sequence
  Description of Artificial Sequence: Synthetic oligonucleotide
aggagagaatatttggagata

SEQ ID NO: 3044 - DNA, 21 bp, Artificial Sequence
  Description of Artificial Sequence: Synthetic oligonucleotide
tctccaaatattctctcctat

SEQ ID NO: 3045 - DNA, 21 bp, Artificial Sequence
  Description of Artificial Sequence: Synthetic oligonucleotide
ggagagaatatttggagatag

SEQ ID NO: 3046 - DNA, 21 bp, Artificial Sequence
  Description of Artificial Sequence: Synthetic oligonucleotide
atctccaaatattctctccta

SEQ ID NO: 3047 - DNA, 21 bp, Artificial Sequence
  Description of Artificial Sequence: Synthetic oligonucleotide
gagagaatatttggagatagg

SEQ ID NO: 3048 - DNA, 21 bp, Artificial Sequence
  Description of Artificial Sequence: Synthetic oligonucleotide
tatctccaaatattctctcct

SEQ ID NO: 3049 - DNA, 21 bp, Artificial Sequence
  Description of Artificial Sequence: Synthetic oligonucleotide
agagaatatttggagataggc

SEQ ID NO: 3050 - DNA, 21 bp, Artificial Sequence
  Description of Artificial Sequence: Synthetic oligonucleotide
ctatctccaaatattctctcc

SEQ ID NO: 3051 - DNA, 21 bp, Artificial Sequence
  Description of Artificial Sequence: Synthetic oligonucleotide
gagaatatttggagataggca

SEQ ID NO: 3052 - DNA, 21 bp, Artificial Sequence
  Description of Artificial Sequence: Synthetic oligonucleotide
cctatctccaaatattctctc

SEQ ID NO: 3053 - DNA, 21 bp, Artificial Sequence
  Description of Artificial Sequence: Synthetic oligonucleotide
agaatatttggagataggcag

SEQ ID NO: 3054 - DNA, 21 bp, Artificial Sequence
  Description of Artificial Sequence: Synthetic oligonucleotide
gcctatctccaaatattctct

SEQ ID NO: 3055 - DNA, 21 bp, Artificial Sequence
  Description of Artificial Sequence: Synthetic oligonucleotide
gaatatttggagataggcagc

SEQ ID NO: 3056 - DNA, 21 bp, Artificial Sequence
  Description of Artificial Sequence: Synthetic oligonucleotide
tgcctatctccaaatattctc

SEQ ID NO: 3057 - DNA, 21 bp, Artificial Sequence
  Description of Artificial Sequence: Synthetic oligonucleotide
aatatttggagataggcagct

SEQ ID NO: 3058 - DNA, 21 bp, Artificial Sequence
  Description of Artificial Sequence: Synthetic oligonucleotide
ctgcctatctccaaatattct

SEQ ID NO: 3059 - DNA, 21 bp, Artificial Sequence
  Description of Artificial Sequence: Synthetic oligonucleotide
atatttggagataggcagctt

SEQ ID NO: 3060 - DNA, 21 bp, Artificial Sequence
  Description of Artificial Sequence: Synthetic oligonucleotide
gctgcctatctccaaatattc

SEQ ID NO: 3061 - DNA, 21 bp, Artificial Sequence
  Description of Artificial Sequence: Synthetic oligonucleotide
tatttggagataggcagcttc

SEQ ID NO: 3062 - DNA, 21 bp, Artificial Sequence
  Description of Artificial Sequence: Synthetic oligonucleotide
agctgcctatctccaaatatt

SEQ ID NO: 3063 - DNA, 21 bp, Artificial Sequence
  Description of Artificial Sequence: Synthetic oligonucleotide
atttggagataggcagcttca

SEQ ID NO: 3064 - DNA, 21 bp, Artificial Sequence
  Description of Artificial Sequence: Synthetic oligonucleotide
aagctgcctatctccaaatat

SEQ ID NO: 3065 - DNA, 21 bp, Artificial Sequence
  Description of Artificial Sequence: Synthetic oligonucleotide
tttggagataggcagcttcag

SEQ ID NO: 3066 - DNA, 21 bp, Artificial Sequence
  Description of Artificial Sequence: Synthetic oligonucleotide
gaagctgcctatctccaaata

SEQ ID NO: 3067 - DNA, 21 bp, Artificial Sequence
  Description of Artificial Sequence: Synthetic oligonucleotide
ttggagataggcagcttcagg

SEQ ID NO: 3068 - DNA, 21 bp, Artificial Sequence
  Description of Artificial Sequence: Synthetic oligonucleotide
tgaagctgcctatctccaaat

SEQ ID NO: 3069 - DNA, 21 bp, Artificial Sequence
  Description of Artificial Sequence: Synthetic oligonucleotide
tggagataggcagcttcagga

SEQ ID NO: 3070 - DNA, 21 bp, Artificial Sequence
  Description of Artificial Sequence: Synthetic oligonucleotide
ctgaagctgcctatctccaaa

SEQ ID NO: 3071 - DNA, 21 bp, Artificial Sequence
  Description of Artificial Sequence: Synthetic oligonucleotide
ggagataggcagcttcaggat

SEQ ID NO: 3072 - DNA, 21 bp, Artificial Sequence
  Description of Artificial Sequence: Synthetic oligonucleotide
cctgaagctgcctatctccaa

SEQ ID NO: 3073 - DNA, 21 bp, Artificial Sequence
  Description of Artificial Sequence: Synthetic oligonucleotide
gagataggcagcttcaggatg

SEQ ID NO: 3074 - DNA, 21 bp, Artificial Sequence
  Description of Artificial Sequence: Synthetic oligonucleotide
tcctgaagctgcctatctcca

SEQ ID NO: 3075 - DNA, 21 bp, Artificial Sequence
  Description of Artificial Sequence: Synthetic oligonucleotide
agataggcagcttcaggatgc

SEQ ID NO: 3076 - DNA, 21 bp, Artificial Sequence
  Description of Artificial Sequence: Synthetic oligonucleotide
atcctgaagctgcctatctcc

SEQ ID NO: 3077 - DNA, 21 bp, Artificial Sequence
  Description of Artificial Sequence: Synthetic oligonucleotide
gataggcagcttcaggatgca

SEQ ID NO: 3078 - DNA, 21 bp, Artificial Sequence
  Description of Artificial Sequence: Synthetic oligonucleotide
catcctgaagctgcctatctc

SEQ ID NO: 3079 - DNA, 21 bp, Artificial Sequence
  Description of Artificial Sequence: Synthetic oligonucleotide
ataggcagcttcaggatgcat

SEQ ID NO: 3080 - DNA, 21 bp, Artificial Sequence
  Description of Artificial Sequence: Synthetic oligonucleotide
gcatcctgaagctgcctatct

SEQ ID NO: 3081 - DNA, 21 bp, Artificial Sequence
  Description of Artificial Sequence: Synthetic oligonucleotide
taggcagcttcaggatgcatt

SEQ ID NO: 3082 - DNA, 21 bp, Artificial Sequence
  Description of Artificial Sequence: Synthetic oligonucleotide
tgcatcctgaagctgcctatc

SEQ ID NO: 3083 - DNA, 21 bp, Artificial Sequence
  Description of Artificial Sequence: Synthetic oligonucleotide
aggcagcttcaggatgcattg

SEQ ID NO: 3084 - DNA, 21 bp, Artificial Sequence
  Description of Artificial Sequence: Synthetic oligonucleotide
atgcatcctgaagctgcctat

SEQ ID NO: 3085 - DNA, 21 bp, Artificial Sequence
  Description of Artificial Sequence: Synthetic oligonucleotide
ggcagcttcaggatgcattgc

SEQ ID NO: 3086 - DNA, 21 bp, Artificial Sequence
  Description of Artificial Sequence: Synthetic oligonucleotide
aatgcatcctgaagctgccta

SEQ ID NO: 3087 - DNA, 21 bp, Artificial Sequence
  Description of Artificial Sequence: Synthetic oligonucleotide
gcagcttcaggatgcattgca

SEQ ID NO: 3088 - DNA, 21 bp, Artificial Sequence
  Description of Artificial Sequence: Synthetic oligonucleotide
caatgcatcctgaagctgcct

SEQ ID NO: 3089 - DNA, 21 bp, Artificial Sequence
  Description of Artificial Sequence: Synthetic oligonucleotide
cagcttcaggatgcattgcaa

SEQ ID NO: 3090 - DNA, 21 bp, Artificial Sequence
  Description of Artificial Sequence: Synthetic oligonucleotide
gcaatgcatcctgaagctgcc

SEQ ID NO: 3091 - DNA, 21 bp, Artificial Sequence
  Description of Artificial Sequence: Synthetic oligonucleotide
agcttcaggatgcattgcaat

SEQ ID NO: 3092 - DNA, 21 bp, Artificial Sequence
  Description of Artificial Sequence: Synthetic oligonucleotide
tgcaatgcatcctgaagctgc

SEQ ID NO: 3093 - DNA, 21 bp, Artificial Sequence
  Description of Artificial Sequence: Synthetic oligonucleotide
gcttcaggatgcattgcaatc

SEQ ID NO: 3094 - DNA, 21 bp, Artificial Sequence
  Description of Artificial Sequence: Synthetic oligonucleotide
ttgcaatgcatcctgaagctg

SEQ ID NO: 3095 - DNA, 21 bp, Artificial Sequence
  Description of Artificial Sequence: Synthetic oligonucleotide
cttcaggatgcattgcaatca

SEQ ID NO: 3096 - DNA, 21 bp, Artificial Sequence
  Description of Artificial Sequence: Synthetic oligonucleotide
attgcaatgcatcctgaagct

SEQ ID NO: 3097 - DNA, 21 bp, Artificial Sequence
  Description of Artificial Sequence: Synthetic oligonucleotide
ttcaggatgcattgcaatcat

SEQ ID NO: 3098 - DNA, 21 bp, Artificial Sequence
  Description of Artificial Sequence: Synthetic oligonucleotide
gattgcaatgcatcctgaagc

SEQ ID NO: 3099 - DNA, 21 bp, Artificial Sequence
  Description of Artificial Sequence: Synthetic oligonucleotide
tcaggatgcattgcaatcatc

SEQ ID NO: 3100 - DNA, 21 bp, Artificial Sequence
  Description of Artificial Sequence: Synthetic oligonucleotide
tgattgcaatgcatcctgaag

SEQ ID NO: 3101 - DNA, 21 bp, Artificial Sequence
  Description of Artificial Sequence: Synthetic oligonucleotide
caggatgcattgcaatcatcc

SEQ ID NO: 3102 - DNA, 21 bp, Artificial Sequence
  Description of Artificial Sequence: Synthetic oligonucleotide
atgattgcaatgcatcctgaa

SEQ ID NO: 3103 - DNA, 21 bp, Artificial Sequence
  Description of Artificial Sequence: Synthetic oligonucleotide
aggatgcattgcaatcatcct

SEQ ID NO: 3104 - DNA, 21 bp, Artificial Sequence
  Description of Artificial Sequence: Synthetic oligonucleotide
gatgattgcaatgcatcctga

SEQ ID NO: 3105 - DNA, 21 bp, Artificial Sequence
  Description of Artificial Sequence: Synthetic oligonucleotide
ggatgcattgcaatcatcctt

SEQ ID NO: 3106 - DNA, 21 bp, Artificial Sequence
  Description of Artificial Sequence: Synthetic oligonucleotide
ggatgattgcaatgcatcctg

SEQ ID NO: 3107 - DNA, 21 bp, Artificial Sequence
  Description of Artificial Sequence: Synthetic oligonucleotide
gatgcattgcaatcatccttt

SEQ ID NO: 3108 - DNA, 21 bp, Artificial Sequence
  Description of Artificial Sequence: Synthetic oligonucleotide
aggatgattgcaatgcatcct

SEQ ID NO: 3109 - DNA, 21 bp, Artificial Sequence
  Description of Artificial Sequence: Synthetic oligonucleotide
atgcattgcaatcatcctttt

SEQ ID NO: 3110 - DNA, 21 bp, Artificial Sequence
  Description of Artificial Sequence: Synthetic oligonucleotide
aaggatgattgcaatgcatcc

SEQ ID NO: 3111 - DNA, 21 bp, Artificial Sequence
  Description of Artificial Sequence: Synthetic oligonucleotide
tgcattgcaatcatccttttc

SEQ ID NO: 3112 - DNA, 21 bp, Artificial Sequence
  Description of Artificial Sequence: Synthetic oligonucleotide
aaaggatgattgcaatgcatc

SEQ ID NO: 3113 - DNA, 21 bp, Artificial Sequence
  Description of Artificial Sequence: Synthetic oligonucleotide
gcattgcaatcatccttttct

SEQ ID NO: 3114 - DNA, 21 bp, Artificial Sequence
  Description of Artificial Sequence: Synthetic oligonucleotide
aaaaggatgattgcaatgcat

SEQ ID NO: 3115 - DNA, 21 bp, Artificial Sequence
  Description of Artificial Sequence: Synthetic oligonucleotide
cattgcaatcatccttttctt

SEQ ID NO: 3116 - DNA, 21 bp, Artificial Sequence
  Description of Artificial Sequence: Synthetic oligonucleotide
gaaaaggatgattgcaatgca

SEQ ID NO: 3117 - DNA, 21 bp, Artificial Sequence
  Description of Artificial Sequence: Synthetic oligonucleotide
attgcaatcatccttttctta

SEQ ID NO: 3118 - DNA, 21 bp, Artificial Sequence
  Description of Artificial Sequence: Synthetic oligonucleotide
agaaaaggatgattgcaatgc

SEQ ID NO: 3119 - DNA, 21 bp, Artificial Sequence
  Description of Artificial Sequence: Synthetic oligonucleotide
ttgcaatcatccttttcttaa

SEQ ID NO: 3120 - DNA, 21 bp, Artificial Sequence
  Description of Artificial Sequence: Synthetic oligonucleotide
aagaaaaggatgattgcaatg

SEQ ID NO: 3121 - DNA, 21 bp, Artificial Sequence
  Description of Artificial Sequence: Synthetic oligonucleotide
tgcaatcatccttttcttaaa

SEQ ID NO: 3122 - DNA, 21 bp, Artificial Sequence
  Description of Artificial Sequence: Synthetic oligonucleotide
taagaaaaggatgattgcaat

SEQ ID NO: 3123 - DNA, 21 bp, Artificial Sequence
  Description of Artificial Sequence: Synthetic oligonucleotide
gcaatcatccttttcttaaat

SEQ ID NO: 3124 - DNA, 21 bp, Artificial Sequence
  Description of Artificial Sequence: Synthetic oligonucleotide
ttaagaaaaggatgattgcaa

SEQ ID NO: 3125 - DNA, 21 bp, Artificial Sequence
  Description of Artificial Sequence: Synthetic oligonucleotide
caatcatccttttcttaaatt

SEQ ID NO: 3126 - DNA, 21 bp, Artificial Sequence
  Description of Artificial Sequence: Synthetic oligonucleotide
tttaagaaaaggatgattgca

SEQ ID NO: 3127 - DNA, 21 bp, Artificial Sequence
  Description of Artificial Sequence: Synthetic oligonucleotide
aatcatccttttcttaaatta

SEQ ID NO: 3128 - DNA, 21 bp, Artificial Sequence
  Description of Artificial Sequence: Synthetic oligonucleotide
atttaagaaaaggatgattgc

SEQ ID NO: 3129 - DNA, 21 bp, Artificial Sequence
  Description of Artificial Sequence: Synthetic oligonucleotide
atcatccttttcttaaattat

SEQ ID NO: 3130 - DNA, 21 bp, Artificial Sequence
  Description of Artificial Sequence: Synthetic oligonucleotide
aatttaagaaaaggatgattg

SEQ ID NO: 3131 - DNA, 21 bp, Artificial Sequence
  Description of Artificial Sequence: Synthetic oligonucleotide
tcatccttttcttaaattatg

SEQ ID NO: 3132 - DNA, 21 bp, Artificial Sequence
  Description of Artificial Sequence: Synthetic oligonucleotide
taatttaagaaaaggatgatt

SEQ ID NO: 3133 - DNA, 21 bp, Artificial Sequence
  Description of Artificial Sequence: Synthetic oligonucleotide
catccttttcttaaattatgt

SEQ ID NO: 3134 - DNA, 21 bp, Artificial Sequence
  Description of Artificial Sequence: Synthetic oligonucleotide
ataatttaagaaaaggatgat

SEQ ID NO: 3135 - DNA, 21 bp, Artificial Sequence
  Description of Artificial Sequence: Synthetic oligonucleotide
atccttttcttaaattatgtc

SEQ ID NO: 3136 - DNA, 21 bp, Artificial Sequence
  Description of Artificial Sequence: Synthetic oligonucleotide
cataatttaagaaaaggatga

SEQ ID NO: 3137 - DNA, 21 bp, Artificial Sequence
  Description of Artificial Sequence: Synthetic oligonucleotide
tccttttcttaaattatgtca

SEQ ID NO: 3138 - DNA, 21 bp, Artificial Sequence
  Description of Artificial Sequence: Synthetic oligonucleotide
acataatttaagaaaaggatg

SEQ ID NO: 3139 - DNA, 21 bp, Artificial Sequence
  Description of Artificial Sequence: Synthetic oligonucleotide
ccttttcttaaattatgtcac

SEQ ID NO: 3140 - DNA, 21 bp, Artificial Sequence
  Description of Artificial Sequence: Synthetic oligonucleotide
gacataatttaagaaaaggat

SEQ ID NO: 3141 - DNA, 21 bp, Artificial Sequence
  Description of Artificial Sequence: Synthetic oligonucleotide
cttttcttaaattatgtcact

SEQ ID NO: 3142 - DNA, 21 bp, Artificial Sequence
  Description of Artificial Sequence: Synthetic oligonucleotide
tgacataatttaagaaaagga

SEQ ID NO: 3143 - DNA, 21 bp, Artificial Sequence
  Description of Artificial Sequence: Synthetic oligonucleotide
ttttcttaaattatgtcacta

SEQ ID NO: 3144 - DNA, 21 bp, Artificial Sequence
  Description of Artificial Sequence: Synthetic oligonucleotide
gtgacataatttaagaaaagg

SEQ ID NO: 3145 - DNA, 21 bp, Artificial Sequence
  Description of Artificial Sequence: Synthetic oligonucleotide
tttcttaaattatgtcactag

SEQ ID NO: 3146 - DNA, 21 bp, Artificial Sequence
  Description of Artificial Sequence: Synthetic oligonucleotide
agtgacataatttaagaaaag

SEQ ID NO: 3147 - DNA, 21 bp, Artificial Sequence
  Description of Artificial Sequence: Synthetic oligonucleotide
ttcttaaattatgtcactagt

SEQ ID NO: 3148 - DNA, 21 bp, Artificial Sequence
  Description of Artificial Sequence: Synthetic oligonucleotide
tagtgacataatttaagaaaa

SEQ ID NO: 3149 - DNA, 21 bp, Artificial Sequence
  Description of Artificial Sequence: Synthetic oligonucleotide
tcttaaattatgtcactagtc

SEQ ID NO: 3150 - DNA, 21 bp, Artificial Sequence
  Description of Artificial Sequence: Synthetic oligonucleotide
ctagtgacataatttaagaaa

SEQ ID NO: 3151 - DNA, 21 bp, Artificial Sequence
  Description of Artificial Sequence: Synthetic oligonucleotide
cttaaattatgtcactagtct

SEQ ID NO: 3152 - DNA, 21 bp, Artificial Sequence
  Description of Artificial Sequence: Synthetic oligonucleotide
actagtgacataatttaagaa

SEQ ID NO: 3153 - DNA, 21 bp, Artificial Sequence
  Description of Artificial Sequence: Synthetic oligonucleotide
ttaaattatgtcactagtctt

SEQ ID NO: 3154 - DNA, 21 bp, Artificial Sequence
  Description of Artificial Sequence: Synthetic oligonucleotide
gactagtgacataatttaaga

SEQ ID NO: 3155 - DNA, 21 bp, Artificial Sequence
  Description of Artificial Sequence: Synthetic oligonucleotide
taaattatgtcactagtcttt

SEQ ID NO: 3156 - DNA, 21 bp, Artificial Sequence
  Description of Artificial Sequence: Synthetic oligonucleotide
agactagtgacataatttaag

SEQ ID NO: 3157 - DNA, 21 bp, Artificial Sequence
  Description of Artificial Sequence: Synthetic oligonucleotide
aaattatgtcactagtctttt

SEQ ID NO: 3158 - DNA, 21 bp, Artificial Sequence
  Description of Artificial Sequence: Synthetic oligonucleotide
aagactagtgacataatttaa

SEQ ID NO: 3159 - DNA, 21 bp, Artificial Sequence
  Description of Artificial Sequence: Synthetic oligonucleotide
aattatgtcactagtctttta

SEQ ID NO: 3160 - DNA, 21 bp, Artificial Sequence
  Description of Artificial Sequence: Synthetic oligonucleotide
aaagactagtgacataattta

SEQ ID NO: 3161 - DNA, 21 bp, Artificial Sequence
  Description of Artificial Sequence: Synthetic oligonucleotide
attatgtcactagtcttttat

SEQ ID NO: 3162 - DNA, 21 bp, Artificial Sequence
  Description of Artificial Sequence: Synthetic oligonucleotide
aaaagactagtgacataattt

SEQ ID NO: 3163 - DNA, 21 bp, Artificial Sequence
  Description of Artificial Sequence: Synthetic oligonucleotide
ttatgtcactagtcttttatt

SEQ ID NO: 3164 - DNA, 21 bp, Artificial Sequence
  Description of Artificial Sequence: Synthetic oligonucleotide
taaaagactagtgacataatt

SEQ ID NO: 3165 - DNA, 21 bp, Artificial Sequence
  Description of Artificial Sequence: Synthetic oligonucleotide
tatgtcactagtcttttattt

SEQ ID NO: 3166 - DNA, 21 bp, Artificial Sequence
  Description of Artificial Sequence: Synthetic oligonucleotide
ataaaagactagtgacataat

SEQ ID NO: 3167 - DNA, 21 bp, Artificial Sequence
  Description of Artificial Sequence: Synthetic oligonucleotide
atgtcactagtcttttatttt

SEQ ID NO: 3168 - DNA, 21 bp, Artificial Sequence
  Description of Artificial Sequence: Synthetic oligonucleotide
aataaaagactagtgacataa

SEQ ID NO: 3169 - DNA, 21 bp, Artificial Sequence
  Description of Artificial Sequence: Synthetic oligonucleotide
tgtcactagtcttttattttt

SEQ ID NO: 3170 - DNA, 21 bp, Artificial Sequence
  Description of Artificial Sequence: Synthetic oligonucleotide
aaataaaagactagtgacata

SEQ ID NO: 3171 - DNA, 21 bp, Artificial Sequence
  Description of Artificial Sequence: Synthetic oligonucleotide
gtcactagtcttttatttttt

SEQ ID NO: 3172 - DNA, 21 bp, Artificial Sequence
  Description of Artificial Sequence: Synthetic oligonucleotide
aaaataaaagactagtgacat

SEQ ID NO: 3173 - DNA, 21 bp, Artificial Sequence
  Description of Artificial Sequence: Synthetic oligonucleotide
tcactagtcttttattttttc

SEQ ID NO: 3174 - DNA, 21 bp, Artificial Sequence
  Description of Artificial Sequence: Synthetic oligonucleotide
aaaaataaaagactagtgaca

SEQ ID NO: 3175 - DNA, 21 bp, Artificial Sequence
  Description of Artificial Sequence: Synthetic oligonucleotide
cactagtcttttattttttcc

SEQ ID NO: 3176 - DNA, 21 bp, Artificial Sequence
  Description of Artificial Sequence: Synthetic oligonucleotide
aaaaaataaaagactagtgac

SEQ ID NO: 3177 - DNA, 21 bp, Artificial Sequence
  Description of Artificial Sequence: Synthetic oligonucleotide
actagtcttttattttttccc

SEQ ID NO: 3178 - DNA, 21 bp, Artificial Sequence
  Description of Artificial Sequence: Synthetic oligonucleotide
gaaaaaataaaagactagtga

SEQ ID NO: 3179 - DNA, 21 bp, Artificial Sequence
  Description of Artificial Sequence: Synthetic oligonucleotide
ctagtcttttattttttcccc

SEQ ID NO: 3180 - DNA, 21 bp, Artificial Sequence
  Description of Artificial Sequence: Synthetic oligonucleotide
ggaaaaaataaaagactagtg

SEQ ID NO: 3181 - DNA, 21 bp, Artificial Sequence
  Description of Artificial Sequence: Synthetic oligonucleotide
tagtcttttattttttcccct

SEQ ID NO: 3182 - DNA, 21 bp, Artificial Sequence
  Description of Artificial Sequence: Synthetic oligonucleotide
gggaaaaaataaaagactagt

SEQ ID NO: 3183 - DNA, 21 bp, Artificial Sequence
  Description of Artificial Sequence: Synthetic oligonucleotide
agtcttttattttttcccctc

SEQ ID NO: 3184 - DNA, 21 bp, Artificial Sequence
  Description of Artificial Sequence: Synthetic oligonucleotide
ggggaaaaaataaaagactag

SEQ ID NO: 3185 - DNA, 21 bp, Artificial Sequence
  Description of Artificial Sequence: Synthetic oligonucleotide
gtcttttattttttcccctct

SEQ ID NO: 3186 - DNA, 21 bp, Artificial Sequence
  Description of Artificial Sequence: Synthetic oligonucleotide
aggggaaaaaataaaagacta

SEQ ID NO: 3187 - DNA, 21 bp, Artificial Sequence
  Description of Artificial Sequence: Synthetic oligonucleotide
tcttttattttttcccctctt

SEQ ID NO: 3188 - DNA, 21 bp, Artificial Sequence
  Description of Artificial Sequence: Synthetic oligonucleotide
gaggggaaaaaataaaagact

SEQ ID NO: 3189 - DNA, 21 bp, Artificial Sequence
  Description of Artificial Sequence: Synthetic oligonucleotide
cttttattttttcccctcttg

SEQ ID NO: 3190 - DNA, 21 bp, Artificial Sequence
  Description of Artificial Sequence: Synthetic oligonucleotide
agaggggaaaaaataaaagac

SEQ ID NO: 3191 - DNA, 21 bp, Artificial Sequence
  Description of Artificial Sequence: Synthetic oligonucleotide
ttttattttttcccctcttga

SEQ ID NO: 3192 - DNA, 21 bp, Artificial Sequence
  Description of Artificial Sequence: Synthetic oligonucleotide
aagaggggaaaaaataaaaga

SEQ ID NO: 3193 - DNA, 21 bp, Artificial Sequence
  Description of Artificial Sequence: Synthetic oligonucleotide
tttattttttcccctcttgaa

SEQ ID NO: 3194 - DNA, 21 bp, Artificial Sequence
  Description of Artificial Sequence: Synthetic oligonucleotide
caagaggggaaaaaataaaag

SEQ ID NO: 3195 - DNA, 21 bp, Artificial Sequence
  Description of Artificial Sequence: Synthetic oligonucleotide
ttattttttcccctcttgaac

SEQ ID NO: 3196 - DNA, 21 bp, Artificial Sequence
  Description of Artificial Sequence: Synthetic oligonucleotide
tcaagaggggaaaaaataaaa

SEQ ID NO: 3197 - DNA, 21 bp, Artificial Sequence
  Description of Artificial Sequence: Synthetic oligonucleotide
tattttttcccctcttgaact

SEQ ID NO: 3198 - DNA, 21 bp, Artificial Sequence
  Description of Artificial Sequence: Synthetic oligonucleotide
ttcaagaggggaaaaaataaa

SEQ ID NO: 3199 - DNA, 21 bp, Artificial Sequence
  Description of Artificial Sequence: Synthetic oligonucleotide
attttttcccctcttgaactt

SEQ ID NO: 3200 - DNA, 21 bp, Artificial Sequence
  Description of Artificial Sequence: Synthetic oligonucleotide
gttcaagaggggaaaaaataa

SEQ ID NO: 3201 - DNA, 21 bp, Artificial Sequence
  Description of Artificial Sequence: Synthetic oligonucleotide
ttttttcccctcttgaacttt

SEQ ID NO: 3202 - DNA, 21 bp, Artificial Sequence
  Description of Artificial Sequence: Synthetic oligonucleotide
agttcaagaggggaaaaaata

SEQ ID NO: 3203 - DNA, 21 bp, Artificial Sequence
  Description of Artificial Sequence: Synthetic oligonucleotide
tttttcccctcttgaactttc

SEQ ID NO: 3204 - DNA, 21 bp, Artificial Sequence
  Description of Artificial Sequence: Synthetic oligonucleotide
aagttcaagaggggaaaaaat

SEQ ID NO: 3205 - DNA, 21 bp, Artificial Sequence
  Description of Artificial Sequence: Synthetic oligonucleotide
ttttcccctcttgaactttcc

SEQ ID NO: 3206 - DNA, 21 bp, Artificial Sequence
  Description of Artificial Sequence: Synthetic oligonucleotide
aaagttcaagaggggaaaaaa

SEQ ID NO: 3207 - DNA, 21 bp, Artificial Sequence
  Description of Artificial Sequence: Synthetic oligonucleotide
tttcccctcttgaactttcct

SEQ ID NO: 3208 - DNA, 21 bp, Artificial Sequence
  Description of Artificial Sequence: Synthetic oligonucleotide
gaaagttcaagaggggaaaaa

SEQ ID NO: 3209 - DNA, 21 bp, Artificial Sequence
  Description of Artificial Sequence: Synthetic oligonucleotide
ttcccctcttgaactttcctc

SEQ ID NO: 3210 - DNA, 21 bp, Artificial Sequence
  Description of Artificial Sequence: Synthetic oligonucleotide
ggaaagttcaagaggggaaaa

SEQ ID NO: 3211 - DNA, 21 bp, Artificial Sequence
  Description of Artificial Sequence: Synthetic oligonucleotide
tcccctcttgaactttcctca

SEQ ID NO: 3212 - DNA, 21 bp, Artificial Sequence
  Description of Artificial Sequence: Synthetic oligonucleotide
aggaaagttcaagaggggaaa

SEQ ID NO: 3213 - DNA, 21 bp, Artificial Sequence
  Description of Artificial Sequence: Synthetic oligonucleotide
cccctcttgaactttcctcac

SEQ ID NO: 3214 - DNA, 21 bp, Artificial Sequence
  Description of Artificial Sequence: Synthetic oligonucleotide
gaggaaagttcaagaggggaa

SEQ ID NO: 3215 - DNA, 21 bp, Artificial Sequence
  Description of Artificial Sequence: Synthetic oligonucleotide
ccctcttgaactttcctcaca

SEQ ID NO: 3216 - DNA, 21 bp, Artificial Sequence
  Description of Artificial Sequence: Synthetic oligonucleotide
tgaggaaagttcaagagggga

SEQ ID NO: 3217 - DNA, 21 bp, Artificial Sequence
  Description of Artificial Sequence: Synthetic oligonucleotide
cctcttgaactttcctcacac

SEQ ID NO: 3218 - DNA, 21 bp, Artificial Sequence
  Description of Artificial Sequence: Synthetic oligonucleotide
gtgaggaaagttcaagagggg

SEQ ID NO: 3219 - DNA, 21 bp, Artificial Sequence
  Description of Artificial Sequence: Synthetic oligonucleotide
ctcttgaactttcctcacacc

SEQ ID NO: 3220 - DNA, 21 bp, Artificial Sequence
  Description of Artificial Sequence: Synthetic oligonucleotide
tgtgaggaaagttcaagaggg

SEQ ID NO: 3221 - DNA, 21 bp, Artificial Sequence
  Description of Artificial Sequence: Synthetic oligonucleotide
tcttgaactttcctcacacct

SEQ ID NO: 3222 - DNA, 21 bp, Artificial Sequence
  Description of Artificial Sequence: Synthetic oligonucleotide
gtgtgaggaaagttcaagagg

SEQ ID NO: 3223 - DNA, 21 bp, Artificial Sequence
  Description of Artificial Sequence: Synthetic oligonucleotide
cttgaactttcctcacacctg

SEQ ID NO: 3224 - DNA, 21 bp, Artificial Sequence
  Description of Artificial Sequence: Synthetic oligonucleotide
ggtgtgaggaaagttcaagag

SEQ ID NO: 3225 - DNA, 21 bp, Artificial Sequence
  Description of Artificial Sequence: Synthetic oligonucleotide
ttgaactttcctcacacctgg

SEQ ID NO: 3226 - DNA, 21 bp, Artificial Sequence
  Description of Artificial Sequence: Synthetic oligonucleotide
aggtgtgaggaaagttcaaga

SEQ ID NO: 3227 - DNA, 21 bp, Artificial Sequence
  Description of Artificial Sequence: Synthetic oligonucleotide
tgaactttcctcacacctgga

SEQ ID NO: 3228 - DNA, 21 bp, Artificial Sequence
  Description of Artificial Sequence: Synthetic oligonucleotide
caggtgtgaggaaagttcaag

SEQ ID NO: 3229 - DNA, 21 bp, Artificial Sequence
  Description of Artificial Sequence: Synthetic oligonucleotide
gaactttcctcacacctggaa

SEQ ID NO: 3230 - DNA, 21 bp, Artificial Sequence
  Description of Artificial Sequence: Synthetic oligonucleotide
ccaggtgtgaggaaagttcaa

SEQ ID NO: 3231 - DNA, 21 bp, Artificial Sequence
  Description of Artificial Sequence: Synthetic oligonucleotide
aactttcctcacacctggaag

SEQ ID NO: 3232 - DNA, 21 bp, Artificial Sequence
  Description of Artificial Sequence: Synthetic oligonucleotide
tccaggtgtgaggaaagttca

SEQ ID NO: 3233 - DNA, 21 bp, Artificial Sequence
  Description of Artificial Sequence: Synthetic oligonucleotide
actttcctcacacctggaaga

SEQ ID NO: 3234 - DNA, 21 bp, Artificial Sequence
  Description of Artificial Sequence: Synthetic oligonucleotide
ttccaggtgtgaggaaagttc

SEQ ID NO: 3235 - DNA, 21 bp, Artificial Sequence
  Description of Artificial Sequence: Synthetic oligonucleotide
ctttcctcacacctggaagaa

SEQ ID NO: 3236 - DNA, 21 bp, Artificial Sequence
  Description of Artificial Sequence: Synthetic oligonucleotide
cttccaggtgtgaggaaagtt

SEQ ID NO: 3237 - DNA, 21 bp, Artificial Sequence
  Description of Artificial Sequence: Synthetic oligonucleotide
tttcctcacacctggaagaaa

SEQ ID NO: 3238 - DNA, 21 bp, Artificial Sequence
  Description of Artificial Sequence: Synthetic oligonucleotide
tcttccaggtgtgaggaaagt

SEQ ID NO: 3239 - DNA, 21 bp, Artificial Sequence
  Description of Artificial Sequence: Synthetic oligonucleotide
ttcctcacacctggaagaaac

SEQ ID NO: 3240 - DNA, 21 bp, Artificial Sequence
  Description of Artificial Sequence: Synthetic oligonucleotide
ttcttccaggtgtgaggaaag

SEQ ID NO: 3241 - DNA, 21 bp, Artificial Sequence
  Description of Artificial Sequence: Synthetic oligonucleotide
tcctcacacctggaagaaaca

SEQ ID NO: 3242 - DNA, 21 bp, Artificial Sequence
  Description of Artificial Sequence: Synthetic oligonucleotide
tttcttccaggtgtgaggaaa

SEQ ID NO: 3243 - DNA, 21 bp, Artificial Sequence
  Description of Artificial Sequence: Synthetic oligonucleotide
cctcacacctggaagaaacaa

SEQ ID NO: 3244 - DNA, 21 bp, Artificial Sequence
  Description of Artificial Sequence: Synthetic oligonucleotide
gtttcttccaggtgtgaggaa

SEQ ID NO: 3245 - DNA, 21 bp, Artificial Sequence
  Description of Artificial Sequence: Synthetic oligonucleotide
ctcacacctggaagaaacaaa

SEQ ID NO: 3246 - DNA, 21 bp, Artificial Sequence
  Description of Artificial Sequence: Synthetic oligonucleotide
tgtttcttccaggtgtgagga

SEQ ID NO: 3247 - DNA, 21 bp, Artificial Sequence
  Description of Artificial Sequence: Synthetic oligonucleotide
tcacacctggaagaaacaaag

SEQ ID NO: 3248 - DNA, 21 bp, Artificial Sequence
  Description of Artificial Sequence: Synthetic oligonucleotide
ttgtttcttccaggtgtgagg

SEQ ID NO: 3249 - DNA, 21 bp, Artificial Sequence
  Description of Artificial Sequence: Synthetic oligonucleotide
cacacctggaagaaacaaagt

SEQ ID NO: 3250 - DNA, 21 bp, Artificial Sequence
  Description of Artificial Sequence: Synthetic oligonucleotide
tttgtttcttccaggtgtgag

SEQ ID NO: 3251 - DNA, 21 bp, Artificial Sequence
  Description of Artificial Sequence: Synthetic oligonucleotide
acacctggaagaaacaaagta

SEQ ID NO: 3252 - DNA, 21 bp, Artificial Sequence
  Description of Artificial Sequence: Synthetic oligonucleotide
ctttgtttcttccaggtgtga

SEQ ID NO: 3253 - DNA, 21 bp, Artificial Sequence
  Description of Artificial Sequence: Synthetic oligonucleotide
cacctggaagaaacaaagtag

SEQ ID NO: 3254 - DNA, 21 bp, Artificial Sequence
  Description of Artificial Sequence: Synthetic oligonucleotide
actttgtttcttccaggtgtg

SEQ ID NO: 3255 - DNA, 21 bp, Artificial Sequence
  Description of Artificial Sequence: Synthetic oligonucleotide
acctggaagaaacaaagtagg

SEQ ID NO: 3256 - DNA, 21 bp, Artificial Sequence
  Description of Artificial Sequence: Synthetic oligonucleotide
tactttgtttcttccaggtgt

SEQ ID NO: 3257 - DNA, 21 bp, Artificial Sequence
  Description of Artificial Sequence: Synthetic oligonucleotide
cctggaagaaacaaagtagga

SEQ ID NO: 3258 - DNA, 21 bp, Artificial Sequence
  Description of Artificial Sequence: Synthetic oligonucleotide
ctactttgtttcttccaggtg

SEQ ID NO: 3259 - DNA, 21 bp, Artificial Sequence
  Description of Artificial Sequence: Synthetic oligonucleotide
ctggaagaaacaaagtaggaa

SEQ ID NO: 3260 - DNA, 21 bp, Artificial Sequence
  Description of Artificial Sequence: Synthetic oligonucleotide
cctactttgtttcttccaggt

SEQ ID NO: 3261 - DNA, 21 bp, Artificial Sequence
  Description of Artificial Sequence: Synthetic oligonucleotide
tggaagaaacaaagtaggaaa

SEQ ID NO: 3262 - DNA, 21 bp, Artificial Sequence
  Description of Artificial Sequence: Synthetic oligonucleotide
tcctactttgtttcttccagg

SEQ ID NO: 3263 - DNA, 21 bp, Artificial Sequence
  Description of Artificial Sequence: Synthetic oligonucleotide
ggaagaaacaaagtaggaaaa

SEQ ID NO: 3264 - DNA, 21 bp, Artificial Sequence
  Description of Artificial Sequence: Synthetic oligonucleotide
ttcctactttgtttcttccag

SEQ ID NO: 3265 - DNA, 21 bp, Artificial Sequence
  Description of Artificial Sequence: Synthetic oligonucleotide
gaagaaacaaagtaggaaaaa

SEQ ID NO: 3266 - DNA, 21 bp, Artificial Sequence
  Description of Artificial Sequence: Synthetic oligonucleotide
tttcctactttgtttcttcca

SEQ ID NO: 3267 - DNA, 21 bp, Artificial Sequence
  Description of Artificial Sequence: Synthetic oligonucleotide
aagaaacaaagtaggaaaaag

SEQ ID NO: 3268 - DNA, 21 bp, Artificial Sequence
  Description of Artificial Sequence: Synthetic oligonucleotide
ttttcctactttgtttcttcc

SEQ ID NO: 3269 - DNA, 21 bp, Artificial Sequence
  Description of Artificial Sequence: Synthetic oligonucleotide
agaaacaaagtaggaaaaagt

SEQ ID NO: 3270 - DNA, 21 bp, Artificial Sequence
  Description of Artificial Sequence: Synthetic oligonucleotide
tttttcctactttgtttcttc

SEQ ID NO: 3271 - DNA, 21 bp, Artificial Sequence
  Description of Artificial Sequence: Synthetic oligonucleotide
gaaacaaagtaggaaaaagtg

SEQ ID NO: 3272 - DNA, 21 bp, Artificial Sequence
  Description of Artificial Sequence: Synthetic oligonucleotide
ctttttcctactttgtttctt

SEQ ID NO: 3273 - DNA, 21 bp, Artificial Sequence
  Description of Artificial Sequence: Synthetic oligonucleotide
aaacaaagtaggaaaaagtga

SEQ ID NO: 3274 - DNA, 21 bp, Artificial Sequence
  Description of Artificial Sequence: Synthetic oligonucleotide
actttttcctactttgtttct

SEQ ID NO: 3275 - DNA, 21 bp, Artificial Sequence
  Description of Artificial Sequence: Synthetic oligonucleotide
aacaaagtaggaaaaagtgaa

SEQ ID NO: 3276 - DNA, 21 bp, Artificial Sequence
  Description of Artificial Sequence: Synthetic oligonucleotide
cactttttcctactttgtttc

SEQ ID NO: 3277 - DNA, 21 bp, Artificial Sequence
  Description of Artificial Sequence: Synthetic oligonucleotide
acaaagtaggaaaaagtgaac

SEQ ID NO: 3278 - DNA, 21 bp, Artificial Sequence
  Description of Artificial Sequence: Synthetic oligonucleotide
tcactttttcctactttgttt

SEQ ID NO: 3279 - DNA, 21 bp, Artificial Sequence
  Description of Artificial Sequence: Synthetic oligonucleotide
caaagtaggaaaaagtgaaca

SEQ ID NO: 3280 - DNA, 21 bp, Artificial Sequence
  Description of Artificial Sequence: Synthetic oligonucleotide
ttcactttttcctactttgtt

SEQ ID NO: 3281 - DNA, 21 bp, Artificial Sequence
  Description of Artificial Sequence: Synthetic oligonucleotide
aaagtaggaaaaagtgaacag

SEQ ID NO: 3282 - DNA, 21 bp, Artificial Sequence
  Description of Artificial Sequence: Synthetic oligonucleotide
gttcactttttcctactttgt

SEQ ID NO: 3283 - DNA, 21 bp, Artificial Sequence
  Description of Artificial Sequence: Synthetic oligonucleotide
aagtaggaaaaagtgaacagg

SEQ ID NO: 3284 - DNA, 21 bp, Artificial Sequence
  Description of Artificial Sequence: Synthetic oligonucleotide
tgttcactttttcctactttg

SEQ ID NO: 3285 - DNA, 21 bp, Artificial Sequence
  Description of Artificial Sequence: Synthetic oligonucleotide
agtaggaaaaagtgaacaggg

SEQ ID NO: 3286 - DNA, 21 bp, Artificial Sequence
  Description of Artificial Sequence: Synthetic oligonucleotide
ctgttcactttttcctacttt

SEQ ID NO: 3287 - DNA, 21 bp, Artificial Sequence
  Description of Artificial Sequence: Synthetic oligonucleotide
gtaggaaaaagtgaacagggg

SEQ ID NO: 3288 - DNA, 21 bp, Artificial Sequence
  Description of Artificial Sequence: Synthetic oligonucleotide
cctgttcactttttcctactt

SEQ ID NO: 3289 - DNA, 21 bp, Artificial Sequence
  Description of Artificial Sequence: Synthetic oligonucleotide
taggaaaaagtgaacagggga

SEQ ID NO: 3290 - DNA, 21 bp, Artificial Sequence
  Description of Artificial Sequence: Synthetic oligonucleotide
ccctgttcactttttcctact

SEQ ID NO: 3291 - DNA, 21 bp, Artificial Sequence
  Description of Artificial Sequence: Synthetic oligonucleotide
aggaaaaagtgaacaggggat

SEQ ID NO: 3292 - DNA, 21 bp, Artificial Sequence
  Description of Artificial Sequence: Synthetic oligonucleotide
cccctgttcactttttcctac

SEQ ID NO: 3293 - DNA, 21 bp, Artificial Sequence
  Description of Artificial Sequence: Synthetic oligonucleotide
ggaaaaagtgaacaggggatg

SEQ ID NO: 3294 - DNA, 21 bp, Artificial Sequence
  Description of Artificial Sequence: Synthetic oligonucleotide
tcccctgttcactttttccta

SEQ ID NO: 3295 - DNA, 21 bp, Artificial Sequence
  Description of Artificial Sequence: Synthetic oligonucleotide
gaaaaagtgaacaggggatgt

SEQ ID NO: 3296 - DNA, 21 bp, Artificial Sequence
  Description of Artificial Sequence: Synthetic oligonucleotide
atcccctgttcactttttcct

SEQ ID NO: 3297 - DNA, 21 bp, Artificial Sequence
  Description of Artificial Sequence: Synthetic oligonucleotide
aaaaagtgaacaggggatgtc

SEQ ID NO: 3298 - DNA, 21 bp, Artificial Sequence
  Description of Artificial Sequence: Synthetic oligonucleotide
catcccctgttcactttttcc

SEQ ID NO: 3299 - DNA, 21 bp, Artificial Sequence
  Description of Artificial Sequence: Synthetic oligonucleotide
aaaagtgaacaggggatgtca

SEQ ID NO: 3300 - DNA, 21 bp, Artificial Sequence
  Description of Artificial Sequence: Synthetic oligonucleotide
acatcccctgttcactttttc

SEQ ID NO: 3301 - DNA, 21 bp, Artificial Sequence
  Description of Artificial Sequence: Synthetic oligonucleotide
aaagtgaacaggggatgtcaa

SEQ ID NO: 3302 - DNA, 21 bp, Artificial Sequence
  Description of Artificial Sequence: Synthetic oligonucleotide
gacatcccctgttcacttttt

SEQ ID NO: 3303 - DNA, 21 bp, Artificial Sequence
  Description of Artificial Sequence: Synthetic oligonucleotide
aagtgaacaggggatgtcaaa

SEQ ID NO: 3304 - DNA, 21 bp, Artificial Sequence
  Description of Artificial Sequence: Synthetic oligonucleotide
tgacatcccctgttcactttt

SEQ ID NO: 3305 - DNA, 21 bp, Artificial Sequence
  Description of Artificial Sequence: Synthetic oligonucleotide
agtgaacaggggatgtcaaat

SEQ ID NO: 3306 - DNA, 21 bp, Artificial Sequence
  Description of Artificial Sequence: Synthetic oligonucleotide
ttgacatcccctgttcacttt

SEQ ID NO: 3307 - DNA, 21 bp, Artificial Sequence
  Description of Artificial Sequence: Synthetic oligonucleotide
gtgaacaggggatgtcaaatc

SEQ ID NO: 3308 - DNA, 21 bp, Artificial Sequence
  Description of Artificial Sequence: Synthetic oligonucleotide
tttgacatcccctgttcactt

SEQ ID NO: 3309 - DNA, 21 bp, Artificial Sequence
  Description of Artificial Sequence: Synthetic oligonucleotide
tgaacaggggatgtcaaatcg

SEQ ID NO: 3310 - DNA, 21 bp, Artificial Sequence
  Description of Artificial Sequence: Synthetic oligonucleotide
atttgacatcccctgttcact

SEQ ID NO: 3311 - DNA, 21 bp, Artificial Sequence
  Description of Artificial Sequence: Synthetic oligonucleotide
gaacaggggatgtcaaatcga

SEQ ID NO: 3312 - DNA, 21 bp, Artificial Sequence
  Description of Artificial Sequence: Synthetic oligonucleotide
gatttgacatcccctgttcac

SEQ ID NO: 3313 - DNA, 21 bp, Artificial Sequence
  Description of Artificial Sequence: Synthetic oligonucleotide
aacaggggatgtcaaatcgat

SEQ ID NO: 3314 - DNA, 21 bp, Artificial Sequence
  Description of Artificial Sequence: Synthetic oligonucleotide
cgatttgacatcccctgttca

SEQ ID NO: 3315 - DNA, 21 bp, Artificial Sequence
  Description of Artificial Sequence: Synthetic oligonucleotide
acaggggatgtcaaatcgatt

SEQ ID NO: 3316 - DNA, 21 bp, Artificial Sequence
  Description of Artificial Sequence: Synthetic oligonucleotide
tcgatttgacatcccctgttc

SEQ ID NO: 3317 - DNA, 21 bp, Artificial Sequence
  Description of Artificial Sequence: Synthetic oligonucleotide
caggggatgtcaaatcgattc

SEQ ID NO: 3318 - DNA, 21 bp, Artificial Sequence
  Description of Artificial Sequence: Synthetic oligonucleotide
atcgatttgacatcccctgtt

SEQ ID NO: 3319 - DNA, 21 bp, Artificial Sequence
  Description of Artificial Sequence: Synthetic oligonucleotide
aggggatgtcaaatcgattct

SEQ ID NO: 3320 - DNA, 21 bp, Artificial Sequence
  Description of Artificial Sequence: Synthetic oligonucleotide
aatcgatttgacatcccctgt

SEQ ID NO: 3321 - DNA, 21 bp, Artificial Sequence
  Description of Artificial Sequence: Synthetic oligonucleotide
ggggatgtcaaatcgattctt

SEQ ID NO: 3322 - DNA, 21 bp, Artificial Sequence
  Description of Artificial Sequence: Synthetic oligonucleotide
gaatcgatttgacatcccctg

SEQ ID NO: 3323 - DNA, 21 bp, Artificial Sequence
  Description of Artificial Sequence: Synthetic oligonucleotide
gggatgtcaaatcgattcttg

SEQ ID NO: 3324 - DNA, 21 bp, Artificial Sequence
  Description of Artificial Sequence: Synthetic oligonucleotide
agaatcgatttgacatcccct

SEQ ID NO: 3325 - DNA, 21 bp, Artificial Sequence
  Description of Artificial Sequence: Synthetic oligonucleotide
ggatgtcaaatcgattcttga

SEQ ID NO: 3326 - DNA, 21 bp, Artificial Sequence
  Description of Artificial Sequence: Synthetic oligonucleotide
aagaatcgatttgacatcccc

SEQ ID NO: 3327 - DNA, 21 bp, Artificial Sequence
  Description of Artificial Sequence: Synthetic oligonucleotide
gatgtcaaatcgattcttgaa

SEQ ID NO: 3328 - DNA, 21 bp, Artificial Sequence
  Description of Artificial Sequence: Synthetic oligonucleotide
caagaatcgatttgacatccc

SEQ ID NO: 3329 - DNA, 21 bp, Artificial Sequence
  Description of Artificial Sequence: Synthetic oligonucleotide
atgtcaaatcgattcttgaat

SEQ ID NO: 3330 - DNA, 21 bp, Artificial Sequence
  Description of Artificial Sequence: Synthetic oligonucleotide
tcaagaatcgatttgacatcc

SEQ ID NO: 3331 - DNA, 21 bp, Artificial Sequence
  Description of Artificial Sequence: Synthetic oligonucleotide
tgtcaaatcgattcttgaatt

SEQ ID NO: 3332 - DNA, 21 bp, Artificial Sequence
  Description of Artificial Sequence: Synthetic oligonucleotide
ttcaagaatcgatttgacatc

SEQ ID NO: 3333 - DNA, 21 bp, Artificial Sequence
  Description of Artificial Sequence: Synthetic oligonucleotide
gtcaaatcgattcttgaattc

SEQ ID NO: 3334 - DNA, 21 bp, Artificial Sequence
  Description of Artificial Sequence: Synthetic oligonucleotide
attcaagaatcgatttgacat

SEQ ID NO: 3335 - DNA, 21 bp, Artificial Sequence
  Description of Artificial Sequence: Synthetic oligonucleotide
tcaaatcgattcttgaattcc

SEQ ID NO: 3336 - DNA, 21 bp, Artificial Sequence
  Description of Artificial Sequence: Synthetic oligonucleotide
aattcaagaatcgatttgaca

SEQ ID NO: 3337 - DNA, 21 bp, Artificial Sequence
  Description of Artificial Sequence: Synthetic oligonucleotide
caaatcgattcttgaattccc

SEQ ID NO: 3338 - DNA, 21 bp, Artificial Sequence
  Description of Artificial Sequence: Synthetic oligonucleotide
gaattcaagaatcgatttgac

SEQ ID NO: 3339 - DNA, 21 bp, Artificial Sequence
  Description of Artificial Sequence: Synthetic oligonucleotide
aaatcgattcttgaattcccg

SEQ ID NO: 3340 - DNA, 21 bp, Artificial Sequence
  Description of Artificial Sequence: Synthetic oligonucleotide
ggaattcaagaatcgatttga

SEQ ID NO: 3341 - DNA, 21 bp, Artificial Sequence
  Description of Artificial Sequence: Synthetic oligonucleotide
aatcgattcttgaattcccgc

SEQ ID NO: 3342 - DNA, 21 bp, Artificial Sequence
  Description of Artificial Sequence: Synthetic oligonucleotide
gggaattcaagaatcgatttg

SEQ ID NO: 3343 - DNA, 21 bp, Artificial Sequence
  Description of Artificial Sequence: Synthetic oligonucleotide
atcgattcttgaattcccgct

SEQ ID NO: 3344 - DNA, 21 bp, Artificial Sequence
  Description of Artificial Sequence: Synthetic oligonucleotide
cgggaattcaagaatcgattt

SEQ ID NO: 3345 - DNA, 21 bp, Artificial Sequence
  Description of Artificial Sequence: Synthetic oligonucleotide
tcgattcttgaattcccgctg

SEQ ID NO: 3346 - DNA, 21 bp, Artificial Sequence
  Description of Artificial Sequence: Synthetic oligonucleotide
gcgggaattcaagaatcgatt

SEQ ID NO: 3347 - DNA, 21 bp, Artificial Sequence
  Description of Artificial Sequence: Synthetic oligonucleotide
cgattcttgaattcccgctgc

SEQ ID NO: 3348 - DNA, 21 bp, Artificial Sequence
  Description of Artificial Sequence: Synthetic oligonucleotide
agcgggaattcaagaatcgat

SEQ ID NO: 3349 - DNA, 21 bp, Artificial Sequence
  Description of Artificial Sequence: Synthetic oligonucleotide
gattcttgaattcccgctgca

SEQ ID NO: 3350 - DNA, 21 bp, Artificial Sequence
  Description of Artificial Sequence: Synthetic oligonucleotide
cagcgggaattcaagaatcga

SEQ ID NO: 3351 - DNA, 21 bp, Artificial Sequence
  Description of Artificial Sequence: Synthetic oligonucleotide
attcttgaattcccgctgcaa

SEQ ID NO: 3352 - DNA, 21 bp, Artificial Sequence
  Description of Artificial Sequence: Synthetic oligonucleotide
gcagcgggaattcaagaatcg

SEQ ID NO: 3353 - DNA, 21 bp, Artificial Sequence
  Description of Artificial Sequence: Synthetic oligonucleotide
ttcttgaattcccgctgcaag

SEQ ID NO: 3354 - DNA, 21 bp, Artificial Sequence
  Description of Artificial Sequence: Synthetic oligonucleotide
tgcagcgggaattcaagaatc

SEQ ID NO: 3355 - DNA, 21 bp, Artificial Sequence
  Description of Artificial Sequence: Synthetic oligonucleotide
tcttgaattcccgctgcaagc

SEQ ID NO: 3356 - DNA, 21 bp, Artificial Sequence
  Description of Artificial Sequence: Synthetic oligonucleotide
ttgcagcgggaattcaagaat

SEQ ID NO: 3357 - DNA, 21 bp, Artificial Sequence
  Description of Artificial Sequence: Synthetic oligonucleotide
cttgaattcccgctgcaagct

SEQ ID NO: 3358 - DNA, 21 bp, Artificial Sequence
  Description of Artificial Sequence: Synthetic oligonucleotide
cttgcagcgggaattcaagaa

SEQ ID NO: 3359 - DNA, 21 bp, Artificial Sequence
  Description of Artificial Sequence: Synthetic oligonucleotide
ttgaattcccgctgcaagcta

SEQ ID NO: 3360 - DNA, 21 bp, Artificial Sequence
  Description of Artificial Sequence: Synthetic oligonucleotide
gcttgcagcgggaattcaaga

SEQ ID NO: 3361 - DNA, 21 bp, Artificial Sequence
  Description of Artificial Sequence: Synthetic oligonucleotide
tgaattcccgctgcaagctag

SEQ ID NO: 3362 - DNA, 21 bp, Artificial Sequence
  Description of Artificial Sequence: Synthetic oligonucleotide
agcttgcagcgggaattcaag

SEQ ID NO: 3363 - DNA, 21 bp, Artificial Sequence
  Description of Artificial Sequence: Synthetic oligonucleotide
gaattcccgctgcaagctaga

SEQ ID NO: 3364 - DNA, 21 bp, Artificial Sequence
  Description of Artificial Sequence: Synthetic oligonucleotide
tagcttgcagcgggaattcaa

SEQ ID NO: 3365 - DNA, 21 bp, Artificial Sequence
  Description of Artificial Sequence: Synthetic oligonucleotide
aattcccgctgcaagctagag

SEQ ID NO: 3366 - DNA, 21 bp, Artificial Sequence
  Description of Artificial Sequence: Synthetic oligonucleotide
ctagcttgcagcgggaattca

SEQ ID NO: 3367 - DNA, 21 bp, Artificial Sequence
  Description of Artificial Sequence: Synthetic oligonucleotide
attcccgctgcaagctagagc

SEQ ID NO: 3368 - DNA, 21 bp, Artificial Sequence
  Description of Artificial Sequence: Synthetic oligonucleotide
tctagcttgcagcgggaattc

SEQ ID NO: 3369 - DNA, 21 bp, Artificial Sequence
  Description of Artificial Sequence: Synthetic oligonucleotide
ttcccgctgcaagctagagcc

SEQ ID NO: 3370 - DNA, 21 bp, Artificial Sequence
  Description of Artificial Sequence: Synthetic oligonucleotide
ctctagcttgcagcgggaatt

SEQ ID NO: 3371 - DNA, 21 bp, Artificial Sequence
  Description of Artificial Sequence: Synthetic oligonucleotide
tcccgctgcaagctagagccg

SEQ ID NO: 3372 - DNA, 21 bp, Artificial Sequence
  Description of Artificial Sequence: Synthetic oligonucleotide
gctctagcttgcagcgggaat

SEQ ID NO: 3373 - DNA, 21 bp, Artificial Sequence
  Description of Artificial Sequence: Synthetic oligonucleotide
cccgctgcaagctagagccgc

SEQ ID NO: 3374 - DNA, 21 bp, Artificial Sequence
  Description of Artificial Sequence: Synthetic oligonucleotide
ggctctagcttgcagcgggaa

SEQ ID NO: 3375 - DNA, 21 bp, Artificial Sequence
  Description of Artificial Sequence: Synthetic oligonucleotide
ccgctgcaagctagagccgca

SEQ ID NO: 3376 - DNA, 21 bp, Artificial Sequence
  Description of Artificial Sequence: Synthetic oligonucleotide
cggctctagcttgcagcggga

SEQ ID NO: 3377 - DNA, 21 bp, Artificial Sequence
  Description of Artificial Sequence: Synthetic oligonucleotide
cgctgcaagctagagccgcag

SEQ ID NO: 3378 - DNA, 21 bp, Artificial Sequence
  Description of Artificial Sequence: Synthetic oligonucleotide
gcggctctagcttgcagcggg

SEQ ID NO: 3379 - DNA, 21 bp, Artificial Sequence
  Description of Artificial Sequence: Synthetic oligonucleotide
gctgcaagctagagccgcagg

SEQ ID NO: 3380 - DNA, 21 bp, Artificial Sequence
  Description of Artificial Sequence: Synthetic oligonucleotide
tgcggctctagcttgcagcgg

SEQ ID NO: 3381 - DNA, 21 bp, Artificial Sequence
  Description of Artificial Sequence: Synthetic oligonucleotide
ctgcaagctagagccgcaggc

SEQ ID NO: 3382 - DNA, 21 bp, Artificial Sequence
  Description of Artificial Sequence: Synthetic oligonucleotide
ctgcggctctagcttgcagcg

SEQ ID NO: 3383 - DNA, 21 bp, Artificial Sequence
  Description of Artificial Sequence: Synthetic oligonucleotide
tgcaagctagagccgcaggca

SEQ ID NO: 3384 - DNA, 21 bp, Artificial Sequence
  Description of Artificial Sequence: Synthetic oligonucleotide
cctgcggctctagcttgcagc

SEQ ID NO: 3385 - DNA, 21 bp, Artificial Sequence
  Description of Artificial Sequence: Synthetic oligonucleotide
gcaagctagagccgcaggcac

SEQ ID NO: 3386 - DNA, 21 bp, Artificial Sequence
  Description of Artificial Sequence: Synthetic oligonucleotide
gcctgcggctctagcttgcag

SEQ ID NO: 3387 - DNA, 21 bp, Artificial Sequence
  Description of Artificial Sequence: Synthetic oligonucleotide
caagctagagccgcaggcacc

SEQ ID NO: 3388 - DNA, 21 bp, Artificial Sequence
  Description of Artificial Sequence: Synthetic oligonucleotide
tgcctgcggctctagcttgca

SEQ ID NO: 3389 - DNA, 21 bp, Artificial Sequence
  Description of Artificial Sequence: Synthetic oligonucleotide
aagctagagccgcaggcaccc

SEQ ID NO: 3390 - DNA, 21 bp, Artificial Sequence
  Description of Artificial Sequence: Synthetic oligonucleotide
gtgcctgcggctctagcttgc

SEQ ID NO: 3391 - DNA, 21 bp, Artificial Sequence
  Description of Artificial Sequence: Synthetic oligonucleotide
agctagagccgcaggcaccct

SEQ ID NO: 3392 - DNA, 21 bp, Artificial Sequence
  Description of Artificial Sequence: Synthetic oligonucleotide
ggtgcctgcggctctagcttg

SEQ ID NO: 3393 - DNA, 21 bp, Artificial Sequence
  Description of Artificial Sequence: Synthetic oligonucleotide
gctagagccgcaggcaccctc

SEQ ID NO: 3394 - DNA, 21 bp, Artificial Sequence
  Description of Artificial Sequence: Synthetic oligonucleotide
gggtgcctgcggctctagctt

SEQ ID NO: 3395 - DNA, 21 bp, Artificial Sequence
  Description of Artificial Sequence: Synthetic oligonucleotide
ctagagccgcaggcaccctct

SEQ ID NO: 3396 - DNA, 21 bp, Artificial Sequence
  Description of Artificial Sequence: Synthetic oligonucleotide
agggtgcctgcggctctagct

SEQ ID NO: 3397 - DNA, 21 bp, Artificial Sequence
  Description of Artificial Sequence: Synthetic oligonucleotide
tagagccgcaggcaccctctc

SEQ ID NO: 3398 - DNA, 21 bp, Artificial Sequence
  Description of Artificial Sequence: Synthetic oligonucleotide
gagggtgcctgcggctctagc

SEQ ID NO: 3399 - DNA, 21 bp, Artificial Sequence
  Description of Artificial Sequence: Synthetic oligonucleotide
agagccgcaggcaccctctca

SEQ ID NO: 3400 - DNA, 21 bp, Artificial Sequence
  Description of Artificial Sequence: Synthetic oligonucleotide
agagggtgcctgcggctctag

SEQ ID NO: 3401 - DNA, 21 bp, Artificial Sequence
  Description of Artificial Sequence: Synthetic oligonucleotide
gagccgcaggcaccctctcac

SEQ ID NO: 3402 - DNA, 21 bp, Artificial Sequence
  Description of Artificial Sequence: Synthetic oligonucleotide
gagagggtgcctgcggctcta

SEQ ID NO: 3403 - DNA, 21 bp, Artificial Sequence
  Description of Artificial Sequence: Synthetic oligonucleotide
agccgcaggcaccctctcact

SEQ ID NO: 3404 - DNA, 21 bp, Artificial Sequence
  Description of Artificial Sequence: Synthetic oligonucleotide
tgagagggtgcctgcggctct

SEQ ID NO: 3405 - DNA, 21 bp, Artificial Sequence
  Description of Artificial Sequence: Synthetic oligonucleotide
gccgcaggcaccctctcactc

SEQ ID NO: 3406 - DNA, 21 bp, Artificial Sequence
  Description of Artificial Sequence: Synthetic oligonucleotide
gtgagagggtgcctgcggctc

SEQ ID NO: 3407 - DNA, 21 bp, Artificial Sequence
  Description of Artificial Sequence: Synthetic oligonucleotide
ccgcaggcaccctctcactca

SEQ ID NO: 3408 - DNA, 21 bp, Artificial Sequence
  Description of Artificial Sequence: Synthetic oligonucleotide
agtgagagggtgcctgcggct

SEQ ID NO: 3409 - DNA, 21 bp, Artificial Sequence
  Description of Artificial Sequence: Synthetic oligonucleotide
cgcaggcaccctctcactcaa

SEQ ID NO: 3410 - DNA, 21 bp, Artificial Sequence
  Description of Artificial Sequence: Synthetic oligonucleotide
gagtgagagggtgcctgcggc

SEQ ID NO: 3411 - DNA, 21 bp, Artificial Sequence
  Description of Artificial Sequence: Synthetic oligonucleotide
gcaggcaccctctcactcaat

SEQ ID NO: 3412 - DNA, 21 bp, Artificial Sequence
  Description of Artificial Sequence: Synthetic oligonucleotide
tgagtgagagggtgcctgcgg

SEQ ID NO: 3413 - DNA, 21 bp, Artificial Sequence
  Description of Artificial Sequence: Synthetic oligonucleotide
caggcaccctctcactcaatt

SEQ ID NO: 3414 - DNA, 21 bp, Artificial Sequence
  Description of Artificial Sequence: Synthetic oligonucleotide
ttgagtgagagggtgcctgcg

SEQ ID NO: 3415 - DNA, 21 bp, Artificial Sequence
  Description of Artificial Sequence: Synthetic oligonucleotide
aggcaccctctcactcaattt

SEQ ID NO: 3416 - DNA, 21 bp, Artificial Sequence
  Description of Artificial Sequence: Synthetic oligonucleotide
attgagtgagagggtgcctgc

SEQ ID NO: 3417 - DNA, 21 bp, Artificial Sequence
  Description of Artificial Sequence: Synthetic oligonucleotide
ggcaccctctcactcaatttc

SEQ ID NO: 3418 - DNA, 21 bp, Artificial Sequence
  Description of Artificial Sequence: Synthetic oligonucleotide
aattgagtgagagggtgcctg

SEQ ID NO: 3419 - DNA, 21 bp, Artificial Sequence
  Description of Artificial Sequence: Synthetic oligonucleotide
gcaccctctcactcaatttcc

SEQ ID NO: 3420 - DNA, 21 bp, Artificial Sequence
  Description of Artificial Sequence: Synthetic oligonucleotide
aaattgagtgagagggtgcct

SEQ ID NO: 3421 - DNA, 21 bp, Artificial Sequence
  Description of Artificial Sequence: Synthetic oligonucleotide
caccctctcactcaatttcca

SEQ ID NO: 3422 - DNA, 21 bp, Artificial Sequence
  Description of Artificial Sequence: Synthetic oligonucleotide
gaaattgagtgagagggtgcc

SEQ ID NO: 3423 - DNA, 21 bp, Artificial Sequence
  Description of Artificial Sequence: Synthetic oligonucleotide
accctctcactcaatttccac

SEQ ID NO: 3424 - DNA, 21 bp, Artificial Sequence
  Description of Artificial Sequence: Synthetic oligonucleotide
ggaaattgagtgagagggtgc

SEQ ID NO: 3425 - DNA, 21 bp, Artificial Sequence
  Description of Artificial Sequence: Synthetic oligonucleotide
ccctctcactcaatttccact

SEQ ID NO: 3426 - DNA, 21 bp, Artificial Sequence
  Description of Artificial Sequence: Synthetic oligonucleotide
tggaaattgagtgagagggtg

SEQ ID NO: 3427 - DNA, 21 bp, Artificial Sequence
  Description of Artificial Sequence: Synthetic oligonucleotide
cctctcactcaatttccactc

SEQ ID NO: 3428 - DNA, 21 bp, Artificial Sequence
  Description of Artificial Sequence: Synthetic oligonucleotide
gtggaaattgagtgagagggt

SEQ ID NO: 3429 - DNA, 21 bp, Artificial Sequence
  Description of Artificial Sequence: Synthetic oligonucleotide
ctctcactcaatttccactca

SEQ ID NO: 3430 - DNA, 21 bp, Artificial Sequence
  Description of Artificial Sequence: Synthetic oligonucleotide
agtggaaattgagtgagaggg

SEQ ID NO: 3431 - DNA, 21 bp, Artificial Sequence
  Description of Artificial Sequence: Synthetic oligonucleotide
tctcactcaatttccactcag

SEQ ID NO: 3432 - DNA, 21 bp, Artificial Sequence
  Description of Artificial Sequence: Synthetic oligonucleotide
gagtggaaattgagtgagagg

SEQ ID NO: 3433 - DNA, 21 bp, Artificial Sequence
  Description of Artificial Sequence: Synthetic oligonucleotide
ctcactcaatttccactcaga

SEQ ID NO: 3434 - DNA, 21 bp, Artificial Sequence
  Description of Artificial Sequence: Synthetic oligonucleotide
tgagtggaaattgagtgagag

SEQ ID NO: 3435 - DNA, 21 bp, Artificial Sequence
  Description of Artificial Sequence: Synthetic oligonucleotide
tcactcaatttccactcagaa

SEQ ID NO: 3436 - DNA, 21 bp, Artificial Sequence
  Description of Artificial Sequence: Synthetic oligonucleotide
ctgagtggaaattgagtgaga

SEQ ID NO: 3437 - DNA, 21 bp, Artificial Sequence
  Description of Artificial Sequence: Synthetic oligonucleotide
cactcaatttccactcagaac

SEQ ID NO: 3438 - DNA, 21 bp, Artificial Sequence
  Description of Artificial Sequence: Synthetic oligonucleotide
tctgagtggaaattgagtgag

SEQ ID NO: 3439 - DNA, 21 bp, Artificial Sequence
  Description of Artificial Sequence: Synthetic oligonucleotide
actcaatttccactcagaacc

SEQ ID NO: 3440 - DNA, 21 bp, Artificial Sequence
  Description of Artificial Sequence: Synthetic oligonucleotide
ttctgagtggaaattgagtga

SEQ ID NO: 3441 - DNA, 21 bp, Artificial Sequence
  Description of Artificial Sequence: Synthetic oligonucleotide
ctcaatttccactcagaaccc

SEQ ID NO: 3442 - DNA, 21 bp, Artificial Sequence
  Description of Artificial Sequence: Synthetic oligonucleotide
gttctgagtggaaattgagtg

SEQ ID NO: 3443 - DNA, 21 bp, Artificial Sequence
  Description of Artificial Sequence: Synthetic oligonucleotide
tcaatttccactcagaaccct

SEQ ID NO: 3444 - DNA, 21 bp, Artificial Sequence
  Description of Artificial Sequence: Synthetic oligonucleotide
ggttctgagtggaaattgagt

SEQ ID NO: 3445 - DNA, 21 bp, Artificial Sequence
  Description of Artificial Sequence: Synthetic oligonucleotide
caatttccactcagaacccta

SEQ ID NO: 3446 - DNA, 21 bp, Artificial Sequence
  Description of Artificial Sequence: Synthetic oligonucleotide
gggttctgagtggaaattgag

SEQ ID NO: 3447 - DNA, 21 bp, Artificial Sequence
  Description of Artificial Sequence: Synthetic oligonucleotide
aatttccactcagaaccctat

SEQ ID NO: 3448 - DNA, 21 bp, Artificial Sequence
  Description of Artificial Sequence: Synthetic oligonucleotide
agggttctgagtggaaattga

SEQ ID NO: 3449 - DNA, 21 bp, Artificial Sequence
  Description of Artificial Sequence: Synthetic oligonucleotide
atttccactcagaaccctata

SEQ ID NO: 3450 - DNA, 21 bp, Artificial Sequence
  Description of Artificial Sequence: Synthetic oligonucleotide
tagggttctgagtggaaattg

SEQ ID NO: 3451 - DNA, 21 bp, Artificial Sequence
  Description of Artificial Sequence: Synthetic oligonucleotide
tttccactcagaaccctataa

SEQ ID NO: 3452 - DNA, 21 bp, Artificial Sequence
  Description of Artificial Sequence: Synthetic oligonucleotide
atagggttctgagtggaaatt

SEQ ID NO: 3453 - DNA, 21 bp, Artificial Sequence
  Description of Artificial Sequence: Synthetic oligonucleotide
ttccactcagaaccctataaa

SEQ ID NO: 3454 - DNA, 21 bp, Artificial Sequence
  Description of Artificial Sequence: Synthetic oligonucleotide
tatagggttctgagtggaaat

SEQ ID NO: 3455 - DNA, 21 bp, Artificial Sequence
  Description of Artificial Sequence: Synthetic oligonucleotide
tccactcagaaccctataaac

SEQ ID NO: 3456 - DNA, 21 bp, Artificial Sequence
  Description of Artificial Sequence: Synthetic oligonucleotide
ttatagggttctgagtggaaa

SEQ ID NO: 3457 - DNA, 21 bp, Artificial Sequence
  Description of Artificial Sequence: Synthetic oligonucleotide
ccactcagaaccctataaaca

SEQ ID NO: 3458 - DNA, 21 bp, Artificial Sequence
  Description of Artificial Sequence: Synthetic oligonucleotide
tttatagggttctgagtggaa

SEQ ID NO: 3459 - DNA, 21 bp, Artificial Sequence
  Description of Artificial Sequence: Synthetic oligonucleotide
cactcagaaccctataaacac

SEQ ID NO: 3460 - DNA, 21 bp, Artificial Sequence
  Description of Artificial Sequence: Synthetic oligonucleotide
gtttatagggttctgagtgga

SEQ ID NO: 3461 - DNA, 21 bp, Artificial Sequence
  Description of Artificial Sequence: Synthetic oligonucleotide
actcagaaccctataaacacc

SEQ ID NO: 3462 - DNA, 21 bp, Artificial Sequence
  Description of Artificial Sequence: Synthetic oligonucleotide
tgtttatagggttctgagtgg

SEQ ID NO: 3463 - DNA, 21 bp, Artificial Sequence
  Description of Artificial Sequence: Synthetic oligonucleotide
ctcagaaccctataaacacca

SEQ ID NO: 3464 - DNA, 21 bp, Artificial Sequence
  Description of Artificial Sequence: Synthetic oligonucleotide
gtgtttatagggttctgagtg

SEQ ID NO: 3465 - DNA, 21 bp, Artificial Sequence
  Description of Artificial Sequence: Synthetic oligonucleotide
tcagaaccctataaacaccag

SEQ ID NO: 3466 - DNA, 21 bp, Artificial Sequence
  Description of Artificial Sequence: Synthetic oligonucleotide
ggtgtttatagggttctgagt

SEQ ID NO: 3467 - DNA, 21 bp, Artificial Sequence
  Description of Artificial Sequence: Synthetic oligonucleotide
cagaaccctataaacaccagt

SEQ ID NO: 3468 - DNA, 21 bp, Artificial Sequence
  Description of Artificial Sequence: Synthetic oligonucleotide
tggtgtttatagggttctgag

SEQ ID NO: 3469 - DNA, 21 bp, Artificial Sequence
  Description of Artificial Sequence: Synthetic oligonucleotide
agaaccctataaacaccagtg

SEQ ID NO: 3470 - DNA, 21 bp, Artificial Sequence
  Description of Artificial Sequence: Synthetic oligonucleotide
ctggtgtttatagggttctga

SEQ ID NO: 3471 - DNA, 21 bp, Artificial Sequence
  Description of Artificial Sequence: Synthetic oligonucleotide
gaaccctataaacaccagtgg

SEQ ID NO: 3472 - DNA, 21 bp, Artificial Sequence
  Description of Artificial Sequence: Synthetic oligonucleotide
actggtgtttatagggttctg

SEQ ID NO: 3473 - DNA, 21 bp, Artificial Sequence
  Description of Artificial Sequence: Synthetic oligonucleotide
aaccctataaacaccagtggg

SEQ ID NO: 3474 - DNA, 21 bp, Artificial Sequence
  Description of Artificial Sequence: Synthetic oligonucleotide
cactggtgtttatagggttct

SEQ ID NO: 3475 - DNA, 21 bp, Artificial Sequence
  Description of Artificial Sequence: Synthetic oligonucleotide
accctataaacaccagtggga

SEQ ID NO: 3476 - DNA, 21 bp, Artificial Sequence
  Description of Artificial Sequence: Synthetic oligonucleotide
ccactggtgtttatagggttc

SEQ ID NO: 3477 - DNA, 21 bp, Artificial Sequence
  Description of Artificial Sequence: Synthetic oligonucleotide
ccctataaacaccagtgggaa

SEQ ID NO: 3478 - DNA, 21 bp, Artificial Sequence
  Description of Artificial Sequence: Synthetic oligonucleotide
cccactggtgtttatagggtt

SEQ ID NO: 3479 - DNA, 21 bp, Artificial Sequence
  Description of Artificial Sequence: Synthetic oligonucleotide
cctataaacaccagtgggaag

SEQ ID NO: 3480 - DNA, 21 bp, Artificial Sequence
  Description of Artificial Sequence: Synthetic oligonucleotide
tcccactggtgtttatagggt

SEQ ID NO: 3481 - DNA, 21 bp, Artificial Sequence
  Description of Artificial Sequence: Synthetic oligonucleotide
ctataaacaccagtgggaagg

SEQ ID NO: 3482 - DNA, 21 bp, Artificial Sequence
  Description of Artificial Sequence: Synthetic oligonucleotide
ttcccactggtgtttataggg

SEQ ID NO: 3483 - DNA, 21 bp, Artificial Sequence
  Description of Artificial Sequence: Synthetic oligonucleotide
tataaacaccagtgggaaggg

SEQ ID NO: 3484 - DNA, 21 bp, Artificial Sequence
  Description of Artificial Sequence: Synthetic oligonucleotide
cttcccactggtgtttatagg

SEQ ID NO: 3485 - DNA, 21 bp, Artificial Sequence
  Description of Artificial Sequence: Synthetic oligonucleotide
ataaacaccagtgggaagggc

SEQ ID NO: 3486 - DNA, 21 bp, Artificial Sequence
  Description of Artificial Sequence: Synthetic oligonucleotide
ccttcccactggtgtttatag

SEQ ID NO: 3487 - DNA, 21 bp, Artificial Sequence
  Description of Artificial Sequence: Synthetic oligonucleotide
taaacaccagtgggaagggca

SEQ ID NO: 3488 - DNA, 21 bp, Artificial Sequence
  Description of Artificial Sequence: Synthetic oligonucleotide
cccttcccactggtgtttata

SEQ ID NO: 3489 - DNA, 21 bp, Artificial Sequence
  Description of Artificial Sequence: Synthetic oligonucleotide
aaacaccagtgggaagggcaa

SEQ ID NO: 3490 - DNA, 21 bp, Artificial Sequence
  Description of Artificial Sequence: Synthetic oligonucleotide
gcccttcccactggtgtttat

SEQ ID NO: 3491 - DNA, 21 bp, Artificial Sequence
  Description of Artificial Sequence: Synthetic oligonucleotide
aacaccagtgggaagggcaac

SEQ ID NO: 3492 - DNA, 21 bp, Artificial Sequence
  Description of Artificial Sequence: Synthetic oligonucleotide
tgcccttcccactggtgttta

SEQ ID NO: 3493 - DNA, 21 bp, Artificial Sequence
  Description of Artificial Sequence: Synthetic oligonucleotide
acaccagtgggaagggcaacc

SEQ ID NO: 3494 - DNA, 21 bp, Artificial Sequence
  Description of Artificial Sequence: Synthetic oligonucleotide
ttgcccttcccactggtgttt

SEQ ID NO: 3495 - DNA, 21 bp, Artificial Sequence
  Description of Artificial Sequence: Synthetic oligonucleotide
caccagtgggaagggcaaccc

SEQ ID NO: 3496 - DNA, 21 bp, Artificial Sequence
  Description of Artificial Sequence: Synthetic oligonucleotide
gttgcccttcccactggtgtt

SEQ ID NO: 3497 - DNA, 21 bp, Artificial Sequence
  Description of Artificial Sequence: Synthetic oligonucleotide
accagtgggaagggcaaccca

SEQ ID NO: 3498 - DNA, 21 bp, Artificial Sequence
  Description of Artificial Sequence: Synthetic oligonucleotide
ggttgcccttcccactggtgt

SEQ ID NO: 3499 - DNA, 21 bp, Artificial Sequence
  Description of Artificial Sequence: Synthetic oligonucleotide
ccagtgggaagggcaacccac

SEQ ID NO: 3500 - DNA, 21 bp, Artificial Sequence
  Description of Artificial Sequence: Synthetic oligonucleotide
gggttgcccttcccactggtg

SEQ ID NO: 3501 - DNA, 21 bp, Artificial Sequence
  Description of Artificial Sequence: Synthetic oligonucleotide
cagtgggaagggcaacccact

SEQ ID NO: 3502 - DNA, 21 bp, Artificial Sequence
  Description of Artificial Sequence: Synthetic oligonucleotide
tgggttgcccttcccactggt

SEQ ID NO: 3503 - DNA, 21 bp, Artificial Sequence
  Description of Artificial Sequence: Synthetic oligonucleotide
agtgggaagggcaacccactg

SEQ ID NO: 3504 - DNA, 21 bp, Artificial Sequence
  Description of Artificial Sequence: Synthetic oligonucleotide
gtgggttgcccttcccactgg

SEQ ID NO: 3505 - DNA, 21 bp, Artificial Sequence
  Description of Artificial Sequence: Synthetic oligonucleotide
gtgggaagggcaacccactgc

SEQ ID NO: 3506 - DNA, 21 bp, Artificial Sequence
  Description of Artificial Sequence: Synthetic oligonucleotide
agtgggttgcccttcccactg

SEQ ID NO: 3507 - DNA, 21 bp, Artificial Sequence
  Description of Artificial Sequence: Synthetic oligonucleotide
tgggaagggcaacccactgca

SEQ ID NO: 3508 - DNA, 21 bp, Artificial Sequence
  Description of Artificial Sequence: Synthetic oligonucleotide
cagtgggttgcccttcccact

SEQ ID NO: 3509 - DNA, 21 bp, Artificial Sequence
  Description of Artificial Sequence: Synthetic oligonucleotide
gggaagggcaacccactgcac

SEQ ID NO: 3510 - DNA, 21 bp, Artificial Sequence
  Description of Artificial Sequence: Synthetic oligonucleotide
gcagtgggttgcccttcccac

SEQ ID NO: 3511 - DNA, 21 bp, Artificial Sequence
  Description of Artificial Sequence: Synthetic oligonucleotide
ggaagggcaacccactgcacg

SEQ ID NO: 3512 - DNA, 21 bp, Artificial Sequence
  Description of Artificial Sequence: Synthetic oligonucleotide
tgcagtgggttgcccttccca

SEQ ID NO: 3513 - DNA, 21 bp, Artificial Sequence
  Description of Artificial Sequence: Synthetic oligonucleotide
gaagggcaacccactgcacgt

SEQ ID NO: 3514 - DNA, 21 bp, Artificial Sequence
  Description of Artificial Sequence: Synthetic oligonucleotide
gtgcagtgggttgcccttccc

SEQ ID NO: 3515 - DNA, 21 bp, Artificial Sequence
  Description of Artificial Sequence: Synthetic oligonucleotide
aagggcaacccactgcacgtg

SEQ ID NO: 3516 - DNA, 21 bp, Artificial Sequence
  Description of Artificial Sequence: Synthetic oligonucleotide
cgtgcagtgggttgcccttcc

SEQ ID NO: 3517 - DNA, 21 bp, Artificial Sequence
  Description of Artificial Sequence: Synthetic oligonucleotide
agggcaacccactgcacgtgg

SEQ ID NO: 3518 - DNA, 21 bp, Artificial Sequence
  Description of Artificial Sequence: Synthetic oligonucleotide
acgtgcagtgggttgcccttc

SEQ ID NO: 3519 - DNA, 21 bp, Artificial Sequence
  Description of Artificial Sequence: Synthetic oligonucleotide
gggcaacccactgcacgtggg

SEQ ID NO: 3520 - DNA, 21 bp, Artificial Sequence
  Description of Artificial Sequence: Synthetic oligonucleotide
cacgtgcagtgggttgccctt

SEQ ID NO: 3521 - DNA, 21 bp, Artificial Sequence
  Description of Artificial Sequence: Synthetic oligonucleotide
ggcaacccactgcacgtggga

SEQ ID NO: 3522 - DNA, 21 bp, Artificial Sequence
  Description of Artificial Sequence: Synthetic oligonucleotide
ccacgtgcagtgggttgccct

SEQ ID NO: 3523 - DNA, 21 bp, Artificial Sequence
  Description of Artificial Sequence: Synthetic oligonucleotide
gcaacccactgcacgtgggaa

SEQ ID NO: 3524 - DNA, 21 bp, Artificial Sequence
  Description of Artificial Sequence: Synthetic oligonucleotide
cccacgtgcagtgggttgccc

SEQ ID NO: 3525 - DNA, 21 bp, Artificial Sequence
  Description of Artificial Sequence: Synthetic oligonucleotide
caacccactgcacgtgggaat

SEQ ID NO: 3526 - DNA, 21 bp, Artificial Sequence
  Description of Artificial Sequence: Synthetic oligonucleotide
tcccacgtgcagtgggttgcc

SEQ ID NO: 3527 - DNA, 21 bp, Artificial Sequence
  Description of Artificial Sequence: Synthetic oligonucleotide
aacccactgcacgtgggaatg

SEQ ID NO: 3528 - DNA, 21 bp, Artificial Sequence
  Description of Artificial Sequence: Synthetic oligonucleotide
ttcccacgtgcagtgggttgc

SEQ ID NO: 3529 - DNA, 21 bp, Artificial Sequence
  Description of Artificial Sequence: Synthetic oligonucleotide
acccactgcacgtgggaatgc

SEQ ID NO: 3530 - DNA, 21 bp, Artificial Sequence
  Description of Artificial Sequence: Synthetic oligonucleotide
attcccacgtgcagtgggttg

SEQ ID NO: 3531 - DNA, 21 bp, Artificial Sequence
  Description of Artificial Sequence: Synthetic oligonucleotide
cccactgcacgtgggaatgca

SEQ ID NO: 3532 - DNA, 21 bp, Artificial Sequence
  Description of Artificial Sequence: Synthetic oligonucleotide
cattcccacgtgcagtgggtt

SEQ ID NO: 3533 - DNA, 21 bp, Artificial Sequence
  Description of Artificial Sequence: Synthetic oligonucleotide
ccactgcacgtgggaatgcac

SEQ ID NO: 3534 - DNA, 21 bp, Artificial Sequence
  Description of Artificial Sequence: Synthetic oligonucleotide
gcattcccacgtgcagtgggt

SEQ ID NO: 3535 - DNA, 21 bp, Artificial Sequence
  Description of Artificial Sequence: Synthetic oligonucleotide
cactgcacgtgggaatgcact

SEQ ID NO: 3536 - DNA, 21 bp, Artificial Sequence
  Description of Artificial Sequence: Synthetic oligonucleotide
tgcattcccacgtgcagtggg

SEQ ID NO: 3537 - DNA, 21 bp, Artificial Sequence
  Description of Artificial Sequence: Synthetic oligonucleotide
actgcacgtgggaatgcactg

SEQ ID NO: 3538 - DNA, 21 bp, Artificial Sequence
  Description of Artificial Sequence: Synthetic oligonucleotide
gtgcattcccacgtgcagtgg

SEQ ID NO: 3539 - DNA, 21 bp, Artificial Sequence
  Description of Artificial Sequence: Synthetic oligonucleotide
ctgcacgtgggaatgcactga

SEQ ID NO: 3540 - DNA, 21 bp, Artificial Sequence
  Description of Artificial Sequence: Synthetic oligonucleotide
agtgcattcccacgtgcagtg

SEQ ID NO: 3541 - DNA, 21 bp, Artificial Sequence
  Description of Artificial Sequence: Synthetic oligonucleotide
tgcacgtgggaatgcactgat

SEQ ID NO: 3542 - DNA, 21 bp, Artificial Sequence
  Description of Artificial Sequence: Synthetic oligonucleotide
cagtgcattcccacgtgcagt

SEQ ID NO: 3543 - DNA, 21 bp, Artificial Sequence
  Description of Artificial Sequence: Synthetic oligonucleotide
gcacgtgggaatgcactgatt

SEQ ID NO: 3544 - DNA, 21 bp, Artificial Sequence
  Description of Artificial Sequence: Synthetic oligonucleotide
tcagtgcattcccacgtgcag

SEQ ID NO: 3545 - DNA, 21 bp, Artificial Sequence
  Description of Artificial Sequence: Synthetic oligonucleotide
cacgtgggaatgcactgattt

SEQ ID NO: 3546 - DNA, 21 bp, Artificial Sequence
  Description of Artificial Sequence: Synthetic oligonucleotide
atcagtgcattcccacgtgca

SEQ ID NO: 3547 - DNA, 21 bp, Artificial Sequence
  Description of Artificial Sequence: Synthetic oligonucleotide
acgtgggaatgcactgatttt

SEQ ID NO: 3548 - DNA, 21 bp, Artificial Sequence
  Description of Artificial Sequence: Synthetic oligonucleotide
aatcagtgcattcccacgtgc

SEQ ID NO: 3549 - DNA, 21 bp, Artificial Sequence
  Description of Artificial Sequence: Synthetic oligonucleotide
cgtgggaatgcactgattttt

SEQ ID NO: 3550 - DNA, 21 bp, Artificial Sequence
  Description of Artificial Sequence: Synthetic oligonucleotide
aaatcagtgcattcccacgtg

SEQ ID NO: 3551 - DNA, 21 bp, Artificial Sequence
  Description of Artificial Sequence: Synthetic oligonucleotide
gtgggaatgcactgatttttc

SEQ ID NO: 3552 - DNA, 21 bp, Artificial Sequence
  Description of Artificial Sequence: Synthetic oligonucleotide
aaaatcagtgcattcccacgt

SEQ ID NO: 3553 - DNA, 21 bp, Artificial Sequence
  Description of Artificial Sequence: Synthetic oligonucleotide
tgggaatgcactgatttttcc

SEQ ID NO: 3554 - DNA, 21 bp, Artificial Sequence
  Description of Artificial Sequence: Synthetic oligonucleotide
aaaaatcagtgcattcccacg

SEQ ID NO: 3555 - DNA, 21 bp, Artificial Sequence
  Description of Artificial Sequence: Synthetic oligonucleotide
gggaatgcactgatttttcct

SEQ ID NO: 3556 - DNA, 21 bp, Artificial Sequence
  Description of Artificial Sequence: Synthetic oligonucleotide
gaaaaatcagtgcattcccac

SEQ ID NO: 3557 - DNA, 21 bp, Artificial Sequence
  Description of Artificial Sequence: Synthetic oligonucleotide
ggaatgcactgatttttccta

SEQ ID NO: 3558 - DNA, 21 bp, Artificial Sequence
  Description of Artificial Sequence: Synthetic oligonucleotide
ggaaaaatcagtgcattccca

SEQ ID NO: 3559 - DNA, 21 bp, Artificial Sequence
  Description of Artificial Sequence: Synthetic oligonucleotide
gaatgcactgatttttcctag

SEQ ID NO: 3560 - DNA, 21 bp, Artificial Sequence
  Description of Artificial Sequence: Synthetic oligonucleotide
aggaaaaatcagtgcattccc

SEQ ID NO: 3561 - DNA, 21 bp, Artificial Sequence
  Description of Artificial Sequence: Synthetic oligonucleotide
aatgcactgatttttcctagg

SEQ ID NO: 3562 - DNA, 21 bp, Artificial Sequence
  Description of Artificial Sequence: Synthetic oligonucleotide
taggaaaaatcagtgcattcc

SEQ ID NO: 3563 - DNA, 21 bp, Artificial Sequence
  Description of Artificial Sequence: Synthetic oligonucleotide
atgcactgatttttcctagga

SEQ ID NO: 3564 - DNA, 21 bp, Artificial Sequence
  Description of Artificial Sequence: Synthetic oligonucleotide
ctaggaaaaatcagtgcattc

SEQ ID NO: 3565 - DNA, 21 bp, Artificial Sequence
  Description of Artificial Sequence: Synthetic oligonucleotide
tgcactgatttttcctaggag

SEQ ID NO: 3566 - DNA, 21 bp, Artificial Sequence
  Description of Artificial Sequence: Synthetic oligonucleotide
cctaggaaaaatcagtgcatt

SEQ ID NO: 3567 - DNA, 21 bp, Artificial Sequence
  Description of Artificial Sequence: Synthetic oligonucleotide
gcactgatttttcctaggagt

SEQ ID NO: 3568 - DNA, 21 bp, Artificial Sequence
  Description of Artificial Sequence: Synthetic oligonucleotide
tcctaggaaaaatcagtgcat

SEQ ID NO: 3569 - DNA, 21 bp, Artificial Sequence
  Description of Artificial Sequence: Synthetic oligonucleotide
cactgatttttcctaggagta

SEQ ID NO: 3570 - DNA, 21 bp, Artificial Sequence
  Description of Artificial Sequence: Synthetic oligonucleotide
ctcctaggaaaaatcagtgca

SEQ ID NO: 3571 - DNA, 21 bp, Artificial Sequence
  Description of Artificial Sequence: Synthetic oligonucleotide
actgatttttcctaggagtag

SEQ ID NO: 3572 - DNA, 21 bp, Artificial Sequence
  Description of Artificial Sequence: Synthetic oligonucleotide
actcctaggaaaaatcagtgc

SEQ ID NO: 3573 - DNA, 21 bp, Artificial Sequence
  Description of Artificial Sequence: Synthetic oligonucleotide
ctgatttttcctaggagtaga

SEQ ID NO: 3574 - DNA, 21 bp, Artificial Sequence
  Description of Artificial Sequence: Synthetic oligonucleotide
tactcctaggaaaaatcagtg

SEQ ID NO: 3575 - DNA, 21 bp, Artificial Sequence
  Description of Artificial Sequence: Synthetic oligonucleotide
tgatttttcctaggagtagac

SEQ ID NO: 3576 - DNA, 21 bp, Artificial Sequence
  Description of Artificial Sequence: Synthetic oligonucleotide
ctactcctaggaaaaatcagt

SEQ ID NO: 3577 - DNA, 21 bp, Artificial Sequence
  Description of Artificial Sequence: Synthetic oligonucleotide
gatttttcctaggagtagaca

SEQ ID NO: 3578 - DNA, 21 bp, Artificial Sequence
  Description of Artificial Sequence: Synthetic oligonucleotide
tctactcctaggaaaaatcag

SEQ ID NO: 3579 - DNA, 21 bp, Artificial Sequence
  Description of Artificial Sequence: Synthetic oligonucleotide
atttttcctaggagtagacat

SEQ ID NO: 3580 - DNA, 21 bp, Artificial Sequence
  Description of Artificial Sequence: Synthetic oligonucleotide
gtctactcctaggaaaaatca

SEQ ID NO: 3581 - DNA, 21 bp, Artificial Sequence
  Description of Artificial Sequence: Synthetic oligonucleotide
tttttcctaggagtagacatg

SEQ ID NO: 3582 - DNA, 21 bp, Artificial Sequence
  Description of Artificial Sequence: Synthetic oligonucleotide
tgtctactcctaggaaaaatc

SEQ ID NO: 3583 - DNA, 21 bp, Artificial Sequence
  Description of Artificial Sequence: Synthetic oligonucleotide
ttttcctaggagtagacatgt

SEQ ID NO: 3584 - DNA, 21 bp, Artificial Sequence
  Description of Artificial Sequence: Synthetic oligonucleotide
atgtctactcctaggaaaaat

SEQ ID NO: 3585 - DNA, 21 bp, Artificial Sequence
  Description of Artificial Sequence: Synthetic oligonucleotide
tttcctaggagtagacatgtt

SEQ ID NO: 3586 - DNA, 21 bp, Artificial Sequence
  Description of Artificial Sequence: Synthetic oligonucleotide
catgtctactcctaggaaaaa

SEQ ID NO: 3587 - DNA, 21 bp, Artificial Sequence
  Description of Artificial Sequence: Synthetic oligonucleotide
ttcctaggagtagacatgttc

SEQ ID NO: 3588 - DNA, 21 bp, Artificial Sequence
  Description of Artificial Sequence: Synthetic oligonucleotide
acatgtctactcctaggaaaa

SEQ ID NO: 3589 - DNA, 21 bp, Artificial Sequence
  Description of Artificial Sequence: Synthetic oligonucleotide
tcctaggagtagacatgttcc

SEQ ID NO: 3590 - DNA, 21 bp, Artificial Sequence
  Description of Artificial Sequence: Synthetic oligonucleotide
aacatgtctactcctaggaaa

SEQ ID NO: 3591 - DNA, 21 bp, Artificial Sequence
  Description of Artificial Sequence: Synthetic oligonucleotide
cctaggagtagacatgttcct

SEQ ID NO: 3592 - DNA, 21 bp, Artificial Sequence
  Description of Artificial Sequence: Synthetic oligonucleotide
gaacatgtctactcctaggaa

SEQ ID NO: 3593 - DNA, 21 bp, Artificial Sequence
  Description of Artificial Sequence: Synthetic oligonucleotide
ctaggagtagacatgttcctc

SEQ ID NO: 3594 - DNA, 21 bp, Artificial Sequence
  Description of Artificial Sequence: Synthetic oligonucleotide
ggaacatgtctactcctagga

SEQ ID NO: 3595 - DNA, 21 bp, Artificial Sequence
  Description of Artificial Sequence: Synthetic oligonucleotide
taggagtagacatgttcctct

SEQ ID NO: 3596 - DNA, 21 bp, Artificial Sequence
  Description of Artificial Sequence: Synthetic oligonucleotide
aggaacatgtctactcctagg

SEQ ID NO: 3597 - DNA, 21 bp, Artificial Sequence
  Description of Artificial Sequence: Synthetic oligonucleotide
aggagtagacatgttcctcta

SEQ ID NO: 3598 - DNA, 21 bp, Artificial Sequence
  Description of Artificial Sequence: Synthetic oligonucleotide
gaggaacatgtctactcctag

SEQ ID NO: 3599 - DNA, 21 bp, Artificial Sequence
  Description of Artificial Sequence: Synthetic oligonucleotide
ggagtagacatgttcctctaa

SEQ ID NO: 3600 - DNA, 21 bp, Artificial Sequence
  Description of Artificial Sequence: Synthetic oligonucleotide
agaggaacatgtctactccta

SEQ ID NO: 3601 - DNA, 21 bp, Artificial Sequence
  Description of Artificial Sequence: Synthetic oligonucleotide
gagtagacatgttcctctaat

SEQ ID NO: 3602 - DNA, 21 bp, Artificial Sequence
  Description of Artificial Sequence: Synthetic oligonucleotide
tagaggaacatgtctactcct

SEQ ID NO: 3603 - DNA, 21 bp, Artificial Sequence
  Description of Artificial Sequence: Synthetic oligonucleotide
agtagacatgttcctctaatt

SEQ ID NO: 3604 - DNA, 21 bp, Artificial Sequence
  Description of Artificial Sequence: Synthetic oligonucleotide
ttagaggaacatgtctactcc

SEQ ID NO: 3605 - DNA, 21 bp, Artificial Sequence
  Description of Artificial Sequence: Synthetic oligonucleotide
gtagacatgttcctctaatta

SEQ ID NO: 3606 - DNA, 21 bp, Artificial Sequence
  Description of Artificial Sequence: Synthetic oligonucleotide
attagaggaacatgtctactc

SEQ ID NO: 3607 - DNA, 21 bp, Artificial Sequence
  Description of Artificial Sequence: Synthetic oligonucleotide
tagacatgttcctctaattac

SEQ ID NO: 3608 - DNA, 21 bp, Artificial Sequence
  Description of Artificial Sequence: Synthetic oligonucleotide
aattagaggaacatgtctact

SEQ ID NO: 3609 - DNA, 21 bp, Artificial Sequence
  Description of Artificial Sequence: Synthetic oligonucleotide
agacatgttcctctaattact

SEQ ID NO: 3610 - DNA, 21 bp, Artificial Sequence
  Description of Artificial Sequence: Synthetic oligonucleotide
taattagaggaacatgtctac

SEQ ID NO: 3611 - DNA, 21 bp, Artificial Sequence
  Description of Artificial Sequence: Synthetic oligonucleotide
gacatgttcctctaattactc

SEQ ID NO: 3612 - DNA, 21 bp, Artificial Sequence
  Description of Artificial Sequence: Synthetic oligonucleotide
gtaattagaggaacatgtcta

SEQ ID NO: 3613 - DNA, 21 bp, Artificial Sequence
  Description of Artificial Sequence: Synthetic oligonucleotide
acatgttcctctaattactcc

SEQ ID NO: 3614 - DNA, 21 bp, Artificial Sequence
  Description of Artificial Sequence: Synthetic oligonucleotide
agtaattagaggaacatgtct

SEQ ID NO: 3615 - DNA, 21 bp, Artificial Sequence
  Description of Artificial Sequence: Synthetic oligonucleotide
catgttcctctaattactccc

SEQ ID NO: 3616 - DNA, 21 bp, Artificial Sequence
  Description of Artificial Sequence: Synthetic oligonucleotide
gagtaattagaggaacatgtc

SEQ ID NO: 3617 - DNA, 21 bp, Artificial Sequence
  Description of Artificial Sequence: Synthetic oligonucleotide
atgttcctctaattactccct

SEQ ID NO: 3618 - DNA, 21 bp, Artificial Sequence
  Description of Artificial Sequence: Synthetic oligonucleotide
ggagtaattagaggaacatgt

SEQ ID NO: 3619 - DNA, 21 bp, Artificial Sequence
  Description of Artificial Sequence: Synthetic oligonucleotide
tgttcctctaattactccctg

SEQ ID NO: 3620 - DNA, 21 bp, Artificial Sequence
  Description of Artificial Sequence: Synthetic oligonucleotide
gggagtaattagaggaacatg

SEQ ID NO: 3621 - DNA, 21 bp, Artificial Sequence
  Description of Artificial Sequence: Synthetic oligonucleotide
gttcctctaattactccctga

SEQ ID NO: 3622 - DNA, 21 bp, Artificial Sequence
  Description of Artificial Sequence: Synthetic oligonucleotide
agggagtaattagaggaacat

SEQ ID NO: 3623 - DNA, 21 bp, Artificial Sequence
  Description of Artificial Sequence: Synthetic oligonucleotide
ttcctctaattactccctgag

SEQ ID NO: 3624 - DNA, 21 bp, Artificial Sequence
  Description of Artificial Sequence: Synthetic oligonucleotide
cagggagtaattagaggaaca

SEQ ID NO: 3625 - DNA, 21 bp, Artificial Sequence
  Description of Artificial Sequence: Synthetic oligonucleotide
tcctctaattactccctgagg

SEQ ID NO: 3626 - DNA, 21 bp, Artificial Sequence
  Description of Artificial Sequence: Synthetic oligonucleotide
tcagggagtaattagaggaac

SEQ ID NO: 3627 - DNA, 21 bp, Artificial Sequence
  Description of Artificial Sequence: Synthetic oligonucleotide
cctctaattactccctgaggg

SEQ ID NO: 3628 - DNA, 21 bp, Artificial Sequence
  Description of Artificial Sequence: Synthetic oligonucleotide
ctcagggagtaattagaggaa

SEQ ID NO: 3629 - DNA, 21 bp, Artificial Sequence
  Description of Artificial Sequence: Synthetic oligonucleotide
ctctaattactccctgagggt

SEQ ID NO: 3630 - DNA, 21 bp, Artificial Sequence
  Description of Artificial Sequence: Synthetic oligonucleotide
cctcagggagtaattagagga

SEQ ID NO: 3631 - DNA, 21 bp, Artificial Sequence
  Description of Artificial Sequence: Synthetic oligonucleotide
tctaattactccctgagggtt

SEQ ID NO: 3632 - DNA, 21 bp, Artificial Sequence
  Description of Artificial Sequence: Synthetic oligonucleotide
ccctcagggagtaattagagg

SEQ ID NO: 3633 - DNA, 21 bp, Artificial Sequence
  Description of Artificial Sequence: Synthetic oligonucleotide
ctaattactccctgagggtta

SEQ ID NO: 3634 - DNA, 21 bp, Artificial Sequence
  Description of Artificial Sequence: Synthetic oligonucleotide
accctcagggagtaattagag

SEQ ID NO: 3635 - DNA, 21 bp, Artificial Sequence
  Description of Artificial Sequence: Synthetic oligonucleotide
taattactccctgagggttag

SEQ ID NO: 3636 - DNA, 21 bp, Artificial Sequence
  Description of Artificial Sequence: Synthetic oligonucleotide
aaccctcagggagtaattaga

SEQ ID NO: 3637 - DNA, 21 bp, Artificial Sequence
  Description of Artificial Sequence: Synthetic oligonucleotide
aattactccctgagggttagt

SEQ ID NO: 3638 - DNA, 21 bp, Artificial Sequence
  Description of Artificial Sequence: Synthetic oligonucleotide
taaccctcagggagtaattag

SEQ ID NO: 3639 - DNA, 21 bp, Artificial Sequence
  Description of Artificial Sequence: Synthetic oligonucleotide
attactccctgagggttagtt

SEQ ID NO: 3640 - DNA, 21 bp, Artificial Sequence
  Description of Artificial Sequence: Synthetic oligonucleotide
ctaaccctcagggagtaatta

SEQ ID NO: 3641 - DNA, 21 bp, Artificial Sequence
  Description of Artificial Sequence: Synthetic oligonucleotide
ttactccctgagggttagttg

SEQ ID NO: 3642 - DNA, 21 bp, Artificial Sequence
  Description of Artificial Sequence: Synthetic oligonucleotide
actaaccctcagggagtaatt

SEQ ID NO: 3643 - DNA, 21 bp, Artificial Sequence
  Description of Artificial Sequence: Synthetic oligonucleotide
tactccctgagggttagttgg

SEQ ID NO: 3644 - DNA, 21 bp, Artificial Sequence
  Description of Artificial Sequence: Synthetic oligonucleotide
aactaaccctcagggagtaat

SEQ ID NO: 3645 - DNA, 21 bp, Artificial Sequence
  Description of Artificial Sequence: Synthetic oligonucleotide
actccctgagggttagttggg

SEQ ID NO: 3646 - DNA, 21 bp, Artificial Sequence
  Description of Artificial Sequence: Synthetic oligonucleotide
caactaaccctcagggagtaa

SEQ ID NO: 3647 - DNA, 21 bp, Artificial Sequence
  Description of Artificial Sequence: Synthetic oligonucleotide
ctccctgagggttagttgggg

SEQ ID NO: 3648 - DNA, 21 bp, Artificial Sequence
  Description of Artificial Sequence: Synthetic oligonucleotide
ccaactaaccctcagggagta

SEQ ID NO: 3649 - DNA, 21 bp, Artificial Sequence
  Description of Artificial Sequence: Synthetic oligonucleotide
tccctgagggttagttggggc

SEQ ID NO: 3650 - DNA, 21 bp, Artificial Sequence
  Description of Artificial Sequence: Synthetic oligonucleotide
cccaactaaccctcagggagt

SEQ ID NO: 3651 - DNA, 21 bp, Artificial Sequence
  Description of Artificial Sequence: Synthetic oligonucleotide
ccctgagggttagttggggct

SEQ ID NO: 3652 - DNA, 21 bp, Artificial Sequence
  Description of Artificial Sequence: Synthetic oligonucleotide
ccccaactaaccctcagggag

SEQ ID NO: 3653 - DNA, 21 bp, Artificial Sequence
  Description of Artificial Sequence: Synthetic oligonucleotide
cctgagggttagttggggcta

SEQ ID NO: 3654 - DNA, 21 bp, Artificial Sequence
  Description of Artificial Sequence: Synthetic oligonucleotide
gccccaactaaccctcaggga

SEQ ID NO: 3655 - DNA, 21 bp, Artificial Sequence
  Description of Artificial Sequence: Synthetic oligonucleotide
ctgagggttagttggggctaa

SEQ ID NO: 3656 - DNA, 21 bp, Artificial Sequence
  Description of Artificial Sequence: Synthetic oligonucleotide
agccccaactaaccctcaggg

SEQ ID NO: 3657 - DNA, 21 bp, Artificial Sequence
  Description of Artificial Sequence: Synthetic oligonucleotide
tgagggttagttggggctaaa

SEQ ID NO: 3658 - DNA, 21 bp, Artificial Sequence
  Description of Artificial Sequence: Synthetic oligonucleotide
tagccccaactaaccctcagg

SEQ ID NO: 3659 - DNA, 21 bp, Artificial Sequence
  Description of Artificial Sequence: Synthetic oligonucleotide
gagggttagttggggctaaac

SEQ ID NO: 3660 - DNA, 21 bp, Artificial Sequence
  Description of Artificial Sequence: Synthetic oligonucleotide
ttagccccaactaaccctcag

SEQ ID NO: 3661 - DNA, 21 bp, Artificial Sequence
  Description of Artificial Sequence: Synthetic oligonucleotide
agggttagttggggctaaacc

SEQ ID NO: 3662 - DNA, 21 bp, Artificial Sequence
  Description of Artificial Sequence: Synthetic oligonucleotide
tttagccccaactaaccctca

SEQ ID NO: 3663 - DNA, 21 bp, Artificial Sequence
  Description of Artificial Sequence: Synthetic oligonucleotide
gggttagttggggctaaacca

SEQ ID NO: 3664 - DNA, 21 bp, Artificial Sequence
  Description of Artificial Sequence: Synthetic oligonucleotide
gtttagccccaactaaccctc

SEQ ID NO: 3665 - DNA, 21 bp, Artificial Sequence
  Description of Artificial Sequence: Synthetic oligonucleotide
ggttagttggggctaaaccat

SEQ ID NO: 3666 - DNA, 21 bp, Artificial Sequence
  Description of Artificial Sequence: Synthetic oligonucleotide
ggtttagccccaactaaccct

SEQ ID NO: 3667 - DNA, 21 bp, Artificial Sequence
  Description of Artificial Sequence: Synthetic oligonucleotide
gttagttggggctaaaccatg

SEQ ID NO: 3668 - DNA, 21 bp, Artificial Sequence
  Description of Artificial Sequence: Synthetic oligonucleotide
tggtttagccccaactaaccc

SEQ ID NO: 3669 - DNA, 21 bp, Artificial Sequence
  Description of Artificial Sequence: Synthetic oligonucleotide
ttagttggggctaaaccatga

SEQ ID NO: 3670 - DNA, 21 bp, Artificial Sequence
  Description of Artificial Sequence: Synthetic oligonucleotide
atggtttagccccaactaacc

SEQ ID NO: 3671 - DNA, 21 bp, Artificial Sequence
  Description of Artificial Sequence: Synthetic oligonucleotide
tagttggggctaaaccatgac

SEQ ID NO: 3672 - DNA, 21 bp, Artificial Sequence
  Description of Artificial Sequence: Synthetic oligonucleotide
catggtttagccccaactaac

SEQ ID NO: 3673 - DNA, 21 bp, Artificial Sequence
  Description of Artificial Sequence: Synthetic oligonucleotide
agttggggctaaaccatgaca

SEQ ID NO: 3674 - DNA, 21 bp, Artificial Sequence
  Description of Artificial Sequence: Synthetic oligonucleotide
tcatggtttagccccaactaa

SEQ ID NO: 3675 - DNA, 21 bp, Artificial Sequence
  Description of Artificial Sequence: Synthetic oligonucleotide
gttggggctaaaccatgacag

SEQ ID NO: 3676 - DNA, 21 bp, Artificial Sequence
  Description of Artificial Sequence: Synthetic oligonucleotide
gtcatggtttagccccaacta

SEQ ID NO: 3677 - DNA, 21 bp, Artificial Sequence
  Description of Artificial Sequence: Synthetic oligonucleotide
ttggggctaaaccatgacaga

SEQ ID NO: 3678 - DNA, 21 bp, Artificial Sequence
  Description of Artificial Sequence: Synthetic oligonucleotide
tgtcatggtttagccccaact

SEQ ID NO: 3679 - DNA, 21 bp, Artificial Sequence
  Description of Artificial Sequence: Synthetic oligonucleotide
tggggctaaaccatgacagaa

SEQ ID NO: 3680 - DNA, 21 bp, Artificial Sequence
  Description of Artificial Sequence: Synthetic oligonucleotide
ctgtcatggtttagccccaac

SEQ ID NO: 3681 - DNA, 21 bp, Artificial Sequence
  Description of Artificial Sequence: Synthetic oligonucleotide
ggggctaaaccatgacagaag

SEQ ID NO: 3682 - DNA, 21 bp, Artificial Sequence
  Description of Artificial Sequence: Synthetic oligonucleotide
tctgtcatggtttagccccaa

SEQ ID NO: 3683 - DNA, 21 bp, Artificial Sequence
  Description of Artificial Sequence: Synthetic oligonucleotide
gggctaaaccatgacagaagt

SEQ ID NO: 3684 - DNA, 21 bp, Artificial Sequence
  Description of Artificial Sequence: Synthetic oligonucleotide
ttctgtcatggtttagcccca

SEQ ID NO: 3685 - DNA, 21 bp, Artificial Sequence
  Description of Artificial Sequence: Synthetic oligonucleotide
ggctaaaccatgacagaagtg

SEQ ID NO: 3686 - DNA, 21 bp, Artificial Sequence
  Description of Artificial Sequence: Synthetic oligonucleotide
cttctgtcatggtttagcccc

SEQ ID NO: 3687 - DNA, 21 bp, Artificial Sequence
  Description of Artificial Sequence: Synthetic oligonucleotide
gctaaaccatgacagaagtgg

SEQ ID NO: 3688 - DNA, 21 bp, Artificial Sequence
  Description of Artificial Sequence: Synthetic oligonucleotide
acttctgtcatggtttagccc

SEQ ID NO: 3689 - DNA, 21 bp, Artificial Sequence
  Description of Artificial Sequence: Synthetic oligonucleotide
ctaaaccatgacagaagtggg

SEQ ID NO: 3690 - DNA, 21 bp, Artificial Sequence
  Description of Artificial Sequence: Synthetic oligonucleotide
cacttctgtcatggtttagcc

SEQ ID NO: 3691 - DNA, 21 bp, Artificial Sequence
  Description of Artificial Sequence: Synthetic oligonucleotide
taaaccatgacagaagtgggg

SEQ ID NO: 3692 - DNA, 21 bp, Artificial Sequence
  Description of Artificial Sequence: Synthetic oligonucleotide
ccacttctgtcatggtttagc

SEQ ID NO: 3693 - DNA, 21 bp, Artificial Sequence
  Description of Artificial Sequence: Synthetic oligonucleotide
aaaccatgacagaagtgggga

SEQ ID NO: 3694 - DNA, 21 bp, Artificial Sequence
  Description of Artificial Sequence: Synthetic oligonucleotide
cccacttctgtcatggtttag

SEQ ID NO: 3695 - DNA, 21 bp, Artificial Sequence
  Description of Artificial Sequence: Synthetic oligonucleotide
aaccatgacagaagtggggaa

SEQ ID NO: 3696 - DNA, 21 bp, Artificial Sequence
  Description of Artificial Sequence: Synthetic oligonucleotide
ccccacttctgtcatggttta

SEQ ID NO: 3697 - DNA, 21 bp, Artificial Sequence
  Description of Artificial Sequence: Synthetic oligonucleotide
accatgacagaagtggggaag

SEQ ID NO: 3698 - DNA, 21 bp, Artificial Sequence
  Description of Artificial Sequence: Synthetic oligonucleotide
tccccacttctgtcatggttt

SEQ ID NO: 3699 - DNA, 21 bp, Artificial Sequence
  Description of Artificial Sequence: Synthetic oligonucleotide
ccatgacagaagtggggaagt

SEQ ID NO: 3700 - DNA, 21 bp, Artificial Sequence
  Description of Artificial Sequence: Synthetic oligonucleotide
ttccccacttctgtcatggtt

SEQ ID NO: 3701 - DNA, 21 bp, Artificial Sequence
  Description of Artificial Sequence: Synthetic oligonucleotide
catgacagaagtggggaagtt

SEQ ID NO: 3702 - DNA, 21 bp, Artificial Sequence
  Description of Artificial Sequence: Synthetic oligonucleotide
cttccccacttctgtcatggt

SEQ ID NO: 3703 - DNA, 21 bp, Artificial Sequence
  Description of Artificial Sequence: Synthetic oligonucleotide
atgacagaagtggggaagttc

SEQ ID NO: 3704 - DNA, 21 bp, Artificial Sequence
  Description of Artificial Sequence: Synthetic oligonucleotide
acttccccacttctgtcatgg

SEQ ID NO: 3705 - DNA, 21 bp, Artificial Sequence
  Description of Artificial Sequence: Synthetic oligonucleotide
tgacagaagtggggaagttca

SEQ ID NO: 3706 - DNA, 21 bp, Artificial Sequence
  Description of Artificial Sequence: Synthetic oligonucleotide
aacttccccacttctgtcatg

SEQ ID NO: 3707 - DNA, 21 bp, Artificial Sequence
  Description of Artificial Sequence: Synthetic oligonucleotide
gacagaagtggggaagttcaa

SEQ ID NO: 3708 - DNA, 21 bp, Artificial Sequence
  Description of Artificial Sequence: Synthetic oligonucleotide
gaacttccccacttctgtcat

SEQ ID NO: 3709 - DNA, 21 bp, Artificial Sequence
  Description of Artificial Sequence: Synthetic oligonucleotide
acagaagtggggaagttcaat

SEQ ID NO: 3710 - DNA, 21 bp, Artificial Sequence
  Description of Artificial Sequence: Synthetic oligonucleotide
tgaacttccccacttctgtca

SEQ ID NO: 3711 - DNA, 21 bp, Artificial Sequence
  Description of Artificial Sequence: Synthetic oligonucleotide
cagaagtggggaagttcaatg

SEQ ID NO: 3712 - DNA, 21 bp, Artificial Sequence
  Description of Artificial Sequence: Synthetic oligonucleotide
ttgaacttccccacttctgtc

SEQ ID NO: 3713 - DNA, 21 bp, Artificial Sequence
  Description of Artificial Sequence: Synthetic oligonucleotide
agaagtggggaagttcaatgt

SEQ ID NO: 3714 - DNA, 21 bp, Artificial Sequence
  Description of Artificial Sequence: Synthetic oligonucleotide
attgaacttccccacttctgt

SEQ ID NO: 3715 - DNA, 21 bp, Artificial Sequence
  Description of Artificial Sequence: Synthetic oligonucleotide
gaagtggggaagttcaatgtc

SEQ ID NO: 3716 - DNA, 21 bp, Artificial Sequence
  Description of Artificial Sequence: Synthetic oligonucleotide
cattgaacttccccacttctg

SEQ ID NO: 3717 - DNA, 21 bp, Artificial Sequence
  Description of Artificial Sequence: Synthetic oligonucleotide
aagtggggaagttcaatgtcc

SEQ ID NO: 3718 - DNA, 21 bp, Artificial Sequence
  Description of Artificial Sequence: Synthetic oligonucleotide
acattgaacttccccacttct

SEQ ID NO: 3719 - DNA, 21 bp, Artificial Sequence
  Description of Artificial Sequence: Synthetic oligonucleotide
agtggggaagttcaatgtcct

SEQ ID NO: 3720 - DNA, 21 bp, Artificial Sequence
  Description of Artificial Sequence: Synthetic oligonucleotide
gacattgaacttccccacttc

SEQ ID NO: 3721 - DNA, 21 bp, Artificial Sequence
  Description of Artificial Sequence: Synthetic oligonucleotide
gtggggaagttcaatgtcctt

SEQ ID NO: 3722 - DNA, 21 bp, Artificial Sequence
  Description of Artificial Sequence: Synthetic oligonucleotide
ggacattgaacttccccactt

SEQ ID NO: 3723 - DNA, 21 bp, Artificial Sequence
  Description of Artificial Sequence: Synthetic oligonucleotide
tggggaagttcaatgtcctta

SEQ ID NO: 3724 - DNA, 21 bp, Artificial Sequence
  Description of Artificial Sequence: Synthetic oligonucleotide
aggacattgaacttccccact

SEQ ID NO: 3725 - DNA, 21 bp, Artificial Sequence
  Description of Artificial Sequence: Synthetic oligonucleotide
ggggaagttcaatgtccttaa

SEQ ID NO: 3726 - DNA, 21 bp, Artificial Sequence
  Description of Artificial Sequence: Synthetic oligonucleotide
aaggacattgaacttccccac

SEQ ID NO: 3727 - DNA, 21 bp, Artificial Sequence
  Description of Artificial Sequence: Synthetic oligonucleotide
gggaagttcaatgtccttaaa

SEQ ID NO: 3728 - DNA, 21 bp, Artificial Sequence
  Description of Artificial Sequence: Synthetic oligonucleotide
taaggacattgaacttcccca

SEQ ID NO: 3729 - DNA, 21 bp, Artificial Sequence
  Description of Artificial Sequence: Synthetic oligonucleotide
ggaagttcaatgtccttaaat

SEQ ID NO: 3730 - DNA, 21 bp, Artificial Sequence
  Description of Artificial Sequence: Synthetic oligonucleotide
ttaaggacattgaacttcccc

SEQ ID NO: 3731 - DNA, 21 bp, Artificial Sequence
  Description of Artificial Sequence: Synthetic oligonucleotide
gaagttcaatgtccttaaatc

SEQ ID NO: 3732 - DNA, 21 bp, Artificial Sequence
  Description of Artificial Sequence: Synthetic oligonucleotide
tttaaggacattgaacttccc

SEQ ID NO: 3733 - DNA, 21 bp, Artificial Sequence
  Description of Artificial Sequence: Synthetic oligonucleotide
aagttcaatgtccttaaatcc

SEQ ID NO: 3734 - DNA, 21 bp, Artificial Sequence
  Description of Artificial Sequence: Synthetic oligonucleotide
atttaaggacattgaacttcc

SEQ ID NO: 3735 - DNA, 21 bp, Artificial Sequence
  Description of Artificial Sequence: Synthetic oligonucleotide
agttcaatgtccttaaatcca

SEQ ID NO: 3736 - DNA, 21 bp, Artificial Sequence
  Description of Artificial Sequence: Synthetic oligonucleotide
gatttaaggacattgaacttc

SEQ ID NO: 3737 - DNA, 21 bp, Artificial Sequence
  Description of Artificial Sequence: Synthetic oligonucleotide
gttcaatgtccttaaatccat

SEQ ID NO: 3738 - DNA, 21 bp, Artificial Sequence
  Description of Artificial Sequence: Synthetic oligonucleotide
ggatttaaggacattgaactt

SEQ ID NO: 3739 - DNA, 21 bp, Artificial Sequence
  Description of Artificial Sequence: Synthetic oligonucleotide
ttcaatgtccttaaatccatc

SEQ ID NO: 3740 - DNA, 21 bp, Artificial Sequence
  Description of Artificial Sequence: Synthetic oligonucleotide
tggatttaaggacattgaact

SEQ ID NO: 3741 - DNA, 21 bp, Artificial Sequence
  Description of Artificial Sequence: Synthetic oligonucleotide
tcaatgtccttaaatccatct

SEQ ID NO: 3742 - DNA, 21 bp, Artificial Sequence
  Description of Artificial Sequence: Synthetic oligonucleotide
atggatttaaggacattgaac

SEQ ID NO: 3743 - DNA, 21 bp, Artificial Sequence
  Description of Artificial Sequence: Synthetic oligonucleotide
caatgtccttaaatccatctt

SEQ ID NO: 3744 - DNA, 21 bp, Artificial Sequence
  Description of Artificial Sequence: Synthetic oligonucleotide
gatggatttaaggacattgaa

SEQ ID NO: 3745 - DNA, 21 bp, Artificial Sequence
  Description of Artificial Sequence: Synthetic oligonucleotide
aatgtccttaaatccatctta

SEQ ID NO: 3746 - DNA, 21 bp, Artificial Sequence
  Description of Artificial Sequence: Synthetic oligonucleotide
agatggatttaaggacattga

SEQ ID NO: 3747 - DNA, 21 bp, Artificial Sequence
  Description of Artificial Sequence: Synthetic oligonucleotide
atgtccttaaatccatcttac

SEQ ID NO: 3748 - DNA, 21 bp, Artificial Sequence
  Description of Artificial Sequence: Synthetic oligonucleotide
aagatggatttaaggacattg

SEQ ID NO: 3749 - DNA, 21 bp, Artificial Sequence
  Description of Artificial Sequence: Synthetic oligonucleotide
tgtccttaaatccatcttact

SEQ ID NO: 3750 - DNA, 21 bp, Artificial Sequence
  Description of Artificial Sequence: Synthetic oligonucleotide
taagatggatttaaggacatt

SEQ ID NO: 3751 - DNA, 21 bp, Artificial Sequence
  Description of Artificial Sequence: Synthetic oligonucleotide
gtccttaaatccatcttactt

SEQ ID NO: 3752 - DNA, 21 bp, Artificial Sequence
  Description of Artificial Sequence: Synthetic oligonucleotide
gtaagatggatttaaggacat

SEQ ID NO: 3753 - DNA, 21 bp, Artificial Sequence
  Description of Artificial Sequence: Synthetic oligonucleotide
tccttaaatccatcttacttg

SEQ ID NO: 3754 - DNA, 21 bp, Artificial Sequence
  Description of Artificial Sequence: Synthetic oligonucleotide
agtaagatggatttaaggaca

SEQ ID NO: 3755 - DNA, 21 bp, Artificial Sequence
  Description of Artificial Sequence: Synthetic oligonucleotide
ccttaaatccatcttacttgc

SEQ ID NO: 3756 - DNA, 21 bp, Artificial Sequence
  Description of Artificial Sequence: Synthetic oligonucleotide
aagtaagatggatttaaggac

SEQ ID NO: 3757 - DNA, 21 bp, Artificial Sequence
  Description of Artificial Sequence: Synthetic oligonucleotide
cttaaatccatcttacttgcc

SEQ ID NO: 3758 - DNA, 21 bp, Artificial Sequence
  Description of Artificial Sequence: Synthetic oligonucleotide
caagtaagatggatttaagga

SEQ ID NO: 3759 - DNA, 21 bp, Artificial Sequence
  Description of Artificial Sequence: Synthetic oligonucleotide
ttaaatccatcttacttgcca

SEQ ID NO: 3760 - DNA, 21 bp, Artificial Sequence
  Description of Artificial Sequence: Synthetic oligonucleotide
gcaagtaagatggatttaagg

SEQ ID NO: 3761 - DNA, 21 bp, Artificial Sequence
  Description of Artificial Sequence: Synthetic oligonucleotide
taaatccatcttacttgccaa

SEQ ID NO: 3762 - DNA, 21 bp, Artificial Sequence
  Description of Artificial Sequence: Synthetic oligonucleotide
ggcaagtaagatggatttaag

SEQ ID NO: 3763 - DNA, 21 bp, Artificial Sequence
  Description of Artificial Sequence: Synthetic oligonucleotide
aaatccatcttacttgccaac

SEQ ID NO: 3764 - DNA, 21 bp, Artificial Sequence
  Description of Artificial Sequence: Synthetic oligonucleotide
tggcaagtaagatggatttaa

SEQ ID NO: 3765 - DNA, 21 bp, Artificial Sequence
  Description of Artificial Sequence: Synthetic oligonucleotide
aatccatcttacttgccaaca

SEQ ID NO: 3766 - DNA, 21 bp, Artificial Sequence
  Description of Artificial Sequence: Synthetic oligonucleotide
ttggcaagtaagatggattta

SEQ ID NO: 3767 - DNA, 21 bp, Artificial Sequence
  Description of Artificial Sequence: Synthetic oligonucleotide
atccatcttacttgccaacag

SEQ ID NO: 3768 - DNA, 21 bp, Artificial Sequence
  Description of Artificial Sequence: Synthetic oligonucleotide
gttggcaagtaagatggattt

SEQ ID NO: 3769 - DNA, 21 bp, Artificial Sequence
  Description of Artificial Sequence: Synthetic oligonucleotide
tccatcttacttgccaacagg

SEQ ID NO: 3770 - DNA, 21 bp, Artificial Sequence
  Description of Artificial Sequence: Synthetic oligonucleotide
tgttggcaagtaagatggatt

SEQ ID NO: 3771 - DNA, 21 bp, Artificial Sequence
  Description of Artificial Sequence: Synthetic oligonucleotide
ccatcttacttgccaacaggt

SEQ ID NO: 3772 - DNA, 21 bp, Artificial Sequence
  Description of Artificial Sequence: Synthetic oligonucleotide
ctgttggcaagtaagatggat

SEQ ID NO: 3773 - DNA, 21 bp, Artificial Sequence
  Description of Artificial Sequence: Synthetic oligonucleotide
catcttacttgccaacaggta

SEQ ID NO: 3774 - DNA, 21 bp, Artificial Sequence
  Description of Artificial Sequence: Synthetic oligonucleotide
cctgttggcaagtaagatgga

SEQ ID NO: 3775 - DNA, 21 bp, Artificial Sequence
  Description of Artificial Sequence: Synthetic oligonucleotide
atcttacttgccaacaggtaa

SEQ ID NO: 3776 - DNA, 21 bp, Artificial Sequence
  Description of Artificial Sequence: Synthetic oligonucleotide
acctgttggcaagtaagatgg

SEQ ID NO: 3777 - DNA, 21 bp, Artificial Sequence
  Description of Artificial Sequence: Synthetic oligonucleotide
tcttacttgccaacaggtaag

SEQ ID NO: 3778 - DNA, 21 bp, Artificial Sequence
  Description of Artificial Sequence: Synthetic oligonucleotide
tacctgttggcaagtaagatg

SEQ ID NO: 3779 - DNA, 21 bp, Artificial Sequence
  Description of Artificial Sequence: Synthetic oligonucleotide
cttacttgccaacaggtaaga

SEQ ID NO: 3780 - DNA, 21 bp, Artificial Sequence
  Description of Artificial Sequence: Synthetic oligonucleotide
ttacctgttggcaagtaagat

SEQ ID NO: 3781 - DNA, 21 bp, Artificial Sequence
  Description of Artificial Sequence: Synthetic oligonucleotide
ttacttgccaacaggtaagag

SEQ ID NO: 3782 - DNA, 21 bp, Artificial Sequence
  Description of Artificial Sequence: Synthetic oligonucleotide
cttacctgttggcaagtaaga

SEQ ID NO: 3783 - DNA, 21 bp, Artificial Sequence
  Description of Artificial Sequence: Synthetic oligonucleotide
tacttgccaacaggtaagagg

SEQ ID NO: 3784 - DNA, 21 bp, Artificial Sequence
  Description of Artificial Sequence: Synthetic oligonucleotide
tcttacctgttggcaagtaag

SEQ ID NO: 3785 - DNA, 21 bp, Artificial Sequence
  Description of Artificial Sequence: Synthetic oligonucleotide
acttgccaacaggtaagagga

SEQ ID NO: 3786 - DNA, 21 bp, Artificial Sequence
  Description of Artificial Sequence: Synthetic oligonucleotide
ctcttacctgttggcaagtaa

SEQ ID NO: 3787 - DNA, 21 bp, Artificial Sequence
  Description of Artificial Sequence: Synthetic oligonucleotide
cttgccaacaggtaagaggaa

SEQ ID NO: 3788 - DNA, 21 bp, Artificial Sequence
  Description of Artificial Sequence: Synthetic oligonucleotide
cctcttacctgttggcaagta

SEQ ID NO: 3789 - DNA, 21 bp, Artificial Sequence
  Description of Artificial Sequence: Synthetic oligonucleotide
ttgccaacaggtaagaggaag

SEQ ID NO: 3790 - DNA, 21 bp, Artificial Sequence
  Description of Artificial Sequence: Synthetic oligonucleotide
tcctcttacctgttggcaagt

SEQ ID NO: 3791 - DNA, 21 bp, Artificial Sequence
  Description of Artificial Sequence: Synthetic oligonucleotide
tgccaacaggtaagaggaagc

SEQ ID NO: 3792 - DNA, 21 bp, Artificial Sequence
  Description of Artificial Sequence: Synthetic oligonucleotide
ttcctcttacctgttggcaag

SEQ ID NO: 3793 - DNA, 21 bp, Artificial Sequence
  Description of Artificial Sequence: Synthetic oligonucleotide
gccaacaggtaagaggaagct

SEQ ID NO: 3794 - DNA, 21 bp, Artificial Sequence
  Description of Artificial Sequence: Synthetic oligonucleotide
cttcctcttacctgttggcaa

SEQ ID NO: 3795 - DNA, 21 bp, Artificial Sequence
  Description of Artificial Sequence: Synthetic oligonucleotide
ccaacaggtaagaggaagctt

SEQ ID NO: 3796 - DNA, 21 bp, Artificial Sequence
  Description of Artificial Sequence: Synthetic oligonucleotide
gcttcctcttacctgttggca

SEQ ID NO: 3797 - DNA, 21 bp, Artificial Sequence
  Description of Artificial Sequence: Synthetic oligonucleotide
caacaggtaagaggaagctta

SEQ ID NO: 3798 - DNA, 21 bp, Artificial Sequence
  Description of Artificial Sequence: Synthetic oligonucleotide
agcttcctcttacctgttggc

SEQ ID NO: 3799 - DNA, 21 bp, Artificial Sequence
  Description of Artificial Sequence: Synthetic oligonucleotide
aacaggtaagaggaagcttac

SEQ ID NO: 3800 - DNA, 21 bp, Artificial Sequence
  Description of Artificial Sequence: Synthetic oligonucleotide
aagcttcctcttacctgttgg

SEQ ID NO: 3801 - DNA, 21 bp, Artificial Sequence
  Description of Artificial Sequence: Synthetic oligonucleotide
acaggtaagaggaagcttaca

SEQ ID NO: 3802 - DNA, 21 bp, Artificial Sequence
  Description of Artificial Sequence: Synthetic oligonucleotide
taagcttcctcttacctgttg

SEQ ID NO: 3803 - DNA, 21 bp, Artificial Sequence
  Description of Artificial Sequence: Synthetic oligonucleotide
caggtaagaggaagcttacat

SEQ ID NO: 3804 - DNA, 21 bp, Artificial Sequence
  Description of Artificial Sequence: Synthetic oligonucleotide
gtaagcttcctcttacctgtt

SEQ ID NO: 3805 - DNA, 21 bp, Artificial Sequence
  Description of Artificial Sequence: Synthetic oligonucleotide
aggtaagaggaagcttacatt

SEQ ID NO: 3806 - DNA, 21 bp, Artificial Sequence
  Description of Artificial Sequence: Synthetic oligonucleotide
tgtaagcttcctcttacctgt

SEQ ID NO: 3807 - DNA, 21 bp, Artificial Sequence
  Description of Artificial Sequence: Synthetic oligonucleotide
ggtaagaggaagcttacatta

SEQ ID NO: 3808 - DNA, 21 bp, Artificial Sequence
  Description of Artificial Sequence: Synthetic oligonucleotide
atgtaagcttcctcttacctg

SEQ ID NO: 3809 - DNA, 21 bp, Artificial Sequence
  Description of Artificial Sequence: Synthetic oligonucleotide
gtaagaggaagcttacattac

SEQ ID NO: 3810 - DNA, 21 bp, Artificial Sequence
  Description of Artificial Sequence: Synthetic oligonucleotide
aatgtaagcttcctcttacct

SEQ ID NO: 3811 - DNA, 21 bp, Artificial Sequence
  Description of Artificial Sequence: Synthetic oligonucleotide
taagaggaagcttacattaca

SEQ ID NO: 3812 - DNA, 21 bp, Artificial Sequence
  Description of Artificial Sequence: Synthetic oligonucleotide
taatgtaagcttcctcttacc

SEQ ID NO: 3813 - DNA, 21 bp, Artificial Sequence
  Description of Artificial Sequence: Synthetic oligonucleotide
aagaggaagcttacattacat

SEQ ID NO: 3814 - DNA, 21 bp, Artificial Sequence
  Description of Artificial Sequence: Synthetic oligonucleotide
gtaatgtaagcttcctcttac

SEQ ID NO: 3815 - DNA, 21 bp, Artificial Sequence
  Description of Artificial Sequence: Synthetic oligonucleotide
agaggaagcttacattacatg

SEQ ID NO: 3816 - DNA, 21 bp, Artificial Sequence
  Description of Artificial Sequence: Synthetic oligonucleotide
tgtaatgtaagcttcctctta

SEQ ID NO: 3817 - DNA, 21 bp, Artificial Sequence
  Description of Artificial Sequence: Synthetic oligonucleotide
gaggaagcttacattacatgt

SEQ ID NO: 3818 - DNA, 21 bp, Artificial Sequence
  Description of Artificial Sequence: Synthetic oligonucleotide
atgtaatgtaagcttcctctt

SEQ ID NO: 3819 - DNA, 21 bp, Artificial Sequence
  Description of Artificial Sequence: Synthetic oligonucleotide
aggaagcttacattacatgtc

SEQ ID NO: 3820 - DNA, 21 bp, Artificial Sequence
  Description of Artificial Sequence: Synthetic oligonucleotide
catgtaatgtaagcttcctct

SEQ ID NO: 3821 - DNA, 21 bp, Artificial Sequence
  Description of Artificial Sequence: Synthetic oligonucleotide
ggaagcttacattacatgtcc

SEQ ID NO: 3822 - DNA, 21 bp, Artificial Sequence
  Description of Artificial Sequence: Synthetic oligonucleotide
acatgtaatgtaagcttcctc

SEQ ID NO: 3823 - DNA, 21 bp, Artificial Sequence
  Description of Artificial Sequence: Synthetic oligonucleotide
gaagcttacattacatgtcca

SEQ ID NO: 3824 - DNA, 21 bp, Artificial Sequence
  Description of Artificial Sequence: Synthetic oligonucleotide
gacatgtaatgtaagcttcct

SEQ ID NO: 3825 - DNA, 21 bp, Artificial Sequence
  Description of Artificial Sequence: Synthetic oligonucleotide
aagcttacattacatgtccag

SEQ ID NO: 3826 - DNA, 21 bp, Artificial Sequence
  Description of Artificial Sequence: Synthetic oligonucleotide
ggacatgtaatgtaagcttcc

SEQ ID NO: 3827 - DNA, 21 bp, Artificial Sequence
  Description of Artificial Sequence: Synthetic oligonucleotide
agcttacattacatgtccagt

SEQ ID NO: 3828 - DNA, 21 bp, Artificial Sequence
  Description of Artificial Sequence: Synthetic oligonucleotide
tggacatgtaatgtaagcttc

SEQ ID NO: 3829 - DNA, 21 bp, Artificial Sequence
  Description of Artificial Sequence: Synthetic oligonucleotide
gcttacattacatgtccagtc

SEQ ID NO: 3830 - DNA, 21 bp, Artificial Sequence
  Description of Artificial Sequence: Synthetic oligonucleotide
ctggacatgtaatgtaagctt

SEQ ID NO: 3831 - DNA, 21 bp, Artificial Sequence
  Description of Artificial Sequence: Synthetic oligonucleotide
cttacattacatgtccagtcc

SEQ ID NO: 3832 - DNA, 21 bp, Artificial Sequence
  Description of Artificial Sequence: Synthetic oligonucleotide
actggacatgtaatgtaagct

SEQ ID NO: 3833 - DNA, 21 bp, Artificial Sequence
  Description of Artificial Sequence: Synthetic oligonucleotide
ttacattacatgtccagtcca

SEQ ID NO: 3834 - DNA, 21 bp, Artificial Sequence
  Description of Artificial Sequence: Synthetic oligonucleotide
gactggacatgtaatgtaagc

SEQ ID NO: 3835 - DNA, 21 bp, Artificial Sequence
  Description of Artificial Sequence: Synthetic oligonucleotide
tacattacatgtccagtccac

SEQ ID NO: 3836 - DNA, 21 bp, Artificial Sequence
  Description of Artificial Sequence: Synthetic oligonucleotide
ggactggacatgtaatgtaag

SEQ ID NO: 3837 - DNA, 21 bp, Artificial Sequence
  Description of Artificial Sequence: Synthetic oligonucleotide
acattacatgtccagtccaca

SEQ ID NO: 3838 - DNA, 21 bp, Artificial Sequence
  Description of Artificial Sequence: Synthetic oligonucleotide
tggactggacatgtaatgtaa

SEQ ID NO: 3839 - DNA, 21 bp, Artificial Sequence
  Description of Artificial Sequence: Synthetic oligonucleotide
cattacatgtccagtccacat

SEQ ID NO: 3840 - DNA, 21 bp, Artificial Sequence
  Description of Artificial Sequence: Synthetic oligonucleotide
gtggactggacatgtaatgta

SEQ ID NO: 3841 - DNA, 21 bp, Artificial Sequence
  Description of Artificial Sequence: Synthetic oligonucleotide
attacatgtccagtccacatt

SEQ ID NO: 3842 - DNA, 21 bp, Artificial Sequence
  Description of Artificial Sequence: Synthetic oligonucleotide
tgtggactggacatgtaatgt

SEQ ID NO: 3843 - DNA, 21 bp, Artificial Sequence
  Description of Artificial Sequence: Synthetic oligonucleotide
ttacatgtccagtccacattt

SEQ ID NO: 3844 - DNA, 21 bp, Artificial Sequence
  Description of Artificial Sequence: Synthetic oligonucleotide
atgtggactggacatgtaatg

SEQ ID NO: 3845 - DNA, 21 bp, Artificial Sequence
  Description of Artificial Sequence: Synthetic oligonucleotide
tacatgtccagtccacattta

SEQ ID NO: 3846 - DNA, 21 bp, Artificial Sequence
  Description of Artificial Sequence: Synthetic oligonucleotide
aatgtggactggacatgtaat

SEQ ID NO: 3847 - DNA, 21 bp, Artificial Sequence
  Description of Artificial Sequence: Synthetic oligonucleotide
acatgtccagtccacatttaa

SEQ ID NO: 3848 - DNA, 21 bp, Artificial Sequence
  Description of Artificial Sequence: Synthetic oligonucleotide
aaatgtggactggacatgtaa

SEQ ID NO: 3849 - DNA, 21 bp, Artificial Sequence
  Description of Artificial Sequence: Synthetic oligonucleotide
catgtccagtccacatttaaa

SEQ ID NO: 3850 - DNA, 21 bp, Artificial Sequence
  Description of Artificial Sequence: Synthetic oligonucleotide
taaatgtggactggacatgta

SEQ ID NO: 3851 - DNA, 21 bp, Artificial Sequence
  Description of Artificial Sequence: Synthetic oligonucleotide
atgtccagtccacatttaaag

SEQ ID NO: 3852 - DNA, 21 bp, Artificial Sequence
  Description of Artificial Sequence: Synthetic oligonucleotide
ttaaatgtggactggacatgt

SEQ ID NO: 3853 - DNA, 21 bp, Artificial Sequence
  Description of Artificial Sequence: Synthetic oligonucleotide
tgtccagtccacatttaaaga

SEQ ID NO: 3854 - DNA, 21 bp, Artificial Sequence
  Description of Artificial Sequence: Synthetic oligonucleotide
tttaaatgtggactggacatg

SEQ ID NO: 3855 - DNA, 21 bp, Artificial Sequence
  Description of Artificial Sequence: Synthetic oligonucleotide
gtccagtccacatttaaagag

SEQ ID NO: 3856 - DNA, 21 bp, Artificial Sequence
  Description of Artificial Sequence: Synthetic oligonucleotide
ctttaaatgtggactggacat

SEQ ID NO: 3857 - DNA, 21 bp, Artificial Sequence
  Description of Artificial Sequence: Synthetic oligonucleotide
tccagtccacatttaaagagc

SEQ ID NO: 3858 - DNA, 21 bp, Artificial Sequence
  Description of Artificial Sequence: Synthetic oligonucleotide
tctttaaatgtggactggaca

SEQ ID NO: 3859 - DNA, 21 bp, Artificial Sequence
  Description of Artificial Sequence: Synthetic oligonucleotide
ccagtccacatttaaagagca

SEQ ID NO: 3860 - DNA, 21 bp, Artificial Sequence
  Description of Artificial Sequence: Synthetic oligonucleotide
ctctttaaatgtggactggac

SEQ ID NO: 3861 - DNA, 21 bp, Artificial Sequence
  Description of Artificial Sequence: Synthetic oligonucleotide
cagtccacatttaaagagcac

SEQ ID NO: 3862 - DNA, 21 bp, Artificial Sequence
  Description of Artificial Sequence: Synthetic oligonucleotide
gctctttaaatgtggactgga

SEQ ID NO: 3863 - DNA, 21 bp, Artificial Sequence
  Description of Artificial Sequence: Synthetic oligonucleotide
agtccacatttaaagagcact

SEQ ID NO: 3864 - DNA, 21 bp, Artificial Sequence
  Description of Artificial Sequence: Synthetic oligonucleotide
tgctctttaaatgtggactgg

SEQ ID NO: 3865 - DNA, 21 bp, Artificial Sequence
  Description of Artificial Sequence: Synthetic oligonucleotide
gtccacatttaaagagcactt

SEQ ID NO: 3866 - DNA, 21 bp, Artificial Sequence
  Description of Artificial Sequence: Synthetic oligonucleotide
gtgctctttaaatgtggactg

SEQ ID NO: 3867 - DNA, 21 bp, Artificial Sequence
  Description of Artificial Sequence: Synthetic oligonucleotide
tccacatttaaagagcactta

SEQ ID NO: 3868 - DNA, 21 bp, Artificial Sequence
  Description of Artificial Sequence: Synthetic oligonucleotide
agtgctctttaaatgtggact

SEQ ID NO: 3869 - DNA, 21 bp, Artificial Sequence
  Description of Artificial Sequence: Synthetic oligonucleotide
ccacatttaaagagcacttac

SEQ ID NO: 3870 - DNA, 21 bp, Artificial Sequence
  Description of Artificial Sequence: Synthetic oligonucleotide
aagtgctctttaaatgtggac

SEQ ID NO: 3871 - DNA, 21 bp, Artificial Sequence
  Description of Artificial Sequence: Synthetic oligonucleotide
cacatttaaagagcacttact

SEQ ID NO: 3872 - DNA, 21 bp, Artificial Sequence
  Description of Artificial Sequence: Synthetic oligonucleotide
taagtgctctttaaatgtgga

SEQ ID NO: 3873 - DNA, 21 bp, Artificial Sequence
  Description of Artificial Sequence: Synthetic oligonucleotide
acatttaaagagcacttactg

SEQ ID NO: 3874 - DNA, 21 bp, Artificial Sequence
  Description of Artificial Sequence: Synthetic oligonucleotide
gtaagtgctctttaaatgtgg

SEQ ID NO: 3875 - DNA, 21 bp, Artificial Sequence
  Description of Artificial Sequence: Synthetic oligonucleotide
catttaaagagcacttactgt

SEQ ID NO: 3876 - DNA, 21 bp, Artificial Sequence
  Description of Artificial Sequence: Synthetic oligonucleotide
agtaagtgctctttaaatgtg

SEQ ID NO: 3877 - DNA, 21 bp, Artificial Sequence
  Description of Artificial Sequence: Synthetic oligonucleotide
atttaaagagcacttactgtg

SEQ ID NO: 3878 - DNA, 21 bp, Artificial Sequence
  Description of Artificial Sequence: Synthetic oligonucleotide
cagtaagtgctctttaaatgt

SEQ ID NO: 3879 - DNA, 21 bp, Artificial Sequence
  Description of Artificial Sequence: Synthetic oligonucleotide
tttaaagagcacttactgtgg

SEQ ID NO: 3880 - DNA, 21 bp, Artificial Sequence
  Description of Artificial Sequence: Synthetic oligonucleotide
acagtaagtgctctttaaatg

SEQ ID NO: 3881 - DNA, 21 bp, Artificial Sequence
  Description of Artificial Sequence: Synthetic oligonucleotide
ttaaagagcacttactgtgga

SEQ ID NO: 3882 - DNA, 21 bp, Artificial Sequence
  Description of Artificial Sequence: Synthetic oligonucleotide
cacagtaagtgctctttaaat

SEQ ID NO: 3883 - DNA, 21 bp, Artificial Sequence
  Description of Artificial Sequence: Synthetic oligonucleotide
taaagagcacttactgtggaa

SEQ ID NO: 3884 - DNA, 21 bp, Artificial Sequence
  Description of Artificial Sequence: Synthetic oligonucleotide
ccacagtaagtgctctttaaa

SEQ ID NO: 3885 - DNA, 21 bp, Artificial Sequence
  Description of Artificial Sequence: Synthetic oligonucleotide
aaagagcacttactgtggaac

SEQ ID NO: 3886 - DNA, 21 bp, Artificial Sequence
  Description of Artificial Sequence: Synthetic oligonucleotide
tccacagtaagtgctctttaa

SEQ ID NO: 3887 - DNA, 21 bp, Artificial Sequence
  Description of Artificial Sequence: Synthetic oligonucleotide
aagagcacttactgtggaaca

SEQ ID NO: 3888 - DNA, 21 bp, Artificial Sequence
  Description of Artificial Sequence: Synthetic oligonucleotide
ttccacagtaagtgctcttta

SEQ ID NO: 3889 - DNA, 21 bp, Artificial Sequence
  Description of Artificial Sequence: Synthetic oligonucleotide
agagcacttactgtggaacaa

SEQ ID NO: 3890 - DNA, 21 bp, Artificial Sequence
  Description of Artificial Sequence: Synthetic oligonucleotide
gttccacagtaagtgctcttt

SEQ ID NO: 3891 - DNA, 21 bp, Artificial Sequence
  Description of Artificial Sequence: Synthetic oligonucleotide
gagcacttactgtggaacaag

SEQ ID NO: 3892 - DNA, 21 bp, Artificial Sequence
  Description of Artificial Sequence: Synthetic oligonucleotide
tgttccacagtaagtgctctt

SEQ ID NO: 3893 - DNA, 21 bp, Artificial Sequence
  Description of Artificial Sequence: Synthetic oligonucleotide
agcacttactgtggaacaagc

SEQ ID NO: 3894 - DNA, 21 bp, Artificial Sequence
  Description of Artificial Sequence: Synthetic oligonucleotide
ttgttccacagtaagtgctct

SEQ ID NO: 3895 - DNA, 21 bp, Artificial Sequence
  Description of Artificial Sequence: Synthetic oligonucleotide
gcacttactgtggaacaagcc

SEQ ID NO: 3896 - DNA, 21 bp, Artificial Sequence
  Description of Artificial Sequence: Synthetic oligonucleotide
cttgttccacagtaagtgctc

SEQ ID NO: 3897 - DNA, 21 bp, Artificial Sequence
  Description of Artificial Sequence: Synthetic oligonucleotide
cacttactgtggaacaagcct

SEQ ID NO: 3898 - DNA, 21 bp, Artificial Sequence
  Description of Artificial Sequence: Synthetic oligonucleotide
gcttgttccacagtaagtgct

SEQ ID NO: 3899 - DNA, 21 bp, Artificial Sequence
  Description of Artificial Sequence: Synthetic oligonucleotide
acttactgtggaacaagcctt

SEQ ID NO: 3900 - DNA, 21 bp, Artificial Sequence
  Description of Artificial Sequence: Synthetic oligonucleotide
ggcttgttccacagtaagtgc

SEQ ID NO: 3901 - DNA, 21 bp, Artificial Sequence
  Description of Artificial Sequence: Synthetic oligonucleotide
cttactgtggaacaagccttc

SEQ ID NO: 3902 - DNA, 21 bp, Artificial Sequence
  Description of Artificial Sequence: Synthetic oligonucleotide
aggcttgttccacagtaagtg

SEQ ID NO: 3903 - DNA, 21 bp, Artificial Sequence
  Description of Artificial Sequence: Synthetic oligonucleotide
ttactgtggaacaagccttca

SEQ ID NO: 3904 - DNA, 21 bp, Artificial Sequence
  Description of Artificial Sequence: Synthetic oligonucleotide
aaggcttgttccacagtaagt

SEQ ID NO: 3905 - DNA, 21 bp, Artificial Sequence
  Description of Artificial Sequence: Synthetic oligonucleotide
tactgtggaacaagccttcag

SEQ ID NO: 3906 - DNA, 21 bp, Artificial Sequence
  Description of Artificial Sequence: Synthetic oligonucleotide
gaaggcttgttccacagtaag

SEQ ID NO: 3907 - DNA, 21 bp, Artificial Sequence
  Description of Artificial Sequence: Synthetic oligonucleotide
actgtggaacaagccttcagc

SEQ ID NO: 3908 - DNA, 21 bp, Artificial Sequence
  Description of Artificial Sequence: Synthetic oligonucleotide
tgaaggcttgttccacagtaa

SEQ ID NO: 3909 - DNA, 21 bp, Artificial Sequence
  Description of Artificial Sequence: Synthetic oligonucleotide
ctgtggaacaagccttcagcc

SEQ ID NO: 3910 - DNA, 21 bp, Artificial Sequence
  Description of Artificial Sequence: Synthetic oligonucleotide
ctgaaggcttgttccacagta

SEQ ID NO: 3911 - DNA, 21 bp, Artificial Sequence
  Description of Artificial Sequence: Synthetic oligonucleotide
tgtggaacaagccttcagcca

SEQ ID NO: 3912 - DNA, 21 bp, Artificial Sequence
  Description of Artificial Sequence: Synthetic oligonucleotide
gctgaaggcttgttccacagt

SEQ ID NO: 3913 - DNA, 21 bp, Artificial Sequence
  Description of Artificial Sequence: Synthetic oligonucleotide
gtggaacaagccttcagccaa

SEQ ID NO: 3914 - DNA, 21 bp, Artificial Sequence
  Description of Artificial Sequence: Synthetic oligonucleotide
ggctgaaggcttgttccacag

SEQ ID NO: 3915 - DNA, 21 bp, Artificial Sequence
  Description of Artificial Sequence: Synthetic oligonucleotide
tggaacaagccttcagccaaa

SEQ ID NO: 3916 - DNA, 21 bp, Artificial Sequence
  Description of Artificial Sequence: Synthetic oligonucleotide
tggctgaaggcttgttccaca

SEQ ID NO: 3917 - DNA, 21 bp, Artificial Sequence
  Description of Artificial Sequence: Synthetic oligonucleotide
ggaacaagccttcagccaaac

SEQ ID NO: 3918 - DNA, 21 bp, Artificial Sequence
  Description of Artificial Sequence: Synthetic oligonucleotide
ttggctgaaggcttgttccac

SEQ ID NO: 3919 - DNA, 21 bp, Artificial Sequence
  Description of Artificial Sequence: Synthetic oligonucleotide
gaacaagccttcagccaaaca

SEQ ID NO: 3920 - DNA, 21 bp, Artificial Sequence
  Description of Artificial Sequence: Synthetic oligonucleotide
tttggctgaaggcttgttcca

SEQ ID NO: 3921 - DNA, 21 bp, Artificial Sequence
  Description of Artificial Sequence: Synthetic oligonucleotide
aacaagccttcagccaaacaa

SEQ ID NO: 3922 - DNA, 21 bp, Artificial Sequence
  Description of Artificial Sequence: Synthetic oligonucleotide
gtttggctgaaggcttgttcc

SEQ ID NO: 3923 - DNA, 21 bp, Artificial Sequence
  Description of Artificial Sequence: Synthetic oligonucleotide
acaagccttcagccaaacaat

SEQ ID NO: 3924 - DNA, 21 bp, Artificial Sequence
  Description of Artificial Sequence: Synthetic oligonucleotide
tgtttggctgaaggcttgttc

SEQ ID NO: 3925 - DNA, 21 bp, Artificial Sequence
  Description of Artificial Sequence: Synthetic oligonucleotide
caagccttcagccaaacaatg

SEQ ID NO: 3926 - DNA, 21 bp, Artificial Sequence
  Description of Artificial Sequence: Synthetic oligonucleotide
ttgtttggctgaaggcttgtt

SEQ ID NO: 3927 - DNA, 21 bp, Artificial Sequence
  Description of Artificial Sequence: Synthetic oligonucleotide
aagccttcagccaaacaatgg

SEQ ID NO: 3928 - DNA, 21 bp, Artificial Sequence
  Description of Artificial Sequence: Synthetic oligonucleotide
attgtttggctgaaggcttgt

SEQ ID NO: 3929 - DNA, 21 bp, Artificial Sequence
  Description of Artificial Sequence: Synthetic oligonucleotide
agccttcagccaaacaatggg

SEQ ID NO: 3930 - DNA, 21 bp, Artificial Sequence
  Description of Artificial Sequence: Synthetic oligonucleotide
cattgtttggctgaaggcttg

SEQ ID NO: 3931 - DNA, 21 bp, Artificial Sequence
  Description of Artificial Sequence: Synthetic oligonucleotide
gccttcagccaaacaatgggg

SEQ ID NO: 3932 - DNA, 21 bp, Artificial Sequence
  Description of Artificial Sequence: Synthetic oligonucleotide
ccattgtttggctgaaggctt

SEQ ID NO: 3933 - DNA, 21 bp, Artificial Sequence
  Description of Artificial Sequence: Synthetic oligonucleotide
ccttcagccaaacaatgggga

SEQ ID NO: 3934 - DNA, 21 bp, Artificial Sequence
  Description of Artificial Sequence: Synthetic oligonucleotide
cccattgtttggctgaaggct

SEQ ID NO: 3935 - DNA, 21 bp, Artificial Sequence
  Description of Artificial Sequence: Synthetic oligonucleotide
cttcagccaaacaatggggat

SEQ ID NO: 3936 - DNA, 21 bp, Artificial Sequence
  Description of Artificial Sequence: Synthetic oligonucleotide
ccccattgtttggctgaaggc

SEQ ID NO: 3937 - DNA, 21 bp, Artificial Sequence
  Description of Artificial Sequence: Synthetic oligonucleotide
ttcagccaaacaatggggata

SEQ ID NO: 3938 - DNA, 21 bp, Artificial Sequence
  Description of Artificial Sequence: Synthetic oligonucleotide
tccccattgtttggctgaagg

SEQ ID NO: 3939 - DNA, 21 bp, Artificial Sequence
  Description of Artificial Sequence: Synthetic oligonucleotide
tcagccaaacaatggggatag

SEQ ID NO: 3940 - DNA, 21 bp, Artificial Sequence
  Description of Artificial Sequence: Synthetic oligonucleotide
atccccattgtttggctgaag

SEQ ID NO: 3941 - DNA, 21 bp, Artificial Sequence
  Description of Artificial Sequence: Synthetic oligonucleotide
cagccaaacaatggggataga

SEQ ID NO: 3942 - DNA, 21 bp, Artificial Sequence
  Description of Artificial Sequence: Synthetic oligonucleotide
tatccccattgtttggctgaa

SEQ ID NO: 3943 - DNA, 21 bp, Artificial Sequence
  Description of Artificial Sequence: Synthetic oligonucleotide
agccaaacaatggggatagaa

SEQ ID NO: 3944 - DNA, 21 bp, Artificial Sequence
  Description of Artificial Sequence: Synthetic oligonucleotide
ctatccccattgtttggctga

SEQ ID NO: 3945 - DNA, 21 bp, Artificial Sequence
  Description of Artificial Sequence: Synthetic oligonucleotide
gccaaacaatggggatagaaa

SEQ ID NO: 3946 - DNA, 21 bp, Artificial Sequence
  Description of Artificial Sequence: Synthetic oligonucleotide
tctatccccattgtttggctg

SEQ ID NO: 3947 - DNA, 21 bp, Artificial Sequence
  Description of Artificial Sequence: Synthetic oligonucleotide
ccaaacaatggggatagaaaa

SEQ ID NO: 3948 - DNA, 21 bp, Artificial Sequence
  Description of Artificial Sequence: Synthetic oligonucleotide
ttctatccccattgtttggct

SEQ ID NO: 3949 - DNA, 21 bp, Artificial Sequence
  Description of Artificial Sequence: Synthetic oligonucleotide
caaacaatggggatagaaaag

SEQ ID NO: 3950 - DNA, 21 bp, Artificial Sequence
  Description of Artificial Sequence: Synthetic oligonucleotide
tttctatccccattgtttggc

SEQ ID NO: 3951 - DNA, 21 bp, Artificial Sequence
  Description of Artificial Sequence: Synthetic oligonucleotide
aaacaatggggatagaaaagt

SEQ ID NO: 3952 - DNA, 21 bp, Artificial Sequence
  Description of Artificial Sequence: Synthetic oligonucleotide
ttttctatccccattgtttgg

SEQ ID NO: 3953 - DNA, 21 bp, Artificial Sequence
  Description of Artificial Sequence: Synthetic oligonucleotide
aacaatggggatagaaaagta

SEQ ID NO: 3954 - DNA, 21 bp, Artificial Sequence
  Description of Artificial Sequence: Synthetic oligonucleotide
cttttctatccccattgtttg

SEQ ID NO: 3955 - DNA, 21 bp, Artificial Sequence
  Description of Artificial Sequence: Synthetic oligonucleotide
acaatggggatagaaaagtag

SEQ ID NO: 3956 - DNA, 21 bp, Artificial Sequence
  Description of Artificial Sequence: Synthetic oligonucleotide
acttttctatccccattgttt

SEQ ID NO: 3957 - DNA, 21 bp, Artificial Sequence
  Description of Artificial Sequence: Synthetic oligonucleotide
caatggggatagaaaagtagg

SEQ ID NO: 3958 - DNA, 21 bp, Artificial Sequence
  Description of Artificial Sequence: Synthetic oligonucleotide
tacttttctatccccattgtt

SEQ ID NO: 3959 - DNA, 21 bp, Artificial Sequence
  Description of Artificial Sequence: Synthetic oligonucleotide
aatggggatagaaaagtaggt

SEQ ID NO: 3960 - DNA, 21 bp, Artificial Sequence
  Description of Artificial Sequence: Synthetic oligonucleotide
ctacttttctatccccattgt

SEQ ID NO: 3961 - DNA, 21 bp, Artificial Sequence
  Description of Artificial Sequence: Synthetic oligonucleotide
atggggatagaaaagtaggta

SEQ ID NO: 3962 - DNA, 21 bp, Artificial Sequence
  Description of Artificial Sequence: Synthetic oligonucleotide
cctacttttctatccccattg

SEQ ID NO: 3963 - DNA, 21 bp, Artificial Sequence
  Description of Artificial Sequence: Synthetic oligonucleotide
tggggatagaaaagtaggtaa

SEQ ID NO: 3964 - DNA, 21 bp, Artificial Sequence
  Description of Artificial Sequence: Synthetic oligonucleotide
acctacttttctatccccatt

SEQ ID NO: 3965 - DNA, 21 bp, Artificial Sequence
  Description of Artificial Sequence: Synthetic oligonucleotide
ggggatagaaaagtaggtaag

SEQ ID NO: 3966 - DNA, 21 bp, Artificial Sequence
  Description of Artificial Sequence: Synthetic oligonucleotide
tacctacttttctatccccat

SEQ ID NO: 3967 - DNA, 21 bp, Artificial Sequence
  Description of Artificial Sequence: Synthetic oligonucleotide
gggatagaaaagtaggtaaga

SEQ ID NO: 3968 - DNA, 21 bp, Artificial Sequence
  Description of Artificial Sequence: Synthetic oligonucleotide
ttacctacttttctatcccca

SEQ ID NO: 3969 - DNA, 21 bp, Artificial Sequence
  Description of Artificial Sequence: Synthetic oligonucleotide
ggatagaaaagtaggtaagac

SEQ ID NO: 3970 - DNA, 21 bp, Artificial Sequence
  Description of Artificial Sequence: Synthetic oligonucleotide
cttacctacttttctatcccc

SEQ ID NO: 3971 - DNA, 21 bp, Artificial Sequence
  Description of Artificial Sequence: Synthetic oligonucleotide
gatagaaaagtaggtaagact

SEQ ID NO: 3972 - DNA, 21 bp, Artificial Sequence
  Description of Artificial Sequence: Synthetic oligonucleotide
tcttacctacttttctatccc

SEQ ID NO: 3973 - DNA, 21 bp, Artificial Sequence
  Description of Artificial Sequence: Synthetic oligonucleotide
atagaaaagtaggtaagactc

SEQ ID NO: 3974 - DNA, 21 bp, Artificial Sequence
  Description of Artificial Sequence: Synthetic oligonucleotide
gtcttacctacttttctatcc

SEQ ID NO: 3975 - DNA, 21 bp, Artificial Sequence
  Description of Artificial Sequence: Synthetic oligonucleotide
tagaaaagtaggtaagactca

SEQ ID NO: 3976 - DNA, 21 bp, Artificial Sequence
  Description of Artificial Sequence: Synthetic oligonucleotide
agtcttacctacttttctatc

SEQ ID NO: 3977 - DNA, 21 bp, Artificial Sequence
  Description of Artificial Sequence: Synthetic oligonucleotide
agaaaagtaggtaagactcag

SEQ ID NO: 3978 - DNA, 21 bp, Artificial Sequence
  Description of Artificial Sequence: Synthetic oligonucleotide
gagtcttacctacttttctat

SEQ ID NO: 3979 - DNA, 21 bp, Artificial Sequence
  Description of Artificial Sequence: Synthetic oligonucleotide
gaaaagtaggtaagactcagc

SEQ ID NO: 3980 - DNA, 21 bp, Artificial Sequence
  Description of Artificial Sequence: Synthetic oligonucleotide
tgagtcttacctacttttcta

SEQ ID NO: 3981 - DNA, 21 bp, Artificial Sequence
  Description of Artificial Sequence: Synthetic oligonucleotide
aaaagtaggtaagactcagcc

SEQ ID NO: 3982 - DNA, 21 bp, Artificial Sequence
  Description of Artificial Sequence: Synthetic oligonucleotide
ctgagtcttacctacttttct

SEQ ID NO: 3983 - DNA, 21 bp, Artificial Sequence
  Description of Artificial Sequence: Synthetic oligonucleotide
aaagtaggtaagactcagcct

SEQ ID NO: 3984 - DNA, 21 bp, Artificial Sequence
  Description of Artificial Sequence: Synthetic oligonucleotide
gctgagtcttacctacttttc

SEQ ID NO: 3985 - DNA, 21 bp, Artificial Sequence
  Description of Artificial Sequence: Synthetic oligonucleotide
aagtaggtaagactcagcctt

SEQ ID NO: 3986 - DNA, 21 bp, Artificial Sequence
  Description of Artificial Sequence: Synthetic oligonucleotide
ggctgagtcttacctactttt

SEQ ID NO: 3987 - DNA, 21 bp, Artificial Sequence
  Description of Artificial Sequence: Synthetic oligonucleotide
agtaggtaagactcagccttt

SEQ ID NO: 3988 - DNA, 21 bp, Artificial Sequence
  Description of Artificial Sequence: Synthetic oligonucleotide
aggctgagtcttacctacttt

SEQ ID NO: 3989 - DNA, 21 bp, Artificial Sequence
  Description of Artificial Sequence: Synthetic oligonucleotide
gtaggtaagactcagcctttg

SEQ ID NO: 3990 - DNA, 21 bp, Artificial Sequence
  Description of Artificial Sequence: Synthetic oligonucleotide
aaggctgagtcttacctactt

SEQ ID NO: 3991 - DNA, 21 bp, Artificial Sequence
  Description of Artificial Sequence: Synthetic oligonucleotide
taggtaagactcagcctttgt

SEQ ID NO: 3992 - DNA, 21 bp, Artificial Sequence
  Description of Artificial Sequence: Synthetic oligonucleotide
aaaggctgagtcttacctact

SEQ ID NO: 3993 - DNA, 21 bp, Artificial Sequence
  Description of Artificial Sequence: Synthetic oligonucleotide
aggtaagactcagcctttgtc

SEQ ID NO: 3994 - DNA, 21 bp, Artificial Sequence
  Description of Artificial Sequence: Synthetic oligonucleotide
caaaggctgagtcttacctac

SEQ ID NO: 3995 - DNA, 21 bp, Artificial Sequence
  Description of Artificial Sequence: Synthetic oligonucleotide
ggtaagactcagcctttgtcc

SEQ ID NO: 3996 - DNA, 21 bp, Artificial Sequence
  Description of Artificial Sequence: Synthetic oligonucleotide
acaaaggctgagtcttaccta

SEQ ID NO: 3997 - DNA, 21 bp, Artificial Sequence
  Description of Artificial Sequence: Synthetic oligonucleotide
gtaagactcagcctttgtcca

SEQ ID NO: 3998 - DNA, 21 bp, Artificial Sequence
  Description of Artificial Sequence: Synthetic oligonucleotide
gacaaaggctgagtcttacct

SEQ ID NO: 3999 - DNA, 21 bp, Artificial Sequence
  Description of Artificial Sequence: Synthetic oligonucleotide
taagactcagcctttgtccag

SEQ ID NO: 4000 - DNA, 21 bp, Artificial Sequence
  Description of Artificial Sequence: Synthetic oligonucleotide
ggacaaaggctgagtcttacc

SEQ ID NO: 4001 - DNA, 21 bp, Artificial Sequence
  Description of Artificial Sequence: Synthetic oligonucleotide
aagactcagcctttgtccaga

SEQ ID NO: 4002 - DNA, 21 bp, Artificial Sequence
  Description of Artificial Sequence: Synthetic oligonucleotide
tggacaaaggctgagtcttac

SEQ ID NO: 4003 - DNA, 21 bp, Artificial Sequence
  Description of Artificial Sequence: Synthetic oligonucleotide
agactcagcctttgtccagag

SEQ ID NO: 4004 - DNA, 21 bp, Artificial Sequence
  Description of Artificial Sequence: Synthetic oligonucleotide
ctggacaaaggctgagtctta

SEQ ID NO: 4005 - DNA, 21 bp, Artificial Sequence
  Description of Artificial Sequence: Synthetic oligonucleotide
gactcagcctttgtccagaga

SEQ ID NO: 4006 - DNA, 21 bp, Artificial Sequence
  Description of Artificial Sequence: Synthetic oligonucleotide
tctggacaaaggctgagtctt

SEQ ID NO: 4007 - DNA, 21 bp, Artificial Sequence
  Description of Artificial Sequence: Synthetic oligonucleotide
actcagcctttgtccagagaa

SEQ ID NO: 4008 - DNA, 21 bp, Artificial Sequence
  Description of Artificial Sequence: Synthetic oligonucleotide
ctctggacaaaggctgagtct

SEQ ID NO: 4009 - DNA, 21 bp, Artificial Sequence
  Description of Artificial Sequence: Synthetic oligonucleotide
ctcagcctttgtccagagaag

SEQ ID NO: 4010 - DNA, 21 bp, Artificial Sequence
  Description of Artificial Sequence: Synthetic oligonucleotide
tctctggacaaaggctgagtc

SEQ ID NO: 4011 - DNA, 21 bp, Artificial Sequence
  Description of Artificial Sequence: Synthetic oligonucleotide
tcagcctttgtccagagaagc

SEQ ID NO: 4012 - DNA, 21 bp, Artificial Sequence
  Description of Artificial Sequence: Synthetic oligonucleotide
ttctctggacaaaggctgagt

SEQ ID NO: 4013 - DNA, 21 bp, Artificial Sequence
  Description of Artificial Sequence: Synthetic oligonucleotide
cagcctttgtccagagaagct

SEQ ID NO: 4014 - DNA, 21 bp, Artificial Sequence
  Description of Artificial Sequence: Synthetic oligonucleotide
cttctctggacaaaggctgag

SEQ ID NO: 4015 - DNA, 21 bp, Artificial Sequence
  Description of Artificial Sequence: Synthetic oligonucleotide
agcctttgtccagagaagctc

SEQ ID NO: 4016 - DNA, 21 bp, Artificial Sequence
  Description of Artificial Sequence: Synthetic oligonucleotide
gcttctctggacaaaggctga

SEQ ID NO: 4017 - DNA, 21 bp, Artificial Sequence
  Description of Artificial Sequence: Synthetic oligonucleotide
gcctttgtccagagaagctca

SEQ ID NO: 4018 - DNA, 21 bp, Artificial Sequence
  Description of Artificial Sequence: Synthetic oligonucleotide
agcttctctggacaaaggctg

SEQ ID NO: 4019 - DNA, 21 bp, Artificial Sequence
  Description of Artificial Sequence: Synthetic oligonucleotide
cctttgtccagagaagctcag

SEQ ID NO: 4020 - DNA, 21 bp, Artificial Sequence
  Description of Artificial Sequence: Synthetic oligonucleotide
gagcttctctggacaaaggct

SEQ ID NO: 4021 - DNA, 21 bp, Artificial Sequence
  Description of Artificial Sequence: Synthetic oligonucleotide
ctttgtccagagaagctcagg

SEQ ID NO: 4022 - DNA, 21 bp, Artificial Sequence
  Description of Artificial Sequence: Synthetic oligonucleotide
tgagcttctctggacaaaggc

SEQ ID NO: 4023 - DNA, 21 bp, Artificial Sequence
  Description of Artificial Sequence: Synthetic oligonucleotide
tttgtccagagaagctcaggg

SEQ ID NO: 4024 - DNA, 21 bp, Artificial Sequence
  Description of Artificial Sequence: Synthetic oligonucleotide
ctgagcttctctggacaaagg

SEQ ID NO: 4025 - DNA, 21 bp, Artificial Sequence
  Description of Artificial Sequence: Synthetic oligonucleotide
ttgtccagagaagctcagggt

SEQ ID NO: 4026 - DNA, 21 bp, Artificial Sequence
  Description of Artificial Sequence: Synthetic oligonucleotide
cctgagcttctctggacaaag

SEQ ID NO: 4027 - DNA, 21 bp, Artificial Sequence
  Description of Artificial Sequence: Synthetic oligonucleotide
tgtccagagaagctcagggta

SEQ ID NO: 4028 - DNA, 21 bp, Artificial Sequence
  Description of Artificial Sequence: Synthetic oligonucleotide
ccctgagcttctctggacaaa

SEQ ID NO: 4029 - DNA, 21 bp, Artificial Sequence
  Description of Artificial Sequence: Synthetic oligonucleotide
gtccagagaagctcagggtat

SEQ ID NO: 4030 - DNA, 21 bp, Artificial Sequence
  Description of Artificial Sequence: Synthetic oligonucleotide
accctgagcttctctggacaa

SEQ ID NO: 4031 - DNA, 21 bp, Artificial Sequence
  Description of Artificial Sequence: Synthetic oligonucleotide
tccagagaagctcagggtata

SEQ ID NO: 4032 - DNA, 21 bp, Artificial Sequence
  Description of Artificial Sequence: Synthetic oligonucleotide
taccctgagcttctctggaca

SEQ ID NO: 4033 - DNA, 21 bp, Artificial Sequence
  Description of Artificial Sequence: Synthetic oligonucleotide
ccagagaagctcagggtatag

SEQ ID NO: 4034 - DNA, 21 bp, Artificial Sequence
  Description of Artificial Sequence: Synthetic oligonucleotide
ataccctgagcttctctggac

SEQ ID NO: 4035 - DNA, 21 bp, Artificial Sequence
  Description of Artificial Sequence: Synthetic oligonucleotide
cagagaagctcagggtatagc

SEQ ID NO: 4036 - DNA, 21 bp, Artificial Sequence
  Description of Artificial Sequence: Synthetic oligonucleotide
tataccctgagcttctctgga

SEQ ID NO: 4037 - DNA, 21 bp, Artificial Sequence
  Description of Artificial Sequence: Synthetic oligonucleotide
agagaagctcagggtatagct

SEQ ID NO: 4038 - DNA, 21 bp, Artificial Sequence
  Description of Artificial Sequence: Synthetic oligonucleotide
ctataccctgagcttctctgg

SEQ ID NO: 4039 - DNA, 21 bp, Artificial Sequence
  Description of Artificial Sequence: Synthetic oligonucleotide
gagaagctcagggtatagctg

SEQ ID NO: 4040 - DNA, 21 bp, Artificial Sequence
  Description of Artificial Sequence: Synthetic oligonucleotide
gctataccctgagcttctctg

SEQ ID NO: 4041 - DNA, 21 bp, Artificial Sequence
  Description of Artificial Sequence: Synthetic oligonucleotide
agaagctcagggtatagctga

SEQ ID NO: 4042 - DNA, 21 bp, Artificial Sequence
  Description of Artificial Sequence: Synthetic oligonucleotide
agctataccctgagcttctct

SEQ ID NO: 4043 - DNA, 21 bp, Artificial Sequence
  Description of Artificial Sequence: Synthetic oligonucleotide
gaagctcagggtatagctgaa

SEQ ID NO: 4044 - DNA, 21 bp, Artificial Sequence
  Description of Artificial Sequence: Synthetic oligonucleotide
cagctataccctgagcttctc

SEQ ID NO: 4045 - DNA, 21 bp, Artificial Sequence
  Description of Artificial Sequence: Synthetic oligonucleotide
aagctcagggtatagctgaat

SEQ ID NO: 4046 - DNA, 21 bp, Artificial Sequence
  Description of Artificial Sequence: Synthetic oligonucleotide
tcagctataccctgagcttct

SEQ ID NO: 4047 - DNA, 21 bp, Artificial Sequence
  Description of Artificial Sequence: Synthetic oligonucleotide
agctcagggtatagctgaata

SEQ ID NO: 4048 - DNA, 21 bp, Artificial Sequence
  Description of Artificial Sequence: Synthetic oligonucleotide
ttcagctataccctgagcttc

SEQ ID NO: 4049 - DNA, 21 bp, Artificial Sequence
  Description of Artificial Sequence: Synthetic oligonucleotide
gctcagggtatagctgaatag

SEQ ID NO: 4050 - DNA, 21 bp, Artificial Sequence
  Description of Artificial Sequence: Synthetic oligonucleotide
attcagctataccctgagctt

SEQ ID NO: 4051 - DNA, 21 bp, Artificial Sequence
  Description of Artificial Sequence: Synthetic oligonucleotide
ctcagggtatagctgaatagg

SEQ ID NO: 4052 - DNA, 21 bp, Artificial Sequence
  Description of Artificial Sequence: Synthetic oligonucleotide
tattcagctataccctgagct

SEQ ID NO: 4053 - DNA, 21 bp, Artificial Sequence
  Description of Artificial Sequence: Synthetic oligonucleotide
tcagggtatagctgaataggc

SEQ ID NO: 4054 - DNA, 21 bp, Artificial Sequence
  Description of Artificial Sequence: Synthetic oligonucleotide
ctattcagctataccctgagc

SEQ ID NO: 4055 - DNA, 21 bp, Artificial Sequence
  Description of Artificial Sequence: Synthetic oligonucleotide
cagggtatagctgaataggca

SEQ ID NO: 4056 - DNA, 21 bp, Artificial Sequence
  Description of Artificial Sequence: Synthetic oligonucleotide
cctattcagctataccctgag

SEQ ID NO: 4057 - DNA, 21 bp, Artificial Sequence
  Description of Artificial Sequence: Synthetic oligonucleotide
agggtatagctgaataggcag

SEQ ID NO: 4058 - DNA, 21 bp, Artificial Sequence
  Description of Artificial Sequence: Synthetic oligonucleotide
gcctattcagctataccctga

SEQ ID NO: 4059 - DNA, 21 bp, Artificial Sequence
  Description of Artificial Sequence: Synthetic oligonucleotide
gggtatagctgaataggcagt

SEQ ID NO: 4060 - DNA, 21 bp, Artificial Sequence
  Description of Artificial Sequence: Synthetic oligonucleotide
tgcctattcagctataccctg

SEQ ID NO: 4061 - DNA, 21 bp, Artificial Sequence
  Description of Artificial Sequence: Synthetic oligonucleotide
ggtatagctgaataggcagtt

SEQ ID NO: 4062 - DNA, 21 bp, Artificial Sequence
  Description of Artificial Sequence: Synthetic oligonucleotide
ctgcctattcagctataccct

SEQ ID NO: 4063 - DNA, 21 bp, Artificial Sequence
  Description of Artificial Sequence: Synthetic oligonucleotide
gtatagctgaataggcagttt

SEQ ID NO: 4064 - DNA, 21 bp, Artificial Sequence
  Description of Artificial Sequence: Synthetic oligonucleotide
actgcctattcagctataccc

SEQ ID NO: 4065 - DNA, 21 bp, Artificial Sequence
  Description of Artificial Sequence: Synthetic oligonucleotide
tatagctgaataggcagtttc

SEQ ID NO: 4066 - DNA, 21 bp, Artificial Sequence
  Description of Artificial Sequence: Synthetic oligonucleotide
aactgcctattcagctatacc

SEQ ID NO: 4067 - DNA, 21 bp, Artificial Sequence
  Description of Artificial Sequence: Synthetic oligonucleotide
atagctgaataggcagtttct

SEQ ID NO: 4068 - DNA, 21 bp, Artificial Sequence
  Description of Artificial Sequence: Synthetic oligonucleotide
aaactgcctattcagctatac

SEQ ID NO: 4069 - DNA, 21 bp, Artificial Sequence
  Description of Artificial Sequence: Synthetic oligonucleotide
tagctgaataggcagtttctt

SEQ ID NO: 4070 - DNA, 21 bp, Artificial Sequence
  Description of Artificial Sequence: Synthetic oligonucleotide
gaaactgcctattcagctata

SEQ ID NO: 4071 - DNA, 21 bp, Artificial Sequence
  Description of Artificial Sequence: Synthetic oligonucleotide
agctgaataggcagtttcttt

SEQ ID NO: 4072 - DNA, 21 bp, Artificial Sequence
  Description of Artificial Sequence: Synthetic oligonucleotide
agaaactgcctattcagctat

SEQ ID NO: 4073 - DNA, 21 bp, Artificial Sequence
  Description of Artificial Sequence: Synthetic oligonucleotide
gctgaataggcagtttctttt

SEQ ID NO: 4074 - DNA, 21 bp, Artificial Sequence
  Description of Artificial Sequence: Synthetic oligonucleotide
aagaaactgcctattcagcta

SEQ ID NO: 4075 - DNA, 21 bp, Artificial Sequence
  Description of Artificial Sequence: Synthetic oligonucleotide
ctgaataggcagtttcttttg

SEQ ID NO: 4076 - DNA, 21 bp, Artificial Sequence
  Description of Artificial Sequence: Synthetic oligonucleotide
aaagaaactgcctattcagct

SEQ ID NO: 4077 - DNA, 21 bp, Artificial Sequence
  Description of Artificial Sequence: Synthetic oligonucleotide
tgaataggcagtttcttttgt

SEQ ID NO: 4078 - DNA, 21 bp, Artificial Sequence
  Description of Artificial Sequence: Synthetic oligonucleotide
aaaagaaactgcctattcagc

SEQ ID NO: 4079 - DNA, 21 bp, Artificial Sequence
  Description of Artificial Sequence: Synthetic oligonucleotide
gaataggcagtttcttttgtc

SEQ ID NO: 4080 - DNA, 21 bp, Artificial Sequence
  Description of Artificial Sequence: Synthetic oligonucleotide
caaaagaaactgcctattcag

SEQ ID NO: 4081 - DNA, 21 bp, Artificial Sequence
  Description of Artificial Sequence: Synthetic oligonucleotide
aataggcagtttcttttgtcc

SEQ ID NO: 4082 - DNA, 21 bp, Artificial Sequence
  Description of Artificial Sequence: Synthetic oligonucleotide
acaaaagaaactgcctattca

SEQ ID NO: 4083 - DNA, 21 bp, Artificial Sequence
  Description of Artificial Sequence: Synthetic oligonucleotide
ataggcagtttcttttgtcct

SEQ ID NO: 4084 - DNA, 21 bp, Artificial Sequence
  Description of Artificial Sequence: Synthetic oligonucleotide
gacaaaagaaactgcctattc

SEQ ID NO: 4085 - DNA, 21 bp, Artificial Sequence
  Description of Artificial Sequence: Synthetic oligonucleotide
taggcagtttcttttgtcctg

SEQ ID NO: 4086 - DNA, 21 bp, Artificial Sequence
  Description of Artificial Sequence: Synthetic oligonucleotide
ggacaaaagaaactgcctatt

SEQ ID NO: 4087 - DNA, 21 bp, Artificial Sequence
  Description of Artificial Sequence: Synthetic oligonucleotide
aggcagtttcttttgtcctga

SEQ ID NO: 4088 - DNA, 21 bp, Artificial Sequence
  Description of Artificial Sequence: Synthetic oligonucleotide
aggacaaaagaaactgcctat

SEQ ID NO: 4089 - DNA, 21 bp, Artificial Sequence
  Description of Artificial Sequence: Synthetic oligonucleotide
ggcagtttcttttgtcctgag

SEQ ID NO: 4090 - DNA, 21 bp, Artificial Sequence
  Description of Artificial Sequence: Synthetic oligonucleotide
caggacaaaagaaactgccta

SEQ ID NO: 4091 - DNA, 21 bp, Artificial Sequence
  Description of Artificial Sequence: Synthetic oligonucleotide
gcagtttcttttgtcctgagg

SEQ ID NO: 4092 - DNA, 21 bp, Artificial Sequence
  Description of Artificial Sequence: Synthetic oligonucleotide
tcaggacaaaagaaactgcct

SEQ ID NO: 4093 - DNA, 21 bp, Artificial Sequence
  Description of Artificial Sequence: Synthetic oligonucleotide
cagtttcttttgtcctgagga

SEQ ID NO: 4094 - DNA, 21 bp, Artificial Sequence
  Description of Artificial Sequence: Synthetic oligonucleotide
ctcaggacaaaagaaactgcc

SEQ ID NO: 4095 - DNA, 21 bp, Artificial Sequence
  Description of Artificial Sequence: Synthetic oligonucleotide
agtttcttttgtcctgaggaa

SEQ ID NO: 4096 - DNA, 21 bp, Artificial Sequence
  Description of Artificial Sequence: Synthetic oligonucleotide
cctcaggacaaaagaaactgc

SEQ ID NO: 4097 - DNA, 21 bp, Artificial Sequence
  Description of Artificial Sequence: Synthetic oligonucleotide
gtttcttttgtcctgaggaaa

SEQ ID NO: 4098 - DNA, 21 bp, Artificial Sequence
  Description of Artificial Sequence: Synthetic oligonucleotide
tcctcaggacaaaagaaactg

SEQ ID NO: 4099 - DNA, 21 bp, Artificial Sequence
  Description of Artificial Sequence: Synthetic oligonucleotide
tttcttttgtcctgaggaaaa

SEQ ID NO: 4100 - DNA, 21 bp, Artificial Sequence
  Description of Artificial Sequence: Synthetic oligonucleotide
ttcctcaggacaaaagaaact

SEQ ID NO: 4101 - DNA, 21 bp, Artificial Sequence
  Description of Artificial Sequence: Synthetic oligonucleotide
ttcttttgtcctgaggaaaat

SEQ ID NO: 4102 - DNA, 21 bp, Artificial Sequence
  Description of Artificial Sequence: Synthetic oligonucleotide
tttcctcaggacaaaagaaac

SEQ ID NO: 4103 - DNA, 21 bp, Artificial Sequence
  Description of Artificial Sequence: Synthetic oligonucleotide
tcttttgtcctgaggaaaatc

SEQ ID NO: 4104 - DNA, 21 bp, Artificial Sequence
  Description of Artificial Sequence: Synthetic oligonucleotide
ttttcctcaggacaaaagaaa

SEQ ID NO: 4105 - DNA, 21 bp, Artificial Sequence
  Description of Artificial Sequence: Synthetic oligonucleotide
cttttgtcctgaggaaaatca

SEQ ID NO: 4106 - DNA, 21 bp, Artificial Sequence
  Description of Artificial Sequence: Synthetic oligonucleotide
attttcctcaggacaaaagaa

SEQ ID NO: 4107 - DNA, 21 bp, Artificial Sequence
  Description of Artificial Sequence: Synthetic oligonucleotide
ttttgtcctgaggaaaatcag

SEQ ID NO: 4108 - DNA, 21 bp, Artificial Sequence
  Description of Artificial Sequence: Synthetic oligonucleotide
gattttcctcaggacaaaaga

SEQ ID NO: 4109 - DNA, 21 bp, Artificial Sequence
  Description of Artificial Sequence: Synthetic oligonucleotide
tttgtcctgaggaaaatcagg

SEQ ID NO: 4110 - DNA, 21 bp, Artificial Sequence
  Description of Artificial Sequence: Synthetic oligonucleotide
tgattttcctcaggacaaaag

SEQ ID NO: 4111 - DNA, 21 bp, Artificial Sequence
  Description of Artificial Sequence: Synthetic oligonucleotide
ttgtcctgaggaaaatcagga

SEQ ID NO: 4112 - DNA, 21 bp, Artificial Sequence
  Description of Artificial Sequence: Synthetic oligonucleotide
ctgattttcctcaggacaaaa

SEQ ID NO: 4113 - DNA, 21 bp, Artificial Sequence
  Description of Artificial Sequence: Synthetic oligonucleotide
tgtcctgaggaaaatcaggac

SEQ ID NO: 4114 - DNA, 21 bp, Artificial Sequence
  Description of Artificial Sequence: Synthetic oligonucleotide
cctgattttcctcaggacaaa

SEQ ID NO: 4115 - DNA, 21 bp, Artificial Sequence
  Description of Artificial Sequence: Synthetic oligonucleotide
gtcctgaggaaaatcaggaca

SEQ ID NO: 4116 - DNA, 21 bp, Artificial Sequence
  Description of Artificial Sequence: Synthetic oligonucleotide
tcctgattttcctcaggacaa

SEQ ID NO: 4117 - DNA, 21 bp, Artificial Sequence
  Description of Artificial Sequence: Synthetic oligonucleotide
tcctgaggaaaatcaggacat

SEQ ID NO: 4118 - DNA, 21 bp, Artificial Sequence
  Description of Artificial Sequence: Synthetic oligonucleotide
gtcctgattttcctcaggaca

SEQ ID NO: 4119 - DNA, 21 bp, Artificial Sequence
  Description of Artificial Sequence: Synthetic oligonucleotide
cctgaggaaaatcaggacatg

SEQ ID NO: 4120 - DNA, 21 bp, Artificial Sequence
  Description of Artificial Sequence: Synthetic oligonucleotide
tgtcctgattttcctcaggac

SEQ ID NO: 4121 - DNA, 21 bp, Artificial Sequence
  Description of Artificial Sequence: Synthetic oligonucleotide
ctgaggaaaatcaggacatgc

SEQ ID NO: 4122 - DNA, 21 bp, Artificial Sequence
  Description of Artificial Sequence: Synthetic oligonucleotide
atgtcctgattttcctcagga

SEQ ID NO: 4123 - DNA, 21 bp, Artificial Sequence
  Description of Artificial Sequence: Synthetic oligonucleotide
tgaggaaaatcaggacatgcc

SEQ ID NO: 4124 - DNA, 21 bp, Artificial Sequence
  Description of Artificial Sequence: Synthetic oligonucleotide
catgtcctgattttcctcagg

SEQ ID NO: 4125 - DNA, 21 bp, Artificial Sequence
  Description of Artificial Sequence: Synthetic oligonucleotide
gaggaaaatcaggacatgcct

SEQ ID NO: 4126 - DNA, 21 bp, Artificial Sequence
  Description of Artificial Sequence: Synthetic oligonucleotide
gcatgtcctgattttcctcag

SEQ ID NO: 4127 - DNA, 21 bp, Artificial Sequence
  Description of Artificial Sequence: Synthetic oligonucleotide
aggaaaatcaggacatgcctg

SEQ ID NO: 4128 - DNA, 21 bp, Artificial Sequence
  Description of Artificial Sequence: Synthetic oligonucleotide
ggcatgtcctgattttcctca

SEQ ID NO: 4129 - DNA, 21 bp, Artificial Sequence
  Description of Artificial Sequence: Synthetic oligonucleotide
ggaaaatcaggacatgcctgc

SEQ ID NO: 4130 - DNA, 21 bp, Artificial Sequence
  Description of Artificial Sequence: Synthetic oligonucleotide
aggcatgtcctgattttcctc

SEQ ID NO: 4131 - DNA, 21 bp, Artificial Sequence
  Description of Artificial Sequence: Synthetic oligonucleotide
gaaaatcaggacatgcctgct

SEQ ID NO: 4132 - DNA, 21 bp, Artificial Sequence
  Description of Artificial Sequence: Synthetic oligonucleotide
caggcatgtcctgattttcct

SEQ ID NO: 4133 - DNA, 21 bp, Artificial Sequence
  Description of Artificial Sequence: Synthetic oligonucleotide
aaaatcaggacatgcctgctt

SEQ ID NO: 4134 - DNA, 21 bp, Artificial Sequence
  Description of Artificial Sequence: Synthetic oligonucleotide
gcaggcatgtcctgattttcc

SEQ ID NO: 4135 - DNA, 21 bp, Artificial Sequence
  Description of Artificial Sequence: Synthetic oligonucleotide
aaatcaggacatgcctgcttt

SEQ ID NO: 4136 - DNA, 21 bp, Artificial Sequence
  Description of Artificial Sequence: Synthetic oligonucleotide
agcaggcatgtcctgattttc

SEQ ID NO: 4137 - DNA, 21 bp, Artificial Sequence
  Description of Artificial Sequence: Synthetic oligonucleotide
aatcaggacatgcctgctttc

SEQ ID NO: 4138 - DNA, 21 bp, Artificial Sequence
  Description of Artificial Sequence: Synthetic oligonucleotide
aagcaggcatgtcctgatttt

SEQ ID NO: 4139 - DNA, 21 bp, Artificial Sequence
  Description of Artificial Sequence: Synthetic oligonucleotide
atcaggacatgcctgctttct

SEQ ID NO: 4140 - DNA, 21 bp, Artificial Sequence
  Description of Artificial Sequence: Synthetic oligonucleotide
aaagcaggcatgtcctgattt

SEQ ID NO: 4141 - DNA, 21 bp, Artificial Sequence
  Description of Artificial Sequence: Synthetic oligonucleotide
tcaggacatgcctgctttcta

SEQ ID NO: 4142 - DNA, 21 bp, Artificial Sequence
  Description of Artificial Sequence: Synthetic oligonucleotide
gaaagcaggcatgtcctgatt

SEQ ID NO: 4143 - DNA, 21 bp, Artificial Sequence
  Description of Artificial Sequence: Synthetic oligonucleotide
caggacatgcctgctttctaa

SEQ ID NO: 4144 - DNA, 21 bp, Artificial Sequence
  Description of Artificial Sequence: Synthetic oligonucleotide
agaaagcaggcatgtcctgat

SEQ ID NO: 4145 - DNA, 21 bp, Artificial Sequence
  Description of Artificial Sequence: Synthetic oligonucleotide
aggacatgcctgctttctaaa

SEQ ID NO: 4146 - DNA, 21 bp, Artificial Sequence
  Description of Artificial Sequence: Synthetic oligonucleotide
tagaaagcaggcatgtcctga

SEQ ID NO: 4147 - DNA, 21 bp, Artificial Sequence
  Description of Artificial Sequence: Synthetic oligonucleotide
ggacatgcctgctttctaaaa

SEQ ID NO: 4148 - DNA, 21 bp, Artificial Sequence
  Description of Artificial Sequence: Synthetic oligonucleotide
ttagaaagcaggcatgtcctg

SEQ ID NO: 4149 - DNA, 21 bp, Artificial Sequence
  Description of Artificial Sequence: Synthetic oligonucleotide
gacatgcctgctttctaaaaa

SEQ ID NO: 4150 - DNA, 21 bp, Artificial Sequence
  Description of Artificial Sequence: Synthetic oligonucleotide
tttagaaagcaggcatgtcct

SEQ ID NO: 4151 - DNA, 21 bp, Artificial Sequence
  Description of Artificial Sequence: Synthetic oligonucleotide
acatgcctgctttctaaaaat

SEQ ID NO: 4152 - DNA, 21 bp, Artificial Sequence
  Description of Artificial Sequence: Synthetic oligonucleotide
ttttagaaagcaggcatgtcc

SEQ ID NO: 4153 - DNA, 21 bp, Artificial Sequence
  Description of Artificial Sequence: Synthetic oligonucleotide
catgcctgctttctaaaaatc

SEQ ID NO: 4154 - DNA, 21 bp, Artificial Sequence
  Description of Artificial Sequence: Synthetic oligonucleotide
tttttagaaagcaggcatgtc

SEQ ID NO: 4155 - DNA, 21 bp, Artificial Sequence
  Description of Artificial Sequence: Synthetic oligonucleotide
atgcctgctttctaaaaatct

SEQ ID NO: 4156 - DNA, 21 bp, Artificial Sequence
  Description of Artificial Sequence: Synthetic oligonucleotide
atttttagaaagcaggcatgt

SEQ ID NO: 4157 - DNA, 21 bp, Artificial Sequence
  Description of Artificial Sequence: Synthetic oligonucleotide
tgcctgctttctaaaaatctt

SEQ ID NO: 4158 - DNA, 21 bp, Artificial Sequence
  Description of Artificial Sequence: Synthetic oligonucleotide
gatttttagaaagcaggcatg

SEQ ID NO: 4159 - DNA, 21 bp, Artificial Sequence
  Description of Artificial Sequence: Synthetic oligonucleotide
gcctgctttctaaaaatcttc

SEQ ID NO: 4160 - DNA, 21 bp, Artificial Sequence
  Description of Artificial Sequence: Synthetic oligonucleotide
agatttttagaaagcaggcat

SEQ ID NO: 4161 - DNA, 21 bp, Artificial Sequence
  Description of Artificial Sequence: Synthetic oligonucleotide
cctgctttctaaaaatcttcc

SEQ ID NO: 4162 - DNA, 21 bp, Artificial Sequence
  Description of Artificial Sequence: Synthetic oligonucleotide
aagatttttagaaagcaggca

SEQ ID NO: 4163 - DNA, 21 bp, Artificial Sequence
  Description of Artificial Sequence: Synthetic oligonucleotide
ctgctttctaaaaatcttcct

SEQ ID NO: 4164 - DNA, 21 bp, Artificial Sequence
  Description of Artificial Sequence: Synthetic oligonucleotide
gaagatttttagaaagcaggc

SEQ ID NO: 4165 - DNA, 21 bp, Artificial Sequence
  Description of Artificial Sequence: Synthetic oligonucleotide
tgctttctaaaaatcttcctc

SEQ ID NO: 4166 - DNA, 21 bp, Artificial Sequence
  Description of Artificial Sequence: Synthetic oligonucleotide
ggaagatttttagaaagcagg

SEQ ID NO: 4167 - DNA, 21 bp, Artificial Sequence
  Description of Artificial Sequence: Synthetic oligonucleotide
gctttctaaaaatcttcctct

SEQ ID NO: 4168 - DNA, 21 bp, Artificial Sequence
  Description of Artificial Sequence: Synthetic oligonucleotide
aggaagatttttagaaagcag

SEQ ID NO: 4169 - DNA, 21 bp, Artificial Sequence
  Description of Artificial Sequence: Synthetic oligonucleotide
ctttctaaaaatcttcctctg

SEQ ID NO: 4170 - DNA, 21 bp, Artificial Sequence
  Description of Artificial Sequence: Synthetic oligonucleotide
gaggaagatttttagaaagca

SEQ ID NO: 4171 - DNA, 21 bp, Artificial Sequence
  Description of Artificial Sequence: Synthetic oligonucleotide
tttctaaaaatcttcctctga

SEQ ID NO: 4172 - DNA, 21 bp, Artificial Sequence
  Description of Artificial Sequence: Synthetic oligonucleotide
agaggaagatttttagaaagc

SEQ ID NO: 4173 - DNA, 21 bp, Artificial Sequence
  Description of Artificial Sequence: Synthetic oligonucleotide
ttctaaaaatcttcctctgaa

SEQ ID NO: 4174 - DNA, 21 bp, Artificial Sequence
  Description of Artificial Sequence: Synthetic oligonucleotide
cagaggaagatttttagaaag

SEQ ID NO: 4175 - DNA, 21 bp, Artificial Sequence
  Description of Artificial Sequence: Synthetic oligonucleotide
tctaaaaatcttcctctgaag

SEQ ID NO: 4176 - DNA, 21 bp, Artificial Sequence
  Description of Artificial Sequence: Synthetic oligonucleotide
tcagaggaagatttttagaaa

SEQ ID NO: 4177 - DNA, 21 bp, Artificial Sequence
  Description of Artificial Sequence: Synthetic oligonucleotide
ctaaaaatcttcctctgaaga

SEQ ID NO: 4178 - DNA, 21 bp, Artificial Sequence
  Description of Artificial Sequence: Synthetic oligonucleotide
ttcagaggaagatttttagaa

SEQ ID NO: 4179 - DNA, 21 bp, Artificial Sequence
  Description of Artificial Sequence: Synthetic oligonucleotide
taaaaatcttcctctgaagac

SEQ ID NO: 4180 - DNA, 21 bp, Artificial Sequence
  Description of Artificial Sequence: Synthetic oligonucleotide
cttcagaggaagatttttaga

SEQ ID NO: 4181 - DNA, 21 bp, Artificial Sequence
  Description of Artificial Sequence: Synthetic oligonucleotide
aaaaatcttcctctgaagacc

SEQ ID NO: 4182 - DNA, 21 bp, Artificial Sequence
  Description of Artificial Sequence: Synthetic oligonucleotide
tcttcagaggaagatttttag

SEQ ID NO: 4183 - DNA, 21 bp, Artificial Sequence
  Description of Artificial Sequence: Synthetic oligonucleotide
aaaatcttcctctgaagacct

SEQ ID NO: 4184 - DNA, 21 bp, Artificial Sequence
  Description of Artificial Sequence: Synthetic oligonucleotide
gtcttcagaggaagattttta

SEQ ID NO: 4185 - DNA, 21 bp, Artificial Sequence
  Description of Artificial Sequence: Synthetic oligonucleotide
aaatcttcctctgaagacctg

SEQ ID NO: 4186 - DNA, 21 bp, Artificial Sequence
  Description of Artificial Sequence: Synthetic oligonucleotide
ggtcttcagaggaagattttt

SEQ ID NO: 4187 - DNA, 21 bp, Artificial Sequence
  Description of Artificial Sequence: Synthetic oligonucleotide
aatcttcctctgaagacctga

SEQ ID NO: 4188 - DNA, 21 bp, Artificial Sequence
  Description of Artificial Sequence: Synthetic oligonucleotide
aggtcttcagaggaagatttt

SEQ ID NO: 4189 - DNA, 21 bp, Artificial Sequence
  Description of Artificial Sequence: Synthetic oligonucleotide
atcttcctctgaagacctgac

SEQ ID NO: 4190 - DNA, 21 bp, Artificial Sequence
  Description of Artificial Sequence: Synthetic oligonucleotide
caggtcttcagaggaagattt

SEQ ID NO: 4191 - DNA, 21 bp, Artificial Sequence
  Description of Artificial Sequence: Synthetic oligonucleotide
tcttcctctgaagacctgacc

SEQ ID NO: 4192 - DNA, 21 bp, Artificial Sequence
  Description of Artificial Sequence: Synthetic oligonucleotide
tcaggtcttcagaggaagatt

SEQ ID NO: 4193 - DNA, 21 bp, Artificial Sequence
  Description of Artificial Sequence: Synthetic oligonucleotide
cttcctctgaagacctgaccc

SEQ ID NO: 4194 - DNA, 21 bp, Artificial Sequence
  Description of Artificial Sequence: Synthetic oligonucleotide
gtcaggtcttcagaggaagat

SEQ ID NO: 4195 - DNA, 21 bp, Artificial Sequence
  Description of Artificial Sequence: Synthetic oligonucleotide
ttcctctgaagacctgaccca

SEQ ID NO: 4196 - DNA, 21 bp, Artificial Sequence
  Description of Artificial Sequence: Synthetic oligonucleotide
ggtcaggtcttcagaggaaga

SEQ ID NO: 4197 - DNA, 21 bp, Artificial Sequence
  Description of Artificial Sequence: Synthetic oligonucleotide
tcctctgaagacctgacccaa

SEQ ID NO: 4198 - DNA, 21 bp, Artificial Sequence
  Description of Artificial Sequence: Synthetic oligonucleotide
gggtcaggtcttcagaggaag

SEQ ID NO: 4199 - DNA, 21 bp, Artificial Sequence
  Description of Artificial Sequence: Synthetic oligonucleotide
cctctgaagacctgacccaag

SEQ ID NO: 4200 - DNA, 21 bp, Artificial Sequence
  Description of Artificial Sequence: Synthetic oligonucleotide
tgggtcaggtcttcagaggaa

SEQ ID NO: 4201 - DNA, 21 bp, Artificial Sequence
  Description of Artificial Sequence: Synthetic oligonucleotide
ctctgaagacctgacccaagc

SEQ ID NO: 4202 - DNA, 21 bp, Artificial Sequence
  Description of Artificial Sequence: Synthetic oligonucleotide
ttgggtcaggtcttcagagga

SEQ ID NO: 4203 - DNA, 21 bp, Artificial Sequence
  Description of Artificial Sequence: Synthetic oligonucleotide
tctgaagacctgacccaagct

SEQ ID NO: 4204 - DNA, 21 bp, Artificial Sequence
  Description of Artificial Sequence: Synthetic oligonucleotide
cttgggtcaggtcttcagagg

SEQ ID NO: 4205 - DNA, 21 bp, Artificial Sequence
  Description of Artificial Sequence: Synthetic oligonucleotide
ctgaagacctgacccaagctc

SEQ ID NO: 4206 - DNA, 21 bp, Artificial Sequence
  Description of Artificial Sequence: Synthetic oligonucleotide
gcttgggtcaggtcttcagag

SEQ ID NO: 4207 - DNA, 21 bp, Artificial Sequence
  Description of Artificial Sequence: Synthetic oligonucleotide
tgaagacctgacccaagctct

SEQ ID NO: 4208 - DNA, 21 bp, Artificial Sequence
  Description of Artificial Sequence: Synthetic oligonucleotide
agcttgggtcaggtcttcaga

SEQ ID NO: 4209 - DNA, 21 bp, Artificial Sequence
  Description of Artificial Sequence: Synthetic oligonucleotide
gaagacctgacccaagctctt

SEQ ID NO: 4210 - DNA, 21 bp, Artificial Sequence
  Description of Artificial Sequence: Synthetic oligonucleotide
gagcttgggtcaggtcttcag

SEQ ID NO: 4211 - DNA, 21 bp, Artificial Sequence
  Description of Artificial Sequence: Synthetic oligonucleotide
aagacctgacccaagctctta

SEQ ID NO: 4212 - DNA, 21 bp, Artificial Sequence
  Description of Artificial Sequence: Synthetic oligonucleotide
agagcttgggtcaggtcttca

SEQ ID NO: 4213 - DNA, 21 bp, Artificial Sequence
  Description of Artificial Sequence: Synthetic oligonucleotide
agacctgacccaagctcttaa

SEQ ID NO: 4214 - DNA, 21 bp, Artificial Sequence
  Description of Artificial Sequence: Synthetic oligonucleotide
aagagcttgggtcaggtcttc

SEQ ID NO: 4215 - DNA, 21 bp, Artificial Sequence
  Description of Artificial Sequence: Synthetic oligonucleotide
gacctgacccaagctcttaaa

SEQ ID NO: 4216 - DNA, 21 bp, Artificial Sequence
  Description of Artificial Sequence: Synthetic oligonucleotide
taagagcttgggtcaggtctt

SEQ ID NO: 4217 - DNA, 21 bp, Artificial Sequence
  Description of Artificial Sequence: Synthetic oligonucleotide
acctgacccaagctcttaaat

SEQ ID NO: 4218 - DNA, 21 bp, Artificial Sequence
  Description of Artificial Sequence: Synthetic oligonucleotide
ttaagagcttgggtcaggtct

SEQ ID NO: 4219 - DNA, 21 bp, Artificial Sequence
  Description of Artificial Sequence: Synthetic oligonucleotide
cctgacccaagctcttaaatg

SEQ ID NO: 4220 - DNA, 21 bp, Artificial Sequence
  Description of Artificial Sequence: Synthetic oligonucleotide
tttaagagcttgggtcaggtc

SEQ ID NO: 4221 - DNA, 21 bp, Artificial Sequence
  Description of Artificial Sequence: Synthetic oligonucleotide
ctgacccaagctcttaaatgc

SEQ ID NO: 4222 - DNA, 21 bp, Artificial Sequence
  Description of Artificial Sequence: Synthetic oligonucleotide
atttaagagcttgggtcaggt

SEQ ID NO: 4223 - DNA, 21 bp, Artificial Sequence
  Description of Artificial Sequence: Synthetic oligonucleotide
tgacccaagctcttaaatgct

SEQ ID NO: 4224 - DNA, 21 bp, Artificial Sequence
  Description of Artificial Sequence: Synthetic oligonucleotide
catttaagagcttgggtcagg

SEQ ID NO: 4225 - DNA, 21 bp, Artificial Sequence
  Description of Artificial Sequence: Synthetic oligonucleotide
gacccaagctcttaaatgcta

SEQ ID NO: 4226 - DNA, 21 bp, Artificial Sequence
  Description of Artificial Sequence: Synthetic oligonucleotide
gcatttaagagcttgggtcag

SEQ ID NO: 4227 - DNA, 21 bp, Artificial Sequence
  Description of Artificial Sequence: Synthetic oligonucleotide
acccaagctcttaaatgctat

SEQ ID NO: 4228 - DNA, 21 bp, Artificial Sequence
  Description of Artificial Sequence: Synthetic oligonucleotide
agcatttaagagcttgggtca

SEQ ID NO: 4229 - DNA, 21 bp, Artificial Sequence
  Description of Artificial Sequence: Synthetic oligonucleotide
cccaagctcttaaatgctatt

SEQ ID NO: 4230 - DNA, 21 bp, Artificial Sequence
  Description of Artificial Sequence: Synthetic oligonucleotide
tagcatttaagagcttgggtc

SEQ ID NO: 4231 - DNA, 21 bp, Artificial Sequence
  Description of Artificial Sequence: Synthetic oligonucleotide
ccaagctcttaaatgctattg

SEQ ID NO: 4232 - DNA, 21 bp, Artificial Sequence
  Description of Artificial Sequence: Synthetic oligonucleotide
atagcatttaagagcttgggt

SEQ ID NO: 4233 - DNA, 21 bp, Artificial Sequence
  Description of Artificial Sequence: Synthetic oligonucleotide
caagctcttaaatgctattgt

SEQ ID NO: 4234 - DNA, 21 bp, Artificial Sequence
  Description of Artificial Sequence: Synthetic oligonucleotide
aatagcatttaagagcttggg

SEQ ID NO: 4235 - DNA, 21 bp, Artificial Sequence
  Description of Artificial Sequence: Synthetic oligonucleotide
aagctcttaaatgctattgta

SEQ ID NO: 4236 - DNA, 21 bp, Artificial Sequence
  Description of Artificial Sequence: Synthetic oligonucleotide
caatagcatttaagagcttgg

SEQ ID NO: 4237 - DNA, 21 bp, Artificial Sequence
  Description of Artificial Sequence: Synthetic oligonucleotide
agctcttaaatgctattgtaa

SEQ ID NO: 4238 - DNA, 21 bp, Artificial Sequence
  Description of Artificial Sequence: Synthetic oligonucleotide
acaatagcatttaagagcttg

SEQ ID NO: 4239 - DNA, 21 bp, Artificial Sequence
  Description of Artificial Sequence: Synthetic oligonucleotide
gctcttaaatgctattgtaag

SEQ ID NO: 4240 - DNA, 21 bp, Artificial Sequence
  Description of Artificial Sequence: Synthetic oligonucleotide
tacaatagcatttaagagctt

SEQ ID NO: 4241 - DNA, 21 bp, Artificial Sequence
  Description of Artificial Sequence: Synthetic oligonucleotide
ctcttaaatgctattgtaaga

SEQ ID NO: 4242 - DNA, 21 bp, Artificial Sequence
  Description of Artificial Sequence: Synthetic oligonucleotide
ttacaatagcatttaagagct

SEQ ID NO: 4243 - DNA, 21 bp, Artificial Sequence
  Description of Artificial Sequence: Synthetic oligonucleotide
tcttaaatgctattgtaagag

SEQ ID NO: 4244 - DNA, 21 bp, Artificial Sequence
  Description of Artificial Sequence: Synthetic oligonucleotide
cttacaatagcatttaagagc

SEQ ID NO: 4245 - DNA, 21 bp, Artificial Sequence
  Description of Artificial Sequence: Synthetic oligonucleotide
cttaaatgctattgtaagaga

SEQ ID NO: 4246 - DNA, 21 bp, Artificial Sequence
  Description of Artificial Sequence: Synthetic oligonucleotide
tcttacaatagcatttaagag

SEQ ID NO: 4247 - DNA, 21 bp, Artificial Sequence
  Description of Artificial Sequence: Synthetic oligonucleotide
ttaaatgctattgtaagagaa

SEQ ID NO: 4248 - DNA, 21 bp, Artificial Sequence
  Description of Artificial Sequence: Synthetic oligonucleotide
ctcttacaatagcatttaaga

SEQ ID NO: 4249 - DNA, 21 bp, Artificial Sequence
  Description of Artificial Sequence: Synthetic oligonucleotide
taaatgctattgtaagagaaa

SEQ ID NO: 4250 - DNA, 21 bp, Artificial Sequence
  Description of Artificial Sequence: Synthetic oligonucleotide
tctcttacaatagcatttaag

SEQ ID NO: 4251 - DNA, 21 bp, Artificial Sequence
  Description of Artificial Sequence: Synthetic oligonucleotide
aaatgctattgtaagagaaat

SEQ ID NO: 4252 - DNA, 21 bp, Artificial Sequence
  Description of Artificial Sequence: Synthetic oligonucleotide
ttctcttacaatagcatttaa

SEQ ID NO: 4253 - DNA, 21 bp, Artificial Sequence
  Description of Artificial Sequence: Synthetic oligonucleotide
aatgctattgtaagagaaatt

SEQ ID NO: 4254 - DNA, 21 bp, Artificial Sequence
  Description of Artificial Sequence: Synthetic oligonucleotide
tttctcttacaatagcattta

SEQ ID NO: 4255 - DNA, 21 bp, Artificial Sequence
  Description of Artificial Sequence: Synthetic oligonucleotide
atgctattgtaagagaaattt

SEQ ID NO: 4256 - DNA, 21 bp, Artificial Sequence
  Description of Artificial Sequence: Synthetic oligonucleotide
atttctcttacaatagcattt

SEQ ID NO: 4257 - DNA, 21 bp, Artificial Sequence
  Description of Artificial Sequence: Synthetic oligonucleotide
tgctattgtaagagaaatttc

SEQ ID NO: 4258 - DNA, 21 bp, Artificial Sequence
  Description of Artificial Sequence: Synthetic oligonucleotide
aatttctcttacaatagcatt

SEQ ID NO: 4259 - DNA, 21 bp, Artificial Sequence
  Description of Artificial Sequence: Synthetic oligonucleotide
gctattgtaagagaaatttct

SEQ ID NO: 4260 - DNA, 21 bp, Artificial Sequence
  Description of Artificial Sequence: Synthetic oligonucleotide
aaatttctcttacaatagcat

SEQ ID NO: 4261 - DNA, 21 bp, Artificial Sequence
  Description of Artificial Sequence: Synthetic oligonucleotide
ctattgtaagagaaatttctt

SEQ ID NO: 4262 - DNA, 21 bp, Artificial Sequence
  Description of Artificial Sequence: Synthetic oligonucleotide
gaaatttctcttacaatagca

SEQ ID NO: 4263 - DNA, 21 bp, Artificial Sequence
  Description of Artificial Sequence: Synthetic oligonucleotide
tattgtaagagaaatttcttt

SEQ ID NO: 4264 - DNA, 21 bp, Artificial Sequence
  Description of Artificial Sequence: Synthetic oligonucleotide
agaaatttctcttacaatagc

SEQ ID NO: 4265 - DNA, 21 bp, Artificial Sequence
  Description of Artificial Sequence: Synthetic oligonucleotide
attgtaagagaaatttctttg

SEQ ID NO: 4266 - DNA, 21 bp, Artificial Sequence
  Description of Artificial Sequence: Synthetic oligonucleotide
aagaaatttctcttacaatag

SEQ ID NO: 4267 - DNA, 21 bp, Artificial Sequence
  Description of Artificial Sequence: Synthetic oligonucleotide
ttgtaagagaaatttctttgt

SEQ ID NO: 4268 - DNA, 21 bp, Artificial Sequence
  Description of Artificial Sequence: Synthetic oligonucleotide
aaagaaatttctcttacaata

SEQ ID NO: 4269 - DNA, 21 bp, Artificial Sequence
  Description of Artificial Sequence: Synthetic oligonucleotide
tgtaagagaaatttctttgtc

SEQ ID NO: 4270 - DNA, 21 bp, Artificial Sequence
  Description of Artificial Sequence: Synthetic oligonucleotide
caaagaaatttctcttacaat

SEQ ID NO: 4271 - DNA, 21 bp, Artificial Sequence
  Description of Artificial Sequence: Synthetic oligonucleotide
gtaagagaaatttctttgtct

SEQ ID NO: 4272 - DNA, 21 bp, Artificial Sequence
  Description of Artificial Sequence: Synthetic oligonucleotide
acaaagaaatttctcttacaa

SEQ ID NO: 4273 - DNA, 21 bp, Artificial Sequence
  Description of Artificial Sequence: Synthetic oligonucleotide
taagagaaatttctttgtcta

SEQ ID NO: 4274 - DNA, 21 bp, Artificial Sequence
  Description of Artificial Sequence: Synthetic oligonucleotide
gacaaagaaatttctcttaca

SEQ ID NO: 4275 - DNA, 21 bp, Artificial Sequence
  Description of Artificial Sequence: Synthetic oligonucleotide
aagagaaatttctttgtctat

SEQ ID NO: 4276 - DNA, 21 bp, Artificial Sequence
  Description of Artificial Sequence: Synthetic oligonucleotide
agacaaagaaatttctcttac

SEQ ID NO: 4277 - DNA, 21 bp, Artificial Sequence
  Description of Artificial Sequence: Synthetic oligonucleotide
agagaaatttctttgtctatt

SEQ ID NO: 4278 - DNA, 21 bp, Artificial Sequence
  Description of Artificial Sequence: Synthetic oligonucleotide
tagacaaagaaatttctctta

SEQ ID NO: 4279 - DNA, 21 bp, Artificial Sequence
  Description of Artificial Sequence: Synthetic oligonucleotide
gagaaatttctttgtctatta

SEQ ID NO: 4280 - DNA, 21 bp, Artificial Sequence
  Description of Artificial Sequence: Synthetic oligonucleotide
atagacaaagaaatttctctt

SEQ ID NO: 4281 - DNA, 21 bp, Artificial Sequence
  Description of Artificial Sequence: Synthetic oligonucleotide
agaaatttctttgtctattaa

SEQ ID NO: 4282 - DNA, 21 bp, Artificial Sequence
  Description of Artificial Sequence: Synthetic oligonucleotide
aatagacaaagaaatttctct

SEQ ID NO: 4283 - DNA, 21 bp, Artificial Sequence
  Description of Artificial Sequence: Synthetic oligonucleotide
gaaatttctttgtctattaac

SEQ ID NO: 4284 - DNA, 21 bp, Artificial Sequence
  Description of Artificial Sequence: Synthetic oligonucleotide
taatagacaaagaaatttctc

SEQ ID NO: 4285 - DNA, 21 bp, Artificial Sequence
  Description of Artificial Sequence: Synthetic oligonucleotide
aaatttctttgtctattaact

SEQ ID NO: 4286 - DNA, 21 bp, Artificial Sequence
  Description of Artificial Sequence: Synthetic oligonucleotide
ttaatagacaaagaaatttct

SEQ ID NO: 4287 - DNA, 21 bp, Artificial Sequence
  Description of Artificial Sequence: Synthetic oligonucleotide
aatttctttgtctattaactc

SEQ ID NO: 4288 - DNA, 21 bp, Artificial Sequence
  Description of Artificial Sequence: Synthetic oligonucleotide
gttaatagacaaagaaatttc

SEQ ID NO: 4289 - DNA, 21 bp, Artificial Sequence
  Description of Artificial Sequence: Synthetic oligonucleotide
atttctttgtctattaactcc

SEQ ID NO: 4290 - DNA, 21 bp, Artificial Sequence
  Description of Artificial Sequence: Synthetic oligonucleotide
agttaatagacaaagaaattt

SEQ ID NO: 4291 - DNA, 21 bp, Artificial Sequence
  Description of Artificial Sequence: Synthetic oligonucleotide
tttctttgtctattaactcca

SEQ ID NO: 4292 - DNA, 21 bp, Artificial Sequence
  Description of Artificial Sequence: Synthetic oligonucleotide
gagttaatagacaaagaaatt

SEQ ID NO: 4293 - DNA, 21 bp, Artificial Sequence
  Description of Artificial Sequence: Synthetic oligonucleotide
ttctttgtctattaactccat

SEQ ID NO: 4294 - DNA, 21 bp, Artificial Sequence
  Description of Artificial Sequence: Synthetic oligonucleotide
ggagttaatagacaaagaaat

SEQ ID NO: 4295 - DNA, 21 bp, Artificial Sequence
  Description of Artificial Sequence: Synthetic oligonucleotide
tctttgtctattaactccatt

SEQ ID NO: 4296 - DNA, 21 bp, Artificial Sequence
  Description of Artificial Sequence: Synthetic oligonucleotide
tggagttaatagacaaagaaa

SEQ ID NO: 4297 - DNA, 21 bp, Artificial Sequence
  Description of Artificial Sequence: Synthetic oligonucleotide
ctttgtctattaactccattt

SEQ ID NO: 4298 - DNA, 21 bp, Artificial Sequence
  Description of Artificial Sequence: Synthetic oligonucleotide
atggagttaatagacaaagaa

SEQ ID NO: 4299 - DNA, 21 bp, Artificial Sequence
  Description of Artificial Sequence: Synthetic oligonucleotide
tttgtctattaactccatttt

SEQ ID NO: 4300 - DNA, 21 bp, Artificial Sequence
  Description of Artificial Sequence: Synthetic oligonucleotide
aatggagttaatagacaaaga

SEQ ID NO: 4301 - DNA, 21 bp, Artificial Sequence
  Description of Artificial Sequence: Synthetic oligonucleotide
ttgtctattaactccatttta

SEQ ID NO: 4302 - DNA, 21 bp, Artificial Sequence
  Description of Artificial Sequence: Synthetic oligonucleotide
aaatggagttaatagacaaag

SEQ ID NO: 4303 - DNA, 21 bp, Artificial Sequence
  Description of Artificial Sequence: Synthetic oligonucleotide
tgtctattaactccattttag

SEQ ID NO: 4304 - DNA, 21 bp, Artificial Sequence
  Description of Artificial Sequence: Synthetic oligonucleotide
aaaatggagttaatagacaaa

SEQ ID NO: 4305 - DNA, 21 bp, Artificial Sequence
  Description of Artificial Sequence: Synthetic oligonucleotide
gtctattaactccattttagt

SEQ ID NO: 4306 - DNA, 21 bp, Artificial Sequence
  Description of Artificial Sequence: Synthetic oligonucleotide
taaaatggagttaatagacaa

SEQ ID NO: 4307 - DNA, 21 bp, Artificial Sequence
  Description of Artificial Sequence: Synthetic oligonucleotide
tctattaactccattttagta

SEQ ID NO: 4308 - DNA, 21 bp, Artificial Sequence
  Description of Artificial Sequence: Synthetic oligonucleotide
ctaaaatggagttaatagaca

SEQ ID NO: 4309 - DNA, 21 bp, Artificial Sequence
  Description of Artificial Sequence: Synthetic oligonucleotide
ctattaactccattttagtag

SEQ ID NO: 4310 - DNA, 21 bp, Artificial Sequence
  Description of Artificial Sequence: Synthetic oligonucleotide
actaaaatggagttaatagac

SEQ ID NO: 4311 - DNA, 21 bp, Artificial Sequence
  Description of Artificial Sequence: Synthetic oligonucleotide
tattaactccattttagtagg

SEQ ID NO: 4312 - DNA, 21 bp, Artificial Sequence
  Description of Artificial Sequence: Synthetic oligonucleotide
tactaaaatggagttaataga

SEQ ID NO: 4313 - DNA, 21 bp, Artificial Sequence
  Description of Artificial Sequence: Synthetic oligonucleotide
attaactccattttagtaggg

SEQ ID NO: 4314 - DNA, 21 bp, Artificial Sequence
  Description of Artificial Sequence: Synthetic oligonucleotide
ctactaaaatggagttaatag

SEQ ID NO: 4315 - DNA, 21 bp, Artificial Sequence
  Description of Artificial Sequence: Synthetic oligonucleotide
ttaactccattttagtaggga

SEQ ID NO: 4316 - DNA, 21 bp, Artificial Sequence
  Description of Artificial Sequence: Synthetic oligonucleotide
cctactaaaatggagttaata

SEQ ID NO: 4317 - DNA, 21 bp, Artificial Sequence
  Description of Artificial Sequence: Synthetic oligonucleotide
taactccattttagtagggat

SEQ ID NO: 4318 - DNA, 21 bp, Artificial Sequence
  Description of Artificial Sequence: Synthetic oligonucleotide
ccctactaaaatggagttaat

SEQ ID NO: 4319 - DNA, 21 bp, Artificial Sequence
  Description of Artificial Sequence: Synthetic oligonucleotide
aactccattttagtagggatt

SEQ ID NO: 4320 - DNA, 21 bp, Artificial Sequence
  Description of Artificial Sequence: Synthetic oligonucleotide
tccctactaaaatggagttaa

SEQ ID NO: 4321 - DNA, 21 bp, Artificial Sequence
  Description of Artificial Sequence: Synthetic oligonucleotide
actccattttagtagggattc

SEQ ID NO: 4322 - DNA, 21 bp, Artificial Sequence
  Description of Artificial Sequence: Synthetic oligonucleotide
atccctactaaaatggagtta

SEQ ID NO: 4323 - DNA, 21 bp, Artificial Sequence
  Description of Artificial Sequence: Synthetic oligonucleotide
ctccattttagtagggattca

SEQ ID NO: 4324 - DNA, 21 bp, Artificial Sequence
  Description of Artificial Sequence: Synthetic oligonucleotide
aatccctactaaaatggagtt

SEQ ID NO: 4325 - DNA, 21 bp, Artificial Sequence
  Description of Artificial Sequence: Synthetic oligonucleotide
tccattttagtagggattcac

SEQ ID NO: 4326 - DNA, 21 bp, Artificial Sequence
  Description of Artificial Sequence: Synthetic oligonucleotide
gaatccctactaaaatggagt

SEQ ID NO: 4327 - DNA, 21 bp, Artificial Sequence
  Description of Artificial Sequence: Synthetic oligonucleotide
ccattttagtagggattcact

SEQ ID NO: 4328 - DNA, 21 bp, Artificial Sequence
  Description of Artificial Sequence: Synthetic oligonucleotide
tgaatccctactaaaatggag

SEQ ID NO: 4329 - DNA, 21 bp, Artificial Sequence
  Description of Artificial Sequence: Synthetic oligonucleotide
cattttagtagggattcactg

SEQ ID NO: 4330 - DNA, 21 bp, Artificial Sequence
  Description of Artificial Sequence: Synthetic oligonucleotide
gtgaatccctactaaaatgga

SEQ ID NO: 4331 - DNA, 21 bp, Artificial Sequence
  Description of Artificial Sequence: Synthetic oligonucleotide
attttagtagggattcactga

SEQ ID NO: 4332 - DNA, 21 bp, Artificial Sequence
  Description of Artificial Sequence: Synthetic oligonucleotide
agtgaatccctactaaaatgg

SEQ ID NO: 4333 - DNA, 21 bp, Artificial Sequence
  Description of Artificial Sequence: Synthetic oligonucleotide
ttttagtagggattcactgac

SEQ ID NO: 4334 - DNA, 21 bp, Artificial Sequence
  Description of Artificial Sequence: Synthetic oligonucleotide
cagtgaatccctactaaaatg

SEQ ID NO: 4335 - DNA, 21 bp, Artificial Sequence
  Description of Artificial Sequence: Synthetic oligonucleotide
tttagtagggattcactgact

SEQ ID NO: 4336 - DNA, 21 bp, Artificial Sequence
  Description of Artificial Sequence: Synthetic oligonucleotide
tcagtgaatccctactaaaat

SEQ ID NO: 4337 - DNA, 21 bp, Artificial Sequence
  Description of Artificial Sequence: Synthetic oligonucleotide
ttagtagggattcactgacta

SEQ ID NO: 4338 - DNA, 21 bp, Artificial Sequence
  Description of Artificial Sequence: Synthetic oligonucleotide
gtcagtgaatccctactaaaa

SEQ ID NO: 4339 - DNA, 21 bp, Artificial Sequence
  Description of Artificial Sequence: Synthetic oligonucleotide
tagtagggattcactgactag

SEQ ID NO: 4340 - DNA, 21 bp, Artificial Sequence
  Description of Artificial Sequence: Synthetic oligonucleotide
agtcagtgaatccctactaaa

SEQ ID NO: 4341 - DNA, 21 bp, Artificial Sequence
  Description of Artificial Sequence: Synthetic oligonucleotide
agtagggattcactgactaga

SEQ ID NO: 4342 - DNA, 21 bp, Artificial Sequence
  Description of Artificial Sequence: Synthetic oligonucleotide
tagtcagtgaatccctactaa

SEQ ID NO: 4343 - DNA, 21 bp, Artificial Sequence
  Description of Artificial Sequence: Synthetic oligonucleotide
gtagggattcactgactagat

SEQ ID NO: 4344 - DNA, 21 bp, Artificial Sequence
  Description of Artificial Sequence: Synthetic oligonucleotide
ctagtcagtgaatccctacta

SEQ ID NO: 4345 - DNA, 21 bp, Artificial Sequence
  Description of Artificial Sequence: Synthetic oligonucleotide
tagggattcactgactagatt

SEQ ID NO: 4346 - DNA, 21 bp, Artificial Sequence
  Description of Artificial Sequence: Synthetic oligonucleotide
tctagtcagtgaatccctact

SEQ ID NO: 4347 - DNA, 21 bp, Artificial Sequence
  Description of Artificial Sequence: Synthetic oligonucleotide
agggattcactgactagattt

SEQ ID NO: 4348 - DNA, 21 bp, Artificial Sequence
  Description of Artificial Sequence: Synthetic oligonucleotide
atctagtcagtgaatccctac

SEQ ID NO: 4349 - DNA, 21 bp, Artificial Sequence
  Description of Artificial Sequence: Synthetic oligonucleotide
gggattcactgactagatttt

SEQ ID NO: 4350 - DNA, 21 bp, Artificial Sequence
  Description of Artificial Sequence: Synthetic oligonucleotide
aatctagtcagtgaatcccta

SEQ ID NO: 4351 - DNA, 21 bp, Artificial Sequence
  Description of Artificial Sequence: Synthetic oligonucleotide
ggattcactgactagatttta

SEQ ID NO: 4352 - DNA, 21 bp, Artificial Sequence
  Description of Artificial Sequence: Synthetic oligonucleotide
aaatctagtcagtgaatccct

SEQ ID NO: 4353 - DNA, 21 bp, Artificial Sequence
  Description of Artificial Sequence: Synthetic oligonucleotide
gattcactgactagattttac

SEQ ID NO: 4354 - DNA, 21 bp, Artificial Sequence
  Description of Artificial Sequence: Synthetic oligonucleotide
aaaatctagtcagtgaatccc

SEQ ID NO: 4355 - DNA, 21 bp, Artificial Sequence
  Description of Artificial Sequence: Synthetic oligonucleotide
attcactgactagattttact

SEQ ID NO: 4356 - DNA, 21 bp, Artificial Sequence
  Description of Artificial Sequence: Synthetic oligonucleotide
taaaatctagtcagtgaatcc

SEQ ID NO: 4357 - DNA, 21 bp, Artificial Sequence
  Description of Artificial Sequence: Synthetic oligonucleotide
ttcactgactagattttactg

SEQ ID NO: 4358 - DNA, 21 bp, Artificial Sequence
  Description of Artificial Sequence: Synthetic oligonucleotide
gtaaaatctagtcagtgaatc

SEQ ID NO: 4359 - DNA, 21 bp, Artificial Sequence
  Description of Artificial Sequence: Synthetic oligonucleotide
tcactgactagattttactga

SEQ ID NO: 4360 - DNA, 21 bp, Artificial Sequence
  Description of Artificial Sequence: Synthetic oligonucleotide
agtaaaatctagtcagtgaat

SEQ ID NO: 4361 - DNA, 21 bp, Artificial Sequence
  Description of Artificial Sequence: Synthetic oligonucleotide
cactgactagattttactgaa

SEQ ID NO: 4362 - DNA, 21 bp, Artificial Sequence
  Description of Artificial Sequence: Synthetic oligonucleotide
cagtaaaatctagtcagtgaa

SEQ ID NO: 4363 - DNA, 21 bp, Artificial Sequence
  Description of Artificial Sequence: Synthetic oligonucleotide
actgactagattttactgaac

SEQ ID NO: 4364 - DNA, 21 bp, Artificial Sequence
  Description of Artificial Sequence: Synthetic oligonucleotide
tcagtaaaatctagtcagtga

SEQ ID NO: 4365 - DNA, 21 bp, Artificial Sequence
  Description of Artificial Sequence: Synthetic oligonucleotide
ctgactagattttactgaact

SEQ ID NO: 4366 - DNA, 21 bp, Artificial Sequence
  Description of Artificial Sequence: Synthetic oligonucleotide
ttcagtaaaatctagtcagtg

SEQ ID NO: 4367 - DNA, 21 bp, Artificial Sequence
  Description of Artificial Sequence: Synthetic oligonucleotide
tgactagattttactgaacta

SEQ ID NO: 4368 - DNA, 21 bp, Artificial Sequence
  Description of Artificial Sequence: Synthetic oligonucleotide
gttcagtaaaatctagtcagt

SEQ ID NO: 4369 - DNA, 21 bp, Artificial Sequence
  Description of Artificial Sequence: Synthetic oligonucleotide
gactagattttactgaactat

SEQ ID NO: 4370 - DNA, 21 bp, Artificial Sequence
  Description of Artificial Sequence: Synthetic oligonucleotide
agttcagtaaaatctagtcag

SEQ ID NO: 4371 - DNA, 21 bp, Artificial Sequence
  Description of Artificial Sequence: Synthetic oligonucleotide
actagattttactgaactatg

SEQ ID NO: 4372 - DNA, 21 bp, Artificial Sequence
  Description of Artificial Sequence: Synthetic oligonucleotide
tagttcagtaaaatctagtca

SEQ ID NO: 4373 - DNA, 21 bp, Artificial Sequence
  Description of Artificial Sequence: Synthetic oligonucleotide
ctagattttactgaactatga

SEQ ID NO: 4374 - DNA, 21 bp, Artificial Sequence
  Description of Artificial Sequence: Synthetic oligonucleotide
atagttcagtaaaatctagtc

SEQ ID NO: 4375 - DNA, 21 bp, Artificial Sequence
  Description of Artificial Sequence: Synthetic oligonucleotide
tagattttactgaactatgaa

SEQ ID NO: 4376 - DNA, 21 bp, Artificial Sequence
  Description of Artificial Sequence: Synthetic oligonucleotide
catagttcagtaaaatctagt

SEQ ID NO: 4377 - DNA, 21 bp, Artificial Sequence
  Description of Artificial Sequence: Synthetic oligonucleotide
agattttactgaactatgaaa

SEQ ID NO: 4378 - DNA, 21 bp, Artificial Sequence
  Description of Artificial Sequence: Synthetic oligonucleotide
tcatagttcagtaaaatctag

SEQ ID NO: 4379 - DNA, 21 bp, Artificial Sequence
  Description of Artificial Sequence: Synthetic oligonucleotide
gattttactgaactatgaaaa

SEQ ID NO: 4380 - DNA, 21 bp, Artificial Sequence
  Description of Artificial Sequence: Synthetic oligonucleotide
ttcatagttcagtaaaatcta

SEQ ID NO: 4381 - DNA, 21 bp, Artificial Sequence
  Description of Artificial Sequence: Synthetic oligonucleotide
attttactgaactatgaaaat

SEQ ID NO: 4382 - DNA, 21 bp, Artificial Sequence
  Description of Artificial Sequence: Synthetic oligonucleotide
tttcatagttcagtaaaatct

SEQ ID NO: 4383 - DNA, 21 bp, Artificial Sequence
  Description of Artificial Sequence: Synthetic oligonucleotide
ttttactgaactatgaaaata

SEQ ID NO: 4384 - DNA, 21 bp, Artificial Sequence
  Description of Artificial Sequence: Synthetic oligonucleotide
ttttcatagttcagtaaaatc

SEQ ID NO: 4385 - DNA, 21 bp, Artificial Sequence
  Description of Artificial Sequence: Synthetic oligonucleotide
tttactgaactatgaaaataa

SEQ ID NO: 4386 - DNA, 21 bp, Artificial Sequence
  Description of Artificial Sequence: Synthetic oligonucleotide
attttcatagttcagtaaaat

SEQ ID NO: 4387 - DNA, 21 bp, Artificial Sequence
  Description of Artificial Sequence: Synthetic oligonucleotide
ttactgaactatgaaaataaa

SEQ ID NO: 4388 - DNA, 21 bp, Artificial Sequence
  Description of Artificial Sequence: Synthetic oligonucleotide
tattttcatagttcagtaaaa

SEQ ID NO: 4389 - DNA, 21 bp, Artificial Sequence
  Description of Artificial Sequence: Synthetic oligonucleotide
tactgaactatgaaaataaat

SEQ ID NO: 4390 - DNA, 21 bp, Artificial Sequence
  Description of Artificial Sequence: Synthetic oligonucleotide
ttattttcatagttcagtaaa

SEQ ID NO: 4391 - DNA, 21 bp, Artificial Sequence
  Description of Artificial Sequence: Synthetic oligonucleotide
actgaactatgaaaataaata

SEQ ID NO: 4392 - DNA, 21 bp, Artificial Sequence
  Description of Artificial Sequence: Synthetic oligonucleotide
tttattttcatagttcagtaa

SEQ ID NO: 4393 - DNA, 21 bp, Artificial Sequence
  Description of Artificial Sequence: Synthetic oligonucleotide
ctgaactatgaaaataaatac

SEQ ID NO: 4394 - DNA, 21 bp, Artificial Sequence
  Description of Artificial Sequence: Synthetic oligonucleotide
atttattttcatagttcagta

SEQ ID NO: 4395 - DNA, 21 bp, Artificial Sequence
  Description of Artificial Sequence: Synthetic oligonucleotide
tgaactatgaaaataaataca

SEQ ID NO: 4396 - DNA, 21 bp, Artificial Sequence
  Description of Artificial Sequence: Synthetic oligonucleotide
tatttattttcatagttcagt

SEQ ID NO: 4397 - DNA, 21 bp, Artificial Sequence
  Description of Artificial Sequence: Synthetic oligonucleotide
gaactatgaaaataaatacac

SEQ ID NO: 4398 - DNA, 21 bp, Artificial Sequence
  Description of Artificial Sequence: Synthetic oligonucleotide
gtatttattttcatagttcag

SEQ ID NO: 4399 - DNA, 21 bp, Artificial Sequence
  Description of Artificial Sequence: Synthetic oligonucleotide
aactatgaaaataaatacaca

SEQ ID NO: 4400 - DNA, 21 bp, Artificial Sequence
  Description of Artificial Sequence: Synthetic oligonucleotide
tgtatttattttcatagttca

SEQ ID NO: 4401 - DNA, 21 bp, Artificial Sequence
  Description of Artificial Sequence: Synthetic oligonucleotide
actatgaaaataaatacacat

SEQ ID NO: 4402 - DNA, 21 bp, Artificial Sequence
  Description of Artificial Sequence: Synthetic oligonucleotide
gtgtatttattttcatagttc

SEQ ID NO: 4403 - DNA, 21 bp, Artificial Sequence
  Description of Artificial Sequence: Synthetic oligonucleotide
ctatgaaaataaatacacata

SEQ ID NO: 4404 - DNA, 21 bp, Artificial Sequence
  Description of Artificial Sequence: Synthetic oligonucleotide
tgtgtatttattttcatagtt

SEQ ID NO: 4405 - DNA, 21 bp, Artificial Sequence
  Description of Artificial Sequence: Synthetic oligonucleotide
tatgaaaataaatacacataa

SEQ ID NO: 4406 - DNA, 21 bp, Artificial Sequence
  Description of Artificial Sequence: Synthetic oligonucleotide
atgtgtatttattttcatagt

SEQ ID NO: 4407 - DNA, 21 bp, Artificial Sequence
  Description of Artificial Sequence: Synthetic oligonucleotide
atgaaaataaatacacataat

SEQ ID NO: 4408 - DNA, 21 bp, Artificial Sequence
  Description of Artificial Sequence: Synthetic oligonucleotide
tatgtgtatttattttcatag

SEQ ID NO: 4409 - DNA, 21 bp, Artificial Sequence
  Description of Artificial Sequence: Synthetic oligonucleotide
tgaaaataaatacacataatt

SEQ ID NO: 4410 - DNA, 21 bp, Artificial Sequence
  Description of Artificial Sequence: Synthetic oligonucleotide
ttatgtgtatttattttcata

SEQ ID NO: 4411 - DNA, 21 bp, Artificial Sequence
  Description of Artificial Sequence: Synthetic oligonucleotide
gaaaataaatacacataattt

SEQ ID NO: 4412 - DNA, 21 bp, Artificial Sequence
  Description of Artificial Sequence: Synthetic oligonucleotide
attatgtgtatttattttcat

SEQ ID NO: 4413 - DNA, 21 bp, Artificial Sequence
  Description of Artificial Sequence: Synthetic oligonucleotide
aaaataaatacacataatttt

SEQ ID NO: 4414 - DNA, 21 bp, Artificial Sequence
  Description of Artificial Sequence: Synthetic oligonucleotide
aattatgtgtatttattttca

SEQ ID NO: 4415 - DNA, 21 bp, Artificial Sequence
  Description of Artificial Sequence: Synthetic oligonucleotide
aaataaatacacataattttt

SEQ ID NO: 4416 - DNA, 21 bp, Artificial Sequence
  Description of Artificial Sequence: Synthetic oligonucleotide
aaattatgtgtatttattttc

SEQ ID NO: 4417 - DNA, 21 bp, Artificial Sequence
  Description of Artificial Sequence: Synthetic oligonucleotide
aataaatacacataatttttc

SEQ ID NO: 4418 - DNA, 21 bp, Artificial Sequence
  Description of Artificial Sequence: Synthetic oligonucleotide
aaaattatgtgtatttatttt

SEQ ID NO: 4419 - DNA, 21 bp, Artificial Sequence
  Description of Artificial Sequence: Synthetic oligonucleotide
ataaatacacataatttttca

SEQ ID NO: 4420 - DNA, 21 bp, Artificial Sequence
  Description of Artificial Sequence: Synthetic oligonucleotide
aaaaattatgtgtatttattt

SEQ ID NO: 4421 - DNA, 21 bp, Artificial Sequence
  Description of Artificial Sequence: Synthetic oligonucleotide
taaatacacataatttttcac

SEQ ID NO: 4422 - DNA, 21 bp, Artificial Sequence
  Description of Artificial Sequence: Synthetic oligonucleotide
gaaaaattatgtgtatttatt

SEQ ID NO: 4423 - DNA, 21 bp, Artificial Sequence
  Description of Artificial Sequence: Synthetic oligonucleotide
aaatacacataatttttcaca

SEQ ID NO: 4424 - DNA, 21 bp, Artificial Sequence
  Description of Artificial Sequence: Synthetic oligonucleotide
tgaaaaattatgtgtatttat

SEQ ID NO: 4425 - DNA, 21 bp, Artificial Sequence
  Description of Artificial Sequence: Synthetic oligonucleotide
aatacacataatttttcacaa

SEQ ID NO: 4426 - DNA, 21 bp, Artificial Sequence
  Description of Artificial Sequence: Synthetic oligonucleotide
gtgaaaaattatgtgtattta

SEQ ID NO: 4427 - DNA, 21 bp, Artificial Sequence
  Description of Artificial Sequence: Synthetic oligonucleotide
atacacataatttttcacaaa

SEQ ID NO: 4428 - DNA, 21 bp, Artificial Sequence
  Description of Artificial Sequence: Synthetic oligonucleotide
tgtgaaaaattatgtgtattt

SEQ ID NO: 4429 - DNA, 21 bp, Artificial Sequence
  Description of Artificial Sequence: Synthetic oligonucleotide
tacacataatttttcacaaaa

SEQ ID NO: 4430 - DNA, 21 bp, Artificial Sequence
  Description of Artificial Sequence: Synthetic oligonucleotide
ttgtgaaaaattatgtgtatt

SEQ ID NO: 4431 - DNA, 21 bp, Artificial Sequence
  Description of Artificial Sequence: Synthetic oligonucleotide
acacataatttttcacaaaat

SEQ ID NO: 4432 - DNA, 21 bp, Artificial Sequence
  Description of Artificial Sequence: Synthetic oligonucleotide
tttgtgaaaaattatgtgtat

SEQ ID NO: 4433 - DNA, 21 bp, Artificial Sequence
  Description of Artificial Sequence: Synthetic oligonucleotide
cacataatttttcacaaaatt

SEQ ID NO: 4434 - DNA, 21 bp, Artificial Sequence
  Description of Artificial Sequence: Synthetic oligonucleotide
ttttgtgaaaaattatgtgta

SEQ ID NO: 4435 - DNA, 21 bp, Artificial Sequence
  Description of Artificial Sequence: Synthetic oligonucleotide
acataatttttcacaaaattt

SEQ ID NO: 4436 - DNA, 21 bp, Artificial Sequence
  Description of Artificial Sequence: Synthetic oligonucleotide
attttgtgaaaaattatgtgt

SEQ ID NO: 4437 - DNA, 21 bp, Artificial Sequence
  Description of Artificial Sequence: Synthetic oligonucleotide
cataatttttcacaaaatttt

SEQ ID NO: 4438 - DNA, 21 bp, Artificial Sequence
  Description of Artificial Sequence: Synthetic oligonucleotide
aattttgtgaaaaattatgtg

SEQ ID NO: 4439 - DNA, 21 bp, Artificial Sequence
  Description of Artificial Sequence: Synthetic oligonucleotide
ataatttttcacaaaattttg

SEQ ID NO: 4440 - DNA, 21 bp, Artificial Sequence
  Description of Artificial Sequence: Synthetic oligonucleotide
aaattttgtgaaaaattatgt

SEQ ID NO: 4441 - DNA, 21 bp, Artificial Sequence
  Description of Artificial Sequence: Synthetic oligonucleotide
taatttttcacaaaattttgg

SEQ ID NO: 4442 - DNA, 21 bp, Artificial Sequence
  Description of Artificial Sequence: Synthetic oligonucleotide
aaaattttgtgaaaaattatg

SEQ ID NO: 4443 - DNA, 21 bp, Artificial Sequence
  Description of Artificial Sequence: Synthetic oligonucleotide
aatttttcacaaaattttggg

SEQ ID NO: 4444 - DNA, 21 bp, Artificial Sequence
  Description of Artificial Sequence: Synthetic oligonucleotide
caaaattttgtgaaaaattat

SEQ ID NO: 4445 - DNA, 21 bp, Artificial Sequence
  Description of Artificial Sequence: Synthetic oligonucleotide
atttttcacaaaattttgggc

SEQ ID NO: 4446 - DNA, 21 bp, Artificial Sequence
  Description of Artificial Sequence: Synthetic oligonucleotide
ccaaaattttgtgaaaaatta

SEQ ID NO: 4447 - DNA, 21 bp, Artificial Sequence
  Description of Artificial Sequence: Synthetic oligonucleotide
tttttcacaaaattttgggcc

SEQ ID NO: 4448 - DNA, 21 bp, Artificial Sequence
  Description of Artificial Sequence: Synthetic oligonucleotide
cccaaaattttgtgaaaaatt

SEQ ID NO: 4449 - DNA, 21 bp, Artificial Sequence
  Description of Artificial Sequence: Synthetic oligonucleotide
ttttcacaaaattttgggccc

SEQ ID NO: 4450 - DNA, 21 bp, Artificial Sequence
  Description of Artificial Sequence: Synthetic oligonucleotide
gcccaaaattttgtgaaaaat

SEQ ID NO: 4451 - DNA, 21 bp, Artificial Sequence
  Description of Artificial Sequence: Synthetic oligonucleotide
tttcacaaaattttgggccca

SEQ ID NO: 4452 - DNA, 21 bp, Artificial Sequence
  Description of Artificial Sequence: Synthetic oligonucleotide
ggcccaaaattttgtgaaaaa

SEQ ID NO: 4453 - DNA, 21 bp, Artificial Sequence
  Description of Artificial Sequence: Synthetic oligonucleotide
ttcacaaaattttgggcccaa

SEQ ID NO: 4454 - DNA, 21 bp, Artificial Sequence
  Description of Artificial Sequence: Synthetic oligonucleotide
gggcccaaaattttgtgaaaa

SEQ ID NO: 4455 - DNA, 21 bp, Artificial Sequence
  Description of Artificial Sequence: Synthetic oligonucleotide
tcacaaaattttgggcccaat

SEQ ID NO: 4456 - DNA, 21 bp, Artificial Sequence
  Description of Artificial Sequence: Synthetic oligonucleotide
tgggcccaaaattttgtgaaa

SEQ ID NO: 4457 - DNA, 21 bp, Artificial Sequence
  Description of Artificial Sequence: Synthetic oligonucleotide
cacaaaattttgggcccaatt

SEQ ID NO: 4458 - DNA, 21 bp, Artificial Sequence
  Description of Artificial Sequence: Synthetic oligonucleotide
ttgggcccaaaattttgtgaa

SEQ ID NO: 4459 - DNA, 21 bp, Artificial Sequence
  Description of Artificial Sequence: Synthetic oligonucleotide
acaaaattttgggcccaattc

SEQ ID NO: 4460 - DNA, 21 bp, Artificial Sequence
  Description of Artificial Sequence: Synthetic oligonucleotide
attgggcccaaaattttgtga

SEQ ID NO: 4461 - DNA, 21 bp, Artificial Sequence
  Description of Artificial Sequence: Synthetic oligonucleotide
caaaattttgggcccaattcc

SEQ ID NO: 4462 - DNA, 21 bp, Artificial Sequence
  Description of Artificial Sequence: Synthetic oligonucleotide
aattgggcccaaaattttgtg

SEQ ID NO: 4463 - DNA, 21 bp, Artificial Sequence
  Description of Artificial Sequence: Synthetic oligonucleotide
aaaattttgggcccaattccc

SEQ ID NO: 4464 - DNA, 21 bp, Artificial Sequence
  Description of Artificial Sequence: Synthetic oligonucleotide
gaattgggcccaaaattttgt

SEQ ID NO: 4465 - DNA, 21 bp, Artificial Sequence
  Description of Artificial Sequence: Synthetic oligonucleotide
aaattttgggcccaattcccc

SEQ ID NO: 4466 - DNA, 21 bp, Artificial Sequence
  Description of Artificial Sequence: Synthetic oligonucleotide
ggaattgggcccaaaattttg

SEQ ID NO: 4467 - DNA, 21 bp, Artificial Sequence
  Description of Artificial Sequence: Synthetic oligonucleotide
aattttgggcccaattcccct

SEQ ID NO: 4468 - DNA, 21 bp, Artificial Sequence
  Description of Artificial Sequence: Synthetic oligonucleotide
gggaattgggcccaaaatttt

SEQ ID NO: 4469 - DNA, 21 bp, Artificial Sequence
  Description of Artificial Sequence: Synthetic oligonucleotide
attttgggcccaattccccta

SEQ ID NO: 4470 - DNA, 21 bp, Artificial Sequence
  Description of Artificial Sequence: Synthetic oligonucleotide
ggggaattgggcccaaaattt

SEQ ID NO: 4471 - DNA, 21 bp, Artificial Sequence
  Description of Artificial Sequence: Synthetic oligonucleotide
ttttgggcccaattcccctaa

SEQ ID NO: 4472 - DNA, 21 bp, Artificial Sequence
  Description of Artificial Sequence: Synthetic oligonucleotide
aggggaattgggcccaaaatt

SEQ ID NO: 4473 - DNA, 21 bp, Artificial Sequence
  Description of Artificial Sequence: Synthetic oligonucleotide
tttgggcccaattcccctaaa

SEQ ID NO: 4474 - DNA, 21 bp, Artificial Sequence
  Description of Artificial Sequence: Synthetic oligonucleotide
taggggaattgggcccaaaat

SEQ ID NO: 4475 - DNA, 21 bp, Artificial Sequence
  Description of Artificial Sequence: Synthetic oligonucleotide
ttgggcccaattcccctaaaa

SEQ ID NO: 4476 - DNA, 21 bp, Artificial Sequence
  Description of Artificial Sequence: Synthetic oligonucleotide
ttaggggaattgggcccaaaa

SEQ ID NO: 4477 - DNA, 21 bp, Artificial Sequence
  Description of Artificial Sequence: Synthetic oligonucleotide
tgggcccaattcccctaaaag

SEQ ID NO: 4478 - DNA, 21 bp, Artificial Sequence
  Description of Artificial Sequence: Synthetic oligonucleotide
tttaggggaattgggcccaaa

SEQ ID NO: 4479 - DNA, 21 bp, Artificial Sequence
  Description of Artificial Sequence: Synthetic oligonucleotide
gggcccaattcccctaaaaga

SEQ ID NO: 4480 - DNA, 21 bp, Artificial Sequence
  Description of Artificial Sequence: Synthetic oligonucleotide
ttttaggggaattgggcccaa

SEQ ID NO: 4481 - DNA, 21 bp, Artificial Sequence
  Description of Artificial Sequence: Synthetic oligonucleotide
ggcccaattcccctaaaagaa

SEQ ID NO: 4482 - DNA, 21 bp, Artificial Sequence
  Description of Artificial Sequence: Synthetic oligonucleotide
cttttaggggaattgggccca

SEQ ID NO: 4483 - DNA, 21 bp, Artificial Sequence
  Description of Artificial Sequence: Synthetic oligonucleotide
gcccaattcccctaaaagaat

SEQ ID NO: 4484 - DNA, 21 bp, Artificial Sequence
  Description of Artificial Sequence: Synthetic oligonucleotide
tcttttaggggaattgggccc

SEQ ID NO: 4485 - DNA, 21 bp, Artificial Sequence
  Description of Artificial Sequence: Synthetic oligonucleotide
cccaattcccctaaaagaatt

SEQ ID NO: 4486 - DNA, 21 bp, Artificial Sequence
  Description of Artificial Sequence: Synthetic oligonucleotide
ttcttttaggggaattgggcc

SEQ ID NO: 4487 - DNA, 21 bp, Artificial Sequence
  Description of Artificial Sequence: Synthetic oligonucleotide
ccaattcccctaaaagaattg

SEQ ID NO: 4488 - DNA, 21 bp, Artificial Sequence
  Description of Artificial Sequence: Synthetic oligonucleotide
attcttttaggggaattgggc

SEQ ID NO: 4489 - DNA, 21 bp, Artificial Sequence
  Description of Artificial Sequence: Synthetic oligonucleotide
caattcccctaaaagaattga

SEQ ID NO: 4490 - DNA, 21 bp, Artificial Sequence
  Description of Artificial Sequence: Synthetic oligonucleotide
aattcttttaggggaattggg

SEQ ID NO: 4491 - DNA, 21 bp, Artificial Sequence
  Description of Artificial Sequence: Synthetic oligonucleotide
aattcccctaaaagaattgag

SEQ ID NO: 4492 - DNA, 21 bp, Artificial Sequence
  Description of Artificial Sequence: Synthetic oligonucleotide
caattcttttaggggaattgg

SEQ ID NO: 4493 - DNA, 21 bp, Artificial Sequence
  Description of Artificial Sequence: Synthetic oligonucleotide
attcccctaaaagaattgagg

SEQ ID NO: 4494 - DNA, 21 bp, Artificial Sequence
  Description of Artificial Sequence: Synthetic oligonucleotide
tcaattcttttaggggaattg

SEQ ID NO: 4495 - DNA, 21 bp, Artificial Sequence
  Description of Artificial Sequence: Synthetic oligonucleotide
ttcccctaaaagaattgagga

SEQ ID NO: 4496 - DNA, 21 bp, Artificial Sequence
  Description of Artificial Sequence: Synthetic oligonucleotide
ctcaattcttttaggggaatt

SEQ ID NO: 4497 - DNA, 21 bp, Artificial Sequence
  Description of Artificial Sequence: Synthetic oligonucleotide
tcccctaaaagaattgaggat

SEQ ID NO: 4498 - DNA, 21 bp, Artificial Sequence
  Description of Artificial Sequence: Synthetic oligonucleotide
cctcaattcttttaggggaat

SEQ ID NO: 4499 - DNA, 21 bp, Artificial Sequence
  Description of Artificial Sequence: Synthetic oligonucleotide
cccctaaaagaattgaggatt

SEQ ID NO: 4500 - DNA, 21 bp, Artificial Sequence
  Description of Artificial Sequence: Synthetic oligonucleotide
tcctcaattcttttaggggaa

SEQ ID NO: 4501 - DNA, 21 bp, Artificial Sequence
  Description of Artificial Sequence: Synthetic oligonucleotide
ccctaaaagaattgaggatta

SEQ ID NO: 4502 - DNA, 21 bp, Artificial Sequence
  Description of Artificial Sequence: Synthetic oligonucleotide
atcctcaattcttttagggga

SEQ ID NO: 4503 - DNA, 21 bp, Artificial Sequence
  Description of Artificial Sequence: Synthetic oligonucleotide
cctaaaagaattgaggattag

SEQ ID NO: 4504 - DNA, 21 bp, Artificial Sequence
  Description of Artificial Sequence: Synthetic oligonucleotide
aatcctcaattcttttagggg

SEQ ID NO: 4505 - DNA, 21 bp, Artificial Sequence
  Description of Artificial Sequence: Synthetic oligonucleotide
ctaaaagaattgaggattagg

SEQ ID NO: 4506 - DNA, 21 bp, Artificial Sequence
  Description of Artificial Sequence: Synthetic oligonucleotide
taatcctcaattcttttaggg

SEQ ID NO: 4507 - DNA, 21 bp, Artificial Sequence
  Description of Artificial Sequence: Synthetic oligonucleotide
taaaagaattgaggattaggg

SEQ ID NO: 4508 - DNA, 21 bp, Artificial Sequence
  Description of Artificial Sequence: Synthetic oligonucleotide
ctaatcctcaattcttttagg

SEQ ID NO: 4509 - DNA, 21 bp, Artificial Sequence
  Description of Artificial Sequence: Synthetic oligonucleotide
aaaagaattgaggattaggga

SEQ ID NO: 4510 - DNA, 21 bp, Artificial Sequence
  Description of Artificial Sequence: Synthetic oligonucleotide
cctaatcctcaattcttttag

SEQ ID NO: 4511 - DNA, 21 bp, Artificial Sequence
  Description of Artificial Sequence: Synthetic oligonucleotide
aaagaattgaggattagggag

SEQ ID NO: 4512 - DNA, 21 bp, Artificial Sequence
  Description of Artificial Sequence: Synthetic oligonucleotide
ccctaatcctcaattctttta

SEQ ID NO: 4513 - DNA, 21 bp, Artificial Sequence
  Description of Artificial Sequence: Synthetic oligonucleotide
aagaattgaggattagggaga

SEQ ID NO: 4514 - DNA, 21 bp, Artificial Sequence
  Description of Artificial Sequence: Synthetic oligonucleotide
tccctaatcctcaattctttt

SEQ ID NO: 4515 - DNA, 21 bp, Artificial Sequence
  Description of Artificial Sequence: Synthetic oligonucleotide
agaattgaggattagggagaa

SEQ ID NO: 4516 - DNA, 21 bp, Artificial Sequence
  Description of Artificial Sequence: Synthetic oligonucleotide
ctccctaatcctcaattcttt

SEQ ID NO: 4517 - DNA, 21 bp, Artificial Sequence
  Description of Artificial Sequence: Synthetic oligonucleotide
gaattgaggattagggagaaa

SEQ ID NO: 4518 - DNA, 21 bp, Artificial Sequence
  Description of Artificial Sequence: Synthetic oligonucleotide
tctccctaatcctcaattctt

SEQ ID NO: 4519 - DNA, 21 bp, Artificial Sequence
  Description of Artificial Sequence: Synthetic oligonucleotide
aattgaggattagggagaaag

SEQ ID NO: 4520 - DNA, 21 bp, Artificial Sequence
  Description of Artificial Sequence: Synthetic oligonucleotide
ttctccctaatcctcaattct

SEQ ID NO: 4521 - DNA, 21 bp, Artificial Sequence
  Description of Artificial Sequence: Synthetic oligonucleotide
attgaggattagggagaaagg

SEQ ID NO: 4522 - DNA, 21 bp, Artificial Sequence
  Description of Artificial Sequence: Synthetic oligonucleotide
tttctccctaatcctcaattc

SEQ ID NO: 4523 - DNA, 21 bp, Artificial Sequence
  Description of Artificial Sequence: Synthetic oligonucleotide
ttgaggattagggagaaagga

SEQ ID NO: 4524 - DNA, 21 bp, Artificial Sequence
  Description of Artificial Sequence: Synthetic oligonucleotide
ctttctccctaatcctcaatt

SEQ ID NO: 4525 - DNA, 21 bp, Artificial Sequence
  Description of Artificial Sequence: Synthetic oligonucleotide
tgaggattagggagaaaggag

SEQ ID NO: 4526 - DNA, 21 bp, Artificial Sequence
  Description of Artificial Sequence: Synthetic oligonucleotide
cctttctccctaatcctcaat

SEQ ID NO: 4527 - DNA, 21 bp, Artificial Sequence
  Description of Artificial Sequence: Synthetic oligonucleotide
gaggattagggagaaaggaga

SEQ ID NO: 4528 - DNA, 21 bp, Artificial Sequence
  Description of Artificial Sequence: Synthetic oligonucleotide
tcctttctccctaatcctcaa

SEQ ID NO: 4529 - DNA, 21 bp, Artificial Sequence
  Description of Artificial Sequence: Synthetic oligonucleotide
aggattagggagaaaggagac

SEQ ID NO: 4530 - DNA, 21 bp, Artificial Sequence
  Description of Artificial Sequence: Synthetic oligonucleotide
ctcctttctccctaatcctca

SEQ ID NO: 4531 - DNA, 21 bp, Artificial Sequence
  Description of Artificial Sequence: Synthetic oligonucleotide
ggattagggagaaaggagaca

SEQ ID NO: 4532 - DNA, 21 bp, Artificial Sequence
  Description of Artificial Sequence: Synthetic oligonucleotide
tctcctttctccctaatcctc

SEQ ID NO: 4533 - DNA, 21 bp, Artificial Sequence
  Description of Artificial Sequence: Synthetic oligonucleotide
gattagggagaaaggagacaa

SEQ ID NO: 4534 - DNA, 21 bp, Artificial Sequence
  Description of Artificial Sequence: Synthetic oligonucleotide
gtctcctttctccctaatcct

SEQ ID NO: 4535 - DNA, 21 bp, Artificial Sequence
  Description of Artificial Sequence: Synthetic oligonucleotide
attagggagaaaggagacaac

SEQ ID NO: 4536 - DNA, 21 bp, Artificial Sequence
  Description of Artificial Sequence: Synthetic oligonucleotide
tgtctcctttctccctaatcc

SEQ ID NO: 4537 - DNA, 21 bp, Artificial Sequence
  Description of Artificial Sequence: Synthetic oligonucleotide
ttagggagaaaggagacaact

SEQ ID NO: 4538 - DNA, 21 bp, Artificial Sequence
  Description of Artificial Sequence: Synthetic oligonucleotide
ttgtctcctttctccctaatc

SEQ ID NO: 4539 - DNA, 21 bp, Artificial Sequence
  Description of Artificial Sequence: Synthetic oligonucleotide
tagggagaaaggagacaactc

SEQ ID NO: 4540 - DNA, 21 bp, Artificial Sequence
  Description of Artificial Sequence: Synthetic oligonucleotide
gttgtctcctttctccctaat

SEQ ID NO: 4541 - DNA, 21 bp, Artificial Sequence
  Description of Artificial Sequence: Synthetic oligonucleotide
agggagaaaggagacaactca

SEQ ID NO: 4542 - DNA, 21 bp, Artificial Sequence
  Description of Artificial Sequence: Synthetic oligonucleotide
agttgtctcctttctccctaa

SEQ ID NO: 4543 - DNA, 21 bp, Artificial Sequence
  Description of Artificial Sequence: Synthetic oligonucleotide
gggagaaaggagacaactcaa

SEQ ID NO: 4544 - DNA, 21 bp, Artificial Sequence
  Description of Artificial Sequence: Synthetic oligonucleotide
gagttgtctcctttctcccta

SEQ ID NO: 4545 - DNA, 21 bp, Artificial Sequence
  Description of Artificial Sequence: Synthetic oligonucleotide
ggagaaaggagacaactcaaa

SEQ ID NO: 4546 - DNA, 21 bp, Artificial Sequence
  Description of Artificial Sequence: Synthetic oligonucleotide
tgagttgtctcctttctccct

SEQ ID NO: 4547 - DNA, 21 bp, Artificial Sequence
  Description of Artificial Sequence: Synthetic oligonucleotide
gagaaaggagacaactcaaag

SEQ ID NO: 4548 - DNA, 21 bp, Artificial Sequence
  Description of Artificial Sequence: Synthetic oligonucleotide
ttgagttgtctcctttctccc

SEQ ID NO: 4549 - DNA, 21 bp, Artificial Sequence
  Description of Artificial Sequence: Synthetic oligonucleotide
agaaaggagacaactcaaagt

SEQ ID NO: 4550 - DNA, 21 bp, Artificial Sequence
  Description of Artificial Sequence: Synthetic oligonucleotide
tttgagttgtctcctttctcc

SEQ ID NO: 4551 - DNA, 21 bp, Artificial Sequence
  Description of Artificial Sequence: Synthetic oligonucleotide
gaaaggagacaactcaaagtc

SEQ ID NO: 4552 - DNA, 21 bp, Artificial Sequence
  Description of Artificial Sequence: Synthetic oligonucleotide
ctttgagttgtctcctttctc

SEQ ID NO: 4553 - DNA, 21 bp, Artificial Sequence
  Description of Artificial Sequence: Synthetic oligonucleotide
aaaggagacaactcaaagtca

SEQ ID NO: 4554 - DNA, 21 bp, Artificial Sequence
  Description of Artificial Sequence: Synthetic oligonucleotide
actttgagttgtctcctttct

SEQ ID NO: 4555 - DNA, 21 bp, Artificial Sequence
  Description of Artificial Sequence: Synthetic oligonucleotide
aaggagacaactcaaagtcat

SEQ ID NO: 4556 - DNA, 21 bp, Artificial Sequence
  Description of Artificial Sequence: Synthetic oligonucleotide
gactttgagttgtctcctttc

SEQ ID NO: 4557 - DNA, 21 bp, Artificial Sequence
  Description of Artificial Sequence: Synthetic oligonucleotide
aggagacaactcaaagtcatc

SEQ ID NO: 4558 - DNA, 21 bp, Artificial Sequence
  Description of Artificial Sequence: Synthetic oligonucleotide
tgactttgagttgtctccttt

SEQ ID NO: 4559 - DNA, 21 bp, Artificial Sequence
  Description of Artificial Sequence: Synthetic oligonucleotide
ggagacaactcaaagtcatcc

SEQ ID NO: 4560 - DNA, 21 bp, Artificial Sequence
  Description of Artificial Sequence: Synthetic oligonucleotide
atgactttgagttgtctcctt

SEQ ID NO: 4561 - DNA, 21 bp, Artificial Sequence
  Description of Artificial Sequence: Synthetic oligonucleotide
gagacaactcaaagtcatccc

SEQ ID NO: 4562 - DNA, 21 bp, Artificial Sequence
  Description of Artificial Sequence: Synthetic oligonucleotide
gatgactttgagttgtctcct

SEQ ID NO: 4563 - DNA, 21 bp, Artificial Sequence
  Description of Artificial Sequence: Synthetic oligonucleotide
agacaactcaaagtcatccca

SEQ ID NO: 4564 - DNA, 21 bp, Artificial Sequence
  Description of Artificial Sequence: Synthetic oligonucleotide
ggatgactttgagttgtctcc

SEQ ID NO: 4565 - DNA, 21 bp, Artificial Sequence
  Description of Artificial Sequence: Synthetic oligonucleotide
gacaactcaaagtcatcccat

SEQ ID NO: 4566 - DNA, 21 bp, Artificial Sequence
  Description of Artificial Sequence: Synthetic oligonucleotide
gggatgactttgagttgtctc

SEQ ID NO: 4567 - DNA, 21 bp, Artificial Sequence
  Description of Artificial Sequence: Synthetic oligonucleotide
acaactcaaagtcatcccatt

SEQ ID NO: 4568 - DNA, 21 bp, Artificial Sequence
  Description of Artificial Sequence: Synthetic oligonucleotide
tgggatgactttgagttgtct

SEQ ID NO: 4569 - DNA, 21 bp, Artificial Sequence
  Description of Artificial Sequence: Synthetic oligonucleotide
caactcaaagtcatcccatta

SEQ ID NO: 4570 - DNA, 21 bp, Artificial Sequence
  Description of Artificial Sequence: Synthetic oligonucleotide
atgggatgactttgagttgtc

SEQ ID NO: 4571 - DNA, 21 bp, Artificial Sequence
  Description of Artificial Sequence: Synthetic oligonucleotide
aactcaaagtcatcccattaa

SEQ ID NO: 4572 - DNA, 21 bp, Artificial Sequence
  Description of Artificial Sequence: Synthetic oligonucleotide
aatgggatgactttgagttgt

SEQ ID NO: 4573 - DNA, 21 bp, Artificial Sequence
  Description of Artificial Sequence: Synthetic oligonucleotide
actcaaagtcatcccattaag

SEQ ID NO: 4574 - DNA, 21 bp, Artificial Sequence
  Description of Artificial Sequence: Synthetic oligonucleotide
taatgggatgactttgagttg

SEQ ID NO: 4575 - DNA, 21 bp, Artificial Sequence
  Description of Artificial Sequence: Synthetic oligonucleotide
ctcaaagtcatcccattaagt

SEQ ID NO: 4576 - DNA, 21 bp, Artificial Sequence
  Description of Artificial Sequence: Synthetic oligonucleotide
ttaatgggatgactttgagtt

SEQ ID NO: 4577 - DNA, 21 bp, Artificial Sequence
  Description of Artificial Sequence: Synthetic oligonucleotide
tcaaagtcatcccattaagtg

SEQ ID NO: 4578 - DNA, 21 bp, Artificial Sequence
  Description of Artificial Sequence: Synthetic oligonucleotide
cttaatgggatgactttgagt

SEQ ID NO: 4579 - DNA, 21 bp, Artificial Sequence
  Description of Artificial Sequence: Synthetic oligonucleotide
caaagtcatcccattaagtgc

SEQ ID NO: 4580 - DNA, 21 bp, Artificial Sequence
  Description of Artificial Sequence: Synthetic oligonucleotide
acttaatgggatgactttgag

SEQ ID NO: 4581 - DNA, 21 bp, Artificial Sequence
  Description of Artificial Sequence: Synthetic oligonucleotide
aaagtcatcccattaagtgca

SEQ ID NO: 4582 - DNA, 21 bp, Artificial Sequence
  Description of Artificial Sequence: Synthetic oligonucleotide
cacttaatgggatgactttga

SEQ ID NO: 4583 - DNA, 21 bp, Artificial Sequence
  Description of Artificial Sequence: Synthetic oligonucleotide
aagtcatcccattaagtgcag

SEQ ID NO: 4584 - DNA, 21 bp, Artificial Sequence
  Description of Artificial Sequence: Synthetic oligonucleotide
gcacttaatgggatgactttg

SEQ ID NO: 4585 - DNA, 21 bp, Artificial Sequence
  Description of Artificial Sequence: Synthetic oligonucleotide
agtcatcccattaagtgcagt

SEQ ID NO: 4586 - DNA, 21 bp, Artificial Sequence
  Description of Artificial Sequence: Synthetic oligonucleotide
tgcacttaatgggatgacttt

SEQ ID NO: 4587 - DNA, 21 bp, Artificial Sequence
  Description of Artificial Sequence: Synthetic oligonucleotide
gtcatcccattaagtgcagtt

SEQ ID NO: 4588 - DNA, 21 bp, Artificial Sequence
  Description of Artificial Sequence: Synthetic oligonucleotide
ctgcacttaatgggatgactt

SEQ ID NO: 4589 - DNA, 21 bp, Artificial Sequence
  Description of Artificial Sequence: Synthetic oligonucleotide
tcatcccattaagtgcagttt

SEQ ID NO: 4590 - DNA, 21 bp, Artificial Sequence
  Description of Artificial Sequence: Synthetic oligonucleotide
actgcacttaatgggatgact

SEQ ID NO: 4591 - DNA, 21 bp, Artificial Sequence
  Description of Artificial Sequence: Synthetic oligonucleotide
catcccattaagtgcagtttc

SEQ ID NO: 4592 - DNA, 21 bp, Artificial Sequence
  Description of Artificial Sequence: Synthetic oligonucleotide
aactgcacttaatgggatgac

SEQ ID NO: 4593 - DNA, 21 bp, Artificial Sequence
  Description of Artificial Sequence: Synthetic oligonucleotide
atcccattaagtgcagtttct

SEQ ID NO: 4594 - DNA, 21 bp, Artificial Sequence
  Description of Artificial Sequence: Synthetic oligonucleotide
aaactgcacttaatgggatga

SEQ ID NO: 4595 - DNA, 21 bp, Artificial Sequence
  Description of Artificial Sequence: Synthetic oligonucleotide
tcccattaagtgcagtttctt

SEQ ID NO: 4596 - DNA, 21 bp, Artificial Sequence
  Description of Artificial Sequence: Synthetic oligonucleotide
gaaactgcacttaatgggatg

SEQ ID NO: 4597 - DNA, 21 bp, Artificial Sequence
  Description of Artificial Sequence: Synthetic oligonucleotide
cccattaagtgcagtttcttt

SEQ ID NO: 4598 - DNA, 21 bp, Artificial Sequence
  Description of Artificial Sequence: Synthetic oligonucleotide
agaaactgcacttaatgggat

SEQ ID NO: 4599 - DNA, 21 bp, Artificial Sequence
  Description of Artificial Sequence: Synthetic oligonucleotide
ccattaagtgcagtttctttg

SEQ ID NO: 4600 - DNA, 21 bp, Artificial Sequence
  Description of Artificial Sequence: Synthetic oligonucleotide
aagaaactgcacttaatggga

SEQ ID NO: 4601 - DNA, 21 bp, Artificial Sequence
  Description of Artificial Sequence: Synthetic oligonucleotide
cattaagtgcagtttctttga

SEQ ID NO: 4602 - DNA, 21 bp, Artificial Sequence
  Description of Artificial Sequence: Synthetic oligonucleotide
aaagaaactgcacttaatggg

SEQ ID NO: 4603 - DNA, 21 bp, Artificial Sequence
  Description of Artificial Sequence: Synthetic oligonucleotide
attaagtgcagtttctttgaa

SEQ ID NO: 4604 - DNA, 21 bp, Artificial Sequence
  Description of Artificial Sequence: Synthetic oligonucleotide
caaagaaactgcacttaatgg

SEQ ID NO: 4605 - DNA, 21 bp, Artificial Sequence
  Description of Artificial Sequence: Synthetic oligonucleotide
ttaagtgcagtttctttgaat

SEQ ID NO: 4606 - DNA, 21 bp, Artificial Sequence
  Description of Artificial Sequence: Synthetic oligonucleotide
tcaaagaaactgcacttaatg

SEQ ID NO: 4607 - DNA, 21 bp, Artificial Sequence
  Description of Artificial Sequence: Synthetic oligonucleotide
taagtgcagtttctttgaatc

SEQ ID NO: 4608 - DNA, 21 bp, Artificial Sequence
  Description of Artificial Sequence: Synthetic oligonucleotide
ttcaaagaaactgcacttaat

SEQ ID NO: 4609 - DNA, 21 bp, Artificial Sequence
  Description of Artificial Sequence: Synthetic oligonucleotide
aagtgcagtttctttgaatct

SEQ ID NO: 4610 - DNA, 21 bp, Artificial Sequence
  Description of Artificial Sequence: Synthetic oligonucleotide
attcaaagaaactgcacttaa

SEQ ID NO: 4611 - DNA, 21 bp, Artificial Sequence
  Description of Artificial Sequence: Synthetic oligonucleotide
agtgcagtttctttgaatctt

SEQ ID NO: 4612 - DNA, 21 bp, Artificial Sequence
  Description of Artificial Sequence: Synthetic oligonucleotide
gattcaaagaaactgcactta

SEQ ID NO: 4613 - DNA, 21 bp, Artificial Sequence
  Description of Artificial Sequence: Synthetic oligonucleotide
gtgcagtttctttgaatcttc

SEQ ID NO: 4614 - DNA, 21 bp, Artificial Sequence
  Description of Artificial Sequence: Synthetic oligonucleotide
agattcaaagaaactgcactt

SEQ ID NO: 4615 - DNA, 21 bp, Artificial Sequence
  Description of Artificial Sequence: Synthetic oligonucleotide
tgcagtttctttgaatcttct

SEQ ID NO: 4616 - DNA, 21 bp, Artificial Sequence
  Description of Artificial Sequence: Synthetic oligonucleotide
aagattcaaagaaactgcact

SEQ ID NO: 4617 - DNA, 21 bp, Artificial Sequence
  Description of Artificial Sequence: Synthetic oligonucleotide
gcagtttctttgaatcttctg

SEQ ID NO: 4618 - DNA, 21 bp, Artificial Sequence
  Description of Artificial Sequence: Synthetic oligonucleotide
gaagattcaaagaaactgcac

SEQ ID NO: 4619 - DNA, 21 bp, Artificial Sequence
  Description of Artificial Sequence: Synthetic oligonucleotide
cagtttctttgaatcttctgc

SEQ ID NO: 4620 - DNA, 21 bp, Artificial Sequence
  Description of Artificial Sequence: Synthetic oligonucleotide
agaagattcaaagaaactgca

SEQ ID NO: 4621 - DNA, 21 bp, Artificial Sequence
  Description of Artificial Sequence: Synthetic oligonucleotide
agtttctttgaatcttctgct

SEQ ID NO: 4622 - DNA, 21 bp, Artificial Sequence
  Description of Artificial Sequence: Synthetic oligonucleotide
cagaagattcaaagaaactgc

SEQ ID NO: 4623 - DNA, 21 bp, Artificial Sequence
  Description of Artificial Sequence: Synthetic oligonucleotide
gtttctttgaatcttctgctt

SEQ ID NO: 4624 - DNA, 21 bp, Artificial Sequence
  Description of Artificial Sequence: Synthetic oligonucleotide
gcagaagattcaaagaaactg

SEQ ID NO: 4625 - DNA, 21 bp, Artificial Sequence
  Description of Artificial Sequence: Synthetic oligonucleotide
tttctttgaatcttctgcttt

SEQ ID NO: 4626 - DNA, 21 bp, Artificial Sequence
  Description of Artificial Sequence: Synthetic oligonucleotide
agcagaagattcaaagaaact

SEQ ID NO: 4627 - DNA, 21 bp, Artificial Sequence
  Description of Artificial Sequence: Synthetic oligonucleotide
ttctttgaatcttctgcttta

SEQ ID NO: 4628 - DNA, 21 bp, Artificial Sequence
  Description of Artificial Sequence: Synthetic oligonucleotide
aagcagaagattcaaagaaac

SEQ ID NO: 4629 - DNA, 21 bp, Artificial Sequence
  Description of Artificial Sequence: Synthetic oligonucleotide
tctttgaatcttctgctttat

SEQ ID NO: 4630 - DNA, 21 bp, Artificial Sequence
  Description of Artificial Sequence: Synthetic oligonucleotide
aaagcagaagattcaaagaaa

SEQ ID NO: 4631 - DNA, 21 bp, Artificial Sequence
  Description of Artificial Sequence: Synthetic oligonucleotide
ctttgaatcttctgctttatc

SEQ ID NO: 4632 - DNA, 21 bp, Artificial Sequence
  Description of Artificial Sequence: Synthetic oligonucleotide
taaagcagaagattcaaagaa

SEQ ID NO: 4633 - DNA, 21 bp, Artificial Sequence
  Description of Artificial Sequence: Synthetic oligonucleotide
tttgaatcttctgctttatct

SEQ ID NO: 4634 - DNA, 21 bp, Artificial Sequence
  Description of Artificial Sequence: Synthetic oligonucleotide
ataaagcagaagattcaaaga

SEQ ID NO: 4635 - DNA, 21 bp, Artificial Sequence
  Description of Artificial Sequence: Synthetic oligonucleotide
ttgaatcttctgctttatctt

SEQ ID NO: 4636 - DNA, 21 bp, Artificial Sequence
  Description of Artificial Sequence: Synthetic oligonucleotide
gataaagcagaagattcaaag

SEQ ID NO: 4637 - DNA, 21 bp, Artificial Sequence
  Description of Artificial Sequence: Synthetic oligonucleotide
tgaatcttctgctttatcttt

SEQ ID NO: 4638 - DNA, 21 bp, Artificial Sequence
  Description of Artificial Sequence: Synthetic oligonucleotide
agataaagcagaagattcaaa

SEQ ID NO: 4639 - DNA, 21 bp, Artificial Sequence
  Description of Artificial Sequence: Synthetic oligonucleotide
gaatcttctgctttatcttta

SEQ ID NO: 4640 - DNA, 21 bp, Artificial Sequence
  Description of Artificial Sequence: Synthetic oligonucleotide
aagataaagcagaagattcaa

SEQ ID NO: 4641 - DNA, 21 bp, Artificial Sequence
  Description of Artificial Sequence: Synthetic oligonucleotide
aatcttctgctttatctttaa

SEQ ID NO: 4642 - DNA, 21 bp, Artificial Sequence
  Description of Artificial Sequence: Synthetic oligonucleotide
aaagataaagcagaagattca

SEQ ID NO: 4643 - DNA, 21 bp, Artificial Sequence
  Description of Artificial Sequence: Synthetic oligonucleotide
atcttctgctttatctttaaa

SEQ ID NO: 4644 - DNA, 21 bp, Artificial Sequence
  Description of Artificial Sequence: Synthetic oligonucleotide
taaagataaagcagaagattc

SEQ ID NO: 4645 - DNA, 21 bp, Artificial Sequence
  Description of Artificial Sequence: Synthetic oligonucleotide
tcttctgctttatctttaaaa

SEQ ID NO: 4646 - DNA, 21 bp, Artificial Sequence
  Description of Artificial Sequence: Synthetic oligonucleotide
ttaaagataaagcagaagatt

SEQ ID NO: 4647 - DNA, 21 bp, Artificial Sequence
  Description of Artificial Sequence: Synthetic oligonucleotide
cttctgctttatctttaaaaa

SEQ ID NO: 4648 - DNA, 21 bp, Artificial Sequence
  Description of Artificial Sequence: Synthetic oligonucleotide
tttaaagataaagcagaagat

SEQ ID NO: 4649 - DNA, 21 bp, Artificial Sequence
  Description of Artificial Sequence: Synthetic oligonucleotide
ttctgctttatctttaaaaat

SEQ ID NO: 4650 - DNA, 21 bp, Artificial Sequence
  Description of Artificial Sequence: Synthetic oligonucleotide
ttttaaagataaagcagaaga

SEQ ID NO: 4651 - DNA, 21 bp, Artificial Sequence
  Description of Artificial Sequence: Synthetic oligonucleotide
tctgctttatctttaaaaatt

SEQ ID NO: 4652 - DNA, 21 bp, Artificial Sequence
  Description of Artificial Sequence: Synthetic oligonucleotide
tttttaaagataaagcagaag

SEQ ID NO: 4653 - DNA, 21 bp, Artificial Sequence
  Description of Artificial Sequence: Synthetic oligonucleotide
ctgctttatctttaaaaattt

SEQ ID NO: 4654 - DNA, 21 bp, Artificial Sequence
  Description of Artificial Sequence: Synthetic oligonucleotide
atttttaaagataaagcagaa

SEQ ID NO: 4655 - DNA, 21 bp, Artificial Sequence
  Description of Artificial Sequence: Synthetic oligonucleotide
tgctttatctttaaaaatttg

SEQ ID NO: 4656 - DNA, 21 bp, Artificial Sequence
  Description of Artificial Sequence: Synthetic oligonucleotide
aatttttaaagataaagcaga

SEQ ID NO: 4657 - DNA, 21 bp, Artificial Sequence
  Description of Artificial Sequence: Synthetic oligonucleotide
gctttatctttaaaaatttgt

SEQ ID NO: 4658 - DNA, 21 bp, Artificial Sequence
  Description of Artificial Sequence: Synthetic oligonucleotide
aaatttttaaagataaagcag

SEQ ID NO: 4659 - DNA, 21 bp, Artificial Sequence
  Description of Artificial Sequence: Synthetic oligonucleotide
ctttatctttaaaaatttgta

SEQ ID NO: 4660 - DNA, 21 bp, Artificial Sequence
  Description of Artificial Sequence: Synthetic oligonucleotide
caaatttttaaagataaagca

SEQ ID NO: 4661 - DNA, 21 bp, Artificial Sequence
  Description of Artificial Sequence: Synthetic oligonucleotide
tttatctttaaaaatttgtat

SEQ ID NO: 4662 - DNA, 21 bp, Artificial Sequence
  Description of Artificial Sequence: Synthetic oligonucleotide
acaaatttttaaagataaagc

SEQ ID NO: 4663 - DNA, 21 bp, Artificial Sequence
  Description of Artificial Sequence: Synthetic oligonucleotide
ttatctttaaaaatttgtata

SEQ ID NO: 4664 - DNA, 21 bp, Artificial Sequence
  Description of Artificial Sequence: Synthetic oligonucleotide
tacaaatttttaaagataaag

SEQ ID NO: 4665 - DNA, 21 bp, Artificial Sequence
  Description of Artificial Sequence: Synthetic oligonucleotide
tatctttaaaaatttgtataa

SEQ ID NO: 4666 - DNA, 21 bp, Artificial Sequence
  Description of Artificial Sequence: Synthetic oligonucleotide
atacaaatttttaaagataaa

SEQ ID NO: 4667 - DNA, 21 bp, Artificial Sequence
  Description of Artificial Sequence: Synthetic oligonucleotide
atctttaaaaatttgtataat

SEQ ID NO: 4668 - DNA, 21 bp, Artificial Sequence
  Description of Artificial Sequence: Synthetic oligonucleotide
tatacaaatttttaaagataa

SEQ ID NO: 4669 - DNA, 21 bp, Artificial Sequence
  Description of Artificial Sequence: Synthetic oligonucleotide
tctttaaaaatttgtataatt

SEQ ID NO: 4670 - DNA, 21 bp, Artificial Sequence
  Description of Artificial Sequence: Synthetic oligonucleotide
ttatacaaatttttaaagata

SEQ ID NO: 4671 - DNA, 21 bp, Artificial Sequence
  Description of Artificial Sequence: Synthetic oligonucleotide
ctttaaaaatttgtataattt

SEQ ID NO: 4672 - DNA, 21 bp, Artificial Sequence
  Description of Artificial Sequence: Synthetic oligonucleotide
attatacaaatttttaaagat

SEQ ID NO: 4673 - DNA, 21 bp, Artificial Sequence
  Description of Artificial Sequence: Synthetic oligonucleotide
tttaaaaatttgtataattta

SEQ ID NO: 4674 - DNA, 21 bp, Artificial Sequence
  Description of Artificial Sequence: Synthetic oligonucleotide
aattatacaaatttttaaaga

SEQ ID NO: 4675 - DNA, 21 bp, Artificial Sequence
  Description of Artificial Sequence: Synthetic oligonucleotide
ttaaaaatttgtataatttat

SEQ ID NO: 4676 - DNA, 21 bp, Artificial Sequence
  Description of Artificial Sequence: Synthetic oligonucleotide
aaattatacaaatttttaaag

SEQ ID NO: 4677 - DNA, 21 bp, Artificial Sequence
  Description of Artificial Sequence: Synthetic oligonucleotide
taaaaatttgtataatttata

SEQ ID NO: 4678 - DNA, 21 bp, Artificial Sequence
  Description of Artificial Sequence: Synthetic oligonucleotide
taaattatacaaatttttaaa

SEQ ID NO: 4679 - DNA, 21 bp, Artificial Sequence
  Description of Artificial Sequence: Synthetic oligonucleotide
aaaaatttgtataatttatat

SEQ ID NO: 4680 - DNA, 21 bp, Artificial Sequence
  Description of Artificial Sequence: Synthetic oligonucleotide
ataaattatacaaatttttaa

SEQ ID NO: 4681 - DNA, 21 bp, Artificial Sequence
  Description of Artificial Sequence: Synthetic oligonucleotide
aaaatttgtataatttatata

SEQ ID NO: 4682 - DNA, 21 bp, Artificial Sequence
  Description of Artificial Sequence: Synthetic oligonucleotide
tataaattatacaaattttta

SEQ ID NO: 4683 - DNA, 21 bp, Artificial Sequence
  Description of Artificial Sequence: Synthetic oligonucleotide
aaatttgtataatttatatat

SEQ ID NO: 4684 - DNA, 21 bp, Artificial Sequence
  Description of Artificial Sequence: Synthetic oligonucleotide
atataaattatacaaattttt

SEQ ID NO: 4685 - DNA, 21 bp, Artificial Sequence
  Description of Artificial Sequence: Synthetic oligonucleotide
aatttgtataatttatatatt

SEQ ID NO: 4686 - DNA, 21 bp, Artificial Sequence
  Description of Artificial Sequence: Synthetic oligonucleotide
tatataaattatacaaatttt

SEQ ID NO: 4687 - DNA, 21 bp, Artificial Sequence
  Description of Artificial Sequence: Synthetic oligonucleotide
atttgtataatttatatattt

SEQ ID NO: 4688 - DNA, 21 bp, Artificial Sequence
  Description of Artificial Sequence: Synthetic oligonucleotide
atatataaattatacaaattt

SEQ ID NO: 4689 - DNA, 21 bp, Artificial Sequence
  Description of Artificial Sequence: Synthetic oligonucleotide
tttgtataatttatatatttt

SEQ ID NO: 4690 - DNA, 21 bp, Artificial Sequence
  Description of Artificial Sequence: Synthetic oligonucleotide
aatatataaattatacaaatt

SEQ ID NO: 4691 - DNA, 21 bp, Artificial Sequence
  Description of Artificial Sequence: Synthetic oligonucleotide
ttgtataatttatatatttta

SEQ ID NO: 4692 - DNA, 21 bp, Artificial Sequence
  Description of Artificial Sequence: Synthetic oligonucleotide
aaatatataaattatacaaat

SEQ ID NO: 4693 - DNA, 21 bp, Artificial Sequence
  Description of Artificial Sequence: Synthetic oligonucleotide
tgtataatttatatattttat

SEQ ID NO: 4694 - DNA, 21 bp, Artificial Sequence
  Description of Artificial Sequence: Synthetic oligonucleotide
aaaatatataaattatacaaa

SEQ ID NO: 4695 - DNA, 21 bp, Artificial Sequence
  Description of Artificial Sequence: Synthetic oligonucleotide
gtataatttatatattttatt

SEQ ID NO: 4696 - DNA, 21 bp, Artificial Sequence
  Description of Artificial Sequence: Synthetic oligonucleotide
taaaatatataaattatacaa

SEQ ID NO: 4697 - DNA, 21 bp, Artificial Sequence
  Description of Artificial Sequence: Synthetic oligonucleotide
tataatttatatattttattc

SEQ ID NO: 4698 - DNA, 21 bp, Artificial Sequence
  Description of Artificial Sequence: Synthetic oligonucleotide
ataaaatatataaattataca

SEQ ID NO: 4699 - DNA, 21 bp, Artificial Sequence
  Description of Artificial Sequence: Synthetic oligonucleotide
ataatttatatattttattct

SEQ ID NO: 4700 - DNA, 21 bp, Artificial Sequence
  Description of Artificial Sequence: Synthetic oligonucleotide
aataaaatatataaattatac

SEQ ID NO: 4701 - DNA, 21 bp, Artificial Sequence
  Description of Artificial Sequence: Synthetic oligonucleotide
taatttatatattttattcta

SEQ ID NO: 4702 - DNA, 21 bp, Artificial Sequence
  Description of Artificial Sequence: Synthetic oligonucleotide
gaataaaatatataaattata

SEQ ID NO: 4703 - DNA, 21 bp, Artificial Sequence
  Description of Artificial Sequence: Synthetic oligonucleotide
aatttatatattttattctat

SEQ ID NO: 4704 - DNA, 21 bp, Artificial Sequence
  Description of Artificial Sequence: Synthetic oligonucleotide
agaataaaatatataaattat

SEQ ID NO: 4705 - DNA, 21 bp, Artificial Sequence
  Description of Artificial Sequence: Synthetic oligonucleotide
atttatatattttattctatg

SEQ ID NO: 4706 - DNA, 21 bp, Artificial Sequence
  Description of Artificial Sequence: Synthetic oligonucleotide
tagaataaaatatataaatta

SEQ ID NO: 4707 - DNA, 21 bp, Artificial Sequence
  Description of Artificial Sequence: Synthetic oligonucleotide
tttatatattttattctatgt

SEQ ID NO: 4708 - DNA, 21 bp, Artificial Sequence
  Description of Artificial Sequence: Synthetic oligonucleotide
atagaataaaatatataaatt

SEQ ID NO: 4709 - DNA, 21 bp, Artificial Sequence
  Description of Artificial Sequence: Synthetic oligonucleotide
ttatatattttattctatgtg

SEQ ID NO: 4710 - DNA, 21 bp, Artificial Sequence
  Description of Artificial Sequence: Synthetic oligonucleotide
catagaataaaatatataaat

SEQ ID NO: 4711 - DNA, 21 bp, Artificial Sequence
  Description of Artificial Sequence: Synthetic oligonucleotide
tatatattttattctatgtgt

SEQ ID NO: 4712 - DNA, 21 bp, Artificial Sequence
  Description of Artificial Sequence: Synthetic oligonucleotide
acatagaataaaatatataaa

SEQ ID NO: 4713 - DNA, 21 bp, Artificial Sequence
  Description of Artificial Sequence: Synthetic oligonucleotide
atatattttattctatgtgtt

SEQ ID NO: 4714 - DNA, 21 bp, Artificial Sequence
  Description of Artificial Sequence: Synthetic oligonucleotide
cacatagaataaaatatataa

SEQ ID NO: 4715 - DNA, 21 bp, Artificial Sequence
  Description of Artificial Sequence: Synthetic oligonucleotide
tatattttattctatgtgttc

SEQ ID NO: 4716 - DNA, 21 bp, Artificial Sequence
  Description of Artificial Sequence: Synthetic oligonucleotide
acacatagaataaaatatata

SEQ ID NO: 4717 - DNA, 21 bp, Artificial Sequence
  Description of Artificial Sequence: Synthetic oligonucleotide
atattttattctatgtgttcc

SEQ ID NO: 4718 - DNA, 21 bp, Artificial Sequence
  Description of Artificial Sequence: Synthetic oligonucleotide
aacacatagaataaaatatat

SEQ ID NO: 4719 - DNA, 21 bp, Artificial Sequence
  Description of Artificial Sequence: Synthetic oligonucleotide
tattttattctatgtgttcca

SEQ ID NO: 4720 - DNA, 21 bp, Artificial Sequence
  Description of Artificial Sequence: Synthetic oligonucleotide
gaacacatagaataaaatata

SEQ ID NO: 4721 - DNA, 21 bp, Artificial Sequence
  Description of Artificial Sequence: Synthetic oligonucleotide
attttattctatgtgttccat

SEQ ID NO: 4722 - DNA, 21 bp, Artificial Sequence
  Description of Artificial Sequence: Synthetic oligonucleotide
ggaacacatagaataaaatat

SEQ ID NO: 4723 - DNA, 21 bp, Artificial Sequence
  Description of Artificial Sequence: Synthetic oligonucleotide
ttttattctatgtgttccata

SEQ ID NO: 4724 - DNA, 21 bp, Artificial Sequence
  Description of Artificial Sequence: Synthetic oligonucleotide
tggaacacatagaataaaata

SEQ ID NO: 4725 - DNA, 21 bp, Artificial Sequence
  Description of Artificial Sequence: Synthetic oligonucleotide
tttattctatgtgttccatag

SEQ ID NO: 4726 - DNA, 21 bp, Artificial Sequence
  Description of Artificial Sequence: Synthetic oligonucleotide
atggaacacatagaataaaat

SEQ ID NO: 4727 - DNA, 21 bp, Artificial Sequence
  Description of Artificial Sequence: Synthetic oligonucleotide
ttattctatgtgttccataga

SEQ ID NO: 4728 - DNA, 21 bp, Artificial Sequence
  Description of Artificial Sequence: Synthetic oligonucleotide
tatggaacacatagaataaaa

SEQ ID NO: 4729 - DNA, 21 bp, Artificial Sequence
  Description of Artificial Sequence: Synthetic oligonucleotide
tattctatgtgttccatagat

SEQ ID NO: 4730 - DNA, 21 bp, Artificial Sequence
  Description of Artificial Sequence: Synthetic oligonucleotide
ctatggaacacatagaataaa

SEQ ID NO: 4731 - DNA, 21 bp, Artificial Sequence
  Description of Artificial Sequence: Synthetic oligonucleotide
attctatgtgttccatagata

SEQ ID NO: 4732 - DNA, 21 bp, Artificial Sequence
  Description of Artificial Sequence: Synthetic oligonucleotide
tctatggaacacatagaataa

SEQ ID NO: 4733 - DNA, 21 bp, Artificial Sequence
  Description of Artificial Sequence: Synthetic oligonucleotide
ttctatgtgttccatagatat

SEQ ID NO: 4734 - DNA, 21 bp, Artificial Sequence
  Description of Artificial Sequence: Synthetic oligonucleotide
atctatggaacacatagaata

SEQ ID NO: 4735 - DNA, 21 bp, Artificial Sequence
  Description of Artificial Sequence: Synthetic oligonucleotide
tctatgtgttccatagatatc

SEQ ID NO: 4736 - DNA, 21 bp, Artificial Sequence
  Description of Artificial Sequence: Synthetic oligonucleotide
tatctatggaacacatagaat

SEQ ID NO: 4737 - DNA, 21 bp, Artificial Sequence
  Description of Artificial Sequence: Synthetic oligonucleotide
ctatgtgttccatagatatct

SEQ ID NO: 4738 - DNA, 21 bp, Artificial Sequence
  Description of Artificial Sequence: Synthetic oligonucleotide
atatctatggaacacatagaa

SEQ ID NO: 4739 - DNA, 21 bp, Artificial Sequence
  Description of Artificial Sequence: Synthetic oligonucleotide
tatgtgttccatagatatctt

SEQ ID NO: 4740 - DNA, 21 bp, Artificial Sequence
  Description of Artificial Sequence: Synthetic oligonucleotide
gatatctatggaacacataga

SEQ ID NO: 4741 - DNA, 21 bp, Artificial Sequence
  Description of Artificial Sequence: Synthetic oligonucleotide
atgtgttccatagatatctta

SEQ ID NO: 4742 - DNA, 21 bp, Artificial Sequence
  Description of Artificial Sequence: Synthetic oligonucleotide
agatatctatggaacacatag

SEQ ID NO: 4743 - DNA, 21 bp, Artificial Sequence
  Description of Artificial Sequence: Synthetic oligonucleotide
tgtgttccatagatatcttaa

SEQ ID NO: 4744 - DNA, 21 bp, Artificial Sequence
  Description of Artificial Sequence: Synthetic oligonucleotide
aagatatctatggaacacata

SEQ ID NO: 4745 - DNA, 21 bp, Artificial Sequence
  Description of Artificial Sequence: Synthetic oligonucleotide
gtgttccatagatatcttaat

SEQ ID NO: 4746 - DNA, 21 bp, Artificial Sequence
  Description of Artificial Sequence: Synthetic oligonucleotide
taagatatctatggaacacat

SEQ ID NO: 4747 - DNA, 21 bp, Artificial Sequence
  Description of Artificial Sequence: Synthetic oligonucleotide
tgttccatagatatcttaatg

SEQ ID NO: 4748 - DNA, 21 bp, Artificial Sequence
  Description of Artificial Sequence: Synthetic oligonucleotide
ttaagatatctatggaacaca

SEQ ID NO: 4749 - DNA, 21 bp, Artificial Sequence
  Description of Artificial Sequence: Synthetic oligonucleotide
gttccatagatatcttaatgt

SEQ ID NO: 4750 - DNA, 21 bp, Artificial Sequence
  Description of Artificial Sequence: Synthetic oligonucleotide
attaagatatctatggaacac

SEQ ID NO: 4751 - DNA, 21 bp, Artificial Sequence
  Description of Artificial Sequence: Synthetic oligonucleotide
ttccatagatatcttaatgta

SEQ ID NO: 4752 - DNA, 21 bp, Artificial Sequence
  Description of Artificial Sequence: Synthetic oligonucleotide
cattaagatatctatggaaca

SEQ ID NO: 4753 - DNA, 21 bp, Artificial Sequence
  Description of Artificial Sequence: Synthetic oligonucleotide
tccatagatatcttaatgtaa

SEQ ID NO: 4754 - DNA, 21 bp, Artificial Sequence
  Description of Artificial Sequence: Synthetic oligonucleotide
acattaagatatctatggaac

SEQ ID NO: 4755 - DNA, 21 bp, Artificial Sequence
  Description of Artificial Sequence: Synthetic oligonucleotide
ccatagatatcttaatgtaaa

SEQ ID NO: 4756 - DNA, 21 bp, Artificial Sequence
  Description of Artificial Sequence: Synthetic oligonucleotide
tacattaagatatctatggaa

SEQ ID NO: 4757 - DNA, 21 bp, Artificial Sequence
  Description of Artificial Sequence: Synthetic oligonucleotide
catagatatcttaatgtaaaa

SEQ ID NO: 4758 - DNA, 21 bp, Artificial Sequence
  Description of Artificial Sequence: Synthetic oligonucleotide
ttacattaagatatctatgga

SEQ ID NO: 4759 - DNA, 21 bp, Artificial Sequence
  Description of Artificial Sequence: Synthetic oligonucleotide
atagatatcttaatgtaaaat

SEQ ID NO: 4760 - DNA, 21 bp, Artificial Sequence
  Description of Artificial Sequence: Synthetic oligonucleotide
tttacattaagatatctatgg

SEQ ID NO: 4761 - DNA, 21 bp, Artificial Sequence
  Description of Artificial Sequence: Synthetic oligonucleotide
tagatatcttaatgtaaaatt

SEQ ID NO: 4762 - DNA, 21 bp, Artificial Sequence
  Description of Artificial Sequence: Synthetic oligonucleotide
ttttacattaagatatctatg

SEQ ID NO: 4763 - DNA, 21 bp, Artificial Sequence
  Description of Artificial Sequence: Synthetic oligonucleotide
agatatcttaatgtaaaatta

SEQ ID NO: 4764 - DNA, 21 bp, Artificial Sequence
  Description of Artificial Sequence: Synthetic oligonucleotide
attttacattaagatatctat

SEQ ID NO: 4765 - DNA, 21 bp, Artificial Sequence
  Description of Artificial Sequence: Synthetic oligonucleotide
gatatcttaatgtaaaattag

SEQ ID NO: 4766 - DNA, 21 bp, Artificial Sequence
  Description of Artificial Sequence: Synthetic oligonucleotide
aattttacattaagatatcta

SEQ ID NO: 4767 - DNA, 21 bp, Artificial Sequence
  Description of Artificial Sequence: Synthetic oligonucleotide
atatcttaatgtaaaattagt

SEQ ID NO: 4768 - DNA, 21 bp, Artificial Sequence
  Description of Artificial Sequence: Synthetic oligonucleotide
taattttacattaagatatct

SEQ ID NO: 4769 - DNA, 21 bp, Artificial Sequence
  Description of Artificial Sequence: Synthetic oligonucleotide
tatcttaatgtaaaattagtc

SEQ ID NO: 4770 - DNA, 21 bp, Artificial Sequence
  Description of Artificial Sequence: Synthetic oligonucleotide
ctaattttacattaagatatc

SEQ ID NO: 4771 - DNA, 21 bp, Artificial Sequence
  Description of Artificial Sequence: Synthetic oligonucleotide
atcttaatgtaaaattagtca

SEQ ID NO: 4772 - DNA, 21 bp, Artificial Sequence
  Description of Artificial Sequence: Synthetic oligonucleotide
actaattttacattaagatat

SEQ ID NO: 4773 - DNA, 21 bp, Artificial Sequence
  Description of Artificial Sequence: Synthetic oligonucleotide
tcttaatgtaaaattagtcat

SEQ ID NO: 4774 - DNA, 21 bp, Artificial Sequence
  Description of Artificial Sequence: Synthetic oligonucleotide
gactaattttacattaagata

SEQ ID NO: 4775 - DNA, 21 bp, Artificial Sequence
  Description of Artificial Sequence: Synthetic oligonucleotide
cttaatgtaaaattagtcatt

SEQ ID NO: 4776 - DNA, 21 bp, Artificial Sequence
  Description of Artificial Sequence: Synthetic oligonucleotide
tgactaattttacattaagat

SEQ ID NO: 4777 - DNA, 21 bp, Artificial Sequence
  Description of Artificial Sequence: Synthetic oligonucleotide
ttaatgtaaaattagtcattt

SEQ ID NO: 4778 - DNA, 21 bp, Artificial Sequence
  Description of Artificial Sequence: Synthetic oligonucleotide
atgactaattttacattaaga

SEQ ID NO: 4779 - DNA, 21 bp, Artificial Sequence
  Description of Artificial Sequence: Synthetic oligonucleotide
taatgtaaaattagtcattta

SEQ ID NO: 4780 - DNA, 21 bp, Artificial Sequence
  Description of Artificial Sequence: Synthetic oligonucleotide
aatgactaattttacattaag

SEQ ID NO: 4781 - DNA, 21 bp, Artificial Sequence
  Description of Artificial Sequence: Synthetic oligonucleotide
aatgtaaaattagtcatttaa

SEQ ID NO: 4782 - DNA, 21 bp, Artificial Sequence
  Description of Artificial Sequence: Synthetic oligonucleotide
aaatgactaattttacattaa

SEQ ID NO: 4783 - DNA, 21 bp, Artificial Sequence
  Description of Artificial Sequence: Synthetic oligonucleotide
atgtaaaattagtcatttaaa

SEQ ID NO: 4784 - DNA, 21 bp, Artificial Sequence
  Description of Artificial Sequence: Synthetic oligonucleotide
taaatgactaattttacatta

SEQ ID NO: 4785 - DNA, 21 bp, Artificial Sequence
  Description of Artificial Sequence: Synthetic oligonucleotide
tgtaaaattagtcatttaaat

SEQ ID NO: 4786 - DNA, 21 bp, Artificial Sequence
  Description of Artificial Sequence: Synthetic oligonucleotide
ttaaatgactaattttacatt

SEQ ID NO: 4787 - DNA, 21 bp, Artificial Sequence
  Description of Artificial Sequence: Synthetic oligonucleotide
gtaaaattagtcatttaaatt

SEQ ID NO: 4788 - DNA, 21 bp, Artificial Sequence
  Description of Artificial Sequence: Synthetic oligonucleotide
tttaaatgactaattttacat

SEQ ID NO: 4789 - DNA, 21 bp, Artificial Sequence
  Description of Artificial Sequence: Synthetic oligonucleotide
taaaattagtcatttaaatta

SEQ ID NO: 4790 - DNA, 21 bp, Artificial Sequence
  Description of Artificial Sequence: Synthetic oligonucleotide
atttaaatgactaattttaca

SEQ ID NO: 4791 - DNA, 21 bp, Artificial Sequence
  Description of Artificial Sequence: Synthetic oligonucleotide
aaaattagtcatttaaattac

SEQ ID NO: 4792 - DNA, 21 bp, Artificial Sequence
  Description of Artificial Sequence: Synthetic oligonucleotide
aatttaaatgactaattttac

SEQ ID NO: 4793 - DNA, 21 bp, Artificial Sequence
  Description of Artificial Sequence: Synthetic oligonucleotide
aaattagtcatttaaattaca

SEQ ID NO: 4794 - DNA, 21 bp, Artificial Sequence
  Description of Artificial Sequence: Synthetic oligonucleotide
taatttaaatgactaatttta

SEQ ID NO: 4795 - DNA, 21 bp, Artificial Sequence
  Description of Artificial Sequence: Synthetic oligonucleotide
aattagtcatttaaattacac

SEQ ID NO: 4796 - DNA, 21 bp, Artificial Sequence
  Description of Artificial Sequence: Synthetic oligonucleotide
gtaatttaaatgactaatttt

SEQ ID NO: 4797 - DNA, 21 bp, Artificial Sequence
  Description of Artificial Sequence: Synthetic oligonucleotide
attagtcatttaaattacact

SEQ ID NO: 4798 - DNA, 21 bp, Artificial Sequence
  Description of Artificial Sequence: Synthetic oligonucleotide
tgtaatttaaatgactaattt

SEQ ID NO: 4799 - DNA, 21 bp, Artificial Sequence
  Description of Artificial Sequence: Synthetic oligonucleotide
ttagtcatttaaattacactg

SEQ ID NO: 4800 - DNA, 21 bp, Artificial Sequence
  Description of Artificial Sequence: Synthetic oligonucleotide
gtgtaatttaaatgactaatt

SEQ ID NO: 4801 - DNA, 21 bp, Artificial Sequence
  Description of Artificial Sequence: Synthetic oligonucleotide
tagtcatttaaattacactgt

SEQ ID NO: 4802 - DNA, 21 bp, Artificial Sequence
  Description of Artificial Sequence: Synthetic oligonucleotide
agtgtaatttaaatgactaat

SEQ ID NO: 4803 - DNA, 21 bp, Artificial Sequence
  Description of Artificial Sequence: Synthetic oligonucleotide
agtcatttaaattacactgtc

SEQ ID NO: 4804 - DNA, 21 bp, Artificial Sequence
  Description of Artificial Sequence: Synthetic oligonucleotide
cagtgtaatttaaatgactaa

SEQ ID NO: 4805 - DNA, 21 bp, Artificial Sequence
  Description of Artificial Sequence: Synthetic oligonucleotide
gtcatttaaattacactgtca

SEQ ID NO: 4806 - DNA, 21 bp, Artificial Sequence
  Description of Artificial Sequence: Synthetic oligonucleotide
acagtgtaatttaaatgacta

SEQ ID NO: 4807 - DNA, 21 bp, Artificial Sequence
  Description of Artificial Sequence: Synthetic oligonucleotide
tcatttaaattacactgtcaa

SEQ ID NO: 4808 - DNA, 21 bp, Artificial Sequence
  Description of Artificial Sequence: Synthetic oligonucleotide
gacagtgtaatttaaatgact

SEQ ID NO: 4809 - DNA, 21 bp, Artificial Sequence
  Description of Artificial Sequence: Synthetic oligonucleotide
catttaaattacactgtcaat

SEQ ID NO: 4810 - DNA, 21 bp, Artificial Sequence
  Description of Artificial Sequence: Synthetic oligonucleotide
tgacagtgtaatttaaatgac

SEQ ID NO: 4811 - DNA, 21 bp, Artificial Sequence
  Description of Artificial Sequence: Synthetic oligonucleotide
atttaaattacactgtcaatt

SEQ ID NO: 4812 - DNA, 21 bp, Artificial Sequence
  Description of Artificial Sequence: Synthetic oligonucleotide
ttgacagtgtaatttaaatga

SEQ ID NO: 4813 - DNA, 21 bp, Artificial Sequence
  Description of Artificial Sequence: Synthetic oligonucleotide
tttaaattacactgtcaatta

SEQ ID NO: 4814 - DNA, 21 bp, Artificial Sequence
  Description of Artificial Sequence: Synthetic oligonucleotide
attgacagtgtaatttaaatg

SEQ ID NO: 4815 - DNA, 21 bp, Artificial Sequence
  Description of Artificial Sequence: Synthetic oligonucleotide
ttaaattacactgtcaattaa

SEQ ID NO: 4816 - DNA, 21 bp, Artificial Sequence
  Description of Artificial Sequence: Synthetic oligonucleotide
aattgacagtgtaatttaaat

SEQ ID NO: 4817 - DNA, 21 bp, Artificial Sequence
  Description of Artificial Sequence: Synthetic oligonucleotide
taaattacactgtcaattaaa

SEQ ID NO: 4818 - DNA, 21 bp, Artificial Sequence
  Description of Artificial Sequence: Synthetic oligonucleotide
taattgacagtgtaatttaaa

SEQ ID NO: 4819 - DNA, 21 bp, Artificial Sequence
  Description of Artificial Sequence: Synthetic oligonucleotide
aaattacactgtcaattaaaa

SEQ ID NO: 4820 - DNA, 21 bp, Artificial Sequence
  Description of Artificial Sequence: Synthetic oligonucleotide
ttaattgacagtgtaatttaa

SEQ ID NO: 4821 - DNA, 21 bp, Artificial Sequence
  Description of Artificial Sequence: Synthetic oligonucleotide
aattacactgtcaattaaaag

SEQ ID NO: 4822 - DNA, 21 bp, Artificial Sequence
  Description of Artificial Sequence: Synthetic oligonucleotide
tttaattgacagtgtaattta

SEQ ID NO: 4823 - DNA, 21 bp, Artificial Sequence
  Description of Artificial Sequence: Synthetic oligonucleotide
attacactgtcaattaaaagt

SEQ ID NO: 4824 - DNA, 21 bp, Artificial Sequence
  Description of Artificial Sequence: Synthetic oligonucleotide
ttttaattgacagtgtaattt

SEQ ID NO: 4825 - DNA, 21 bp, Artificial Sequence
  Description of Artificial Sequence: Synthetic oligonucleotide
ttacactgtcaattaaaagta

SEQ ID NO: 4826 - DNA, 21 bp, Artificial Sequence
  Description of Artificial Sequence: Synthetic oligonucleotide
cttttaattgacagtgtaatt

SEQ ID NO: 4827 - DNA, 21 bp, Artificial Sequence
  Description of Artificial Sequence: Synthetic oligonucleotide
tacactgtcaattaaaagtaa

SEQ ID NO: 4828 - DNA, 21 bp, Artificial Sequence
  Description of Artificial Sequence: Synthetic oligonucleotide
acttttaattgacagtgtaat

SEQ ID NO: 4829 - DNA, 21 bp, Artificial Sequence
  Description of Artificial Sequence: Synthetic oligonucleotide
acactgtcaattaaaagtaat

SEQ ID NO: 4830 - DNA, 21 bp, Artificial Sequence
  Description of Artificial Sequence: Synthetic oligonucleotide
tacttttaattgacagtgtaa

SEQ ID NO: 4831 - DNA, 21 bp, Artificial Sequence
  Description of Artificial Sequence: Synthetic oligonucleotide
cactgtcaattaaaagtaatg

SEQ ID NO: 4832 - DNA, 21 bp, Artificial Sequence
  Description of Artificial Sequence: Synthetic oligonucleotide
ttacttttaattgacagtgta

SEQ ID NO: 4833 - DNA, 21 bp, Artificial Sequence
  Description of Artificial Sequence: Synthetic oligonucleotide
actgtcaattaaaagtaatgg

SEQ ID NO: 4834 - DNA, 21 bp, Artificial Sequence
  Description of Artificial Sequence: Synthetic oligonucleotide
attacttttaattgacagtgt

SEQ ID NO: 4835 - DNA, 21 bp, Artificial Sequence
  Description of Artificial Sequence: Synthetic oligonucleotide
ctgtcaattaaaagtaatggg

SEQ ID NO: 4836 - DNA, 21 bp, Artificial Sequence
  Description of Artificial Sequence: Synthetic oligonucleotide
cattacttttaattgacagtg

SEQ ID NO: 4837 - DNA, 21 bp, Artificial Sequence
  Description of Artificial Sequence: Synthetic oligonucleotide
tgtcaattaaaagtaatgggc

SEQ ID NO: 4838 - DNA, 21 bp, Artificial Sequence
  Description of Artificial Sequence: Synthetic oligonucleotide
ccattacttttaattgacagt

SEQ ID NO: 4839 - DNA, 21 bp, Artificial Sequence
  Description of Artificial Sequence: Synthetic oligonucleotide
gtcaattaaaagtaatgggca

SEQ ID NO: 4840 - DNA, 21 bp, Artificial Sequence
  Description of Artificial Sequence: Synthetic oligonucleotide
cccattacttttaattgacag

SEQ ID NO: 4841 - DNA, 21 bp, Artificial Sequence
  Description of Artificial Sequence: Synthetic oligonucleotide
tcaattaaaagtaatgggcaa

SEQ ID NO: 4842 - DNA, 21 bp, Artificial Sequence
  Description of Artificial Sequence: Synthetic oligonucleotide
gcccattacttttaattgaca

SEQ ID NO: 4843 - DNA, 21 bp, Artificial Sequence
  Description of Artificial Sequence: Synthetic oligonucleotide
caattaaaagtaatgggcaag

SEQ ID NO: 4844 - DNA, 21 bp, Artificial Sequence
  Description of Artificial Sequence: Synthetic oligonucleotide
tgcccattacttttaattgac

SEQ ID NO: 4845 - DNA, 21 bp, Artificial Sequence
  Description of Artificial Sequence: Synthetic oligonucleotide
aattaaaagtaatgggcaaga

SEQ ID NO: 4846 - DNA, 21 bp, Artificial Sequence
  Description of Artificial Sequence: Synthetic oligonucleotide
ttgcccattacttttaattga

SEQ ID NO: 4847 - DNA, 21 bp, Artificial Sequence
  Description of Artificial Sequence: Synthetic oligonucleotide
attaaaagtaatgggcaagag

SEQ ID NO: 4848 - DNA, 21 bp, Artificial Sequence
  Description of Artificial Sequence: Synthetic oligonucleotide
cttgcccattacttttaattg

SEQ ID NO: 4849 - DNA, 21 bp, Artificial Sequence
  Description of Artificial Sequence: Synthetic oligonucleotide
ttaaaagtaatgggcaagaga

SEQ ID NO: 4850 - DNA, 21 bp, Artificial Sequence
  Description of Artificial Sequence: Synthetic oligonucleotide
tcttgcccattacttttaatt

SEQ ID NO: 4851 - DNA, 21 bp, Artificial Sequence
  Description of Artificial Sequence: Synthetic oligonucleotide
taaaagtaatgggcaagagat

SEQ ID NO: 4852 - DNA, 21 bp, Artificial Sequence
  Description of Artificial Sequence: Synthetic oligonucleotide
ctcttgcccattacttttaat

SEQ ID NO: 4853 - DNA, 21 bp, Artificial Sequence
  Description of Artificial Sequence: Synthetic oligonucleotide
aaaagtaatgggcaagagatt

SEQ ID NO: 4854 - DNA, 21 bp, Artificial Sequence
  Description of Artificial Sequence: Synthetic oligonucleotide
tctcttgcccattacttttaa

SEQ ID NO: 4855 - DNA, 21 bp, Artificial Sequence
  Description of Artificial Sequence: Synthetic oligonucleotide
aaagtaatgggcaagagattg

SEQ ID NO: 4856 - DNA, 21 bp, Artificial Sequence
  Description of Artificial Sequence: Synthetic oligonucleotide
atctcttgcccattactttta

SEQ ID NO: 4857 - DNA, 21 bp, Artificial Sequence
  Description of Artificial Sequence: Synthetic oligonucleotide
aagtaatgggcaagagattgc

SEQ ID NO: 4858 - DNA, 21 bp, Artificial Sequence
  Description of Artificial Sequence: Synthetic oligonucleotide
aatctcttgcccattactttt

SEQ ID NO: 4859 - DNA, 21 bp, Artificial Sequence
  Description of Artificial Sequence: Synthetic oligonucleotide
agtaatgggcaagagattgca

SEQ ID NO: 4860 - DNA, 21 bp, Artificial Sequence
  Description of Artificial Sequence: Synthetic oligonucleotide
caatctcttgcccattacttt

SEQ ID NO: 4861 - DNA, 21 bp, Artificial Sequence
  Description of Artificial Sequence: Synthetic oligonucleotide
gtaatgggcaagagattgcat

SEQ ID NO: 4862 - DNA, 21 bp, Artificial Sequence
  Description of Artificial Sequence: Synthetic oligonucleotide
gcaatctcttgcccattactt

SEQ ID NO: 4863 - DNA, 21 bp, Artificial Sequence
  Description of Artificial Sequence: Synthetic oligonucleotide
taatgggcaagagattgcatc

SEQ ID NO: 4864 - DNA, 21 bp, Artificial Sequence
  Description of Artificial Sequence: Synthetic oligonucleotide
tgcaatctcttgcccattact

SEQ ID NO: 4865 - DNA, 21 bp, Artificial Sequence
  Description of Artificial Sequence: Synthetic oligonucleotide
aatgggcaagagattgcatca

SEQ ID NO: 4866 - DNA, 21 bp, Artificial Sequence
  Description of Artificial Sequence: Synthetic oligonucleotide
atgcaatctcttgcccattac

SEQ ID NO: 4867 - DNA, 21 bp, Artificial Sequence
  Description of Artificial Sequence: Synthetic oligonucleotide
atgggcaagagattgcatcat

SEQ ID NO: 4868 - DNA, 21 bp, Artificial Sequence
  Description of Artificial Sequence: Synthetic oligonucleotide
gatgcaatctcttgcccatta

SEQ ID NO: 4869 - DNA, 21 bp, Artificial Sequence
  Description of Artificial Sequence: Synthetic oligonucleotide
tgggcaagagattgcatcata

SEQ ID NO: 4870 - DNA, 21 bp, Artificial Sequence
  Description of Artificial Sequence: Synthetic oligonucleotide
tgatgcaatctcttgcccatt

SEQ ID NO: 4871 - DNA, 21 bp, Artificial Sequence
  Description of Artificial Sequence: Synthetic oligonucleotide
gggcaagagattgcatcatac

SEQ ID NO: 4872 - DNA, 21 bp, Artificial Sequence
  Description of Artificial Sequence: Synthetic oligonucleotide
atgatgcaatctcttgcccat

SEQ ID NO: 4873 - DNA, 21 bp, Artificial Sequence
  Description of Artificial Sequence: Synthetic oligonucleotide
ggcaagagattgcatcatact

SEQ ID NO: 4874 - DNA, 21 bp, Artificial Sequence
  Description of Artificial Sequence: Synthetic oligonucleotide
tatgatgcaatctcttgccca

SEQ ID NO: 4875 - DNA, 21 bp, Artificial Sequence
  Description of Artificial Sequence: Synthetic oligonucleotide
gcaagagattgcatcatacta

SEQ ID NO: 4876 - DNA, 21 bp, Artificial Sequence
  Description of Artificial Sequence: Synthetic oligonucleotide
gtatgatgcaatctcttgccc

SEQ ID NO: 4877 - DNA, 21 bp, Artificial Sequence
  Description of Artificial Sequence: Synthetic oligonucleotide
caagagattgcatcatactaa

SEQ ID NO: 4878 - DNA, 21 bp, Artificial Sequence
  Description of Artificial Sequence: Synthetic oligonucleotide
agtatgatgcaatctcttgcc

SEQ ID NO: 4879 - DNA, 21 bp, Artificial Sequence
  Description of Artificial Sequence: Synthetic oligonucleotide
aagagattgcatcatactaat

SEQ ID NO: 4880 - DNA, 21 bp, Artificial Sequence
  Description of Artificial Sequence: Synthetic oligonucleotide
tagtatgatgcaatctcttgc

SEQ ID NO: 4881 - DNA, 21 bp, Artificial Sequence
  Description of Artificial Sequence: Synthetic oligonucleotide
agagattgcatcatactaatt

SEQ ID NO: 4882 - DNA, 21 bp, Artificial Sequence
  Description of Artificial Sequence: Synthetic oligonucleotide
ttagtatgatgcaatctcttg

SEQ ID NO: 4883 - DNA, 21 bp, Artificial Sequence
  Description of Artificial Sequence: Synthetic oligonucleotide
gagattgcatcatactaattt

SEQ ID NO: 4884 - DNA, 21 bp, Artificial Sequence
  Description of Artificial Sequence: Synthetic oligonucleotide
attagtatgatgcaatctctt

SEQ ID NO: 4885 - DNA, 21 bp, Artificial Sequence
  Description of Artificial Sequence: Synthetic oligonucleotide
agattgcatcatactaattta

SEQ ID NO: 4886 - DNA, 21 bp, Artificial Sequence
  Description of Artificial Sequence: Synthetic oligonucleotide
aattagtatgatgcaatctct

SEQ ID NO: 4887 - DNA, 21 bp, Artificial Sequence
  Description of Artificial Sequence: Synthetic oligonucleotide
gattgcatcatactaatttag

SEQ ID NO: 4888 - DNA, 21 bp, Artificial Sequence
  Description of Artificial Sequence: Synthetic oligonucleotide
aaattagtatgatgcaatctc

SEQ ID NO: 4889 - DNA, 21 bp, Artificial Sequence
  Description of Artificial Sequence: Synthetic oligonucleotide
attgcatcatactaatttagt

SEQ ID NO: 4890 - DNA, 21 bp, Artificial Sequence
  Description of Artificial Sequence: Synthetic oligonucleotide
taaattagtatgatgcaatct

SEQ ID NO: 4891 - DNA, 21 bp, Artificial Sequence
  Description of Artificial Sequence: Synthetic oligonucleotide
ttgcatcatactaatttagta

SEQ ID NO: 4892 - DNA, 21 bp, Artificial Sequence
  Description of Artificial Sequence: Synthetic oligonucleotide
ctaaattagtatgatgcaatc

SEQ ID NO: 4893 - DNA, 21 bp, Artificial Sequence
  Description of Artificial Sequence: Synthetic oligonucleotide
tgcatcatactaatttagtaa

SEQ ID NO: 4894 - DNA, 21 bp, Artificial Sequence
  Description of Artificial Sequence: Synthetic oligonucleotide
actaaattagtatgatgcaat

SEQ ID NO: 4895 - DNA, 21 bp, Artificial Sequence
  Description of Artificial Sequence: Synthetic oligonucleotide
gcatcatactaatttagtaag

SEQ ID NO: 4896 - DNA, 21 bp, Artificial Sequence
  Description of Artificial Sequence: Synthetic oligonucleotide
tactaaattagtatgatgcaa

SEQ ID NO: 4897 - DNA, 21 bp, Artificial Sequence
  Description of Artificial Sequence: Synthetic oligonucleotide
catcatactaatttagtaaga

SEQ ID NO: 4898 - DNA, 21 bp, Artificial Sequence
  Description of Artificial Sequence: Synthetic oligonucleotide
ttactaaattagtatgatgca

SEQ ID NO: 4899 - DNA, 21 bp, Artificial Sequence
  Description of Artificial Sequence: Synthetic oligonucleotide
atcatactaatttagtaagaa

SEQ ID NO: 4900 - DNA, 21 bp, Artificial Sequence
  Description of Artificial Sequence: Synthetic oligonucleotide
cttactaaattagtatgatgc

SEQ ID NO: 4901 - DNA, 21 bp, Artificial Sequence
  Description of Artificial Sequence: Synthetic oligonucleotide
tcatactaatttagtaagaac

SEQ ID NO: 4902 - DNA, 21 bp, Artificial Sequence
  Description of Artificial Sequence: Synthetic oligonucleotide
tcttactaaattagtatgatg

SEQ ID NO: 4903 - DNA, 21 bp, Artificial Sequence
  Description of Artificial Sequence: Synthetic oligonucleotide
catactaatttagtaagaacg

SEQ ID NO: 4904 - DNA, 21 bp, Artificial Sequence
  Description of Artificial Sequence: Synthetic oligonucleotide
ttcttactaaattagtatgat

SEQ ID NO: 4905 - DNA, 21 bp, Artificial Sequence
  Description of Artificial Sequence: Synthetic oligonucleotide
atactaatttagtaagaacgt

SEQ ID NO: 4906 - DNA, 21 bp, Artificial Sequence
  Description of Artificial Sequence: Synthetic oligonucleotide
gttcttactaaattagtatga

SEQ ID NO: 4907 - DNA, 21 bp, Artificial Sequence
  Description of Artificial Sequence: Synthetic oligonucleotide
tactaatttagtaagaacgtt

SEQ ID NO: 4908 - DNA, 21 bp, Artificial Sequence
  Description of Artificial Sequence: Synthetic oligonucleotide
cgttcttactaaattagtatg

SEQ ID NO: 4909 - DNA, 21 bp, Artificial Sequence
  Description of Artificial Sequence: Synthetic oligonucleotide
actaatttagtaagaacgttc

SEQ ID NO: 4910 - DNA, 21 bp, Artificial Sequence
  Description of Artificial Sequence: Synthetic oligonucleotide
acgttcttactaaattagtat

SEQ ID NO: 4911 - DNA, 21 bp, Artificial Sequence
  Description of Artificial Sequence: Synthetic oligonucleotide
ctaatttagtaagaacgttcc

SEQ ID NO: 4912 - DNA, 21 bp, Artificial Sequence
  Description of Artificial Sequence: Synthetic oligonucleotide
aacgttcttactaaattagta

SEQ ID NO: 4913 - DNA, 21 bp, Artificial Sequence
  Description of Artificial Sequence: Synthetic oligonucleotide
taatttagtaagaacgttccc

SEQ ID NO: 4914 - DNA, 21 bp, Artificial Sequence
  Description of Artificial Sequence: Synthetic oligonucleotide
gaacgttcttactaaattagt

SEQ ID NO: 4915 - DNA, 21 bp, Artificial Sequence
  Description of Artificial Sequence: Synthetic oligonucleotide
aatttagtaagaacgttccca

SEQ ID NO: 4916 - DNA, 21 bp, Artificial Sequence
  Description of Artificial Sequence: Synthetic oligonucleotide
ggaacgttcttactaaattag

SEQ ID NO: 4917 - DNA, 21 bp, Artificial Sequence
  Description of Artificial Sequence: Synthetic oligonucleotide
atttagtaagaacgttcccaa

SEQ ID NO: 4918 - DNA, 21 bp, Artificial Sequence
  Description of Artificial Sequence: Synthetic oligonucleotide
gggaacgttcttactaaatta

SEQ ID NO: 4919 - DNA, 21 bp, Artificial Sequence
  Description of Artificial Sequence: Synthetic oligonucleotide
tttagtaagaacgttcccaaa

SEQ ID NO: 4920 - DNA, 21 bp, Artificial Sequence
  Description of Artificial Sequence: Synthetic oligonucleotide
tgggaacgttcttactaaatt

SEQ ID NO: 4921 - DNA, 21 bp, Artificial Sequence
  Description of Artificial Sequence: Synthetic oligonucleotide
ttagtaagaacgttcccaaat

SEQ ID NO: 4922 - DNA, 21 bp, Artificial Sequence
  Description of Artificial Sequence: Synthetic oligonucleotide
ttgggaacgttcttactaaat

SEQ ID NO: 4923 - DNA, 21 bp, Artificial Sequence
  Description of Artificial Sequence: Synthetic oligonucleotide
tagtaagaacgttcccaaatg

SEQ ID NO: 4924 - DNA, 21 bp, Artificial Sequence
  Description of Artificial Sequence: Synthetic oligonucleotide
tttgggaacgttcttactaaa

SEQ ID NO: 4925 - DNA, 21 bp, Artificial Sequence
  Description of Artificial Sequence: Synthetic oligonucleotide
agtaagaacgttcccaaatgt

SEQ ID NO: 4926 - DNA, 21 bp, Artificial Sequence
  Description of Artificial Sequence: Synthetic oligonucleotide
atttgggaacgttcttactaa

SEQ ID NO: 4927 - DNA, 21 bp, Artificial Sequence
  Description of Artificial Sequence: Synthetic oligonucleotide
gtaagaacgttcccaaatgtt

SEQ ID NO: 4928 - DNA, 21 bp, Artificial Sequence
  Description of Artificial Sequence: Synthetic oligonucleotide
catttgggaacgttcttacta

SEQ ID NO: 4929 - DNA, 21 bp, Artificial Sequence
  Description of Artificial Sequence: Synthetic oligonucleotide
taagaacgttcccaaatgttg

SEQ ID NO: 4930 - DNA, 21 bp, Artificial Sequence
  Description of Artificial Sequence: Synthetic oligonucleotide
acatttgggaacgttcttact

SEQ ID NO: 4931 - DNA, 21 bp, Artificial Sequence
  Description of Artificial Sequence: Synthetic oligonucleotide
aagaacgttcccaaatgttgt

SEQ ID NO: 4932 - DNA, 21 bp, Artificial Sequence
  Description of Artificial Sequence: Synthetic oligonucleotide
aacatttgggaacgttcttac

SEQ ID NO: 4933 - DNA, 21 bp, Artificial Sequence
  Description of Artificial Sequence: Synthetic oligonucleotide
agaacgttcccaaatgttgta

SEQ ID NO: 4934 - DNA, 21 bp, Artificial Sequence
  Description of Artificial Sequence: Synthetic oligonucleotide
caacatttgggaacgttctta

SEQ ID NO: 4935 - DNA, 21 bp, Artificial Sequence
  Description of Artificial Sequence: Synthetic oligonucleotide
gaacgttcccaaatgttgtaa

SEQ ID NO: 4936 - DNA, 21 bp, Artificial Sequence
  Description of Artificial Sequence: Synthetic oligonucleotide
acaacatttgggaacgttctt

SEQ ID NO: 4937 - DNA, 21 bp, Artificial Sequence
  Description of Artificial Sequence: Synthetic oligonucleotide
aacgttcccaaatgttgtaac

SEQ ID NO: 4938 - DNA, 21 bp, Artificial Sequence
  Description of Artificial Sequence: Synthetic oligonucleotide
tacaacatttgggaacgttct

SEQ ID NO: 4939 - DNA, 21 bp, Artificial Sequence
  Description of Artificial Sequence: Synthetic oligonucleotide
acgttcccaaatgttgtaaca

SEQ ID NO: 4940 - DNA, 21 bp, Artificial Sequence
  Description of Artificial Sequence: Synthetic oligonucleotide
ttacaacatttgggaacgttc

SEQ ID NO: 4941 - DNA, 21 bp, Artificial Sequence
  Description of Artificial Sequence: Synthetic oligonucleotide
cgttcccaaatgttgtaacaa

SEQ ID NO: 4942 - DNA, 21 bp, Artificial Sequence
  Description of Artificial Sequence: Synthetic oligonucleotide
gttacaacatttgggaacgtt

SEQ ID NO: 4943 - DNA, 21 bp, Artificial Sequence
  Description of Artificial Sequence: Synthetic oligonucleotide
gttcccaaatgttgtaacaat

SEQ ID NO: 4944 - DNA, 21 bp, Artificial Sequence
  Description of Artificial Sequence: Synthetic oligonucleotide
tgttacaacatttgggaacgt

SEQ ID NO: 4945 - DNA, 21 bp, Artificial Sequence
  Description of Artificial Sequence: Synthetic oligonucleotide
ttcccaaatgttgtaacaatg

SEQ ID NO: 4946 - DNA, 21 bp, Artificial Sequence
  Description of Artificial Sequence: Synthetic oligonucleotide
ttgttacaacatttgggaacg

SEQ ID NO: 4947 - DNA, 21 bp, Artificial Sequence
  Description of Artificial Sequence: Synthetic oligonucleotide
tcccaaatgttgtaacaatgt

SEQ ID NO: 4948 - DNA, 21 bp, Artificial Sequence
  Description of Artificial Sequence: Synthetic oligonucleotide
attgttacaacatttgggaac

SEQ ID NO: 4949 - DNA, 21 bp, Artificial Sequence
  Description of Artificial Sequence: Synthetic oligonucleotide
cccaaatgttgtaacaatgtg

SEQ ID NO: 4950 - DNA, 21 bp, Artificial Sequence
  Description of Artificial Sequence: Synthetic oligonucleotide
cattgttacaacatttgggaa

SEQ ID NO: 4951 - DNA, 21 bp, Artificial Sequence
  Description of Artificial Sequence: Synthetic oligonucleotide
ccaaatgttgtaacaatgtgg

SEQ ID NO: 4952 - DNA, 21 bp, Artificial Sequence
  Description of Artificial Sequence: Synthetic oligonucleotide
acattgttacaacatttggga

SEQ ID NO: 4953 - DNA, 21 bp, Artificial Sequence
  Description of Artificial Sequence: Synthetic oligonucleotide
caaatgttgtaacaatgtgga

SEQ ID NO: 4954 - DNA, 21 bp, Artificial Sequence
  Description of Artificial Sequence: Synthetic oligonucleotide
cacattgttacaacatttggg

SEQ ID NO: 4955 - DNA, 21 bp, Artificial Sequence
  Description of Artificial Sequence: Synthetic oligonucleotide
aaatgttgtaacaatgtggat

SEQ ID NO: 4956 - DNA, 21 bp, Artificial Sequence
  Description of Artificial Sequence: Synthetic oligonucleotide
ccacattgttacaacatttgg

SEQ ID NO: 4957 - DNA, 21 bp, Artificial Sequence
  Description of Artificial Sequence: Synthetic oligonucleotide
aatgttgtaacaatgtggatc

SEQ ID NO: 4958 - DNA, 21 bp, Artificial Sequence
  Description of Artificial Sequence: Synthetic oligonucleotide
tccacattgttacaacatttg

SEQ ID NO: 4959 - DNA, 21 bp, Artificial Sequence
  Description of Artificial Sequence: Synthetic oligonucleotide
atgttgtaacaatgtggatca

SEQ ID NO: 4960 - DNA, 21 bp, Artificial Sequence
  Description of Artificial Sequence: Synthetic oligonucleotide
atccacattgttacaacattt

SEQ ID NO: 4961 - DNA, 21 bp, Artificial Sequence
  Description of Artificial Sequence: Synthetic oligonucleotide
tgttgtaacaatgtggatcat

SEQ ID NO: 4962 - DNA, 21 bp, Artificial Sequence
  Description of Artificial Sequence: Synthetic oligonucleotide
gatccacattgttacaacatt

SEQ ID NO: 4963 - DNA, 21 bp, Artificial Sequence
  Description of Artificial Sequence: Synthetic oligonucleotide
gttgtaacaatgtggatcata

SEQ ID NO: 4964 - DNA, 21 bp, Artificial Sequence
  Description of Artificial Sequence: Synthetic oligonucleotide
tgatccacattgttacaacat

SEQ ID NO: 4965 - DNA, 21 bp, Artificial Sequence
  Description of Artificial Sequence: Synthetic oligonucleotide
ttgtaacaatgtggatcatac

SEQ ID NO: 4966 - DNA, 21 bp, Artificial Sequence
  Description of Artificial Sequence: Synthetic oligonucleotide
atgatccacattgttacaaca

SEQ ID NO: 4967 - DNA, 21 bp, Artificial Sequence
  Description of Artificial Sequence: Synthetic oligonucleotide
tgtaacaatgtggatcataca

SEQ ID NO: 4968 - DNA, 21 bp, Artificial Sequence
  Description of Artificial Sequence: Synthetic oligonucleotide
tatgatccacattgttacaac

SEQ ID NO: 4969 - DNA, 21 bp, Artificial Sequence
  Description of Artificial Sequence: Synthetic oligonucleotide
gtaacaatgtggatcatacat

SEQ ID NO: 4970 - DNA, 21 bp, Artificial Sequence
  Description of Artificial Sequence: Synthetic oligonucleotide
gtatgatccacattgttacaa

SEQ ID NO: 4971 - DNA, 21 bp, Artificial Sequence
  Description of Artificial Sequence: Synthetic oligonucleotide
taacaatgtggatcatacatc

SEQ ID NO: 4972 - DNA, 21 bp, Artificial Sequence
  Description of Artificial Sequence: Synthetic oligonucleotide
tgtatgatccacattgttaca

SEQ ID NO: 4973 - DNA, 21 bp, Artificial Sequence
  Description of Artificial Sequence: Synthetic oligonucleotide
aacaatgtggatcatacatct

SEQ ID NO: 4974 - DNA, 21 bp, Artificial Sequence
  Description of Artificial Sequence: Synthetic oligonucleotide
atgtatgatccacattgttac

SEQ ID NO: 4975 - DNA, 21 bp, Artificial Sequence
  Description of Artificial Sequence: Synthetic oligonucleotide
acaatgtggatcatacatctc

SEQ ID NO: 4976 - DNA, 21 bp, Artificial Sequence
  Description of Artificial Sequence: Synthetic oligonucleotide
gatgtatgatccacattgtta

SEQ ID NO: 4977 - DNA, 21 bp, Artificial Sequence
  Description of Artificial Sequence: Synthetic oligonucleotide
caatgtggatcatacatctct

SEQ ID NO: 4978 - DNA, 21 bp, Artificial Sequence
  Description of Artificial Sequence: Synthetic oligonucleotide
agatgtatgatccacattgtt

SEQ ID NO: 4979 - DNA, 21 bp, Artificial Sequence
  Description of Artificial Sequence: Synthetic oligonucleotide
aatgtggatcatacatctctg

SEQ ID NO: 4980 - DNA, 21 bp, Artificial Sequence
  Description of Artificial Sequence: Synthetic oligonucleotide
gagatgtatgatccacattgt

SEQ ID NO: 4981 - DNA, 21 bp, Artificial Sequence
  Description of Artificial Sequence: Synthetic oligonucleotide
atgtggatcatacatctctgg

SEQ ID NO: 4982 - DNA, 21 bp, Artificial Sequence
  Description of Artificial Sequence: Synthetic oligonucleotide
agagatgtatgatccacattg

SEQ ID NO: 4983 - DNA, 21 bp, Artificial Sequence
  Description of Artificial Sequence: Synthetic oligonucleotide
tgtggatcatacatctctggt

SEQ ID NO: 4984 - DNA, 21 bp, Artificial Sequence
  Description of Artificial Sequence: Synthetic oligonucleotide
cagagatgtatgatccacatt

SEQ ID NO: 4985 - DNA, 21 bp, Artificial Sequence
  Description of Artificial Sequence: Synthetic oligonucleotide
gtggatcatacatctctggtt

SEQ ID NO: 4986 - DNA, 21 bp, Artificial Sequence
  Description of Artificial Sequence: Synthetic oligonucleotide
ccagagatgtatgatccacat

SEQ ID NO: 4987 - DNA, 21 bp, Artificial Sequence
  Description of Artificial Sequence: Synthetic oligonucleotide
tggatcatacatctctggttt

SEQ ID NO: 4988 - DNA, 21 bp, Artificial Sequence
  Description of Artificial Sequence: Synthetic oligonucleotide
accagagatgtatgatccaca

SEQ ID NO: 4989 - DNA, 21 bp, Artificial Sequence
  Description of Artificial Sequence: Synthetic oligonucleotide
ggatcatacatctctggtttt

SEQ ID NO: 4990 - DNA, 21 bp, Artificial Sequence
  Description of Artificial Sequence: Synthetic oligonucleotide
aaccagagatgtatgatccac

SEQ ID NO: 4991 - DNA, 21 bp, Artificial Sequence
  Description of Artificial Sequence: Synthetic oligonucleotide
gatcatacatctctggttttt

SEQ ID NO: 4992 - DNA, 21 bp, Artificial Sequence
  Description of Artificial Sequence: Synthetic oligonucleotide
aaaccagagatgtatgatcca

SEQ ID NO: 4993 - DNA, 21 bp, Artificial Sequence
  Description of Artificial Sequence: Synthetic oligonucleotide
atcatacatctctggtttttt

SEQ ID NO: 4994 - DNA, 21 bp, Artificial Sequence
  Description of Artificial Sequence: Synthetic oligonucleotide
aaaaccagagatgtatgatcc

SEQ ID NO: 4995 - DNA, 21 bp, Artificial Sequence
  Description of Artificial Sequence: Synthetic oligonucleotide
tcatacatctctggtttttta

SEQ ID NO: 4996 - DNA, 21 bp, Artificial Sequence
  Description of Artificial Sequence: Synthetic oligonucleotide
aaaaaccagagatgtatgatc

SEQ ID NO: 4997 - DNA, 21 bp, Artificial Sequence
  Description of Artificial Sequence: Synthetic oligonucleotide
catacatctctggttttttaa

SEQ ID NO: 4998 - DNA, 21 bp, Artificial Sequence
  Description of Artificial Sequence: Synthetic oligonucleotide
aaaaaaccagagatgtatgat

SEQ ID NO: 4999 - DNA, 21 bp, Artificial Sequence
  Description of Artificial Sequence: Synthetic oligonucleotide
atacatctctggttttttaaa

SEQ ID NO: 5000 - DNA, 21 bp, Artificial Sequence
  Description of Artificial Sequence: Synthetic oligonucleotide
taaaaaaccagagatgtatga

SEQ ID NO: 5001 - DNA, 21 bp, Artificial Sequence
  Description of Artificial Sequence: Synthetic oligonucleotide
tacatctctggttttttaaat

SEQ ID NO: 5002 - DNA, 21 bp, Artificial Sequence
  Description of Artificial Sequence: Synthetic oligonucleotide
ttaaaaaaccagagatgtatg

SEQ ID NO: 5003 - DNA, 21 bp, Artificial Sequence
  Description of Artificial Sequence: Synthetic oligonucleotide
acatctctggttttttaaatg

SEQ ID NO: 5004 - DNA, 21 bp, Artificial Sequence
  Description of Artificial Sequence: Synthetic oligonucleotide
tttaaaaaaccagagatgtat

SEQ ID NO: 5005 - DNA, 21 bp, Artificial Sequence
  Description of Artificial Sequence: Synthetic oligonucleotide
catctctggttttttaaatgt

SEQ ID NO: 5006 - DNA, 21 bp, Artificial Sequence
  Description of Artificial Sequence: Synthetic oligonucleotide
atttaaaaaaccagagatgta

SEQ ID NO: 5007 - DNA, 21 bp, Artificial Sequence
  Description of Artificial Sequence: Synthetic oligonucleotide
atctctggttttttaaatgta

SEQ ID NO: 5008 - DNA, 21 bp, Artificial Sequence
  Description of Artificial Sequence: Synthetic oligonucleotide
catttaaaaaaccagagatgt

SEQ ID NO: 5009 - DNA, 21 bp, Artificial Sequence
  Description of Artificial Sequence: Synthetic oligonucleotide
tctctggttttttaaatgtat

SEQ ID NO: 5010 - DNA, 21 bp, Artificial Sequence
  Description of Artificial Sequence: Synthetic oligonucleotide
acatttaaaaaaccagagatg

SEQ ID NO: 5011 - DNA, 21 bp, Artificial Sequence
  Description of Artificial Sequence: Synthetic oligonucleotide
ctctggttttttaaatgtatt

SEQ ID NO: 5012 - DNA, 21 bp, Artificial Sequence
  Description of Artificial Sequence: Synthetic oligonucleotide
tacatttaaaaaaccagagat

SEQ ID NO: 5013 - DNA, 21 bp, Artificial Sequence
  Description of Artificial Sequence: Synthetic oligonucleotide
tctggttttttaaatgtattg

SEQ ID NO: 5014 - DNA, 21 bp, Artificial Sequence
  Description of Artificial Sequence: Synthetic oligonucleotide
atacatttaaaaaaccagaga

SEQ ID NO: 5015 - DNA, 21 bp, Artificial Sequence
  Description of Artificial Sequence: Synthetic oligonucleotide
ctggttttttaaatgtattga

SEQ ID NO: 5016 - DNA, 21 bp, Artificial Sequence
  Description of Artificial Sequence: Synthetic oligonucleotide
aatacatttaaaaaaccagag

SEQ ID NO: 5017 - DNA, 21 bp, Artificial Sequence
  Description of Artificial Sequence: Synthetic oligonucleotide
tggttttttaaatgtattgag

SEQ ID NO: 5018 - DNA, 21 bp, Artificial Sequence
  Description of Artificial Sequence: Synthetic oligonucleotide
caatacatttaaaaaaccaga

SEQ ID NO: 5019 - DNA, 21 bp, Artificial Sequence
  Description of Artificial Sequence: Synthetic oligonucleotide
ggttttttaaatgtattgagg

SEQ ID NO: 5020 - DNA, 21 bp, Artificial Sequence
  Description of Artificial Sequence: Synthetic oligonucleotide
tcaatacatttaaaaaaccag

SEQ ID NO: 5021 - DNA, 21 bp, Artificial Sequence
  Description of Artificial Sequence: Synthetic oligonucleotide
gttttttaaatgtattgaggc

SEQ ID NO: 5022 - DNA, 21 bp, Artificial Sequence
  Description of Artificial Sequence: Synthetic oligonucleotide
ctcaatacatttaaaaaacca

SEQ ID NO: 5023 - DNA, 21 bp, Artificial Sequence
  Description of Artificial Sequence: Synthetic oligonucleotide
ttttttaaatgtattgaggct

SEQ ID NO: 5024 - DNA, 21 bp, Artificial Sequence
  Description of Artificial Sequence: Synthetic oligonucleotide
cctcaatacatttaaaaaacc

SEQ ID NO: 5025 - DNA, 21 bp, Artificial Sequence
  Description of Artificial Sequence: Synthetic oligonucleotide
tttttaaatgtattgaggctt

SEQ ID NO: 5026 - DNA, 21 bp, Artificial Sequence
  Description of Artificial Sequence: Synthetic oligonucleotide
gcctcaatacatttaaaaaac

SEQ ID NO: 5027 - DNA, 21 bp, Artificial Sequence
  Description of Artificial Sequence: Synthetic oligonucleotide
ttttaaatgtattgaggcttt

SEQ ID NO: 5028 - DNA, 21 bp, Artificial Sequence
  Description of Artificial Sequence: Synthetic oligonucleotide
agcctcaatacatttaaaaaa

SEQ ID NO: 5029 - DNA, 21 bp, Artificial Sequence
  Description of Artificial Sequence: Synthetic oligonucleotide
tttaaatgtattgaggctttc

SEQ ID NO: 5030 - DNA, 21 bp, Artificial Sequence
  Description of Artificial Sequence: Synthetic oligonucleotide
aagcctcaatacatttaaaaa

SEQ ID NO: 5031 - DNA, 21 bp, Artificial Sequence
  Description of Artificial Sequence: Synthetic oligonucleotide
ttaaatgtattgaggctttct

SEQ ID NO: 5032 - DNA, 21 bp, Artificial Sequence
  Description of Artificial Sequence: Synthetic oligonucleotide
aaagcctcaatacatttaaaa

SEQ ID NO: 5033 - DNA, 21 bp, Artificial Sequence
  Description of Artificial Sequence: Synthetic oligonucleotide
taaatgtattgaggctttctt

SEQ ID NO: 5034 - DNA, 21 bp, Artificial Sequence
  Description of Artificial Sequence: Synthetic oligonucleotide
gaaagcctcaatacatttaaa

SEQ ID NO: 5035 - DNA, 21 bp, Artificial Sequence
  Description of Artificial Sequence: Synthetic oligonucleotide
aaatgtattgaggctttcttg

SEQ ID NO: 5036 - DNA, 21 bp, Artificial Sequence
  Description of Artificial Sequence: Synthetic oligonucleotide
agaaagcctcaatacatttaa

SEQ ID NO: 5037 - DNA, 21 bp, Artificial Sequence
  Description of Artificial Sequence: Synthetic oligonucleotide
aatgtattgaggctttcttgg

SEQ ID NO: 5038 - DNA, 21 bp, Artificial Sequence
  Description of Artificial Sequence: Synthetic oligonucleotide
aagaaagcctcaatacattta

SEQ ID NO: 5039 - DNA, 21 bp, Artificial Sequence
  Description of Artificial Sequence: Synthetic oligonucleotide
atgtattgaggctttcttggt

SEQ ID NO: 5040 - DNA, 21 bp, Artificial Sequence
  Description of Artificial Sequence: Synthetic oligonucleotide
caagaaagcctcaatacattt

SEQ ID NO: 5041 - DNA, 21 bp, Artificial Sequence
  Description of Artificial Sequence: Synthetic oligonucleotide
tgtattgaggctttcttggtg

SEQ ID NO: 5042 - DNA, 21 bp, Artificial Sequence
  Description of Artificial Sequence: Synthetic oligonucleotide
ccaagaaagcctcaatacatt

SEQ ID NO: 5043 - DNA, 21 bp, Artificial Sequence
  Description of Artificial Sequence: Synthetic oligonucleotide
gtattgaggctttcttggtgg

SEQ ID NO: 5044 - DNA, 21 bp, Artificial Sequence
  Description of Artificial Sequence: Synthetic oligonucleotide
accaagaaagcctcaatacat

SEQ ID NO: 5045 - DNA, 21 bp, Artificial Sequence
  Description of Artificial Sequence: Synthetic oligonucleotide
tattgaggctttcttggtgga

SEQ ID NO: 5046 - DNA, 21 bp, Artificial Sequence
  Description of Artificial Sequence: Synthetic oligonucleotide
caccaagaaagcctcaataca

SEQ ID NO: 5047 - DNA, 21 bp, Artificial Sequence
  Description of Artificial Sequence: Synthetic oligonucleotide
attgaggctttcttggtggac

SEQ ID NO: 5048 - DNA, 21 bp, Artificial Sequence
  Description of Artificial Sequence: Synthetic oligonucleotide
ccaccaagaaagcctcaatac

SEQ ID NO: 5049 - DNA, 21 bp, Artificial Sequence
  Description of Artificial Sequence: Synthetic oligonucleotide
ttgaggctttcttggtggact

SEQ ID NO: 5050 - DNA, 21 bp, Artificial Sequence
  Description of Artificial Sequence: Synthetic oligonucleotide
tccaccaagaaagcctcaata

SEQ ID NO: 5051 - DNA, 21 bp, Artificial Sequence
  Description of Artificial Sequence: Synthetic oligonucleotide
tgaggctttcttggtggacta

SEQ ID NO: 5052 - DNA, 21 bp, Artificial Sequence
  Description of Artificial Sequence: Synthetic oligonucleotide
gtccaccaagaaagcctcaat

SEQ ID NO: 5053 - DNA, 21 bp, Artificial Sequence
  Description of Artificial Sequence: Synthetic oligonucleotide
gaggctttcttggtggactag

SEQ ID NO: 5054 - DNA, 21 bp, Artificial Sequence
  Description of Artificial Sequence: Synthetic oligonucleotide
agtccaccaagaaagcctcaa

SEQ ID NO: 5055 - DNA, 21 bp, Artificial Sequence
  Description of Artificial Sequence: Synthetic oligonucleotide
aggctttcttggtggactagt

SEQ ID NO: 5056 - DNA, 21 bp, Artificial Sequence
  Description of Artificial Sequence: Synthetic oligonucleotide
tagtccaccaagaaagcctca

SEQ ID NO: 5057 - DNA, 21 bp, Artificial Sequence
  Description of Artificial Sequence: Synthetic oligonucleotide
ggctttcttggtggactagta

SEQ ID NO: 5058 - DNA, 21 bp, Artificial Sequence
  Description of Artificial Sequence: Synthetic oligonucleotide
ctagtccaccaagaaagcctc

SEQ ID NO: 5059 - DNA, 21 bp, Artificial Sequence
  Description of Artificial Sequence: Synthetic oligonucleotide
gctttcttggtggactagtat

SEQ ID NO: 5060 - DNA, 21 bp, Artificial Sequence
  Description of Artificial Sequence: Synthetic oligonucleotide
actagtccaccaagaaagcct

SEQ ID NO: 5061 - DNA, 21 bp, Artificial Sequence
  Description of Artificial Sequence: Synthetic oligonucleotide
ctttcttggtggactagtata

SEQ ID NO: 5062 - DNA, 21 bp, Artificial Sequence
  Description of Artificial Sequence: Synthetic oligonucleotide
tactagtccaccaagaaagcc

SEQ ID NO: 5063 - DNA, 21 bp, Artificial Sequence
  Description of Artificial Sequence: Synthetic oligonucleotide
tttcttggtggactagtatag

SEQ ID NO: 5064 - DNA, 21 bp, Artificial Sequence
  Description of Artificial Sequence: Synthetic oligonucleotide
atactagtccaccaagaaagc

SEQ ID NO: 5065 - DNA, 21 bp, Artificial Sequence
  Description of Artificial Sequence: Synthetic oligonucleotide
ttcttggtggactagtatagt

SEQ ID NO: 5066 - DNA, 21 bp, Artificial Sequence
  Description of Artificial Sequence: Synthetic oligonucleotide
tatactagtccaccaagaaag

SEQ ID NO: 5067 - DNA, 21 bp, Artificial Sequence
  Description of Artificial Sequence: Synthetic oligonucleotide
tcttggtggactagtatagta

SEQ ID NO: 5068 - DNA, 21 bp, Artificial Sequence
  Description of Artificial Sequence: Synthetic oligonucleotide
ctatactagtccaccaagaaa

SEQ ID NO: 5069 - DNA, 21 bp, Artificial Sequence
  Description of Artificial Sequence: Synthetic oligonucleotide
cttggtggactagtatagtat

SEQ ID NO: 5070 - DNA, 21 bp, Artificial Sequence
  Description of Artificial Sequence: Synthetic oligonucleotide
actatactagtccaccaagaa

SEQ ID NO: 5071 - DNA, 21 bp, Artificial Sequence
  Description of Artificial Sequence: Synthetic oligonucleotide
ttggtggactagtatagtata

SEQ ID NO: 5072 - DNA, 21 bp, Artificial Sequence
  Description of Artificial Sequence: Synthetic oligonucleotide
tactatactagtccaccaaga

SEQ ID NO: 5073 - DNA, 21 bp, Artificial Sequence
  Description of Artificial Sequence: Synthetic oligonucleotide
tggtggactagtatagtatac

SEQ ID NO: 5074 - DNA, 21 bp, Artificial Sequence
  Description of Artificial Sequence: Synthetic oligonucleotide
atactatactagtccaccaag

SEQ ID NO: 5075 - DNA, 21 bp, Artificial Sequence
  Description of Artificial Sequence: Synthetic oligonucleotide
ggtggactagtatagtatacg

SEQ ID NO: 5076 - DNA, 21 bp, Artificial Sequence
  Description of Artificial Sequence: Synthetic oligonucleotide
tatactatactagtccaccaa

SEQ ID NO: 5077 - DNA, 21 bp, Artificial Sequence
  Description of Artificial Sequence: Synthetic oligonucleotide
gtggactagtatagtatacgg

SEQ ID NO: 5078 - DNA, 21 bp, Artificial Sequence
  Description of Artificial Sequence: Synthetic oligonucleotide
gtatactatactagtccacca

SEQ ID NO: 5079 - DNA, 21 bp, Artificial Sequence
  Description of Artificial Sequence: Synthetic oligonucleotide
tggactagtatagtatacggt

SEQ ID NO: 5080 - DNA, 21 bp, Artificial Sequence
  Description of Artificial Sequence: Synthetic oligonucleotide
cgtatactatactagtccacc

SEQ ID NO: 5081 - DNA, 21 bp, Artificial Sequence
  Description of Artificial Sequence: Synthetic oligonucleotide
ggactagtatagtatacggtc

SEQ ID NO: 5082 - DNA, 21 bp, Artificial Sequence
  Description of Artificial Sequence: Synthetic oligonucleotide
ccgtatactatactagtccac

SEQ ID NO: 5083 - DNA, 21 bp, Artificial Sequence
  Description of Artificial Sequence: Synthetic oligonucleotide
gactagtatagtatacggtca

SEQ ID NO: 5084 - DNA, 21 bp, Artificial Sequence
  Description of Artificial Sequence: Synthetic oligonucleotide
accgtatactatactagtcca

SEQ ID NO: 5085 - DNA, 21 bp, Artificial Sequence
  Description of Artificial Sequence: Synthetic oligonucleotide
actagtatagtatacggtcag

SEQ ID NO: 5086 - DNA, 21 bp, Artificial Sequence
  Description of Artificial Sequence: Synthetic oligonucleotide
gaccgtatactatactagtcc

SEQ ID NO: 5087 - DNA, 21 bp, Artificial Sequence
  Description of Artificial Sequence: Synthetic oligonucleotide
ctagtatagtatacggtcagt

SEQ ID NO: 5088 - DNA, 21 bp, Artificial Sequence
  Description of Artificial Sequence: Synthetic oligonucleotide
tgaccgtatactatactagtc

SEQ ID NO: 5089 - DNA, 21 bp, Artificial Sequence
  Description of Artificial Sequence: Synthetic oligonucleotide
tagtatagtatacggtcagtt

SEQ ID NO: 5090 - DNA, 21 bp, Artificial Sequence
  Description of Artificial Sequence: Synthetic oligonucleotide
ctgaccgtatactatactagt

SEQ ID NO: 5091 - DNA, 21 bp, Artificial Sequence
  Description of Artificial Sequence: Synthetic oligonucleotide
agtatagtatacggtcagtta

SEQ ID NO: 5092 - DNA, 21 bp, Artificial Sequence
  Description of Artificial Sequence: Synthetic oligonucleotide
actgaccgtatactatactag

SEQ ID NO: 5093 - DNA, 21 bp, Artificial Sequence
  Description of Artificial Sequence: Synthetic oligonucleotide
gtatagtatacggtcagttat

SEQ ID NO: 5094 - DNA, 21 bp, Artificial Sequence
  Description of Artificial Sequence: Synthetic oligonucleotide
aactgaccgtatactatacta

SEQ ID NO: 5095 - DNA, 21 bp, Artificial Sequence
  Description of Artificial Sequence: Synthetic oligonucleotide
tatagtatacggtcagttatg

SEQ ID NO: 5096 - DNA, 21 bp, Artificial Sequence
  Description of Artificial Sequence: Synthetic oligonucleotide
taactgaccgtatactatact

SEQ ID NO: 5097 - DNA, 21 bp, Artificial Sequence
  Description of Artificial Sequence: Synthetic oligonucleotide
atagtatacggtcagttatgt

SEQ ID NO: 5098 - DNA, 21 bp, Artificial Sequence
  Description of Artificial Sequence: Synthetic oligonucleotide
ataactgaccgtatactatac

SEQ ID NO: 5099 - DNA, 21 bp, Artificial Sequence
  Description of Artificial Sequence: Synthetic oligonucleotide
tagtatacggtcagttatgtc

SEQ ID NO: 5100 - DNA, 21 bp, Artificial Sequence
  Description of Artificial Sequence: Synthetic oligonucleotide
cataactgaccgtatactata

SEQ ID NO: 5101 - DNA, 21 bp, Artificial Sequence
  Description of Artificial Sequence: Synthetic oligonucleotide
agtatacggtcagttatgtca

SEQ ID NO: 5102 - DNA, 21 bp, Artificial Sequence
  Description of Artificial Sequence: Synthetic oligonucleotide
acataactgaccgtatactat

SEQ ID NO: 5103 - DNA, 21 bp, Artificial Sequence
  Description of Artificial Sequence: Synthetic oligonucleotide
gtatacggtcagttatgtcaa

SEQ ID NO: 5104 - DNA, 21 bp, Artificial Sequence
  Description of Artificial Sequence: Synthetic oligonucleotide
gacataactgaccgtatacta

SEQ ID NO: 5105 - DNA, 21 bp, Artificial Sequence
  Description of Artificial Sequence: Synthetic oligonucleotide
tatacggtcagttatgtcaat

SEQ ID NO: 5106 - DNA, 21 bp, Artificial Sequence
  Description of Artificial Sequence: Synthetic oligonucleotide
tgacataactgaccgtatact

SEQ ID NO: 5107 - DNA, 21 bp, Artificial Sequence
  Description of Artificial Sequence: Synthetic oligonucleotide
atacggtcagttatgtcaatg

SEQ ID NO: 5108 - DNA, 21 bp, Artificial Sequence
  Description of Artificial Sequence: Synthetic oligonucleotide
ttgacataactgaccgtatac

SEQ ID NO: 5109 - DNA, 21 bp, Artificial Sequence
  Description of Artificial Sequence: Synthetic oligonucleotide
tacggtcagttatgtcaatgt

SEQ ID NO: 5110 - DNA, 21 bp, Artificial Sequence
  Description of Artificial Sequence: Synthetic oligonucleotide
attgacataactgaccgtata

SEQ ID NO: 5111 - DNA, 21 bp, Artificial Sequence
  Description of Artificial Sequence: Synthetic oligonucleotide
acggtcagttatgtcaatgtt

SEQ ID NO: 5112 - DNA, 21 bp, Artificial Sequence
  Description of Artificial Sequence: Synthetic oligonucleotide
cattgacataactgaccgtat

SEQ ID NO: 5113 - DNA, 21 bp, Artificial Sequence
  Description of Artificial Sequence: Synthetic oligonucleotide
cggtcagttatgtcaatgttt

SEQ ID NO: 5114 - DNA, 21 bp, Artificial Sequence
  Description of Artificial Sequence: Synthetic oligonucleotide
acattgacataactgaccgta

SEQ ID NO: 5115 - DNA, 21 bp, Artificial Sequence
  Description of Artificial Sequence: Synthetic oligonucleotide
ggtcagttatgtcaatgtttc

SEQ ID NO: 5116 - DNA, 21 bp, Artificial Sequence
  Description of Artificial Sequence: Synthetic oligonucleotide
aacattgacataactgaccgt

SEQ ID NO: 5117 - DNA, 21 bp, Artificial Sequence
  Description of Artificial Sequence: Synthetic oligonucleotide
gtcagttatgtcaatgtttca

SEQ ID NO: 5118 - DNA, 21 bp, Artificial Sequence
  Description of Artificial Sequence: Synthetic oligonucleotide
aaacattgacataactgaccg

SEQ ID NO: 5119 - DNA, 21 bp, Artificial Sequence
  Description of Artificial Sequence: Synthetic oligonucleotide
tcagttatgtcaatgtttcat

SEQ ID NO: 5120 - DNA, 21 bp, Artificial Sequence
  Description of Artificial Sequence: Synthetic oligonucleotide
gaaacattgacataactgacc

SEQ ID NO: 5121 - DNA, 21 bp, Artificial Sequence
  Description of Artificial Sequence: Synthetic oligonucleotide
cagttatgtcaatgtttcatg

SEQ ID NO: 5122 - DNA, 21 bp, Artificial Sequence
  Description of Artificial Sequence: Synthetic oligonucleotide
tgaaacattgacataactgac

SEQ ID NO: 5123 - DNA, 21 bp, Artificial Sequence
  Description of Artificial Sequence: Synthetic oligonucleotide
agttatgtcaatgtttcatgg

SEQ ID NO: 5124 - DNA, 21 bp, Artificial Sequence
  Description of Artificial Sequence: Synthetic oligonucleotide
atgaaacattgacataactga

SEQ ID NO: 5125 - DNA, 21 bp, Artificial Sequence
  Description of Artificial Sequence: Synthetic oligonucleotide
gttatgtcaatgtttcatggt

SEQ ID NO: 5126 - DNA, 21 bp, Artificial Sequence
  Description of Artificial Sequence: Synthetic oligonucleotide
catgaaacattgacataactg

SEQ ID NO: 5127 - DNA, 21 bp, Artificial Sequence
  Description of Artificial Sequence: Synthetic oligonucleotide
ttatgtcaatgtttcatggtc

SEQ ID NO: 5128 - DNA, 21 bp, Artificial Sequence
  Description of Artificial Sequence: Synthetic oligonucleotide
ccatgaaacattgacataact

SEQ ID NO: 5129 - DNA, 21 bp, Artificial Sequence
  Description of Artificial Sequence: Synthetic oligonucleotide
tatgtcaatgtttcatggtca

SEQ ID NO: 5130 - DNA, 21 bp, Artificial Sequence
  Description of Artificial Sequence: Synthetic oligonucleotide
accatgaaacattgacataac

SEQ ID NO: 5131 - DNA, 21 bp, Artificial Sequence
  Description of Artificial Sequence: Synthetic oligonucleotide
atgtcaatgtttcatggtcaa

SEQ ID NO: 5132 - DNA, 21 bp, Artificial Sequence
  Description of Artificial Sequence: Synthetic oligonucleotide
gaccatgaaacattgacataa

SEQ ID NO: 5133 - DNA, 21 bp, Artificial Sequence
  Description of Artificial Sequence: Synthetic oligonucleotide
tgtcaatgtttcatggtcaat

SEQ ID NO: 5134 - DNA, 21 bp, Artificial Sequence
  Description of Artificial Sequence: Synthetic oligonucleotide
tgaccatgaaacattgacata

SEQ ID NO: 5135 - DNA, 21 bp, Artificial Sequence
  Description of Artificial Sequence: Synthetic oligonucleotide
gtcaatgtttcatggtcaata

SEQ ID NO: 5136 - DNA, 21 bp, Artificial Sequence
  Description of Artificial Sequence: Synthetic oligonucleotide
ttgaccatgaaacattgacat

SEQ ID NO: 5137 - DNA, 21 bp, Artificial Sequence
  Description of Artificial Sequence: Synthetic oligonucleotide
tcaatgtttcatggtcaataa

SEQ ID NO: 5138 - DNA, 21 bp, Artificial Sequence
  Description of Artificial Sequence: Synthetic oligonucleotide
attgaccatgaaacattgaca

SEQ ID NO: 5139 - DNA, 21 bp, Artificial Sequence
  Description of Artificial Sequence: Synthetic oligonucleotide
caatgtttcatggtcaataaa

SEQ ID NO: 5140 - DNA, 21 bp, Artificial Sequence
  Description of Artificial Sequence: Synthetic oligonucleotide
tattgaccatgaaacattgac

SEQ ID NO: 5141 - DNA, 21 bp, Artificial Sequence
  Description of Artificial Sequence: Synthetic oligonucleotide
aatgtttcatggtcaataaaa

SEQ ID NO: 5142 - DNA, 21 bp, Artificial Sequence
  Description of Artificial Sequence: Synthetic oligonucleotide
ttattgaccatgaaacattga

SEQ ID NO: 5143 - DNA, 21 bp, Artificial Sequence
  Description of Artificial Sequence: Synthetic oligonucleotide
atgtttcatggtcaataaaaa

SEQ ID NO: 5144 - DNA, 21 bp, Artificial Sequence
  Description of Artificial Sequence: Synthetic oligonucleotide
tttattgaccatgaaacattg

SEQ ID NO: 5145 - DNA, 21 bp, Artificial Sequence
  Description of Artificial Sequence: Synthetic oligonucleotide
tgtttcatggtcaataaaaag

SEQ ID NO: 5146 - DNA, 21 bp, Artificial Sequence
  Description of Artificial Sequence: Synthetic oligonucleotide
ttttattgaccatgaaacatt

SEQ ID NO: 5147 - DNA, 21 bp, Artificial Sequence
  Description of Artificial Sequence: Synthetic oligonucleotide
gtttcatggtcaataaaaagg

SEQ ID NO: 5148 - DNA, 21 bp, Artificial Sequence
  Description of Artificial Sequence: Synthetic oligonucleotide
tttttattgaccatgaaacat

SEQ ID NO: 5149 - DNA, 21 bp, Artificial Sequence
  Description of Artificial Sequence: Synthetic oligonucleotide
tttcatggtcaataaaaagga

SEQ ID NO: 5150 - DNA, 21 bp, Artificial Sequence
  Description of Artificial Sequence: Synthetic oligonucleotide
ctttttattgaccatgaaaca

SEQ ID NO: 5151 - DNA, 21 bp, Artificial Sequence
  Description of Artificial Sequence: Synthetic oligonucleotide
ttcatggtcaataaaaaggaa

SEQ ID NO: 5152 - DNA, 21 bp, Artificial Sequence
  Description of Artificial Sequence: Synthetic oligonucleotide
cctttttattgaccatgaaac

SEQ ID NO: 5153 - DNA, 21 bp, Artificial Sequence
  Description of Artificial Sequence: Synthetic oligonucleotide
tcatggtcaataaaaaggaag

SEQ ID NO: 5154 - DNA, 21 bp, Artificial Sequence
  Description of Artificial Sequence: Synthetic oligonucleotide
tcctttttattgaccatgaaa

SEQ ID NO: 5155 - DNA, 21 bp, Artificial Sequence
  Description of Artificial Sequence: Synthetic oligonucleotide
catggtcaataaaaaggaagt

SEQ ID NO: 5156 - DNA, 21 bp, Artificial Sequence
  Description of Artificial Sequence: Synthetic oligonucleotide
ttcctttttattgaccatgaa

SEQ ID NO: 5157 - DNA, 21 bp, Artificial Sequence
  Description of Artificial Sequence: Synthetic oligonucleotide
atggtcaataaaaaggaagtt

SEQ ID NO: 5158 - DNA, 21 bp, Artificial Sequence
  Description of Artificial Sequence: Synthetic oligonucleotide
cttcctttttattgaccatga

SEQ ID NO: 5159 - DNA, 21 bp, Artificial Sequence
  Description of Artificial Sequence: Synthetic oligonucleotide
tggtcaataaaaaggaagttg

SEQ ID NO: 5160 - DNA, 21 bp, Artificial Sequence
  Description of Artificial Sequence: Synthetic oligonucleotide
acttcctttttattgaccatg

SEQ ID NO: 5161 - DNA, 21 bp, Artificial Sequence
  Description of Artificial Sequence: Synthetic oligonucleotide
ggtcaataaaaaggaagttgc

SEQ ID NO: 5162 - DNA, 21 bp, Artificial Sequence
  Description of Artificial Sequence: Synthetic oligonucleotide
aacttcctttttattgaccat

SEQ ID NO: 5163 - DNA, 21 bp, Artificial Sequence
  Description of Artificial Sequence: Synthetic oligonucleotide
gtcaataaaaaggaagttgca

SEQ ID NO: 5164 - DNA, 21 bp, Artificial Sequence
  Description of Artificial Sequence: Synthetic oligonucleotide
caacttcctttttattgacca

SEQ ID NO: 5165 - DNA, 21 bp, Artificial Sequence
  Description of Artificial Sequence: Synthetic oligonucleotide
tcaataaaaaggaagttgcaa

SEQ ID NO: 5166 - DNA, 21 bp, Artificial Sequence
  Description of Artificial Sequence: Synthetic oligonucleotide
gcaacttcctttttattgacc

SEQ ID NO: 5167 - DNA, 21 bp, Artificial Sequence
  Description of Artificial Sequence: Synthetic oligonucleotide
caataaaaaggaagttgcaaa

SEQ ID NO: 5168 - DNA, 21 bp, Artificial Sequence
  Description of Artificial Sequence: Synthetic oligonucleotide
tgcaacttcctttttattgac

SEQ ID NO: 5169 - DNA, 21 bp, Artificial Sequence
  Description of Artificial Sequence: Synthetic oligonucleotide
aataaaaaggaagttgcaaat

SEQ ID NO: 5170 - DNA, 21 bp, Artificial Sequence
  Description of Artificial Sequence: Synthetic oligonucleotide
ttgcaacttcctttttattga

SEQ ID NO: 5171 - DNA, 21 bp, Artificial Sequence
  Description of Artificial Sequence: Synthetic oligonucleotide
ataaaaaggaagttgcaaatt

SEQ ID NO: 5172 - DNA, 21 bp, Artificial Sequence
  Description of Artificial Sequence: Synthetic oligonucleotide
tttgcaacttcctttttattg

SEQ ID NO: 5173 - DNA, 21 bp, Artificial Sequence
  Description of Artificial Sequence: Synthetic oligonucleotide
taaaaaggaagttgcaaattg

SEQ ID NO: 5174 - DNA, 21 bp, Artificial Sequence
  Description of Artificial Sequence: Synthetic oligonucleotide
atttgcaacttcctttttatt

SEQ ID NO: 5175 - DNA, 21 bp, Artificial Sequence
  Description of Artificial Sequence: Synthetic oligonucleotide
aaaaaggaagttgcaaattgt

SEQ ID NO: 5176 - DNA, 21 bp, Artificial Sequence
  Description of Artificial Sequence: Synthetic oligonucleotide
aatttgcaacttcctttttat

SEQ ID NO: 5177 - DNA, 21 bp, Artificial Sequence
  Description of Artificial Sequence: Synthetic oligonucleotide
aaaaggaagttgcaaattgtg

SEQ ID NO: 5178 - DNA, 21 bp, Artificial Sequence
  Description of Artificial Sequence: Synthetic oligonucleotide
caatttgcaacttccttttta

SEQ ID NO: 5179 - DNA, 21 bp, Artificial Sequence
  Description of Artificial Sequence: Synthetic oligonucleotide
aaaggaagttgcaaattgtga

SEQ ID NO: 5180 - DNA, 21 bp, Artificial Sequence
  Description of Artificial Sequence: Synthetic oligonucleotide
acaatttgcaacttccttttt

SEQ ID NO: 5181 - DNA, 21 bp, Artificial Sequence
  Description of Artificial Sequence: Synthetic oligonucleotide
aaggaagttgcaaattgtgat

SEQ ID NO: 5182 - DNA, 21 bp, Artificial Sequence
  Description of Artificial Sequence: Synthetic oligonucleotide
cacaatttgcaacttcctttt

SEQ ID NO: 5183 - DNA, 21 bp, Artificial Sequence
  Description of Artificial Sequence: Synthetic oligonucleotide
aggaagttgcaaattgtgatt

SEQ ID NO: 5184 - DNA, 21 bp, Artificial Sequence
  Description of Artificial Sequence: Synthetic oligonucleotide
tcacaatttgcaacttccttt

SEQ ID NO: 5185 - DNA, 21 bp, Artificial Sequence
  Description of Artificial Sequence: Synthetic oligonucleotide
accctcgccacgcccctgctc

SEQ ID NO: 5186 - DNA, 21 bp, Artificial Sequence
  Description of Artificial Sequence: Synthetic oligonucleotide
gcaggggcgtggcgagggttt

SEQ ID NO: 5187 - DNA, 21 bp, Artificial Sequence
  Description of Artificial Sequence: Synthetic oligonucleotide
ccctcgccacgcccctgctcc

SEQ ID NO: 5188 - DNA, 21 bp, Artificial Sequence
  Description of Artificial Sequence: Synthetic oligonucleotide
agcaggggcgtggcgagggtt

SEQ ID NO: 5189 - DNA, 21 bp, Artificial Sequence
  Description of Artificial Sequence: Synthetic oligonucleotide
cctcgccacgcccctgctccc

SEQ ID NO: 5190 - DNA, 21 bp, Artificial Sequence
  Description of Artificial Sequence: Synthetic oligonucleotide
gagcaggggcgtggcgagggt

SEQ ID NO: 5191 - DNA, 21 bp, Artificial Sequence
  Description of Artificial Sequence: Synthetic oligonucleotide
ctcgccacgcccctgctcccc

SEQ ID NO: 5192 - DNA, 21 bp, Artificial Sequence
  Description of Artificial Sequence: Synthetic oligonucleotide
ggagcaggggcgtggcgaggg

SEQ ID NO: 5193 - DNA, 21 bp, Artificial Sequence
  Description of Artificial Sequence: Synthetic oligonucleotide
tcgccacgcccctgctccccc

SEQ ID NO: 5194 - DNA, 21 bp, Artificial Sequence
  Description of Artificial Sequence: Synthetic oligonucleotide
gggagcaggggcgtggcgagg

SEQ ID NO: 5195 - DNA, 21 bp, Artificial Sequence
  Description of Artificial Sequence: Synthetic oligonucleotide
cgccacgcccctgctcccccg

SEQ ID NO: 5196 - DNA, 21 bp, Artificial Sequence
  Description of Artificial Sequence: Synthetic oligonucleotide
ggggagcaggggcgtggcgag

SEQ ID NO: 5197 - DNA, 21 bp, Artificial Sequence
  Description of Artificial Sequence: Synthetic oligonucleotide
gccacgcccctgctcccccgc

SEQ ID NO: 5198 - DNA, 21 bp, Artificial Sequence
  Description of Artificial Sequence: Synthetic oligonucleotide
gggggagcaggggcgtggcga

SEQ ID NO: 5199 - DNA, 21 bp, Artificial Sequence
  Description of Artificial Sequence: Synthetic oligonucleotide
ccacgcccctgctcccccgcg

SEQ ID NO: 5200 - DNA, 21 bp, Artificial Sequence
  Description of Artificial Sequence: Synthetic oligonucleotide
cgggggagcaggggcgtggcg

SEQ ID NO: 5201 - DNA, 21 bp, Artificial Sequence
  Description of Artificial Sequence: Synthetic oligonucleotide
cacgcccctgctcccccgcgg

SEQ ID NO: 5202 - DNA, 21 bp, Artificial Sequence
  Description of Artificial Sequence: Synthetic oligonucleotide
gcgggggagcaggggcgtggc

SEQ ID NO: 5203 - DNA, 21 bp, Artificial Sequence
  Description of Artificial Sequence: Synthetic oligonucleotide
acgcccctgctcccccgcggt

SEQ ID NO: 5204 - DNA, 21 bp, Artificial Sequence
  Description of Artificial Sequence: Synthetic oligonucleotide
cgcgggggagcaggggcgtgg

SEQ ID NO: 5205 - DNA, 21 bp, Artificial Sequence
  Description of Artificial Sequence: Synthetic oligonucleotide
cgcccctgctcccccgcggtt

SEQ ID NO: 5206 - DNA, 21 bp, Artificial Sequence
  Description of Artificial Sequence: Synthetic oligonucleotide
ccgcgggggagcaggggcgtg

SEQ ID NO: 5207 - DNA, 21 bp, Artificial Sequence
  Description of Artificial Sequence: Synthetic oligonucleotide
gcccctgctcccccgcggttg

SEQ ID NO: 5208 - DNA, 21 bp, Artificial Sequence
  Description of Artificial Sequence: Synthetic oligonucleotide
accgcgggggagcaggggcgt

SEQ ID NO: 5209 - DNA, 21 bp, Artificial Sequence
  Description of Artificial Sequence: Synthetic oligonucleotide
cccctgctcccccgcggttgg

SEQ ID NO: 5210 - DNA, 21 bp, Artificial Sequence
  Description of Artificial Sequence: Synthetic oligonucleotide
aaccgcgggggagcaggggcg

SEQ ID NO: 5211 - DNA, 21 bp, Artificial Sequence
  Description of Artificial Sequence: Synthetic oligonucleotide
ccctgctcccccgcggttggt

SEQ ID NO: 5212 - DNA, 21 bp, Artificial Sequence
  Description of Artificial Sequence: Synthetic oligonucleotide
caaccgcgggggagcaggggc

SEQ ID NO: 5213 - DNA, 21 bp, Artificial Sequence
  Description of Artificial Sequence: Synthetic oligonucleotide
cctgctcccccgcggttggtt

SEQ ID NO: 5214 - DNA, 21 bp, Artificial Sequence
  Description of Artificial Sequence: Synthetic oligonucleotide
ccaaccgcgggggagcagggg

SEQ ID NO: 5215 - DNA, 21 bp, Artificial Sequence
  Description of Artificial Sequence: Synthetic oligonucleotide
ctgctcccccgcggttggttc

SEQ ID NO: 5216 - DNA, 21 bp, Artificial Sequence
  Description of Artificial Sequence: Synthetic oligonucleotide
accaaccgcgggggagcaggg

SEQ ID NO: 5217 - DNA, 21 bp, Artificial Sequence
  Description of Artificial Sequence: Synthetic oligonucleotide
tgctcccccgcggttggttct

SEQ ID NO: 5218 - DNA, 21 bp, Artificial Sequence
  Description of Artificial Sequence: Synthetic oligonucleotide
aaccaaccgcgggggagcagg

SEQ ID NO: 5219 - DNA, 21 bp, Artificial Sequence
  Description of Artificial Sequence: Synthetic oligonucleotide
gctcccccgcggttggttctt

SEQ ID NO: 5220 - DNA, 21 bp, Artificial Sequence
  Description of Artificial Sequence: Synthetic oligonucleotide
gaaccaaccgcgggggagcag

SEQ ID NO: 5221 - DNA, 21 bp, Artificial Sequence
  Description of Artificial Sequence: Synthetic oligonucleotide
ctcccccgcggttggttcttc

SEQ ID NO: 5222 - DNA, 21 bp, Artificial Sequence
  Description of Artificial Sequence: Synthetic oligonucleotide
agaaccaaccgcgggggagca

SEQ ID NO: 5223 - DNA, 21 bp, Artificial Sequence
  Description of Artificial Sequence: Synthetic oligonucleotide
tcccccgcggttggttcttcc

SEQ ID NO: 5224 - DNA, 21 bp, Artificial Sequence
  Description of Artificial Sequence: Synthetic oligonucleotide
aagaaccaaccgcgggggagc

SEQ ID NO: 5225 - DNA, 21 bp, Artificial Sequence
  Description of Artificial Sequence: Synthetic oligonucleotide
cccccgcggttggttcttcct

SEQ ID NO: 5226 - DNA, 21 bp, Artificial Sequence
  Description of Artificial Sequence: Synthetic oligonucleotide
gaagaaccaaccgcgggggag

SEQ ID NO: 5227 - DNA, 21 bp, Artificial Sequence
  Description of Artificial Sequence: Synthetic oligonucleotide
ccccgcggttggttcttcctt

SEQ ID NO: 5228 - DNA, 21 bp, Artificial Sequence
  Description of Artificial Sequence: Synthetic oligonucleotide
ggaagaaccaaccgcggggga

SEQ ID NO: 5229 - DNA, 21 bp, Artificial Sequence
  Description of Artificial Sequence: Synthetic oligonucleotide
cccgcggttggttcttccttg

SEQ ID NO: 5230 - DNA, 21 bp, Artificial Sequence
  Description of Artificial Sequence: Synthetic oligonucleotide
aggaagaaccaaccgcggggg

SEQ ID NO: 5231 - DNA, 21 bp, Artificial Sequence
  Description of Artificial Sequence: Synthetic oligonucleotide
ccgcggttggttcttccttgc

SEQ ID NO: 5232 - DNA, 21 bp, Artificial Sequence
  Description of Artificial Sequence: Synthetic oligonucleotide
aaggaagaaccaaccgcgggg

SEQ ID NO: 5233 - DNA, 21 bp, Artificial Sequence
  Description of Artificial Sequence: Synthetic oligonucleotide
cgcggttggttcttccttgct

SEQ ID NO: 5234 - DNA, 21 bp, Artificial Sequence
  Description of Artificial Sequence: Synthetic oligonucleotide
caaggaagaaccaaccgcggg

SEQ ID NO: 5235 - DNA, 21 bp, Artificial Sequence
  Description of Artificial Sequence: Synthetic oligonucleotide
gcggttggttcttccttgctc

SEQ ID NO: 5236 - DNA, 21 bp, Artificial Sequence
  Description of Artificial Sequence: Synthetic oligonucleotide
gcaaggaagaaccaaccgcgg

SEQ ID NO: 5237 - DNA, 21 bp, Artificial Sequence
  Description of Artificial Sequence: Synthetic oligonucleotide
cggttggttcttccttgctct

SEQ ID NO: 5238 - DNA, 21 bp, Artificial Sequence
  Description of Artificial Sequence: Synthetic oligonucleotide
agcaaggaagaaccaaccgcg

SEQ ID NO: 5239 - DNA, 21 bp, Artificial Sequence
  Description of Artificial Sequence: Synthetic oligonucleotide
ggttggttcttccttgctcta

SEQ ID NO: 5240 - DNA, 21 bp, Artificial Sequence
  Description of Artificial Sequence: Synthetic oligonucleotide
gagcaaggaagaaccaaccgc

SEQ ID NO: 5241 - DNA, 21 bp, Artificial Sequence
  Description of Artificial Sequence: Synthetic oligonucleotide
gttggttcttccttgctctac

SEQ ID NO: 5242 - DNA, 21 bp, Artificial Sequence
  Description of Artificial Sequence: Synthetic oligonucleotide
agagcaaggaagaaccaaccg

SEQ ID NO: 5243 - DNA, 21 bp, Artificial Sequence
  Description of Artificial Sequence: Synthetic oligonucleotide
ttggttcttccttgctctact

SEQ ID NO: 5244 - DNA, 21 bp, Artificial Sequence
  Description of Artificial Sequence: Synthetic oligonucleotide
tagagcaaggaagaaccaacc

SEQ ID NO: 5245 - DNA, 21 bp, Artificial Sequence
  Description of Artificial Sequence: Synthetic oligonucleotide
tggttcttccttgctctactc

SEQ ID NO: 5246 - DNA, 21 bp, Artificial Sequence
  Description of Artificial Sequence: Synthetic oligonucleotide
gtagagcaaggaagaaccaac

SEQ ID NO: 5247 - DNA, 21 bp, Artificial Sequence
  Description of Artificial Sequence: Synthetic oligonucleotide
ggttcttccttgctctactca

SEQ ID NO: 5248 - DNA, 21 bp, Artificial Sequence
  Description of Artificial Sequence: Synthetic oligonucleotide
agtagagcaaggaagaaccaa

SEQ ID NO: 5249 - DNA, 21 bp, Artificial Sequence
  Description of Artificial Sequence: Synthetic oligonucleotide
gttcttccttgctctactcaa

SEQ ID NO: 5250 - DNA, 21 bp, Artificial Sequence
  Description of Artificial Sequence: Synthetic oligonucleotide
gagtagagcaaggaagaacca

SEQ ID NO: 5251 - DNA, 21 bp, Artificial Sequence
  Description of Artificial Sequence: Synthetic oligonucleotide
ttcttccttgctctactcaac

SEQ ID NO: 5252 - DNA, 21 bp, Artificial Sequence
  Description of Artificial Sequence: Synthetic oligonucleotide
tgagtagagcaaggaagaacc

SEQ ID NO: 5253 - DNA, 21 bp, Artificial Sequence
  Description of Artificial Sequence: Synthetic oligonucleotide
tcttccttgctctactcaacc

SEQ ID NO: 5254 - DNA, 21 bp, Artificial Sequence
  Description of Artificial Sequence: Synthetic oligonucleotide
ttgagtagagcaaggaagaac

SEQ ID NO: 5255 - DNA, 21 bp, Artificial Sequence
  Description of Artificial Sequence: Synthetic oligonucleotide
cttccttgctctactcaaccc

SEQ ID NO: 5256 - DNA, 21 bp, Artificial Sequence
  Description of Artificial Sequence: Synthetic oligonucleotide
gttgagtagagcaaggaagaa

SEQ ID NO: 5257 - DNA, 21 bp, Artificial Sequence
  Description of Artificial Sequence: Synthetic oligonucleotide
ttccttgctctactcaaccct

SEQ ID NO: 5258 - DNA, 21 bp, Artificial Sequence
  Description of Artificial Sequence: Synthetic oligonucleotide
ggttgagtagagcaaggaaga

SEQ ID NO: 5259 - DNA, 21 bp, Artificial Sequence
  Description of Artificial Sequence: Synthetic oligonucleotide
tccttgctctactcaaccctg

SEQ ID NO: 5260 - DNA, 21 bp, Artificial Sequence
  Description of Artificial Sequence: Synthetic oligonucleotide
gggttgagtagagcaaggaag

SEQ ID NO: 5261 - DNA, 21 bp, Artificial Sequence
  Description of Artificial Sequence: Synthetic oligonucleotide
ccttgctctactcaaccctga

SEQ ID NO: 5262 - DNA, 21 bp, Artificial Sequence
  Description of Artificial Sequence: Synthetic oligonucleotide
agggttgagtagagcaaggaa

SEQ ID NO: 5263 - DNA, 21 bp, Artificial Sequence
  Description of Artificial Sequence: Synthetic oligonucleotide
cttgctctactcaaccctgac

SEQ ID NO: 5264 - DNA, 21 bp, Artificial Sequence
  Description of Artificial Sequence: Synthetic oligonucleotide
cagggttgagtagagcaagga

SEQ ID NO: 5265 - DNA, 21 bp, Artificial Sequence
  Description of Artificial Sequence: Synthetic oligonucleotide
ttgctctactcaaccctgacc

SEQ ID NO: 5266 - DNA, 21 bp, Artificial Sequence
  Description of Artificial Sequence: Synthetic oligonucleotide
tcagggttgagtagagcaagg

SEQ ID NO: 5267 - DNA, 21 bp, Artificial Sequence
  Description of Artificial Sequence: Synthetic oligonucleotide
tgctctactcaaccctgacct

SEQ ID NO: 5268 - DNA, 21 bp, Artificial Sequence
  Description of Artificial Sequence: Synthetic oligonucleotide
gtcagggttgagtagagcaag

SEQ ID NO: 5269 - DNA, 21 bp, Artificial Sequence
  Description of Artificial Sequence: Synthetic oligonucleotide
gctctactcaaccctgacctc

SEQ ID NO: 5270 - DNA, 21 bp, Artificial Sequence
  Description of Artificial Sequence: Synthetic oligonucleotide
ggtcagggttgagtagagcaa

SEQ ID NO: 5271 - DNA, 21 bp, Artificial Sequence
  Description of Artificial Sequence: Synthetic oligonucleotide
ctctactcaaccctgacctct

SEQ ID NO: 5272 - DNA, 21 bp, Artificial Sequence
  Description of Artificial Sequence: Synthetic oligonucleotide
aggtcagggttgagtagagca

SEQ ID NO: 5273 - DNA, 21 bp, Artificial Sequence
  Description of Artificial Sequence: Synthetic oligonucleotide
tctactcaaccctgacctctt

SEQ ID NO: 5274 - DNA, 21 bp, Artificial Sequence
  Description of Artificial Sequence: Synthetic oligonucleotide
gaggtcagggttgagtagagc

SEQ ID NO: 5275 - DNA, 21 bp, Artificial Sequence
  Description of Artificial Sequence: Synthetic oligonucleotide
ctactcaaccctgacctcttc

SEQ ID NO: 5276 - DNA, 21 bp, Artificial Sequence
  Description of Artificial Sequence: Synthetic oligonucleotide
agaggtcagggttgagtagag

SEQ ID NO: 5277 - DNA, 21 bp, Artificial Sequence
  Description of Artificial Sequence: Synthetic oligonucleotide
tactcaaccctgacctcttct

SEQ ID NO: 5278 - DNA, 21 bp, Artificial Sequence
  Description of Artificial Sequence: Synthetic oligonucleotide
aagaggtcagggttgagtaga

SEQ ID NO: 5279 - DNA, 21 bp, Artificial Sequence
  Description of Artificial Sequence: Synthetic oligonucleotide
actcaaccctgacctcttctc

SEQ ID NO: 5280 - DNA, 21 bp, Artificial Sequence
  Description of Artificial Sequence: Synthetic oligonucleotide
gaagaggtcagggttgagtag

SEQ ID NO: 5281 - DNA, 21 bp, Artificial Sequence
  Description of Artificial Sequence: Synthetic oligonucleotide
ctcaaccctgacctcttctct

SEQ ID NO: 5282 - DNA, 21 bp, Artificial Sequence
  Description of Artificial Sequence: Synthetic oligonucleotide
agaagaggtcagggttgagta

SEQ ID NO: 5283 - DNA, 21 bp, Artificial Sequence
  Description of Artificial Sequence: Synthetic oligonucleotide
tcaaccctgacctcttctctc

SEQ ID NO: 5284 - DNA, 21 bp, Artificial Sequence
  Description of Artificial Sequence: Synthetic oligonucleotide
gagaagaggtcagggttgagt

SEQ ID NO: 5285 - DNA, 21 bp, Artificial Sequence
  Description of Artificial Sequence: Synthetic oligonucleotide
caaccctgacctcttctctct

SEQ ID NO: 5286 - DNA, 21 bp, Artificial Sequence
  Description of Artificial Sequence: Synthetic oligonucleotide
agagaagaggtcagggttgag

SEQ ID NO: 5287 - DNA, 21 bp, Artificial Sequence
  Description of Artificial Sequence: Synthetic oligonucleotide
aaccctgacctcttctctctg

SEQ ID NO: 5288 - DNA, 21 bp, Artificial Sequence
  Description of Artificial Sequence: Synthetic oligonucleotide
gagagaagaggtcagggttga

SEQ ID NO: 5289 - DNA, 21 bp, Artificial Sequence
  Description of Artificial Sequence: Synthetic oligonucleotide
accctgacctcttctctctga

SEQ ID NO: 5290 - DNA, 21 bp, Artificial Sequence
  Description of Artificial Sequence: Synthetic oligonucleotide
agagagaagaggtcagggttg

SEQ ID NO: 5291 - DNA, 21 bp, Artificial Sequence
  Description of Artificial Sequence: Synthetic oligonucleotide
ccctgacctcttctctctgac

SEQ ID NO: 5292 - DNA, 21 bp, Artificial Sequence
  Description of Artificial Sequence: Synthetic oligonucleotide
cagagagaagaggtcagggtt

SEQ ID NO: 5293 - DNA, 21 bp, Artificial Sequence
  Description of Artificial Sequence: Synthetic oligonucleotide
cctgacctcttctctctgact

SEQ ID NO: 5294 - DNA, 21 bp, Artificial Sequence
  Description of Artificial Sequence: Synthetic oligonucleotide
tcagagagaagaggtcagggt

SEQ ID NO: 5295 - DNA, 21 bp, Artificial Sequence
  Description of Artificial Sequence: Synthetic oligonucleotide
ctgacctcttctctctgactc

SEQ ID NO: 5296 - DNA, 21 bp, Artificial Sequence
  Description of Artificial Sequence: Synthetic oligonucleotide
gtcagagagaagaggtcaggg

SEQ ID NO: 5297 - DNA, 21 bp, Artificial Sequence
  Description of Artificial Sequence: Synthetic oligonucleotide
tgacctcttctctctgactct

SEQ ID NO: 5298 - DNA, 21 bp, Artificial Sequence
  Description of Artificial Sequence: Synthetic oligonucleotide
agtcagagagaagaggtcagg

SEQ ID NO: 5299 - DNA, 21 bp, Artificial Sequence
  Description of Artificial Sequence: Synthetic oligonucleotide
gacctcttctctctgactctc

SEQ ID NO: 5300 - DNA, 21 bp, Artificial Sequence
  Description of Artificial Sequence: Synthetic oligonucleotide
gagtcagagagaagaggtcag

SEQ ID NO: 5301 - DNA, 21 bp, Artificial Sequence
  Description of Artificial Sequence: Synthetic oligonucleotide
acctcttctctctgactctcg

SEQ ID NO: 5302 - DNA, 21 bp, Artificial Sequence
  Description of Artificial Sequence: Synthetic oligonucleotide
agagtcagagagaagaggtca

SEQ ID NO: 5303 - DNA, 21 bp, Artificial Sequence
  Description of Artificial Sequence: Synthetic oligonucleotide
cctcttctctctgactctcga

SEQ ID NO: 5304 - DNA, 21 bp, Artificial Sequence
  Description of Artificial Sequence: Synthetic oligonucleotide
gagagtcagagagaagaggtc

SEQ ID NO: 5305 - DNA, 21 bp, Artificial Sequence
  Description of Artificial Sequence: Synthetic oligonucleotide
ctcttctctctgactctcgac

SEQ ID NO: 5306 - DNA, 21 bp, Artificial Sequence
  Description of Artificial Sequence: Synthetic oligonucleotide
cgagagtcagagagaagaggt

SEQ ID NO: 5307 - DNA, 21 bp, Artificial Sequence
  Description of Artificial Sequence: Synthetic oligonucleotide
tcttctctctgactctcgact

SEQ ID NO: 5308 - DNA, 21 bp, Artificial Sequence
  Description of Artificial Sequence: Synthetic oligonucleotide
tcgagagtcagagagaagagg

SEQ ID NO: 5309 - DNA, 21 bp, Artificial Sequence
  Description of Artificial Sequence: Synthetic oligonucleotide
cttctctctgactctcgactt

SEQ ID NO: 5310 - DNA, 21 bp, Artificial Sequence
  Description of Artificial Sequence: Synthetic oligonucleotide
gtcgagagtcagagagaagag

SEQ ID NO: 5311 - DNA, 21 bp, Artificial Sequence
  Description of Artificial Sequence: Synthetic oligonucleotide
ttctctctgactctcgacttg

SEQ ID NO: 5312 - DNA, 21 bp, Artificial Sequence
  Description of Artificial Sequence: Synthetic oligonucleotide
agtcgagagtcagagagaaga

SEQ ID NO: 5313 - DNA, 21 bp, Artificial Sequence
  Description of Artificial Sequence: Synthetic oligonucleotide
tctctctgactctcgacttgt

SEQ ID NO: 5314 - DNA, 21 bp, Artificial Sequence
  Description of Artificial Sequence: Synthetic oligonucleotide
aagtcgagagtcagagagaag

SEQ ID NO: 5315 - DNA, 21 bp, Artificial Sequence
  Description of Artificial Sequence: Synthetic oligonucleotide
ctctctgactctcgacttgtg

SEQ ID NO: 5316 - DNA, 21 bp, Artificial Sequence
  Description of Artificial Sequence: Synthetic oligonucleotide
caagtcgagagtcagagagaa

SEQ ID NO: 5317 - DNA, 21 bp, Artificial Sequence
  Description of Artificial Sequence: Synthetic oligonucleotide
tctctgactctcgacttgtgt

SEQ ID NO: 5318 - DNA, 21 bp, Artificial Sequence
  Description of Artificial Sequence: Synthetic oligonucleotide
acaagtcgagagtcagagaga

SEQ ID NO: 5319 - DNA, 21 bp, Artificial Sequence
  Description of Artificial Sequence: Synthetic oligonucleotide
ctctgactctcgacttgtgtt

SEQ ID NO: 5320 - DNA, 21 bp, Artificial Sequence
  Description of Artificial Sequence: Synthetic oligonucleotide
cacaagtcgagagtcagagag

SEQ ID NO: 5321 - DNA, 21 bp, Artificial Sequence
  Description of Artificial Sequence: Synthetic oligonucleotide
tctgactctcgacttgtgttc

SEQ ID NO: 5322 - DNA, 21 bp, Artificial Sequence
  Description of Artificial Sequence: Synthetic oligonucleotide
acacaagtcgagagtcagaga

SEQ ID NO: 5323 - DNA, 21 bp, Artificial Sequence
  Description of Artificial Sequence: Synthetic oligonucleotide
ctgactctcgacttgtgttcc

SEQ ID NO: 5324 - DNA, 21 bp, Artificial Sequence
  Description of Artificial Sequence: Synthetic oligonucleotide
aacacaagtcgagagtcagag

SEQ ID NO: 5325 - DNA, 21 bp, Artificial Sequence
  Description of Artificial Sequence: Synthetic oligonucleotide
tgactctcgacttgtgttccc

SEQ ID NO: 5326 - DNA, 21 bp, Artificial Sequence
  Description of Artificial Sequence: Synthetic oligonucleotide
gaacacaagtcgagagtcaga

SEQ ID NO: 5327 - DNA, 21 bp, Artificial Sequence
  Description of Artificial Sequence: Synthetic oligonucleotide
gactctcgacttgtgttcccc

SEQ ID NO: 5328 - DNA, 21 bp, Artificial Sequence
  Description of Artificial Sequence: Synthetic oligonucleotide
ggaacacaagtcgagagtcag

SEQ ID NO: 5329 - DNA, 21 bp, Artificial Sequence
  Description of Artificial Sequence: Synthetic oligonucleotide
actctcgacttgtgttccccg

SEQ ID NO: 5330 - DNA, 21 bp, Artificial Sequence
  Description of Artificial Sequence: Synthetic oligonucleotide
gggaacacaagtcgagagtca

SEQ ID NO: 5331 - DNA, 21 bp, Artificial Sequence
  Description of Artificial Sequence: Synthetic oligonucleotide
ctctcgacttgtgttccccgc

SEQ ID NO: 5332 - DNA, 21 bp, Artificial Sequence
  Description of Artificial Sequence: Synthetic oligonucleotide
ggggaacacaagtcgagagtc

SEQ ID NO: 5333 - DNA, 21 bp, Artificial Sequence
  Description of Artificial Sequence: Synthetic oligonucleotide
tctcgacttgtgttccccgct

SEQ ID NO: 5334 - DNA, 21 bp, Artificial Sequence
  Description of Artificial Sequence: Synthetic oligonucleotide
cggggaacacaagtcgagagt

SEQ ID NO: 5335 - DNA, 21 bp, Artificial Sequence
  Description of Artificial Sequence: Synthetic oligonucleotide
ctcgacttgtgttccccgctc

SEQ ID NO: 5336 - DNA, 21 bp, Artificial Sequence
  Description of Artificial Sequence: Synthetic oligonucleotide
gcggggaacacaagtcgagag

SEQ ID NO: 5337 - DNA, 21 bp, Artificial Sequence
  Description of Artificial Sequence: Synthetic oligonucleotide
tcgacttgtgttccccgctcc

SEQ ID NO: 5338 - DNA, 21 bp, Artificial Sequence
  Description of Artificial Sequence: Synthetic oligonucleotide
agcggggaacacaagtcgaga

SEQ ID NO: 5339 - DNA, 21 bp, Artificial Sequence
  Description of Artificial Sequence: Synthetic oligonucleotide
cgacttgtgttccccgctcct

SEQ ID NO: 5340 - DNA, 21 bp, Artificial Sequence
  Description of Artificial Sequence: Synthetic oligonucleotide
gagcggggaacacaagtcgag

SEQ ID NO: 5341 - DNA, 21 bp, Artificial Sequence
  Description of Artificial Sequence: Synthetic oligonucleotide
gacttgtgttccccgctcctc

SEQ ID NO: 5342 - DNA, 21 bp, Artificial Sequence
  Description of Artificial Sequence: Synthetic oligonucleotide
ggagcggggaacacaagtcga

SEQ ID NO: 5343 - DNA, 21 bp, Artificial Sequence
  Description of Artificial Sequence: Synthetic oligonucleotide
acttgtgttccccgctcctcc

SEQ ID NO: 5344 - DNA, 21 bp, Artificial Sequence
  Description of Artificial Sequence: Synthetic oligonucleotide
aggagcggggaacacaagtcg

SEQ ID NO: 5345 - DNA, 21 bp, Artificial Sequence
  Description of Artificial Sequence: Synthetic oligonucleotide
cttgtgttccccgctcctccc

SEQ ID NO: 5346 - DNA, 21 bp, Artificial Sequence
  Description of Artificial Sequence: Synthetic oligonucleotide
gaggagcggggaacacaagtc

SEQ ID NO: 5347 - DNA, 21 bp, Artificial Sequence
  Description of Artificial Sequence: Synthetic oligonucleotide
ttgtgttccccgctcctccct

SEQ ID NO: 5348 - DNA, 21 bp, Artificial Sequence
  Description of Artificial Sequence: Synthetic oligonucleotide
ggaggagcggggaacacaagt

SEQ ID NO: 5349 - DNA, 21 bp, Artificial Sequence
  Description of Artificial Sequence: Synthetic oligonucleotide
tgtgttccccgctcctccctg

SEQ ID NO: 5350 - DNA, 21 bp, Artificial Sequence
  Description of Artificial Sequence: Synthetic oligonucleotide
gggaggagcggggaacacaag

SEQ ID NO: 5351 - DNA, 21 bp, Artificial Sequence
  Description of Artificial Sequence: Synthetic oligonucleotide
gtgttccccgctcctccctga

SEQ ID NO: 5352 - DNA, 21 bp, Artificial Sequence
  Description of Artificial Sequence: Synthetic oligonucleotide
agggaggagcggggaacacaa

SEQ ID NO: 5353 - DNA, 21 bp, Artificial Sequence
  Description of Artificial Sequence: Synthetic oligonucleotide
tgttccccgctcctccctgac

SEQ ID NO: 5354 - DNA, 21 bp, Artificial Sequence
  Description of Artificial Sequence: Synthetic oligonucleotide
cagggaggagcggggaacaca

SEQ ID NO: 5355 - DNA, 21 bp, Artificial Sequence
  Description of Artificial Sequence: Synthetic oligonucleotide
gttccccgctcctccctgacc

SEQ ID NO: 5356 - DNA, 21 bp, Artificial Sequence
  Description of Artificial Sequence: Synthetic oligonucleotide
tcagggaggagcggggaacac

SEQ ID NO: 5357 - DNA, 21 bp, Artificial Sequence
  Description of Artificial Sequence: Synthetic oligonucleotide
ttccccgctcctccctgacct

SEQ ID NO: 5358 - DNA, 21 bp, Artificial Sequence
  Description of Artificial Sequence: Synthetic oligonucleotide
gtcagggaggagcggggaaca

SEQ ID NO: 5359 - DNA, 21 bp, Artificial Sequence
  Description of Artificial Sequence: Synthetic oligonucleotide
tccccgctcctccctgacctt

SEQ ID NO: 5360 - DNA, 21 bp, Artificial Sequence
  Description of Artificial Sequence: Synthetic oligonucleotide
ggtcagggaggagcggggaac

SEQ ID NO: 5361 - DNA, 21 bp, Artificial Sequence
  Description of Artificial Sequence: Synthetic oligonucleotide
ccccgctcctccctgaccttc

SEQ ID NO: 5362 - DNA, 21 bp, Artificial Sequence
  Description of Artificial Sequence: Synthetic oligonucleotide
aggtcagggaggagcggggaa

SEQ ID NO: 5363 - DNA, 21 bp, Artificial Sequence
  Description of Artificial Sequence: Synthetic oligonucleotide
cccgctcctccctgaccttcc

SEQ ID NO: 5364 - DNA, 21 bp, Artificial Sequence
  Description of Artificial Sequence: Synthetic oligonucleotide
aaggtcagggaggagcgggga

SEQ ID NO: 5365 - DNA, 21 bp, Artificial Sequence
  Description of Artificial Sequence: Synthetic oligonucleotide
ccgctcctccctgaccttcct

SEQ ID NO: 5366 - DNA, 21 bp, Artificial Sequence
  Description of Artificial Sequence: Synthetic oligonucleotide
gaaggtcagggaggagcgggg

SEQ ID NO: 5367 - DNA, 21 bp, Artificial Sequence
  Description of Artificial Sequence: Synthetic oligonucleotide
cgctcctccctgaccttcctc

SEQ ID NO: 5368 - DNA, 21 bp, Artificial Sequence
  Description of Artificial Sequence: Synthetic oligonucleotide
ggaaggtcagggaggagcggg

SEQ ID NO: 5369 - DNA, 21 bp, Artificial Sequence
  Description of Artificial Sequence: Synthetic oligonucleotide
gctcctccctgaccttcctcc

SEQ ID NO: 5370 - DNA, 21 bp, Artificial Sequence
  Description of Artificial Sequence: Synthetic oligonucleotide
aggaaggtcagggaggagcgg

SEQ ID NO: 5371 - DNA, 21 bp, Artificial Sequence
  Description of Artificial Sequence: Synthetic oligonucleotide
ctcctccctgaccttcctccc

SEQ ID NO: 5372 - DNA, 21 bp, Artificial Sequence
  Description of Artificial Sequence: Synthetic oligonucleotide
gaggaaggtcagggaggagcg

SEQ ID NO: 5373 - DNA, 21 bp, Artificial Sequence
  Description of Artificial Sequence: Synthetic oligonucleotide
tcctccctgaccttcctcccc

SEQ ID NO: 5374 - DNA, 21 bp, Artificial Sequence
  Description of Artificial Sequence: Synthetic oligonucleotide
ggaggaaggtcagggaggagc

SEQ ID NO: 5375 - DNA, 21 bp, Artificial Sequence
  Description of Artificial Sequence: Synthetic oligonucleotide
cctccctgaccttcctcccct

SEQ ID NO: 5376 - DNA, 21 bp, Artificial Sequence
  Description of Artificial Sequence: Synthetic oligonucleotide
gggaggaaggtcagggaggag

SEQ ID NO: 5377 - DNA, 21 bp, Artificial Sequence
  Description of Artificial Sequence: Synthetic oligonucleotide
ctccctgaccttcctcccctc

SEQ ID NO: 5378 - DNA, 21 bp, Artificial Sequence
  Description of Artificial Sequence: Synthetic oligonucleotide
ggggaggaaggtcagggagga

SEQ ID NO: 5379 - DNA, 21 bp, Artificial Sequence
  Description of Artificial Sequence: Synthetic oligonucleotide
tccctgaccttcctcccctcc

SEQ ID NO: 5380 - DNA, 21 bp, Artificial Sequence
  Description of Artificial Sequence: Synthetic oligonucleotide
aggggaggaaggtcagggagg

SEQ ID NO: 5381 - DNA, 21 bp, Artificial Sequence
  Description of Artificial Sequence: Synthetic oligonucleotide
ccctgaccttcctcccctccc

SEQ ID NO: 5382 - DNA, 21 bp, Artificial Sequence
  Description of Artificial Sequence: Synthetic oligonucleotide
gaggggaggaaggtcagggag

SEQ ID NO: 5383 - DNA, 21 bp, Artificial Sequence
  Description of Artificial Sequence: Synthetic oligonucleotide
cctgaccttcctcccctcccc

SEQ ID NO: 5384 - DNA, 21 bp, Artificial Sequence
  Description of Artificial Sequence: Synthetic oligonucleotide
ggaggggaggaaggtcaggga

SEQ ID NO: 5385 - DNA, 21 bp, Artificial Sequence
  Description of Artificial Sequence: Synthetic oligonucleotide
ctgaccttcctcccctcccct

SEQ ID NO: 5386 - DNA, 21 bp, Artificial Sequence
  Description of Artificial Sequence: Synthetic oligonucleotide
gggaggggaggaaggtcaggg

SEQ ID NO: 5387 - DNA, 21 bp, Artificial Sequence
  Description of Artificial Sequence: Synthetic oligonucleotide
tgaccttcctcccctcccctt

SEQ ID NO: 5388 - DNA, 21 bp, Artificial Sequence
  Description of Artificial Sequence: Synthetic oligonucleotide
ggggaggggaggaaggtcagg

SEQ ID NO: 5389 - DNA, 21 bp, Artificial Sequence
  Description of Artificial Sequence: Synthetic oligonucleotide
gaccttcctcccctccccttt

SEQ ID NO: 5390 - DNA, 21 bp, Artificial Sequence
  Description of Artificial Sequence: Synthetic oligonucleotide
aggggaggggaggaaggtcag

SEQ ID NO: 5391 - DNA, 21 bp, Artificial Sequence
  Description of Artificial Sequence: Synthetic oligonucleotide
accttcctcccctcccctttc

SEQ ID NO: 5392 - DNA, 21 bp, Artificial Sequence
  Description of Artificial Sequence: Synthetic oligonucleotide
aaggggaggggaggaaggtca

SEQ ID NO: 5393 - DNA, 21 bp, Artificial Sequence
  Description of Artificial Sequence: Synthetic oligonucleotide
ccttcctcccctcccctttca

SEQ ID NO: 5394 - DNA, 21 bp, Artificial Sequence
  Description of Artificial Sequence: Synthetic oligonucleotide
aaaggggaggggaggaaggtc

SEQ ID NO: 5395 - DNA, 21 bp, Artificial Sequence
  Description of Artificial Sequence: Synthetic oligonucleotide
cttcctcccctcccctttcac

SEQ ID NO: 5396 - DNA, 21 bp, Artificial Sequence
  Description of Artificial Sequence: Synthetic oligonucleotide
gaaaggggaggggaggaaggt

SEQ ID NO: 5397 - DNA, 21 bp, Artificial Sequence
  Description of Artificial Sequence: Synthetic oligonucleotide
ttcctcccctcccctttcact

SEQ ID NO: 5398 - DNA, 21 bp, Artificial Sequence
  Description of Artificial Sequence: Synthetic oligonucleotide
tgaaaggggaggggaggaagg

SEQ ID NO: 5399 - DNA, 21 bp, Artificial Sequence
  Description of Artificial Sequence: Synthetic oligonucleotide
tcctcccctcccctttcactc

SEQ ID NO: 5400 - DNA, 21 bp, Artificial Sequence
  Description of Artificial Sequence: Synthetic oligonucleotide
gtgaaaggggaggggaggaag

SEQ ID NO: 5401 - DNA, 21 bp, Artificial Sequence
  Description of Artificial Sequence: Synthetic oligonucleotide
cctcccctcccctttcactca

SEQ ID NO: 5402 - DNA, 21 bp, Artificial Sequence
  Description of Artificial Sequence: Synthetic oligonucleotide
agtgaaaggggaggggaggaa

SEQ ID NO: 5403 - DNA, 21 bp, Artificial Sequence
  Description of Artificial Sequence: Synthetic oligonucleotide
ctcccctcccctttcactcaa

SEQ ID NO: 5404 - DNA, 21 bp, Artificial Sequence
  Description of Artificial Sequence: Synthetic oligonucleotide
gagtgaaaggggaggggagga

SEQ ID NO: 5405 - DNA, 21 bp, Artificial Sequence
  Description of Artificial Sequence: Synthetic oligonucleotide
tcccctcccctttcactcaat

SEQ ID NO: 5406 - DNA, 21 bp, Artificial Sequence
  Description of Artificial Sequence: Synthetic oligonucleotide
tgagtgaaaggggaggggagg

SEQ ID NO: 5407 - DNA, 21 bp, Artificial Sequence
  Description of Artificial Sequence: Synthetic oligonucleotide
cccctcccctttcactcaatt

SEQ ID NO: 5408 - DNA, 21 bp, Artificial Sequence
  Description of Artificial Sequence: Synthetic oligonucleotide
ttgagtgaaaggggaggggag

SEQ ID NO: 5409 - DNA, 21 bp, Artificial Sequence
  Description of Artificial Sequence: Synthetic oligonucleotide
ccctcccctttcactcaattc

SEQ ID NO: 5410 - DNA, 21 bp, Artificial Sequence
  Description of Artificial Sequence: Synthetic oligonucleotide
attgagtgaaaggggagggga

SEQ ID NO: 5411 - DNA, 21 bp, Artificial Sequence
  Description of Artificial Sequence: Synthetic oligonucleotide
cctcccctttcactcaattct

SEQ ID NO: 5412 - DNA, 21 bp, Artificial Sequence
  Description of Artificial Sequence: Synthetic oligonucleotide
aattgagtgaaaggggagggg

SEQ ID NO: 5413 - DNA, 21 bp, Artificial Sequence
  Description of Artificial Sequence: Synthetic oligonucleotide
ctcccctttcactcaattctc

SEQ ID NO: 5414 - DNA, 21 bp, Artificial Sequence
  Description of Artificial Sequence: Synthetic oligonucleotide
gaattgagtgaaaggggaggg

SEQ ID NO: 5415 - DNA, 21 bp, Artificial Sequence
  Description of Artificial Sequence: Synthetic oligonucleotide
tcccctttcactcaattctca

SEQ ID NO: 5416 - DNA, 21 bp, Artificial Sequence
  Description of Artificial Sequence: Synthetic oligonucleotide
agaattgagtgaaaggggagg

SEQ ID NO: 5417 - DNA, 21 bp, Artificial Sequence
  Description of Artificial Sequence: Synthetic oligonucleotide
cccctttcactcaattctcac

SEQ ID NO: 5418 - DNA, 21 bp, Artificial Sequence
  Description of Artificial Sequence: Synthetic oligonucleotide
gagaattgagtgaaaggggag

SEQ ID NO: 5419 - DNA, 21 bp, Artificial Sequence
  Description of Artificial Sequence: Synthetic oligonucleotide
ccctttcactcaattctcacc

SEQ ID NO: 5420 - DNA, 21 bp, Artificial Sequence
  Description of Artificial Sequence: Synthetic oligonucleotide
tgagaattgagtgaaagggga

SEQ ID NO: 5421 - DNA, 21 bp, Artificial Sequence
  Description of Artificial Sequence: Synthetic oligonucleotide
cctttcactcaattctcacca

SEQ ID NO: 5422 - DNA, 21 bp, Artificial Sequence
  Description of Artificial Sequence: Synthetic oligonucleotide
gtgagaattgagtgaaagggg

SEQ ID NO: 5423 - DNA, 21 bp, Artificial Sequence
  Description of Artificial Sequence: Synthetic oligonucleotide
ctttcactcaattctcaccaa

SEQ ID NO: 5424 - DNA, 21 bp, Artificial Sequence
  Description of Artificial Sequence: Synthetic oligonucleotide
ggtgagaattgagtgaaaggg

SEQ ID NO: 5425 - DNA, 21 bp, Artificial Sequence
  Description of Artificial Sequence: Synthetic oligonucleotide
tttcactcaattctcaccaac

SEQ ID NO: 5426 - DNA, 21 bp, Artificial Sequence
  Description of Artificial Sequence: Synthetic oligonucleotide
tggtgagaattgagtgaaagg

SEQ ID NO: 5427 - DNA, 21 bp, Artificial Sequence
  Description of Artificial Sequence: Synthetic oligonucleotide
ttcactcaattctcaccaact

SEQ ID NO: 5428 - DNA, 21 bp, Artificial Sequence
  Description of Artificial Sequence: Synthetic oligonucleotide
ttggtgagaattgagtgaaag

SEQ ID NO: 5429 - DNA, 21 bp, Artificial Sequence
  Description of Artificial Sequence: Synthetic oligonucleotide
tcactcaattctcaccaactc

SEQ ID NO: 5430 - DNA, 21 bp, Artificial Sequence
  Description of Artificial Sequence: Synthetic oligonucleotide
gttggtgagaattgagtgaaa

SEQ ID NO: 5431 - DNA, 21 bp, Artificial Sequence
  Description of Artificial Sequence: Synthetic oligonucleotide
cactcaattctcaccaactct

SEQ ID NO: 5432 - DNA, 21 bp, Artificial Sequence
  Description of Artificial Sequence: Synthetic oligonucleotide
agttggtgagaattgagtgaa

SEQ ID NO: 5433 - DNA, 21 bp, Artificial Sequence
  Description of Artificial Sequence: Synthetic oligonucleotide
actcaattctcaccaactctt

SEQ ID NO: 5434 - DNA, 21 bp, Artificial Sequence
  Description of Artificial Sequence: Synthetic oligonucleotide
gagttggtgagaattgagtga

SEQ ID NO: 5435 - DNA, 21 bp, Artificial Sequence
  Description of Artificial Sequence: Synthetic oligonucleotide
ctcaattctcaccaactcttt

SEQ ID NO: 5436 - DNA, 21 bp, Artificial Sequence
  Description of Artificial Sequence: Synthetic oligonucleotide
agagttggtgagaattgagtg

SEQ ID NO: 5437 - DNA, 21 bp, Artificial Sequence
  Description of Artificial Sequence: Synthetic oligonucleotide
tcaattctcaccaactctttc

SEQ ID NO: 5438 - DNA, 21 bp, Artificial Sequence
  Description of Artificial Sequence: Synthetic oligonucleotide
aagagttggtgagaattgagt

SEQ ID NO: 5439 - DNA, 21 bp, Artificial Sequence
  Description of Artificial Sequence: Synthetic oligonucleotide
caattctcaccaactctttct

SEQ ID NO: 5440 - DNA, 21 bp, Artificial Sequence
  Description of Artificial Sequence: Synthetic oligonucleotide
aaagagttggtgagaattgag

SEQ ID NO: 5441 - DNA, 21 bp, Artificial Sequence
  Description of Artificial Sequence: Synthetic oligonucleotide
aattctcaccaactctttctc

SEQ ID NO: 5442 - DNA, 21 bp, Artificial Sequence
  Description of Artificial Sequence: Synthetic oligonucleotide
gaaagagttggtgagaattga

SEQ ID NO: 5443 - DNA, 21 bp, Artificial Sequence
  Description of Artificial Sequence: Synthetic oligonucleotide
attctcaccaactctttctct

SEQ ID NO: 5444 - DNA, 21 bp, Artificial Sequence
  Description of Artificial Sequence: Synthetic oligonucleotide
agaaagagttggtgagaattg

SEQ ID NO: 5445 - DNA, 21 bp, Artificial Sequence
  Description of Artificial Sequence: Synthetic oligonucleotide
ttctcaccaactctttctctc

SEQ ID NO: 5446 - DNA, 21 bp, Artificial Sequence
  Description of Artificial Sequence: Synthetic oligonucleotide
gagaaagagttggtgagaatt

SEQ ID NO: 5447 - DNA, 21 bp, Artificial Sequence
  Description of Artificial Sequence: Synthetic oligonucleotide
tctcaccaactctttctctct

SEQ ID NO: 5448 - DNA, 21 bp, Artificial Sequence
  Description of Artificial Sequence: Synthetic oligonucleotide
agagaaagagttggtgagaat

SEQ ID NO: 5449 - DNA, 21 bp, Artificial Sequence
  Description of Artificial Sequence: Synthetic oligonucleotide
ctcaccaactctttctctctc

SEQ ID NO: 5450 - DNA, 21 bp, Artificial Sequence
  Description of Artificial Sequence: Synthetic oligonucleotide
gagagaaagagttggtgagaa

SEQ ID NO: 5451 - DNA, 21 bp, Artificial Sequence
  Description of Artificial Sequence: Synthetic oligonucleotide
tcaccaactctttctctctct

SEQ ID NO: 5452 - DNA, 21 bp, Artificial Sequence
  Description of Artificial Sequence: Synthetic oligonucleotide
agagagaaagagttggtgaga

SEQ ID NO: 5453 - DNA, 21 bp, Artificial Sequence
  Description of Artificial Sequence: Synthetic oligonucleotide
caccaactctttctctctctg

SEQ ID NO: 5454 - DNA, 21 bp, Artificial Sequence
  Description of Artificial Sequence: Synthetic oligonucleotide
gagagagaaagagttggtgag

SEQ ID NO: 5455 - DNA, 21 bp, Artificial Sequence
  Description of Artificial Sequence: Synthetic oligonucleotide
accaactctttctctctctgg

SEQ ID NO: 5456 - DNA, 21 bp, Artificial Sequence
  Description of Artificial Sequence: Synthetic oligonucleotide
agagagagaaagagttggtga

SEQ ID NO: 5457 - DNA, 21 bp, Artificial Sequence
  Description of Artificial Sequence: Synthetic oligonucleotide
ccaactctttctctctctggt

SEQ ID NO: 5458 - DNA, 21 bp, Artificial Sequence
  Description of Artificial Sequence: Synthetic oligonucleotide
cagagagagaaagagttggtg

SEQ ID NO: 5459 - DNA, 21 bp, Artificial Sequence
  Description of Artificial Sequence: Synthetic oligonucleotide
caactctttctctctctggtg

SEQ ID NO: 5460 - DNA, 21 bp, Artificial Sequence
  Description of Artificial Sequence: Synthetic oligonucleotide
ccagagagagaaagagttggt

SEQ ID NO: 5461 - DNA, 21 bp, Artificial Sequence
  Description of Artificial Sequence: Synthetic oligonucleotide
aactctttctctctctggtgt

SEQ ID NO: 5462 - DNA, 21 bp, Artificial Sequence
  Description of Artificial Sequence: Synthetic oligonucleotide
accagagagagaaagagttgg

SEQ ID NO: 5463 - DNA, 21 bp, Artificial Sequence
  Description of Artificial Sequence: Synthetic oligonucleotide
actctttctctctctggtgtt

SEQ ID NO: 5464 - DNA, 21 bp, Artificial Sequence
  Description of Artificial Sequence: Synthetic oligonucleotide
caccagagagagaaagagttg

SEQ ID NO: 5465 - DNA, 21 bp, Artificial Sequence
  Description of Artificial Sequence: Synthetic oligonucleotide
ctctttctctctctggtgttt

SEQ ID NO: 5466 - DNA, 21 bp, Artificial Sequence
  Description of Artificial Sequence: Synthetic oligonucleotide
acaccagagagagaaagagtt

SEQ ID NO: 5467 - DNA, 21 bp, Artificial Sequence
  Description of Artificial Sequence: Synthetic oligonucleotide
tctttctctctctggtgtttt

SEQ ID NO: 5468 - DNA, 21 bp, Artificial Sequence
  Description of Artificial Sequence: Synthetic oligonucleotide
aacaccagagagagaaagagt

SEQ ID NO: 5469 - DNA, 21 bp, Artificial Sequence
  Description of Artificial Sequence: Synthetic oligonucleotide
ctttctctctctggtgttttc

SEQ ID NO: 5470 - DNA, 21 bp, Artificial Sequence
  Description of Artificial Sequence: Synthetic oligonucleotide
aaacaccagagagagaaagag

SEQ ID NO: 5471 - DNA, 21 bp, Artificial Sequence
  Description of Artificial Sequence: Synthetic oligonucleotide
tttctctctctggtgttttct

SEQ ID NO: 5472 - DNA, 21 bp, Artificial Sequence
  Description of Artificial Sequence: Synthetic oligonucleotide
aaaacaccagagagagaaaga

SEQ ID NO: 5473 - DNA, 21 bp, Artificial Sequence
  Description of Artificial Sequence: Synthetic oligonucleotide
ttctctctctggtgttttctc

SEQ ID NO: 5474 - DNA, 21 bp, Artificial Sequence
  Description of Artificial Sequence: Synthetic oligonucleotide
gaaaacaccagagagagaaag

SEQ ID NO: 5475 - DNA, 21 bp, Artificial Sequence
  Description of Artificial Sequence: Synthetic oligonucleotide
tctctctctggtgttttctcc

SEQ ID NO: 5476 - DNA, 21 bp, Artificial Sequence
  Description of Artificial Sequence: Synthetic oligonucleotide
agaaaacaccagagagagaaa

SEQ ID NO: 5477 - DNA, 21 bp, Artificial Sequence
  Description of Artificial Sequence: Synthetic oligonucleotide
ctctctctggtgttttctcct

SEQ ID NO: 5478 - DNA, 21 bp, Artificial Sequence
  Description of Artificial Sequence: Synthetic oligonucleotide
gagaaaacaccagagagagaa

SEQ ID NO: 5479 - DNA, 21 bp, Artificial Sequence
  Description of Artificial Sequence: Synthetic oligonucleotide
tctctctggtgttttctcctt

SEQ ID NO: 5480 - DNA, 21 bp, Artificial Sequence
  Description of Artificial Sequence: Synthetic oligonucleotide
ggagaaaacaccagagagaga

SEQ ID NO: 5481 - DNA, 21 bp, Artificial Sequence
  Description of Artificial Sequence: Synthetic oligonucleotide
ctctctggtgttttctccttt

SEQ ID NO: 5482 - DNA, 21 bp, Artificial Sequence
  Description of Artificial Sequence: Synthetic oligonucleotide
aggagaaaacaccagagagag

SEQ ID NO: 5483 - DNA, 21 bp, Artificial Sequence
  Description of Artificial Sequence: Synthetic oligonucleotide
tctctggtgttttctcctttt

SEQ ID NO: 5484 - DNA, 21 bp, Artificial Sequence
  Description of Artificial Sequence: Synthetic oligonucleotide
aaggagaaaacaccagagaga

SEQ ID NO: 5485 - DNA, 21 bp, Artificial Sequence
  Description of Artificial Sequence: Synthetic oligonucleotide
ctctggtgttttctccttttc

SEQ ID NO: 5486 - DNA, 21 bp, Artificial Sequence
  Description of Artificial Sequence: Synthetic oligonucleotide
aaaggagaaaacaccagagag

SEQ ID NO: 5487 - DNA, 21 bp, Artificial Sequence
  Description of Artificial Sequence: Synthetic oligonucleotide
tctggtgttttctccttttct

SEQ ID NO: 5488 - DNA, 21 bp, Artificial Sequence
  Description of Artificial Sequence: Synthetic oligonucleotide
aaaaggagaaaacaccagaga

SEQ ID NO: 5489 - DNA, 21 bp, Artificial Sequence
  Description of Artificial Sequence: Synthetic oligonucleotide
ctggtgttttctccttttctc

SEQ ID NO: 5490 - DNA, 21 bp, Artificial Sequence
  Description of Artificial Sequence: Synthetic oligonucleotide
gaaaaggagaaaacaccagag

SEQ ID NO: 5491 - DNA, 21 bp, Artificial Sequence
  Description of Artificial Sequence: Synthetic oligonucleotide
tggtgttttctccttttctcg

SEQ ID NO: 5492 - DNA, 21 bp, Artificial Sequence
  Description of Artificial Sequence: Synthetic oligonucleotide
agaaaaggagaaaacaccaga

SEQ ID NO: 5493 - DNA, 21 bp, Artificial Sequence
  Description of Artificial Sequence: Synthetic oligonucleotide
ggtgttttctccttttctcgt

SEQ ID NO: 5494 - DNA, 21 bp, Artificial Sequence
  Description of Artificial Sequence: Synthetic oligonucleotide
gagaaaaggagaaaacaccag

SEQ ID NO: 5495 - DNA, 21 bp, Artificial Sequence
  Description of Artificial Sequence: Synthetic oligonucleotide
gtgttttctccttttctcgta

SEQ ID NO: 5496 - DNA, 21 bp, Artificial Sequence
  Description of Artificial Sequence: Synthetic oligonucleotide
cgagaaaaggagaaaacacca

SEQ ID NO: 5497 - DNA, 21 bp, Artificial Sequence
  Description of Artificial Sequence: Synthetic oligonucleotide
tgttttctccttttctcgtaa

SEQ ID NO: 5498 - DNA, 21 bp, Artificial Sequence
  Description of Artificial Sequence: Synthetic oligonucleotide
acgagaaaaggagaaaacacc

SEQ ID NO: 5499 - DNA, 21 bp, Artificial Sequence
  Description of Artificial Sequence: Synthetic oligonucleotide
gttttctccttttctcgtaaa

SEQ ID NO: 5500 - DNA, 21 bp, Artificial Sequence
  Description of Artificial Sequence: Synthetic oligonucleotide
tacgagaaaaggagaaaacac

SEQ ID NO: 5501 - DNA, 21 bp, Artificial Sequence
  Description of Artificial Sequence: Synthetic oligonucleotide
ttttctccttttctcgtaaac

SEQ ID NO: 5502 - DNA, 21 bp, Artificial Sequence
  Description of Artificial Sequence: Synthetic oligonucleotide
ttacgagaaaaggagaaaaca

SEQ ID NO: 5503 - DNA, 21 bp, Artificial Sequence
  Description of Artificial Sequence: Synthetic oligonucleotide
tttctccttttctcgtaaact

SEQ ID NO: 5504 - DNA, 21 bp, Artificial Sequence
  Description of Artificial Sequence: Synthetic oligonucleotide
tttacgagaaaaggagaaaac

SEQ ID NO: 5505 - DNA, 21 bp, Artificial Sequence
  Description of Artificial Sequence: Synthetic oligonucleotide
ttctccttttctcgtaaactt

SEQ ID NO: 5506 - DNA, 21 bp, Artificial Sequence
  Description of Artificial Sequence: Synthetic oligonucleotide
gtttacgagaaaaggagaaaa

SEQ ID NO: 5507 - DNA, 21 bp, Artificial Sequence
  Description of Artificial Sequence: Synthetic oligonucleotide
tctccttttctcgtaaacttt

SEQ ID NO: 5508 - DNA, 21 bp, Artificial Sequence
  Description of Artificial Sequence: Synthetic oligonucleotide
agtttacgagaaaaggagaaa

SEQ ID NO: 5509 - DNA, 21 bp, Artificial Sequence
  Description of Artificial Sequence: Synthetic oligonucleotide
ctccttttctcgtaaactttg

SEQ ID NO: 5510 - DNA, 21 bp, Artificial Sequence
  Description of Artificial Sequence: Synthetic oligonucleotide
aagtttacgagaaaaggagaa

SEQ ID NO: 5511 - DNA, 21 bp, Artificial Sequence
  Description of Artificial Sequence: Synthetic oligonucleotide
tccttttctcgtaaactttgc

SEQ ID NO: 5512 - DNA, 21 bp, Artificial Sequence
  Description of Artificial Sequence: Synthetic oligonucleotide
aaagtttacgagaaaaggaga

SEQ ID NO: 5513 - DNA, 21 bp, Artificial Sequence
  Description of Artificial Sequence: Synthetic oligonucleotide
ccttttctcgtaaactttgcc

SEQ ID NO: 5514 - DNA, 21 bp, Artificial Sequence
  Description of Artificial Sequence: Synthetic oligonucleotide
caaagtttacgagaaaaggag

SEQ ID NO: 5515 - DNA, 21 bp, Artificial Sequence
  Description of Artificial Sequence: Synthetic oligonucleotide
cttttctcgtaaactttgccg

SEQ ID NO: 5516 - DNA, 21 bp, Artificial Sequence
  Description of Artificial Sequence: Synthetic oligonucleotide
gcaaagtttacgagaaaagga

SEQ ID NO: 5517 - DNA, 21 bp, Artificial Sequence
  Description of Artificial Sequence: Synthetic oligonucleotide
ttttctcgtaaactttgccgc

SEQ ID NO: 5518 - DNA, 21 bp, Artificial Sequence
  Description of Artificial Sequence: Synthetic oligonucleotide
ggcaaagtttacgagaaaagg

SEQ ID NO: 5519 - DNA, 21 bp, Artificial Sequence
  Description of Artificial Sequence: Synthetic oligonucleotide
tttctcgtaaactttgccgcc

SEQ ID NO: 5520 - DNA, 21 bp, Artificial Sequence
  Description of Artificial Sequence: Synthetic oligonucleotide
cggcaaagtttacgagaaaag

SEQ ID NO: 5521 - DNA, 21 bp, Artificial Sequence
  Description of Artificial Sequence: Synthetic oligonucleotide
ttctcgtaaactttgccgcct

SEQ ID NO: 5522 - DNA, 21 bp, Artificial Sequence
  Description of Artificial Sequence: Synthetic oligonucleotide
gcggcaaagtttacgagaaaa

SEQ ID NO: 5523 - DNA, 21 bp, Artificial Sequence
  Description of Artificial Sequence: Synthetic oligonucleotide
tctcgtaaactttgccgccta

SEQ ID NO: 5524 - DNA, 21 bp, Artificial Sequence
  Description of Artificial Sequence: Synthetic oligonucleotide
ggcggcaaagtttacgagaaa

SEQ ID NO: 5525 - DNA, 21 bp, Artificial Sequence
  Description of Artificial Sequence: Synthetic oligonucleotide
ctcgtaaactttgccgcctat

SEQ ID NO: 5526 - DNA, 21 bp, Artificial Sequence
  Description of Artificial Sequence: Synthetic oligonucleotide
aggcggcaaagtttacgagaa

SEQ ID NO: 5527 - DNA, 21 bp, Artificial Sequence
  Description of Artificial Sequence: Synthetic oligonucleotide
tcgtaaactttgccgcctatg

SEQ ID NO: 5528 - DNA, 21 bp, Artificial Sequence
  Description of Artificial Sequence: Synthetic oligonucleotide
taggcggcaaagtttacgaga

SEQ ID NO: 5529 - DNA, 21 bp, Artificial Sequence
  Description of Artificial Sequence: Synthetic oligonucleotide
cgtaaactttgccgcctatga

SEQ ID NO: 5530 - DNA, 21 bp, Artificial Sequence
  Description of Artificial Sequence: Synthetic oligonucleotide
ataggcggcaaagtttacgag

SEQ ID NO: 5531 - DNA, 21 bp, Artificial Sequence
  Description of Artificial Sequence: Synthetic oligonucleotide
gtaaactttgccgcctatgag

SEQ ID NO: 5532 - DNA, 21 bp, Artificial Sequence
  Description of Artificial Sequence: Synthetic oligonucleotide
cataggcggcaaagtttacga

SEQ ID NO: 5533 - DNA, 21 bp, Artificial Sequence
  Description of Artificial Sequence: Synthetic oligonucleotide
taaactttgccgcctatgagc

SEQ ID NO: 5534 - DNA, 21 bp, Artificial Sequence
  Description of Artificial Sequence: Synthetic oligonucleotide
tcataggcggcaaagtttacg

SEQ ID NO: 5535 - DNA, 21 bp, Artificial Sequence
  Description of Artificial Sequence: Synthetic oligonucleotide
aaactttgccgcctatgagca

SEQ ID NO: 5536 - DNA, 21 bp, Artificial Sequence
  Description of Artificial Sequence: Synthetic oligonucleotide
ctcataggcggcaaagtttac

SEQ ID NO: 5537 - DNA, 21 bp, Artificial Sequence
  Description of Artificial Sequence: Synthetic oligonucleotide
aactttgccgcctatgagcag

SEQ ID NO: 5538 - DNA, 21 bp, Artificial Sequence
  Description of Artificial Sequence: Synthetic oligonucleotide
gctcataggcggcaaagttta

SEQ ID NO: 5539 - DNA, 21 bp, Artificial Sequence
  Description of Artificial Sequence: Synthetic oligonucleotide
actttgccgcctatgagcagc

SEQ ID NO: 5540 - DNA, 21 bp, Artificial Sequence
  Description of Artificial Sequence: Synthetic oligonucleotide
tgctcataggcggcaaagttt

SEQ ID NO: 5541 - DNA, 21 bp, Artificial Sequence
  Description of Artificial Sequence: Synthetic oligonucleotide
ctttgccgcctatgagcagcc

SEQ ID NO: 5542 - DNA, 21 bp, Artificial Sequence
  Description of Artificial Sequence: Synthetic oligonucleotide
ctgctcataggcggcaaagtt

SEQ ID NO: 5543 - DNA, 21 bp, Artificial Sequence
  Description of Artificial Sequence: Synthetic oligonucleotide
tttgccgcctatgagcagcca

SEQ ID NO: 5544 - DNA, 21 bp, Artificial Sequence
  Description of Artificial Sequence: Synthetic oligonucleotide
gctgctcataggcggcaaagt

SEQ ID NO: 5545 - DNA, 21 bp, Artificial Sequence
  Description of Artificial Sequence: Synthetic oligonucleotide
ttgccgcctatgagcagccac

SEQ ID NO: 5546 - DNA, 21 bp, Artificial Sequence
  Description of Artificial Sequence: Synthetic oligonucleotide
ggctgctcataggcggcaaag

SEQ ID NO: 5547 - DNA, 21 bp, Artificial Sequence
  Description of Artificial Sequence: Synthetic oligonucleotide
tgccgcctatgagcagccaca

SEQ ID NO: 5548 - DNA, 21 bp, Artificial Sequence
  Description of Artificial Sequence: Synthetic oligonucleotide
tggctgctcataggcggcaaa

SEQ ID NO: 5549 - DNA, 21 bp, Artificial Sequence
  Description of Artificial Sequence: Synthetic oligonucleotide
gccgcctatgagcagccacat

SEQ ID NO: 5550 - DNA, 21 bp, Artificial Sequence
  Description of Artificial Sequence: Synthetic oligonucleotide
gtggctgctcataggcggcaa

SEQ ID NO: 5551 - DNA, 21 bp, Artificial Sequence
  Description of Artificial Sequence: Synthetic oligonucleotide
ccgcctatgagcagccacatt

SEQ ID NO: 5552 - DNA, 21 bp, Artificial Sequence
  Description of Artificial Sequence: Synthetic oligonucleotide
tgtggctgctcataggcggca

SEQ ID NO: 5553 - DNA, 21 bp, Artificial Sequence
  Description of Artificial Sequence: Synthetic oligonucleotide
cgcctatgagcagccacattg

SEQ ID NO: 5554 - DNA, 21 bp, Artificial Sequence
  Description of Artificial Sequence: Synthetic oligonucleotide
atgtggctgctcataggcggc

SEQ ID NO: 5555 - DNA, 21 bp, Artificial Sequence
  Description of Artificial Sequence: Synthetic oligonucleotide
gcctatgagcagccacattgc

SEQ ID NO: 5556 - DNA, 21 bp, Artificial Sequence
  Description of Artificial Sequence: Synthetic oligonucleotide
aatgtggctgctcataggcgg

SEQ ID NO: 5557 - DNA, 21 bp, Artificial Sequence
  Description of Artificial Sequence: Synthetic oligonucleotide
cctatgagcagccacattgcc

SEQ ID NO: 5558 - DNA, 21 bp, Artificial Sequence
  Description of Artificial Sequence: Synthetic oligonucleotide
caatgtggctgctcataggcg

SEQ ID NO: 5559 - DNA, 21 bp, Artificial Sequence
  Description of Artificial Sequence: Synthetic oligonucleotide
ctatgagcagccacattgcct

SEQ ID NO: 5560 - DNA, 21 bp, Artificial Sequence
  Description of Artificial Sequence: Synthetic oligonucleotide
gcaatgtggctgctcataggc

SEQ ID NO: 5561 - DNA, 21 bp, Artificial Sequence
  Description of Artificial Sequence: Synthetic oligonucleotide
tatgagcagccacattgcctt

SEQ ID NO: 5562 - DNA, 21 bp, Artificial Sequence
  Description of Artificial Sequence: Synthetic oligonucleotide
ggcaatgtggctgctcatagg

SEQ ID NO: 5563 - DNA, 21 bp, Artificial Sequence
  Description of Artificial Sequence: Synthetic oligonucleotide
atgagcagccacattgcctta

SEQ ID NO: 5564 - DNA, 21 bp, Artificial Sequence
  Description of Artificial Sequence: Synthetic oligonucleotide
aggcaatgtggctgctcatag

SEQ ID NO: 5565 - DNA, 21 bp, Artificial Sequence
  Description of Artificial Sequence: Synthetic oligonucleotide
tgagcagccacattgccttac

SEQ ID NO: 5566 - DNA, 21 bp, Artificial Sequence
  Description of Artificial Sequence: Synthetic oligonucleotide
aaggcaatgtggctgctcata

SEQ ID NO: 5567 - DNA, 21 bp, Artificial Sequence
  Description of Artificial Sequence: Synthetic oligonucleotide
gagcagccacattgccttact

SEQ ID NO: 5568 - DNA, 21 bp, Artificial Sequence
  Description of Artificial Sequence: Synthetic oligonucleotide
taaggcaatgtggctgctcat

SEQ ID NO: 5569 - DNA, 21 bp, Artificial Sequence
  Description of Artificial Sequence: Synthetic oligonucleotide
agcagccacattgccttactg

SEQ ID NO: 5570 - DNA, 21 bp, Artificial Sequence
  Description of Artificial Sequence: Synthetic oligonucleotide
gtaaggcaatgtggctgctca

SEQ ID NO: 5571 - DNA, 21 bp, Artificial Sequence
  Description of Artificial Sequence: Synthetic oligonucleotide
gcagccacattgccttactga

SEQ ID NO: 5572 - DNA, 21 bp, Artificial Sequence
  Description of Artificial Sequence: Synthetic oligonucleotide
agtaaggcaatgtggctgctc

SEQ ID NO: 5573 - DNA, 21 bp, Artificial Sequence
  Description of Artificial Sequence: Synthetic oligonucleotide
cagccacattgccttactgaa

SEQ ID NO: 5574 - DNA, 21 bp, Artificial Sequence
  Description of Artificial Sequence: Synthetic oligonucleotide
cagtaaggcaatgtggctgct

SEQ ID NO: 5575 - DNA, 21 bp, Artificial Sequence
  Description of Artificial Sequence: Synthetic oligonucleotide
agccacattgccttactgaaa

SEQ ID NO: 5576 - DNA, 21 bp, Artificial Sequence
  Description of Artificial Sequence: Synthetic oligonucleotide
tcagtaaggcaatgtggctgc

SEQ ID NO: 5577 - DNA, 21 bp, Artificial Sequence
  Description of Artificial Sequence: Synthetic oligonucleotide
gccacattgccttactgaaat

SEQ ID NO: 5578 - DNA, 21 bp, Artificial Sequence
  Description of Artificial Sequence: Synthetic oligonucleotide
ttcagtaaggcaatgtggctg

SEQ ID NO: 5579 - DNA, 21 bp, Artificial Sequence
  Description of Artificial Sequence: Synthetic oligonucleotide
ccacattgccttactgaaatc

SEQ ID NO: 5580 - DNA, 21 bp, Artificial Sequence
  Description of Artificial Sequence: Synthetic oligonucleotide
tttcagtaaggcaatgtggct

SEQ ID NO: 5581 - DNA, 21 bp, Artificial Sequence
  Description of Artificial Sequence: Synthetic oligonucleotide
cacattgccttactgaaatcc

SEQ ID NO: 5582 - DNA, 21 bp, Artificial Sequence
  Description of Artificial Sequence: Synthetic oligonucleotide
atttcagtaaggcaatgtggc

SEQ ID NO: 5583 - DNA, 21 bp, Artificial Sequence
  Description of Artificial Sequence: Synthetic oligonucleotide
acattgccttactgaaatcca

SEQ ID NO: 5584 - DNA, 21 bp, Artificial Sequence
  Description of Artificial Sequence: Synthetic oligonucleotide
gatttcagtaaggcaatgtgg

SEQ ID NO: 5585 - DNA, 21 bp, Artificial Sequence
  Description of Artificial Sequence: Synthetic oligonucleotide
cattgccttactgaaatccag

SEQ ID NO: 5586 - DNA, 21 bp, Artificial Sequence
  Description of Artificial Sequence: Synthetic oligonucleotide
ggatttcagtaaggcaatgtg

SEQ ID NO: 5587 - DNA, 21 bp, Artificial Sequence
  Description of Artificial Sequence: Synthetic oligonucleotide
attgccttactgaaatccaga

SEQ ID NO: 5588 - DNA, 21 bp, Artificial Sequence
  Description of Artificial Sequence: Synthetic oligonucleotide
tggatttcagtaaggcaatgt

SEQ ID NO: 5589 - DNA, 21 bp, Artificial Sequence
  Description of Artificial Sequence: Synthetic oligonucleotide
ttgccttactgaaatccagag

SEQ ID NO: 5590 - DNA, 21 bp, Artificial Sequence
  Description of Artificial Sequence: Synthetic oligonucleotide
ctggatttcagtaaggcaatg

SEQ ID NO: 5591 - DNA, 21 bp, Artificial Sequence
  Description of Artificial Sequence: Synthetic oligonucleotide
tgccttactgaaatccagagc

SEQ ID NO: 5592 - DNA, 21 bp, Artificial Sequence
  Description of Artificial Sequence: Synthetic oligonucleotide
tctggatttcagtaaggcaat

SEQ ID NO: 5593 - DNA, 21 bp, Artificial Sequence
  Description of Artificial Sequence: Synthetic oligonucleotide
gccttactgaaatccagagcc

SEQ ID NO: 5594 - DNA, 21 bp, Artificial Sequence
  Description of Artificial Sequence: Synthetic oligonucleotide
ctctggatttcagtaaggcaa

SEQ ID NO: 5595 - DNA, 21 bp, Artificial Sequence
  Description of Artificial Sequence: Synthetic oligonucleotide
ccttactgaaatccagagcct

SEQ ID NO: 5596 - DNA, 21 bp, Artificial Sequence
  Description of Artificial Sequence: Synthetic oligonucleotide
gctctggatttcagtaaggca

SEQ ID NO: 5597 - DNA, 21 bp, Artificial Sequence
  Description of Artificial Sequence: Synthetic oligonucleotide
cttactgaaatccagagccta

SEQ ID NO: 5598 - DNA, 21 bp, Artificial Sequence
  Description of Artificial Sequence: Synthetic oligonucleotide
ggctctggatttcagtaaggc

SEQ ID NO: 5599 - DNA, 21 bp, Artificial Sequence
  Description of Artificial Sequence: Synthetic oligonucleotide
ttactgaaatccagagcctaa

SEQ ID NO: 5600 - DNA, 21 bp, Artificial Sequence
  Description of Artificial Sequence: Synthetic oligonucleotide
aggctctggatttcagtaagg

SEQ ID NO: 5601 - DNA, 21 bp, Artificial Sequence
  Description of Artificial Sequence: Synthetic oligonucleotide
tactgaaatccagagcctaac

SEQ ID NO: 5602 - DNA, 21 bp, Artificial Sequence
  Description of Artificial Sequence: Synthetic oligonucleotide
taggctctggatttcagtaag

SEQ ID NO: 5603 - DNA, 21 bp, Artificial Sequence
  Description of Artificial Sequence: Synthetic oligonucleotide
actgaaatccagagcctaacc

SEQ ID NO: 5604 - DNA, 21 bp, Artificial Sequence
  Description of Artificial Sequence: Synthetic oligonucleotide
ttaggctctggatttcagtaa

SEQ ID NO: 5605 - DNA, 21 bp, Artificial Sequence
  Description of Artificial Sequence: Synthetic oligonucleotide
ctgaaatccagagcctaacct

SEQ ID NO: 5606 - DNA, 21 bp, Artificial Sequence
  Description of Artificial Sequence: Synthetic oligonucleotide
gttaggctctggatttcagta

SEQ ID NO: 5607 - DNA, 21 bp, Artificial Sequence
  Description of Artificial Sequence: Synthetic oligonucleotide
tgaaatccagagcctaacctt

SEQ ID NO: 5608 - DNA, 21 bp, Artificial Sequence
  Description of Artificial Sequence: Synthetic oligonucleotide
ggttaggctctggatttcagt

SEQ ID NO: 5609 - DNA, 21 bp, Artificial Sequence
  Description of Artificial Sequence: Synthetic oligonucleotide
gaaatccagagcctaaccttc

SEQ ID NO: 5610 - DNA, 21 bp, Artificial Sequence
  Description of Artificial Sequence: Synthetic oligonucleotide
aggttaggctctggatttcag

SEQ ID NO: 5611 - DNA, 21 bp, Artificial Sequence
  Description of Artificial Sequence: Synthetic oligonucleotide
aaatccagagcctaaccttca

SEQ ID NO: 5612 - DNA, 21 bp, Artificial Sequence
  Description of Artificial Sequence: Synthetic oligonucleotide
aaggttaggctctggatttca

SEQ ID NO: 5613 - DNA, 21 bp, Artificial Sequence
  Description of Artificial Sequence: Synthetic oligonucleotide
aatccagagcctaaccttcaa

SEQ ID NO: 5614 - DNA, 21 bp, Artificial Sequence
  Description of Artificial Sequence: Synthetic oligonucleotide
gaaggttaggctctggatttc

SEQ ID NO: 5615 - DNA, 21 bp, Artificial Sequence
  Description of Artificial Sequence: Synthetic oligonucleotide
atccagagcctaaccttcaat

SEQ ID NO: 5616 - DNA, 21 bp, Artificial Sequence
  Description of Artificial Sequence: Synthetic oligonucleotide
tgaaggttaggctctggattt

SEQ ID NO: 5617 - DNA, 21 bp, Artificial Sequence
  Description of Artificial Sequence: Synthetic oligonucleotide
tccagagcctaaccttcaatc

SEQ ID NO: 5618 - DNA, 21 bp, Artificial Sequence
  Description of Artificial Sequence: Synthetic oligonucleotide
ttgaaggttaggctctggatt

SEQ ID NO: 5619 - DNA, 21 bp, Artificial Sequence
  Description of Artificial Sequence: Synthetic oligonucleotide
ccagagcctaaccttcaatcc

SEQ ID NO: 5620 - DNA, 21 bp, Artificial Sequence
  Description of Artificial Sequence: Synthetic oligonucleotide
attgaaggttaggctctggat

SEQ ID NO: 5621 - DNA, 21 bp, Artificial Sequence
  Description of Artificial Sequence: Synthetic oligonucleotide
cagagcctaaccttcaatccc

SEQ ID NO: 5622 - DNA, 21 bp, Artificial Sequence
  Description of Artificial Sequence: Synthetic oligonucleotide
gattgaaggttaggctctgga

SEQ ID NO: 5623 - DNA, 21 bp, Artificial Sequence
  Description of Artificial Sequence: Synthetic oligonucleotide
agagcctaaccttcaatccca

SEQ ID NO: 5624 - DNA, 21 bp, Artificial Sequence
  Description of Artificial Sequence: Synthetic oligonucleotide
ggattgaaggttaggctctgg

SEQ ID NO: 5625 - DNA, 21 bp, Artificial Sequence
  Description of Artificial Sequence: Synthetic oligonucleotide
gagcctaaccttcaatcccac

SEQ ID NO: 5626 - DNA, 21 bp, Artificial Sequence
  Description of Artificial Sequence: Synthetic oligonucleotide
gggattgaaggttaggctctg

SEQ ID NO: 5627 - DNA, 21 bp, Artificial Sequence
  Description of Artificial Sequence: Synthetic oligonucleotide
agcctaaccttcaatcccacc

SEQ ID NO: 5628 - DNA, 21 bp, Artificial Sequence
  Description of Artificial Sequence: Synthetic oligonucleotide
tgggattgaaggttaggctct

SEQ ID NO: 5629 - DNA, 21 bp, Artificial Sequence
  Description of Artificial Sequence: Synthetic oligonucleotide
gcctaaccttcaatcccaccg

SEQ ID NO: 5630 - DNA, 21 bp, Artificial Sequence
  Description of Artificial Sequence: Synthetic oligonucleotide
gtgggattgaaggttaggctc

SEQ ID NO: 5631 - DNA, 21 bp, Artificial Sequence
  Description of Artificial Sequence: Synthetic oligonucleotide
cctaaccttcaatcccaccgc

SEQ ID NO: 5632 - DNA, 21 bp, Artificial Sequence
  Description of Artificial Sequence: Synthetic oligonucleotide
ggtgggattgaaggttaggct

SEQ ID NO: 5633 - DNA, 21 bp, Artificial Sequence
  Description of Artificial Sequence: Synthetic oligonucleotide
ctaaccttcaatcccaccgcc

SEQ ID NO: 5634 - DNA, 21 bp, Artificial Sequence
  Description of Artificial Sequence: Synthetic oligonucleotide
cggtgggattgaaggttaggc

SEQ ID NO: 5635 - DNA, 21 bp, Artificial Sequence
  Description of Artificial Sequence: Synthetic oligonucleotide
taaccttcaatcccaccgccg

SEQ ID NO: 5636 - DNA, 21 bp, Artificial Sequence
  Description of Artificial Sequence: Synthetic oligonucleotide
gcggtgggattgaaggttagg

SEQ ID NO: 5637 - DNA, 21 bp, Artificial Sequence
  Description of Artificial Sequence: Synthetic oligonucleotide
aaccttcaatcccaccgccgg

SEQ ID NO: 5638 - DNA, 21 bp, Artificial Sequence
  Description of Artificial Sequence: Synthetic oligonucleotide
ggcggtgggattgaaggttag

SEQ ID NO: 5639 - DNA, 21 bp, Artificial Sequence
  Description of Artificial Sequence: Synthetic oligonucleotide
accttcaatcccaccgccggc

SEQ ID NO: 5640 - DNA, 21 bp, Artificial Sequence
  Description of Artificial Sequence: Synthetic oligonucleotide
cggcggtgggattgaaggtta

SEQ ID NO: 5641 - DNA, 21 bp, Artificial Sequence
  Description of Artificial Sequence: Synthetic oligonucleotide
ccttcaatcccaccgccggct

SEQ ID NO: 5642 - DNA, 21 bp, Artificial Sequence
  Description of Artificial Sequence: Synthetic oligonucleotide
ccggcggtgggattgaaggtt

SEQ ID NO: 5643 - DNA, 21 bp, Artificial Sequence
  Description of Artificial Sequence: Synthetic oligonucleotide
cttcaatcccaccgccggctg

SEQ ID NO: 5644 - DNA, 21 bp, Artificial Sequence
  Description of Artificial Sequence: Synthetic oligonucleotide
gccggcggtgggattgaaggt

SEQ ID NO: 5645 - DNA, 21 bp, Artificial Sequence
  Description of Artificial Sequence: Synthetic oligonucleotide
ttcaatcccaccgccggctgc

SEQ ID NO: 5646 - DNA, 21 bp, Artificial Sequence
  Description of Artificial Sequence: Synthetic oligonucleotide
agccggcggtgggattgaagg

SEQ ID NO: 5647 - DNA, 21 bp, Artificial Sequence
  Description of Artificial Sequence: Synthetic oligonucleotide
tcaatcccaccgccggctgcg

SEQ ID NO: 5648 - DNA, 21 bp, Artificial Sequence
  Description of Artificial Sequence: Synthetic oligonucleotide
cagccggcggtgggattgaag

SEQ ID NO: 5649 - DNA, 21 bp, Artificial Sequence
  Description of Artificial Sequence: Synthetic oligonucleotide
caatcccaccgccggctgcgc

SEQ ID NO: 5650 - DNA, 21 bp, Artificial Sequence
  Description of Artificial Sequence: Synthetic oligonucleotide
gcagccggcggtgggattgaa

SEQ ID NO: 5651 - DNA, 21 bp, Artificial Sequence
  Description of Artificial Sequence: Synthetic oligonucleotide
aatcccaccgccggctgcgcg

SEQ ID NO: 5652 - DNA, 21 bp, Artificial Sequence
  Description of Artificial Sequence: Synthetic oligonucleotide
cgcagccggcggtgggattga

SEQ ID NO: 5653 - DNA, 21 bp, Artificial Sequence
  Description of Artificial Sequence: Synthetic oligonucleotide
atcccaccgccggctgcgcgt

SEQ ID NO: 5654 - DNA, 21 bp, Artificial Sequence
  Description of Artificial Sequence: Synthetic oligonucleotide
gcgcagccggcggtgggattg

SEQ ID NO: 5655 - DNA, 21 bp, Artificial Sequence
  Description of Artificial Sequence: Synthetic oligonucleotide
tcccaccgccggctgcgcgtc

SEQ ID NO: 5656 - DNA, 21 bp, Artificial Sequence
  Description of Artificial Sequence: Synthetic oligonucleotide
cgcgcagccggcggtgggatt

SEQ ID NO: 5657 - DNA, 21 bp, Artificial Sequence
  Description of Artificial Sequence: Synthetic oligonucleotide
cccaccgccggctgcgcgtcg

SEQ ID NO: 5658 - DNA, 21 bp, Artificial Sequence
  Description of Artificial Sequence: Synthetic oligonucleotide
acgcgcagccggcggtgggat

SEQ ID NO: 5659 - DNA, 21 bp, Artificial Sequence
  Description of Artificial Sequence: Synthetic oligonucleotide
ccaccgccggctgcgcgtcgc

SEQ ID NO: 5660 - DNA, 21 bp, Artificial Sequence
  Description of Artificial Sequence: Synthetic oligonucleotide
gacgcgcagccggcggtggga

SEQ ID NO: 5661 - DNA, 21 bp, Artificial Sequence
  Description of Artificial Sequence: Synthetic oligonucleotide
caccgccggctgcgcgtcgct

SEQ ID NO: 5662 - DNA, 21 bp, Artificial Sequence
  Description of Artificial Sequence: Synthetic oligonucleotide
cgacgcgcagccggcggtggg

SEQ ID NO: 5663 - DNA, 21 bp, Artificial Sequence
  Description of Artificial Sequence: Synthetic oligonucleotide
accgccggctgcgcgtcgctc

SEQ ID NO: 5664 - DNA, 21 bp, Artificial Sequence
  Description of Artificial Sequence: Synthetic oligonucleotide
gcgacgcgcagccggcggtgg

SEQ ID NO: 5665 - DNA, 21 bp, Artificial Sequence
  Description of Artificial Sequence: Synthetic oligonucleotide
ccgccggctgcgcgtcgctcg

SEQ ID NO: 5666 - DNA, 21 bp, Artificial Sequence
  Description of Artificial Sequence: Synthetic oligonucleotide
agcgacgcgcagccggcggtg

SEQ ID NO: 5667 - DNA, 21 bp, Artificial Sequence
  Description of Artificial Sequence: Synthetic oligonucleotide
cgccggctgcgcgtcgctcgc

SEQ ID NO: 5668 - DNA, 21 bp, Artificial Sequence
  Description of Artificial Sequence: Synthetic oligonucleotide
gagcgacgcgcagccggcggt

SEQ ID NO: 5669 - DNA, 21 bp, Artificial Sequence
  Description of Artificial Sequence: Synthetic oligonucleotide
gccggctgcgcgtcgctcgcc

SEQ ID NO: 5670 - DNA, 21 bp, Artificial Sequence
  Description of Artificial Sequence: Synthetic oligonucleotide
cgagcgacgcgcagccggcgg

SEQ ID NO: 5671 - DNA, 21 bp, Artificial Sequence
  Description of Artificial Sequence: Synthetic oligonucleotide
ccggctgcgcgtcgctcgcca

SEQ ID NO: 5672 - DNA, 21 bp, Artificial Sequence
  Description of Artificial Sequence: Synthetic oligonucleotide
gcgagcgacgcgcagccggcg

SEQ ID NO: 5673 - DNA, 21 bp, Artificial Sequence
  Description of Artificial Sequence: Synthetic oligonucleotide
cggctgcgcgtcgctcgccaa

SEQ ID NO: 5674 - DNA, 21 bp, Artificial Sequence
  Description of Artificial Sequence: Synthetic oligonucleotide
ggcgagcgacgcgcagccggc

SEQ ID NO: 5675 - DNA, 21 bp, Artificial Sequence
  Description of Artificial Sequence: Synthetic oligonucleotide
ggctgcgcgtcgctcgccaaa

SEQ ID NO: 5676 - DNA, 21 bp, Artificial Sequence
  Description of Artificial Sequence: Synthetic oligonucleotide
tggcgagcgacgcgcagccgg

SEQ ID NO: 5677 - DNA, 21 bp, Artificial Sequence
  Description of Artificial Sequence: Synthetic oligonucleotide
gctgcgcgtcgctcgccaaag

SEQ ID NO: 5678 - DNA, 21 bp, Artificial Sequence
  Description of Artificial Sequence: Synthetic oligonucleotide
ttggcgagcgacgcgcagccg

SEQ ID NO: 5679 - DNA, 21 bp, Artificial Sequence
  Description of Artificial Sequence: Synthetic oligonucleotide
ctgcgcgtcgctcgccaaaga

SEQ ID NO: 5680 - DNA, 21 bp, Artificial Sequence
  Description of Artificial Sequence: Synthetic oligonucleotide
tttggcgagcgacgcgcagcc

SEQ ID NO: 5681 - DNA, 21 bp, Artificial Sequence
  Description of Artificial Sequence: Synthetic oligonucleotide
tgcgcgtcgctcgccaaagaa

SEQ ID NO: 5682 - DNA, 21 bp, Artificial Sequence
  Description of Artificial Sequence: Synthetic oligonucleotide
ctttggcgagcgacgcgcagc

SEQ ID NO: 5683 - DNA, 21 bp, Artificial Sequence
  Description of Artificial Sequence: Synthetic oligonucleotide
gcgcgtcgctcgccaaagaaa

SEQ ID NO: 5684 - DNA, 21 bp, Artificial Sequence
  Description of Artificial Sequence: Synthetic oligonucleotide
tctttggcgagcgacgcgcag

SEQ ID NO: 5685 - DNA, 21 bp, Artificial Sequence
  Description of Artificial Sequence: Synthetic oligonucleotide
cgcgtcgctcgccaaagaaat

SEQ ID NO: 5686 - DNA, 21 bp, Artificial Sequence
  Description of Artificial Sequence: Synthetic oligonucleotide
ttctttggcgagcgacgcgca

SEQ ID NO: 5687 - DNA, 21 bp, Artificial Sequence
  Description of Artificial Sequence: Synthetic oligonucleotide
gcgtcgctcgccaaagaaatg

SEQ ID NO: 5688 - DNA, 21 bp, Artificial Sequence
  Description of Artificial Sequence: Synthetic oligonucleotide
tttctttggcgagcgacgcgc

SEQ ID NO: 5689 - DNA, 21 bp, Artificial Sequence
  Description of Artificial Sequence: Synthetic oligonucleotide
cgtcgctcgccaaagaaatgt

SEQ ID NO: 5690 - DNA, 21 bp, Artificial Sequence
  Description of Artificial Sequence: Synthetic oligonucleotide
atttctttggcgagcgacgcg

SEQ ID NO: 5691 - DNA, 21 bp, Artificial Sequence
  Description of Artificial Sequence: Synthetic oligonucleotide
gtcgctcgccaaagaaatgtt

SEQ ID NO: 5692 - DNA, 21 bp, Artificial Sequence
  Description of Artificial Sequence: Synthetic oligonucleotide
catttctttggcgagcgacgc

SEQ ID NO: 5693 - DNA, 21 bp, Artificial Sequence
  Description of Artificial Sequence: Synthetic oligonucleotide
tcgctcgccaaagaaatgttc

SEQ ID NO: 5694 - DNA, 21 bp, Artificial Sequence
  Description of Artificial Sequence: Synthetic oligonucleotide
acatttctttggcgagcgacg

SEQ ID NO: 5695 - DNA, 21 bp, Artificial Sequence
  Description of Artificial Sequence: Synthetic oligonucleotide
cgctcgccaaagaaatgttcg

SEQ ID NO: 5696 - DNA, 21 bp, Artificial Sequence
  Description of Artificial Sequence: Synthetic oligonucleotide
aacatttctttggcgagcgac

SEQ ID NO: 5697 - DNA, 21 bp, Artificial Sequence
  Description of Artificial Sequence: Synthetic oligonucleotide
gctcgccaaagaaatgttcgc

SEQ ID NO: 5698 - DNA, 21 bp, Artificial Sequence
  Description of Artificial Sequence: Synthetic oligonucleotide
gaacatttctttggcgagcga

SEQ ID NO: 5699 - DNA, 21 bp, Artificial Sequence
  Description of Artificial Sequence: Synthetic oligonucleotide
ctcgccaaagaaatgttcgcc

SEQ ID NO: 5700 - DNA, 21 bp, Artificial Sequence
  Description of Artificial Sequence: Synthetic oligonucleotide
cgaacatttctttggcgagcg

SEQ ID NO: 5701 - DNA, 21 bp, Artificial Sequence
  Description of Artificial Sequence: Synthetic oligonucleotide
tcgccaaagaaatgttcgcca

SEQ ID NO: 5702 - DNA, 21 bp, Artificial Sequence
  Description of Artificial Sequence: Synthetic oligonucleotide
gcgaacatttctttggcgagc

SEQ ID NO: 5703 - DNA, 21 bp, Artificial Sequence
  Description of Artificial Sequence: Synthetic oligonucleotide
cgccaaagaaatgttcgccat

SEQ ID NO: 5704 - DNA, 21 bp, Artificial Sequence
  Description of Artificial Sequence: Synthetic oligonucleotide
ggcgaacatttctttggcgag

SEQ ID NO: 5705 - DNA, 21 bp, Artificial Sequence
  Description of Artificial Sequence: Synthetic oligonucleotide
gccaaagaaatgttcgccatg

SEQ ID NO: 5706 - DNA, 21 bp, Artificial Sequence
  Description of Artificial Sequence: Synthetic oligonucleotide
tggcgaacatttctttggcga

SEQ ID NO: 5707 - DNA, 21 bp, Artificial Sequence
  Description of Artificial Sequence: Synthetic oligonucleotide
ccaaagaaatgttcgccatga

SEQ ID NO: 5708 - DNA, 21 bp, Artificial Sequence
  Description of Artificial Sequence: Synthetic oligonucleotide
atggcgaacatttctttggcg

SEQ ID NO: 5709 - DNA, 21 bp, Artificial Sequence
  Description of Artificial Sequence: Synthetic oligonucleotide
caaagaaatgttcgccatgaa

SEQ ID NO: 5710 - DNA, 21 bp, Artificial Sequence
  Description of Artificial Sequence: Synthetic oligonucleotide
catggcgaacatttctttggc

SEQ ID NO: 5711 - DNA, 21 bp, Artificial Sequence
  Description of Artificial Sequence: Synthetic oligonucleotide
aaagaaatgttcgccatgaaa

SEQ ID NO: 5712 - DNA, 21 bp, Artificial Sequence
  Description of Artificial Sequence: Synthetic oligonucleotide
tcatggcgaacatttctttgg

SEQ ID NO: 5713 - DNA, 21 bp, Artificial Sequence
  Description of Artificial Sequence: Synthetic oligonucleotide
aagaaatgttcgccatgaaaa

SEQ ID NO: 5714 - DNA, 21 bp, Artificial Sequence
  Description of Artificial Sequence: Synthetic oligonucleotide
ttcatggcgaacatttctttg

SEQ ID NO: 5715 - DNA, 21 bp, Artificial Sequence
  Description of Artificial Sequence: Synthetic oligonucleotide
agaaatgttcgccatgaaaac

SEQ ID NO: 5716 - DNA, 21 bp, Artificial Sequence
  Description of Artificial Sequence: Synthetic oligonucleotide
tttcatggcgaacatttcttt

SEQ ID NO: 5717 - DNA, 21 bp, Artificial Sequence
  Description of Artificial Sequence: Synthetic oligonucleotide
gaaatgttcgccatgaaaact

SEQ ID NO: 5718 - DNA, 21 bp, Artificial Sequence
  Description of Artificial Sequence: Synthetic oligonucleotide
ttttcatggcgaacatttctt

SEQ ID NO: 5719 - DNA, 21 bp, Artificial Sequence
  Description of Artificial Sequence: Synthetic oligonucleotide
aaatgttcgccatgaaaacta

SEQ ID NO: 5720 - DNA, 21 bp, Artificial Sequence
  Description of Artificial Sequence: Synthetic oligonucleotide
gttttcatggcgaacatttct

SEQ ID NO: 5721 - DNA, 21 bp, Artificial Sequence
  Description of Artificial Sequence: Synthetic oligonucleotide
aatgttcgccatgaaaactaa

SEQ ID NO: 5722 - DNA, 21 bp, Artificial Sequence
  Description of Artificial Sequence: Synthetic oligonucleotide
agttttcatggcgaacatttc

SEQ ID NO: 5723 - DNA, 21 bp, Artificial Sequence
  Description of Artificial Sequence: Synthetic oligonucleotide
atgttcgccatgaaaactaag

SEQ ID NO: 5724 - DNA, 21 bp, Artificial Sequence
  Description of Artificial Sequence: Synthetic oligonucleotide
tagttttcatggcgaacattt

SEQ ID NO: 5725 - DNA, 21 bp, Artificial Sequence
  Description of Artificial Sequence: Synthetic oligonucleotide
tgttcgccatgaaaactaagg

SEQ ID NO: 5726 - DNA, 21 bp, Artificial Sequence
  Description of Artificial Sequence: Synthetic oligonucleotide
ttagttttcatggcgaacatt

SEQ ID NO: 5727 - DNA, 21 bp, Artificial Sequence
  Description of Artificial Sequence: Synthetic oligonucleotide
gttcgccatgaaaactaaggc

SEQ ID NO: 5728 - DNA, 21 bp, Artificial Sequence
  Description of Artificial Sequence: Synthetic oligonucleotide
cttagttttcatggcgaacat

SEQ ID NO: 5729 - DNA, 21 bp, Artificial Sequence
  Description of Artificial Sequence: Synthetic oligonucleotide
ttcgccatgaaaactaaggct

SEQ ID NO: 5730 - DNA, 21 bp, Artificial Sequence
  Description of Artificial Sequence: Synthetic oligonucleotide
ccttagttttcatggcgaaca

SEQ ID NO: 5731 - DNA, 21 bp, Artificial Sequence
  Description of Artificial Sequence: Synthetic oligonucleotide
tcgccatgaaaactaaggctg

SEQ ID NO: 5732 - DNA, 21 bp, Artificial Sequence
  Description of Artificial Sequence: Synthetic oligonucleotide
gccttagttttcatggcgaac

SEQ ID NO: 5733 - DNA, 21 bp, Artificial Sequence
  Description of Artificial Sequence: Synthetic oligonucleotide
cgccatgaaaactaaggctgc

SEQ ID NO: 5734 - DNA, 21 bp, Artificial Sequence
  Description of Artificial Sequence: Synthetic oligonucleotide
agccttagttttcatggcgaa

SEQ ID NO: 5735 - DNA, 21 bp, Artificial Sequence
  Description of Artificial Sequence: Synthetic oligonucleotide
gccatgaaaactaaggctgcc

SEQ ID NO: 5736 - DNA, 21 bp, Artificial Sequence
  Description of Artificial Sequence: Synthetic oligonucleotide
cagccttagttttcatggcga

SEQ ID NO: 5737 - DNA, 21 bp, Artificial Sequence
  Description of Artificial Sequence: Synthetic oligonucleotide
ccatgaaaactaaggctgcct

SEQ ID NO: 5738 - DNA, 21 bp, Artificial Sequence
  Description of Artificial Sequence: Synthetic oligonucleotide
gcagccttagttttcatggcg

SEQ ID NO: 5739 - DNA, 21 bp, Artificial Sequence
  Description of Artificial Sequence: Synthetic oligonucleotide
catgaaaactaaggctgcctt

SEQ ID NO: 5740 - DNA, 21 bp, Artificial Sequence
  Description of Artificial Sequence: Synthetic oligonucleotide
ggcagccttagttttcatggc

SEQ ID NO: 5741 - DNA, 21 bp, Artificial Sequence
  Description of Artificial Sequence: Synthetic oligonucleotide
atgaaaactaaggctgcctta

SEQ ID NO: 5742 - DNA, 21 bp, Artificial Sequence
  Description of Artificial Sequence: Synthetic oligonucleotide
aggcagccttagttttcatgg

SEQ ID NO: 5743 - DNA, 21 bp, Artificial Sequence
  Description of Artificial Sequence: Synthetic oligonucleotide
tgaaaactaaggctgccttag

SEQ ID NO: 5744 - DNA, 21 bp, Artificial Sequence
  Description of Artificial Sequence: Synthetic oligonucleotide
aaggcagccttagttttcatg

SEQ ID NO: 5745 - DNA, 21 bp, Artificial Sequence
  Description of Artificial Sequence: Synthetic oligonucleotide
gaaaactaaggctgccttagc

SEQ ID NO: 5746 - DNA, 21 bp, Artificial Sequence
  Description of Artificial Sequence: Synthetic oligonucleotide
taaggcagccttagttttcat

SEQ ID NO: 5747 - DNA, 21 bp, Artificial Sequence
  Description of Artificial Sequence: Synthetic oligonucleotide
aaaactaaggctgccttagct

SEQ ID NO: 5748 - DNA, 21 bp, Artificial Sequence
  Description of Artificial Sequence: Synthetic oligonucleotide
ctaaggcagccttagttttca

SEQ ID NO: 5749 - DNA, 21 bp, Artificial Sequence
  Description of Artificial Sequence: Synthetic oligonucleotide
aaactaaggctgccttagcta

SEQ ID NO: 5750 - DNA, 21 bp, Artificial Sequence
  Description of Artificial Sequence: Synthetic oligonucleotide
gctaaggcagccttagttttc

SEQ ID NO: 5751 - DNA, 21 bp, Artificial Sequence
  Description of Artificial Sequence: Synthetic oligonucleotide
aactaaggctgccttagctat

SEQ ID NO: 5752 - DNA, 21 bp, Artificial Sequence
  Description of Artificial Sequence: Synthetic oligonucleotide
agctaaggcagccttagtttt

SEQ ID NO: 5753 - DNA, 21 bp, Artificial Sequence
  Description of Artificial Sequence: Synthetic oligonucleotide
actaaggctgccttagctatc

SEQ ID NO: 5754 - DNA, 21 bp, Artificial Sequence
  Description of Artificial Sequence: Synthetic oligonucleotide
tagctaaggcagccttagttt

SEQ ID NO: 5755 - DNA, 21 bp, Artificial Sequence
  Description of Artificial Sequence: Synthetic oligonucleotide
ctaaggctgccttagctatct

SEQ ID NO: 5756 - DNA, 21 bp, Artificial Sequence
  Description of Artificial Sequence: Synthetic oligonucleotide
atagctaaggcagccttagtt

SEQ ID NO: 5757 - DNA, 21 bp, Artificial Sequence
  Description of Artificial Sequence: Synthetic oligonucleotide
taaggctgccttagctatctg

SEQ ID NO: 5758 - DNA, 21 bp, Artificial Sequence
  Description of Artificial Sequence: Synthetic oligonucleotide
gatagctaaggcagccttagt

SEQ ID NO: 5759 - DNA, 21 bp, Artificial Sequence
  Description of Artificial Sequence: Synthetic oligonucleotide
aaggctgccttagctatctgg

SEQ ID NO: 5760 - DNA, 21 bp, Artificial Sequence
  Description of Artificial Sequence: Synthetic oligonucleotide
agatagctaaggcagccttag

SEQ ID NO: 5761 - DNA, 21 bp, Artificial Sequence
  Description of Artificial Sequence: Synthetic oligonucleotide
aggctgccttagctatctggt

SEQ ID NO: 5762 - DNA, 21 bp, Artificial Sequence
  Description of Artificial Sequence: Synthetic oligonucleotide
cagatagctaaggcagcctta

SEQ ID NO: 5763 - DNA, 21 bp, Artificial Sequence
  Description of Artificial Sequence: Synthetic oligonucleotide
ggctgccttagctatctggtg

SEQ ID NO: 5764 - DNA, 21 bp, Artificial Sequence
  Description of Artificial Sequence: Synthetic oligonucleotide
ccagatagctaaggcagcctt

SEQ ID NO: 5765 - DNA, 21 bp, Artificial Sequence
  Description of Artificial Sequence: Synthetic oligonucleotide
gctgccttagctatctggtgc

SEQ ID NO: 5766 - DNA, 21 bp, Artificial Sequence
  Description of Artificial Sequence: Synthetic oligonucleotide
accagatagctaaggcagcct

SEQ ID NO: 5767 - DNA, 21 bp, Artificial Sequence
  Description of Artificial Sequence: Synthetic oligonucleotide
ctgccttagctatctggtgcc

SEQ ID NO: 5768 - DNA, 21 bp, Artificial Sequence
  Description of Artificial Sequence: Synthetic oligonucleotide
caccagatagctaaggcagcc

SEQ ID NO: 5769 - DNA, 21 bp, Artificial Sequence
  Description of Artificial Sequence: Synthetic oligonucleotide
tgccttagctatctggtgccc

SEQ ID NO: 5770 - DNA, 21 bp, Artificial Sequence
  Description of Artificial Sequence: Synthetic oligonucleotide
gcaccagatagctaaggcagc

SEQ ID NO: 5771 - DNA, 21 bp, Artificial Sequence
  Description of Artificial Sequence: Synthetic oligonucleotide
gccttagctatctggtgccca

SEQ ID NO: 5772 - DNA, 21 bp, Artificial Sequence
  Description of Artificial Sequence: Synthetic oligonucleotide
ggcaccagatagctaaggcag

SEQ ID NO: 5773 - DNA, 21 bp, Artificial Sequence
  Description of Artificial Sequence: Synthetic oligonucleotide
ccttagctatctggtgcccag

SEQ ID NO: 5774 - DNA, 21 bp, Artificial Sequence
  Description of Artificial Sequence: Synthetic oligonucleotide
gggcaccagatagctaaggca

SEQ ID NO: 5775 - DNA, 21 bp, Artificial Sequence
  Description of Artificial Sequence: Synthetic oligonucleotide
cttagctatctggtgcccagg

SEQ ID NO: 5776 - DNA, 21 bp, Artificial Sequence
  Description of Artificial Sequence: Synthetic oligonucleotide
tgggcaccagatagctaaggc

SEQ ID NO: 5777 - DNA, 21 bp, Artificial Sequence
  Description of Artificial Sequence: Synthetic oligonucleotide
ttagctatctggtgcccaggc

SEQ ID NO: 5778 - DNA, 21 bp, Artificial Sequence
  Description of Artificial Sequence: Synthetic oligonucleotide
ctgggcaccagatagctaagg

SEQ ID NO: 5779 - DNA, 21 bp, Artificial Sequence
  Description of Artificial Sequence: Synthetic oligonucleotide
tagctatctggtgcccaggct

SEQ ID NO: 5780 - DNA, 21 bp, Artificial Sequence
  Description of Artificial Sequence: Synthetic oligonucleotide
cctgggcaccagatagctaag

SEQ ID NO: 5781 - DNA, 21 bp, Artificial Sequence
  Description of Artificial Sequence: Synthetic oligonucleotide
agctatctggtgcccaggcta

SEQ ID NO: 5782 - DNA, 21 bp, Artificial Sequence
  Description of Artificial Sequence: Synthetic oligonucleotide
gcctgggcaccagatagctaa

SEQ ID NO: 5783 - DNA, 21 bp, Artificial Sequence
  Description of Artificial Sequence: Synthetic oligonucleotide
gctatctggtgcccaggctat

SEQ ID NO: 5784 - DNA, 21 bp, Artificial Sequence
  Description of Artificial Sequence: Synthetic oligonucleotide
agcctgggcaccagatagcta

SEQ ID NO: 5785 - DNA, 21 bp, Artificial Sequence
  Description of Artificial Sequence: Synthetic oligonucleotide
ctatctggtgcccaggctatt

SEQ ID NO: 5786 - DNA, 21 bp, Artificial Sequence
  Description of Artificial Sequence: Synthetic oligonucleotide
tagcctgggcaccagatagct

SEQ ID NO: 5787 - DNA, 21 bp, Artificial Sequence
  Description of Artificial Sequence: Synthetic oligonucleotide
tatctggtgcccaggctattc

SEQ ID NO: 5788 - DNA, 21 bp, Artificial Sequence
  Description of Artificial Sequence: Synthetic oligonucleotide
atagcctgggcaccagatagc

SEQ ID NO: 5789 - DNA, 21 bp, Artificial Sequence
  Description of Artificial Sequence: Synthetic oligonucleotide
atctggtgcccaggctattcg

SEQ ID NO: 5790 - DNA, 21 bp, Artificial Sequence
  Description of Artificial Sequence: Synthetic oligonucleotide
aatagcctgggcaccagatag

SEQ ID NO: 5791 - DNA, 21 bp, Artificial Sequence
  Description of Artificial Sequence: Synthetic oligonucleotide
tctggtgcccaggctattcgg

SEQ ID NO: 5792 - DNA, 21 bp, Artificial Sequence
  Description of Artificial Sequence: Synthetic oligonucleotide
gaatagcctgggcaccagata

SEQ ID NO: 5793 - DNA, 21 bp, Artificial Sequence
  Description of Artificial Sequence: Synthetic oligonucleotide
ctggtgcccaggctattcgga

SEQ ID NO: 5794 - DNA, 21 bp, Artificial Sequence
  Description of Artificial Sequence: Synthetic oligonucleotide
cgaatagcctgggcaccagat

SEQ ID NO: 5795 - DNA, 21 bp, Artificial Sequence
  Description of Artificial Sequence: Synthetic oligonucleotide
tggtgcccaggctattcggaa

SEQ ID NO: 5796 - DNA, 21 bp, Artificial Sequence
  Description of Artificial Sequence: Synthetic oligonucleotide
ccgaatagcctgggcaccaga

SEQ ID NO: 5797 - DNA, 21 bp, Artificial Sequence
  Description of Artificial Sequence: Synthetic oligonucleotide
ggtgcccaggctattcggaaa

SEQ ID NO: 5798 - DNA, 21 bp, Artificial Sequence
  Description of Artificial Sequence: Synthetic oligonucleotide
tccgaatagcctgggcaccag

SEQ ID NO: 5799 - DNA, 21 bp, Artificial Sequence
  Description of Artificial Sequence: Synthetic oligonucleotide
gtgcccaggctattcggaaac

SEQ ID NO: 5800 - DNA, 21 bp, Artificial Sequence
  Description of Artificial Sequence: Synthetic oligonucleotide
ttccgaatagcctgggcacca

SEQ ID NO: 5801 - DNA, 21 bp, Artificial Sequence
  Description of Artificial Sequence: Synthetic oligonucleotide
tgcccaggctattcggaaact

SEQ ID NO: 5802 - DNA, 21 bp, Artificial Sequence
  Description of Artificial Sequence: Synthetic oligonucleotide
tttccgaatagcctgggcacc

SEQ ID NO: 5803 - DNA, 21 bp, Artificial Sequence
  Description of Artificial Sequence: Synthetic oligonucleotide
gcccaggctattcggaaactc

SEQ ID NO: 5804 - DNA, 21 bp, Artificial Sequence
  Description of Artificial Sequence: Synthetic oligonucleotide
gtttccgaatagcctgggcac

SEQ ID NO: 5805 - DNA, 21 bp, Artificial Sequence
  Description of Artificial Sequence: Synthetic oligonucleotide
cccaggctattcggaaactca

SEQ ID NO: 5806 - DNA, 21 bp, Artificial Sequence
  Description of Artificial Sequence: Synthetic oligonucleotide
agtttccgaatagcctgggca

SEQ ID NO: 5807 - DNA, 21 bp, Artificial Sequence
  Description of Artificial Sequence: Synthetic oligonucleotide
ccaggctattcggaaactcag

SEQ ID NO: 5808 - DNA, 21 bp, Artificial Sequence
  Description of Artificial Sequence: Synthetic oligonucleotide
gagtttccgaatagcctgggc

SEQ ID NO: 5809 - DNA, 21 bp, Artificial Sequence
  Description of Artificial Sequence: Synthetic oligonucleotide
caggctattcggaaactcaga

SEQ ID NO: 5810 - DNA, 21 bp, Artificial Sequence
  Description of Artificial Sequence: Synthetic oligonucleotide
tgagtttccgaatagcctggg

SEQ ID NO: 5811 - DNA, 21 bp, Artificial Sequence
  Description of Artificial Sequence: Synthetic oligonucleotide
aggctattcggaaactcagat

SEQ ID NO: 5812 - DNA, 21 bp, Artificial Sequence
  Description of Artificial Sequence: Synthetic oligonucleotide
ctgagtttccgaatagcctgg

SEQ ID NO: 5813 - DNA, 21 bp, Artificial Sequence
  Description of Artificial Sequence: Synthetic oligonucleotide
ggctattcggaaactcagata

SEQ ID NO: 5814 - DNA, 21 bp, Artificial Sequence
  Description of Artificial Sequence: Synthetic oligonucleotide
tctgagtttccgaatagcctg

SEQ ID NO: 5815 - DNA, 21 bp, Artificial Sequence
  Description of Artificial Sequence: Synthetic oligonucleotide
gctattcggaaactcagataa

SEQ ID NO: 5816 - DNA, 21 bp, Artificial Sequence
  Description of Artificial Sequence: Synthetic oligonucleotide
atctgagtttccgaatagcct

SEQ ID NO: 5817 - DNA, 21 bp, Artificial Sequence
  Description of Artificial Sequence: Synthetic oligonucleotide
ctattcggaaactcagataaa

SEQ ID NO: 5818 - DNA, 21 bp, Artificial Sequence
  Description of Artificial Sequence: Synthetic oligonucleotide
tatctgagtttccgaatagcc

SEQ ID NO: 5819 - DNA, 21 bp, Artificial Sequence
  Description of Artificial Sequence: Synthetic oligonucleotide
tattcggaaactcagataaat

SEQ ID NO: 5820 - DNA, 21 bp, Artificial Sequence
  Description of Artificial Sequence: Synthetic oligonucleotide
ttatctgagtttccgaatagc

SEQ ID NO: 5821 - DNA, 21 bp, Artificial Sequence
  Description of Artificial Sequence: Synthetic oligonucleotide
attcggaaactcagataaatg

SEQ ID NO: 5822 - DNA, 21 bp, Artificial Sequence
  Description of Artificial Sequence: Synthetic oligonucleotide
tttatctgagtttccgaatag

SEQ ID NO: 5823 - DNA, 21 bp, Artificial Sequence
  Description of Artificial Sequence: Synthetic oligonucleotide
ttcggaaactcagataaatgc

SEQ ID NO: 5824 - DNA, 21 bp, Artificial Sequence
  Description of Artificial Sequence: Synthetic oligonucleotide
atttatctgagtttccgaata

SEQ ID NO: 5825 - DNA, 21 bp, Artificial Sequence
  Description of Artificial Sequence: Synthetic oligonucleotide
tcggaaactcagataaatgct

SEQ ID NO: 5826 - DNA, 21 bp, Artificial Sequence
  Description of Artificial Sequence: Synthetic oligonucleotide
catttatctgagtttccgaat

SEQ ID NO: 5827 - DNA, 21 bp, Artificial Sequence
  Description of Artificial Sequence: Synthetic oligonucleotide
cggaaactcagataaatgcta

SEQ ID NO: 5828 - DNA, 21 bp, Artificial Sequence
  Description of Artificial Sequence: Synthetic oligonucleotide
gcatttatctgagtttccgaa

SEQ ID NO: 5829 - DNA, 21 bp, Artificial Sequence
  Description of Artificial Sequence: Synthetic oligonucleotide
ggaaactcagataaatgctac

SEQ ID NO: 5830 - DNA, 21 bp, Artificial Sequence
  Description of Artificial Sequence: Synthetic oligonucleotide
agcatttatctgagtttccga

SEQ ID NO: 5831 - DNA, 21 bp, Artificial Sequence
  Description of Artificial Sequence: Synthetic oligonucleotide
gaaactcagataaatgctact

SEQ ID NO: 5832 - DNA, 21 bp, Artificial Sequence
  Description of Artificial Sequence: Synthetic oligonucleotide
tagcatttatctgagtttccg

SEQ ID NO: 5833 - DNA, 21 bp, Artificial Sequence
  Description of Artificial Sequence: Synthetic oligonucleotide
aaactcagataaatgctactc

SEQ ID NO: 5834 - DNA, 21 bp, Artificial Sequence
  Description of Artificial Sequence: Synthetic oligonucleotide
gtagcatttatctgagtttcc

SEQ ID NO: 5835 - DNA, 21 bp, Artificial Sequence
  Description of Artificial Sequence: Synthetic oligonucleotide
aactcagataaatgctactca

SEQ ID NO: 5836 - DNA, 21 bp, Artificial Sequence
  Description of Artificial Sequence: Synthetic oligonucleotide
agtagcatttatctgagtttc

SEQ ID NO: 5837 - DNA, 21 bp, Artificial Sequence
  Description of Artificial Sequence: Synthetic oligonucleotide
actcagataaatgctactcag

SEQ ID NO: 5838 - DNA, 21 bp, Artificial Sequence
  Description of Artificial Sequence: Synthetic oligonucleotide
gagtagcatttatctgagttt

SEQ ID NO: 5839 - DNA, 21 bp, Artificial Sequence
  Description of Artificial Sequence: Synthetic oligonucleotide
ctcagataaatgctactcagg

SEQ ID NO: 5840 - DNA, 21 bp, Artificial Sequence
  Description of Artificial Sequence: Synthetic oligonucleotide
tgagtagcatttatctgagtt

SEQ ID NO: 5841 - DNA, 21 bp, Artificial Sequence
  Description of Artificial Sequence: Synthetic oligonucleotide
tcagataaatgctactcaggc

SEQ ID NO: 5842 - DNA, 21 bp, Artificial Sequence
  Description of Artificial Sequence: Synthetic oligonucleotide
ctgagtagcatttatctgagt

SEQ ID NO: 5843 - DNA, 21 bp, Artificial Sequence
  Description of Artificial Sequence: Synthetic oligonucleotide
cagataaatgctactcaggca

SEQ ID NO: 5844 - DNA, 21 bp, Artificial Sequence
  Description of Artificial Sequence: Synthetic oligonucleotide
cctgagtagcatttatctgag

SEQ ID NO: 5845 - DNA, 21 bp, Artificial Sequence
  Description of Artificial Sequence: Synthetic oligonucleotide
agataaatgctactcaggcaa

SEQ ID NO: 5846 - DNA, 21 bp, Artificial Sequence
  Description of Artificial Sequence: Synthetic oligonucleotide
gcctgagtagcatttatctga

SEQ ID NO: 5847 - DNA, 21 bp, Artificial Sequence
  Description of Artificial Sequence: Synthetic oligonucleotide
gataaatgctactcaggcaat

SEQ ID NO: 5848 - DNA, 21 bp, Artificial Sequence
  Description of Artificial Sequence: Synthetic oligonucleotide
tgcctgagtagcatttatctg

SEQ ID NO: 5849 - DNA, 21 bp, Artificial Sequence
  Description of Artificial Sequence: Synthetic oligonucleotide
ataaatgctactcaggcaatg

SEQ ID NO: 5850 - DNA, 21 bp, Artificial Sequence
  Description of Artificial Sequence: Synthetic oligonucleotide
ttgcctgagtagcatttatct

SEQ ID NO: 5851 - DNA, 21 bp, Artificial Sequence
  Description of Artificial Sequence: Synthetic oligonucleotide
taaatgctactcaggcaatga

SEQ ID NO: 5852 - DNA, 21 bp, Artificial Sequence
  Description of Artificial Sequence: Synthetic oligonucleotide
attgcctgagtagcatttatc

SEQ ID NO: 5853 - DNA, 21 bp, Artificial Sequence
  Description of Artificial Sequence: Synthetic oligonucleotide
aaatgctactcaggcaatgaa

SEQ ID NO: 5854 - DNA, 21 bp, Artificial Sequence
  Description of Artificial Sequence: Synthetic oligonucleotide
cattgcctgagtagcatttat

SEQ ID NO: 5855 - DNA, 21 bp, Artificial Sequence
  Description of Artificial Sequence: Synthetic oligonucleotide
aatgctactcaggcaatgaag

SEQ ID NO: 5856 - DNA, 21 bp, Artificial Sequence
  Description of Artificial Sequence: Synthetic oligonucleotide
tcattgcctgagtagcattta

SEQ ID NO: 5857 - DNA, 21 bp, Artificial Sequence
  Description of Artificial Sequence: Synthetic oligonucleotide
atgctactcaggcaatgaaga

SEQ ID NO: 5858 - DNA, 21 bp, Artificial Sequence
  Description of Artificial Sequence: Synthetic oligonucleotide
ttcattgcctgagtagcattt

SEQ ID NO: 5859 - DNA, 21 bp, Artificial Sequence
  Description of Artificial Sequence: Synthetic oligonucleotide
tgctactcaggcaatgaagaa

SEQ ID NO: 5860 - DNA, 21 bp, Artificial Sequence
  Description of Artificial Sequence: Synthetic oligonucleotide
cttcattgcctgagtagcatt

SEQ ID NO: 5861 - DNA, 21 bp, Artificial Sequence
  Description of Artificial Sequence: Synthetic oligonucleotide
gctactcaggcaatgaagaag

SEQ ID NO: 5862 - DNA, 21 bp, Artificial Sequence
  Description of Artificial Sequence: Synthetic oligonucleotide
tcttcattgcctgagtagcat

SEQ ID NO: 5863 - DNA, 21 bp, Artificial Sequence
  Description of Artificial Sequence: Synthetic oligonucleotide
ctactcaggcaatgaagaaga

SEQ ID NO: 5864 - DNA, 21 bp, Artificial Sequence
  Description of Artificial Sequence: Synthetic oligonucleotide
ttcttcattgcctgagtagca

SEQ ID NO: 5865 - DNA, 21 bp, Artificial Sequence
  Description of Artificial Sequence: Synthetic oligonucleotide
tactcaggcaatgaagaagag

SEQ ID NO: 5866 - DNA, 21 bp, Artificial Sequence
  Description of Artificial Sequence: Synthetic oligonucleotide
cttcttcattgcctgagtagc

SEQ ID NO: 5867 - DNA, 21 bp, Artificial Sequence
  Description of Artificial Sequence: Synthetic oligonucleotide
actcaggcaatgaagaagagg

SEQ ID NO: 5868 - DNA, 21 bp, Artificial Sequence
  Description of Artificial Sequence: Synthetic oligonucleotide
tcttcttcattgcctgagtag

SEQ ID NO: 5869 - DNA, 21 bp, Artificial Sequence
  Description of Artificial Sequence: Synthetic oligonucleotide
ctcaggcaatgaagaagagga

SEQ ID NO: 5870 - DNA, 21 bp, Artificial Sequence
  Description of Artificial Sequence: Synthetic oligonucleotide
ctcttcttcattgcctgagta

SEQ ID NO: 5871 - DNA, 21 bp, Artificial Sequence
  Description of Artificial Sequence: Synthetic oligonucleotide
tcaggcaatgaagaagaggag

SEQ ID NO: 5872 - DNA, 21 bp, Artificial Sequence
  Description of Artificial Sequence: Synthetic oligonucleotide
cctcttcttcattgcctgagt

SEQ ID NO: 5873 - DNA, 21 bp, Artificial Sequence
  Description of Artificial Sequence: Synthetic oligonucleotide
caggcaatgaagaagaggaga

SEQ ID NO: 5874 - DNA, 21 bp, Artificial Sequence
  Description of Artificial Sequence: Synthetic oligonucleotide
tcctcttcttcattgcctgag

SEQ ID NO: 5875 - DNA, 21 bp, Artificial Sequence
  Description of Artificial Sequence: Synthetic oligonucleotide
aggcaatgaagaagaggagaa

SEQ ID NO: 5876 - DNA, 21 bp, Artificial Sequence
  Description of Artificial Sequence: Synthetic oligonucleotide
ctcctcttcttcattgcctga

SEQ ID NO: 5877 - DNA, 21 bp, Artificial Sequence
  Description of Artificial Sequence: Synthetic oligonucleotide
ggcaatgaagaagaggagaaa

SEQ ID NO: 5878 - DNA, 21 bp, Artificial Sequence
  Description of Artificial Sequence: Synthetic oligonucleotide
tctcctcttcttcattgcctg

SEQ ID NO: 5879 - DNA, 21 bp, Artificial Sequence
  Description of Artificial Sequence: Synthetic oligonucleotide
gcaatgaagaagaggagaaaa

SEQ ID NO: 5880 - DNA, 21 bp, Artificial Sequence
  Description of Artificial Sequence: Synthetic oligonucleotide
ttctcctcttcttcattgcct

SEQ ID NO: 5881 - DNA, 21 bp, Artificial Sequence
  Description of Artificial Sequence: Synthetic oligonucleotide
caatgaagaagaggagaaaaa

SEQ ID NO: 5882 - DNA, 21 bp, Artificial Sequence
  Description of Artificial Sequence: Synthetic oligonucleotide
tttctcctcttcttcattgcc

SEQ ID NO: 5883 - DNA, 21 bp, Artificial Sequence
  Description of Artificial Sequence: Synthetic oligonucleotide
aatgaagaagaggagaaaaag

SEQ ID NO: 5884 - DNA, 21 bp, Artificial Sequence
  Description of Artificial Sequence: Synthetic oligonucleotide
ttttctcctcttcttcattgc

SEQ ID NO: 5885 - DNA, 21 bp, Artificial Sequence
  Description of Artificial Sequence: Synthetic oligonucleotide
atgaagaagaggagaaaaagg

SEQ ID NO: 5886 - DNA, 21 bp, Artificial Sequence
  Description of Artificial Sequence: Synthetic oligonucleotide
tttttctcctcttcttcattg

SEQ ID NO: 5887 - DNA, 21 bp, Artificial Sequence
  Description of Artificial Sequence: Synthetic oligonucleotide
tgaagaagaggagaaaaagga

SEQ ID NO: 5888 - DNA, 21 bp, Artificial Sequence
  Description of Artificial Sequence: Synthetic oligonucleotide
ctttttctcctcttcttcatt

SEQ ID NO: 5889 - DNA, 21 bp, Artificial Sequence
  Description of Artificial Sequence: Synthetic oligonucleotide
gaagaagaggagaaaaaggaa

SEQ ID NO: 5890 - DNA, 21 bp, Artificial Sequence
  Description of Artificial Sequence: Synthetic oligonucleotide
cctttttctcctcttcttcat

SEQ ID NO: 5891 - DNA, 21 bp, Artificial Sequence
  Description of Artificial Sequence: Synthetic oligonucleotide
aagaagaggagaaaaaggaaa

SEQ ID NO: 5892 - DNA, 21 bp, Artificial Sequence
  Description of Artificial Sequence: Synthetic oligonucleotide
tcctttttctcctcttcttca

SEQ ID NO: 5893 - DNA, 21 bp, Artificial Sequence
  Description of Artificial Sequence: Synthetic oligonucleotide
agaagaggagaaaaaggaaag

SEQ ID NO: 5894 - DNA, 21 bp, Artificial Sequence
  Description of Artificial Sequence: Synthetic oligonucleotide
ttcctttttctcctcttcttc

SEQ ID NO: 5895 - DNA, 21 bp, Artificial Sequence
  Description of Artificial Sequence: Synthetic oligonucleotide
gaagaggagaaaaaggaaagt

SEQ ID NO: 5896 - DNA, 21 bp, Artificial Sequence
  Description of Artificial Sequence: Synthetic oligonucleotide
tttcctttttctcctcttctt

SEQ ID NO: 5897 - DNA, 21 bp, Artificial Sequence
  Description of Artificial Sequence: Synthetic oligonucleotide
aagaggagaaaaaggaaagtc

SEQ ID NO: 5898 - DNA, 21 bp, Artificial Sequence
  Description of Artificial Sequence: Synthetic oligonucleotide
ctttcctttttctcctcttct

SEQ ID NO: 5899 - DNA, 21 bp, Artificial Sequence
  Description of Artificial Sequence: Synthetic oligonucleotide
agaggagaaaaaggaaagtca

SEQ ID NO: 5900 - DNA, 21 bp, Artificial Sequence
  Description of Artificial Sequence: Synthetic oligonucleotide
actttcctttttctcctcttc

SEQ ID NO: 5901 - DNA, 21 bp, Artificial Sequence
  Description of Artificial Sequence: Synthetic oligonucleotide
gaggagaaaaaggaaagtcac

SEQ ID NO: 5902 - DNA, 21 bp, Artificial Sequence
  Description of Artificial Sequence: Synthetic oligonucleotide
gactttcctttttctcctctt

SEQ ID NO: 5903 - DNA, 21 bp, Artificial Sequence
  Description of Artificial Sequence: Synthetic oligonucleotide
aggagaaaaaggaaagtcaca

SEQ ID NO: 5904 - DNA, 21 bp, Artificial Sequence
  Description of Artificial Sequence: Synthetic oligonucleotide
tgactttcctttttctcctct

SEQ ID NO: 5905 - DNA, 21 bp, Artificial Sequence
  Description of Artificial Sequence: Synthetic oligonucleotide
ggagaaaaaggaaagtcacaa

SEQ ID NO: 5906 - DNA, 21 bp, Artificial Sequence
  Description of Artificial Sequence: Synthetic oligonucleotide
gtgactttcctttttctcctc

SEQ ID NO: 5907 - DNA, 21 bp, Artificial Sequence
  Description of Artificial Sequence: Synthetic oligonucleotide
gagaaaaaggaaagtcacaac

SEQ ID NO: 5908 - DNA, 21 bp, Artificial Sequence
  Description of Artificial Sequence: Synthetic oligonucleotide
tgtgactttcctttttctcct

SEQ ID NO: 5909 - DNA, 21 bp, Artificial Sequence
  Description of Artificial Sequence: Synthetic oligonucleotide
agaaaaaggaaagtcacaacc

SEQ ID NO: 5910 - DNA, 21 bp, Artificial Sequence
  Description of Artificial Sequence: Synthetic oligonucleotide
ttgtgactttcctttttctcc

SEQ ID NO: 5911 - DNA, 21 bp, Artificial Sequence
  Description of Artificial Sequence: Synthetic oligonucleotide
gaaaaaggaaagtcacaacca

SEQ ID NO: 5912 - DNA, 21 bp, Artificial Sequence
  Description of Artificial Sequence: Synthetic oligonucleotide
gttgtgactttcctttttctc

SEQ ID NO: 5913 - DNA, 21 bp, Artificial Sequence
  Description of Artificial Sequence: Synthetic oligonucleotide
aaaaaggaaagtcacaaccaa

SEQ ID NO: 5914 - DNA, 21 bp, Artificial Sequence
  Description of Artificial Sequence: Synthetic oligonucleotide
ggttgtgactttcctttttct

SEQ ID NO: 5915 - DNA, 21 bp, Artificial Sequence
  Description of Artificial Sequence: Synthetic oligonucleotide
aaaaggaaagtcacaaccaat

SEQ ID NO: 5916 - DNA, 21 bp, Artificial Sequence
  Description of Artificial Sequence: Synthetic oligonucleotide
tggttgtgactttcctttttc

SEQ ID NO: 5917 - DNA, 21 bp, Artificial Sequence
  Description of Artificial Sequence: Synthetic oligonucleotide
aaaggaaagtcacaaccaata

SEQ ID NO: 5918 - DNA, 21 bp, Artificial Sequence
  Description of Artificial Sequence: Synthetic oligonucleotide
ttggttgtgactttccttttt

SEQ ID NO: 5919 - DNA, 21 bp, Artificial Sequence
  Description of Artificial Sequence: Synthetic oligonucleotide
aaggaaagtcacaaccaataa

SEQ ID NO: 5920 - DNA, 21 bp, Artificial Sequence
  Description of Artificial Sequence: Synthetic oligonucleotide
attggttgtgactttcctttt

SEQ ID NO: 5921 - DNA, 21 bp, Artificial Sequence
  Description of Artificial Sequence: Synthetic oligonucleotide
aggaaagtcacaaccaataaa

SEQ ID NO: 5922 - DNA, 21 bp, Artificial Sequence
  Description of Artificial Sequence: Synthetic oligonucleotide
tattggttgtgactttccttt

SEQ ID NO: 5923 - DNA, 21 bp, Artificial Sequence
  Description of Artificial Sequence: Synthetic oligonucleotide
ggaaagtcacaaccaataaat

SEQ ID NO: 5924 - DNA, 21 bp, Artificial Sequence
  Description of Artificial Sequence: Synthetic oligonucleotide
ttattggttgtgactttcctt

SEQ ID NO: 5925 - DNA, 21 bp, Artificial Sequence
  Description of Artificial Sequence: Synthetic oligonucleotide
gaaagtcacaaccaataaatg

SEQ ID NO: 5926 - DNA, 21 bp, Artificial Sequence
  Description of Artificial Sequence: Synthetic oligonucleotide
tttattggttgtgactttcct

SEQ ID NO: 5927 - DNA, 21 bp, Artificial Sequence
  Description of Artificial Sequence: Synthetic oligonucleotide
aaagtcacaaccaataaatgt

SEQ ID NO: 5928 - DNA, 21 bp, Artificial Sequence
  Description of Artificial Sequence: Synthetic oligonucleotide
atttattggttgtgactttcc

SEQ ID NO: 5929 - DNA, 21 bp, Artificial Sequence
  Description of Artificial Sequence: Synthetic oligonucleotide
aagtcacaaccaataaatgtc

SEQ ID NO: 5930 - DNA, 21 bp, Artificial Sequence
  Description of Artificial Sequence: Synthetic oligonucleotide
catttattggttgtgactttc

SEQ ID NO: 5931 - DNA, 21 bp, Artificial Sequence
  Description of Artificial Sequence: Synthetic oligonucleotide
agtcacaaccaataaatgtct

SEQ ID NO: 5932 - DNA, 21 bp, Artificial Sequence
  Description of Artificial Sequence: Synthetic oligonucleotide
acatttattggttgtgacttt

SEQ ID NO: 5933 - DNA, 21 bp, Artificial Sequence
  Description of Artificial Sequence: Synthetic oligonucleotide
gtcacaaccaataaatgtctg

SEQ ID NO: 5934 - DNA, 21 bp, Artificial Sequence
  Description of Artificial Sequence: Synthetic oligonucleotide
gacatttattggttgtgactt

SEQ ID NO: 5935 - DNA, 21 bp, Artificial Sequence
  Description of Artificial Sequence: Synthetic oligonucleotide
tcacaaccaataaatgtctgg

SEQ ID NO: 5936 - DNA, 21 bp, Artificial Sequence
  Description of Artificial Sequence: Synthetic oligonucleotide
agacatttattggttgtgact

SEQ ID NO: 5937 - DNA, 21 bp, Artificial Sequence
  Description of Artificial Sequence: Synthetic oligonucleotide
cacaaccaataaatgtctgga

SEQ ID NO: 5938 - DNA, 21 bp, Artificial Sequence
  Description of Artificial Sequence: Synthetic oligonucleotide
cagacatttattggttgtgac

SEQ ID NO: 5939 - DNA, 21 bp, Artificial Sequence
  Description of Artificial Sequence: Synthetic oligonucleotide
acaaccaataaatgtctggaa

SEQ ID NO: 5940 - DNA, 21 bp, Artificial Sequence
  Description of Artificial Sequence: Synthetic oligonucleotide
ccagacatttattggttgtga

SEQ ID NO: 5941 - DNA, 21 bp, Artificial Sequence
  Description of Artificial Sequence: Synthetic oligonucleotide
caaccaataaatgtctggaac

SEQ ID NO: 5942 - DNA, 21 bp, Artificial Sequence
  Description of Artificial Sequence: Synthetic oligonucleotide
tccagacatttattggttgtg

SEQ ID NO: 5943 - DNA, 21 bp, Artificial Sequence
  Description of Artificial Sequence: Synthetic oligonucleotide
aaccaataaatgtctggaaca

SEQ ID NO: 5944 - DNA, 21 bp, Artificial Sequence
  Description of Artificial Sequence: Synthetic oligonucleotide
ttccagacatttattggttgt

SEQ ID NO: 5945 - DNA, 21 bp, Artificial Sequence
  Description of Artificial Sequence: Synthetic oligonucleotide
accaataaatgtctggaacaa

SEQ ID NO: 5946 - DNA, 21 bp, Artificial Sequence
  Description of Artificial Sequence: Synthetic oligonucleotide
gttccagacatttattggttg

SEQ ID NO: 5947 - DNA, 21 bp, Artificial Sequence
  Description of Artificial Sequence: Synthetic oligonucleotide
ccaataaatgtctggaacaag

SEQ ID NO: 5948 - DNA, 21 bp, Artificial Sequence
  Description of Artificial Sequence: Synthetic oligonucleotide
tgttccagacatttattggtt

SEQ ID NO: 5949 - DNA, 21 bp, Artificial Sequence
  Description of Artificial Sequence: Synthetic oligonucleotide
caataaatgtctggaacaagt

SEQ ID NO: 5950 - DNA, 21 bp, Artificial Sequence
  Description of Artificial Sequence: Synthetic oligonucleotide
ttgttccagacatttattggt

SEQ ID NO: 5951 - DNA, 21 bp, Artificial Sequence
  Description of Artificial Sequence: Synthetic oligonucleotide
aataaatgtctggaacaagtg

SEQ ID NO: 5952 - DNA, 21 bp, Artificial Sequence
  Description of Artificial Sequence: Synthetic oligonucleotide
cttgttccagacatttattgg

SEQ ID NO: 5953 - DNA, 21 bp, Artificial Sequence
  Description of Artificial Sequence: Synthetic oligonucleotide
ataaatgtctggaacaagtgt

SEQ ID NO: 5954 - DNA, 21 bp, Artificial Sequence
  Description of Artificial Sequence: Synthetic oligonucleotide
acttgttccagacatttattg

SEQ ID NO: 5955 - DNA, 21 bp, Artificial Sequence
  Description of Artificial Sequence: Synthetic oligonucleotide
taaatgtctggaacaagtgtc

SEQ ID NO: 5956 - DNA, 21 bp, Artificial Sequence
  Description of Artificial Sequence: Synthetic oligonucleotide
cacttgttccagacatttatt

SEQ ID NO: 5957 - DNA, 21 bp, Artificial Sequence
  Description of Artificial Sequence: Synthetic oligonucleotide
aaatgtctggaacaagtgtca

SEQ ID NO: 5958 - DNA, 21 bp, Artificial Sequence
  Description of Artificial Sequence: Synthetic oligonucleotide
acacttgttccagacatttat

SEQ ID NO: 5959 - DNA, 21 bp, Artificial Sequence
  Description of Artificial Sequence: Synthetic oligonucleotide
aatgtctggaacaagtgtcac

SEQ ID NO: 5960 - DNA, 21 bp, Artificial Sequence
  Description of Artificial Sequence: Synthetic oligonucleotide
gacacttgttccagacattta

SEQ ID NO: 5961 - DNA, 21 bp, Artificial Sequence
  Description of Artificial Sequence: Synthetic oligonucleotide
atgtctggaacaagtgtcaca

SEQ ID NO: 5962 - DNA, 21 bp, Artificial Sequence
  Description of Artificial Sequence: Synthetic oligonucleotide
tgacacttgttccagacattt

SEQ ID NO: 5963 - DNA, 21 bp, Artificial Sequence
  Description of Artificial Sequence: Synthetic oligonucleotide
tgtctggaacaagtgtcacaa

SEQ ID NO: 5964 - DNA, 21 bp, Artificial Sequence
  Description of Artificial Sequence: Synthetic oligonucleotide
gtgacacttgttccagacatt

SEQ ID NO: 5965 - DNA, 21 bp, Artificial Sequence
  Description of Artificial Sequence: Synthetic oligonucleotide
gtctggaacaagtgtcacaat

SEQ ID NO: 5966 - DNA, 21 bp, Artificial Sequence
  Description of Artificial Sequence: Synthetic oligonucleotide
tgtgacacttgttccagacat

SEQ ID NO: 5967 - DNA, 21 bp, Artificial Sequence
  Description of Artificial Sequence: Synthetic oligonucleotide
tctggaacaagtgtcacaatt

SEQ ID NO: 5968 - DNA, 21 bp, Artificial Sequence
  Description of Artificial Sequence: Synthetic oligonucleotide
ttgtgacacttgttccagaca

SEQ ID NO: 5969 - DNA, 21 bp, Artificial Sequence
  Description of Artificial Sequence: Synthetic oligonucleotide
ctggaacaagtgtcacaatta

SEQ ID NO: 5970 - DNA, 21 bp, Artificial Sequence
  Description of Artificial Sequence: Synthetic oligonucleotide
attgtgacacttgttccagac

SEQ ID NO: 5971 - DNA, 21 bp, Artificial Sequence
  Description of Artificial Sequence: Synthetic oligonucleotide
tggaacaagtgtcacaattac

SEQ ID NO: 5972 - DNA, 21 bp, Artificial Sequence
  Description of Artificial Sequence: Synthetic oligonucleotide
aattgtgacacttgttccaga

SEQ ID NO: 5973 - DNA, 21 bp, Artificial Sequence
  Description of Artificial Sequence: Synthetic oligonucleotide
ggaacaagtgtcacaattaca

SEQ ID NO: 5974 - DNA, 21 bp, Artificial Sequence
  Description of Artificial Sequence: Synthetic oligonucleotide
taattgtgacacttgttccag

SEQ ID NO: 5975 - DNA, 21 bp, Artificial Sequence
  Description of Artificial Sequence: Synthetic oligonucleotide
gaacaagtgtcacaattacaa

SEQ ID NO: 5976 - DNA, 21 bp, Artificial Sequence
  Description of Artificial Sequence: Synthetic oligonucleotide
gtaattgtgacacttgttcca

SEQ ID NO: 5977 - DNA, 21 bp, Artificial Sequence
  Description of Artificial Sequence: Synthetic oligonucleotide
aacaagtgtcacaattacaag

SEQ ID NO: 5978 - DNA, 21 bp, Artificial Sequence
  Description of Artificial Sequence: Synthetic oligonucleotide
tgtaattgtgacacttgttcc

SEQ ID NO: 5979 - DNA, 21 bp, Artificial Sequence
  Description of Artificial Sequence: Synthetic oligonucleotide
acaagtgtcacaattacaagg

SEQ ID NO: 5980 - DNA, 21 bp, Artificial Sequence
  Description of Artificial Sequence: Synthetic oligonucleotide
ttgtaattgtgacacttgttc

SEQ ID NO: 5981 - DNA, 21 bp, Artificial Sequence
  Description of Artificial Sequence: Synthetic oligonucleotide
caagtgtcacaattacaagga

SEQ ID NO: 5982 - DNA, 21 bp, Artificial Sequence
  Description of Artificial Sequence: Synthetic oligonucleotide
cttgtaattgtgacacttgtt

SEQ ID NO: 5983 - DNA, 21 bp, Artificial Sequence
  Description of Artificial Sequence: Synthetic oligonucleotide
aagtgtcacaattacaaggat

SEQ ID NO: 5984 - DNA, 21 bp, Artificial Sequence
  Description of Artificial Sequence: Synthetic oligonucleotide
ccttgtaattgtgacacttgt

SEQ ID NO: 5985 - DNA, 21 bp, Artificial Sequence
  Description of Artificial Sequence: Synthetic oligonucleotide
agtgtcacaattacaaggatt

SEQ ID NO: 5986 - DNA, 21 bp, Artificial Sequence
  Description of Artificial Sequence: Synthetic oligonucleotide
tccttgtaattgtgacacttg

SEQ ID NO: 5987 - DNA, 21 bp, Artificial Sequence
  Description of Artificial Sequence: Synthetic oligonucleotide
gtgtcacaattacaaggattg

SEQ ID NO: 5988 - DNA, 21 bp, Artificial Sequence
  Description of Artificial Sequence: Synthetic oligonucleotide
atccttgtaattgtgacactt

SEQ ID NO: 5989 - DNA, 21 bp, Artificial Sequence
  Description of Artificial Sequence: Synthetic oligonucleotide
tgtcacaattacaaggattgt

SEQ ID NO: 5990 - DNA, 21 bp, Artificial Sequence
  Description of Artificial Sequence: Synthetic oligonucleotide
aatccttgtaattgtgacact

SEQ ID NO: 5991 - DNA, 21 bp, Artificial Sequence
  Description of Artificial Sequence: Synthetic oligonucleotide
gtcacaattacaaggattgtg

SEQ ID NO: 5992 - DNA, 21 bp, Artificial Sequence
  Description of Artificial Sequence: Synthetic oligonucleotide
caatccttgtaattgtgacac

SEQ ID NO: 5993 - DNA, 21 bp, Artificial Sequence
  Description of Artificial Sequence: Synthetic oligonucleotide
tcacaattacaaggattgtgg

SEQ ID NO: 5994 - DNA, 21 bp, Artificial Sequence
  Description of Artificial Sequence: Synthetic oligonucleotide
acaatccttgtaattgtgaca

SEQ ID NO: 5995 - DNA, 21 bp, Artificial Sequence
  Description of Artificial Sequence: Synthetic oligonucleotide
cacaattacaaggattgtggc

SEQ ID NO: 5996 - DNA, 21 bp, Artificial Sequence
  Description of Artificial Sequence: Synthetic oligonucleotide
cacaatccttgtaattgtgac

SEQ ID NO: 5997 - DNA, 21 bp, Artificial Sequence
  Description of Artificial Sequence: Synthetic oligonucleotide
acaattacaaggattgtggcg

SEQ ID NO: 5998 - DNA, 21 bp, Artificial Sequence
  Description of Artificial Sequence: Synthetic oligonucleotide
ccacaatccttgtaattgtga

SEQ ID NO: 5999 - DNA, 21 bp, Artificial Sequence
  Description of Artificial Sequence: Synthetic oligonucleotide
caattacaaggattgtggcgt

SEQ ID NO: 6000 - DNA, 21 bp, Artificial Sequence
  Description of Artificial Sequence: Synthetic oligonucleotide
gccacaatccttgtaattgtg

SEQ ID NO: 6001 - DNA, 21 bp, Artificial Sequence
  Description of Artificial Sequence: Synthetic oligonucleotide
aattacaaggattgtggcgtc

SEQ ID NO: 6002 - DNA, 21 bp, Artificial Sequence
  Description of Artificial Sequence: Synthetic oligonucleotide
cgccacaatccttgtaattgt

SEQ ID NO: 6003 - DNA, 21 bp, Artificial Sequence
  Description of Artificial Sequence: Synthetic oligonucleotide
attacaaggattgtggcgtcg

SEQ ID NO: 6004 - DNA, 21 bp, Artificial Sequence
  Description of Artificial Sequence: Synthetic oligonucleotide
acgccacaatccttgtaattg

SEQ ID NO: 6005 - DNA, 21 bp, Artificial Sequence
  Description of Artificial Sequence: Synthetic oligonucleotide
ttacaaggattgtggcgtcgc

SEQ ID NO: 6006 - DNA, 21 bp, Artificial Sequence
  Description of Artificial Sequence: Synthetic oligonucleotide
gacgccacaatccttgtaatt

SEQ ID NO: 6007 - DNA, 21 bp, Artificial Sequence
  Description of Artificial Sequence: Synthetic oligonucleotide
tacaaggattgtggcgtcgct

SEQ ID NO: 6008 - DNA, 21 bp, Artificial Sequence
  Description of Artificial Sequence: Synthetic oligonucleotide
cgacgccacaatccttgtaat

SEQ ID NO: 6009 - DNA, 21 bp, Artificial Sequence
  Description of Artificial Sequence: Synthetic oligonucleotide
acaaggattgtggcgtcgctt

SEQ ID NO: 6010 - DNA, 21 bp, Artificial Sequence
  Description of Artificial Sequence: Synthetic oligonucleotide
gcgacgccacaatccttgtaa

SEQ ID NO: 6011 - DNA, 21 bp, Artificial Sequence
  Description of Artificial Sequence: Synthetic oligonucleotide
caaggattgtggcgtcgcttc

SEQ ID NO: 6012 - DNA, 21 bp, Artificial Sequence
  Description of Artificial Sequence: Synthetic oligonucleotide
agcgacgccacaatccttgta

SEQ ID NO: 6013 - DNA, 21 bp, Artificial Sequence
  Description of Artificial Sequence: Synthetic oligonucleotide
aaggattgtggcgtcgcttca

SEQ ID NO: 6014 - DNA, 21 bp, Artificial Sequence
  Description of Artificial Sequence: Synthetic oligonucleotide
aagcgacgccacaatccttgt

SEQ ID NO: 6015 - DNA, 21 bp, Artificial Sequence
  Description of Artificial Sequence: Synthetic oligonucleotide
aggattgtggcgtcgcttcaa

SEQ ID NO: 6016 - DNA, 21 bp, Artificial Sequence
  Description of Artificial Sequence: Synthetic oligonucleotide
gaagcgacgccacaatccttg

SEQ ID NO: 6017 - DNA, 21 bp, Artificial Sequence
  Description of Artificial Sequence: Synthetic oligonucleotide
ggattgtggcgtcgcttcaat

SEQ ID NO: 6018 - DNA, 21 bp, Artificial Sequence
  Description of Artificial Sequence: Synthetic oligonucleotide
tgaagcgacgccacaatcctt

SEQ ID NO: 6019 - DNA, 21 bp, Artificial Sequence
  Description of Artificial Sequence: Synthetic oligonucleotide
gattgtggcgtcgcttcaatc

SEQ ID NO: 6020 - DNA, 21 bp, Artificial Sequence
  Description of Artificial Sequence: Synthetic oligonucleotide
ttgaagcgacgccacaatcct

SEQ ID NO: 6021 - DNA, 21 bp, Artificial Sequence
  Description of Artificial Sequence: Synthetic oligonucleotide
attgtggcgtcgcttcaatcg

SEQ ID NO: 6022 - DNA, 21 bp, Artificial Sequence
  Description of Artificial Sequence: Synthetic oligonucleotide
attgaagcgacgccacaatcc

SEQ ID NO: 6023 - DNA, 21 bp, Artificial Sequence
  Description of Artificial Sequence: Synthetic oligonucleotide
ttgtggcgtcgcttcaatcga

SEQ ID NO: 6024 - DNA, 21 bp, Artificial Sequence
  Description of Artificial Sequence: Synthetic oligonucleotide
gattgaagcgacgccacaatc

SEQ ID NO: 6025 - DNA, 21 bp, Artificial Sequence
  Description of Artificial Sequence: Synthetic oligonucleotide
tgtggcgtcgcttcaatcgac

SEQ ID NO: 6026 - DNA, 21 bp, Artificial Sequence
  Description of Artificial Sequence: Synthetic oligonucleotide
cgattgaagcgacgccacaat

SEQ ID NO: 6027 - DNA, 21 bp, Artificial Sequence
  Description of Artificial Sequence: Synthetic oligonucleotide
gtggcgtcgcttcaatcgacc

SEQ ID NO: 6028 - DNA, 21 bp, Artificial Sequence
  Description of Artificial Sequence: Synthetic oligonucleotide
tcgattgaagcgacgccacaa

SEQ ID NO: 6029 - DNA, 21 bp, Artificial Sequence
  Description of Artificial Sequence: Synthetic oligonucleotide
tggcgtcgcttcaatcgacct

SEQ ID NO: 6030 - DNA, 21 bp, Artificial Sequence
  Description of Artificial Sequence: Synthetic oligonucleotide
gtcgattgaagcgacgccaca

SEQ ID NO: 6031 - DNA, 21 bp, Artificial Sequence
  Description of Artificial Sequence: Synthetic oligonucleotide
ggcgtcgcttcaatcgacctt

SEQ ID NO: 6032 - DNA, 21 bp, Artificial Sequence
  Description of Artificial Sequence: Synthetic oligonucleotide
ggtcgattgaagcgacgccac

SEQ ID NO: 6033 - DNA, 21 bp, Artificial Sequence
  Description of Artificial Sequence: Synthetic oligonucleotide
gcgtcgcttcaatcgaccttt

SEQ ID NO: 6034 - DNA, 21 bp, Artificial Sequence
  Description of Artificial Sequence: Synthetic oligonucleotide
aggtcgattgaagcgacgcca

SEQ ID NO: 6035 - DNA, 21 bp, Artificial Sequence
  Description of Artificial Sequence: Synthetic oligonucleotide
cgtcgcttcaatcgaccttta

SEQ ID NO: 6036 - DNA, 21 bp, Artificial Sequence
  Description of Artificial Sequence: Synthetic oligonucleotide
aaggtcgattgaagcgacgcc

SEQ ID NO: 6037 - DNA, 21 bp, Artificial Sequence
  Description of Artificial Sequence: Synthetic oligonucleotide
gtcgcttcaatcgacctttac

SEQ ID NO: 6038 - DNA, 21 bp, Artificial Sequence
  Description of Artificial Sequence: Synthetic oligonucleotide
aaaggtcgattgaagcgacgc

SEQ ID NO: 6039 - DNA, 21 bp, Artificial Sequence
  Description of Artificial Sequence: Synthetic oligonucleotide
tcgcttcaatcgacctttact

SEQ ID NO: 6040 - DNA, 21 bp, Artificial Sequence
  Description of Artificial Sequence: Synthetic oligonucleotide
taaaggtcgattgaagcgacg

SEQ ID NO: 6041 - DNA, 21 bp, Artificial Sequence
  Description of Artificial Sequence: Synthetic oligonucleotide
cgcttcaatcgacctttactg

SEQ ID NO: 6042 - DNA, 21 bp, Artificial Sequence
  Description of Artificial Sequence: Synthetic oligonucleotide
gtaaaggtcgattgaagcgac

SEQ ID NO: 6043 - DNA, 21 bp, Artificial Sequence
  Description of Artificial Sequence: Synthetic oligonucleotide
gcttcaatcgacctttactga

SEQ ID NO: 6044 - DNA, 21 bp, Artificial Sequence
  Description of Artificial Sequence: Synthetic oligonucleotide
agtaaaggtcgattgaagcga

SEQ ID NO: 6045 - DNA, 21 bp, Artificial Sequence
  Description of Artificial Sequence: Synthetic oligonucleotide
cttcaatcgacctttactgaa

SEQ ID NO: 6046 - DNA, 21 bp, Artificial Sequence
  Description of Artificial Sequence: Synthetic oligonucleotide
cagtaaaggtcgattgaagcg

SEQ ID NO: 6047 - DNA, 21 bp, Artificial Sequence
  Description of Artificial Sequence: Synthetic oligonucleotide
ttcaatcgacctttactgaaa

SEQ ID NO: 6048 - DNA, 21 bp, Artificial Sequence
  Description of Artificial Sequence: Synthetic oligonucleotide
tcagtaaaggtcgattgaagc

SEQ ID NO: 6049 - DNA, 21 bp, Artificial Sequence
  Description of Artificial Sequence: Synthetic oligonucleotide
tcaatcgacctttactgaaac

SEQ ID NO: 6050 - DNA, 21 bp, Artificial Sequence
  Description of Artificial Sequence: Synthetic oligonucleotide
ttcagtaaaggtcgattgaag

SEQ ID NO: 6051 - DNA, 21 bp, Artificial Sequence
  Description of Artificial Sequence: Synthetic oligonucleotide
caatcgacctttactgaaaca

SEQ ID NO: 6052 - DNA, 21 bp, Artificial Sequence
  Description of Artificial Sequence: Synthetic oligonucleotide
tttcagtaaaggtcgattgaa

SEQ ID NO: 6053 - DNA, 21 bp, Artificial Sequence
  Description of Artificial Sequence: Synthetic oligonucleotide
aatcgacctttactgaaacaa

SEQ ID NO: 6054 - DNA, 21 bp, Artificial Sequence
  Description of Artificial Sequence: Synthetic oligonucleotide
gtttcagtaaaggtcgattga

SEQ ID NO: 6055 - DNA, 21 bp, Artificial Sequence
  Description of Artificial Sequence: Synthetic oligonucleotide
atcgacctttactgaaacaac

SEQ ID NO: 6056 - DNA, 21 bp, Artificial Sequence
  Description of Artificial Sequence: Synthetic oligonucleotide
tgtttcagtaaaggtcgattg

SEQ ID NO: 6057 - DNA, 21 bp, Artificial Sequence
  Description of Artificial Sequence: Synthetic oligonucleotide
tcgacctttactgaaacaaca

SEQ ID NO: 6058 - DNA, 21 bp, Artificial Sequence
  Description of Artificial Sequence: Synthetic oligonucleotide
ttgtttcagtaaaggtcgatt

SEQ ID NO: 6059 - DNA, 21 bp, Artificial Sequence
  Description of Artificial Sequence: Synthetic oligonucleotide
cgacctttactgaaacaacag

SEQ ID NO: 6060 - DNA, 21 bp, Artificial Sequence
  Description of Artificial Sequence: Synthetic oligonucleotide
gttgtttcagtaaaggtcgat

SEQ ID NO: 6061 - DNA, 21 bp, Artificial Sequence
  Description of Artificial Sequence: Synthetic oligonucleotide
gacctttactgaaacaacagt

SEQ ID NO: 6062 - DNA, 21 bp, Artificial Sequence
  Description of Artificial Sequence: Synthetic oligonucleotide
tgttgtttcagtaaaggtcga

SEQ ID NO: 6063 - DNA, 21 bp, Artificial Sequence
  Description of Artificial Sequence: Synthetic oligonucleotide
acctttactgaaacaacagta

SEQ ID NO: 6064 - DNA, 21 bp, Artificial Sequence
  Description of Artificial Sequence: Synthetic oligonucleotide
ctgttgtttcagtaaaggtcg

SEQ ID NO: 6065 - DNA, 21 bp, Artificial Sequence
  Description of Artificial Sequence: Synthetic oligonucleotide
cctttactgaaacaacagtaa

SEQ ID NO: 6066 - DNA, 21 bp, Artificial Sequence
  Description of Artificial Sequence: Synthetic oligonucleotide
actgttgtttcagtaaaggtc

SEQ ID NO: 6067 - DNA, 21 bp, Artificial Sequence
  Description of Artificial Sequence: Synthetic oligonucleotide
ctttactgaaacaacagtaaa

SEQ ID NO: 6068 - DNA, 21 bp, Artificial Sequence
  Description of Artificial Sequence: Synthetic oligonucleotide
tactgttgtttcagtaaaggt

SEQ ID NO: 6069 - DNA, 21 bp, Artificial Sequence
  Description of Artificial Sequence: Synthetic oligonucleotide
tttactgaaacaacagtaaac

SEQ ID NO: 6070 - DNA, 21 bp, Artificial Sequence
  Description of Artificial Sequence: Synthetic oligonucleotide
ttactgttgtttcagtaaagg

SEQ ID NO: 6071 - DNA, 21 bp, Artificial Sequence
  Description of Artificial Sequence: Synthetic oligonucleotide
ttactgaaacaacagtaaacc

SEQ ID NO: 6072 - DNA, 21 bp, Artificial Sequence
  Description of Artificial Sequence: Synthetic oligonucleotide
tttactgttgtttcagtaaag

SEQ ID NO: 6073 - DNA, 21 bp, Artificial Sequence
  Description of Artificial Sequence: Synthetic oligonucleotide
tactgaaacaacagtaaacca

SEQ ID NO: 6074 - DNA, 21 bp, Artificial Sequence
  Description of Artificial Sequence: Synthetic oligonucleotide
gtttactgttgtttcagtaaa

SEQ ID NO: 6075 - DNA, 21 bp, Artificial Sequence
  Description of Artificial Sequence: Synthetic oligonucleotide
actgaaacaacagtaaaccat

SEQ ID NO: 6076 - DNA, 21 bp, Artificial Sequence
  Description of Artificial Sequence: Synthetic oligonucleotide
ggtttactgttgtttcagtaa

SEQ ID NO: 6077 - DNA, 21 bp, Artificial Sequence
  Description of Artificial Sequence: Synthetic oligonucleotide
ctgaaacaacagtaaaccatc

SEQ ID NO: 6078 - DNA, 21 bp, Artificial Sequence
  Description of Artificial Sequence: Synthetic oligonucleotide
tggtttactgttgtttcagta

SEQ ID NO: 6079 - DNA, 21 bp, Artificial Sequence
  Description of Artificial Sequence: Synthetic oligonucleotide
tgaaacaacagtaaaccatct

SEQ ID NO: 6080 - DNA, 21 bp, Artificial Sequence
  Description of Artificial Sequence: Synthetic oligonucleotide
atggtttactgttgtttcagt

SEQ ID NO: 6081 - DNA, 21 bp, Artificial Sequence
  Description of Artificial Sequence: Synthetic oligonucleotide
gaaacaacagtaaaccatctt

SEQ ID NO: 6082 - DNA, 21 bp, Artificial Sequence
  Description of Artificial Sequence: Synthetic oligonucleotide
gatggtttactgttgtttcag

SEQ ID NO: 6083 - DNA, 21 bp, Artificial Sequence
  Description of Artificial Sequence: Synthetic oligonucleotide
aaacaacagtaaaccatcttt

SEQ ID NO: 6084 - DNA, 21 bp, Artificial Sequence
  Description of Artificial Sequence: Synthetic oligonucleotide
agatggtttactgttgtttca

SEQ ID NO: 6085 - DNA, 21 bp, Artificial Sequence
  Description of Artificial Sequence: Synthetic oligonucleotide
aacaacagtaaaccatcttta

SEQ ID NO: 6086 - DNA, 21 bp, Artificial Sequence
  Description of Artificial Sequence: Synthetic oligonucleotide
aagatggtttactgttgtttc

SEQ ID NO: 6087 - DNA, 21 bp, Artificial Sequence
  Description of Artificial Sequence: Synthetic oligonucleotide
acaacagtaaaccatctttat

SEQ ID NO: 6088 - DNA, 21 bp, Artificial Sequence
  Description of Artificial Sequence: Synthetic oligonucleotide
aaagatggtttactgttgttt

SEQ ID NO: 6089 - DNA, 21 bp, Artificial Sequence
  Description of Artificial Sequence: Synthetic oligonucleotide
caacagtaaaccatctttatt

SEQ ID NO: 6090 - DNA, 21 bp, Artificial Sequence
  Description of Artificial Sequence: Synthetic oligonucleotide
taaagatggtttactgttgtt

SEQ ID NO: 6091 - DNA, 21 bp, Artificial Sequence
  Description of Artificial Sequence: Synthetic oligonucleotide
aacagtaaaccatctttatta

SEQ ID NO: 6092 - DNA, 21 bp, Artificial Sequence
  Description of Artificial Sequence: Synthetic oligonucleotide
ataaagatggtttactgttgt

SEQ ID NO: 6093 - DNA, 21 bp, Artificial Sequence
  Description of Artificial Sequence: Synthetic oligonucleotide
acagtaaaccatctttattat

SEQ ID NO: 6094 - DNA, 21 bp, Artificial Sequence
  Description of Artificial Sequence: Synthetic oligonucleotide
aataaagatggtttactgttg

SEQ ID NO: 6095 - DNA, 21 bp, Artificial Sequence
  Description of Artificial Sequence: Synthetic oligonucleotide
cagtaaaccatctttattatg

SEQ ID NO: 6096 - DNA, 21 bp, Artificial Sequence
  Description of Artificial Sequence: Synthetic oligonucleotide
taataaagatggtttactgtt

SEQ ID NO: 6097 - DNA, 21 bp, Artificial Sequence
  Description of Artificial Sequence: Synthetic oligonucleotide
agtaaaccatctttattatgg

SEQ ID NO: 6098 - DNA, 21 bp, Artificial Sequence
  Description of Artificial Sequence: Synthetic oligonucleotide
ataataaagatggtttactgt

SEQ ID NO: 6099 - DNA, 21 bp, Artificial Sequence
  Description of Artificial Sequence: Synthetic oligonucleotide
gtaaaccatctttattatggt

SEQ ID NO: 6100 - DNA, 21 bp, Artificial Sequence
  Description of Artificial Sequence: Synthetic oligonucleotide
cataataaagatggtttactg

SEQ ID NO: 6101 - DNA, 21 bp, Artificial Sequence
  Description of Artificial Sequence: Synthetic oligonucleotide
taaaccatctttattatggtc

SEQ ID NO: 6102 - DNA, 21 bp, Artificial Sequence
  Description of Artificial Sequence: Synthetic oligonucleotide
ccataataaagatggtttact

SEQ ID NO: 6103 - DNA, 21 bp, Artificial Sequence
  Description of Artificial Sequence: Synthetic oligonucleotide
aaaccatctttattatggtca

SEQ ID NO: 6104 - DNA, 21 bp, Artificial Sequence
  Description of Artificial Sequence: Synthetic oligonucleotide
accataataaagatggtttac

SEQ ID NO: 6105 - DNA, 21 bp, Artificial Sequence
  Description of Artificial Sequence: Synthetic oligonucleotide
aaccatctttattatggtcat

SEQ ID NO: 6106 - DNA, 21 bp, Artificial Sequence
  Description of Artificial Sequence: Synthetic oligonucleotide
gaccataataaagatggttta

SEQ ID NO: 6107 - DNA, 21 bp, Artificial Sequence
  Description of Artificial Sequence: Synthetic oligonucleotide
accatctttattatggtcata

SEQ ID NO: 6108 - DNA, 21 bp, Artificial Sequence
  Description of Artificial Sequence: Synthetic oligonucleotide
tgaccataataaagatggttt

SEQ ID NO: 6109 - DNA, 21 bp, Artificial Sequence
  Description of Artificial Sequence: Synthetic oligonucleotide
ccatctttattatggtcatat

SEQ ID NO: 6110 - DNA, 21 bp, Artificial Sequence
  Description of Artificial Sequence: Synthetic oligonucleotide
atgaccataataaagatggtt

SEQ ID NO: 6111 - DNA, 21 bp, Artificial Sequence
  Description of Artificial Sequence: Synthetic oligonucleotide
catctttattatggtcatatt

SEQ ID NO: 6112 - DNA, 21 bp, Artificial Sequence
  Description of Artificial Sequence: Synthetic oligonucleotide
tatgaccataataaagatggt

SEQ ID NO: 6113 - DNA, 21 bp, Artificial Sequence
  Description of Artificial Sequence: Synthetic oligonucleotide
atctttattatggtcatattt

SEQ ID NO: 6114 - DNA, 21 bp, Artificial Sequence
  Description of Artificial Sequence: Synthetic oligonucleotide
atatgaccataataaagatgg

SEQ ID NO: 6115 - DNA, 21 bp, Artificial Sequence
  Description of Artificial Sequence: Synthetic oligonucleotide
tctttattatggtcatatttc

SEQ ID NO: 6116 - DNA, 21 bp, Artificial Sequence
  Description of Artificial Sequence: Synthetic oligonucleotide
aatatgaccataataaagatg

SEQ ID NO: 6117 - DNA, 21 bp, Artificial Sequence
  Description of Artificial Sequence: Synthetic oligonucleotide
ctttattatggtcatatttca

SEQ ID NO: 6118 - DNA, 21 bp, Artificial Sequence
  Description of Artificial Sequence: Synthetic oligonucleotide
aaatatgaccataataaagat

SEQ ID NO: 6119 - DNA, 21 bp, Artificial Sequence
  Description of Artificial Sequence: Synthetic oligonucleotide
tttattatggtcatatttcac

SEQ ID NO: 6120 - DNA, 21 bp, Artificial Sequence
  Description of Artificial Sequence: Synthetic oligonucleotide
gaaatatgaccataataaaga

SEQ ID NO: 6121 - DNA, 21 bp, Artificial Sequence
  Description of Artificial Sequence: Synthetic oligonucleotide
ttattatggtcatatttcaca

SEQ ID NO: 6122 - DNA, 21 bp, Artificial Sequence
  Description of Artificial Sequence: Synthetic oligonucleotide
tgaaatatgaccataataaag

SEQ ID NO: 6123 - DNA, 21 bp, Artificial Sequence
  Description of Artificial Sequence: Synthetic oligonucleotide
tattatggtcatatttcacag

SEQ ID NO: 6124 - DNA, 21 bp, Artificial Sequence
  Description of Artificial Sequence: Synthetic oligonucleotide
gtgaaatatgaccataataaa

SEQ ID NO: 6125 - DNA, 21 bp, Artificial Sequence
  Description of Artificial Sequence: Synthetic oligonucleotide
attatggtcatatttcacagc

SEQ ID NO: 6126 - DNA, 21 bp, Artificial Sequence
  Description of Artificial Sequence: Synthetic oligonucleotide
tgtgaaatatgaccataataa

SEQ ID NO: 6127 - DNA, 21 bp, Artificial Sequence
  Description of Artificial Sequence: Synthetic oligonucleotide
ttatggtcatatttcacagca

SEQ ID NO: 6128 - DNA, 21 bp, Artificial Sequence
  Description of Artificial Sequence: Synthetic oligonucleotide
ctgtgaaatatgaccataata

SEQ ID NO: 6129 - DNA, 21 bp, Artificial Sequence
  Description of Artificial Sequence: Synthetic oligonucleotide
tatggtcatatttcacagcac

SEQ ID NO: 6130 - DNA, 21 bp, Artificial Sequence
  Description of Artificial Sequence: Synthetic oligonucleotide
gctgtgaaatatgaccataat

SEQ ID NO: 6131 - DNA, 21 bp, Artificial Sequence
  Description of Artificial Sequence: Synthetic oligonucleotide
atggtcatatttcacagcacc

SEQ ID NO: 6132 - DNA, 21 bp, Artificial Sequence
  Description of Artificial Sequence: Synthetic oligonucleotide
tgctgtgaaatatgaccataa

SEQ ID NO: 6133 - DNA, 21 bp, Artificial Sequence
  Description of Artificial Sequence: Synthetic oligonucleotide
tggtcatatttcacagcacca

SEQ ID NO: 6134 - DNA, 21 bp, Artificial Sequence
  Description of Artificial Sequence: Synthetic oligonucleotide
gtgctgtgaaatatgaccata

SEQ ID NO: 6135 - DNA, 21 bp, Artificial Sequence
  Description of Artificial Sequence: Synthetic oligonucleotide
ggtcatatttcacagcaccaa

SEQ ID NO: 6136 - DNA, 21 bp, Artificial Sequence
  Description of Artificial Sequence: Synthetic oligonucleotide
ggtgctgtgaaatatgaccat

SEQ ID NO: 6137 - DNA, 21 bp, Artificial Sequence
  Description of Artificial Sequence: Synthetic oligonucleotide
gtcatatttcacagcaccaaa

SEQ ID NO: 6138 - DNA, 21 bp, Artificial Sequence
  Description of Artificial Sequence: Synthetic oligonucleotide
tggtgctgtgaaatatgacca

SEQ ID NO: 6139 - DNA, 21 bp, Artificial Sequence
  Description of Artificial Sequence: Synthetic oligonucleotide
tcatatttcacagcaccaaaa

SEQ ID NO: 6140 - DNA, 21 bp, Artificial Sequence
  Description of Artificial Sequence: Synthetic oligonucleotide
ttggtgctgtgaaatatgacc

SEQ ID NO: 6141 - DNA, 21 bp, Artificial Sequence
  Description of Artificial Sequence: Synthetic oligonucleotide
catatttcacagcaccaaaat

SEQ ID NO: 6142 - DNA, 21 bp, Artificial Sequence
  Description of Artificial Sequence: Synthetic oligonucleotide
tttggtgctgtgaaatatgac

SEQ ID NO: 6143 - DNA, 21 bp, Artificial Sequence
  Description of Artificial Sequence: Synthetic oligonucleotide
atatttcacagcaccaaaata

SEQ ID NO: 6144 - DNA, 21 bp, Artificial Sequence
  Description of Artificial Sequence: Synthetic oligonucleotide
ttttggtgctgtgaaatatga

SEQ ID NO: 6145 - DNA, 21 bp, Artificial Sequence
  Description of Artificial Sequence: Synthetic oligonucleotide
tatttcacagcaccaaaataa

SEQ ID NO: 6146 - DNA, 21 bp, Artificial Sequence
  Description of Artificial Sequence: Synthetic oligonucleotide
attttggtgctgtgaaatatg

SEQ ID NO: 6147 - DNA, 21 bp, Artificial Sequence
  Description of Artificial Sequence: Synthetic oligonucleotide
atttcacagcaccaaaataaa

SEQ ID NO: 6148 - DNA, 21 bp, Artificial Sequence
  Description of Artificial Sequence: Synthetic oligonucleotide
tattttggtgctgtgaaatat

SEQ ID NO: 6149 - DNA, 21 bp, Artificial Sequence
  Description of Artificial Sequence: Synthetic oligonucleotide
tttcacagcaccaaaataaat

SEQ ID NO: 6150 - DNA, 21 bp, Artificial Sequence
  Description of Artificial Sequence: Synthetic oligonucleotide
ttattttggtgctgtgaaata

SEQ ID NO: 6151 - DNA, 21 bp, Artificial Sequence
  Description of Artificial Sequence: Synthetic oligonucleotide
ttcacagcaccaaaataaatc

SEQ ID NO: 6152 - DNA, 21 bp, Artificial Sequence
  Description of Artificial Sequence: Synthetic oligonucleotide
tttattttggtgctgtgaaat

SEQ ID NO: 6153 - DNA, 21 bp, Artificial Sequence
  Description of Artificial Sequence: Synthetic oligonucleotide
tcacagcaccaaaataaatca

SEQ ID NO: 6154 - DNA, 21 bp, Artificial Sequence
  Description of Artificial Sequence: Synthetic oligonucleotide
atttattttggtgctgtgaaa

SEQ ID NO: 6155 - DNA, 21 bp, Artificial Sequence
  Description of Artificial Sequence: Synthetic oligonucleotide
cacagcaccaaaataaatcat

SEQ ID NO: 6156 - DNA, 21 bp, Artificial Sequence
  Description of Artificial Sequence: Synthetic oligonucleotide
gatttattttggtgctgtgaa

SEQ ID NO: 6157 - DNA, 21 bp, Artificial Sequence
  Description of Artificial Sequence: Synthetic oligonucleotide
acagcaccaaaataaatcatc

SEQ ID NO: 6158 - DNA, 21 bp, Artificial Sequence
  Description of Artificial Sequence: Synthetic oligonucleotide
tgatttattttggtgctgtga

SEQ ID NO: 6159 - DNA, 21 bp, Artificial Sequence
  Description of Artificial Sequence: Synthetic oligonucleotide
cagcaccaaaataaatcatct

SEQ ID NO: 6160 - DNA, 21 bp, Artificial Sequence
  Description of Artificial Sequence: Synthetic oligonucleotide
atgatttattttggtgctgtg

SEQ ID NO: 6161 - DNA, 21 bp, Artificial Sequence
  Description of Artificial Sequence: Synthetic oligonucleotide
agcaccaaaataaatcatctt

SEQ ID NO: 6162 - DNA, 21 bp, Artificial Sequence
  Description of Artificial Sequence: Synthetic oligonucleotide
gatgatttattttggtgctgt

SEQ ID NO: 6163 - DNA, 21 bp, Artificial Sequence
  Description of Artificial Sequence: Synthetic oligonucleotide
gcaccaaaataaatcatcttt

SEQ ID NO: 6164 - DNA, 21 bp, Artificial Sequence
  Description of Artificial Sequence: Synthetic oligonucleotide
agatgatttattttggtgctg

SEQ ID NO: 6165 - DNA, 21 bp, Artificial Sequence
  Description of Artificial Sequence: Synthetic oligonucleotide
caccaaaataaatcatcttta

SEQ ID NO: 6166 - DNA, 21 bp, Artificial Sequence
  Description of Artificial Sequence: Synthetic oligonucleotide
aagatgatttattttggtgct

SEQ ID NO: 6167 - DNA, 21 bp, Artificial Sequence
  Description of Artificial Sequence: Synthetic oligonucleotide
accaaaataaatcatctttat

SEQ ID NO: 6168 - DNA, 21 bp, Artificial Sequence
  Description of Artificial Sequence: Synthetic oligonucleotide
aaagatgatttattttggtgc

SEQ ID NO: 6169 - DNA, 21 bp, Artificial Sequence
  Description of Artificial Sequence: Synthetic oligonucleotide
ccaaaataaatcatctttatt

SEQ ID NO: 6170 - DNA, 21 bp, Artificial Sequence
  Description of Artificial Sequence: Synthetic oligonucleotide
taaagatgatttattttggtg

SEQ ID NO: 6171 - DNA, 21 bp, Artificial Sequence
  Description of Artificial Sequence: Synthetic oligonucleotide
caaaataaatcatctttatta

SEQ ID NO: 6172 - DNA, 21 bp, Artificial Sequence
  Description of Artificial Sequence: Synthetic oligonucleotide
ataaagatgatttattttggt

SEQ ID NO: 6173 - DNA, 21 bp, Artificial Sequence
  Description of Artificial Sequence: Synthetic oligonucleotide
aaaataaatcatctttattaa

SEQ ID NO: 6174 - DNA, 21 bp, Artificial Sequence
  Description of Artificial Sequence: Synthetic oligonucleotide
aataaagatgatttattttgg

SEQ ID NO: 6175 - DNA, 21 bp, Artificial Sequence
  Description of Artificial Sequence: Synthetic oligonucleotide
aaataaatcatctttattaag

SEQ ID NO: 6176 - DNA, 21 bp, Artificial Sequence
  Description of Artificial Sequence: Synthetic oligonucleotide
taataaagatgatttattttg

SEQ ID NO: 6177 - DNA, 21 bp, Artificial Sequence
  Description of Artificial Sequence: Synthetic oligonucleotide
aataaatcatctttattaagt

SEQ ID NO: 6178 - DNA, 21 bp, Artificial Sequence
  Description of Artificial Sequence: Synthetic oligonucleotide
ttaataaagatgatttatttt

SEQ ID NO: 6179 - DNA, 21 bp, Artificial Sequence
  Description of Artificial Sequence: Synthetic oligonucleotide
ataaatcatctttattaagta

SEQ ID NO: 6180 - DNA, 21 bp, Artificial Sequence
  Description of Artificial Sequence: Synthetic oligonucleotide
cttaataaagatgatttattt

SEQ ID NO: 6181 - DNA, 21 bp, Artificial Sequence
  Description of Artificial Sequence: Synthetic oligonucleotide
taaatcatctttattaagtag

SEQ ID NO: 6182 - DNA, 21 bp, Artificial Sequence
  Description of Artificial Sequence: Synthetic oligonucleotide
acttaataaagatgatttatt

SEQ ID NO: 6183 - DNA, 21 bp, Artificial Sequence
  Description of Artificial Sequence: Synthetic oligonucleotide
aaatcatctttattaagtaga

SEQ ID NO: 6184 - DNA, 21 bp, Artificial Sequence
  Description of Artificial Sequence: Synthetic oligonucleotide
tacttaataaagatgatttat

SEQ ID NO: 6185 - DNA, 21 bp, Artificial Sequence
  Description of Artificial Sequence: Synthetic oligonucleotide
aatcatctttattaagtagat

SEQ ID NO: 6186 - DNA, 21 bp, Artificial Sequence
  Description of Artificial Sequence: Synthetic oligonucleotide
ctacttaataaagatgattta

SEQ ID NO: 6187 - DNA, 21 bp, Artificial Sequence
  Description of Artificial Sequence: Synthetic oligonucleotide
atcatctttattaagtagatg

SEQ ID NO: 6188 - DNA, 21 bp, Artificial Sequence
  Description of Artificial Sequence: Synthetic oligonucleotide
tctacttaataaagatgattt

SEQ ID NO: 6189 - DNA, 21 bp, Artificial Sequence
  Description of Artificial Sequence: Synthetic oligonucleotide
tcatctttattaagtagatga

SEQ ID NO: 6190 - DNA, 21 bp, Artificial Sequence
  Description of Artificial Sequence: Synthetic oligonucleotide
atctacttaataaagatgatt

SEQ ID NO: 6191 - DNA, 21 bp, Artificial Sequence
  Description of Artificial Sequence: Synthetic oligonucleotide
catctttattaagtagatgaa

SEQ ID NO: 6192 - DNA, 21 bp, Artificial Sequence
  Description of Artificial Sequence: Synthetic oligonucleotide
catctacttaataaagatgat

SEQ ID NO: 6193 - DNA, 21 bp, Artificial Sequence
  Description of Artificial Sequence: Synthetic oligonucleotide
atctttattaagtagatgaaa

SEQ ID NO: 6194 - DNA, 21 bp, Artificial Sequence
  Description of Artificial Sequence: Synthetic oligonucleotide
tcatctacttaataaagatga

SEQ ID NO: 6195 - DNA, 21 bp, Artificial Sequence
  Description of Artificial Sequence: Synthetic oligonucleotide
tctttattaagtagatgaaac

SEQ ID NO: 6196 - DNA, 21 bp, Artificial Sequence
  Description of Artificial Sequence: Synthetic oligonucleotide
ttcatctacttaataaagatg

SEQ ID NO: 6197 - DNA, 21 bp, Artificial Sequence
  Description of Artificial Sequence: Synthetic oligonucleotide
ctttattaagtagatgaaaca

SEQ ID NO: 6198 - DNA, 21 bp, Artificial Sequence
  Description of Artificial Sequence: Synthetic oligonucleotide
tttcatctacttaataaagat

SEQ ID NO: 6199 - DNA, 21 bp, Artificial Sequence
  Description of Artificial Sequence: Synthetic oligonucleotide
tttattaagtagatgaaacat

SEQ ID NO: 6200 - DNA, 21 bp, Artificial Sequence
  Description of Artificial Sequence: Synthetic oligonucleotide
gtttcatctacttaataaaga

SEQ ID NO: 6201 - DNA, 21 bp, Artificial Sequence
  Description of Artificial Sequence: Synthetic oligonucleotide
ttattaagtagatgaaacatt

SEQ ID NO: 6202 - DNA, 21 bp, Artificial Sequence
  Description of Artificial Sequence: Synthetic oligonucleotide
tgtttcatctacttaataaag

SEQ ID NO: 6203 - DNA, 21 bp, Artificial Sequence
  Description of Artificial Sequence: Synthetic oligonucleotide
tattaagtagatgaaacatta

SEQ ID NO: 6204 - DNA, 21 bp, Artificial Sequence
  Description of Artificial Sequence: Synthetic oligonucleotide
atgtttcatctacttaataaa

SEQ ID NO: 6205 - DNA, 21 bp, Artificial Sequence
  Description of Artificial Sequence: Synthetic oligonucleotide
attaagtagatgaaacattaa

SEQ ID NO: 6206 - DNA, 21 bp, Artificial Sequence
  Description of Artificial Sequence: Synthetic oligonucleotide
aatgtttcatctacttaataa

SEQ ID NO: 6207 - DNA, 21 bp, Artificial Sequence
  Description of Artificial Sequence: Synthetic oligonucleotide
ttaagtagatgaaacattaac

SEQ ID NO: 6208 - DNA, 21 bp, Artificial Sequence
  Description of Artificial Sequence: Synthetic oligonucleotide
taatgtttcatctacttaata

SEQ ID NO: 6209 - DNA, 21 bp, Artificial Sequence
  Description of Artificial Sequence: Synthetic oligonucleotide
taagtagatgaaacattaact

SEQ ID NO: 6210 - DNA, 21 bp, Artificial Sequence
  Description of Artificial Sequence: Synthetic oligonucleotide
ttaatgtttcatctacttaat

SEQ ID NO: 6211 - DNA, 21 bp, Artificial Sequence
  Description of Artificial Sequence: Synthetic oligonucleotide
aagtagatgaaacattaactc

SEQ ID NO: 6212 - DNA, 21 bp, Artificial Sequence
  Description of Artificial Sequence: Synthetic oligonucleotide
gttaatgtttcatctacttaa

SEQ ID NO: 6213 - DNA, 21 bp, Artificial Sequence
  Description of Artificial Sequence: Synthetic oligonucleotide
agtagatgaaacattaactct

SEQ ID NO: 6214 - DNA, 21 bp, Artificial Sequence
  Description of Artificial Sequence: Synthetic oligonucleotide
agttaatgtttcatctactta

SEQ ID NO: 6215 - DNA, 21 bp, Artificial Sequence
  Description of Artificial Sequence: Synthetic oligonucleotide
gtagatgaaacattaactcta

SEQ ID NO: 6216 - DNA, 21 bp, Artificial Sequence
  Description of Artificial Sequence: Synthetic oligonucleotide
gagttaatgtttcatctactt

SEQ ID NO: 6217 - DNA, 21 bp, Artificial Sequence
  Description of Artificial Sequence: Synthetic oligonucleotide
tagatgaaacattaactctaa

SEQ ID NO: 6218 - DNA, 21 bp, Artificial Sequence
  Description of Artificial Sequence: Synthetic oligonucleotide
agagttaatgtttcatctact

SEQ ID NO: 6219 - DNA, 21 bp, Artificial Sequence
  Description of Artificial Sequence: Synthetic oligonucleotide
agatgaaacattaactctaac

SEQ ID NO: 6220 - DNA, 21 bp, Artificial Sequence
  Description of Artificial Sequence: Synthetic oligonucleotide
tagagttaatgtttcatctac

SEQ ID NO: 6221 - DNA, 21 bp, Artificial Sequence
  Description of Artificial Sequence: Synthetic oligonucleotide
gatgaaacattaactctaact

SEQ ID NO: 6222 - DNA, 21 bp, Artificial Sequence
  Description of Artificial Sequence: Synthetic oligonucleotide
ttagagttaatgtttcatcta

SEQ ID NO: 6223 - DNA, 21 bp, Artificial Sequence
  Description of Artificial Sequence: Synthetic oligonucleotide
atgaaacattaactctaactg

SEQ ID NO: 6224 - DNA, 21 bp, Artificial Sequence
  Description of Artificial Sequence: Synthetic oligonucleotide
gttagagttaatgtttcatct

SEQ ID NO: 6225 - DNA, 21 bp, Artificial Sequence
  Description of Artificial Sequence: Synthetic oligonucleotide
tgaaacattaactctaactgt

SEQ ID NO: 6226 - DNA, 21 bp, Artificial Sequence
  Description of Artificial Sequence: Synthetic oligonucleotide
agttagagttaatgtttcatc

SEQ ID NO: 6227 - DNA, 21 bp, Artificial Sequence
  Description of Artificial Sequence: Synthetic oligonucleotide
gaaacattaactctaactgtg

SEQ ID NO: 6228 - DNA, 21 bp, Artificial Sequence
  Description of Artificial Sequence: Synthetic oligonucleotide
cagttagagttaatgtttcat

SEQ ID NO: 6229 - DNA, 21 bp, Artificial Sequence
  Description of Artificial Sequence: Synthetic oligonucleotide
aaacattaactctaactgtga

SEQ ID NO: 6230 - DNA, 21 bp, Artificial Sequence
  Description of Artificial Sequence: Synthetic oligonucleotide
acagttagagttaatgtttca

SEQ ID NO: 6231 - DNA, 21 bp, Artificial Sequence
  Description of Artificial Sequence: Synthetic oligonucleotide
aacattaactctaactgtgac

SEQ ID NO: 6232 - DNA, 21 bp, Artificial Sequence
  Description of Artificial Sequence: Synthetic oligonucleotide
cacagttagagttaatgtttc

SEQ ID NO: 6233 - DNA, 21 bp, Artificial Sequence
  Description of Artificial Sequence: Synthetic oligonucleotide
acattaactctaactgtgaca

SEQ ID NO: 6234 - DNA, 21 bp, Artificial Sequence
  Description of Artificial Sequence: Synthetic oligonucleotide
tcacagttagagttaatgttt

SEQ ID NO: 6235 - DNA, 21 bp, Artificial Sequence
  Description of Artificial Sequence: Synthetic oligonucleotide
cattaactctaactgtgacaa

SEQ ID NO: 6236 - DNA, 21 bp, Artificial Sequence
  Description of Artificial Sequence: Synthetic oligonucleotide
gtcacagttagagttaatgtt

SEQ ID NO: 6237 - DNA, 21 bp, Artificial Sequence
  Description of Artificial Sequence: Synthetic oligonucleotide
attaactctaactgtgacaaa

SEQ ID NO: 6238 - DNA, 21 bp, Artificial Sequence
  Description of Artificial Sequence: Synthetic oligonucleotide
tgtcacagttagagttaatgt

SEQ ID NO: 6239 - DNA, 21 bp, Artificial Sequence
  Description of Artificial Sequence: Synthetic oligonucleotide
ttaactctaactgtgacaaag

SEQ ID NO: 6240 - DNA, 21 bp, Artificial Sequence
  Description of Artificial Sequence: Synthetic oligonucleotide
ttgtcacagttagagttaatg

SEQ ID NO: 6241 - DNA, 21 bp, Artificial Sequence
  Description of Artificial Sequence: Synthetic oligonucleotide
taactctaactgtgacaaaga

SEQ ID NO: 6242 - DNA, 21 bp, Artificial Sequence
  Description of Artificial Sequence: Synthetic oligonucleotide
tttgtcacagttagagttaat

SEQ ID NO: 6243 - DNA, 21 bp, Artificial Sequence
  Description of Artificial Sequence: Synthetic oligonucleotide
aactctaactgtgacaaagaa

SEQ ID NO: 6244 - DNA, 21 bp, Artificial Sequence
  Description of Artificial Sequence: Synthetic oligonucleotide
ctttgtcacagttagagttaa

SEQ ID NO: 6245 - DNA, 21 bp, Artificial Sequence
  Description of Artificial Sequence: Synthetic oligonucleotide
actctaactgtgacaaagaag

SEQ ID NO: 6246 - DNA, 21 bp, Artificial Sequence
  Description of Artificial Sequence: Synthetic oligonucleotide
tctttgtcacagttagagtta

SEQ ID NO: 6247 - DNA, 21 bp, Artificial Sequence
  Description of Artificial Sequence: Synthetic oligonucleotide
ctctaactgtgacaaagaaga

SEQ ID NO: 6248 - DNA, 21 bp, Artificial Sequence
  Description of Artificial Sequence: Synthetic oligonucleotide
ttctttgtcacagttagagtt

SEQ ID NO: 6249 - DNA, 21 bp, Artificial Sequence
  Description of Artificial Sequence: Synthetic oligonucleotide
tctaactgtgacaaagaagac

SEQ ID NO: 6250 - DNA, 21 bp, Artificial Sequence
  Description of Artificial Sequence: Synthetic oligonucleotide
cttctttgtcacagttagagt

SEQ ID NO: 6251 - DNA, 21 bp, Artificial Sequence
  Description of Artificial Sequence: Synthetic oligonucleotide
ctaactgtgacaaagaagacc

SEQ ID NO: 6252 - DNA, 21 bp, Artificial Sequence
  Description of Artificial Sequence: Synthetic oligonucleotide
tcttctttgtcacagttagag

SEQ ID NO: 6253 - DNA, 21 bp, Artificial Sequence
  Description of Artificial Sequence: Synthetic oligonucleotide
taactgtgacaaagaagacca

SEQ ID NO: 6254 - DNA, 21 bp, Artificial Sequence
  Description of Artificial Sequence: Synthetic oligonucleotide
gtcttctttgtcacagttaga

SEQ ID NO: 6255 - DNA, 21 bp, Artificial Sequence
  Description of Artificial Sequence: Synthetic oligonucleotide
aactgtgacaaagaagaccac

SEQ ID NO: 6256 - DNA, 21 bp, Artificial Sequence
  Description of Artificial Sequence: Synthetic oligonucleotide
ggtcttctttgtcacagttag

SEQ ID NO: 6257 - DNA, 21 bp, Artificial Sequence
  Description of Artificial Sequence: Synthetic oligonucleotide
actgtgacaaagaagaccaca

SEQ ID NO: 6258 - DNA, 21 bp, Artificial Sequence
  Description of Artificial Sequence: Synthetic oligonucleotide
tggtcttctttgtcacagtta

SEQ ID NO: 6259 - DNA, 21 bp, Artificial Sequence
  Description of Artificial Sequence: Synthetic oligonucleotide
ctgtgacaaagaagaccacaa

SEQ ID NO: 6260 - DNA, 21 bp, Artificial Sequence
  Description of Artificial Sequence: Synthetic oligonucleotide
gtggtcttctttgtcacagtt

SEQ ID NO: 6261 - DNA, 21 bp, Artificial Sequence
  Description of Artificial Sequence: Synthetic oligonucleotide
tgtgacaaagaagaccacaaa

SEQ ID NO: 6262 - DNA, 21 bp, Artificial Sequence
  Description of Artificial Sequence: Synthetic oligonucleotide
tgtggtcttctttgtcacagt

SEQ ID NO: 6263 - DNA, 21 bp, Artificial Sequence
  Description of Artificial Sequence: Synthetic oligonucleotide
gtgacaaagaagaccacaaat

SEQ ID NO: 6264 - DNA, 21 bp, Artificial Sequence
  Description of Artificial Sequence: Synthetic oligonucleotide
ttgtggtcttctttgtcacag

SEQ ID NO: 6265 - DNA, 21 bp, Artificial Sequence
  Description of Artificial Sequence: Synthetic oligonucleotide
tgacaaagaagaccacaaata

SEQ ID NO: 6266 - DNA, 21 bp, Artificial Sequence
  Description of Artificial Sequence: Synthetic oligonucleotide
tttgtggtcttctttgtcaca

SEQ ID NO: 6267 - DNA, 21 bp, Artificial Sequence
  Description of Artificial Sequence: Synthetic oligonucleotide
gacaaagaagaccacaaatag

SEQ ID NO: 6268 - DNA, 21 bp, Artificial Sequence
  Description of Artificial Sequence: Synthetic oligonucleotide
atttgtggtcttctttgtcac

SEQ ID NO: 6269 - DNA, 21 bp, Artificial Sequence
  Description of Artificial Sequence: Synthetic oligonucleotide
acaaagaagaccacaaatagt

SEQ ID NO: 6270 - DNA, 21 bp, Artificial Sequence
  Description of Artificial Sequence: Synthetic oligonucleotide
tatttgtggtcttctttgtca

SEQ ID NO: 6271 - DNA, 21 bp, Artificial Sequence
  Description of Artificial Sequence: Synthetic oligonucleotide
caaagaagaccacaaatagtt

SEQ ID NO: 6272 - DNA, 21 bp, Artificial Sequence
  Description of Artificial Sequence: Synthetic oligonucleotide
ctatttgtggtcttctttgtc

SEQ ID NO: 6273 - DNA, 21 bp, Artificial Sequence
  Description of Artificial Sequence: Synthetic oligonucleotide
aaagaagaccacaaatagtta

SEQ ID NO: 6274 - DNA, 21 bp, Artificial Sequence
  Description of Artificial Sequence: Synthetic oligonucleotide
actatttgtggtcttctttgt

SEQ ID NO: 6275 - DNA, 21 bp, Artificial Sequence
  Description of Artificial Sequence: Synthetic oligonucleotide
aagaagaccacaaatagttat

SEQ ID NO: 6276 - DNA, 21 bp, Artificial Sequence
  Description of Artificial Sequence: Synthetic oligonucleotide
aactatttgtggtcttctttg

SEQ ID NO: 6277 - DNA, 21 bp, Artificial Sequence
  Description of Artificial Sequence: Synthetic oligonucleotide
agaagaccacaaatagttatc

SEQ ID NO: 6278 - DNA, 21 bp, Artificial Sequence
  Description of Artificial Sequence: Synthetic oligonucleotide
taactatttgtggtcttcttt

SEQ ID NO: 6279 - DNA, 21 bp, Artificial Sequence
  Description of Artificial Sequence: Synthetic oligonucleotide
gaagaccacaaatagttatct

SEQ ID NO: 6280 - DNA, 21 bp, Artificial Sequence
  Description of Artificial Sequence: Synthetic oligonucleotide
ataactatttgtggtcttctt

SEQ ID NO: 6281 - DNA, 21 bp, Artificial Sequence
  Description of Artificial Sequence: Synthetic oligonucleotide
aagaccacaaatagttatctt

SEQ ID NO: 6282 - DNA, 21 bp, Artificial Sequence
  Description of Artificial Sequence: Synthetic oligonucleotide
gataactatttgtggtcttct

SEQ ID NO: 6283 - DNA, 21 bp, Artificial Sequence
  Description of Artificial Sequence: Synthetic oligonucleotide
agaccacaaatagttatcttt

SEQ ID NO: 6284 - DNA, 21 bp, Artificial Sequence
  Description of Artificial Sequence: Synthetic oligonucleotide
agataactatttgtggtcttc

SEQ ID NO: 6285 - DNA, 21 bp, Artificial Sequence
  Description of Artificial Sequence: Synthetic oligonucleotide
gaccacaaatagttatctttt

SEQ ID NO: 6286 - DNA, 21 bp, Artificial Sequence
  Description of Artificial Sequence: Synthetic oligonucleotide
aagataactatttgtggtctt

SEQ ID NO: 6287 - DNA, 21 bp, Artificial Sequence
  Description of Artificial Sequence: Synthetic oligonucleotide
accacaaatagttatctttta

SEQ ID NO: 6288 - DNA, 21 bp, Artificial Sequence
  Description of Artificial Sequence: Synthetic oligonucleotide
aaagataactatttgtggtct

SEQ ID NO: 6289 - DNA, 21 bp, Artificial Sequence
  Description of Artificial Sequence: Synthetic oligonucleotide
ccacaaatagttatcttttaa

SEQ ID NO: 6290 - DNA, 21 bp, Artificial Sequence
  Description of Artificial Sequence: Synthetic oligonucleotide
aaaagataactatttgtggtc

SEQ ID NO: 6291 - DNA, 21 bp, Artificial Sequence
  Description of Artificial Sequence: Synthetic oligonucleotide
cacaaatagttatcttttaat

SEQ ID NO: 6292 - DNA, 21 bp, Artificial Sequence
  Description of Artificial Sequence: Synthetic oligonucleotide
taaaagataactatttgtggt

SEQ ID NO: 6293 - DNA, 21 bp, Artificial Sequence
  Description of Artificial Sequence: Synthetic oligonucleotide
acaaatagttatcttttaatt

SEQ ID NO: 6294 - DNA, 21 bp, Artificial Sequence
  Description of Artificial Sequence: Synthetic oligonucleotide
ttaaaagataactatttgtgg

SEQ ID NO: 6295 - DNA, 21 bp, Artificial Sequence
  Description of Artificial Sequence: Synthetic oligonucleotide
caaatagttatcttttaatta

SEQ ID NO: 6296 - DNA, 21 bp, Artificial Sequence
  Description of Artificial Sequence: Synthetic oligonucleotide
attaaaagataactatttgtg

SEQ ID NO: 6297 - DNA, 21 bp, Artificial Sequence
  Description of Artificial Sequence: Synthetic oligonucleotide
aaatagttatcttttaattac

SEQ ID NO: 6298 - DNA, 21 bp, Artificial Sequence
  Description of Artificial Sequence: Synthetic oligonucleotide
aattaaaagataactatttgt

SEQ ID NO: 6299 - DNA, 21 bp, Artificial Sequence
  Description of Artificial Sequence: Synthetic oligonucleotide
aatagttatcttttaattaca

SEQ ID NO: 6300 - DNA, 21 bp, Artificial Sequence
  Description of Artificial Sequence: Synthetic oligonucleotide
taattaaaagataactatttg

SEQ ID NO: 6301 - DNA, 21 bp, Artificial Sequence
  Description of Artificial Sequence: Synthetic oligonucleotide
atagttatcttttaattacag

SEQ ID NO: 6302 - DNA, 21 bp, Artificial Sequence
  Description of Artificial Sequence: Synthetic oligonucleotide
gtaattaaaagataactattt

SEQ ID NO: 6303 - DNA, 21 bp, Artificial Sequence
  Description of Artificial Sequence: Synthetic oligonucleotide
tagttatcttttaattacaga

SEQ ID NO: 6304 - DNA, 21 bp, Artificial Sequence
  Description of Artificial Sequence: Synthetic oligonucleotide
tgtaattaaaagataactatt

SEQ ID NO: 6305 - DNA, 21 bp, Artificial Sequence
  Description of Artificial Sequence: Synthetic oligonucleotide
agttatcttttaattacagaa

SEQ ID NO: 6306 - DNA, 21 bp, Artificial Sequence
  Description of Artificial Sequence: Synthetic oligonucleotide
ctgtaattaaaagataactat

SEQ ID NO: 6307 - DNA, 21 bp, Artificial Sequence
  Description of Artificial Sequence: Synthetic oligonucleotide
gttatcttttaattacagaag

SEQ ID NO: 6308 - DNA, 21 bp, Artificial Sequence
  Description of Artificial Sequence: Synthetic oligonucleotide
tctgtaattaaaagataacta

SEQ ID NO: 6309 - DNA, 21 bp, Artificial Sequence
  Description of Artificial Sequence: Synthetic oligonucleotide
ttatcttttaattacagaaga

SEQ ID NO: 6310 - DNA, 21 bp, Artificial Sequence
  Description of Artificial Sequence: Synthetic oligonucleotide
ttctgtaattaaaagataact

SEQ ID NO: 6311 - DNA, 21 bp, Artificial Sequence
  Description of Artificial Sequence: Synthetic oligonucleotide
tatcttttaattacagaagag

SEQ ID NO: 6312 - DNA, 21 bp, Artificial Sequence
  Description of Artificial Sequence: Synthetic oligonucleotide
cttctgtaattaaaagataac

SEQ ID NO: 6313 - DNA, 21 bp, Artificial Sequence
  Description of Artificial Sequence: Synthetic oligonucleotide
atcttttaattacagaagagt

SEQ ID NO: 6314 - DNA, 21 bp, Artificial Sequence
  Description of Artificial Sequence: Synthetic oligonucleotide
tcttctgtaattaaaagataa

SEQ ID NO: 6315 - DNA, 21 bp, Artificial Sequence
  Description of Artificial Sequence: Synthetic oligonucleotide
tcttttaattacagaagagtt

SEQ ID NO: 6316 - DNA, 21 bp, Artificial Sequence
  Description of Artificial Sequence: Synthetic oligonucleotide
ctcttctgtaattaaaagata

SEQ ID NO: 6317 - DNA, 21 bp, Artificial Sequence
  Description of Artificial Sequence: Synthetic oligonucleotide
cttttaattacagaagagttt

SEQ ID NO: 6318 - DNA, 21 bp, Artificial Sequence
  Description of Artificial Sequence: Synthetic oligonucleotide
actcttctgtaattaaaagat

SEQ ID NO: 6319 - DNA, 21 bp, Artificial Sequence
  Description of Artificial Sequence: Synthetic oligonucleotide
ttttaattacagaagagtttc

SEQ ID NO: 6320 - DNA, 21 bp, Artificial Sequence
  Description of Artificial Sequence: Synthetic oligonucleotide
aactcttctgtaattaaaaga

SEQ ID NO: 6321 - DNA, 21 bp, Artificial Sequence
  Description of Artificial Sequence: Synthetic oligonucleotide
tttaattacagaagagtttct

SEQ ID NO: 6322 - DNA, 21 bp, Artificial Sequence
  Description of Artificial Sequence: Synthetic oligonucleotide
aaactcttctgtaattaaaag

SEQ ID NO: 6323 - DNA, 21 bp, Artificial Sequence
  Description of Artificial Sequence: Synthetic oligonucleotide
ttaattacagaagagtttctt

SEQ ID NO: 6324 - DNA, 21 bp, Artificial Sequence
  Description of Artificial Sequence: Synthetic oligonucleotide
gaaactcttctgtaattaaaa

SEQ ID NO: 6325 - DNA, 21 bp, Artificial Sequence
  Description of Artificial Sequence: Synthetic oligonucleotide
taattacagaagagtttctta

SEQ ID NO: 6326 - DNA, 21 bp, Artificial Sequence
  Description of Artificial Sequence: Synthetic oligonucleotide
agaaactcttctgtaattaaa

SEQ ID NO: 6327 - DNA, 21 bp, Artificial Sequence
  Description of Artificial Sequence: Synthetic oligonucleotide
aattacagaagagtttcttaa

SEQ ID NO: 6328 - DNA, 21 bp, Artificial Sequence
  Description of Artificial Sequence: Synthetic oligonucleotide
aagaaactcttctgtaattaa

SEQ ID NO: 6329 - DNA, 21 bp, Artificial Sequence
  Description of Artificial Sequence: Synthetic oligonucleotide
attacagaagagtttcttaac

SEQ ID NO: 6330 - DNA, 21 bp, Artificial Sequence
  Description of Artificial Sequence: Synthetic oligonucleotide
taagaaactcttctgtaatta

SEQ ID NO: 6331 - DNA, 21 bp, Artificial Sequence
  Description of Artificial Sequence: Synthetic oligonucleotide
ttacagaagagtttcttaact

SEQ ID NO: 6332 - DNA, 21 bp, Artificial Sequence
  Description of Artificial Sequence: Synthetic oligonucleotide
ttaagaaactcttctgtaatt

SEQ ID NO: 6333 - DNA, 21 bp, Artificial Sequence
  Description of Artificial Sequence: Synthetic oligonucleotide
tacagaagagtttcttaactt

SEQ ID NO: 6334 - DNA, 21 bp, Artificial Sequence
  Description of Artificial Sequence: Synthetic oligonucleotide
gttaagaaactcttctgtaat

SEQ ID NO: 6335 - DNA, 21 bp, Artificial Sequence
  Description of Artificial Sequence: Synthetic oligonucleotide
acagaagagtttcttaactta

SEQ ID NO: 6336 - DNA, 21 bp, Artificial Sequence
  Description of Artificial Sequence: Synthetic oligonucleotide
agttaagaaactcttctgtaa

SEQ ID NO: 6337 - DNA, 21 bp, Artificial Sequence
  Description of Artificial Sequence: Synthetic oligonucleotide
cagaagagtttcttaacttac

SEQ ID NO: 6338 - DNA, 21 bp, Artificial Sequence
  Description of Artificial Sequence: Synthetic oligonucleotide
aagttaagaaactcttctgta

SEQ ID NO: 6339 - DNA, 21 bp, Artificial Sequence
  Description of Artificial Sequence: Synthetic oligonucleotide
agaagagtttcttaacttact

SEQ ID NO: 6340 - DNA, 21 bp, Artificial Sequence
  Description of Artificial Sequence: Synthetic oligonucleotide
taagttaagaaactcttctgt

SEQ ID NO: 6341 - DNA, 21 bp, Artificial Sequence
  Description of Artificial Sequence: Synthetic oligonucleotide
gaagagtttcttaacttactt

SEQ ID NO: 6342 - DNA, 21 bp, Artificial Sequence
  Description of Artificial Sequence: Synthetic oligonucleotide
gtaagttaagaaactcttctg

SEQ ID NO: 6343 - DNA, 21 bp, Artificial Sequence
  Description of Artificial Sequence: Synthetic oligonucleotide
aagagtttcttaacttacttt

SEQ ID NO: 6344 - DNA, 21 bp, Artificial Sequence
  Description of Artificial Sequence: Synthetic oligonucleotide
agtaagttaagaaactcttct

SEQ ID NO: 6345 - DNA, 21 bp, Artificial Sequence
  Description of Artificial Sequence: Synthetic oligonucleotide
agagtttcttaacttactttt

SEQ ID NO: 6346 - DNA, 21 bp, Artificial Sequence
  Description of Artificial Sequence: Synthetic oligonucleotide
aagtaagttaagaaactcttc

SEQ ID NO: 6347 - DNA, 21 bp, Artificial Sequence
  Description of Artificial Sequence: Synthetic oligonucleotide
gagtttcttaacttacttttg

SEQ ID NO: 6348 - DNA, 21 bp, Artificial Sequence
  Description of Artificial Sequence: Synthetic oligonucleotide
aaagtaagttaagaaactctt

SEQ ID NO: 6349 - DNA, 21 bp, Artificial Sequence
  Description of Artificial Sequence: Synthetic oligonucleotide
agtttcttaacttacttttgt

SEQ ID NO: 6350 - DNA, 21 bp, Artificial Sequence
  Description of Artificial Sequence: Synthetic oligonucleotide
aaaagtaagttaagaaactct

SEQ ID NO: 6351 - DNA, 21 bp, Artificial Sequence
  Description of Artificial Sequence: Synthetic oligonucleotide
gtttcttaacttacttttgta

SEQ ID NO: 6352 - DNA, 21 bp, Artificial Sequence
  Description of Artificial Sequence: Synthetic oligonucleotide
caaaagtaagttaagaaactc

SEQ ID NO: 6353 - DNA, 21 bp, Artificial Sequence
  Description of Artificial Sequence: Synthetic oligonucleotide
tttcttaacttacttttgtaa

SEQ ID NO: 6354 - DNA, 21 bp, Artificial Sequence
  Description of Artificial Sequence: Synthetic oligonucleotide
acaaaagtaagttaagaaact

SEQ ID NO: 6355 - DNA, 21 bp, Artificial Sequence
  Description of Artificial Sequence: Synthetic oligonucleotide
ttcttaacttacttttgtaag

SEQ ID NO: 6356 - DNA, 21 bp, Artificial Sequence
  Description of Artificial Sequence: Synthetic oligonucleotide
tacaaaagtaagttaagaaac

SEQ ID NO: 6357 - DNA, 21 bp, Artificial Sequence
  Description of Artificial Sequence: Synthetic oligonucleotide
tcttaacttacttttgtaagt

SEQ ID NO: 6358 - DNA, 21 bp, Artificial Sequence
  Description of Artificial Sequence: Synthetic oligonucleotide
ttacaaaagtaagttaagaaa

SEQ ID NO: 6359 - DNA, 21 bp, Artificial Sequence
  Description of Artificial Sequence: Synthetic oligonucleotide
cttaacttacttttgtaagtt

SEQ ID NO: 6360 - DNA, 21 bp, Artificial Sequence
  Description of Artificial Sequence: Synthetic oligonucleotide
cttacaaaagtaagttaagaa

SEQ ID NO: 6361 - DNA, 21 bp, Artificial Sequence
  Description of Artificial Sequence: Synthetic oligonucleotide
ttaacttacttttgtaagttt

SEQ ID NO: 6362 - DNA, 21 bp, Artificial Sequence
  Description of Artificial Sequence: Synthetic oligonucleotide
acttacaaaagtaagttaaga

SEQ ID NO: 6363 - DNA, 21 bp, Artificial Sequence
  Description of Artificial Sequence: Synthetic oligonucleotide
taacttacttttgtaagtttt

SEQ ID NO: 6364 - DNA, 21 bp, Artificial Sequence
  Description of Artificial Sequence: Synthetic oligonucleotide
aacttacaaaagtaagttaag

SEQ ID NO: 6365 - DNA, 21 bp, Artificial Sequence
  Description of Artificial Sequence: Synthetic oligonucleotide
aacttacttttgtaagttttt

SEQ ID NO: 6366 - DNA, 21 bp, Artificial Sequence
  Description of Artificial Sequence: Synthetic oligonucleotide
aaacttacaaaagtaagttaa

SEQ ID NO: 6367 - DNA, 21 bp, Artificial Sequence
  Description of Artificial Sequence: Synthetic oligonucleotide
acttacttttgtaagttttta

SEQ ID NO: 6368 - DNA, 21 bp, Artificial Sequence
  Description of Artificial Sequence: Synthetic oligonucleotide
aaaacttacaaaagtaagtta

SEQ ID NO: 6369 - DNA, 21 bp, Artificial Sequence
  Description of Artificial Sequence: Synthetic oligonucleotide
cttacttttgtaagtttttat

SEQ ID NO: 6370 - DNA, 21 bp, Artificial Sequence
  Description of Artificial Sequence: Synthetic oligonucleotide
aaaaacttacaaaagtaagtt

SEQ ID NO: 6371 - DNA, 21 bp, Artificial Sequence
  Description of Artificial Sequence: Synthetic oligonucleotide
ttacttttgtaagtttttatt

SEQ ID NO: 6372 - DNA, 21 bp, Artificial Sequence
  Description of Artificial Sequence: Synthetic oligonucleotide
taaaaacttacaaaagtaagt

SEQ ID NO: 6373 - DNA, 21 bp, Artificial Sequence
  Description of Artificial Sequence: Synthetic oligonucleotide
tacttttgtaagtttttattg

SEQ ID NO: 6374 - DNA, 21 bp, Artificial Sequence
  Description of Artificial Sequence: Synthetic oligonucleotide
ataaaaacttacaaaagtaag

SEQ ID NO: 6375 - DNA, 21 bp, Artificial Sequence
  Description of Artificial Sequence: Synthetic oligonucleotide
acttttgtaagtttttattgt

SEQ ID NO: 6376 - DNA, 21 bp, Artificial Sequence
  Description of Artificial Sequence: Synthetic oligonucleotide
aataaaaacttacaaaagtaa

SEQ ID NO: 6377 - DNA, 21 bp, Artificial Sequence
  Description of Artificial Sequence: Synthetic oligonucleotide
cttttgtaagtttttattgtg

SEQ ID NO: 6378 - DNA, 21 bp, Artificial Sequence
  Description of Artificial Sequence: Synthetic oligonucleotide
caataaaaacttacaaaagta

SEQ ID NO: 6379 - DNA, 21 bp, Artificial Sequence
  Description of Artificial Sequence: Synthetic oligonucleotide
ttttgtaagtttttattgtgt

SEQ ID NO: 6380 - DNA, 21 bp, Artificial Sequence
  Description of Artificial Sequence: Synthetic oligonucleotide
acaataaaaacttacaaaagt

SEQ ID NO: 6381 - DNA, 21 bp, Artificial Sequence
  Description of Artificial Sequence: Synthetic oligonucleotide
tttgtaagtttttattgtgta

SEQ ID NO: 6382 - DNA, 21 bp, Artificial Sequence
  Description of Artificial Sequence: Synthetic oligonucleotide
cacaataaaaacttacaaaag

SEQ ID NO: 6383 - DNA, 21 bp, Artificial Sequence
  Description of Artificial Sequence: Synthetic oligonucleotide
ttgtaagtttttattgtgtaa

SEQ ID NO: 6384 - DNA, 21 bp, Artificial Sequence
  Description of Artificial Sequence: Synthetic oligonucleotide
acacaataaaaacttacaaaa

SEQ ID NO: 6385 - DNA, 21 bp, Artificial Sequence
  Description of Artificial Sequence: Synthetic oligonucleotide
tgtaagtttttattgtgtaag

SEQ ID NO: 6386 - DNA, 21 bp, Artificial Sequence
  Description of Artificial Sequence: Synthetic oligonucleotide
tacacaataaaaacttacaaa

SEQ ID NO: 6387 - DNA, 21 bp, Artificial Sequence
  Description of Artificial Sequence: Synthetic oligonucleotide
gtaagtttttattgtgtaagt

SEQ ID NO: 6388 - DNA, 21 bp, Artificial Sequence
  Description of Artificial Sequence: Synthetic oligonucleotide
ttacacaataaaaacttacaa

SEQ ID NO: 6389 - DNA, 21 bp, Artificial Sequence
  Description of Artificial Sequence: Synthetic oligonucleotide
taagtttttattgtgtaagtt

SEQ ID NO: 6390 - DNA, 21 bp, Artificial Sequence
  Description of Artificial Sequence: Synthetic oligonucleotide
cttacacaataaaaacttaca

SEQ ID NO: 6391 - DNA, 21 bp, Artificial Sequence
  Description of Artificial Sequence: Synthetic oligonucleotide
aagtttttattgtgtaagttt

SEQ ID NO: 6392 - DNA, 21 bp, Artificial Sequence
  Description of Artificial Sequence: Synthetic oligonucleotide
acttacacaataaaaacttac

SEQ ID NO: 6393 - DNA, 21 bp, Artificial Sequence
  Description of Artificial Sequence: Synthetic oligonucleotide
agtttttattgtgtaagttta

SEQ ID NO: 6394 - DNA, 21 bp, Artificial Sequence
  Description of Artificial Sequence: Synthetic oligonucleotide
aacttacacaataaaaactta

SEQ ID NO: 6395 - DNA, 21 bp, Artificial Sequence
  Description of Artificial Sequence: Synthetic oligonucleotide
gtttttattgtgtaagtttat

SEQ ID NO: 6396 - DNA, 21 bp, Artificial Sequence
  Description of Artificial Sequence: Synthetic oligonucleotide
aaacttacacaataaaaactt

SEQ ID NO: 6397 - DNA, 21 bp, Artificial Sequence
  Description of Artificial Sequence: Synthetic oligonucleotide
tttttattgtgtaagtttata

SEQ ID NO: 6398 - DNA, 21 bp, Artificial Sequence
  Description of Artificial Sequence: Synthetic oligonucleotide
taaacttacacaataaaaact

SEQ ID NO: 6399 - DNA, 21 bp, Artificial Sequence
  Description of Artificial Sequence: Synthetic oligonucleotide
ttttattgtgtaagtttataa

SEQ ID NO: 6400 - DNA, 21 bp, Artificial Sequence
  Description of Artificial Sequence: Synthetic oligonucleotide
ataaacttacacaataaaaac

SEQ ID NO: 6401 - DNA, 21 bp, Artificial Sequence
  Description of Artificial Sequence: Synthetic oligonucleotide
tttattgtgtaagtttataat

SEQ ID NO: 6402 - DNA, 21 bp, Artificial Sequence
  Description of Artificial Sequence: Synthetic oligonucleotide
tataaacttacacaataaaaa

SEQ ID NO: 6403 - DNA, 21 bp, Artificial Sequence
  Description of Artificial Sequence: Synthetic oligonucleotide
ttattgtgtaagtttataatg

SEQ ID NO: 6404 - DNA, 21 bp, Artificial Sequence
  Description of Artificial Sequence: Synthetic oligonucleotide
ttataaacttacacaataaaa

SEQ ID NO: 6405 - DNA, 21 bp, Artificial Sequence
  Description of Artificial Sequence: Synthetic oligonucleotide
tattgtgtaagtttataatgc

SEQ ID NO: 6406 - DNA, 21 bp, Artificial Sequence
  Description of Artificial Sequence: Synthetic oligonucleotide
attataaacttacacaataaa

SEQ ID NO: 6407 - DNA, 21 bp, Artificial Sequence
  Description of Artificial Sequence: Synthetic oligonucleotide
attgtgtaagtttataatgca

SEQ ID NO: 6408 - DNA, 21 bp, Artificial Sequence
  Description of Artificial Sequence: Synthetic oligonucleotide
cattataaacttacacaataa

SEQ ID NO: 6409 - DNA, 21 bp, Artificial Sequence
  Description of Artificial Sequence: Synthetic oligonucleotide
ttgtgtaagtttataatgcag

SEQ ID NO: 6410 - DNA, 21 bp, Artificial Sequence
  Description of Artificial Sequence: Synthetic oligonucleotide
gcattataaacttacacaata

SEQ ID NO: 6411 - DNA, 21 bp, Artificial Sequence
  Description of Artificial Sequence: Synthetic oligonucleotide
tgtgtaagtttataatgcagg

SEQ ID NO: 6412 - DNA, 21 bp, Artificial Sequence
  Description of Artificial Sequence: Synthetic oligonucleotide
tgcattataaacttacacaat

SEQ ID NO: 6413 - DNA, 21 bp, Artificial Sequence
  Description of Artificial Sequence: Synthetic oligonucleotide
gtgtaagtttataatgcaggg

SEQ ID NO: 6414 - DNA, 21 bp, Artificial Sequence
  Description of Artificial Sequence: Synthetic oligonucleotide
ctgcattataaacttacacaa

SEQ ID NO: 6415 - DNA, 21 bp, Artificial Sequence
  Description of Artificial Sequence: Synthetic oligonucleotide
tgtaagtttataatgcagggg

SEQ ID NO: 6416 - DNA, 21 bp, Artificial Sequence
  Description of Artificial Sequence: Synthetic oligonucleotide
cctgcattataaacttacaca

SEQ ID NO: 6417 - DNA, 21 bp, Artificial Sequence
  Description of Artificial Sequence: Synthetic oligonucleotide
gtaagtttataatgcagggga

SEQ ID NO: 6418 - DNA, 21 bp, Artificial Sequence
  Description of Artificial Sequence: Synthetic oligonucleotide
ccctgcattataaacttacac

SEQ ID NO: 6419 - DNA, 21 bp, Artificial Sequence
  Description of Artificial Sequence: Synthetic oligonucleotide
taagtttataatgcaggggaa

SEQ ID NO: 6420 - DNA, 21 bp, Artificial Sequence
  Description of Artificial Sequence: Synthetic oligonucleotide
cccctgcattataaacttaca

SEQ ID NO: 6421 - DNA, 21 bp, Artificial Sequence
  Description of Artificial Sequence: Synthetic oligonucleotide
aagtttataatgcaggggaag

SEQ ID NO: 6422 - DNA, 21 bp, Artificial Sequence
  Description of Artificial Sequence: Synthetic oligonucleotide
tcccctgcattataaacttac

SEQ ID NO: 6423 - DNA, 21 bp, Artificial Sequence
  Description of Artificial Sequence: Synthetic oligonucleotide
agtttataatgcaggggaagt

SEQ ID NO: 6424 - DNA, 21 bp, Artificial Sequence
  Description of Artificial Sequence: Synthetic oligonucleotide
ttcccctgcattataaactta

SEQ ID NO: 6425 - DNA, 21 bp, Artificial Sequence
  Description of Artificial Sequence: Synthetic oligonucleotide
gtttataatgcaggggaagta

SEQ ID NO: 6426 - DNA, 21 bp, Artificial Sequence
  Description of Artificial Sequence: Synthetic oligonucleotide
cttcccctgcattataaactt

SEQ ID NO: 6427 - DNA, 21 bp, Artificial Sequence
  Description of Artificial Sequence: Synthetic oligonucleotide
tttataatgcaggggaagtac

SEQ ID NO: 6428 - DNA, 21 bp, Artificial Sequence
  Description of Artificial Sequence: Synthetic oligonucleotide
acttcccctgcattataaact

SEQ ID NO: 6429 - DNA, 21 bp, Artificial Sequence
  Description of Artificial Sequence: Synthetic oligonucleotide
ttataatgcaggggaagtact

SEQ ID NO: 6430 - DNA, 21 bp, Artificial Sequence
  Description of Artificial Sequence: Synthetic oligonucleotide
tacttcccctgcattataaac

SEQ ID NO: 6431 - DNA, 21 bp, Artificial Sequence
  Description of Artificial Sequence: Synthetic oligonucleotide
tataatgcaggggaagtacta

SEQ ID NO: 6432 - DNA, 21 bp, Artificial Sequence
  Description of Artificial Sequence: Synthetic oligonucleotide
gtacttcccctgcattataaa

SEQ ID NO: 6433 - DNA, 21 bp, Artificial Sequence
  Description of Artificial Sequence: Synthetic oligonucleotide
ataatgcaggggaagtactac

SEQ ID NO: 6434 - DNA, 21 bp, Artificial Sequence
  Description of Artificial Sequence: Synthetic oligonucleotide
agtacttcccctgcattataa

SEQ ID NO: 6435 - DNA, 21 bp, Artificial Sequence
  Description of Artificial Sequence: Synthetic oligonucleotide
taatgcaggggaagtactact

SEQ ID NO: 6436 - DNA, 21 bp, Artificial Sequence
  Description of Artificial Sequence: Synthetic oligonucleotide
tagtacttcccctgcattata

SEQ ID NO: 6437 - DNA, 21 bp, Artificial Sequence
  Description of Artificial Sequence: Synthetic oligonucleotide
aatgcaggggaagtactactc

SEQ ID NO: 6438 - DNA, 21 bp, Artificial Sequence
  Description of Artificial Sequence: Synthetic oligonucleotide
gtagtacttcccctgcattat

SEQ ID NO: 6439 - DNA, 21 bp, Artificial Sequence
  Description of Artificial Sequence: Synthetic oligonucleotide
atgcaggggaagtactactcc

SEQ ID NO: 6440 - DNA, 21 bp, Artificial Sequence
  Description of Artificial Sequence: Synthetic oligonucleotide
agtagtacttcccctgcatta

SEQ ID NO: 6441 - DNA, 21 bp, Artificial Sequence
  Description of Artificial Sequence: Synthetic oligonucleotide
tgcaggggaagtactactcct

SEQ ID NO: 6442 - DNA, 21 bp, Artificial Sequence
  Description of Artificial Sequence: Synthetic oligonucleotide
gagtagtacttcccctgcatt

SEQ ID NO: 6443 - DNA, 21 bp, Artificial Sequence
  Description of Artificial Sequence: Synthetic oligonucleotide
gcaggggaagtactactcctc

SEQ ID NO: 6444 - DNA, 21 bp, Artificial Sequence
  Description of Artificial Sequence: Synthetic oligonucleotide
ggagtagtacttcccctgcat

SEQ ID NO: 6445 - DNA, 21 bp, Artificial Sequence
  Description of Artificial Sequence: Synthetic oligonucleotide
caggggaagtactactcctca

SEQ ID NO: 6446 - DNA, 21 bp, Artificial Sequence
  Description of Artificial Sequence: Synthetic oligonucleotide
aggagtagtacttcccctgca

SEQ ID NO: 6447 - DNA, 21 bp, Artificial Sequence
  Description of Artificial Sequence: Synthetic oligonucleotide
aggggaagtactactcctcaa

SEQ ID NO: 6448 - DNA, 21 bp, Artificial Sequence
  Description of Artificial Sequence: Synthetic oligonucleotide
gaggagtagtacttcccctgc

SEQ ID NO: 6449 - DNA, 21 bp, Artificial Sequence
  Description of Artificial Sequence: Synthetic oligonucleotide
ggggaagtactactcctcaaa

SEQ ID NO: 6450 - DNA, 21 bp, Artificial Sequence
  Description of Artificial Sequence: Synthetic oligonucleotide
tgaggagtagtacttcccctg

SEQ ID NO: 6451 - DNA, 21 bp, Artificial Sequence
  Description of Artificial Sequence: Synthetic oligonucleotide
gggaagtactactcctcaaat

SEQ ID NO: 6452 - DNA, 21 bp, Artificial Sequence
  Description of Artificial Sequence: Synthetic oligonucleotide
ttgaggagtagtacttcccct

SEQ ID NO: 6453 - DNA, 21 bp, Artificial Sequence
  Description of Artificial Sequence: Synthetic oligonucleotide
ggaagtactactcctcaaatg

SEQ ID NO: 6454 - DNA, 21 bp, Artificial Sequence
  Description of Artificial Sequence: Synthetic oligonucleotide
tttgaggagtagtacttcccc

SEQ ID NO: 6455 - DNA, 21 bp, Artificial Sequence
  Description of Artificial Sequence: Synthetic oligonucleotide
gaagtactactcctcaaatgt

SEQ ID NO: 6456 - DNA, 21 bp, Artificial Sequence
  Description of Artificial Sequence: Synthetic oligonucleotide
atttgaggagtagtacttccc

SEQ ID NO: 6457 - DNA, 21 bp, Artificial Sequence
  Description of Artificial Sequence: Synthetic oligonucleotide
aagtactactcctcaaatgtt

SEQ ID NO: 6458 - DNA, 21 bp, Artificial Sequence
  Description of Artificial Sequence: Synthetic oligonucleotide
catttgaggagtagtacttcc

SEQ ID NO: 6459 - DNA, 21 bp, Artificial Sequence
  Description of Artificial Sequence: Synthetic oligonucleotide
agtactactcctcaaatgttg

SEQ ID NO: 6460 - DNA, 21 bp, Artificial Sequence
  Description of Artificial Sequence: Synthetic oligonucleotide
acatttgaggagtagtacttc

SEQ ID NO: 6461 - DNA, 21 bp, Artificial Sequence
  Description of Artificial Sequence: Synthetic oligonucleotide
gtactactcctcaaatgttga

SEQ ID NO: 6462 - DNA, 21 bp, Artificial Sequence
  Description of Artificial Sequence: Synthetic oligonucleotide
aacatttgaggagtagtactt

SEQ ID NO: 6463 - DNA, 21 bp, Artificial Sequence
  Description of Artificial Sequence: Synthetic oligonucleotide
tactactcctcaaatgttgag

SEQ ID NO: 6464 - DNA, 21 bp, Artificial Sequence
  Description of Artificial Sequence: Synthetic oligonucleotide
caacatttgaggagtagtact

SEQ ID NO: 6465 - DNA, 21 bp, Artificial Sequence
  Description of Artificial Sequence: Synthetic oligonucleotide
actactcctcaaatgttgagg

SEQ ID NO: 6466 - DNA, 21 bp, Artificial Sequence
  Description of Artificial Sequence: Synthetic oligonucleotide
tcaacatttgaggagtagtac

SEQ ID NO: 6467 - DNA, 21 bp, Artificial Sequence
  Description of Artificial Sequence: Synthetic oligonucleotide
ctactcctcaaatgttgaggg

SEQ ID NO: 6468 - DNA, 21 bp, Artificial Sequence
  Description of Artificial Sequence: Synthetic oligonucleotide
ctcaacatttgaggagtagta

SEQ ID NO: 6469 - DNA, 21 bp, Artificial Sequence
  Description of Artificial Sequence: Synthetic oligonucleotide
tactcctcaaatgttgaggga

SEQ ID NO: 6470 - DNA, 21 bp, Artificial Sequence
  Description of Artificial Sequence: Synthetic oligonucleotide
cctcaacatttgaggagtagt

SEQ ID NO: 6471 - DNA, 21 bp, Artificial Sequence
  Description of Artificial Sequence: Synthetic oligonucleotide
actcctcaaatgttgagggaa

SEQ ID NO: 6472 - DNA, 21 bp, Artificial Sequence
  Description of Artificial Sequence: Synthetic oligonucleotide
ccctcaacatttgaggagtag

SEQ ID NO: 6473 - DNA, 21 bp, Artificial Sequence
  Description of Artificial Sequence: Synthetic oligonucleotide
ctcctcaaatgttgagggaag

SEQ ID NO: 6474 - DNA, 21 bp, Artificial Sequence
  Description of Artificial Sequence: Synthetic oligonucleotide
tccctcaacatttgaggagta

SEQ ID NO: 6475 - DNA, 21 bp, Artificial Sequence
  Description of Artificial Sequence: Synthetic oligonucleotide
tcctcaaatgttgagggaagc

SEQ ID NO: 6476 - DNA, 21 bp, Artificial Sequence
  Description of Artificial Sequence: Synthetic oligonucleotide
ttccctcaacatttgaggagt

SEQ ID NO: 6477 - DNA, 21 bp, Artificial Sequence
  Description of Artificial Sequence: Synthetic oligonucleotide
cctcaaatgttgagggaagct

SEQ ID NO: 6478 - DNA, 21 bp, Artificial Sequence
  Description of Artificial Sequence: Synthetic oligonucleotide
cttccctcaacatttgaggag

SEQ ID NO: 6479 - DNA, 21 bp, Artificial Sequence
  Description of Artificial Sequence: Synthetic oligonucleotide
ctcaaatgttgagggaagctt

SEQ ID NO: 6480 - DNA, 21 bp, Artificial Sequence
  Description of Artificial Sequence: Synthetic oligonucleotide
gcttccctcaacatttgagga

SEQ ID NO: 6481 - DNA, 21 bp, Artificial Sequence
  Description of Artificial Sequence: Synthetic oligonucleotide
tcaaatgttgagggaagcttc

SEQ ID NO: 6482 - DNA, 21 bp, Artificial Sequence
  Description of Artificial Sequence: Synthetic oligonucleotide
agcttccctcaacatttgagg

SEQ ID NO: 6483 - DNA, 21 bp, Artificial Sequence
  Description of Artificial Sequence: Synthetic oligonucleotide
caaatgttgagggaagcttcc

SEQ ID NO: 6484 - DNA, 21 bp, Artificial Sequence
  Description of Artificial Sequence: Synthetic oligonucleotide
aagcttccctcaacatttgag

SEQ ID NO: 6485 - DNA, 21 bp, Artificial Sequence
  Description of Artificial Sequence: Synthetic oligonucleotide
aaatgttgagggaagcttcca

SEQ ID NO: 6486 - DNA, 21 bp, Artificial Sequence
  Description of Artificial Sequence: Synthetic oligonucleotide
gaagcttccctcaacatttga

SEQ ID NO: 6487 - DNA, 21 bp, Artificial Sequence
  Description of Artificial Sequence: Synthetic oligonucleotide
aatgttgagggaagcttccat

SEQ ID NO: 6488 - DNA, 21 bp, Artificial Sequence
  Description of Artificial Sequence: Synthetic oligonucleotide
ggaagcttccctcaacatttg

SEQ ID NO: 6489 - DNA, 21 bp, Artificial Sequence
  Description of Artificial Sequence: Synthetic oligonucleotide
atgttgagggaagcttccata

SEQ ID NO: 6490 - DNA, 21 bp, Artificial Sequence
  Description of Artificial Sequence: Synthetic oligonucleotide
tggaagcttccctcaacattt

SEQ ID NO: 6491 - DNA, 21 bp, Artificial Sequence
  Description of Artificial Sequence: Synthetic oligonucleotide
tgttgagggaagcttccataa

SEQ ID NO: 6492 - DNA, 21 bp, Artificial Sequence
  Description of Artificial Sequence: Synthetic oligonucleotide
atggaagcttccctcaacatt

SEQ ID NO: 6493 - DNA, 21 bp, Artificial Sequence
  Description of Artificial Sequence: Synthetic oligonucleotide
gttgagggaagcttccataac

SEQ ID NO: 6494 - DNA, 21 bp, Artificial Sequence
  Description of Artificial Sequence: Synthetic oligonucleotide
tatggaagcttccctcaacat

SEQ ID NO: 6495 - DNA, 21 bp, Artificial Sequence
  Description of Artificial Sequence: Synthetic oligonucleotide
ttgagggaagcttccataaca

SEQ ID NO: 6496 - DNA, 21 bp, Artificial Sequence
  Description of Artificial Sequence: Synthetic oligonucleotide
ttatggaagcttccctcaaca

SEQ ID NO: 6497 - DNA, 21 bp, Artificial Sequence
  Description of Artificial Sequence: Synthetic oligonucleotide
tgagggaagcttccataacat

SEQ ID NO: 6498 - DNA, 21 bp, Artificial Sequence
  Description of Artificial Sequence: Synthetic oligonucleotide
gttatggaagcttccctcaac

SEQ ID NO: 6499 - DNA, 21 bp, Artificial Sequence
  Description of Artificial Sequence: Synthetic oligonucleotide
gagggaagcttccataacatt

SEQ ID NO: 6500 - DNA, 21 bp, Artificial Sequence
  Description of Artificial Sequence: Synthetic oligonucleotide
tgttatggaagcttccctcaa

SEQ ID NO: 6501 - DNA, 21 bp, Artificial Sequence
  Description of Artificial Sequence: Synthetic oligonucleotide
agggaagcttccataacattg

SEQ ID NO: 6502 - DNA, 21 bp, Artificial Sequence
  Description of Artificial Sequence: Synthetic oligonucleotide
atgttatggaagcttccctca

SEQ ID NO: 6503 - DNA, 21 bp, Artificial Sequence
  Description of Artificial Sequence: Synthetic oligonucleotide
gggaagcttccataacattga

SEQ ID NO: 6504 - DNA, 21 bp, Artificial Sequence
  Description of Artificial Sequence: Synthetic oligonucleotide
aatgttatggaagcttccctc

SEQ ID NO: 6505 - DNA, 21 bp, Artificial Sequence
  Description of Artificial Sequence: Synthetic oligonucleotide
ggaagcttccataacattgat

SEQ ID NO: 6506 - DNA, 21 bp, Artificial Sequence
  Description of Artificial Sequence: Synthetic oligonucleotide
caatgttatggaagcttccct

SEQ ID NO: 6507 - DNA, 21 bp, Artificial Sequence
  Description of Artificial Sequence: Synthetic oligonucleotide
gaagcttccataacattgatg

SEQ ID NO: 6508 - DNA, 21 bp, Artificial Sequence
  Description of Artificial Sequence: Synthetic oligonucleotide
tcaatgttatggaagcttccc

SEQ ID NO: 6509 - DNA, 21 bp, Artificial Sequence
  Description of Artificial Sequence: Synthetic oligonucleotide
aagcttccataacattgatga

SEQ ID NO: 6510 - DNA, 21 bp, Artificial Sequence
  Description of Artificial Sequence: Synthetic oligonucleotide
atcaatgttatggaagcttcc

SEQ ID NO: 6511 - DNA, 21 bp, Artificial Sequence
  Description of Artificial Sequence: Synthetic oligonucleotide
agcttccataacattgatgac

SEQ ID NO: 6512 - DNA, 21 bp, Artificial Sequence
  Description of Artificial Sequence: Synthetic oligonucleotide
catcaatgttatggaagcttc

SEQ ID NO: 6513 - DNA, 21 bp, Artificial Sequence
  Description of Artificial Sequence: Synthetic oligonucleotide
gcttccataacattgatgact

SEQ ID NO: 6514 - DNA, 21 bp, Artificial Sequence
  Description of Artificial Sequence: Synthetic oligonucleotide
tcatcaatgttatggaagctt

SEQ ID NO: 6515 - DNA, 21 bp, Artificial Sequence
  Description of Artificial Sequence: Synthetic oligonucleotide
cttccataacattgatgactg

SEQ ID NO: 6516 - DNA, 21 bp, Artificial Sequence
  Description of Artificial Sequence: Synthetic oligonucleotide
gtcatcaatgttatggaagct

SEQ ID NO: 6517 - DNA, 21 bp, Artificial Sequence
  Description of Artificial Sequence: Synthetic oligonucleotide
ttccataacattgatgactgg

SEQ ID NO: 6518 - DNA, 21 bp, Artificial Sequence
  Description of Artificial Sequence: Synthetic oligonucleotide
agtcatcaatgttatggaagc

SEQ ID NO: 6519 - DNA, 21 bp, Artificial Sequence
  Description of Artificial Sequence: Synthetic oligonucleotide
tccataacattgatgactggc

SEQ ID NO: 6520 - DNA, 21 bp, Artificial Sequence
  Description of Artificial Sequence: Synthetic oligonucleotide
cagtcatcaatgttatggaag

SEQ ID NO: 6521 - DNA, 21 bp, Artificial Sequence
  Description of Artificial Sequence: Synthetic oligonucleotide
ccataacattgatgactggct

SEQ ID NO: 6522 - DNA, 21 bp, Artificial Sequence
  Description of Artificial Sequence: Synthetic oligonucleotide
ccagtcatcaatgttatggaa

SEQ ID NO: 6523 - DNA, 21 bp, Artificial Sequence
  Description of Artificial Sequence: Synthetic oligonucleotide
cataacattgatgactggctt

SEQ ID NO: 6524 - DNA, 21 bp, Artificial Sequence
  Description of Artificial Sequence: Synthetic oligonucleotide
gccagtcatcaatgttatgga

SEQ ID NO: 6525 - DNA, 21 bp, Artificial Sequence
  Description of Artificial Sequence: Synthetic oligonucleotide
ataacattgatgactggcttc

SEQ ID NO: 6526 - DNA, 21 bp, Artificial Sequence
  Description of Artificial Sequence: Synthetic oligonucleotide
agccagtcatcaatgttatgg

SEQ ID NO: 6527 - DNA, 21 bp, Artificial Sequence
  Description of Artificial Sequence: Synthetic oligonucleotide
taacattgatgactggcttca

SEQ ID NO: 6528 - DNA, 21 bp, Artificial Sequence
  Description of Artificial Sequence: Synthetic oligonucleotide
aagccagtcatcaatgttatg

SEQ ID NO: 6529 - DNA, 21 bp, Artificial Sequence
  Description of Artificial Sequence: Synthetic oligonucleotide
aacattgatgactggcttcat

SEQ ID NO: 6530 - DNA, 21 bp, Artificial Sequence
  Description of Artificial Sequence: Synthetic oligonucleotide
gaagccagtcatcaatgttat

SEQ ID NO: 6531 - DNA, 21 bp, Artificial Sequence
  Description of Artificial Sequence: Synthetic oligonucleotide
acattgatgactggcttcatg

SEQ ID NO: 6532 - DNA, 21 bp, Artificial Sequence
  Description of Artificial Sequence: Synthetic oligonucleotide
tgaagccagtcatcaatgtta

SEQ ID NO: 6533 - DNA, 21 bp, Artificial Sequence
  Description of Artificial Sequence: Synthetic oligonucleotide
cattgatgactggcttcatgg

SEQ ID NO: 6534 - DNA, 21 bp, Artificial Sequence
  Description of Artificial Sequence: Synthetic oligonucleotide
atgaagccagtcatcaatgtt

SEQ ID NO: 6535 - DNA, 21 bp, Artificial Sequence
  Description of Artificial Sequence: Synthetic oligonucleotide
attgatgactggcttcatggc

SEQ ID NO: 6536 - DNA, 21 bp, Artificial Sequence
  Description of Artificial Sequence: Synthetic oligonucleotide
catgaagccagtcatcaatgt

SEQ ID NO: 6537 - DNA, 21 bp, Artificial Sequence
  Description of Artificial Sequence: Synthetic oligonucleotide
ttgatgactggcttcatggca

SEQ ID NO: 6538 - DNA, 21 bp, Artificial Sequence
  Description of Artificial Sequence: Synthetic oligonucleotide
ccatgaagccagtcatcaatg

SEQ ID NO: 6539 - DNA, 21 bp, Artificial Sequence
  Description of Artificial Sequence: Synthetic oligonucleotide
tgatgactggcttcatggcag

SEQ ID NO: 6540 - DNA, 21 bp, Artificial Sequence
  Description of Artificial Sequence: Synthetic oligonucleotide
gccatgaagccagtcatcaat

SEQ ID NO: 6541 - DNA, 21 bp, Artificial Sequence
  Description of Artificial Sequence: Synthetic oligonucleotide
gatgactggcttcatggcagt

SEQ ID NO: 6542 - DNA, 21 bp, Artificial Sequence
  Description of Artificial Sequence: Synthetic oligonucleotide
tgccatgaagccagtcatcaa

SEQ ID NO: 6543 - DNA, 21 bp, Artificial Sequence
  Description of Artificial Sequence: Synthetic oligonucleotide
atgactggcttcatggcagta

SEQ ID NO: 6544 - DNA, 21 bp, Artificial Sequence
  Description of Artificial Sequence: Synthetic oligonucleotide
ctgccatgaagccagtcatca

SEQ ID NO: 6545 - DNA, 21 bp, Artificial Sequence
  Description of Artificial Sequence: Synthetic oligonucleotide
tgactggcttcatggcagtaa

SEQ ID NO: 6546 - DNA, 21 bp, Artificial Sequence
  Description of Artificial Sequence: Synthetic oligonucleotide
actgccatgaagccagtcatc

SEQ ID NO: 6547 - DNA, 21 bp, Artificial Sequence
  Description of Artificial Sequence: Synthetic oligonucleotide
gactggcttcatggcagtaat

SEQ ID NO: 6548 - DNA, 21 bp, Artificial Sequence
  Description of Artificial Sequence: Synthetic oligonucleotide
tactgccatgaagccagtcat

SEQ ID NO: 6549 - DNA, 21 bp, Artificial Sequence
  Description of Artificial Sequence: Synthetic oligonucleotide
actggcttcatggcagtaatt

SEQ ID NO: 6550 - DNA, 21 bp, Artificial Sequence
  Description of Artificial Sequence: Synthetic oligonucleotide
ttactgccatgaagccagtca

SEQ ID NO: 6551 - DNA, 21 bp, Artificial Sequence
  Description of Artificial Sequence: Synthetic oligonucleotide
ctggcttcatggcagtaattc

SEQ ID NO: 6552 - DNA, 21 bp, Artificial Sequence
  Description of Artificial Sequence: Synthetic oligonucleotide
attactgccatgaagccagtc

SEQ ID NO: 6553 - DNA, 21 bp, Artificial Sequence
  Description of Artificial Sequence: Synthetic oligonucleotide
tggcttcatggcagtaattct

SEQ ID NO: 6554 - DNA, 21 bp, Artificial Sequence
  Description of Artificial Sequence: Synthetic oligonucleotide
aattactgccatgaagccagt

SEQ ID NO: 6555 - DNA, 21 bp, Artificial Sequence
  Description of Artificial Sequence: Synthetic oligonucleotide
ggcttcatggcagtaattctc

SEQ ID NO: 6556 - DNA, 21 bp, Artificial Sequence
  Description of Artificial Sequence: Synthetic oligonucleotide
gaattactgccatgaagccag

SEQ ID NO: 6557 - DNA, 21 bp, Artificial Sequence
  Description of Artificial Sequence: Synthetic oligonucleotide
gcttcatggcagtaattctcg

SEQ ID NO: 6558 - DNA, 21 bp, Artificial Sequence
  Description of Artificial Sequence: Synthetic oligonucleotide
agaattactgccatgaagcca

SEQ ID NO: 6559 - DNA, 21 bp, Artificial Sequence
  Description of Artificial Sequence: Synthetic oligonucleotide
cttcatggcagtaattctcgg

SEQ ID NO: 6560 - DNA, 21 bp, Artificial Sequence
  Description of Artificial Sequence: Synthetic oligonucleotide
gagaattactgccatgaagcc

SEQ ID NO: 6561 - DNA, 21 bp, Artificial Sequence
  Description of Artificial Sequence: Synthetic oligonucleotide
ttcatggcagtaattctcggc

SEQ ID NO: 6562 - DNA, 21 bp, Artificial Sequence
  Description of Artificial Sequence: Synthetic oligonucleotide
cgagaattactgccatgaagc

SEQ ID NO: 6563 - DNA, 21 bp, Artificial Sequence
  Description of Artificial Sequence: Synthetic oligonucleotide
tcatggcagtaattctcggct

SEQ ID NO: 6564 - DNA, 21 bp, Artificial Sequence
  Description of Artificial Sequence: Synthetic oligonucleotide
ccgagaattactgccatgaag

SEQ ID NO: 6565 - DNA, 21 bp, Artificial Sequence
  Description of Artificial Sequence: Synthetic oligonucleotide
catggcagtaattctcggctg

SEQ ID NO: 6566 - DNA, 21 bp, Artificial Sequence
  Description of Artificial Sequence: Synthetic oligonucleotide
gccgagaattactgccatgaa

SEQ ID NO: 6567 - DNA, 21 bp, Artificial Sequence
  Description of Artificial Sequence: Synthetic oligonucleotide
atggcagtaattctcggctgt

SEQ ID NO: 6568 - DNA, 21 bp, Artificial Sequence
  Description of Artificial Sequence: Synthetic oligonucleotide
agccgagaattactgccatga

SEQ ID NO: 6569 - DNA, 21 bp, Artificial Sequence
  Description of Artificial Sequence: Synthetic oligonucleotide
tggcagtaattctcggctgta

SEQ ID NO: 6570 - DNA, 21 bp, Artificial Sequence
  Description of Artificial Sequence: Synthetic oligonucleotide
cagccgagaattactgccatg

SEQ ID NO: 6571 - DNA, 21 bp, Artificial Sequence
  Description of Artificial Sequence: Synthetic oligonucleotide
ggcagtaattctcggctgtag

SEQ ID NO: 6572 - DNA, 21 bp, Artificial Sequence
  Description of Artificial Sequence: Synthetic oligonucleotide
acagccgagaattactgccat

SEQ ID NO: 6573 - DNA, 21 bp, Artificial Sequence
  Description of Artificial Sequence: Synthetic oligonucleotide
gcagtaattctcggctgtagt

SEQ ID NO: 6574 - DNA, 21 bp, Artificial Sequence
  Description of Artificial Sequence: Synthetic oligonucleotide
tacagccgagaattactgcca

SEQ ID NO: 6575 - DNA, 21 bp, Artificial Sequence
  Description of Artificial Sequence: Synthetic oligonucleotide
cagtaattctcggctgtagtt

SEQ ID NO: 6576 - DNA, 21 bp, Artificial Sequence
  Description of Artificial Sequence: Synthetic oligonucleotide
ctacagccgagaattactgcc

SEQ ID NO: 6577 - DNA, 21 bp, Artificial Sequence
  Description of Artificial Sequence: Synthetic oligonucleotide
agtaattctcggctgtagttg

SEQ ID NO: 6578 - DNA, 21 bp, Artificial Sequence
  Description of Artificial Sequence: Synthetic oligonucleotide
actacagccgagaattactgc

SEQ ID NO: 6579 - DNA, 21 bp, Artificial Sequence
  Description of Artificial Sequence: Synthetic oligonucleotide
gtaattctcggctgtagttgc

SEQ ID NO: 6580 - DNA, 21 bp, Artificial Sequence
  Description of Artificial Sequence: Synthetic oligonucleotide
aactacagccgagaattactg

SEQ ID NO: 6581 - DNA, 21 bp, Artificial Sequence
  Description of Artificial Sequence: Synthetic oligonucleotide
taattctcggctgtagttgca

SEQ ID NO: 6582 - DNA, 21 bp, Artificial Sequence
  Description of Artificial Sequence: Synthetic oligonucleotide
caactacagccgagaattact

SEQ ID NO: 6583 - DNA, 21 bp, Artificial Sequence
  Description of Artificial Sequence: Synthetic oligonucleotide
aattctcggctgtagttgcat

SEQ ID NO: 6584 - DNA, 21 bp, Artificial Sequence
  Description of Artificial Sequence: Synthetic oligonucleotide
gcaactacagccgagaattac

SEQ ID NO: 6585 - DNA, 21 bp, Artificial Sequence
  Description of Artificial Sequence: Synthetic oligonucleotide
attctcggctgtagttgcata

SEQ ID NO: 6586 - DNA, 21 bp, Artificial Sequence
  Description of Artificial Sequence: Synthetic oligonucleotide
tgcaactacagccgagaatta

SEQ ID NO: 6587 - DNA, 21 bp, Artificial Sequence
  Description of Artificial Sequence: Synthetic oligonucleotide
ttctcggctgtagttgcataa

SEQ ID NO: 6588 - DNA, 21 bp, Artificial Sequence
  Description of Artificial Sequence: Synthetic oligonucleotide
atgcaactacagccgagaatt

SEQ ID NO: 6589 - DNA, 21 bp, Artificial Sequence
  Description of Artificial Sequence: Synthetic oligonucleotide
tctcggctgtagttgcataag

SEQ ID NO: 6590 - DNA, 21 bp, Artificial Sequence
  Description of Artificial Sequence: Synthetic oligonucleotide
tatgcaactacagccgagaat

SEQ ID NO: 6591 - DNA, 21 bp, Artificial Sequence
  Description of Artificial Sequence: Synthetic oligonucleotide
ctcggctgtagttgcataagc

SEQ ID NO: 6592 - DNA, 21 bp, Artificial Sequence
  Description of Artificial Sequence: Synthetic oligonucleotide
ttatgcaactacagccgagaa

SEQ ID NO: 6593 - DNA, 21 bp, Artificial Sequence
  Description of Artificial Sequence: Synthetic oligonucleotide
tcggctgtagttgcataagca

SEQ ID NO: 6594 - DNA, 21 bp, Artificial Sequence
  Description of Artificial Sequence: Synthetic oligonucleotide
cttatgcaactacagccgaga

SEQ ID NO: 6595 - DNA, 21 bp, Artificial Sequence
  Description of Artificial Sequence: Synthetic oligonucleotide
cggctgtagttgcataagcat

SEQ ID NO: 6596 - DNA, 21 bp, Artificial Sequence
  Description of Artificial Sequence: Synthetic oligonucleotide
gcttatgcaactacagccgag

SEQ ID NO: 6597 - DNA, 21 bp, Artificial Sequence
  Description of Artificial Sequence: Synthetic oligonucleotide
ggctgtagttgcataagcatt

SEQ ID NO: 6598 - DNA, 21 bp, Artificial Sequence
  Description of Artificial Sequence: Synthetic oligonucleotide
tgcttatgcaactacagccga

SEQ ID NO: 6599 - DNA, 21 bp, Artificial Sequence
  Description of Artificial Sequence: Synthetic oligonucleotide
gctgtagttgcataagcattg

SEQ ID NO: 6600 - DNA, 21 bp, Artificial Sequence
  Description of Artificial Sequence: Synthetic oligonucleotide
atgcttatgcaactacagccg

SEQ ID NO: 6601 - DNA, 21 bp, Artificial Sequence
  Description of Artificial Sequence: Synthetic oligonucleotide
ctgtagttgcataagcattgc

SEQ ID NO: 6602 - DNA, 21 bp, Artificial Sequence
  Description of Artificial Sequence: Synthetic oligonucleotide
aatgcttatgcaactacagcc

SEQ ID NO: 6603 - DNA, 21 bp, Artificial Sequence
  Description of Artificial Sequence: Synthetic oligonucleotide
tgtagttgcataagcattgct

SEQ ID NO: 6604 - DNA, 21 bp, Artificial Sequence
  Description of Artificial Sequence: Synthetic oligonucleotide
caatgcttatgcaactacagc

SEQ ID NO: 6605 - DNA, 21 bp, Artificial Sequence
  Description of Artificial Sequence: Synthetic oligonucleotide
gtagttgcataagcattgctc

SEQ ID NO: 6606 - DNA, 21 bp, Artificial Sequence
  Description of Artificial Sequence: Synthetic oligonucleotide
gcaatgcttatgcaactacag

SEQ ID NO: 6607 - DNA, 21 bp, Artificial Sequence
  Description of Artificial Sequence: Synthetic oligonucleotide
tagttgcataagcattgctca

SEQ ID NO: 6608 - DNA, 21 bp, Artificial Sequence
  Description of Artificial Sequence: Synthetic oligonucleotide
agcaatgcttatgcaactaca

SEQ ID NO: 6609 - DNA, 21 bp, Artificial Sequence
  Description of Artificial Sequence: Synthetic oligonucleotide
agttgcataagcattgctcaa

SEQ ID NO: 6610 - DNA, 21 bp, Artificial Sequence
  Description of Artificial Sequence: Synthetic oligonucleotide
gagcaatgcttatgcaactac

SEQ ID NO: 6611 - DNA, 21 bp, Artificial Sequence
  Description of Artificial Sequence: Synthetic oligonucleotide
gttgcataagcattgctcaag

SEQ ID NO: 6612 - DNA, 21 bp, Artificial Sequence
  Description of Artificial Sequence: Synthetic oligonucleotide
tgagcaatgcttatgcaacta

SEQ ID NO: 6613 - DNA, 21 bp, Artificial Sequence
  Description of Artificial Sequence: Synthetic oligonucleotide
ttgcataagcattgctcaaga

SEQ ID NO: 6614 - DNA, 21 bp, Artificial Sequence
  Description of Artificial Sequence: Synthetic oligonucleotide
ttgagcaatgcttatgcaact

SEQ ID NO: 6615 - DNA, 21 bp, Artificial Sequence
  Description of Artificial Sequence: Synthetic oligonucleotide
tgcataagcattgctcaagag

SEQ ID NO: 6616 - DNA, 21 bp, Artificial Sequence
  Description of Artificial Sequence: Synthetic oligonucleotide
cttgagcaatgcttatgcaac

SEQ ID NO: 6617 - DNA, 21 bp, Artificial Sequence
  Description of Artificial Sequence: Synthetic oligonucleotide
gcataagcattgctcaagagg

SEQ ID NO: 6618 - DNA, 21 bp, Artificial Sequence
  Description of Artificial Sequence: Synthetic oligonucleotide
tcttgagcaatgcttatgcaa

SEQ ID NO: 6619 - DNA, 21 bp, Artificial Sequence
  Description of Artificial Sequence: Synthetic oligonucleotide
cataagcattgctcaagagga

SEQ ID NO: 6620 - DNA, 21 bp, Artificial Sequence
  Description of Artificial Sequence: Synthetic oligonucleotide
ctcttgagcaatgcttatgca

SEQ ID NO: 6621 - DNA, 21 bp, Artificial Sequence
  Description of Artificial Sequence: Synthetic oligonucleotide
ataagcattgctcaagaggaa

SEQ ID NO: 6622 - DNA, 21 bp, Artificial Sequence
  Description of Artificial Sequence: Synthetic oligonucleotide
cctcttgagcaatgcttatgc

SEQ ID NO: 6623 - DNA, 21 bp, Artificial Sequence
  Description of Artificial Sequence: Synthetic oligonucleotide
taagcattgctcaagaggaaa

SEQ ID NO: 6624 - DNA, 21 bp, Artificial Sequence
  Description of Artificial Sequence: Synthetic oligonucleotide
tcctcttgagcaatgcttatg

SEQ ID NO: 6625 - DNA, 21 bp, Artificial Sequence
  Description of Artificial Sequence: Synthetic oligonucleotide
aagcattgctcaagaggaaaa

SEQ ID NO: 6626 - DNA, 21 bp, Artificial Sequence
  Description of Artificial Sequence: Synthetic oligonucleotide
ttcctcttgagcaatgcttat

SEQ ID NO: 6627 - DNA, 21 bp, Artificial Sequence
  Description of Artificial Sequence: Synthetic oligonucleotide
agcattgctcaagaggaaaat

SEQ ID NO: 6628 - DNA, 21 bp, Artificial Sequence
  Description of Artificial Sequence: Synthetic oligonucleotide
tttcctcttgagcaatgctta

SEQ ID NO: 6629 - DNA, 21 bp, Artificial Sequence
  Description of Artificial Sequence: Synthetic oligonucleotide
gcattgctcaagaggaaaatc

SEQ ID NO: 6630 - DNA, 21 bp, Artificial Sequence
  Description of Artificial Sequence: Synthetic oligonucleotide
ttttcctcttgagcaatgctt

SEQ ID NO: 6631 - DNA, 21 bp, Artificial Sequence
  Description of Artificial Sequence: Synthetic oligonucleotide
cattgctcaagaggaaaatcc

SEQ ID NO: 6632 - DNA, 21 bp, Artificial Sequence
  Description of Artificial Sequence: Synthetic oligonucleotide
attttcctcttgagcaatgct

SEQ ID NO: 6633 - DNA, 21 bp, Artificial Sequence
  Description of Artificial Sequence: Synthetic oligonucleotide
attgctcaagaggaaaatcca

SEQ ID NO: 6634 - DNA, 21 bp, Artificial Sequence
  Description of Artificial Sequence: Synthetic oligonucleotide
gattttcctcttgagcaatgc

SEQ ID NO: 6635 - DNA, 21 bp, Artificial Sequence
  Description of Artificial Sequence: Synthetic oligonucleotide
ttgctcaagaggaaaatccaa

SEQ ID NO: 6636 - DNA, 21 bp, Artificial Sequence
  Description of Artificial Sequence: Synthetic oligonucleotide
ggattttcctcttgagcaatg

SEQ ID NO: 6637 - DNA, 21 bp, Artificial Sequence
  Description of Artificial Sequence: Synthetic oligonucleotide
tgctcaagaggaaaatccaaa

SEQ ID NO: 6638 - DNA, 21 bp, Artificial Sequence
  Description of Artificial Sequence: Synthetic oligonucleotide
tggattttcctcttgagcaat

SEQ ID NO: 6639 - DNA, 21 bp, Artificial Sequence
  Description of Artificial Sequence: Synthetic oligonucleotide
gctcaagaggaaaatccaaaa

SEQ ID NO: 6640 - DNA, 21 bp, Artificial Sequence
  Description of Artificial Sequence: Synthetic oligonucleotide
ttggattttcctcttgagcaa

SEQ ID NO: 6641 - DNA, 21 bp, Artificial Sequence
  Description of Artificial Sequence: Synthetic oligonucleotide
ctcaagaggaaaatccaaaag

SEQ ID NO: 6642 - DNA, 21 bp, Artificial Sequence
  Description of Artificial Sequence: Synthetic oligonucleotide
tttggattttcctcttgagca

SEQ ID NO: 6643 - DNA, 21 bp, Artificial Sequence
  Description of Artificial Sequence: Synthetic oligonucleotide
tcaagaggaaaatccaaaagt

SEQ ID NO: 6644 - DNA, 21 bp, Artificial Sequence
  Description of Artificial Sequence: Synthetic oligonucleotide
ttttggattttcctcttgagc

SEQ ID NO: 6645 - DNA, 21 bp, Artificial Sequence
  Description of Artificial Sequence: Synthetic oligonucleotide
caagaggaaaatccaaaagtg

SEQ ID NO: 6646 - DNA, 21 bp, Artificial Sequence
  Description of Artificial Sequence: Synthetic oligonucleotide
cttttggattttcctcttgag

SEQ ID NO: 6647 - DNA, 21 bp, Artificial Sequence
  Description of Artificial Sequence: Synthetic oligonucleotide
aagaggaaaatccaaaagtgc

SEQ ID NO: 6648 - DNA, 21 bp, Artificial Sequence
  Description of Artificial Sequence: Synthetic oligonucleotide
acttttggattttcctcttga

SEQ ID NO: 6649 - DNA, 21 bp, Artificial Sequence
  Description of Artificial Sequence: Synthetic oligonucleotide
agaggaaaatccaaaagtgca

SEQ ID NO: 6650 - DNA, 21 bp, Artificial Sequence
  Description of Artificial Sequence: Synthetic oligonucleotide
cacttttggattttcctcttg

SEQ ID NO: 6651 - DNA, 21 bp, Artificial Sequence
  Description of Artificial Sequence: Synthetic oligonucleotide
gaggaaaatccaaaagtgcag

SEQ ID NO: 6652 - DNA, 21 bp, Artificial Sequence
  Description of Artificial Sequence: Synthetic oligonucleotide
gcacttttggattttcctctt

SEQ ID NO: 6653 - DNA, 21 bp, Artificial Sequence
  Description of Artificial Sequence: Synthetic oligonucleotide
aggaaaatccaaaagtgcagc

SEQ ID NO: 6654 - DNA, 21 bp, Artificial Sequence
  Description of Artificial Sequence: Synthetic oligonucleotide
tgcacttttggattttcctct

SEQ ID NO: 6655 - DNA, 21 bp, Artificial Sequence
  Description of Artificial Sequence: Synthetic oligonucleotide
ggaaaatccaaaagtgcagca

SEQ ID NO: 6656 - DNA, 21 bp, Artificial Sequence
  Description of Artificial Sequence: Synthetic oligonucleotide
ctgcacttttggattttcctc

SEQ ID NO: 6657 - DNA, 21 bp, Artificial Sequence
  Description of Artificial Sequence: Synthetic oligonucleotide
gaaaatccaaaagtgcagcag

SEQ ID NO: 6658 - DNA, 21 bp, Artificial Sequence
  Description of Artificial Sequence: Synthetic oligonucleotide
gctgcacttttggattttcct

SEQ ID NO: 6659 - DNA, 21 bp, Artificial Sequence
  Description of Artificial Sequence: Synthetic oligonucleotide
aaaatccaaaagtgcagcagg

SEQ ID NO: 6660 - DNA, 21 bp, Artificial Sequence
  Description of Artificial Sequence: Synthetic oligonucleotide
tgctgcacttttggattttcc

SEQ ID NO: 6661 - DNA, 21 bp, Artificial Sequence
  Description of Artificial Sequence: Synthetic oligonucleotide
aaatccaaaagtgcagcagga

SEQ ID NO: 6662 - DNA, 21 bp, Artificial Sequence
  Description of Artificial Sequence: Synthetic oligonucleotide
ctgctgcacttttggattttc

SEQ ID NO: 6663 - DNA, 21 bp, Artificial Sequence
  Description of Artificial Sequence: Synthetic oligonucleotide
aatccaaaagtgcagcaggag

SEQ ID NO: 6664 - DNA, 21 bp, Artificial Sequence
  Description of Artificial Sequence: Synthetic oligonucleotide
cctgctgcacttttggatttt

SEQ ID NO: 6665 - DNA, 21 bp, Artificial Sequence
  Description of Artificial Sequence: Synthetic oligonucleotide
atccaaaagtgcagcaggaga

SEQ ID NO: 6666 - DNA, 21 bp, Artificial Sequence
  Description of Artificial Sequence: Synthetic oligonucleotide
tcctgctgcacttttggattt

SEQ ID NO: 6667 - DNA, 21 bp, Artificial Sequence
  Description of Artificial Sequence: Synthetic oligonucleotide
tccaaaagtgcagcaggagaa

SEQ ID NO: 6668 - DNA, 21 bp, Artificial Sequence
  Description of Artificial Sequence: Synthetic oligonucleotide
ctcctgctgcacttttggatt

SEQ ID NO: 6669 - DNA, 21 bp, Artificial Sequence
  Description of Artificial Sequence: Synthetic oligonucleotide
ccaaaagtgcagcaggagaac

SEQ ID NO: 6670 - DNA, 21 bp, Artificial Sequence
  Description of Artificial Sequence: Synthetic oligonucleotide
tctcctgctgcacttttggat

SEQ ID NO: 6671 - DNA, 21 bp, Artificial Sequence
  Description of Artificial Sequence: Synthetic oligonucleotide
caaaagtgcagcaggagaact

SEQ ID NO: 6672 - DNA, 21 bp, Artificial Sequence
  Description of Artificial Sequence: Synthetic oligonucleotide
ttctcctgctgcacttttgga

SEQ ID NO: 6673 - DNA, 21 bp, Artificial Sequence
  Description of Artificial Sequence: Synthetic oligonucleotide
aaaagtgcagcaggagaactc

SEQ ID NO: 6674 - DNA, 21 bp, Artificial Sequence
  Description of Artificial Sequence: Synthetic oligonucleotide
gttctcctgctgcacttttgg

SEQ ID NO: 6675 - DNA, 21 bp, Artificial Sequence
  Description of Artificial Sequence: Synthetic oligonucleotide
aaagtgcagcaggagaactct

SEQ ID NO: 6676 - DNA, 21 bp, Artificial Sequence
  Description of Artificial Sequence: Synthetic oligonucleotide
agttctcctgctgcacttttg

SEQ ID NO: 6677 - DNA, 21 bp, Artificial Sequence
  Description of Artificial Sequence: Synthetic oligonucleotide
aagtgcagcaggagaactctt

SEQ ID NO: 6678 - DNA, 21 bp, Artificial Sequence
  Description of Artificial Sequence: Synthetic oligonucleotide
gagttctcctgctgcactttt

SEQ ID NO: 6679 - DNA, 21 bp, Artificial Sequence
  Description of Artificial Sequence: Synthetic oligonucleotide
agtgcagcaggagaactcttt

SEQ ID NO: 6680 - DNA, 21 bp, Artificial Sequence
  Description of Artificial Sequence: Synthetic oligonucleotide
agagttctcctgctgcacttt

SEQ ID NO: 6681 - DNA, 21 bp, Artificial Sequence
  Description of Artificial Sequence: Synthetic oligonucleotide
gtgcagcaggagaactctttt

SEQ ID NO: 6682 - DNA, 21 bp, Artificial Sequence
  Description of Artificial Sequence: Synthetic oligonucleotide
aagagttctcctgctgcactt

SEQ ID NO: 6683 - DNA, 21 bp, Artificial Sequence
  Description of Artificial Sequence: Synthetic oligonucleotide
tgcagcaggagaactcttttc

SEQ ID NO: 6684 - DNA, 21 bp, Artificial Sequence
  Description of Artificial Sequence: Synthetic oligonucleotide
aaagagttctcctgctgcact

SEQ ID NO: 6685 - DNA, 21 bp, Artificial Sequence
  Description of Artificial Sequence: Synthetic oligonucleotide
gcagcaggagaactcttttcc

SEQ ID NO: 6686 - DNA, 21 bp, Artificial Sequence
  Description of Artificial Sequence: Synthetic oligonucleotide
aaaagagttctcctgctgcac

SEQ ID NO: 6687 - DNA, 21 bp, Artificial Sequence
  Description of Artificial Sequence: Synthetic oligonucleotide
cagcaggagaactcttttccc

SEQ ID NO: 6688 - DNA, 21 bp, Artificial Sequence
  Description of Artificial Sequence: Synthetic oligonucleotide
gaaaagagttctcctgctgca

SEQ ID NO: 6689 - DNA, 21 bp, Artificial Sequence
  Description of Artificial Sequence: Synthetic oligonucleotide
agcaggagaactcttttccct

SEQ ID NO: 6690 - DNA, 21 bp, Artificial Sequence
  Description of Artificial Sequence: Synthetic oligonucleotide
ggaaaagagttctcctgctgc

SEQ ID NO: 6691 - DNA, 21 bp, Artificial Sequence
  Description of Artificial Sequence: Synthetic oligonucleotide
gcaggagaactcttttccctg

SEQ ID NO: 6692 - DNA, 21 bp, Artificial Sequence
  Description of Artificial Sequence: Synthetic oligonucleotide
gggaaaagagttctcctgctg

SEQ ID NO: 6693 - DNA, 21 bp, Artificial Sequence
  Description of Artificial Sequence: Synthetic oligonucleotide
caggagaactcttttccctga

SEQ ID NO: 6694 - DNA, 21 bp, Artificial Sequence
  Description of Artificial Sequence: Synthetic oligonucleotide
agggaaaagagttctcctgct

SEQ ID NO: 6695 - DNA, 21 bp, Artificial Sequence
  Description of Artificial Sequence: Synthetic oligonucleotide
aggagaactcttttccctgaa

SEQ ID NO: 6696 - DNA, 21 bp, Artificial Sequence
  Description of Artificial Sequence: Synthetic oligonucleotide
cagggaaaagagttctcctgc

SEQ ID NO: 6697 - DNA, 21 bp, Artificial Sequence
  Description of Artificial Sequence: Synthetic oligonucleotide
ggagaactcttttccctgaaa

SEQ ID NO: 6698 - DNA, 21 bp, Artificial Sequence
  Description of Artificial Sequence: Synthetic oligonucleotide
tcagggaaaagagttctcctg

SEQ ID NO: 6699 - DNA, 21 bp, Artificial Sequence
  Description of Artificial Sequence: Synthetic oligonucleotide
gagaactcttttccctgaaaa

SEQ ID NO: 6700 - DNA, 21 bp, Artificial Sequence
  Description of Artificial Sequence: Synthetic oligonucleotide
ttcagggaaaagagttctcct

SEQ ID NO: 6701 - DNA, 21 bp, Artificial Sequence
  Description of Artificial Sequence: Synthetic oligonucleotide
agaactcttttccctgaaaaa

SEQ ID NO: 6702 - DNA, 21 bp, Artificial Sequence
  Description of Artificial Sequence: Synthetic oligonucleotide
tttcagggaaaagagttctcc

SEQ ID NO: 6703 - DNA, 21 bp, Artificial Sequence
  Description of Artificial Sequence: Synthetic oligonucleotide
gaactcttttccctgaaaaag

SEQ ID NO: 6704 - DNA, 21 bp, Artificial Sequence
  Description of Artificial Sequence: Synthetic oligonucleotide
ttttcagggaaaagagttctc

SEQ ID NO: 6705 - DNA, 21 bp, Artificial Sequence
  Description of Artificial Sequence: Synthetic oligonucleotide
aactcttttccctgaaaaagg

SEQ ID NO: 6706 - DNA, 21 bp, Artificial Sequence
  Description of Artificial Sequence: Synthetic oligonucleotide
tttttcagggaaaagagttct

SEQ ID NO: 6707 - DNA, 21 bp, Artificial Sequence
  Description of Artificial Sequence: Synthetic oligonucleotide
actcttttccctgaaaaagga

SEQ ID NO: 6708 - DNA, 21 bp, Artificial Sequence
  Description of Artificial Sequence: Synthetic oligonucleotide
ctttttcagggaaaagagttc

SEQ ID NO: 6709 - DNA, 21 bp, Artificial Sequence
  Description of Artificial Sequence: Synthetic oligonucleotide
ctcttttccctgaaaaaggaa

SEQ ID NO: 6710 - DNA, 21 bp, Artificial Sequence
  Description of Artificial Sequence: Synthetic oligonucleotide
cctttttcagggaaaagagtt

SEQ ID NO: 6711 - DNA, 21 bp, Artificial Sequence
  Description of Artificial Sequence: Synthetic oligonucleotide
tcttttccctgaaaaaggaaa

SEQ ID NO: 6712 - DNA, 21 bp, Artificial Sequence
  Description of Artificial Sequence: Synthetic oligonucleotide
tcctttttcagggaaaagagt

SEQ ID NO: 6713 - DNA, 21 bp, Artificial Sequence
  Description of Artificial Sequence: Synthetic oligonucleotide
cttttccctgaaaaaggaaaa

SEQ ID NO: 6714 - DNA, 21 bp, Artificial Sequence
  Description of Artificial Sequence: Synthetic oligonucleotide
ttcctttttcagggaaaagag

SEQ ID NO: 6715 - DNA, 21 bp, Artificial Sequence
  Description of Artificial Sequence: Synthetic oligonucleotide
ttttccctgaaaaaggaaaaa

SEQ ID NO: 6716 - DNA, 21 bp, Artificial Sequence
  Description of Artificial Sequence: Synthetic oligonucleotide
tttcctttttcagggaaaaga

SEQ ID NO: 6717 - DNA, 21 bp, Artificial Sequence
  Description of Artificial Sequence: Synthetic oligonucleotide
tttccctgaaaaaggaaaaat

SEQ ID NO: 6718 - DNA, 21 bp, Artificial Sequence
  Description of Artificial Sequence: Synthetic oligonucleotide
ttttcctttttcagggaaaag

SEQ ID NO: 6719 - DNA, 21 bp, Artificial Sequence
  Description of Artificial Sequence: Synthetic oligonucleotide
ttccctgaaaaaggaaaaata

SEQ ID NO: 6720 - DNA, 21 bp, Artificial Sequence
  Description of Artificial Sequence: Synthetic oligonucleotide
tttttcctttttcagggaaaa

SEQ ID NO: 6721 - DNA, 21 bp, Artificial Sequence
  Description of Artificial Sequence: Synthetic oligonucleotide
tccctgaaaaaggaaaaatat

SEQ ID NO: 6722 - DNA, 21 bp, Artificial Sequence
  Description of Artificial Sequence: Synthetic oligonucleotide
atttttcctttttcagggaaa

SEQ ID NO: 6723 - DNA, 21 bp, Artificial Sequence
  Description of Artificial Sequence: Synthetic oligonucleotide
ccctgaaaaaggaaaaatatt

SEQ ID NO: 6724 - DNA, 21 bp, Artificial Sequence
  Description of Artificial Sequence: Synthetic oligonucleotide
tatttttcctttttcagggaa

SEQ ID NO: 6725 - DNA, 21 bp, Artificial Sequence
  Description of Artificial Sequence: Synthetic oligonucleotide
cctgaaaaaggaaaaatattg

SEQ ID NO: 6726 - DNA, 21 bp, Artificial Sequence
  Description of Artificial Sequence: Synthetic oligonucleotide
atatttttcctttttcaggga

SEQ ID NO: 6727 - DNA, 21 bp, Artificial Sequence
  Description of Artificial Sequence: Synthetic oligonucleotide
ctgaaaaaggaaaaatattga

SEQ ID NO: 6728 - DNA, 21 bp, Artificial Sequence
  Description of Artificial Sequence: Synthetic oligonucleotide
aatatttttcctttttcaggg

SEQ ID NO: 6729 - DNA, 21 bp, Artificial Sequence
  Description of Artificial Sequence: Synthetic oligonucleotide
tgaaaaaggaaaaatattgaa

SEQ ID NO: 6730 - DNA, 21 bp, Artificial Sequence
  Description of Artificial Sequence: Synthetic oligonucleotide
caatatttttcctttttcagg

SEQ ID NO: 6731 - DNA, 21 bp, Artificial Sequence
  Description of Artificial Sequence: Synthetic oligonucleotide
gaaaaaggaaaaatattgaac

SEQ ID NO: 6732 - DNA, 21 bp, Artificial Sequence
  Description of Artificial Sequence: Synthetic oligonucleotide
tcaatatttttcctttttcag

SEQ ID NO: 6733 - DNA, 21 bp, Artificial Sequence
  Description of Artificial Sequence: Synthetic oligonucleotide
aaaaaggaaaaatattgaact

SEQ ID NO: 6734 - DNA, 21 bp, Artificial Sequence
  Description of Artificial Sequence: Synthetic oligonucleotide
ttcaatatttttcctttttca

SEQ ID NO: 6735 - DNA, 21 bp, Artificial Sequence
  Description of Artificial Sequence: Synthetic oligonucleotide
aaaaggaaaaatattgaactc

SEQ ID NO: 6736 - DNA, 21 bp, Artificial Sequence
  Description of Artificial Sequence: Synthetic oligonucleotide
gttcaatatttttcctttttc

SEQ ID NO: 6737 - DNA, 21 bp, Artificial Sequence
  Description of Artificial Sequence: Synthetic oligonucleotide
aaaggaaaaatattgaactca

SEQ ID NO: 6738 - DNA, 21 bp, Artificial Sequence
  Description of Artificial Sequence: Synthetic oligonucleotide
agttcaatatttttccttttt

SEQ ID NO: 6739 - DNA, 21 bp, Artificial Sequence
  Description of Artificial Sequence: Synthetic oligonucleotide
aaggaaaaatattgaactcaa

SEQ ID NO: 6740 - DNA, 21 bp, Artificial Sequence
  Description of Artificial Sequence: Synthetic oligonucleotide
gagttcaatatttttcctttt

SEQ ID NO: 6741 - DNA, 21 bp, Artificial Sequence
  Description of Artificial Sequence: Synthetic oligonucleotide
aggaaaaatattgaactcaat

SEQ ID NO: 6742 - DNA, 21 bp, Artificial Sequence
  Description of Artificial Sequence: Synthetic oligonucleotide
tgagttcaatatttttccttt

SEQ ID NO: 6743 - DNA, 21 bp, Artificial Sequence
  Description of Artificial Sequence: Synthetic oligonucleotide
ggaaaaatattgaactcaatg

SEQ ID NO: 6744 - DNA, 21 bp, Artificial Sequence
  Description of Artificial Sequence: Synthetic oligonucleotide
ttgagttcaatatttttcctt

SEQ ID NO: 6745 - DNA, 21 bp, Artificial Sequence
  Description of Artificial Sequence: Synthetic oligonucleotide
gaaaaatattgaactcaatga

SEQ ID NO: 6746 - DNA, 21 bp, Artificial Sequence
  Description of Artificial Sequence: Synthetic oligonucleotide
attgagttcaatatttttcct

SEQ ID NO: 6747 - DNA, 21 bp, Artificial Sequence
  Description of Artificial Sequence: Synthetic oligonucleotide
aaaaatattgaactcaatgat

SEQ ID NO: 6748 - DNA, 21 bp, Artificial Sequence
  Description of Artificial Sequence: Synthetic oligonucleotide
cattgagttcaatatttttcc

SEQ ID NO: 6749 - DNA, 21 bp, Artificial Sequence
  Description of Artificial Sequence: Synthetic oligonucleotide
aaaatattgaactcaatgata

SEQ ID NO: 6750 - DNA, 21 bp, Artificial Sequence
  Description of Artificial Sequence: Synthetic oligonucleotide
tcattgagttcaatatttttc

SEQ ID NO: 6751 - DNA, 21 bp, Artificial Sequence
  Description of Artificial Sequence: Synthetic oligonucleotide
aaatattgaactcaatgatag

SEQ ID NO: 6752 - DNA, 21 bp, Artificial Sequence
  Description of Artificial Sequence: Synthetic oligonucleotide
atcattgagttcaatattttt

SEQ ID NO: 6753 - DNA, 21 bp, Artificial Sequence
  Description of Artificial Sequence: Synthetic oligonucleotide
aatattgaactcaatgatagc

SEQ ID NO: 6754 - DNA, 21 bp, Artificial Sequence
  Description of Artificial Sequence: Synthetic oligonucleotide
tatcattgagttcaatatttt

SEQ ID NO: 6755 - DNA, 21 bp, Artificial Sequence
  Description of Artificial Sequence: Synthetic oligonucleotide
atattgaactcaatgatagca

SEQ ID NO: 6756 - DNA, 21 bp, Artificial Sequence
  Description of Artificial Sequence: Synthetic oligonucleotide
ctatcattgagttcaatattt

SEQ ID NO: 6757 - DNA, 21 bp, Artificial Sequence
  Description of Artificial Sequence: Synthetic oligonucleotide
tattgaactcaatgatagcac

SEQ ID NO: 6758 - DNA, 21 bp, Artificial Sequence
  Description of Artificial Sequence: Synthetic oligonucleotide
gctatcattgagttcaatatt

SEQ ID NO: 6759 - DNA, 21 bp, Artificial Sequence
  Description of Artificial Sequence: Synthetic oligonucleotide
attgaactcaatgatagcacc

SEQ ID NO: 6760 - DNA, 21 bp, Artificial Sequence
  Description of Artificial Sequence: Synthetic oligonucleotide
tgctatcattgagttcaatat

SEQ ID NO: 6761 - DNA, 21 bp, Artificial Sequence
  Description of Artificial Sequence: Synthetic oligonucleotide
ttgaactcaatgatagcacct

SEQ ID NO: 6762 - DNA, 21 bp, Artificial Sequence
  Description of Artificial Sequence: Synthetic oligonucleotide
gtgctatcattgagttcaata

SEQ ID NO: 6763 - DNA, 21 bp, Artificial Sequence
  Description of Artificial Sequence: Synthetic oligonucleotide
tgaactcaatgatagcaccta

SEQ ID NO: 6764 - DNA, 21 bp, Artificial Sequence
  Description of Artificial Sequence: Synthetic oligonucleotide
ggtgctatcattgagttcaat

SEQ ID NO: 6765 - DNA, 21 bp, Artificial Sequence
  Description of Artificial Sequence: Synthetic oligonucleotide
gaactcaatgatagcacctaa

SEQ ID NO: 6766 - DNA, 21 bp, Artificial Sequence
  Description of Artificial Sequence: Synthetic oligonucleotide
aggtgctatcattgagttcaa

SEQ ID NO: 6767 - DNA, 21 bp, Artificial Sequence
  Description of Artificial Sequence: Synthetic oligonucleotide
aactcaatgatagcacctaaa

SEQ ID NO: 6768 - DNA, 21 bp, Artificial Sequence
  Description of Artificial Sequence: Synthetic oligonucleotide
taggtgctatcattgagttca

SEQ ID NO: 6769 - DNA, 21 bp, Artificial Sequence
  Description of Artificial Sequence: Synthetic oligonucleotide
actcaatgatagcacctaaac

SEQ ID NO: 6770 - DNA, 21 bp, Artificial Sequence
  Description of Artificial Sequence: Synthetic oligonucleotide
ttaggtgctatcattgagttc

SEQ ID NO: 6771 - DNA, 21 bp, Artificial Sequence
  Description of Artificial Sequence: Synthetic oligonucleotide
ctcaatgatagcacctaaact

SEQ ID NO: 6772 - DNA, 21 bp, Artificial Sequence
  Description of Artificial Sequence: Synthetic oligonucleotide
tttaggtgctatcattgagtt

SEQ ID NO: 6773 - DNA, 21 bp, Artificial Sequence
  Description of Artificial Sequence: Synthetic oligonucleotide
tcaatgatagcacctaaactt

SEQ ID NO: 6774 - DNA, 21 bp, Artificial Sequence
  Description of Artificial Sequence: Synthetic oligonucleotide
gtttaggtgctatcattgagt

SEQ ID NO: 6775 - DNA, 21 bp, Artificial Sequence
  Description of Artificial Sequence: Synthetic oligonucleotide
caatgatagcacctaaactta

SEQ ID NO: 6776 - DNA, 21 bp, Artificial Sequence
  Description of Artificial Sequence: Synthetic oligonucleotide
agtttaggtgctatcattgag

SEQ ID NO: 6777 - DNA, 21 bp, Artificial Sequence
  Description of Artificial Sequence: Synthetic oligonucleotide
aatgatagcacctaaacttac

SEQ ID NO: 6778 - DNA, 21 bp, Artificial Sequence
  Description of Artificial Sequence: Synthetic oligonucleotide
aagtttaggtgctatcattga

SEQ ID NO: 6779 - DNA, 21 bp, Artificial Sequence
  Description of Artificial Sequence: Synthetic oligonucleotide
atgatagcacctaaacttaca

SEQ ID NO: 6780 - DNA, 21 bp, Artificial Sequence
  Description of Artificial Sequence: Synthetic oligonucleotide
taagtttaggtgctatcattg

SEQ ID NO: 6781 - DNA, 21 bp, Artificial Sequence
  Description of Artificial Sequence: Synthetic oligonucleotide
tgatagcacctaaacttacat

SEQ ID NO: 6782 - DNA, 21 bp, Artificial Sequence
  Description of Artificial Sequence: Synthetic oligonucleotide
gtaagtttaggtgctatcatt

SEQ ID NO: 6783 - DNA, 21 bp, Artificial Sequence
  Description of Artificial Sequence: Synthetic oligonucleotide
gatagcacctaaacttacatt

SEQ ID NO: 6784 - DNA, 21 bp, Artificial Sequence
  Description of Artificial Sequence: Synthetic oligonucleotide
tgtaagtttaggtgctatcat

SEQ ID NO: 6785 - DNA, 21 bp, Artificial Sequence
  Description of Artificial Sequence: Synthetic oligonucleotide
atagcacctaaacttacattt

SEQ ID NO: 6786 - DNA, 21 bp, Artificial Sequence
  Description of Artificial Sequence: Synthetic oligonucleotide
atgtaagtttaggtgctatca

SEQ ID NO: 6787 - DNA, 21 bp, Artificial Sequence
  Description of Artificial Sequence: Synthetic oligonucleotide
tagcacctaaacttacattta

SEQ ID NO: 6788 - DNA, 21 bp, Artificial Sequence
  Description of Artificial Sequence: Synthetic oligonucleotide
aatgtaagtttaggtgctatc

SEQ ID NO: 6789 - DNA, 21 bp, Artificial Sequence
  Description of Artificial Sequence: Synthetic oligonucleotide
agcacctaaacttacatttaa

SEQ ID NO: 6790 - DNA, 21 bp, Artificial Sequence
  Description of Artificial Sequence: Synthetic oligonucleotide
aaatgtaagtttaggtgctat

SEQ ID NO: 6791 - DNA, 21 bp, Artificial Sequence
  Description of Artificial Sequence: Synthetic oligonucleotide
gcacctaaacttacatttaaa

SEQ ID NO: 6792 - DNA, 21 bp, Artificial Sequence
  Description of Artificial Sequence: Synthetic oligonucleotide
taaatgtaagtttaggtgcta

SEQ ID NO: 6793 - DNA, 21 bp, Artificial Sequence
  Description of Artificial Sequence: Synthetic oligonucleotide
cacctaaacttacatttaaaa

SEQ ID NO: 6794 - DNA, 21 bp, Artificial Sequence
  Description of Artificial Sequence: Synthetic oligonucleotide
ttaaatgtaagtttaggtgct

SEQ ID NO: 6795 - DNA, 21 bp, Artificial Sequence
  Description of Artificial Sequence: Synthetic oligonucleotide
acctaaacttacatttaaaag

SEQ ID NO: 6796 - DNA, 21 bp, Artificial Sequence
  Description of Artificial Sequence: Synthetic oligonucleotide
tttaaatgtaagtttaggtgc

SEQ ID NO: 6797 - DNA, 21 bp, Artificial Sequence
  Description of Artificial Sequence: Synthetic oligonucleotide
cctaaacttacatttaaaaga

SEQ ID NO: 6798 - DNA, 21 bp, Artificial Sequence
  Description of Artificial Sequence: Synthetic oligonucleotide
ttttaaatgtaagtttaggtg

SEQ ID NO: 6799 - DNA, 21 bp, Artificial Sequence
  Description of Artificial Sequence: Synthetic oligonucleotide
ctaaacttacatttaaaagac

SEQ ID NO: 6800 - DNA, 21 bp, Artificial Sequence
  Description of Artificial Sequence: Synthetic oligonucleotide
cttttaaatgtaagtttaggt

SEQ ID NO: 6801 - DNA, 21 bp, Artificial Sequence
  Description of Artificial Sequence: Synthetic oligonucleotide
taaacttacatttaaaagaca

SEQ ID NO: 6802 - DNA, 21 bp, Artificial Sequence
  Description of Artificial Sequence: Synthetic oligonucleotide
tcttttaaatgtaagtttagg

SEQ ID NO: 6803 - DNA, 21 bp, Artificial Sequence
  Description of Artificial Sequence: Synthetic oligonucleotide
aaacttacatttaaaagacag

SEQ ID NO: 6804 - DNA, 21 bp, Artificial Sequence
  Description of Artificial Sequence: Synthetic oligonucleotide
gtcttttaaatgtaagtttag

SEQ ID NO: 6805 - DNA, 21 bp, Artificial Sequence
  Description of Artificial Sequence: Synthetic oligonucleotide
aacttacatttaaaagacaga

SEQ ID NO: 6806 - DNA, 21 bp, Artificial Sequence
  Description of Artificial Sequence: Synthetic oligonucleotide
tgtcttttaaatgtaagttta

SEQ ID NO: 6807 - DNA, 21 bp, Artificial Sequence
  Description of Artificial Sequence: Synthetic oligonucleotide
acttacatttaaaagacagac

SEQ ID NO: 6808 - DNA, 21 bp, Artificial Sequence
  Description of Artificial Sequence: Synthetic oligonucleotide
ctgtcttttaaatgtaagttt

SEQ ID NO: 6809 - DNA, 21 bp, Artificial Sequence
  Description of Artificial Sequence: Synthetic oligonucleotide
cttacatttaaaagacagaca

SEQ ID NO: 6810 - DNA, 21 bp, Artificial Sequence
  Description of Artificial Sequence: Synthetic oligonucleotide
tctgtcttttaaatgtaagtt

SEQ ID NO: 6811 - DNA, 21 bp, Artificial Sequence
  Description of Artificial Sequence: Synthetic oligonucleotide
ttacatttaaaagacagacat

SEQ ID NO: 6812 - DNA, 21 bp, Artificial Sequence
  Description of Artificial Sequence: Synthetic oligonucleotide
gtctgtcttttaaatgtaagt

SEQ ID NO: 6813 - DNA, 21 bp, Artificial Sequence
  Description of Artificial Sequence: Synthetic oligonucleotide
tacatttaaaagacagacatt

SEQ ID NO: 6814 - DNA, 21 bp, Artificial Sequence
  Description of Artificial Sequence: Synthetic oligonucleotide
tgtctgtcttttaaatgtaag

SEQ ID NO: 6815 - DNA, 21 bp, Artificial Sequence
  Description of Artificial Sequence: Synthetic oligonucleotide
acatttaaaagacagacattc

SEQ ID NO: 6816 - DNA, 21 bp, Artificial Sequence
  Description of Artificial Sequence: Synthetic oligonucleotide
atgtctgtcttttaaatgtaa

SEQ ID NO: 6817 - DNA, 21 bp, Artificial Sequence
  Description of Artificial Sequence: Synthetic oligonucleotide
catttaaaagacagacattcc

SEQ ID NO: 6818 - DNA, 21 bp, Artificial Sequence
  Description of Artificial Sequence: Synthetic oligonucleotide
aatgtctgtcttttaaatgta

SEQ ID NO: 6819 - DNA, 21 bp, Artificial Sequence
  Description of Artificial Sequence: Synthetic oligonucleotide
atttaaaagacagacattcct

SEQ ID NO: 6820 - DNA, 21 bp, Artificial Sequence
  Description of Artificial Sequence: Synthetic oligonucleotide
gaatgtctgtcttttaaatgt

SEQ ID NO: 6821 - DNA, 21 bp, Artificial Sequence
  Description of Artificial Sequence: Synthetic oligonucleotide
tttaaaagacagacattcctt

SEQ ID NO: 6822 - DNA, 21 bp, Artificial Sequence
  Description of Artificial Sequence: Synthetic oligonucleotide
ggaatgtctgtcttttaaatg

SEQ ID NO: 6823 - DNA, 21 bp, Artificial Sequence
  Description of Artificial Sequence: Synthetic oligonucleotide
ttaaaagacagacattccttc

SEQ ID NO: 6824 - DNA, 21 bp, Artificial Sequence
  Description of Artificial Sequence: Synthetic oligonucleotide
aggaatgtctgtcttttaaat

SEQ ID NO: 6825 - DNA, 21 bp, Artificial Sequence
  Description of Artificial Sequence: Synthetic oligonucleotide
taaaagacagacattccttct

SEQ ID NO: 6826 - DNA, 21 bp, Artificial Sequence
  Description of Artificial Sequence: Synthetic oligonucleotide
aaggaatgtctgtcttttaaa

SEQ ID NO: 6827 - DNA, 21 bp, Artificial Sequence
  Description of Artificial Sequence: Synthetic oligonucleotide
aaaagacagacattccttcta

SEQ ID NO: 6828 - DNA, 21 bp, Artificial Sequence
  Description of Artificial Sequence: Synthetic oligonucleotide
gaaggaatgtctgtcttttaa

SEQ ID NO: 6829 - DNA, 21 bp, Artificial Sequence
  Description of Artificial Sequence: Synthetic oligonucleotide
aaagacagacattccttctac

SEQ ID NO: 6830 - DNA, 21 bp, Artificial Sequence
  Description of Artificial Sequence: Synthetic oligonucleotide
agaaggaatgtctgtctttta

SEQ ID NO: 6831 - DNA, 21 bp, Artificial Sequence
  Description of Artificial Sequence: Synthetic oligonucleotide
aagacagacattccttctaca

SEQ ID NO: 6832 - DNA, 21 bp, Artificial Sequence
  Description of Artificial Sequence: Synthetic oligonucleotide
tagaaggaatgtctgtctttt

SEQ ID NO: 6833 - DNA, 21 bp, Artificial Sequence
  Description of Artificial Sequence: Synthetic oligonucleotide
agacagacattccttctacat

SEQ ID NO: 6834 - DNA, 21 bp, Artificial Sequence
  Description of Artificial Sequence: Synthetic oligonucleotide
gtagaaggaatgtctgtcttt

SEQ ID NO: 6835 - DNA, 21 bp, Artificial Sequence
  Description of Artificial Sequence: Synthetic oligonucleotide
gacagacattccttctacatg

SEQ ID NO: 6836 - DNA, 21 bp, Artificial Sequence
  Description of Artificial Sequence: Synthetic oligonucleotide
tgtagaaggaatgtctgtctt

SEQ ID NO: 6837 - DNA, 21 bp, Artificial Sequence
  Description of Artificial Sequence: Synthetic oligonucleotide
acagacattccttctacatgt

SEQ ID NO: 6838 - DNA, 21 bp, Artificial Sequence
  Description of Artificial Sequence: Synthetic oligonucleotide
atgtagaaggaatgtctgtct

SEQ ID NO: 6839 - DNA, 21 bp, Artificial Sequence
  Description of Artificial Sequence: Synthetic oligonucleotide
cagacattccttctacatgta

SEQ ID NO: 6840 - DNA, 21 bp, Artificial Sequence
  Description of Artificial Sequence: Synthetic oligonucleotide
catgtagaaggaatgtctgtc

SEQ ID NO: 6841 - DNA, 21 bp, Artificial Sequence
  Description of Artificial Sequence: Synthetic oligonucleotide
agacattccttctacatgtaa

SEQ ID NO: 6842 - DNA, 21 bp, Artificial Sequence
  Description of Artificial Sequence: Synthetic oligonucleotide
acatgtagaaggaatgtctgt

SEQ ID NO: 6843 - DNA, 21 bp, Artificial Sequence
  Description of Artificial Sequence: Synthetic oligonucleotide
gacattccttctacatgtaat

SEQ ID NO: 6844 - DNA, 21 bp, Artificial Sequence
  Description of Artificial Sequence: Synthetic oligonucleotide
tacatgtagaaggaatgtctg

SEQ ID NO: 6845 - DNA, 21 bp, Artificial Sequence
  Description of Artificial Sequence: Synthetic oligonucleotide
acattccttctacatgtaatg

SEQ ID NO: 6846 - DNA, 21 bp, Artificial Sequence
  Description of Artificial Sequence: Synthetic oligonucleotide
ttacatgtagaaggaatgtct

SEQ ID NO: 6847 - DNA, 21 bp, Artificial Sequence
  Description of Artificial Sequence: Synthetic oligonucleotide
cattccttctacatgtaatga

SEQ ID NO: 6848 - DNA, 21 bp, Artificial Sequence
  Description of Artificial Sequence: Synthetic oligonucleotide
attacatgtagaaggaatgtc

SEQ ID NO: 6849 - DNA, 21 bp, Artificial Sequence
  Description of Artificial Sequence: Synthetic oligonucleotide
attccttctacatgtaatgac

SEQ ID NO: 6850 - DNA, 21 bp, Artificial Sequence
  Description of Artificial Sequence: Synthetic oligonucleotide
cattacatgtagaaggaatgt

SEQ ID NO: 6851 - DNA, 21 bp, Artificial Sequence
  Description of Artificial Sequence: Synthetic oligonucleotide
ttccttctacatgtaatgaca

SEQ ID NO: 6852 - DNA, 21 bp, Artificial Sequence
  Description of Artificial Sequence: Synthetic oligonucleotide
tcattacatgtagaaggaatg

SEQ ID NO: 6853 - DNA, 21 bp, Artificial Sequence
  Description of Artificial Sequence: Synthetic oligonucleotide
tccttctacatgtaatgacac

SEQ ID NO: 6854 - DNA, 21 bp, Artificial Sequence
  Description of Artificial Sequence: Synthetic oligonucleotide
gtcattacatgtagaaggaat

SEQ ID NO: 6855 - DNA, 21 bp, Artificial Sequence
  Description of Artificial Sequence: Synthetic oligonucleotide
ccttctacatgtaatgacact

SEQ ID NO: 6856 - DNA, 21 bp, Artificial Sequence
  Description of Artificial Sequence: Synthetic oligonucleotide
tgtcattacatgtagaaggaa

SEQ ID NO: 6857 - DNA, 21 bp, Artificial Sequence
  Description of Artificial Sequence: Synthetic oligonucleotide
cttctacatgtaatgacactt

SEQ ID NO: 6858 - DNA, 21 bp, Artificial Sequence
  Description of Artificial Sequence: Synthetic oligonucleotide
gtgtcattacatgtagaagga

SEQ ID NO: 6859 - DNA, 21 bp, Artificial Sequence
  Description of Artificial Sequence: Synthetic oligonucleotide
ttctacatgtaatgacacttc

SEQ ID NO: 6860 - DNA, 21 bp, Artificial Sequence
  Description of Artificial Sequence: Synthetic oligonucleotide
agtgtcattacatgtagaagg

SEQ ID NO: 6861 - DNA, 21 bp, Artificial Sequence
  Description of Artificial Sequence: Synthetic oligonucleotide
tctacatgtaatgacacttct

SEQ ID NO: 6862 - DNA, 21 bp, Artificial Sequence
  Description of Artificial Sequence: Synthetic oligonucleotide
aagtgtcattacatgtagaag

SEQ ID NO: 6863 - DNA, 21 bp, Artificial Sequence
  Description of Artificial Sequence: Synthetic oligonucleotide
ctacatgtaatgacacttctt

SEQ ID NO: 6864 - DNA, 21 bp, Artificial Sequence
  Description of Artificial Sequence: Synthetic oligonucleotide
gaagtgtcattacatgtagaa

SEQ ID NO: 6865 - DNA, 21 bp, Artificial Sequence
  Description of Artificial Sequence: Synthetic oligonucleotide
tacatgtaatgacacttcttg

SEQ ID NO: 6866 - DNA, 21 bp, Artificial Sequence
  Description of Artificial Sequence: Synthetic oligonucleotide
agaagtgtcattacatgtaga

SEQ ID NO: 6867 - DNA, 21 bp, Artificial Sequence
  Description of Artificial Sequence: Synthetic oligonucleotide
acatgtaatgacacttcttgt

SEQ ID NO: 6868 - DNA, 21 bp, Artificial Sequence
  Description of Artificial Sequence: Synthetic oligonucleotide
aagaagtgtcattacatgtag

SEQ ID NO: 6869 - DNA, 21 bp, Artificial Sequence
  Description of Artificial Sequence: Synthetic oligonucleotide
catgtaatgacacttcttgtg

SEQ ID NO: 6870 - DNA, 21 bp, Artificial Sequence
  Description of Artificial Sequence: Synthetic oligonucleotide
caagaagtgtcattacatgta

SEQ ID NO: 6871 - DNA, 21 bp, Artificial Sequence
  Description of Artificial Sequence: Synthetic oligonucleotide
atgtaatgacacttcttgtgt

SEQ ID NO: 6872 - DNA, 21 bp, Artificial Sequence
  Description of Artificial Sequence: Synthetic oligonucleotide
acaagaagtgtcattacatgt

SEQ ID NO: 6873 - DNA, 21 bp, Artificial Sequence
  Description of Artificial Sequence: Synthetic oligonucleotide
tgtaatgacacttcttgtgtt

SEQ ID NO: 6874 - DNA, 21 bp, Artificial Sequence
  Description of Artificial Sequence: Synthetic oligonucleotide
cacaagaagtgtcattacatg

SEQ ID NO: 6875 - DNA, 21 bp, Artificial Sequence
  Description of Artificial Sequence: Synthetic oligonucleotide
gtaatgacacttcttgtgtta

SEQ ID NO: 6876 - DNA, 21 bp, Artificial Sequence
  Description of Artificial Sequence: Synthetic oligonucleotide
acacaagaagtgtcattacat

SEQ ID NO: 6877 - DNA, 21 bp, Artificial Sequence
  Description of Artificial Sequence: Synthetic oligonucleotide
taatgacacttcttgtgttaa

SEQ ID NO: 6878 - DNA, 21 bp, Artificial Sequence
  Description of Artificial Sequence: Synthetic oligonucleotide
aacacaagaagtgtcattaca

SEQ ID NO: 6879 - DNA, 21 bp, Artificial Sequence
  Description of Artificial Sequence: Synthetic oligonucleotide
aatgacacttcttgtgttaaa

SEQ ID NO: 6880 - DNA, 21 bp, Artificial Sequence
  Description of Artificial Sequence: Synthetic oligonucleotide
taacacaagaagtgtcattac

SEQ ID NO: 6881 - DNA, 21 bp, Artificial Sequence
  Description of Artificial Sequence: Synthetic oligonucleotide
atgacacttcttgtgttaaac

SEQ ID NO: 6882 - DNA, 21 bp, Artificial Sequence
  Description of Artificial Sequence: Synthetic oligonucleotide
ttaacacaagaagtgtcatta

SEQ ID NO: 6883 - DNA, 21 bp, Artificial Sequence
  Description of Artificial Sequence: Synthetic oligonucleotide
tgacacttcttgtgttaaact

SEQ ID NO: 6884 - DNA, 21 bp, Artificial Sequence
  Description of Artificial Sequence: Synthetic oligonucleotide
tttaacacaagaagtgtcatt

SEQ ID NO: 6885 - DNA, 21 bp, Artificial Sequence
  Description of Artificial Sequence: Synthetic oligonucleotide
gacacttcttgtgttaaacta

SEQ ID NO: 6886 - DNA, 21 bp, Artificial Sequence
  Description of Artificial Sequence: Synthetic oligonucleotide
gtttaacacaagaagtgtcat

SEQ ID NO: 6887 - DNA, 21 bp, Artificial Sequence
  Description of Artificial Sequence: Synthetic oligonucleotide
acacttcttgtgttaaactaa

SEQ ID NO: 6888 - DNA, 21 bp, Artificial Sequence
  Description of Artificial Sequence: Synthetic oligonucleotide
agtttaacacaagaagtgtca

SEQ ID NO: 6889 - DNA, 21 bp, Artificial Sequence
  Description of Artificial Sequence: Synthetic oligonucleotide
cacttcttgtgttaaactaaa

SEQ ID NO: 6890 - DNA, 21 bp, Artificial Sequence
  Description of Artificial Sequence: Synthetic oligonucleotide
tagtttaacacaagaagtgtc

SEQ ID NO: 6891 - DNA, 21 bp, Artificial Sequence
  Description of Artificial Sequence: Synthetic oligonucleotide
acttcttgtgttaaactaaaa

SEQ ID NO: 6892 - DNA, 21 bp, Artificial Sequence
  Description of Artificial Sequence: Synthetic oligonucleotide
ttagtttaacacaagaagtgt

SEQ ID NO: 6893 - DNA, 21 bp, Artificial Sequence
  Description of Artificial Sequence: Synthetic oligonucleotide
cttcttgtgttaaactaaaaa

SEQ ID NO: 6894 - DNA, 21 bp, Artificial Sequence
  Description of Artificial Sequence: Synthetic oligonucleotide
tttagtttaacacaagaagtg

SEQ ID NO: 6895 - DNA, 21 bp, Artificial Sequence
  Description of Artificial Sequence: Synthetic oligonucleotide
ttcttgtgttaaactaaaaat

SEQ ID NO: 6896 - DNA, 21 bp, Artificial Sequence
  Description of Artificial Sequence: Synthetic oligonucleotide
ttttagtttaacacaagaagt

SEQ ID NO: 6897 - DNA, 21 bp, Artificial Sequence
  Description of Artificial Sequence: Synthetic oligonucleotide
tcttgtgttaaactaaaaatt

SEQ ID NO: 6898 - DNA, 21 bp, Artificial Sequence
  Description of Artificial Sequence: Synthetic oligonucleotide
tttttagtttaacacaagaag

SEQ ID NO: 6899 - DNA, 21 bp, Artificial Sequence
  Description of Artificial Sequence: Synthetic oligonucleotide
cttgtgttaaactaaaaattt

SEQ ID NO: 6900 - DNA, 21 bp, Artificial Sequence
  Description of Artificial Sequence: Synthetic oligonucleotide
atttttagtttaacacaagaa

SEQ ID NO: 6901 - DNA, 21 bp, Artificial Sequence
  Description of Artificial Sequence: Synthetic oligonucleotide
ttgtgttaaactaaaaattta

SEQ ID NO: 6902 - DNA, 21 bp, Artificial Sequence
  Description of Artificial Sequence: Synthetic oligonucleotide
aatttttagtttaacacaaga

SEQ ID NO: 6903 - DNA, 21 bp, Artificial Sequence
  Description of Artificial Sequence: Synthetic oligonucleotide
tgtgttaaactaaaaatttac

SEQ ID NO: 6904 - DNA, 21 bp, Artificial Sequence
  Description of Artificial Sequence: Synthetic oligonucleotide
aaatttttagtttaacacaag

SEQ ID NO: 6905 - DNA, 21 bp, Artificial Sequence
  Description of Artificial Sequence: Synthetic oligonucleotide
gtgttaaactaaaaatttaca

SEQ ID NO: 6906 - DNA, 21 bp, Artificial Sequence
  Description of Artificial Sequence: Synthetic oligonucleotide
taaatttttagtttaacacaa

SEQ ID NO: 6907 - DNA, 21 bp, Artificial Sequence
  Description of Artificial Sequence: Synthetic oligonucleotide
tgttaaactaaaaatttacaa

SEQ ID NO: 6908 - DNA, 21 bp, Artificial Sequence
  Description of Artificial Sequence: Synthetic oligonucleotide
gtaaatttttagtttaacaca

SEQ ID NO: 6909 - DNA, 21 bp, Artificial Sequence
  Description of Artificial Sequence: Synthetic oligonucleotide
gttaaactaaaaatttacaag

SEQ ID NO: 6910 - DNA, 21 bp, Artificial Sequence
  Description of Artificial Sequence: Synthetic oligonucleotide
tgtaaatttttagtttaacac

SEQ ID NO: 6911 - DNA, 21 bp, Artificial Sequence
  Description of Artificial Sequence: Synthetic oligonucleotide
ttaaactaaaaatttacaaga

SEQ ID NO: 6912 - DNA, 21 bp, Artificial Sequence
  Description of Artificial Sequence: Synthetic oligonucleotide
ttgtaaatttttagtttaaca

SEQ ID NO: 6913 - DNA, 21 bp, Artificial Sequence
  Description of Artificial Sequence: Synthetic oligonucleotide
taaactaaaaatttacaagag

SEQ ID NO: 6914 - DNA, 21 bp, Artificial Sequence
  Description of Artificial Sequence: Synthetic oligonucleotide
cttgtaaatttttagtttaac

SEQ ID NO: 6915 - DNA, 21 bp, Artificial Sequence
  Description of Artificial Sequence: Synthetic oligonucleotide
aaactaaaaatttacaagaga

SEQ ID NO: 6916 - DNA, 21 bp, Artificial Sequence
  Description of Artificial Sequence: Synthetic oligonucleotide
tcttgtaaatttttagtttaa

SEQ ID NO: 6917 - DNA, 21 bp, Artificial Sequence
  Description of Artificial Sequence: Synthetic oligonucleotide
aactaaaaatttacaagagaa

SEQ ID NO: 6918 - DNA, 21 bp, Artificial Sequence
  Description of Artificial Sequence: Synthetic oligonucleotide
ctcttgtaaatttttagttta

SEQ ID NO: 6919 - DNA, 21 bp, Artificial Sequence
  Description of Artificial Sequence: Synthetic oligonucleotide
actaaaaatttacaagagaag

SEQ ID NO: 6920 - DNA, 21 bp, Artificial Sequence
  Description of Artificial Sequence: Synthetic oligonucleotide
tctcttgtaaatttttagttt

SEQ ID NO: 6921 - DNA, 21 bp, Artificial Sequence
  Description of Artificial Sequence: Synthetic oligonucleotide
ctaaaaatttacaagagaaga

SEQ ID NO: 6922 - DNA, 21 bp, Artificial Sequence
  Description of Artificial Sequence: Synthetic oligonucleotide
ttctcttgtaaatttttagtt

SEQ ID NO: 6923 - DNA, 21 bp, Artificial Sequence
  Description of Artificial Sequence: Synthetic oligonucleotide
taaaaatttacaagagaagaa

SEQ ID NO: 6924 - DNA, 21 bp, Artificial Sequence
  Description of Artificial Sequence: Synthetic oligonucleotide
cttctcttgtaaatttttagt

SEQ ID NO: 6925 - DNA, 21 bp, Artificial Sequence
  Description of Artificial Sequence: Synthetic oligonucleotide
aaaaatttacaagagaagaaa

SEQ ID NO: 6926 - DNA, 21 bp, Artificial Sequence
  Description of Artificial Sequence: Synthetic oligonucleotide
tcttctcttgtaaatttttag

SEQ ID NO: 6927 - DNA, 21 bp, Artificial Sequence
  Description of Artificial Sequence: Synthetic oligonucleotide
aaaatttacaagagaagaaag

SEQ ID NO: 6928 - DNA, 21 bp, Artificial Sequence
  Description of Artificial Sequence: Synthetic oligonucleotide
ttcttctcttgtaaattttta

SEQ ID NO: 6929 - DNA, 21 bp, Artificial Sequence
  Description of Artificial Sequence: Synthetic oligonucleotide
aaatttacaagagaagaaagt

SEQ ID NO: 6930 - DNA, 21 bp, Artificial Sequence
  Description of Artificial Sequence: Synthetic oligonucleotide
tttcttctcttgtaaattttt

SEQ ID NO: 6931 - DNA, 21 bp, Artificial Sequence
  Description of Artificial Sequence: Synthetic oligonucleotide
aatttacaagagaagaaagtg

SEQ ID NO: 6932 - DNA, 21 bp, Artificial Sequence
  Description of Artificial Sequence: Synthetic oligonucleotide
ctttcttctcttgtaaatttt

SEQ ID NO: 6933 - DNA, 21 bp, Artificial Sequence
  Description of Artificial Sequence: Synthetic oligonucleotide
atttacaagagaagaaagtga

SEQ ID NO: 6934 - DNA, 21 bp, Artificial Sequence
  Description of Artificial Sequence: Synthetic oligonucleotide
actttcttctcttgtaaattt

SEQ ID NO: 6935 - DNA, 21 bp, Artificial Sequence
  Description of Artificial Sequence: Synthetic oligonucleotide
tttacaagagaagaaagtgaa

SEQ ID NO: 6936 - DNA, 21 bp, Artificial Sequence
  Description of Artificial Sequence: Synthetic oligonucleotide
cactttcttctcttgtaaatt

SEQ ID NO: 6937 - DNA, 21 bp, Artificial Sequence
  Description of Artificial Sequence: Synthetic oligonucleotide
ttacaagagaagaaagtgaaa

SEQ ID NO: 6938 - DNA, 21 bp, Artificial Sequence
  Description of Artificial Sequence: Synthetic oligonucleotide
tcactttcttctcttgtaaat

SEQ ID NO: 6939 - DNA, 21 bp, Artificial Sequence
  Description of Artificial Sequence: Synthetic oligonucleotide
tacaagagaagaaagtgaaag

SEQ ID NO: 6940 - DNA, 21 bp, Artificial Sequence
  Description of Artificial Sequence: Synthetic oligonucleotide
ttcactttcttctcttgtaaa

SEQ ID NO: 6941 - DNA, 21 bp, Artificial Sequence
  Description of Artificial Sequence: Synthetic oligonucleotide
acaagagaagaaagtgaaagc

SEQ ID NO: 6942 - DNA, 21 bp, Artificial Sequence
  Description of Artificial Sequence: Synthetic oligonucleotide
tttcactttcttctcttgtaa

SEQ ID NO: 6943 - DNA, 21 bp, Artificial Sequence
  Description of Artificial Sequence: Synthetic oligonucleotide
caagagaagaaagtgaaagca

SEQ ID NO: 6944 - DNA, 21 bp, Artificial Sequence
  Description of Artificial Sequence: Synthetic oligonucleotide
ctttcactttcttctcttgta

SEQ ID NO: 6945 - DNA, 21 bp, Artificial Sequence
  Description of Artificial Sequence: Synthetic oligonucleotide
aagagaagaaagtgaaagcaa

SEQ ID NO: 6946 - DNA, 21 bp, Artificial Sequence
  Description of Artificial Sequence: Synthetic oligonucleotide
gctttcactttcttctcttgt

SEQ ID NO: 6947 - DNA, 21 bp, Artificial Sequence
  Description of Artificial Sequence: Synthetic oligonucleotide
agagaagaaagtgaaagcaaa

SEQ ID NO: 6948 - DNA, 21 bp, Artificial Sequence
  Description of Artificial Sequence: Synthetic oligonucleotide
tgctttcactttcttctcttg

SEQ ID NO: 6949 - DNA, 21 bp, Artificial Sequence
  Description of Artificial Sequence: Synthetic oligonucleotide
gagaagaaagtgaaagcaaat

SEQ ID NO: 6950 - DNA, 21 bp, Artificial Sequence
  Description of Artificial Sequence: Synthetic oligonucleotide
ttgctttcactttcttctctt

SEQ ID NO: 6951 - DNA, 21 bp, Artificial Sequence
  Description of Artificial Sequence: Synthetic oligonucleotide
agaagaaagtgaaagcaaatg

SEQ ID NO: 6952 - DNA, 21 bp, Artificial Sequence
  Description of Artificial Sequence: Synthetic oligonucleotide
tttgctttcactttcttctct

SEQ ID NO: 6953 - DNA, 21 bp, Artificial Sequence
  Description of Artificial Sequence: Synthetic oligonucleotide
gaagaaagtgaaagcaaatgg

SEQ ID NO: 6954 - DNA, 21 bp, Artificial Sequence
  Description of Artificial Sequence: Synthetic oligonucleotide
atttgctttcactttcttctc

SEQ ID NO: 6955 - DNA, 21 bp, Artificial Sequence
  Description of Artificial Sequence: Synthetic oligonucleotide
aagaaagtgaaagcaaatggg

SEQ ID NO: 6956 - DNA, 21 bp, Artificial Sequence
  Description of Artificial Sequence: Synthetic oligonucleotide
catttgctttcactttcttct

SEQ ID NO: 6957 - DNA, 21 bp, Artificial Sequence
  Description of Artificial Sequence: Synthetic oligonucleotide
agaaagtgaaagcaaatgggg

SEQ ID NO: 6958 - DNA, 21 bp, Artificial Sequence
  Description of Artificial Sequence: Synthetic oligonucleotide
ccatttgctttcactttcttc

SEQ ID NO: 6959 - DNA, 21 bp, Artificial Sequence
  Description of Artificial Sequence: Synthetic oligonucleotide
gaaagtgaaagcaaatggggt

SEQ ID NO: 6960 - DNA, 21 bp, Artificial Sequence
  Description of Artificial Sequence: Synthetic oligonucleotide
cccatttgctttcactttctt

SEQ ID NO: 6961 - DNA, 21 bp, Artificial Sequence
  Description of Artificial Sequence: Synthetic oligonucleotide
aaagtgaaagcaaatggggtt

SEQ ID NO: 6962 - DNA, 21 bp, Artificial Sequence
  Description of Artificial Sequence: Synthetic oligonucleotide
ccccatttgctttcactttct

SEQ ID NO: 6963 - DNA, 21 bp, Artificial Sequence
  Description of Artificial Sequence: Synthetic oligonucleotide
aagtgaaagcaaatggggttt

SEQ ID NO: 6964 - DNA, 21 bp, Artificial Sequence
  Description of Artificial Sequence: Synthetic oligonucleotide
accccatttgctttcactttc

SEQ ID NO: 6965 - DNA, 21 bp, Artificial Sequence
  Description of Artificial Sequence: Synthetic oligonucleotide
agtgaaagcaaatggggtttc

SEQ ID NO: 6966 - DNA, 21 bp, Artificial Sequence
  Description of Artificial Sequence: Synthetic oligonucleotide
aaccccatttgctttcacttt

SEQ ID NO: 6967 - DNA, 21 bp, Artificial Sequence
  Description of Artificial Sequence: Synthetic oligonucleotide
gtgaaagcaaatggggtttca

SEQ ID NO: 6968 - DNA, 21 bp, Artificial Sequence
  Description of Artificial Sequence: Synthetic oligonucleotide
aaaccccatttgctttcactt

SEQ ID NO: 6969 - DNA, 21 bp, Artificial Sequence
  Description of Artificial Sequence: Synthetic oligonucleotide
tgaaagcaaatggggtttcac

SEQ ID NO: 6970 - DNA, 21 bp, Artificial Sequence
  Description of Artificial Sequence: Synthetic oligonucleotide
gaaaccccatttgctttcact

SEQ ID NO: 6971 - DNA, 21 bp, Artificial Sequence
  Description of Artificial Sequence: Synthetic oligonucleotide
gaaagcaaatggggtttcaca

SEQ ID NO: 6972 - DNA, 21 bp, Artificial Sequence
  Description of Artificial Sequence: Synthetic oligonucleotide
tgaaaccccatttgctttcac

SEQ ID NO: 6973 - DNA, 21 bp, Artificial Sequence
  Description of Artificial Sequence: Synthetic oligonucleotide
aaagcaaatggggtttcacaa

SEQ ID NO: 6974 - DNA, 21 bp, Artificial Sequence
  Description of Artificial Sequence: Synthetic oligonucleotide
gtgaaaccccatttgctttca

SEQ ID NO: 6975 - DNA, 21 bp, Artificial Sequence
  Description of Artificial Sequence: Synthetic oligonucleotide
aagcaaatggggtttcacaaa

SEQ ID NO: 6976 - DNA, 21 bp, Artificial Sequence
  Description of Artificial Sequence: Synthetic oligonucleotide
tgtgaaaccccatttgctttc

SEQ ID NO: 6977 - DNA, 21 bp, Artificial Sequence
  Description of Artificial Sequence: Synthetic oligonucleotide
agcaaatggggtttcacaaat

SEQ ID NO: 6978 - DNA, 21 bp, Artificial Sequence
  Description of Artificial Sequence: Synthetic oligonucleotide
ttgtgaaaccccatttgcttt

SEQ ID NO: 6979 - DNA, 21 bp, Artificial Sequence
  Description of Artificial Sequence: Synthetic oligonucleotide
gcaaatggggtttcacaaata

SEQ ID NO: 6980 - DNA, 21 bp, Artificial Sequence
  Description of Artificial Sequence: Synthetic oligonucleotide
tttgtgaaaccccatttgctt

SEQ ID NO: 6981 - DNA, 21 bp, Artificial Sequence
  Description of Artificial Sequence: Synthetic oligonucleotide
caaatggggtttcacaaatag

SEQ ID NO: 6982 - DNA, 21 bp, Artificial Sequence
  Description of Artificial Sequence: Synthetic oligonucleotide
atttgtgaaaccccatttgct

SEQ ID NO: 6983 - DNA, 21 bp, Artificial Sequence
  Description of Artificial Sequence: Synthetic oligonucleotide
aaatggggtttcacaaatagt

SEQ ID NO: 6984 - DNA, 21 bp, Artificial Sequence
  Description of Artificial Sequence: Synthetic oligonucleotide
tatttgtgaaaccccatttgc

SEQ ID NO: 6985 - DNA, 21 bp, Artificial Sequence
  Description of Artificial Sequence: Synthetic oligonucleotide
aatggggtttcacaaatagtt

SEQ ID NO: 6986 - DNA, 21 bp, Artificial Sequence
  Description of Artificial Sequence: Synthetic oligonucleotide
ctatttgtgaaaccccatttg

SEQ ID NO: 6987 - DNA, 21 bp, Artificial Sequence
  Description of Artificial Sequence: Synthetic oligonucleotide
atggggtttcacaaatagttg

SEQ ID NO: 6988 - DNA, 21 bp, Artificial Sequence
  Description of Artificial Sequence: Synthetic oligonucleotide
actatttgtgaaaccccattt

SEQ ID NO: 6989 - DNA, 21 bp, Artificial Sequence
  Description of Artificial Sequence: Synthetic oligonucleotide
tggggtttcacaaatagttgt

SEQ ID NO: 6990 - DNA, 21 bp, Artificial Sequence
  Description of Artificial Sequence: Synthetic oligonucleotide
aactatttgtgaaaccccatt

SEQ ID NO: 6991 - DNA, 21 bp, Artificial Sequence
  Description of Artificial Sequence: Synthetic oligonucleotide
ggggtttcacaaatagttgta

SEQ ID NO: 6992 - DNA, 21 bp, Artificial Sequence
  Description of Artificial Sequence: Synthetic oligonucleotide
caactatttgtgaaaccccat

SEQ ID NO: 6993 - DNA, 21 bp, Artificial Sequence
  Description of Artificial Sequence: Synthetic oligonucleotide
gggtttcacaaatagttgtaa

SEQ ID NO: 6994 - DNA, 21 bp, Artificial Sequence
  Description of Artificial Sequence: Synthetic oligonucleotide
acaactatttgtgaaacccca

SEQ ID NO: 6995 - DNA, 21 bp, Artificial Sequence
  Description of Artificial Sequence: Synthetic oligonucleotide
ggtttcacaaatagttgtaaa

SEQ ID NO: 6996 - DNA, 21 bp, Artificial Sequence
  Description of Artificial Sequence: Synthetic oligonucleotide
tacaactatttgtgaaacccc

SEQ ID NO: 6997 - DNA, 21 bp, Artificial Sequence
  Description of Artificial Sequence: Synthetic oligonucleotide
gtttcacaaatagttgtaaat

SEQ ID NO: 6998 - DNA, 21 bp, Artificial Sequence
  Description of Artificial Sequence: Synthetic oligonucleotide
ttacaactatttgtgaaaccc

SEQ ID NO: 6999 - DNA, 21 bp, Artificial Sequence
  Description of Artificial Sequence: Synthetic oligonucleotide
tttcacaaatagttgtaaata

SEQ ID NO: 7000 - DNA, 21 bp, Artificial Sequence
  Description of Artificial Sequence: Synthetic oligonucleotide
tttacaactatttgtgaaacc

SEQ ID NO: 7001 - DNA, 21 bp, Artificial Sequence
  Description of Artificial Sequence: Synthetic oligonucleotide
ttcacaaatagttgtaaatat

SEQ ID NO: 7002 - DNA, 21 bp, Artificial Sequence
  Description of Artificial Sequence: Synthetic oligonucleotide
atttacaactatttgtgaaac

SEQ ID NO: 7003 - DNA, 21 bp, Artificial Sequence
  Description of Artificial Sequence: Synthetic oligonucleotide
tcacaaatagttgtaaatata

SEQ ID NO: 7004 - DNA, 21 bp, Artificial Sequence
  Description of Artificial Sequence: Synthetic oligonucleotide
tatttacaactatttgtgaaa

SEQ ID NO: 7005 - DNA, 21 bp, Artificial Sequence
  Description of Artificial Sequence: Synthetic oligonucleotide
cacaaatagttgtaaatatag

SEQ ID NO: 7006 - DNA, 21 bp, Artificial Sequence
  Description of Artificial Sequence: Synthetic oligonucleotide
atatttacaactatttgtgaa

SEQ ID NO: 7007 - DNA, 21 bp, Artificial Sequence
  Description of Artificial Sequence: Synthetic oligonucleotide
acaaatagttgtaaatatagt

SEQ ID NO: 7008 - DNA, 21 bp, Artificial Sequence
  Description of Artificial Sequence: Synthetic oligonucleotide
tatatttacaactatttgtga

SEQ ID NO: 7009 - DNA, 21 bp, Artificial Sequence
  Description of Artificial Sequence: Synthetic oligonucleotide
caaatagttgtaaatatagtg

SEQ ID NO: 7010 - DNA, 21 bp, Artificial Sequence
  Description of Artificial Sequence: Synthetic oligonucleotide
ctatatttacaactatttgtg

SEQ ID NO: 7011 - DNA, 21 bp, Artificial Sequence
  Description of Artificial Sequence: Synthetic oligonucleotide
aaatagttgtaaatatagtga

SEQ ID NO: 7012 - DNA, 21 bp, Artificial Sequence
  Description of Artificial Sequence: Synthetic oligonucleotide
actatatttacaactatttgt

SEQ ID NO: 7013 - DNA, 21 bp, Artificial Sequence
  Description of Artificial Sequence: Synthetic oligonucleotide
aatagttgtaaatatagtgaa

SEQ ID NO: 7014 - DNA, 21 bp, Artificial Sequence
  Description of Artificial Sequence: Synthetic oligonucleotide
cactatatttacaactatttg

SEQ ID NO: 7015 - DNA, 21 bp, Artificial Sequence
  Description of Artificial Sequence: Synthetic oligonucleotide
atagttgtaaatatagtgaag

SEQ ID NO: 7016 - DNA, 21 bp, Artificial Sequence
  Description of Artificial Sequence: Synthetic oligonucleotide
tcactatatttacaactattt

SEQ ID NO: 7017 - DNA, 21 bp, Artificial Sequence
  Description of Artificial Sequence: Synthetic oligonucleotide
tagttgtaaatatagtgaagc

SEQ ID NO: 7018 - DNA, 21 bp, Artificial Sequence
  Description of Artificial Sequence: Synthetic oligonucleotide
ttcactatatttacaactatt

SEQ ID NO: 7019 - DNA, 21 bp, Artificial Sequence
  Description of Artificial Sequence: Synthetic oligonucleotide
agttgtaaatatagtgaagca

SEQ ID NO: 7020 - DNA, 21 bp, Artificial Sequence
  Description of Artificial Sequence: Synthetic oligonucleotide
cttcactatatttacaactat

SEQ ID NO: 7021 - DNA, 21 bp, Artificial Sequence
  Description of Artificial Sequence: Synthetic oligonucleotide
gttgtaaatatagtgaagcaa

SEQ ID NO: 7022 - DNA, 21 bp, Artificial Sequence
  Description of Artificial Sequence: Synthetic oligonucleotide
gcttcactatatttacaacta

SEQ ID NO: 7023 - DNA, 21 bp, Artificial Sequence
  Description of Artificial Sequence: Synthetic oligonucleotide
ttgtaaatatagtgaagcaat

SEQ ID NO: 7024 - DNA, 21 bp, Artificial Sequence
  Description of Artificial Sequence: Synthetic oligonucleotide
tgcttcactatatttacaact

SEQ ID NO: 7025 - DNA, 21 bp, Artificial Sequence
  Description of Artificial Sequence: Synthetic oligonucleotide
tgtaaatatagtgaagcaatt

SEQ ID NO: 7026 - DNA, 21 bp, Artificial Sequence
  Description of Artificial Sequence: Synthetic oligonucleotide
ttgcttcactatatttacaac

SEQ ID NO: 7027 - DNA, 21 bp, Artificial Sequence
  Description of Artificial Sequence: Synthetic oligonucleotide
gtaaatatagtgaagcaattt

SEQ ID NO: 7028 - DNA, 21 bp, Artificial Sequence
  Description of Artificial Sequence: Synthetic oligonucleotide
attgcttcactatatttacaa

SEQ ID NO: 7029 - DNA, 21 bp, Artificial Sequence
  Description of Artificial Sequence: Synthetic oligonucleotide
taaatatagtgaagcaatttg

SEQ ID NO: 7030 - DNA, 21 bp, Artificial Sequence
  Description of Artificial Sequence: Synthetic oligonucleotide
aattgcttcactatatttaca

SEQ ID NO: 7031 - DNA, 21 bp, Artificial Sequence
  Description of Artificial Sequence: Synthetic oligonucleotide
aaatatagtgaagcaatttga

SEQ ID NO: 7032 - DNA, 21 bp, Artificial Sequence
  Description of Artificial Sequence: Synthetic oligonucleotide
aaattgcttcactatatttac

SEQ ID NO: 7033 - DNA, 21 bp, Artificial Sequence
  Description of Artificial Sequence: Synthetic oligonucleotide
aatatagtgaagcaatttgaa

SEQ ID NO: 7034 - DNA, 21 bp, Artificial Sequence
  Description of Artificial Sequence: Synthetic oligonucleotide
caaattgcttcactatattta

SEQ ID NO: 7035 - DNA, 21 bp, Artificial Sequence
  Description of Artificial Sequence: Synthetic oligonucleotide
atatagtgaagcaatttgaaa

SEQ ID NO: 7036 - DNA, 21 bp, Artificial Sequence
  Description of Artificial Sequence: Synthetic oligonucleotide
tcaaattgcttcactatattt

SEQ ID NO: 7037 - DNA, 21 bp, Artificial Sequence
  Description of Artificial Sequence: Synthetic oligonucleotide
tatagtgaagcaatttgaaat

SEQ ID NO: 7038 - DNA, 21 bp, Artificial Sequence
  Description of Artificial Sequence: Synthetic oligonucleotide
ttcaaattgcttcactatatt

SEQ ID NO: 7039 - DNA, 21 bp, Artificial Sequence
  Description of Artificial Sequence: Synthetic oligonucleotide
atagtgaagcaatttgaaata

SEQ ID NO: 7040 - DNA, 21 bp, Artificial Sequence
  Description of Artificial Sequence: Synthetic oligonucleotide
tttcaaattgcttcactatat

SEQ ID NO: 7041 - DNA, 21 bp, Artificial Sequence
  Description of Artificial Sequence: Synthetic oligonucleotide
tagtgaagcaatttgaaataa

SEQ ID NO: 7042 - DNA, 21 bp, Artificial Sequence
  Description of Artificial Sequence: Synthetic oligonucleotide
atttcaaattgcttcactata

SEQ ID NO: 7043 - DNA, 21 bp, Artificial Sequence
  Description of Artificial Sequence: Synthetic oligonucleotide
agtgaagcaatttgaaataat

SEQ ID NO: 7044 - DNA, 21 bp, Artificial Sequence
  Description of Artificial Sequence: Synthetic oligonucleotide
tatttcaaattgcttcactat

SEQ ID NO: 7045 - DNA, 21 bp, Artificial Sequence
  Description of Artificial Sequence: Synthetic oligonucleotide
gtgaagcaatttgaaataatt

SEQ ID NO: 7046 - DNA, 21 bp, Artificial Sequence
  Description of Artificial Sequence: Synthetic oligonucleotide
ttatttcaaattgcttcacta

SEQ ID NO: 7047 - DNA, 21 bp, Artificial Sequence
  Description of Artificial Sequence: Synthetic oligonucleotide
tgaagcaatttgaaataattt

SEQ ID NO: 7048 - DNA, 21 bp, Artificial Sequence
  Description of Artificial Sequence: Synthetic oligonucleotide
attatttcaaattgcttcact

SEQ ID NO: 7049 - DNA, 21 bp, Artificial Sequence
  Description of Artificial Sequence: Synthetic oligonucleotide
gaagcaatttgaaataatttt

SEQ ID NO: 7050 - DNA, 21 bp, Artificial Sequence
  Description of Artificial Sequence: Synthetic oligonucleotide
aattatttcaaattgcttcac

SEQ ID NO: 7051 - DNA, 21 bp, Artificial Sequence
  Description of Artificial Sequence: Synthetic oligonucleotide
aagcaatttgaaataattttc

SEQ ID NO: 7052 - DNA, 21 bp, Artificial Sequence
  Description of Artificial Sequence: Synthetic oligonucleotide
aaattatttcaaattgcttca

SEQ ID NO: 7053 - DNA, 21 bp, Artificial Sequence
  Description of Artificial Sequence: Synthetic oligonucleotide
agcaatttgaaataattttca

SEQ ID NO: 7054 - DNA, 21 bp, Artificial Sequence
  Description of Artificial Sequence: Synthetic oligonucleotide
aaaattatttcaaattgcttc

SEQ ID NO: 7055 - DNA, 21 bp, Artificial Sequence
  Description of Artificial Sequence: Synthetic oligonucleotide
gcaatttgaaataattttcaa

SEQ ID NO: 7056 - DNA, 21 bp, Artificial Sequence
  Description of Artificial Sequence: Synthetic oligonucleotide
gaaaattatttcaaattgctt

SEQ ID NO: 7057 - DNA, 21 bp, Artificial Sequence
  Description of Artificial Sequence: Synthetic oligonucleotide
caatttgaaataattttcaag

SEQ ID NO: 7058 - DNA, 21 bp, Artificial Sequence
  Description of Artificial Sequence: Synthetic oligonucleotide
tgaaaattatttcaaattgct

SEQ ID NO: 7059 - DNA, 21 bp, Artificial Sequence
  Description of Artificial Sequence: Synthetic oligonucleotide
aatttgaaataattttcaagc

SEQ ID NO: 7060 - DNA, 21 bp, Artificial Sequence
  Description of Artificial Sequence: Synthetic oligonucleotide
ttgaaaattatttcaaattgc

SEQ ID NO: 7061 - DNA, 21 bp, Artificial Sequence
  Description of Artificial Sequence: Synthetic oligonucleotide
atttgaaataattttcaagca

SEQ ID NO: 7062 - DNA, 21 bp, Artificial Sequence
  Description of Artificial Sequence: Synthetic oligonucleotide
cttgaaaattatttcaaattg

SEQ ID NO: 7063 - DNA, 21 bp, Artificial Sequence
  Description of Artificial Sequence: Synthetic oligonucleotide
tttgaaataattttcaagcaa

SEQ ID NO: 7064 - DNA, 21 bp, Artificial Sequence
  Description of Artificial Sequence: Synthetic oligonucleotide
gcttgaaaattatttcaaatt

SEQ ID NO: 7065 - DNA, 21 bp, Artificial Sequence
  Description of Artificial Sequence: Synthetic oligonucleotide
ttgaaataattttcaagcaaa

SEQ ID NO: 7066 - DNA, 21 bp, Artificial Sequence
  Description of Artificial Sequence: Synthetic oligonucleotide
tgcttgaaaattatttcaaat

SEQ ID NO: 7067 - DNA, 21 bp, Artificial Sequence
  Description of Artificial Sequence: Synthetic oligonucleotide
tgaaataattttcaagcaaag

SEQ ID NO: 7068 - DNA, 21 bp, Artificial Sequence
  Description of Artificial Sequence: Synthetic oligonucleotide
ttgcttgaaaattatttcaaa

SEQ ID NO: 7069 - DNA, 21 bp, Artificial Sequence
  Description of Artificial Sequence: Synthetic oligonucleotide
gaaataattttcaagcaaagt

SEQ ID NO: 7070 - DNA, 21 bp, Artificial Sequence
  Description of Artificial Sequence: Synthetic oligonucleotide
tttgcttgaaaattatttcaa

SEQ ID NO: 7071 - DNA, 21 bp, Artificial Sequence
  Description of Artificial Sequence: Synthetic oligonucleotide
aaataattttcaagcaaagta

SEQ ID NO: 7072 - DNA, 21 bp, Artificial Sequence
  Description of Artificial Sequence: Synthetic oligonucleotide
ctttgcttgaaaattatttca

SEQ ID NO: 7073 - DNA, 21 bp, Artificial Sequence
  Description of Artificial Sequence: Synthetic oligonucleotide
aataattttcaagcaaagtat

SEQ ID NO: 7074 - DNA, 21 bp, Artificial Sequence
  Description of Artificial Sequence: Synthetic oligonucleotide
actttgcttgaaaattatttc

SEQ ID NO: 7075 - DNA, 21 bp, Artificial Sequence
  Description of Artificial Sequence: Synthetic oligonucleotide
ataattttcaagcaaagtatt

SEQ ID NO: 7076 - DNA, 21 bp, Artificial Sequence
  Description of Artificial Sequence: Synthetic oligonucleotide
tactttgcttgaaaattattt

SEQ ID NO: 7077 - DNA, 21 bp, Artificial Sequence
  Description of Artificial Sequence: Synthetic oligonucleotide
taattttcaagcaaagtattg

SEQ ID NO: 7078 - DNA, 21 bp, Artificial Sequence
  Description of Artificial Sequence: Synthetic oligonucleotide
atactttgcttgaaaattatt

SEQ ID NO: 7079 - DNA, 21 bp, Artificial Sequence
  Description of Artificial Sequence: Synthetic oligonucleotide
aattttcaagcaaagtattgt

SEQ ID NO: 7080 - DNA, 21 bp, Artificial Sequence
  Description of Artificial Sequence: Synthetic oligonucleotide
aatactttgcttgaaaattat

SEQ ID NO: 7081 - DNA, 21 bp, Artificial Sequence
  Description of Artificial Sequence: Synthetic oligonucleotide
attttcaagcaaagtattgtg

SEQ ID NO: 7082 - DNA, 21 bp, Artificial Sequence
  Description of Artificial Sequence: Synthetic oligonucleotide
caatactttgcttgaaaatta

SEQ ID NO: 7083 - DNA, 21 bp, Artificial Sequence
  Description of Artificial Sequence: Synthetic oligonucleotide
ttttcaagcaaagtattgtga

SEQ ID NO: 7084 - DNA, 21 bp, Artificial Sequence
  Description of Artificial Sequence: Synthetic oligonucleotide
acaatactttgcttgaaaatt

SEQ ID NO: 7085 - DNA, 21 bp, Artificial Sequence
  Description of Artificial Sequence: Synthetic oligonucleotide
tttcaagcaaagtattgtgaa

SEQ ID NO: 7086 - DNA, 21 bp, Artificial Sequence
  Description of Artificial Sequence: Synthetic oligonucleotide
cacaatactttgcttgaaaat

SEQ ID NO: 7087 - DNA, 21 bp, Artificial Sequence
  Description of Artificial Sequence: Synthetic oligonucleotide
ttcaagcaaagtattgtgaaa

SEQ ID NO: 7088 - DNA, 21 bp, Artificial Sequence
  Description of Artificial Sequence: Synthetic oligonucleotide
tcacaatactttgcttgaaaa

SEQ ID NO: 7089 - DNA, 21 bp, Artificial Sequence
  Description of Artificial Sequence: Synthetic oligonucleotide
tcaagcaaagtattgtgaaag

SEQ ID NO: 7090 - DNA, 21 bp, Artificial Sequence
  Description of Artificial Sequence: Synthetic oligonucleotide
ttcacaatactttgcttgaaa

SEQ ID NO: 7091 - DNA, 21 bp, Artificial Sequence
  Description of Artificial Sequence: Synthetic oligonucleotide
caagcaaagtattgtgaaagt

SEQ ID NO: 7092 - DNA, 21 bp, Artificial Sequence
  Description of Artificial Sequence: Synthetic oligonucleotide
tttcacaatactttgcttgaa

SEQ ID NO: 7093 - DNA, 21 bp, Artificial Sequence
  Description of Artificial Sequence: Synthetic oligonucleotide
aagcaaagtattgtgaaagta

SEQ ID NO: 7094 - DNA, 21 bp, Artificial Sequence
  Description of Artificial Sequence: Synthetic oligonucleotide
ctttcacaatactttgcttga

SEQ ID NO: 7095 - DNA, 21 bp, Artificial Sequence
  Description of Artificial Sequence: Synthetic oligonucleotide
agcaaagtattgtgaaagtat

SEQ ID NO: 7096 - DNA, 21 bp, Artificial Sequence
  Description of Artificial Sequence: Synthetic oligonucleotide
actttcacaatactttgcttg

SEQ ID NO: 7097 - DNA, 21 bp, Artificial Sequence
  Description of Artificial Sequence: Synthetic oligonucleotide
gcaaagtattgtgaaagtatt

SEQ ID NO: 7098 - DNA, 21 bp, Artificial Sequence
  Description of Artificial Sequence: Synthetic oligonucleotide
tactttcacaatactttgctt

SEQ ID NO: 7099 - DNA, 21 bp, Artificial Sequence
  Description of Artificial Sequence: Synthetic oligonucleotide
caaagtattgtgaaagtattc

SEQ ID NO: 7100 - DNA, 21 bp, Artificial Sequence
  Description of Artificial Sequence: Synthetic oligonucleotide
atactttcacaatactttgct

SEQ ID NO: 7101 - DNA, 21 bp, Artificial Sequence
  Description of Artificial Sequence: Synthetic oligonucleotide
aaagtattgtgaaagtattct

SEQ ID NO: 7102 - DNA, 21 bp, Artificial Sequence
  Description of Artificial Sequence: Synthetic oligonucleotide
aatactttcacaatactttgc

SEQ ID NO: 7103 - DNA, 21 bp, Artificial Sequence
  Description of Artificial Sequence: Synthetic oligonucleotide
aagtattgtgaaagtattcta

SEQ ID NO: 7104 - DNA, 21 bp, Artificial Sequence
  Description of Artificial Sequence: Synthetic oligonucleotide
gaatactttcacaatactttg

SEQ ID NO: 7105 - DNA, 21 bp, Artificial Sequence
  Description of Artificial Sequence: Synthetic oligonucleotide
agtattgtgaaagtattctaa

SEQ ID NO: 7106 - DNA, 21 bp, Artificial Sequence
  Description of Artificial Sequence: Synthetic oligonucleotide
agaatactttcacaatacttt

SEQ ID NO: 7107 - DNA, 21 bp, Artificial Sequence
  Description of Artificial Sequence: Synthetic oligonucleotide
gtattgtgaaagtattctaag

SEQ ID NO: 7108 - DNA, 21 bp, Artificial Sequence
  Description of Artificial Sequence: Synthetic oligonucleotide
tagaatactttcacaatactt

SEQ ID NO: 7109 - DNA, 21 bp, Artificial Sequence
  Description of Artificial Sequence: Synthetic oligonucleotide
tattgtgaaagtattctaagc

SEQ ID NO: 7110 - DNA, 21 bp, Artificial Sequence
  Description of Artificial Sequence: Synthetic oligonucleotide
ttagaatactttcacaatact

SEQ ID NO: 7111 - DNA, 21 bp, Artificial Sequence
  Description of Artificial Sequence: Synthetic oligonucleotide
attgtgaaagtattctaagcc

SEQ ID NO: 7112 - DNA, 21 bp, Artificial Sequence
  Description of Artificial Sequence: Synthetic oligonucleotide
cttagaatactttcacaatac

SEQ ID NO: 7113 - DNA, 21 bp, Artificial Sequence
  Description of Artificial Sequence: Synthetic oligonucleotide
ttgtgaaagtattctaagcca

SEQ ID NO: 7114 - DNA, 21 bp, Artificial Sequence
  Description of Artificial Sequence: Synthetic oligonucleotide
gcttagaatactttcacaata

SEQ ID NO: 7115 - DNA, 21 bp, Artificial Sequence
  Description of Artificial Sequence: Synthetic oligonucleotide
tgtgaaagtattctaagccaa

SEQ ID NO: 7116 - DNA, 21 bp, Artificial Sequence
  Description of Artificial Sequence: Synthetic oligonucleotide
ggcttagaatactttcacaat

SEQ ID NO: 7117 - DNA, 21 bp, Artificial Sequence
  Description of Artificial Sequence: Synthetic oligonucleotide
gtgaaagtattctaagccaag

SEQ ID NO: 7118 - DNA, 21 bp, Artificial Sequence
  Description of Artificial Sequence: Synthetic oligonucleotide
tggcttagaatactttcacaa

SEQ ID NO: 7119 - DNA, 21 bp, Artificial Sequence
  Description of Artificial Sequence: Synthetic oligonucleotide
tgaaagtattctaagccaagt

SEQ ID NO: 7120 - DNA, 21 bp, Artificial Sequence
  Description of Artificial Sequence: Synthetic oligonucleotide
ttggcttagaatactttcaca

SEQ ID NO: 7121 - DNA, 21 bp, Artificial Sequence
  Description of Artificial Sequence: Synthetic oligonucleotide
gaaagtattctaagccaagtt

SEQ ID NO: 7122 - DNA, 21 bp, Artificial Sequence
  Description of Artificial Sequence: Synthetic oligonucleotide
cttggcttagaatactttcac

SEQ ID NO: 7123 - DNA, 21 bp, Artificial Sequence
  Description of Artificial Sequence: Synthetic oligonucleotide
aaagtattctaagccaagttt

SEQ ID NO: 7124 - DNA, 21 bp, Artificial Sequence
  Description of Artificial Sequence: Synthetic oligonucleotide
acttggcttagaatactttca

SEQ ID NO: 7125 - DNA, 21 bp, Artificial Sequence
  Description of Artificial Sequence: Synthetic oligonucleotide
aagtattctaagccaagtttt

SEQ ID NO: 7126 - DNA, 21 bp, Artificial Sequence
  Description of Artificial Sequence: Synthetic oligonucleotide
aacttggcttagaatactttc

SEQ ID NO: 7127 - DNA, 21 bp, Artificial Sequence
  Description of Artificial Sequence: Synthetic oligonucleotide
agtattctaagccaagtttta

SEQ ID NO: 7128 - DNA, 21 bp, Artificial Sequence
  Description of Artificial Sequence: Synthetic oligonucleotide
aaacttggcttagaatacttt

SEQ ID NO: 7129 - DNA, 21 bp, Artificial Sequence
  Description of Artificial Sequence: Synthetic oligonucleotide
gtattctaagccaagttttaa

SEQ ID NO: 7130 - DNA, 21 bp, Artificial Sequence
  Description of Artificial Sequence: Synthetic oligonucleotide
aaaacttggcttagaatactt

SEQ ID NO: 7131 - DNA, 21 bp, Artificial Sequence
  Description of Artificial Sequence: Synthetic oligonucleotide
tattctaagccaagttttaaa

SEQ ID NO: 7132 - DNA, 21 bp, Artificial Sequence
  Description of Artificial Sequence: Synthetic oligonucleotide
taaaacttggcttagaatact

SEQ ID NO: 7133 - DNA, 21 bp, Artificial Sequence
  Description of Artificial Sequence: Synthetic oligonucleotide
attctaagccaagttttaaat

SEQ ID NO: 7134 - DNA, 21 bp, Artificial Sequence
  Description of Artificial Sequence: Synthetic oligonucleotide
ttaaaacttggcttagaatac

SEQ ID NO: 7135 - DNA, 21 bp, Artificial Sequence
  Description of Artificial Sequence: Synthetic oligonucleotide
ttctaagccaagttttaaata

SEQ ID NO: 7136 - DNA, 21 bp, Artificial Sequence
  Description of Artificial Sequence: Synthetic oligonucleotide
tttaaaacttggcttagaata

SEQ ID NO: 7137 - DNA, 21 bp, Artificial Sequence
  Description of Artificial Sequence: Synthetic oligonucleotide
tctaagccaagttttaaatat

SEQ ID NO: 7138 - DNA, 21 bp, Artificial Sequence
  Description of Artificial Sequence: Synthetic oligonucleotide
atttaaaacttggcttagaat

SEQ ID NO: 7139 - DNA, 21 bp, Artificial Sequence
  Description of Artificial Sequence: Synthetic oligonucleotide
ctaagccaagttttaaatatt

SEQ ID NO: 7140 - DNA, 21 bp, Artificial Sequence
  Description of Artificial Sequence: Synthetic oligonucleotide
tatttaaaacttggcttagaa

SEQ ID NO: 7141 - DNA, 21 bp, Artificial Sequence
  Description of Artificial Sequence: Synthetic oligonucleotide
taagccaagttttaaatatta

SEQ ID NO: 7142 - DNA, 21 bp, Artificial Sequence
  Description of Artificial Sequence: Synthetic oligonucleotide
atatttaaaacttggcttaga

SEQ ID NO: 7143 - DNA, 21 bp, Artificial Sequence
  Description of Artificial Sequence: Synthetic oligonucleotide
aagccaagttttaaatattat

SEQ ID NO: 7144 - DNA, 21 bp, Artificial Sequence
  Description of Artificial Sequence: Synthetic oligonucleotide
aatatttaaaacttggcttag

SEQ ID NO: 7145 - DNA, 21 bp, Artificial Sequence
  Description of Artificial Sequence: Synthetic oligonucleotide
agccaagttttaaatattatc

SEQ ID NO: 7146 - DNA, 21 bp, Artificial Sequence
  Description of Artificial Sequence: Synthetic oligonucleotide
taatatttaaaacttggctta

SEQ ID NO: 7147 - DNA, 21 bp, Artificial Sequence
  Description of Artificial Sequence: Synthetic oligonucleotide
gccaagttttaaatattatct

SEQ ID NO: 7148 - DNA, 21 bp, Artificial Sequence
  Description of Artificial Sequence: Synthetic oligonucleotide
ataatatttaaaacttggctt

SEQ ID NO: 7149 - DNA, 21 bp, Artificial Sequence
  Description of Artificial Sequence: Synthetic oligonucleotide
ccaagttttaaatattatcta

SEQ ID NO: 7150 - DNA, 21 bp, Artificial Sequence
  Description of Artificial Sequence: Synthetic oligonucleotide
gataatatttaaaacttggct

SEQ ID NO: 7151 - DNA, 21 bp, Artificial Sequence
  Description of Artificial Sequence: Synthetic oligonucleotide
caagttttaaatattatctaa

SEQ ID NO: 7152 - DNA, 21 bp, Artificial Sequence
  Description of Artificial Sequence: Synthetic oligonucleotide
agataatatttaaaacttggc

SEQ ID NO: 7153 - DNA, 21 bp, Artificial Sequence
  Description of Artificial Sequence: Synthetic oligonucleotide
aagttttaaatattatctaac

SEQ ID NO: 7154 - DNA, 21 bp, Artificial Sequence
  Description of Artificial Sequence: Synthetic oligonucleotide
tagataatatttaaaacttgg

SEQ ID NO: 7155 - DNA, 21 bp, Artificial Sequence
  Description of Artificial Sequence: Synthetic oligonucleotide
agttttaaatattatctaaca

SEQ ID NO: 7156 - DNA, 21 bp, Artificial Sequence
  Description of Artificial Sequence: Synthetic oligonucleotide
ttagataatatttaaaacttg

SEQ ID NO: 7157 - DNA, 21 bp, Artificial Sequence
  Description of Artificial Sequence: Synthetic oligonucleotide
gttttaaatattatctaacag

SEQ ID NO: 7158 - DNA, 21 bp, Artificial Sequence
  Description of Artificial Sequence: Synthetic oligonucleotide
gttagataatatttaaaactt

SEQ ID NO: 7159 - DNA, 21 bp, Artificial Sequence
  Description of Artificial Sequence: Synthetic oligonucleotide
ttttaaatattatctaacaga

SEQ ID NO: 7160 - DNA, 21 bp, Artificial Sequence
  Description of Artificial Sequence: Synthetic oligonucleotide
tgttagataatatttaaaact

SEQ ID NO: 7161 - DNA, 21 bp, Artificial Sequence
  Description of Artificial Sequence: Synthetic oligonucleotide
tttaaatattatctaacagac

SEQ ID NO: 7162 - DNA, 21 bp, Artificial Sequence
  Description of Artificial Sequence: Synthetic oligonucleotide
ctgttagataatatttaaaac

SEQ ID NO: 7163 - DNA, 21 bp, Artificial Sequence
  Description of Artificial Sequence: Synthetic oligonucleotide
ttaaatattatctaacagaca

SEQ ID NO: 7164 - DNA, 21 bp, Artificial Sequence
  Description of Artificial Sequence: Synthetic oligonucleotide
tctgttagataatatttaaaa

SEQ ID NO: 7165 - DNA, 21 bp, Artificial Sequence
  Description of Artificial Sequence: Synthetic oligonucleotide
taaatattatctaacagacaa

SEQ ID NO: 7166 - DNA, 21 bp, Artificial Sequence
  Description of Artificial Sequence: Synthetic oligonucleotide
gtctgttagataatatttaaa

SEQ ID NO: 7167 - DNA, 21 bp, Artificial Sequence
  Description of Artificial Sequence: Synthetic oligonucleotide
aaatattatctaacagacaag

SEQ ID NO: 7168 - DNA, 21 bp, Artificial Sequence
  Description of Artificial Sequence: Synthetic oligonucleotide
tgtctgttagataatatttaa

SEQ ID NO: 7169 - DNA, 21 bp, Artificial Sequence
  Description of Artificial Sequence: Synthetic oligonucleotide
aatattatctaacagacaaga

SEQ ID NO: 7170 - DNA, 21 bp, Artificial Sequence
  Description of Artificial Sequence: Synthetic oligonucleotide
ttgtctgttagataatattta

SEQ ID NO: 7171 - DNA, 21 bp, Artificial Sequence
  Description of Artificial Sequence: Synthetic oligonucleotide
atattatctaacagacaagag

SEQ ID NO: 7172 - DNA, 21 bp, Artificial Sequence
  Description of Artificial Sequence: Synthetic oligonucleotide
cttgtctgttagataatattt

SEQ ID NO: 7173 - DNA, 21 bp, Artificial Sequence
  Description of Artificial Sequence: Synthetic oligonucleotide
tattatctaacagacaagagt

SEQ ID NO: 7174 - DNA, 21 bp, Artificial Sequence
  Description of Artificial Sequence: Synthetic oligonucleotide
tcttgtctgttagataatatt

SEQ ID NO: 7175 - DNA, 21 bp, Artificial Sequence
  Description of Artificial Sequence: Synthetic oligonucleotide
attatctaacagacaagagtg

SEQ ID NO: 7176 - DNA, 21 bp, Artificial Sequence
  Description of Artificial Sequence: Synthetic oligonucleotide
ctcttgtctgttagataatat

SEQ ID NO: 7177 - DNA, 21 bp, Artificial Sequence
  Description of Artificial Sequence: Synthetic oligonucleotide
ttatctaacagacaagagtgg

SEQ ID NO: 7178 - DNA, 21 bp, Artificial Sequence
  Description of Artificial Sequence: Synthetic oligonucleotide
actcttgtctgttagataata

SEQ ID NO: 7179 - DNA, 21 bp, Artificial Sequence
  Description of Artificial Sequence: Synthetic oligonucleotide
tatctaacagacaagagtggt

SEQ ID NO: 7180 - DNA, 21 bp, Artificial Sequence
  Description of Artificial Sequence: Synthetic oligonucleotide
cactcttgtctgttagataat

SEQ ID NO: 7181 - DNA, 21 bp, Artificial Sequence
  Description of Artificial Sequence: Synthetic oligonucleotide
atctaacagacaagagtggta

SEQ ID NO: 7182 - DNA, 21 bp, Artificial Sequence
  Description of Artificial Sequence: Synthetic oligonucleotide
ccactcttgtctgttagataa

SEQ ID NO: 7183 - DNA, 21 bp, Artificial Sequence
  Description of Artificial Sequence: Synthetic oligonucleotide
tctaacagacaagagtggtat

SEQ ID NO: 7184 - DNA, 21 bp, Artificial Sequence
  Description of Artificial Sequence: Synthetic oligonucleotide
accactcttgtctgttagata

SEQ ID NO: 7185 - DNA, 21 bp, Artificial Sequence
  Description of Artificial Sequence: Synthetic oligonucleotide
ctaacagacaagagtggtata

SEQ ID NO: 7186 - DNA, 21 bp, Artificial Sequence
  Description of Artificial Sequence: Synthetic oligonucleotide
taccactcttgtctgttagat

SEQ ID NO: 7187 - DNA, 21 bp, Artificial Sequence
  Description of Artificial Sequence: Synthetic oligonucleotide
taacagacaagagtggtatat

SEQ ID NO: 7188 - DNA, 21 bp, Artificial Sequence
  Description of Artificial Sequence: Synthetic oligonucleotide
ataccactcttgtctgttaga

SEQ ID NO: 7189 - DNA, 21 bp, Artificial Sequence
  Description of Artificial Sequence: Synthetic oligonucleotide
aacagacaagagtggtatata

SEQ ID NO: 7190 - DNA, 21 bp, Artificial Sequence
  Description of Artificial Sequence: Synthetic oligonucleotide
tataccactcttgtctgttag

SEQ ID NO: 7191 - DNA, 21 bp, Artificial Sequence
  Description of Artificial Sequence: Synthetic oligonucleotide
acagacaagagtggtatatac

SEQ ID NO: 7192 - DNA, 21 bp, Artificial Sequence
  Description of Artificial Sequence: Synthetic oligonucleotide
atataccactcttgtctgtta

SEQ ID NO: 7193 - DNA, 21 bp, Artificial Sequence
  Description of Artificial Sequence: Synthetic oligonucleotide
cagacaagagtggtatataca

SEQ ID NO: 7194 - DNA, 21 bp, Artificial Sequence
  Description of Artificial Sequence: Synthetic oligonucleotide
tatataccactcttgtctgtt

SEQ ID NO: 7195 - DNA, 21 bp, Artificial Sequence
  Description of Artificial Sequence: Synthetic oligonucleotide
agacaagagtggtatatacaa

SEQ ID NO: 7196 - DNA, 21 bp, Artificial Sequence
  Description of Artificial Sequence: Synthetic oligonucleotide
gtatataccactcttgtctgt

SEQ ID NO: 7197 - DNA, 21 bp, Artificial Sequence
  Description of Artificial Sequence: Synthetic oligonucleotide
gacaagagtggtatatacaag

SEQ ID NO: 7198 - DNA, 21 bp, Artificial Sequence
  Description of Artificial Sequence: Synthetic oligonucleotide
tgtatataccactcttgtctg

SEQ ID NO: 7199 - DNA, 21 bp, Artificial Sequence
  Description of Artificial Sequence: Synthetic oligonucleotide
acaagagtggtatatacaagt

SEQ ID NO: 7200 - DNA, 21 bp, Artificial Sequence
  Description of Artificial Sequence: Synthetic oligonucleotide
ttgtatataccactcttgtct

SEQ ID NO: 7201 - DNA, 21 bp, Artificial Sequence
  Description of Artificial Sequence: Synthetic oligonucleotide
caagagtggtatatacaagta

SEQ ID NO: 7202 - DNA, 21 bp, Artificial Sequence
  Description of Artificial Sequence: Synthetic oligonucleotide
cttgtatataccactcttgtc

SEQ ID NO: 7203 - DNA, 21 bp, Artificial Sequence
  Description of Artificial Sequence: Synthetic oligonucleotide
aagagtggtatatacaagtag

SEQ ID NO: 7204 - DNA, 21 bp, Artificial Sequence
  Description of Artificial Sequence: Synthetic oligonucleotide
acttgtatataccactcttgt

SEQ ID NO: 7205 - DNA, 21 bp, Artificial Sequence
  Description of Artificial Sequence: Synthetic oligonucleotide
agagtggtatatacaagtaga

SEQ ID NO: 7206 - DNA, 21 bp, Artificial Sequence
  Description of Artificial Sequence: Synthetic oligonucleotide
tacttgtatataccactcttg

SEQ ID NO: 7207 - DNA, 21 bp, Artificial Sequence
  Description of Artificial Sequence: Synthetic oligonucleotide
gagtggtatatacaagtagat

SEQ ID NO: 7208 - DNA, 21 bp, Artificial Sequence
  Description of Artificial Sequence: Synthetic oligonucleotide
ctacttgtatataccactctt

SEQ ID NO: 7209 - DNA, 21 bp, Artificial Sequence
  Description of Artificial Sequence: Synthetic oligonucleotide
agtggtatatacaagtagatc

SEQ ID NO: 7210 - DNA, 21 bp, Artificial Sequence
  Description of Artificial Sequence: Synthetic oligonucleotide
tctacttgtatataccactct

SEQ ID NO: 7211 - DNA, 21 bp, Artificial Sequence
  Description of Artificial Sequence: Synthetic oligonucleotide
gtggtatatacaagtagatcc

SEQ ID NO: 7212 - DNA, 21 bp, Artificial Sequence
  Description of Artificial Sequence: Synthetic oligonucleotide
atctacttgtatataccactc

SEQ ID NO: 7213 - DNA, 21 bp, Artificial Sequence
  Description of Artificial Sequence: Synthetic oligonucleotide
tggtatatacaagtagatcct

SEQ ID NO: 7214 - DNA, 21 bp, Artificial Sequence
  Description of Artificial Sequence: Synthetic oligonucleotide
gatctacttgtatataccact

SEQ ID NO: 7215 - DNA, 21 bp, Artificial Sequence
  Description of Artificial Sequence: Synthetic oligonucleotide
ggtatatacaagtagatcctg

SEQ ID NO: 7216 - DNA, 21 bp, Artificial Sequence
  Description of Artificial Sequence: Synthetic oligonucleotide
ggatctacttgtatataccac

SEQ ID NO: 7217 - DNA, 21 bp, Artificial Sequence
  Description of Artificial Sequence: Synthetic oligonucleotide
gtatatacaagtagatcctga

SEQ ID NO: 7218 - DNA, 21 bp, Artificial Sequence
  Description of Artificial Sequence: Synthetic oligonucleotide
aggatctacttgtatatacca

SEQ ID NO: 7219 - DNA, 21 bp, Artificial Sequence
  Description of Artificial Sequence: Synthetic oligonucleotide
tatatacaagtagatcctgag

SEQ ID NO: 7220 - DNA, 21 bp, Artificial Sequence
  Description of Artificial Sequence: Synthetic oligonucleotide
caggatctacttgtatatacc

SEQ ID NO: 7221 - DNA, 21 bp, Artificial Sequence
  Description of Artificial Sequence: Synthetic oligonucleotide
atatacaagtagatcctgaga

SEQ ID NO: 7222 - DNA, 21 bp, Artificial Sequence
  Description of Artificial Sequence: Synthetic oligonucleotide
tcaggatctacttgtatatac

SEQ ID NO: 7223 - DNA, 21 bp, Artificial Sequence
  Description of Artificial Sequence: Synthetic oligonucleotide
tatacaagtagatcctgagaa

SEQ ID NO: 7224 - DNA, 21 bp, Artificial Sequence
  Description of Artificial Sequence: Synthetic oligonucleotide
ctcaggatctacttgtatata

SEQ ID NO: 7225 - DNA, 21 bp, Artificial Sequence
  Description of Artificial Sequence: Synthetic oligonucleotide
atacaagtagatcctgagaag

SEQ ID NO: 7226 - DNA, 21 bp, Artificial Sequence
  Description of Artificial Sequence: Synthetic oligonucleotide
tctcaggatctacttgtatat

SEQ ID NO: 7227 - DNA, 21 bp, Artificial Sequence
  Description of Artificial Sequence: Synthetic oligonucleotide
tacaagtagatcctgagaagt

SEQ ID NO: 7228 - DNA, 21 bp, Artificial Sequence
  Description of Artificial Sequence: Synthetic oligonucleotide
ttctcaggatctacttgtata

SEQ ID NO: 7229 - DNA, 21 bp, Artificial Sequence
  Description of Artificial Sequence: Synthetic oligonucleotide
acaagtagatcctgagaagta

SEQ ID NO: 7230 - DNA, 21 bp, Artificial Sequence
  Description of Artificial Sequence: Synthetic oligonucleotide
cttctcaggatctacttgtat

SEQ ID NO: 7231 - DNA, 21 bp, Artificial Sequence
  Description of Artificial Sequence: Synthetic oligonucleotide
caagtagatcctgagaagtac

SEQ ID NO: 7232 - DNA, 21 bp, Artificial Sequence
  Description of Artificial Sequence: Synthetic oligonucleotide
acttctcaggatctacttgta

SEQ ID NO: 7233 - DNA, 21 bp, Artificial Sequence
  Description of Artificial Sequence: Synthetic oligonucleotide
aagtagatcctgagaagtacc

SEQ ID NO: 7234 - DNA, 21 bp, Artificial Sequence
  Description of Artificial Sequence: Synthetic oligonucleotide
tacttctcaggatctacttgt

SEQ ID NO: 7235 - DNA, 21 bp, Artificial Sequence
  Description of Artificial Sequence: Synthetic oligonucleotide
agtagatcctgagaagtacct

SEQ ID NO: 7236 - DNA, 21 bp, Artificial Sequence
  Description of Artificial Sequence: Synthetic oligonucleotide
gtacttctcaggatctacttg

SEQ ID NO: 7237 - DNA, 21 bp, Artificial Sequence
  Description of Artificial Sequence: Synthetic oligonucleotide
gtagatcctgagaagtacctt

SEQ ID NO: 7238 - DNA, 21 bp, Artificial Sequence
  Description of Artificial Sequence: Synthetic oligonucleotide
ggtacttctcaggatctactt

SEQ ID NO: 7239 - DNA, 21 bp, Artificial Sequence
  Description of Artificial Sequence: Synthetic oligonucleotide
tagatcctgagaagtaccttt

SEQ ID NO: 7240 - DNA, 21 bp, Artificial Sequence
  Description of Artificial Sequence: Synthetic oligonucleotide
aggtacttctcaggatctact

SEQ ID NO: 7241 - DNA, 21 bp, Artificial Sequence
  Description of Artificial Sequence: Synthetic oligonucleotide
agatcctgagaagtacctttg

SEQ ID NO: 7242 - DNA, 21 bp, Artificial Sequence
  Description of Artificial Sequence: Synthetic oligonucleotide
aaggtacttctcaggatctac

SEQ ID NO: 7243 - DNA, 21 bp, Artificial Sequence
  Description of Artificial Sequence: Synthetic oligonucleotide
gatcctgagaagtacctttgt

SEQ ID NO: 7244 - DNA, 21 bp, Artificial Sequence
  Description of Artificial Sequence: Synthetic oligonucleotide
aaaggtacttctcaggatcta

SEQ ID NO: 7245 - DNA, 21 bp, Artificial Sequence
  Description of Artificial Sequence: Synthetic oligonucleotide
atcctgagaagtacctttgtt

SEQ ID NO: 7246 - DNA, 21 bp, Artificial Sequence
  Description of Artificial Sequence: Synthetic oligonucleotide
caaaggtacttctcaggatct

SEQ ID NO: 7247 - DNA, 21 bp, Artificial Sequence
  Description of Artificial Sequence: Synthetic oligonucleotide
tcctgagaagtacctttgtta

SEQ ID NO: 7248 - DNA, 21 bp, Artificial Sequence
  Description of Artificial Sequence: Synthetic oligonucleotide
acaaaggtacttctcaggatc

SEQ ID NO: 7249 - DNA, 21 bp, Artificial Sequence
  Description of Artificial Sequence: Synthetic oligonucleotide
cctgagaagtacctttgttac

SEQ ID NO: 7250 - DNA, 21 bp, Artificial Sequence
  Description of Artificial Sequence: Synthetic oligonucleotide
aacaaaggtacttctcaggat

SEQ ID NO: 7251 - DNA, 21 bp, Artificial Sequence
  Description of Artificial Sequence: Synthetic oligonucleotide
ctgagaagtacctttgttaca

SEQ ID NO: 7252 - DNA, 21 bp, Artificial Sequence
  Description of Artificial Sequence: Synthetic oligonucleotide
taacaaaggtacttctcagga

SEQ ID NO: 7253 - DNA, 21 bp, Artificial Sequence
  Description of Artificial Sequence: Synthetic oligonucleotide
tgagaagtacctttgttacag

SEQ ID NO: 7254 - DNA, 21 bp, Artificial Sequence
  Description of Artificial Sequence: Synthetic oligonucleotide
gtaacaaaggtacttctcagg

SEQ ID NO: 7255 - DNA, 21 bp, Artificial Sequence
  Description of Artificial Sequence: Synthetic oligonucleotide
gagaagtacctttgttacagc

SEQ ID NO: 7256 - DNA, 21 bp, Artificial Sequence
  Description of Artificial Sequence: Synthetic oligonucleotide
tgtaacaaaggtacttctcag

SEQ ID NO: 7257 - DNA, 21 bp, Artificial Sequence
  Description of Artificial Sequence: Synthetic oligonucleotide
agaagtacctttgttacagct

SEQ ID NO: 7258 - DNA, 21 bp, Artificial Sequence
  Description of Artificial Sequence: Synthetic oligonucleotide
ctgtaacaaaggtacttctca

SEQ ID NO: 7259 - DNA, 21 bp, Artificial Sequence
  Description of Artificial Sequence: Synthetic oligonucleotide
gaagtacctttgttacagcta

SEQ ID NO: 7260 - DNA, 21 bp, Artificial Sequence
  Description of Artificial Sequence: Synthetic oligonucleotide
gctgtaacaaaggtacttctc

SEQ ID NO: 7261 - DNA, 21 bp, Artificial Sequence
  Description of Artificial Sequence: Synthetic oligonucleotide
aagtacctttgttacagctac

SEQ ID NO: 7262 - DNA, 21 bp, Artificial Sequence
  Description of Artificial Sequence: Synthetic oligonucleotide
agctgtaacaaaggtacttct

SEQ ID NO: 7263 - DNA, 21 bp, Artificial Sequence
  Description of Artificial Sequence: Synthetic oligonucleotide
agtacctttgttacagctact

SEQ ID NO: 7264 - DNA, 21 bp, Artificial Sequence
  Description of Artificial Sequence: Synthetic oligonucleotide
tagctgtaacaaaggtacttc

SEQ ID NO: 7265 - DNA, 21 bp, Artificial Sequence
  Description of Artificial Sequence: Synthetic oligonucleotide
gtacctttgttacagctacta

SEQ ID NO: 7266 - DNA, 21 bp, Artificial Sequence
  Description of Artificial Sequence: Synthetic oligonucleotide
gtagctgtaacaaaggtactt

SEQ ID NO: 7267 - DNA, 21 bp, Artificial Sequence
  Description of Artificial Sequence: Synthetic oligonucleotide
tacctttgttacagctactat

SEQ ID NO: 7268 - DNA, 21 bp, Artificial Sequence
  Description of Artificial Sequence: Synthetic oligonucleotide
agtagctgtaacaaaggtact

SEQ ID NO: 7269 - DNA, 21 bp, Artificial Sequence
  Description of Artificial Sequence: Synthetic oligonucleotide
acctttgttacagctactata

SEQ ID NO: 7270 - DNA, 21 bp, Artificial Sequence
  Description of Artificial Sequence: Synthetic oligonucleotide
tagtagctgtaacaaaggtac

SEQ ID NO: 7271 - DNA, 21 bp, Artificial Sequence
  Description of Artificial Sequence: Synthetic oligonucleotide
cctttgttacagctactataa

SEQ ID NO: 7272 - DNA, 21 bp, Artificial Sequence
  Description of Artificial Sequence: Synthetic oligonucleotide
atagtagctgtaacaaaggta

SEQ ID NO: 7273 - DNA, 21 bp, Artificial Sequence
  Description of Artificial Sequence: Synthetic oligonucleotide
ctttgttacagctactataaa

SEQ ID NO: 7274 - DNA, 21 bp, Artificial Sequence
  Description of Artificial Sequence: Synthetic oligonucleotide
tatagtagctgtaacaaaggt

SEQ ID NO: 7275 - DNA, 21 bp, Artificial Sequence
  Description of Artificial Sequence: Synthetic oligonucleotide
tttgttacagctactataaat

SEQ ID NO: 7276 - DNA, 21 bp, Artificial Sequence
  Description of Artificial Sequence: Synthetic oligonucleotide
ttatagtagctgtaacaaagg

SEQ ID NO: 7277 - DNA, 21 bp, Artificial Sequence
  Description of Artificial Sequence: Synthetic oligonucleotide
ttgttacagctactataaata

SEQ ID NO: 7278 - DNA, 21 bp, Artificial Sequence
  Description of Artificial Sequence: Synthetic oligonucleotide
tttatagtagctgtaacaaag

SEQ ID NO: 7279 - DNA, 21 bp, Artificial Sequence
  Description of Artificial Sequence: Synthetic oligonucleotide
tgttacagctactataaatat

SEQ ID NO: 7280 - DNA, 21 bp, Artificial Sequence
  Description of Artificial Sequence: Synthetic oligonucleotide
atttatagtagctgtaacaaa

SEQ ID NO: 7281 - DNA, 21 bp, Artificial Sequence
  Description of Artificial Sequence: Synthetic oligonucleotide
gttacagctactataaatata

SEQ ID NO: 7282 - DNA, 21 bp, Artificial Sequence
  Description of Artificial Sequence: Synthetic oligonucleotide
tatttatagtagctgtaacaa

SEQ ID NO: 7283 - DNA, 21 bp, Artificial Sequence
  Description of Artificial Sequence: Synthetic oligonucleotide
ttacagctactataaatatac

SEQ ID NO: 7284 - DNA, 21 bp, Artificial Sequence
  Description of Artificial Sequence: Synthetic oligonucleotide
atatttatagtagctgtaaca

SEQ ID NO: 7285 - DNA, 21 bp, Artificial Sequence
  Description of Artificial Sequence: Synthetic oligonucleotide
tacagctactataaatataca

SEQ ID NO: 7286 - DNA, 21 bp, Artificial Sequence
  Description of Artificial Sequence: Synthetic oligonucleotide
tatatttatagtagctgtaac

SEQ ID NO: 7287 - DNA, 21 bp, Artificial Sequence
  Description of Artificial Sequence: Synthetic oligonucleotide
acagctactataaatatacat

SEQ ID NO: 7288 - DNA, 21 bp, Artificial Sequence
  Description of Artificial Sequence: Synthetic oligonucleotide
gtatatttatagtagctgtaa

SEQ ID NO: 7289 - DNA, 21 bp, Artificial Sequence
  Description of Artificial Sequence: Synthetic oligonucleotide
cagctactataaatatacata

SEQ ID NO: 7290 - DNA, 21 bp, Artificial Sequence
  Description of Artificial Sequence: Synthetic oligonucleotide
tgtatatttatagtagctgta

SEQ ID NO: 7291 - DNA, 21 bp, Artificial Sequence
  Description of Artificial Sequence: Synthetic oligonucleotide
agctactataaatatacatat

SEQ ID NO: 7292 - DNA, 21 bp, Artificial Sequence
  Description of Artificial Sequence: Synthetic oligonucleotide
atgtatatttatagtagctgt

SEQ ID NO: 7293 - DNA, 21 bp, Artificial Sequence
  Description of Artificial Sequence: Synthetic oligonucleotide
gctactataaatatacatata

SEQ ID NO: 7294 - DNA, 21 bp, Artificial Sequence
  Description of Artificial Sequence: Synthetic oligonucleotide
tatgtatatttatagtagctg

SEQ ID NO: 7295 - DNA, 21 bp, Artificial Sequence
  Description of Artificial Sequence: Synthetic oligonucleotide
ctactataaatatacatataa

SEQ ID NO: 7296 - DNA, 21 bp, Artificial Sequence
  Description of Artificial Sequence: Synthetic oligonucleotide
atatgtatatttatagtagct

SEQ ID NO: 7297 - DNA, 21 bp, Artificial Sequence
  Description of Artificial Sequence: Synthetic oligonucleotide
tactataaatatacatataaa

SEQ ID NO: 7298 - DNA, 21 bp, Artificial Sequence
  Description of Artificial Sequence: Synthetic oligonucleotide
tatatgtatatttatagtagc

SEQ ID NO: 7299 - DNA, 21 bp, Artificial Sequence
  Description of Artificial Sequence: Synthetic oligonucleotide
actataaatatacatataaat

SEQ ID NO: 7300 - DNA, 21 bp, Artificial Sequence
  Description of Artificial Sequence: Synthetic oligonucleotide
ttatatgtatatttatagtag

SEQ ID NO: 7301 - DNA, 21 bp, Artificial Sequence
  Description of Artificial Sequence: Synthetic oligonucleotide
ctataaatatacatataaatt

SEQ ID NO: 7302 - DNA, 21 bp, Artificial Sequence
  Description of Artificial Sequence: Synthetic oligonucleotide
tttatatgtatatttatagta

SEQ ID NO: 7303 - DNA, 21 bp, Artificial Sequence
  Description of Artificial Sequence: Synthetic oligonucleotide
tataaatatacatataaatta

SEQ ID NO: 7304 - DNA, 21 bp, Artificial Sequence
  Description of Artificial Sequence: Synthetic oligonucleotide
atttatatgtatatttatagt

SEQ ID NO: 7305 - DNA, 21 bp, Artificial Sequence
  Description of Artificial Sequence: Synthetic oligonucleotide
ataaatatacatataaattat

SEQ ID NO: 7306 - DNA, 21 bp, Artificial Sequence
  Description of Artificial Sequence: Synthetic oligonucleotide
aatttatatgtatatttatag

SEQ ID NO: 7307 - DNA, 21 bp, Artificial Sequence
  Description of Artificial Sequence: Synthetic oligonucleotide
taaatatacatataaattata

SEQ ID NO: 7308 - DNA, 21 bp, Artificial Sequence
  Description of Artificial Sequence: Synthetic oligonucleotide
taatttatatgtatatttata

SEQ ID NO: 7309 - DNA, 21 bp, Artificial Sequence
  Description of Artificial Sequence: Synthetic oligonucleotide
aaatatacatataaattatag

SEQ ID NO: 7310 - DNA, 21 bp, Artificial Sequence
  Description of Artificial Sequence: Synthetic oligonucleotide
ataatttatatgtatatttat

SEQ ID NO: 7311 - DNA, 21 bp, Artificial Sequence
  Description of Artificial Sequence: Synthetic oligonucleotide
aatatacatataaattataga

SEQ ID NO: 7312 - DNA, 21 bp, Artificial Sequence
  Description of Artificial Sequence: Synthetic oligonucleotide
tataatttatatgtatattta

SEQ ID NO: 7313 - DNA, 21 bp, Artificial Sequence
  Description of Artificial Sequence: Synthetic oligonucleotide
atatacatataaattatagaa

SEQ ID NO: 7314 - DNA, 21 bp, Artificial Sequence
  Description of Artificial Sequence: Synthetic oligonucleotide
ctataatttatatgtatattt

SEQ ID NO: 7315 - DNA, 21 bp, Artificial Sequence
  Description of Artificial Sequence: Synthetic oligonucleotide
tatacatataaattatagaat

SEQ ID NO: 7316 - DNA, 21 bp, Artificial Sequence
  Description of Artificial Sequence: Synthetic oligonucleotide
tctataatttatatgtatatt

SEQ ID NO: 7317 - DNA, 21 bp, Artificial Sequence
  Description of Artificial Sequence: Synthetic oligonucleotide
atacatataaattatagaatc

SEQ ID NO: 7318 - DNA, 21 bp, Artificial Sequence
  Description of Artificial Sequence: Synthetic oligonucleotide
ttctataatttatatgtatat

SEQ ID NO: 7319 - DNA, 21 bp, Artificial Sequence
  Description of Artificial Sequence: Synthetic oligonucleotide
tacatataaattatagaatct

SEQ ID NO: 7320 - DNA, 21 bp, Artificial Sequence
  Description of Artificial Sequence: Synthetic oligonucleotide
attctataatttatatgtata

SEQ ID NO: 7321 - DNA, 21 bp, Artificial Sequence
  Description of Artificial Sequence: Synthetic oligonucleotide
acatataaattatagaatcta

SEQ ID NO: 7322 - DNA, 21 bp, Artificial Sequence
  Description of Artificial Sequence: Synthetic oligonucleotide
gattctataatttatatgtat

SEQ ID NO: 7323 - DNA, 21 bp, Artificial Sequence
  Description of Artificial Sequence: Synthetic oligonucleotide
catataaattatagaatctac

SEQ ID NO: 7324 - DNA, 21 bp, Artificial Sequence
  Description of Artificial Sequence: Synthetic oligonucleotide
agattctataatttatatgta

SEQ ID NO: 7325 - DNA, 21 bp, Artificial Sequence
  Description of Artificial Sequence: Synthetic oligonucleotide
atataaattatagaatctact

SEQ ID NO: 7326 - DNA, 21 bp, Artificial Sequence
  Description of Artificial Sequence: Synthetic oligonucleotide
tagattctataatttatatgt

SEQ ID NO: 7327 - DNA, 21 bp, Artificial Sequence
  Description of Artificial Sequence: Synthetic oligonucleotide
tataaattatagaatctactt

SEQ ID NO: 7328 - DNA, 21 bp, Artificial Sequence
  Description of Artificial Sequence: Synthetic oligonucleotide
gtagattctataatttatatg

SEQ ID NO: 7329 - DNA, 21 bp, Artificial Sequence
  Description of Artificial Sequence: Synthetic oligonucleotide
ataaattatagaatctacttt

SEQ ID NO: 7330 - DNA, 21 bp, Artificial Sequence
  Description of Artificial Sequence: Synthetic oligonucleotide
agtagattctataatttatat

SEQ ID NO: 7331 - DNA, 21 bp, Artificial Sequence
  Description of Artificial Sequence: Synthetic oligonucleotide
taaattatagaatctacttta

SEQ ID NO: 7332 - DNA, 21 bp, Artificial Sequence
  Description of Artificial Sequence: Synthetic oligonucleotide
aagtagattctataatttata

SEQ ID NO: 7333 - DNA, 21 bp, Artificial Sequence
  Description of Artificial Sequence: Synthetic oligonucleotide
aaattatagaatctactttaa

SEQ ID NO: 7334 - DNA, 21 bp, Artificial Sequence
  Description of Artificial Sequence: Synthetic oligonucleotide
aaagtagattctataatttat

SEQ ID NO: 7335 - DNA, 21 bp, Artificial Sequence
  Description of Artificial Sequence: Synthetic oligonucleotide
aattatagaatctactttaat

SEQ ID NO: 7336 - DNA, 21 bp, Artificial Sequence
  Description of Artificial Sequence: Synthetic oligonucleotide
taaagtagattctataattta

SEQ ID NO: 7337 - DNA, 21 bp, Artificial Sequence
  Description of Artificial Sequence: Synthetic oligonucleotide
attatagaatctactttaatt

SEQ ID NO: 7338 - DNA, 21 bp, Artificial Sequence
  Description of Artificial Sequence: Synthetic oligonucleotide
ttaaagtagattctataattt

SEQ ID NO: 7339 - DNA, 21 bp, Artificial Sequence
  Description of Artificial Sequence: Synthetic oligonucleotide
ttatagaatctactttaattt

SEQ ID NO: 7340 - DNA, 21 bp, Artificial Sequence
  Description of Artificial Sequence: Synthetic oligonucleotide
attaaagtagattctataatt

SEQ ID NO: 7341 - DNA, 21 bp, Artificial Sequence
  Description of Artificial Sequence: Synthetic oligonucleotide
tatagaatctactttaattta

SEQ ID NO: 7342 - DNA, 21 bp, Artificial Sequence
  Description of Artificial Sequence: Synthetic oligonucleotide
aattaaagtagattctataat

SEQ ID NO: 7343 - DNA, 21 bp, Artificial Sequence
  Description of Artificial Sequence: Synthetic oligonucleotide
atagaatctactttaatttat

SEQ ID NO: 7344 - DNA, 21 bp, Artificial Sequence
  Description of Artificial Sequence: Synthetic oligonucleotide
aaattaaagtagattctataa

SEQ ID NO: 7345 - DNA, 21 bp, Artificial Sequence
  Description of Artificial Sequence: Synthetic oligonucleotide
tagaatctactttaatttatt

SEQ ID NO: 7346 - DNA, 21 bp, Artificial Sequence
  Description of Artificial Sequence: Synthetic oligonucleotide
taaattaaagtagattctata

SEQ ID NO: 7347 - DNA, 21 bp, Artificial Sequence
  Description of Artificial Sequence: Synthetic oligonucleotide
agaatctactttaatttattt

SEQ ID NO: 7348 - DNA, 21 bp, Artificial Sequence
  Description of Artificial Sequence: Synthetic oligonucleotide
ataaattaaagtagattctat

SEQ ID NO: 7349 - DNA, 21 bp, Artificial Sequence
  Description of Artificial Sequence: Synthetic oligonucleotide
gaatctactttaatttatttt

SEQ ID NO: 7350 - DNA, 21 bp, Artificial Sequence
  Description of Artificial Sequence: Synthetic oligonucleotide
aataaattaaagtagattcta

SEQ ID NO: 7351 - DNA, 21 bp, Artificial Sequence
  Description of Artificial Sequence: Synthetic oligonucleotide
aatctactttaatttattttg

SEQ ID NO: 7352 - DNA, 21 bp, Artificial Sequence
  Description of Artificial Sequence: Synthetic oligonucleotide
aaataaattaaagtagattct

SEQ ID NO: 7353 - DNA, 21 bp, Artificial Sequence
  Description of Artificial Sequence: Synthetic oligonucleotide
atctactttaatttattttgt

SEQ ID NO: 7354 - DNA, 21 bp, Artificial Sequence
  Description of Artificial Sequence: Synthetic oligonucleotide
aaaataaattaaagtagattc

SEQ ID NO: 7355 - DNA, 21 bp, Artificial Sequence
  Description of Artificial Sequence: Synthetic oligonucleotide
tctactttaatttattttgtg

SEQ ID NO: 7356 - DNA, 21 bp, Artificial Sequence
  Description of Artificial Sequence: Synthetic oligonucleotide
caaaataaattaaagtagatt

SEQ ID NO: 7357 - DNA, 21 bp, Artificial Sequence
  Description of Artificial Sequence: Synthetic oligonucleotide
ctactttaatttattttgtga

SEQ ID NO: 7358 - DNA, 21 bp, Artificial Sequence
  Description of Artificial Sequence: Synthetic oligonucleotide
acaaaataaattaaagtagat

SEQ ID NO: 7359 - DNA, 21 bp, Artificial Sequence
  Description of Artificial Sequence: Synthetic oligonucleotide
tactttaatttattttgtgaa

SEQ ID NO: 7360 - DNA, 21 bp, Artificial Sequence
  Description of Artificial Sequence: Synthetic oligonucleotide
cacaaaataaattaaagtaga

SEQ ID NO: 7361 - DNA, 21 bp, Artificial Sequence
  Description of Artificial Sequence: Synthetic oligonucleotide
actttaatttattttgtgaac

SEQ ID NO: 7362 - DNA, 21 bp, Artificial Sequence
  Description of Artificial Sequence: Synthetic oligonucleotide
tcacaaaataaattaaagtag

SEQ ID NO: 7363 - DNA, 21 bp, Artificial Sequence
  Description of Artificial Sequence: Synthetic oligonucleotide
ctttaatttattttgtgaaca

SEQ ID NO: 7364 - DNA, 21 bp, Artificial Sequence
  Description of Artificial Sequence: Synthetic oligonucleotide
ttcacaaaataaattaaagta

SEQ ID NO: 7365 - DNA, 21 bp, Artificial Sequence
  Description of Artificial Sequence: Synthetic oligonucleotide
tttaatttattttgtgaacac

SEQ ID NO: 7366 - DNA, 21 bp, Artificial Sequence
  Description of Artificial Sequence: Synthetic oligonucleotide
gttcacaaaataaattaaagt

SEQ ID NO: 7367 - DNA, 21 bp, Artificial Sequence
  Description of Artificial Sequence: Synthetic oligonucleotide
ttaatttattttgtgaacact

SEQ ID NO: 7368 - DNA, 21 bp, Artificial Sequence
  Description of Artificial Sequence: Synthetic oligonucleotide
tgttcacaaaataaattaaag

SEQ ID NO: 7369 - DNA, 21 bp, Artificial Sequence
  Description of Artificial Sequence: Synthetic oligonucleotide
taatttattttgtgaacactt

SEQ ID NO: 7370 - DNA, 21 bp, Artificial Sequence
  Description of Artificial Sequence: Synthetic oligonucleotide
gtgttcacaaaataaattaaa

SEQ ID NO: 7371 - DNA, 21 bp, Artificial Sequence
  Description of Artificial Sequence: Synthetic oligonucleotide
aatttattttgtgaacacttt

SEQ ID NO: 7372 - DNA, 21 bp, Artificial Sequence
  Description of Artificial Sequence: Synthetic oligonucleotide
agtgttcacaaaataaattaa

SEQ ID NO: 7373 - DNA, 21 bp, Artificial Sequence
  Description of Artificial Sequence: Synthetic oligonucleotide
atttattttgtgaacactttt

SEQ ID NO: 7374 - DNA, 21 bp, Artificial Sequence
  Description of Artificial Sequence: Synthetic oligonucleotide
aagtgttcacaaaataaatta

SEQ ID NO: 7375 - DNA, 21 bp, Artificial Sequence
  Description of Artificial Sequence: Synthetic oligonucleotide
tttattttgtgaacacttttg

SEQ ID NO: 7376 - DNA, 21 bp, Artificial Sequence
  Description of Artificial Sequence: Synthetic oligonucleotide
aaagtgttcacaaaataaatt

SEQ ID NO: 7377 - DNA, 21 bp, Artificial Sequence
  Description of Artificial Sequence: Synthetic oligonucleotide
ttattttgtgaacacttttga

SEQ ID NO: 7378 - DNA, 21 bp, Artificial Sequence
  Description of Artificial Sequence: Synthetic oligonucleotide
aaaagtgttcacaaaataaat

SEQ ID NO: 7379 - DNA, 21 bp, Artificial Sequence
  Description of Artificial Sequence: Synthetic oligonucleotide
tattttgtgaacacttttgaa

SEQ ID NO: 7380 - DNA, 21 bp, Artificial Sequence
  Description of Artificial Sequence: Synthetic oligonucleotide
caaaagtgttcacaaaataaa

SEQ ID NO: 7381 - DNA, 21 bp, Artificial Sequence
  Description of Artificial Sequence: Synthetic oligonucleotide
attttgtgaacacttttgaaa

SEQ ID NO: 7382 - DNA, 21 bp, Artificial Sequence
  Description of Artificial Sequence: Synthetic oligonucleotide
tcaaaagtgttcacaaaataa

SEQ ID NO: 7383 - DNA, 21 bp, Artificial Sequence
  Description of Artificial Sequence: Synthetic oligonucleotide
ttttgtgaacacttttgaaaa

SEQ ID NO: 7384 - DNA, 21 bp, Artificial Sequence
  Description of Artificial Sequence: Synthetic oligonucleotide
ttcaaaagtgttcacaaaata

SEQ ID NO: 7385 - DNA, 21 bp, Artificial Sequence
  Description of Artificial Sequence: Synthetic oligonucleotide
tttgtgaacacttttgaaaat

SEQ ID NO: 7386 - DNA, 21 bp, Artificial Sequence
  Description of Artificial Sequence: Synthetic oligonucleotide
tttcaaaagtgttcacaaaat

SEQ ID NO: 7387 - DNA, 21 bp, Artificial Sequence
  Description of Artificial Sequence: Synthetic oligonucleotide
ttgtgaacacttttgaaaatg

SEQ ID NO: 7388 - DNA, 21 bp, Artificial Sequence
  Description of Artificial Sequence: Synthetic oligonucleotide
ttttcaaaagtgttcacaaaa

SEQ ID NO: 7389 - DNA, 21 bp, Artificial Sequence
  Description of Artificial Sequence: Synthetic oligonucleotide
tgtgaacacttttgaaaatgt

SEQ ID NO: 7390 - DNA, 21 bp, Artificial Sequence
  Description of Artificial Sequence: Synthetic oligonucleotide
attttcaaaagtgttcacaaa

SEQ ID NO: 7391 - DNA, 21 bp, Artificial Sequence
  Description of Artificial Sequence: Synthetic oligonucleotide
gtgaacacttttgaaaatgta

SEQ ID NO: 7392 - DNA, 21 bp, Artificial Sequence
  Description of Artificial Sequence: Synthetic oligonucleotide
cattttcaaaagtgttcacaa

SEQ ID NO: 7393 - DNA, 21 bp, Artificial Sequence
  Description of Artificial Sequence: Synthetic oligonucleotide
tgaacacttttgaaaatgtac

SEQ ID NO: 7394 - DNA, 21 bp, Artificial Sequence
  Description of Artificial Sequence: Synthetic oligonucleotide
acattttcaaaagtgttcaca

SEQ ID NO: 7395 - DNA, 21 bp, Artificial Sequence
  Description of Artificial Sequence: Synthetic oligonucleotide
gaacacttttgaaaatgtaca

SEQ ID NO: 7396 - DNA, 21 bp, Artificial Sequence
  Description of Artificial Sequence: Synthetic oligonucleotide
tacattttcaaaagtgttcac

SEQ ID NO: 7397 - DNA, 21 bp, Artificial Sequence
  Description of Artificial Sequence: Synthetic oligonucleotide
aacacttttgaaaatgtacat

SEQ ID NO: 7398 - DNA, 21 bp, Artificial Sequence
  Description of Artificial Sequence: Synthetic oligonucleotide
gtacattttcaaaagtgttca

SEQ ID NO: 7399 - DNA, 21 bp, Artificial Sequence
  Description of Artificial Sequence: Synthetic oligonucleotide
acacttttgaaaatgtacatg

SEQ ID NO: 7400 - DNA, 21 bp, Artificial Sequence
  Description of Artificial Sequence: Synthetic oligonucleotide
tgtacattttcaaaagtgttc

SEQ ID NO: 7401 - DNA, 21 bp, Artificial Sequence
  Description of Artificial Sequence: Synthetic oligonucleotide
cacttttgaaaatgtacatgt

SEQ ID NO: 7402 - DNA, 21 bp, Artificial Sequence
  Description of Artificial Sequence: Synthetic oligonucleotide
atgtacattttcaaaagtgtt

SEQ ID NO: 7403 - DNA, 21 bp, Artificial Sequence
  Description of Artificial Sequence: Synthetic oligonucleotide
acttttgaaaatgtacatgtt

SEQ ID NO: 7404 - DNA, 21 bp, Artificial Sequence
  Description of Artificial Sequence: Synthetic oligonucleotide
catgtacattttcaaaagtgt

SEQ ID NO: 7405 - DNA, 21 bp, Artificial Sequence
  Description of Artificial Sequence: Synthetic oligonucleotide
cttttgaaaatgtacatgttc

SEQ ID NO: 7406 - DNA, 21 bp, Artificial Sequence
  Description of Artificial Sequence: Synthetic oligonucleotide
acatgtacattttcaaaagtg

SEQ ID NO: 7407 - DNA, 21 bp, Artificial Sequence
  Description of Artificial Sequence: Synthetic oligonucleotide
ttttgaaaatgtacatgttcc

SEQ ID NO: 7408 - DNA, 21 bp, Artificial Sequence
  Description of Artificial Sequence: Synthetic oligonucleotide
aacatgtacattttcaaaagt

SEQ ID NO: 7409 - DNA, 21 bp, Artificial Sequence
  Description of Artificial Sequence: Synthetic oligonucleotide
tttgaaaatgtacatgttcct

SEQ ID NO: 7410 - DNA, 21 bp, Artificial Sequence
  Description of Artificial Sequence: Synthetic oligonucleotide
gaacatgtacattttcaaaag

SEQ ID NO: 7411 - DNA, 21 bp, Artificial Sequence
  Description of Artificial Sequence: Synthetic oligonucleotide
ttgaaaatgtacatgttcctt

SEQ ID NO: 7412 - DNA, 21 bp, Artificial Sequence
  Description of Artificial Sequence: Synthetic oligonucleotide
ggaacatgtacattttcaaaa

SEQ ID NO: 7413 - DNA, 21 bp, Artificial Sequence
  Description of Artificial Sequence: Synthetic oligonucleotide
tgaaaatgtacatgttccttt

SEQ ID NO: 7414 - DNA, 21 bp, Artificial Sequence
  Description of Artificial Sequence: Synthetic oligonucleotide
aggaacatgtacattttcaaa

SEQ ID NO: 7415 - DNA, 21 bp, Artificial Sequence
  Description of Artificial Sequence: Synthetic oligonucleotide
gaaaatgtacatgttcctttg

SEQ ID NO: 7416 - DNA, 21 bp, Artificial Sequence
  Description of Artificial Sequence: Synthetic oligonucleotide
aaggaacatgtacattttcaa

SEQ ID NO: 7417 - DNA, 21 bp, Artificial Sequence
  Description of Artificial Sequence: Synthetic oligonucleotide
aaaatgtacatgttcctttgt

SEQ ID NO: 7418 - DNA, 21 bp, Artificial Sequence
  Description of Artificial Sequence: Synthetic oligonucleotide
aaaggaacatgtacattttca

SEQ ID NO: 7419 - DNA, 21 bp, Artificial Sequence
  Description of Artificial Sequence: Synthetic oligonucleotide
aaatgtacatgttcctttgta

SEQ ID NO: 7420 - DNA, 21 bp, Artificial Sequence
  Description of Artificial Sequence: Synthetic oligonucleotide
caaaggaacatgtacattttc

SEQ ID NO: 7421 - DNA, 21 bp, Artificial Sequence
  Description of Artificial Sequence: Synthetic oligonucleotide
aatgtacatgttcctttgtaa

SEQ ID NO: 7422 - DNA, 21 bp, Artificial Sequence
  Description of Artificial Sequence: Synthetic oligonucleotide
acaaaggaacatgtacatttt

SEQ ID NO: 7423 - DNA, 21 bp, Artificial Sequence
  Description of Artificial Sequence: Synthetic oligonucleotide
atgtacatgttcctttgtaat

SEQ ID NO: 7424 - DNA, 21 bp, Artificial Sequence
  Description of Artificial Sequence: Synthetic oligonucleotide
tacaaaggaacatgtacattt

SEQ ID NO: 7425 - DNA, 21 bp, Artificial Sequence
  Description of Artificial Sequence: Synthetic oligonucleotide
tgtacatgttcctttgtaatt

SEQ ID NO: 7426 - DNA, 21 bp, Artificial Sequence
  Description of Artificial Sequence: Synthetic oligonucleotide
ttacaaaggaacatgtacatt

SEQ ID NO: 7427 - DNA, 21 bp, Artificial Sequence
  Description of Artificial Sequence: Synthetic oligonucleotide
gtacatgttcctttgtaattg

SEQ ID NO: 7428 - DNA, 21 bp, Artificial Sequence
  Description of Artificial Sequence: Synthetic oligonucleotide
attacaaaggaacatgtacat

SEQ ID NO: 7429 - DNA, 21 bp, Artificial Sequence
  Description of Artificial Sequence: Synthetic oligonucleotide
tacatgttcctttgtaattga

SEQ ID NO: 7430 - DNA, 21 bp, Artificial Sequence
  Description of Artificial Sequence: Synthetic oligonucleotide
aattacaaaggaacatgtaca

SEQ ID NO: 7431 - DNA, 21 bp, Artificial Sequence
  Description of Artificial Sequence: Synthetic oligonucleotide
acatgttcctttgtaattgac

SEQ ID NO: 7432 - DNA, 21 bp, Artificial Sequence
  Description of Artificial Sequence: Synthetic oligonucleotide
caattacaaaggaacatgtac

SEQ ID NO: 7433 - DNA, 21 bp, Artificial Sequence
  Description of Artificial Sequence: Synthetic oligonucleotide
catgttcctttgtaattgaca

SEQ ID NO: 7434 - DNA, 21 bp, Artificial Sequence
  Description of Artificial Sequence: Synthetic oligonucleotide
tcaattacaaaggaacatgta

SEQ ID NO: 7435 - DNA, 21 bp, Artificial Sequence
  Description of Artificial Sequence: Synthetic oligonucleotide
atgttcctttgtaattgacac

SEQ ID NO: 7436 - DNA, 21 bp, Artificial Sequence
  Description of Artificial Sequence: Synthetic oligonucleotide
gtcaattacaaaggaacatgt

SEQ ID NO: 7437 - DNA, 21 bp, Artificial Sequence
  Description of Artificial Sequence: Synthetic oligonucleotide
tgttcctttgtaattgacact

SEQ ID NO: 7438 - DNA, 21 bp, Artificial Sequence
  Description of Artificial Sequence: Synthetic oligonucleotide
tgtcaattacaaaggaacatg

SEQ ID NO: 7439 - DNA, 21 bp, Artificial Sequence
  Description of Artificial Sequence: Synthetic oligonucleotide
gttcctttgtaattgacacta

SEQ ID NO: 7440 - DNA, 21 bp, Artificial Sequence
  Description of Artificial Sequence: Synthetic oligonucleotide
gtgtcaattacaaaggaacat

SEQ ID NO: 7441 - DNA, 21 bp, Artificial Sequence
  Description of Artificial Sequence: Synthetic oligonucleotide
ttcctttgtaattgacactat

SEQ ID NO: 7442 - DNA, 21 bp, Artificial Sequence
  Description of Artificial Sequence: Synthetic oligonucleotide
agtgtcaattacaaaggaaca

SEQ ID NO: 7443 - DNA, 21 bp, Artificial Sequence
  Description of Artificial Sequence: Synthetic oligonucleotide
tcctttgtaattgacactata

SEQ ID NO: 7444 - DNA, 21 bp, Artificial Sequence
  Description of Artificial Sequence: Synthetic oligonucleotide
tagtgtcaattacaaaggaac

SEQ ID NO: 7445 - DNA, 21 bp, Artificial Sequence
  Description of Artificial Sequence: Synthetic oligonucleotide
cctttgtaattgacactatat

SEQ ID NO: 7446 - DNA, 21 bp, Artificial Sequence
  Description of Artificial Sequence: Synthetic oligonucleotide
atagtgtcaattacaaaggaa

SEQ ID NO: 7447 - DNA, 21 bp, Artificial Sequence
  Description of Artificial Sequence: Synthetic oligonucleotide
ctttgtaattgacactatata

SEQ ID NO: 7448 - DNA, 21 bp, Artificial Sequence
  Description of Artificial Sequence: Synthetic oligonucleotide
tatagtgtcaattacaaagga

SEQ ID NO: 7449 - DNA, 21 bp, Artificial Sequence
  Description of Artificial Sequence: Synthetic oligonucleotide
tttgtaattgacactatatat

SEQ ID NO: 7450 - DNA, 21 bp, Artificial Sequence
  Description of Artificial Sequence: Synthetic oligonucleotide
atatagtgtcaattacaaagg

SEQ ID NO: 7451 - DNA, 21 bp, Artificial Sequence
  Description of Artificial Sequence: Synthetic oligonucleotide
ttgtaattgacactatatatt

SEQ ID NO: 7452 - DNA, 21 bp, Artificial Sequence
  Description of Artificial Sequence: Synthetic oligonucleotide
tatatagtgtcaattacaaag

SEQ ID NO: 7453 - DNA, 21 bp, Artificial Sequence
  Description of Artificial Sequence: Synthetic oligonucleotide
tgtaattgacactatatattt

SEQ ID NO: 7454 - DNA, 21 bp, Artificial Sequence
  Description of Artificial Sequence: Synthetic oligonucleotide
atatatagtgtcaattacaaa

SEQ ID NO: 7455 - DNA, 21 bp, Artificial Sequence
  Description of Artificial Sequence: Synthetic oligonucleotide
gtaattgacactatatatttc

SEQ ID NO: 7456 - DNA, 21 bp, Artificial Sequence
  Description of Artificial Sequence: Synthetic oligonucleotide
aatatatagtgtcaattacaa

SEQ ID NO: 7457 - DNA, 21 bp, Artificial Sequence
  Description of Artificial Sequence: Synthetic oligonucleotide
taattgacactatatatttct

SEQ ID NO: 7458 - DNA, 21 bp, Artificial Sequence
  Description of Artificial Sequence: Synthetic oligonucleotide
aaatatatagtgtcaattaca

SEQ ID NO: 7459 - DNA, 21 bp, Artificial Sequence
  Description of Artificial Sequence: Synthetic oligonucleotide
aattgacactatatatttctt

SEQ ID NO: 7460 - DNA, 21 bp, Artificial Sequence
  Description of Artificial Sequence: Synthetic oligonucleotide
gaaatatatagtgtcaattac

SEQ ID NO: 7461 - DNA, 21 bp, Artificial Sequence
  Description of Artificial Sequence: Synthetic oligonucleotide
attgacactatatatttctta

SEQ ID NO: 7462 - DNA, 21 bp, Artificial Sequence
  Description of Artificial Sequence: Synthetic oligonucleotide
agaaatatatagtgtcaatta

SEQ ID NO: 7463 - DNA, 21 bp, Artificial Sequence
  Description of Artificial Sequence: Synthetic oligonucleotide
ttgacactatatatttcttaa

SEQ ID NO: 7464 - DNA, 21 bp, Artificial Sequence
  Description of Artificial Sequence: Synthetic oligonucleotide
aagaaatatatagtgtcaatt

SEQ ID NO: 7465 - DNA, 21 bp, Artificial Sequence
  Description of Artificial Sequence: Synthetic oligonucleotide
tgacactatatatttcttaat

SEQ ID NO: 7466 - DNA, 21 bp, Artificial Sequence
  Description of Artificial Sequence: Synthetic oligonucleotide
taagaaatatatagtgtcaat

SEQ ID NO: 7467 - DNA, 21 bp, Artificial Sequence
  Description of Artificial Sequence: Synthetic oligonucleotide
gacactatatatttcttaata

SEQ ID NO: 7468 - DNA, 21 bp, Artificial Sequence
  Description of Artificial Sequence: Synthetic oligonucleotide
ttaagaaatatatagtgtcaa

SEQ ID NO: 7469 - DNA, 21 bp, Artificial Sequence
  Description of Artificial Sequence: Synthetic oligonucleotide
acactatatatttcttaataa

SEQ ID NO: 7470 - DNA, 21 bp, Artificial Sequence
  Description of Artificial Sequence: Synthetic oligonucleotide
attaagaaatatatagtgtca

SEQ ID NO: 7471 - DNA, 21 bp, Artificial Sequence
  Description of Artificial Sequence: Synthetic oligonucleotide
cactatatatttcttaataaa

SEQ ID NO: 7472 - DNA, 21 bp, Artificial Sequence
  Description of Artificial Sequence: Synthetic oligonucleotide
tattaagaaatatatagtgtc

SEQ ID NO: 7473 - DNA, 21 bp, Artificial Sequence
  Description of Artificial Sequence: Synthetic oligonucleotide
actatatatttcttaataaaa

SEQ ID NO: 7474 - DNA, 21 bp, Artificial Sequence
  Description of Artificial Sequence: Synthetic oligonucleotide
ttattaagaaatatatagtgt

SEQ ID NO: 7475 - DNA, 21 bp, Artificial Sequence
  Description of Artificial Sequence: Synthetic oligonucleotide
ctatatatttcttaataaaat

SEQ ID NO: 7476 - DNA, 21 bp, Artificial Sequence
  Description of Artificial Sequence: Synthetic oligonucleotide
tttattaagaaatatatagtg

SEQ ID NO: 7477 - DNA, 21 bp, Artificial Sequence
  Description of Artificial Sequence: Synthetic oligonucleotide
tatatatttcttaataaaata

SEQ ID NO: 7478 - DNA, 21 bp, Artificial Sequence
  Description of Artificial Sequence: Synthetic oligonucleotide
ttttattaagaaatatatagt

SEQ ID NO: 7479 - DNA, 21 bp, Artificial Sequence
  Description of Artificial Sequence: Synthetic oligonucleotide
atatatttcttaataaaataa

SEQ ID NO: 7480 - DNA, 21 bp, Artificial Sequence
  Description of Artificial Sequence: Synthetic oligonucleotide
attttattaagaaatatatag

SEQ ID NO: 7481 - DNA, 21 bp, Artificial Sequence
  Description of Artificial Sequence: Synthetic oligonucleotide
tatatttcttaataaaataat

SEQ ID NO: 7482 - DNA, 21 bp, Artificial Sequence
  Description of Artificial Sequence: Synthetic oligonucleotide
tattttattaagaaatatata

SEQ ID NO: 7483 - DNA, 21 bp, Artificial Sequence
  Description of Artificial Sequence: Synthetic oligonucleotide
atatttcttaataaaataatt

SEQ ID NO: 7484 - DNA, 21 bp, Artificial Sequence
  Description of Artificial Sequence: Synthetic oligonucleotide
ttattttattaagaaatatat

SEQ ID NO: 7485 - DNA, 21 bp, Artificial Sequence
  Description of Artificial Sequence: Synthetic oligonucleotide
tatttcttaataaaataattc

SEQ ID NO: 7486 - DNA, 21 bp, Artificial Sequence
  Description of Artificial Sequence: Synthetic oligonucleotide
attattttattaagaaatata

SEQ ID NO: 7487 - DNA, 21 bp, Artificial Sequence
  Description of Artificial Sequence: Synthetic oligonucleotide
atttcttaataaaataattct

SEQ ID NO: 7488 - DNA, 21 bp, Artificial Sequence
  Description of Artificial Sequence: Synthetic oligonucleotide
aattattttattaagaaatat

SEQ ID NO: 7489 - DNA, 21 bp, Artificial Sequence
  Description of Artificial Sequence: Synthetic oligonucleotide
tttcttaataaaataattctc

SEQ ID NO: 7490 - DNA, 21 bp, Artificial Sequence
  Description of Artificial Sequence: Synthetic oligonucleotide
gaattattttattaagaaata

SEQ ID NO: 7491 - DNA, 21 bp, Artificial Sequence
  Description of Artificial Sequence: Synthetic oligonucleotide
ttcttaataaaataattctca

SEQ ID NO: 7492 - DNA, 21 bp, Artificial Sequence
  Description of Artificial Sequence: Synthetic oligonucleotide
agaattattttattaagaaat

SEQ ID NO: 7493 - DNA, 21 bp, Artificial Sequence
  Description of Artificial Sequence: Synthetic oligonucleotide
tcttaataaaataattctcaa

SEQ ID NO: 7494 - DNA, 21 bp, Artificial Sequence
  Description of Artificial Sequence: Synthetic oligonucleotide
gagaattattttattaagaaa

SEQ ID NO: 7495 - DNA, 21 bp, Artificial Sequence
  Description of Artificial Sequence: Synthetic oligonucleotide
cttaataaaataattctcaaa

SEQ ID NO: 7496 - DNA, 21 bp, Artificial Sequence
  Description of Artificial Sequence: Synthetic oligonucleotide
tgagaattattttattaagaa

SEQ ID NO: 7497 - DNA, 21 bp, Artificial Sequence
  Description of Artificial Sequence: Synthetic oligonucleotide
ttaataaaataattctcaaat

SEQ ID NO: 7498 - DNA, 21 bp, Artificial Sequence
  Description of Artificial Sequence: Synthetic oligonucleotide
ttgagaattattttattaaga

SEQ ID NO: 7499 - DNA, 21 bp, Artificial Sequence
  Description of Artificial Sequence: Synthetic oligonucleotide
taataaaataattctcaaatt

SEQ ID NO: 7500 - DNA, 21 bp, Artificial Sequence
  Description of Artificial Sequence: Synthetic oligonucleotide
tttgagaattattttattaag

SEQ ID NO: 7501 - DNA, 21 bp, Artificial Sequence
  Description of Artificial Sequence: Synthetic oligonucleotide
aataaaataattctcaaattt

SEQ ID NO: 7502 - DNA, 21 bp, Artificial Sequence
  Description of Artificial Sequence: Synthetic oligonucleotide
atttgagaattattttattaa

SEQ ID NO: 7503 - DNA, 21 bp, Artificial Sequence
  Description of Artificial Sequence: Synthetic oligonucleotide
ataaaataattctcaaatttg

SEQ ID NO: 7504 - DNA, 21 bp, Artificial Sequence
  Description of Artificial Sequence: Synthetic oligonucleotide
aatttgagaattattttatta

SEQ ID NO: 7505 - DNA, 21 bp, Artificial Sequence
  Description of Artificial Sequence: Synthetic oligonucleotide
taaaataattctcaaatttgt

SEQ ID NO: 7506 - DNA, 21 bp, Artificial Sequence
  Description of Artificial Sequence: Synthetic oligonucleotide
aaatttgagaattattttatt

SEQ ID NO: 7507 - DNA, 21 bp, Artificial Sequence
  Description of Artificial Sequence: Synthetic oligonucleotide
aaaataattctcaaatttgtt

SEQ ID NO: 7508 - DNA, 21 bp, Artificial Sequence
  Description of Artificial Sequence: Synthetic oligonucleotide
caaatttgagaattattttat

SEQ ID NO: 7509 - DNA, 21 bp, Artificial Sequence
  Description of Artificial Sequence: Synthetic oligonucleotide
aaataattctcaaatttgttt

SEQ ID NO: 7510 - DNA, 21 bp, Artificial Sequence
  Description of Artificial Sequence: Synthetic oligonucleotide
acaaatttgagaattatttta

SEQ ID NO: 7511 - DNA, 21 bp, Artificial Sequence
  Description of Artificial Sequence: Synthetic oligonucleotide
aataattctcaaatttgtttc

SEQ ID NO: 7512 - DNA, 21 bp, Artificial Sequence
  Description of Artificial Sequence: Synthetic oligonucleotide
aacaaatttgagaattatttt

SEQ ID NO: 7513 - DNA, 21 bp, Artificial Sequence
  Description of Artificial Sequence: Synthetic oligonucleotide
ataattctcaaatttgtttct

SEQ ID NO: 7514 - DNA, 21 bp, Artificial Sequence
  Description of Artificial Sequence: Synthetic oligonucleotide
aaacaaatttgagaattattt

SEQ ID NO: 7515 - DNA, 21 bp, Artificial Sequence
  Description of Artificial Sequence: Synthetic oligonucleotide
taattctcaaatttgtttctt

SEQ ID NO: 7516 - DNA, 21 bp, Artificial Sequence
  Description of Artificial Sequence: Synthetic oligonucleotide
gaaacaaatttgagaattatt

SEQ ID NO: 7517 - DNA, 21 bp, Artificial Sequence
  Description of Artificial Sequence: Synthetic oligonucleotide
aattctcaaatttgtttctta

SEQ ID NO: 7518 - DNA, 21 bp, Artificial Sequence
  Description of Artificial Sequence: Synthetic oligonucleotide
agaaacaaatttgagaattat

SEQ ID NO: 7519 - DNA, 21 bp, Artificial Sequence
  Description of Artificial Sequence: Synthetic oligonucleotide
attctcaaatttgtttcttat

SEQ ID NO: 7520 - DNA, 21 bp, Artificial Sequence
  Description of Artificial Sequence: Synthetic oligonucleotide
aagaaacaaatttgagaatta

SEQ ID NO: 7521 - DNA, 21 bp, Artificial Sequence
  Description of Artificial Sequence: Synthetic oligonucleotide
ttctcaaatttgtttcttatg

SEQ ID NO: 7522 - DNA, 21 bp, Artificial Sequence
  Description of Artificial Sequence: Synthetic oligonucleotide
taagaaacaaatttgagaatt

SEQ ID NO: 7523 - DNA, 21 bp, Artificial Sequence
  Description of Artificial Sequence: Synthetic oligonucleotide
tctcaaatttgtttcttatga

SEQ ID NO: 7524 - DNA, 21 bp, Artificial Sequence
  Description of Artificial Sequence: Synthetic oligonucleotide
ataagaaacaaatttgagaat

SEQ ID NO: 7525 - DNA, 21 bp, Artificial Sequence
  Description of Artificial Sequence: Synthetic oligonucleotide
ctcaaatttgtttcttatgaa

SEQ ID NO: 7526 - DNA, 21 bp, Artificial Sequence
  Description of Artificial Sequence: Synthetic oligonucleotide
cataagaaacaaatttgagaa

SEQ ID NO: 7527 - DNA, 21 bp, Artificial Sequence
  Description of Artificial Sequence: Synthetic oligonucleotide
tcaaatttgtttcttatgaat

SEQ ID NO: 7528 - DNA, 21 bp, Artificial Sequence
  Description of Artificial Sequence: Synthetic oligonucleotide
tcataagaaacaaatttgaga

SEQ ID NO: 7529 - DNA, 21 bp, Artificial Sequence
  Description of Artificial Sequence: Synthetic oligonucleotide
caaatttgtttcttatgaatc

SEQ ID NO: 7530 - DNA, 21 bp, Artificial Sequence
  Description of Artificial Sequence: Synthetic oligonucleotide
ttcataagaaacaaatttgag

SEQ ID NO: 7531 - DNA, 21 bp, Artificial Sequence
  Description of Artificial Sequence: Synthetic oligonucleotide
aaatttgtttcttatgaatca

SEQ ID NO: 7532 - DNA, 21 bp, Artificial Sequence
  Description of Artificial Sequence: Synthetic oligonucleotide
attcataagaaacaaatttga

SEQ ID NO: 7533 - DNA, 21 bp, Artificial Sequence
  Description of Artificial Sequence: Synthetic oligonucleotide
aatttgtttcttatgaatcat

SEQ ID NO: 7534 - DNA, 21 bp, Artificial Sequence
  Description of Artificial Sequence: Synthetic oligonucleotide
gattcataagaaacaaatttg

SEQ ID NO: 7535 - DNA, 21 bp, Artificial Sequence
  Description of Artificial Sequence: Synthetic oligonucleotide
atttgtttcttatgaatcatc

SEQ ID NO: 7536 - DNA, 21 bp, Artificial Sequence
  Description of Artificial Sequence: Synthetic oligonucleotide
tgattcataagaaacaaattt

SEQ ID NO: 7537 - DNA, 21 bp, Artificial Sequence
  Description of Artificial Sequence: Synthetic oligonucleotide
tttgtttcttatgaatcatct

SEQ ID NO: 7538 - DNA, 21 bp, Artificial Sequence
  Description of Artificial Sequence: Synthetic oligonucleotide
atgattcataagaaacaaatt

SEQ ID NO: 7539 - DNA, 21 bp, Artificial Sequence
  Description of Artificial Sequence: Synthetic oligonucleotide
ttgtttcttatgaatcatctc

SEQ ID NO: 7540 - DNA, 21 bp, Artificial Sequence
  Description of Artificial Sequence: Synthetic oligonucleotide
gatgattcataagaaacaaat

SEQ ID NO: 7541 - DNA, 21 bp, Artificial Sequence
  Description of Artificial Sequence: Synthetic oligonucleotide
tgtttcttatgaatcatctct

SEQ ID NO: 7542 - DNA, 21 bp, Artificial Sequence
  Description of Artificial Sequence: Synthetic oligonucleotide
agatgattcataagaaacaaa

SEQ ID NO: 7543 - DNA, 21 bp, Artificial Sequence
  Description of Artificial Sequence: Synthetic oligonucleotide
gtttcttatgaatcatctctc

SEQ ID NO: 7544 - DNA, 21 bp, Artificial Sequence
  Description of Artificial Sequence: Synthetic oligonucleotide
gagatgattcataagaaacaa

SEQ ID NO: 7545 - DNA, 21 bp, Artificial Sequence
  Description of Artificial Sequence: Synthetic oligonucleotide
tttcttatgaatcatctctca

SEQ ID NO: 7546 - DNA, 21 bp, Artificial Sequence
  Description of Artificial Sequence: Synthetic oligonucleotide
agagatgattcataagaaaca

SEQ ID NO: 7547 - DNA, 21 bp, Artificial Sequence
  Description of Artificial Sequence: Synthetic oligonucleotide
ttcttatgaatcatctctcaa

SEQ ID NO: 7548 - DNA, 21 bp, Artificial Sequence
  Description of Artificial Sequence: Synthetic oligonucleotide
gagagatgattcataagaaac

SEQ ID NO: 7549 - DNA, 21 bp, Artificial Sequence
  Description of Artificial Sequence: Synthetic oligonucleotide
tcttatgaatcatctctcaaa

SEQ ID NO: 7550 - DNA, 21 bp, Artificial Sequence
  Description of Artificial Sequence: Synthetic oligonucleotide
tgagagatgattcataagaaa

SEQ ID NO: 7551 - DNA, 21 bp, Artificial Sequence
  Description of Artificial Sequence: Synthetic oligonucleotide
cttatgaatcatctctcaaat

SEQ ID NO: 7552 - DNA, 21 bp, Artificial Sequence
  Description of Artificial Sequence: Synthetic oligonucleotide
ttgagagatgattcataagaa

SEQ ID NO: 7553 - DNA, 21 bp, Artificial Sequence
  Description of Artificial Sequence: Synthetic oligonucleotide
ttatgaatcatctctcaaatc

SEQ ID NO: 7554 - DNA, 21 bp, Artificial Sequence
  Description of Artificial Sequence: Synthetic oligonucleotide
tttgagagatgattcataaga

SEQ ID NO: 7555 - DNA, 21 bp, Artificial Sequence
  Description of Artificial Sequence: Synthetic oligonucleotide
tatgaatcatctctcaaatct

SEQ ID NO: 7556 - DNA, 21 bp, Artificial Sequence
  Description of Artificial Sequence: Synthetic oligonucleotide
atttgagagatgattcataag

SEQ ID NO: 7557 - DNA, 21 bp, Artificial Sequence
  Description of Artificial Sequence: Synthetic oligonucleotide
atgaatcatctctcaaatcta

SEQ ID NO: 7558 - DNA, 21 bp, Artificial Sequence
  Description of Artificial Sequence: Synthetic oligonucleotide
gatttgagagatgattcataa

SEQ ID NO: 7559 - DNA, 21 bp, Artificial Sequence
  Description of Artificial Sequence: Synthetic oligonucleotide
tgaatcatctctcaaatctag

SEQ ID NO: 7560 - DNA, 21 bp, Artificial Sequence
  Description of Artificial Sequence: Synthetic oligonucleotide
agatttgagagatgattcata

SEQ ID NO: 7561 - DNA, 21 bp, Artificial Sequence
  Description of Artificial Sequence: Synthetic oligonucleotide
gaatcatctctcaaatctagt

SEQ ID NO: 7562 - DNA, 21 bp, Artificial Sequence
  Description of Artificial Sequence: Synthetic oligonucleotide
tagatttgagagatgattcat

SEQ ID NO: 7563 - DNA, 21 bp, Artificial Sequence
  Description of Artificial Sequence: Synthetic oligonucleotide
aatcatctctcaaatctagtt

SEQ ID NO: 7564 - DNA, 21 bp, Artificial Sequence
  Description of Artificial Sequence: Synthetic oligonucleotide
ctagatttgagagatgattca

SEQ ID NO: 7565 - DNA, 21 bp, Artificial Sequence
  Description of Artificial Sequence: Synthetic oligonucleotide
atcatctctcaaatctagtta

SEQ ID NO: 7566 - DNA, 21 bp, Artificial Sequence
  Description of Artificial Sequence: Synthetic oligonucleotide
actagatttgagagatgattc

SEQ ID NO: 7567 - DNA, 21 bp, Artificial Sequence
  Description of Artificial Sequence: Synthetic oligonucleotide
tcatctctcaaatctagttag

SEQ ID NO: 7568 - DNA, 21 bp, Artificial Sequence
  Description of Artificial Sequence: Synthetic oligonucleotide
aactagatttgagagatgatt

SEQ ID NO: 7569 - DNA, 21 bp, Artificial Sequence
  Description of Artificial Sequence: Synthetic oligonucleotide
catctctcaaatctagttaga

SEQ ID NO: 7570 - DNA, 21 bp, Artificial Sequence
  Description of Artificial Sequence: Synthetic oligonucleotide
taactagatttgagagatgat

SEQ ID NO: 7571 - DNA, 21 bp, Artificial Sequence
  Description of Artificial Sequence: Synthetic oligonucleotide
atctctcaaatctagttagac

SEQ ID NO: 7572 - DNA, 21 bp, Artificial Sequence
  Description of Artificial Sequence: Synthetic oligonucleotide
ctaactagatttgagagatga

SEQ ID NO: 7573 - DNA, 21 bp, Artificial Sequence
  Description of Artificial Sequence: Synthetic oligonucleotide
tctctcaaatctagttagaca

SEQ ID NO: 7574 - DNA, 21 bp, Artificial Sequence
  Description of Artificial Sequence: Synthetic oligonucleotide
tctaactagatttgagagatg

SEQ ID NO: 7575 - DNA, 21 bp, Artificial Sequence
  Description of Artificial Sequence: Synthetic oligonucleotide
ctctcaaatctagttagacaa

SEQ ID NO: 7576 - DNA, 21 bp, Artificial Sequence
  Description of Artificial Sequence: Synthetic oligonucleotide
gtctaactagatttgagagat

SEQ ID NO: 7577 - DNA, 21 bp, Artificial Sequence
  Description of Artificial Sequence: Synthetic oligonucleotide
tctcaaatctagttagacaat

SEQ ID NO: 7578 - DNA, 21 bp, Artificial Sequence
  Description of Artificial Sequence: Synthetic oligonucleotide
tgtctaactagatttgagaga

SEQ ID NO: 7579 - DNA, 21 bp, Artificial Sequence
  Description of Artificial Sequence: Synthetic oligonucleotide
ctcaaatctagttagacaatt

SEQ ID NO: 7580 - DNA, 21 bp, Artificial Sequence
  Description of Artificial Sequence: Synthetic oligonucleotide
ttgtctaactagatttgagag

SEQ ID NO: 7581 - DNA, 21 bp, Artificial Sequence
  Description of Artificial Sequence: Synthetic oligonucleotide
tcaaatctagttagacaattt

SEQ ID NO: 7582 - DNA, 21 bp, Artificial Sequence
  Description of Artificial Sequence: Synthetic oligonucleotide
attgtctaactagatttgaga

SEQ ID NO: 7583 - DNA, 21 bp, Artificial Sequence
  Description of Artificial Sequence: Synthetic oligonucleotide
caaatctagttagacaatttg

SEQ ID NO: 7584 - DNA, 21 bp, Artificial Sequence
  Description of Artificial Sequence: Synthetic oligonucleotide
aattgtctaactagatttgag

SEQ ID NO: 7585 - DNA, 21 bp, Artificial Sequence
  Description of Artificial Sequence: Synthetic oligonucleotide
aaatctagttagacaatttgc

SEQ ID NO: 7586 - DNA, 21 bp, Artificial Sequence
  Description of Artificial Sequence: Synthetic oligonucleotide
aaattgtctaactagatttga

SEQ ID NO: 7587 - DNA, 21 bp, Artificial Sequence
  Description of Artificial Sequence: Synthetic oligonucleotide
aatctagttagacaatttgca

SEQ ID NO: 7588 - DNA, 21 bp, Artificial Sequence
  Description of Artificial Sequence: Synthetic oligonucleotide
caaattgtctaactagatttg

SEQ ID NO: 7589 - DNA, 21 bp, Artificial Sequence
  Description of Artificial Sequence: Synthetic oligonucleotide
atctagttagacaatttgcac

SEQ ID NO: 7590 - DNA, 21 bp, Artificial Sequence
  Description of Artificial Sequence: Synthetic oligonucleotide
gcaaattgtctaactagattt

SEQ ID NO: 7591 - DNA, 21 bp, Artificial Sequence
  Description of Artificial Sequence: Synthetic oligonucleotide
tctagttagacaatttgcaca

SEQ ID NO: 7592 - DNA, 21 bp, Artificial Sequence
  Description of Artificial Sequence: Synthetic oligonucleotide
tgcaaattgtctaactagatt

SEQ ID NO: 7593 - DNA, 21 bp, Artificial Sequence
  Description of Artificial Sequence: Synthetic oligonucleotide
ctagttagacaatttgcacac

SEQ ID NO: 7594 - DNA, 21 bp, Artificial Sequence
  Description of Artificial Sequence: Synthetic oligonucleotide
gtgcaaattgtctaactagat

SEQ ID NO: 7595 - DNA, 21 bp, Artificial Sequence
  Description of Artificial Sequence: Synthetic oligonucleotide
tagttagacaatttgcacaca

SEQ ID NO: 7596 - DNA, 21 bp, Artificial Sequence
  Description of Artificial Sequence: Synthetic oligonucleotide
tgtgcaaattgtctaactaga

SEQ ID NO: 7597 - DNA, 21 bp, Artificial Sequence
  Description of Artificial Sequence: Synthetic oligonucleotide
agttagacaatttgcacacat

SEQ ID NO: 7598 - DNA, 21 bp, Artificial Sequence
  Description of Artificial Sequence: Synthetic oligonucleotide
gtgtgcaaattgtctaactag

SEQ ID NO: 7599 - DNA, 21 bp, Artificial Sequence
  Description of Artificial Sequence: Synthetic oligonucleotide
gttagacaatttgcacacata

SEQ ID NO: 7600 - DNA, 21 bp, Artificial Sequence
  Description of Artificial Sequence: Synthetic oligonucleotide
tgtgtgcaaattgtctaacta

SEQ ID NO: 7601 - DNA, 21 bp, Artificial Sequence
  Description of Artificial Sequence: Synthetic oligonucleotide
ttagacaatttgcacacatac

SEQ ID NO: 7602 - DNA, 21 bp, Artificial Sequence
  Description of Artificial Sequence: Synthetic oligonucleotide
atgtgtgcaaattgtctaact

SEQ ID NO: 7603 - DNA, 21 bp, Artificial Sequence
  Description of Artificial Sequence: Synthetic oligonucleotide
tagacaatttgcacacatact

SEQ ID NO: 7604 - DNA, 21 bp, Artificial Sequence
  Description of Artificial Sequence: Synthetic oligonucleotide
tatgtgtgcaaattgtctaac

SEQ ID NO: 7605 - DNA, 21 bp, Artificial Sequence
  Description of Artificial Sequence: Synthetic oligonucleotide
agacaatttgcacacatactt

SEQ ID NO: 7606 - DNA, 21 bp, Artificial Sequence
  Description of Artificial Sequence: Synthetic oligonucleotide
gtatgtgtgcaaattgtctaa

SEQ ID NO: 7607 - DNA, 21 bp, Artificial Sequence
  Description of Artificial Sequence: Synthetic oligonucleotide
gacaatttgcacacatacttt

SEQ ID NO: 7608 - DNA, 21 bp, Artificial Sequence
  Description of Artificial Sequence: Synthetic oligonucleotide
agtatgtgtgcaaattgtcta

SEQ ID NO: 7609 - DNA, 21 bp, Artificial Sequence
  Description of Artificial Sequence: Synthetic oligonucleotide
acaatttgcacacatactttt

SEQ ID NO: 7610 - DNA, 21 bp, Artificial Sequence
  Description of Artificial Sequence: Synthetic oligonucleotide
aagtatgtgtgcaaattgtct

SEQ ID NO: 7611 - DNA, 21 bp, Artificial Sequence
  Description of Artificial Sequence: Synthetic oligonucleotide
caatttgcacacatacttttc

SEQ ID NO: 7612 - DNA, 21 bp, Artificial Sequence
  Description of Artificial Sequence: Synthetic oligonucleotide
aaagtatgtgtgcaaattgtc

SEQ ID NO: 7613 - DNA, 21 bp, Artificial Sequence
  Description of Artificial Sequence: Synthetic oligonucleotide
aatttgcacacatacttttct

SEQ ID NO: 7614 - DNA, 21 bp, Artificial Sequence
  Description of Artificial Sequence: Synthetic oligonucleotide
aaaagtatgtgtgcaaattgt

SEQ ID NO: 7615 - DNA, 21 bp, Artificial Sequence
  Description of Artificial Sequence: Synthetic oligonucleotide
atttgcacacatacttttcta

SEQ ID NO: 7616 - DNA, 21 bp, Artificial Sequence
  Description of Artificial Sequence: Synthetic oligonucleotide
gaaaagtatgtgtgcaaattg

SEQ ID NO: 7617 - DNA, 21 bp, Artificial Sequence
  Description of Artificial Sequence: Synthetic oligonucleotide
tttgcacacatacttttctaa

SEQ ID NO: 7618 - DNA, 21 bp, Artificial Sequence
  Description of Artificial Sequence: Synthetic oligonucleotide
agaaaagtatgtgtgcaaatt

SEQ ID NO: 7619 - DNA, 21 bp, Artificial Sequence
  Description of Artificial Sequence: Synthetic oligonucleotide
ttgcacacatacttttctaag

SEQ ID NO: 7620 - DNA, 21 bp, Artificial Sequence
  Description of Artificial Sequence: Synthetic oligonucleotide
tagaaaagtatgtgtgcaaat

SEQ ID NO: 7621 - DNA, 21 bp, Artificial Sequence
  Description of Artificial Sequence: Synthetic oligonucleotide
tgcacacatacttttctaagg

SEQ ID NO: 7622 - DNA, 21 bp, Artificial Sequence
  Description of Artificial Sequence: Synthetic oligonucleotide
ttagaaaagtatgtgtgcaaa

SEQ ID NO: 7623 - DNA, 21 bp, Artificial Sequence
  Description of Artificial Sequence: Synthetic oligonucleotide
gcacacatacttttctaaggg

SEQ ID NO: 7624 - DNA, 21 bp, Artificial Sequence
  Description of Artificial Sequence: Synthetic oligonucleotide
cttagaaaagtatgtgtgcaa

SEQ ID NO: 7625 - DNA, 21 bp, Artificial Sequence
  Description of Artificial Sequence: Synthetic oligonucleotide
cacacatacttttctaaggga

SEQ ID NO: 7626 - DNA, 21 bp, Artificial Sequence
  Description of Artificial Sequence: Synthetic oligonucleotide
ccttagaaaagtatgtgtgca

SEQ ID NO: 7627 - DNA, 21 bp, Artificial Sequence
  Description of Artificial Sequence: Synthetic oligonucleotide
acacatacttttctaagggac

SEQ ID NO: 7628 - DNA, 21 bp, Artificial Sequence
  Description of Artificial Sequence: Synthetic oligonucleotide
cccttagaaaagtatgtgtgc

SEQ ID NO: 7629 - DNA, 21 bp, Artificial Sequence
  Description of Artificial Sequence: Synthetic oligonucleotide
cacatacttttctaagggaca

SEQ ID NO: 7630 - DNA, 21 bp, Artificial Sequence
  Description of Artificial Sequence: Synthetic oligonucleotide
tcccttagaaaagtatgtgtg

SEQ ID NO: 7631 - DNA, 21 bp, Artificial Sequence
  Description of Artificial Sequence: Synthetic oligonucleotide
acatacttttctaagggacat

SEQ ID NO: 7632 - DNA, 21 bp, Artificial Sequence
  Description of Artificial Sequence: Synthetic oligonucleotide
gtcccttagaaaagtatgtgt

SEQ ID NO: 7633 - DNA, 21 bp, Artificial Sequence
  Description of Artificial Sequence: Synthetic oligonucleotide
catacttttctaagggacatt

SEQ ID NO: 7634 - DNA, 21 bp, Artificial Sequence
  Description of Artificial Sequence: Synthetic oligonucleotide
tgtcccttagaaaagtatgtg

SEQ ID NO: 7635 - DNA, 21 bp, Artificial Sequence
  Description of Artificial Sequence: Synthetic oligonucleotide
atacttttctaagggacatta

SEQ ID NO: 7636 - DNA, 21 bp, Artificial Sequence
  Description of Artificial Sequence: Synthetic oligonucleotide
atgtcccttagaaaagtatgt

SEQ ID NO: 7637 - DNA, 21 bp, Artificial Sequence
  Description of Artificial Sequence: Synthetic oligonucleotide
tacttttctaagggacattat

SEQ ID NO: 7638 - DNA, 21 bp, Artificial Sequence
  Description of Artificial Sequence: Synthetic oligonucleotide
aatgtcccttagaaaagtatg

SEQ ID NO: 7639 - DNA, 21 bp, Artificial Sequence
  Description of Artificial Sequence: Synthetic oligonucleotide
acttttctaagggacattatc

SEQ ID NO: 7640 - DNA, 21 bp, Artificial Sequence
  Description of Artificial Sequence: Synthetic oligonucleotide
taatgtcccttagaaaagtat

SEQ ID NO: 7641 - DNA, 21 bp, Artificial Sequence
  Description of Artificial Sequence: Synthetic oligonucleotide
cttttctaagggacattatct

SEQ ID NO: 7642 - DNA, 21 bp, Artificial Sequence
  Description of Artificial Sequence: Synthetic oligonucleotide
ataatgtcccttagaaaagta

SEQ ID NO: 7643 - DNA, 21 bp, Artificial Sequence
  Description of Artificial Sequence: Synthetic oligonucleotide
ttttctaagggacattatctt

SEQ ID NO: 7644 - DNA, 21 bp, Artificial Sequence
  Description of Artificial Sequence: Synthetic oligonucleotide
gataatgtcccttagaaaagt

SEQ ID NO: 7645 - DNA, 21 bp, Artificial Sequence
  Description of Artificial Sequence: Synthetic oligonucleotide
tttctaagggacattatcttc

SEQ ID NO: 7646 - DNA, 21 bp, Artificial Sequence
  Description of Artificial Sequence: Synthetic oligonucleotide
agataatgtcccttagaaaag

SEQ ID NO: 7647 - DNA, 21 bp, Artificial Sequence
  Description of Artificial Sequence: Synthetic oligonucleotide
ttctaagggacattatcttcc

SEQ ID NO: 7648 - DNA, 21 bp, Artificial Sequence
  Description of Artificial Sequence: Synthetic oligonucleotide
aagataatgtcccttagaaaa

SEQ ID NO: 7649 - DNA, 21 bp, Artificial Sequence
  Description of Artificial Sequence: Synthetic oligonucleotide
tctaagggacattatcttcct

SEQ ID NO: 7650 - DNA, 21 bp, Artificial Sequence
  Description of Artificial Sequence: Synthetic oligonucleotide
gaagataatgtcccttagaaa

SEQ ID NO: 7651 - DNA, 21 bp, Artificial Sequence
  Description of Artificial Sequence: Synthetic oligonucleotide
ctaagggacattatcttcctt

SEQ ID NO: 7652 - DNA, 21 bp, Artificial Sequence
  Description of Artificial Sequence: Synthetic oligonucleotide
ggaagataatgtcccttagaa

SEQ ID NO: 7653 - DNA, 21 bp, Artificial Sequence
  Description of Artificial Sequence: Synthetic oligonucleotide
taagggacattatcttccttc

SEQ ID NO: 7654 - DNA, 21 bp, Artificial Sequence
  Description of Artificial Sequence: Synthetic oligonucleotide
aggaagataatgtcccttaga

SEQ ID NO: 7655 - DNA, 21 bp, Artificial Sequence
  Description of Artificial Sequence: Synthetic oligonucleotide
aagggacattatcttccttca

SEQ ID NO: 7656 - DNA, 21 bp, Artificial Sequence
  Description of Artificial Sequence: Synthetic oligonucleotide
aaggaagataatgtcccttag

SEQ ID NO: 7657 - DNA, 21 bp, Artificial Sequence
  Description of Artificial Sequence: Synthetic oligonucleotide
agggacattatcttccttcag

SEQ ID NO: 7658 - DNA, 21 bp, Artificial Sequence
  Description of Artificial Sequence: Synthetic oligonucleotide
gaaggaagataatgtccctta

SEQ ID NO: 7659 - DNA, 21 bp, Artificial Sequence
  Description of Artificial Sequence: Synthetic oligonucleotide
gggacattatcttccttcagg

SEQ ID NO: 7660 - DNA, 21 bp, Artificial Sequence
  Description of Artificial Sequence: Synthetic oligonucleotide
tgaaggaagataatgtccctt

SEQ ID NO: 7661 - DNA, 21 bp, Artificial Sequence
  Description of Artificial Sequence: Synthetic oligonucleotide
ggacattatcttccttcaggt

SEQ ID NO: 7662 - DNA, 21 bp, Artificial Sequence
  Description of Artificial Sequence: Synthetic oligonucleotide
ctgaaggaagataatgtccct

SEQ ID NO: 7663 - DNA, 21 bp, Artificial Sequence
  Description of Artificial Sequence: Synthetic oligonucleotide
gacattatcttccttcaggtt

SEQ ID NO: 7664 - DNA, 21 bp, Artificial Sequence
  Description of Artificial Sequence: Synthetic oligonucleotide
cctgaaggaagataatgtccc

SEQ ID NO: 7665 - DNA, 21 bp, Artificial Sequence
  Description of Artificial Sequence: Synthetic oligonucleotide
acattatcttccttcaggttt

SEQ ID NO: 7666 - DNA, 21 bp, Artificial Sequence
  Description of Artificial Sequence: Synthetic oligonucleotide
acctgaaggaagataatgtcc

SEQ ID NO: 7667 - DNA, 21 bp, Artificial Sequence
  Description of Artificial Sequence: Synthetic oligonucleotide
cattatcttccttcaggtttt

SEQ ID NO: 7668 - DNA, 21 bp, Artificial Sequence
  Description of Artificial Sequence: Synthetic oligonucleotide
aacctgaaggaagataatgtc

SEQ ID NO: 7669 - DNA, 21 bp, Artificial Sequence
  Description of Artificial Sequence: Synthetic oligonucleotide
attatcttccttcaggttttt

SEQ ID NO: 7670 - DNA, 21 bp, Artificial Sequence
  Description of Artificial Sequence: Synthetic oligonucleotide
aaacctgaaggaagataatgt

SEQ ID NO: 7671 - DNA, 21 bp, Artificial Sequence
  Description of Artificial Sequence: Synthetic oligonucleotide
ttatcttccttcaggttttta

SEQ ID NO: 7672 - DNA, 21 bp, Artificial Sequence
  Description of Artificial Sequence: Synthetic oligonucleotide
aaaacctgaaggaagataatg

SEQ ID NO: 7673 - DNA, 21 bp, Artificial Sequence
  Description of Artificial Sequence: Synthetic oligonucleotide
tatcttccttcaggtttttac

SEQ ID NO: 7674 - DNA, 21 bp, Artificial Sequence
  Description of Artificial Sequence: Synthetic oligonucleotide
aaaaacctgaaggaagataat

SEQ ID NO: 7675 - DNA, 21 bp, Artificial Sequence
  Description of Artificial Sequence: Synthetic oligonucleotide
atcttccttcaggtttttacc

SEQ ID NO: 7676 - DNA, 21 bp, Artificial Sequence
  Description of Artificial Sequence: Synthetic oligonucleotide
taaaaacctgaaggaagataa

SEQ ID NO: 7677 - DNA, 21 bp, Artificial Sequence
  Description of Artificial Sequence: Synthetic oligonucleotide
tcttccttcaggtttttacct

SEQ ID NO: 7678 - DNA, 21 bp, Artificial Sequence
  Description of Artificial Sequence: Synthetic oligonucleotide
gtaaaaacctgaaggaagata

SEQ ID NO: 7679 - DNA, 21 bp, Artificial Sequence
  Description of Artificial Sequence: Synthetic oligonucleotide
cttccttcaggtttttacctc

SEQ ID NO: 7680 - DNA, 21 bp, Artificial Sequence
  Description of Artificial Sequence: Synthetic oligonucleotide
ggtaaaaacctgaaggaagat

SEQ ID NO: 7681 - DNA, 21 bp, Artificial Sequence
  Description of Artificial Sequence: Synthetic oligonucleotide
ttccttcaggtttttacctcc

SEQ ID NO: 7682 - DNA, 21 bp, Artificial Sequence
  Description of Artificial Sequence: Synthetic oligonucleotide
aggtaaaaacctgaaggaaga

SEQ ID NO: 7683 - DNA, 21 bp, Artificial Sequence
  Description of Artificial Sequence: Synthetic oligonucleotide
tccttcaggtttttacctcca

SEQ ID NO: 7684 - DNA, 21 bp, Artificial Sequence
  Description of Artificial Sequence: Synthetic oligonucleotide
gaggtaaaaacctgaaggaag

SEQ ID NO: 7685 - DNA, 21 bp, Artificial Sequence
  Description of Artificial Sequence: Synthetic oligonucleotide
ccttcaggtttttacctccac

SEQ ID NO: 7686 - DNA, 21 bp, Artificial Sequence
  Description of Artificial Sequence: Synthetic oligonucleotide
ggaggtaaaaacctgaaggaa

SEQ ID NO: 7687 - DNA, 21 bp, Artificial Sequence
  Description of Artificial Sequence: Synthetic oligonucleotide
cttcaggtttttacctccact

SEQ ID NO: 7688 - DNA, 21 bp, Artificial Sequence
  Description of Artificial Sequence: Synthetic oligonucleotide
tggaggtaaaaacctgaagga

SEQ ID NO: 7689 - DNA, 21 bp, Artificial Sequence
  Description of Artificial Sequence: Synthetic oligonucleotide
ttcaggtttttacctccactc

SEQ ID NO: 7690 - DNA, 21 bp, Artificial Sequence
  Description of Artificial Sequence: Synthetic oligonucleotide
gtggaggtaaaaacctgaagg

SEQ ID NO: 7691 - DNA, 21 bp, Artificial Sequence
  Description of Artificial Sequence: Synthetic oligonucleotide
tcaggtttttacctccactca

SEQ ID NO: 7692 - DNA, 21 bp, Artificial Sequence
  Description of Artificial Sequence: Synthetic oligonucleotide
agtggaggtaaaaacctgaag

SEQ ID NO: 7693 - DNA, 21 bp, Artificial Sequence
  Description of Artificial Sequence: Synthetic oligonucleotide
caggtttttacctccactcat

SEQ ID NO: 7694 - DNA, 21 bp, Artificial Sequence
  Description of Artificial Sequence: Synthetic oligonucleotide
gagtggaggtaaaaacctgaa

SEQ ID NO: 7695 - DNA, 21 bp, Artificial Sequence
  Description of Artificial Sequence: Synthetic oligonucleotide
aggtttttacctccactcatc

SEQ ID NO: 7696 - DNA, 21 bp, Artificial Sequence
  Description of Artificial Sequence: Synthetic oligonucleotide
tgagtggaggtaaaaacctga

SEQ ID NO: 7697 - DNA, 21 bp, Artificial Sequence
  Description of Artificial Sequence: Synthetic oligonucleotide
ggtttttacctccactcatcc

SEQ ID NO: 7698 - DNA, 21 bp, Artificial Sequence
  Description of Artificial Sequence: Synthetic oligonucleotide
atgagtggaggtaaaaacctg

SEQ ID NO: 7699 - DNA, 21 bp, Artificial Sequence
  Description of Artificial Sequence: Synthetic oligonucleotide
gtttttacctccactcatcct

SEQ ID NO: 7700 - DNA, 21 bp, Artificial Sequence
  Description of Artificial Sequence: Synthetic oligonucleotide
gatgagtggaggtaaaaacct

SEQ ID NO: 7701 - DNA, 21 bp, Artificial Sequence
  Description of Artificial Sequence: Synthetic oligonucleotide
tttttacctccactcatcctt

SEQ ID NO: 7702 - DNA, 21 bp, Artificial Sequence
  Description of Artificial Sequence: Synthetic oligonucleotide
ggatgagtggaggtaaaaacc

SEQ ID NO: 7703 - DNA, 21 bp, Artificial Sequence
  Description of Artificial Sequence: Synthetic oligonucleotide
ttttacctccactcatcctta

SEQ ID NO: 7704 - DNA, 21 bp, Artificial Sequence
  Description of Artificial Sequence: Synthetic oligonucleotide
aggatgagtggaggtaaaaac

SEQ ID NO: 7705 - DNA, 21 bp, Artificial Sequence
  Description of Artificial Sequence: Synthetic oligonucleotide
tttacctccactcatccttag

SEQ ID NO: 7706 - DNA, 21 bp, Artificial Sequence
  Description of Artificial Sequence: Synthetic oligonucleotide
aaggatgagtggaggtaaaaa

SEQ ID NO: 7707 - DNA, 21 bp, Artificial Sequence
  Description of Artificial Sequence: Synthetic oligonucleotide
ttacctccactcatccttaga

SEQ ID NO: 7708 - DNA, 21 bp, Artificial Sequence
  Description of Artificial Sequence: Synthetic oligonucleotide
taaggatgagtggaggtaaaa

SEQ ID NO: 7709 - DNA, 21 bp, Artificial Sequence
  Description of Artificial Sequence: Synthetic oligonucleotide
tacctccactcatccttagag

SEQ ID NO: 7710 - DNA, 21 bp, Artificial Sequence
  Description of Artificial Sequence: Synthetic oligonucleotide
ctaaggatgagtggaggtaaa

SEQ ID NO: 7711 - DNA, 21 bp, Artificial Sequence
  Description of Artificial Sequence: Synthetic oligonucleotide
acctccactcatccttagagc

SEQ ID NO: 7712 - DNA, 21 bp, Artificial Sequence
  Description of Artificial Sequence: Synthetic oligonucleotide
tctaaggatgagtggaggtaa

SEQ ID NO: 7713 - DNA, 21 bp, Artificial Sequence
  Description of Artificial Sequence: Synthetic oligonucleotide
cctccactcatccttagagcc

SEQ ID NO: 7714 - DNA, 21 bp, Artificial Sequence
  Description of Artificial Sequence: Synthetic oligonucleotide
ctctaaggatgagtggaggta

SEQ ID NO: 7715 - DNA, 21 bp, Artificial Sequence
  Description of Artificial Sequence: Synthetic oligonucleotide
ctccactcatccttagagccc

SEQ ID NO: 7716 - DNA, 21 bp, Artificial Sequence
  Description of Artificial Sequence: Synthetic oligonucleotide
gctctaaggatgagtggaggt

SEQ ID NO: 7717 - DNA, 21 bp, Artificial Sequence
  Description of Artificial Sequence: Synthetic oligonucleotide
tccactcatccttagagccca

SEQ ID NO: 7718 - DNA, 21 bp, Artificial Sequence
  Description of Artificial Sequence: Synthetic oligonucleotide
ggctctaaggatgagtggagg

SEQ ID NO: 7719 - DNA, 21 bp, Artificial Sequence
  Description of Artificial Sequence: Synthetic oligonucleotide
ccactcatccttagagcccac

SEQ ID NO: 7720 - DNA, 21 bp, Artificial Sequence
  Description of Artificial Sequence: Synthetic oligonucleotide
gggctctaaggatgagtggag

SEQ ID NO: 7721 - DNA, 21 bp, Artificial Sequence
  Description of Artificial Sequence: Synthetic oligonucleotide
cactcatccttagagcccact

SEQ ID NO: 7722 - DNA, 21 bp, Artificial Sequence
  Description of Artificial Sequence: Synthetic oligonucleotide
tgggctctaaggatgagtgga

SEQ ID NO: 7723 - DNA, 21 bp, Artificial Sequence
  Description of Artificial Sequence: Synthetic oligonucleotide
actcatccttagagcccactg

SEQ ID NO: 7724 - DNA, 21 bp, Artificial Sequence
  Description of Artificial Sequence: Synthetic oligonucleotide
gtgggctctaaggatgagtgg

SEQ ID NO: 7725 - DNA, 21 bp, Artificial Sequence
  Description of Artificial Sequence: Synthetic oligonucleotide
ctcatccttagagcccactga

SEQ ID NO: 7726 - DNA, 21 bp, Artificial Sequence
  Description of Artificial Sequence: Synthetic oligonucleotide
agtgggctctaaggatgagtg

SEQ ID NO: 7727 - DNA, 21 bp, Artificial Sequence
  Description of Artificial Sequence: Synthetic oligonucleotide
tcatccttagagcccactgac

SEQ ID NO: 7728 - DNA, 21 bp, Artificial Sequence
  Description of Artificial Sequence: Synthetic oligonucleotide
cagtgggctctaaggatgagt

SEQ ID NO: 7729 - DNA, 21 bp, Artificial Sequence
  Description of Artificial Sequence: Synthetic oligonucleotide
catccttagagcccactgact

SEQ ID NO: 7730 - DNA, 21 bp, Artificial Sequence
  Description of Artificial Sequence: Synthetic oligonucleotide
tcagtgggctctaaggatgag

SEQ ID NO: 7731 - DNA, 21 bp, Artificial Sequence
  Description of Artificial Sequence: Synthetic oligonucleotide
atccttagagcccactgactg

SEQ ID NO: 7732 - DNA, 21 bp, Artificial Sequence
  Description of Artificial Sequence: Synthetic oligonucleotide
gtcagtgggctctaaggatga

SEQ ID NO: 7733 - DNA, 21 bp, Artificial Sequence
  Description of Artificial Sequence: Synthetic oligonucleotide
tccttagagcccactgactgc

SEQ ID NO: 7734 - DNA, 21 bp, Artificial Sequence
  Description of Artificial Sequence: Synthetic oligonucleotide
agtcagtgggctctaaggatg

SEQ ID NO: 7735 - DNA, 21 bp, Artificial Sequence
  Description of Artificial Sequence: Synthetic oligonucleotide
ccttagagcccactgactgct

SEQ ID NO: 7736 - DNA, 21 bp, Artificial Sequence
  Description of Artificial Sequence: Synthetic oligonucleotide
cagtcagtgggctctaaggat

SEQ ID NO: 7737 - DNA, 21 bp, Artificial Sequence
  Description of Artificial Sequence: Synthetic oligonucleotide
cttagagcccactgactgctc

SEQ ID NO: 7738 - DNA, 21 bp, Artificial Sequence
  Description of Artificial Sequence: Synthetic oligonucleotide
gcagtcagtgggctctaagga

SEQ ID NO: 7739 - DNA, 21 bp, Artificial Sequence
  Description of Artificial Sequence: Synthetic oligonucleotide
ttagagcccactgactgctcc

SEQ ID NO: 7740 - DNA, 21 bp, Artificial Sequence
  Description of Artificial Sequence: Synthetic oligonucleotide
agcagtcagtgggctctaagg

SEQ ID NO: 7741 - DNA, 21 bp, Artificial Sequence
  Description of Artificial Sequence: Synthetic oligonucleotide
tagagcccactgactgctccc

SEQ ID NO: 7742 - DNA, 21 bp, Artificial Sequence
  Description of Artificial Sequence: Synthetic oligonucleotide
gagcagtcagtgggctctaag

SEQ ID NO: 7743 - DNA, 21 bp, Artificial Sequence
  Description of Artificial Sequence: Synthetic oligonucleotide
agagcccactgactgctcccc

SEQ ID NO: 7744 - DNA, 21 bp, Artificial Sequence
  Description of Artificial Sequence: Synthetic oligonucleotide
ggagcagtcagtgggctctaa

SEQ ID NO: 7745 - DNA, 21 bp, Artificial Sequence
  Description of Artificial Sequence: Synthetic oligonucleotide
gagcccactgactgctcccct

SEQ ID NO: 7746 - DNA, 21 bp, Artificial Sequence
  Description of Artificial Sequence: Synthetic oligonucleotide
gggagcagtcagtgggctcta

SEQ ID NO: 7747 - DNA, 21 bp, Artificial Sequence
  Description of Artificial Sequence: Synthetic oligonucleotide
agcccactgactgctcccctt

SEQ ID NO: 7748 - DNA, 21 bp, Artificial Sequence
  Description of Artificial Sequence: Synthetic oligonucleotide
ggggagcagtcagtgggctct

SEQ ID NO: 7749 - DNA, 21 bp, Artificial Sequence
  Description of Artificial Sequence: Synthetic oligonucleotide
gcccactgactgctccccttt

SEQ ID NO: 7750 - DNA, 21 bp, Artificial Sequence
  Description of Artificial Sequence: Synthetic oligonucleotide
aggggagcagtcagtgggctc

SEQ ID NO: 7751 - DNA, 21 bp, Artificial Sequence
  Description of Artificial Sequence: Synthetic oligonucleotide
cccactgactgctccccttta

SEQ ID NO: 7752 - DNA, 21 bp, Artificial Sequence
  Description of Artificial Sequence: Synthetic oligonucleotide
aaggggagcagtcagtgggct

SEQ ID NO: 7753 - DNA, 21 bp, Artificial Sequence
  Description of Artificial Sequence: Synthetic oligonucleotide
ccactgactgctcccctttat

SEQ ID NO: 7754 - DNA, 21 bp, Artificial Sequence
  Description of Artificial Sequence: Synthetic oligonucleotide
aaaggggagcagtcagtgggc

SEQ ID NO: 7755 - DNA, 21 bp, Artificial Sequence
  Description of Artificial Sequence: Synthetic oligonucleotide
cactgactgctcccctttata

SEQ ID NO: 7756 - DNA, 21 bp, Artificial Sequence
  Description of Artificial Sequence: Synthetic oligonucleotide
taaaggggagcagtcagtggg

SEQ ID NO: 7757 - DNA, 21 bp, Artificial Sequence
  Description of Artificial Sequence: Synthetic oligonucleotide
actgactgctcccctttatac

SEQ ID NO: 7758 - DNA, 21 bp, Artificial Sequence
  Description of Artificial Sequence: Synthetic oligonucleotide
ataaaggggagcagtcagtgg

SEQ ID NO: 7759 - DNA, 21 bp, Artificial Sequence
  Description of Artificial Sequence: Synthetic oligonucleotide
ctgactgctcccctttatacc

SEQ ID NO: 7760 - DNA, 21 bp, Artificial Sequence
  Description of Artificial Sequence: Synthetic oligonucleotide
tataaaggggagcagtcagtg

SEQ ID NO: 7761 - DNA, 21 bp, Artificial Sequence
  Description of Artificial Sequence: Synthetic oligonucleotide
tgactgctcccctttatacct

SEQ ID NO: 7762 - DNA, 21 bp, Artificial Sequence
  Description of Artificial Sequence: Synthetic oligonucleotide
gtataaaggggagcagtcagt

SEQ ID NO: 7763 - DNA, 21 bp, Artificial Sequence
  Description of Artificial Sequence: Synthetic oligonucleotide
gactgctcccctttatacctg

SEQ ID NO: 7764 - DNA, 21 bp, Artificial Sequence
  Description of Artificial Sequence: Synthetic oligonucleotide
ggtataaaggggagcagtcag

SEQ ID NO: 7765 - DNA, 21 bp, Artificial Sequence
  Description of Artificial Sequence: Synthetic oligonucleotide
actgctcccctttatacctgt

SEQ ID NO: 7766 - DNA, 21 bp, Artificial Sequence
  Description of Artificial Sequence: Synthetic oligonucleotide
aggtataaaggggagcagtca

SEQ ID NO: 7767 - DNA, 21 bp, Artificial Sequence
  Description of Artificial Sequence: Synthetic oligonucleotide
ctgctcccctttatacctgtt

SEQ ID NO: 7768 - DNA, 21 bp, Artificial Sequence
  Description of Artificial Sequence: Synthetic oligonucleotide
caggtataaaggggagcagtc

SEQ ID NO: 7769 - DNA, 21 bp, Artificial Sequence
  Description of Artificial Sequence: Synthetic oligonucleotide
tgctcccctttatacctgttg

SEQ ID NO: 7770 - DNA, 21 bp, Artificial Sequence
  Description of Artificial Sequence: Synthetic oligonucleotide
acaggtataaaggggagcagt

SEQ ID NO: 7771 - DNA, 21 bp, Artificial Sequence
  Description of Artificial Sequence: Synthetic oligonucleotide
gctcccctttatacctgttgg

SEQ ID NO: 7772 - DNA, 21 bp, Artificial Sequence
  Description of Artificial Sequence: Synthetic oligonucleotide
aacaggtataaaggggagcag

SEQ ID NO: 7773 - DNA, 21 bp, Artificial Sequence
  Description of Artificial Sequence: Synthetic oligonucleotide
ctcccctttatacctgttggc

SEQ ID NO: 7774 - DNA, 21 bp, Artificial Sequence
  Description of Artificial Sequence: Synthetic oligonucleotide
caacaggtataaaggggagca

SEQ ID NO: 7775 - DNA, 21 bp, Artificial Sequence
  Description of Artificial Sequence: Synthetic oligonucleotide
tcccctttatacctgttggcc

SEQ ID NO: 7776 - DNA, 21 bp, Artificial Sequence
  Description of Artificial Sequence: Synthetic oligonucleotide
ccaacaggtataaaggggagc

SEQ ID NO: 7777 - DNA, 21 bp, Artificial Sequence
  Description of Artificial Sequence: Synthetic oligonucleotide
cccctttatacctgttggccc

SEQ ID NO: 7778 - DNA, 21 bp, Artificial Sequence
  Description of Artificial Sequence: Synthetic oligonucleotide
gccaacaggtataaaggggag

SEQ ID NO: 7779 - DNA, 21 bp, Artificial Sequence
  Description of Artificial Sequence: Synthetic oligonucleotide
ccctttatacctgttggccct

SEQ ID NO: 7780 - DNA, 21 bp, Artificial Sequence
  Description of Artificial Sequence: Synthetic oligonucleotide
ggccaacaggtataaagggga

SEQ ID NO: 7781 - DNA, 21 bp, Artificial Sequence
  Description of Artificial Sequence: Synthetic oligonucleotide
cctttatacctgttggccctg

SEQ ID NO: 7782 - DNA, 21 bp, Artificial Sequence
  Description of Artificial Sequence: Synthetic oligonucleotide
gggccaacaggtataaagggg

SEQ ID NO: 7783 - DNA, 21 bp, Artificial Sequence
  Description of Artificial Sequence: Synthetic oligonucleotide
ctttatacctgttggccctgc

SEQ ID NO: 7784 - DNA, 21 bp, Artificial Sequence
  Description of Artificial Sequence: Synthetic oligonucleotide
agggccaacaggtataaaggg

SEQ ID NO: 7785 - DNA, 21 bp, Artificial Sequence
  Description of Artificial Sequence: Synthetic oligonucleotide
tttatacctgttggccctgcc

SEQ ID NO: 7786 - DNA, 21 bp, Artificial Sequence
  Description of Artificial Sequence: Synthetic oligonucleotide
cagggccaacaggtataaagg

SEQ ID NO: 7787 - DNA, 21 bp, Artificial Sequence
  Description of Artificial Sequence: Synthetic oligonucleotide
ttatacctgttggccctgcct

SEQ ID NO: 7788 - DNA, 21 bp, Artificial Sequence
  Description of Artificial Sequence: Synthetic oligonucleotide
gcagggccaacaggtataaag

SEQ ID NO: 7789 - DNA, 21 bp, Artificial Sequence
  Description of Artificial Sequence: Synthetic oligonucleotide
tatacctgttggccctgccta

SEQ ID NO: 7790 - DNA, 21 bp, Artificial Sequence
  Description of Artificial Sequence: Synthetic oligonucleotide
ggcagggccaacaggtataaa

SEQ ID NO: 7791 - DNA, 21 bp, Artificial Sequence
  Description of Artificial Sequence: Synthetic oligonucleotide
atacctgttggccctgcctat

SEQ ID NO: 7792 - DNA, 21 bp, Artificial Sequence
  Description of Artificial Sequence: Synthetic oligonucleotide
aggcagggccaacaggtataa

SEQ ID NO: 7793 - DNA, 21 bp, Artificial Sequence
  Description of Artificial Sequence: Synthetic oligonucleotide
tacctgttggccctgcctata

SEQ ID NO: 7794 - DNA, 21 bp, Artificial Sequence
  Description of Artificial Sequence: Synthetic oligonucleotide
taggcagggccaacaggtata

SEQ ID NO: 7795 - DNA, 21 bp, Artificial Sequence
  Description of Artificial Sequence: Synthetic oligonucleotide
acctgttggccctgcctatag

SEQ ID NO: 7796 - DNA, 21 bp, Artificial Sequence
  Description of Artificial Sequence: Synthetic oligonucleotide
ataggcagggccaacaggtat

SEQ ID NO: 7797 - DNA, 21 bp, Artificial Sequence
  Description of Artificial Sequence: Synthetic oligonucleotide
cctgttggccctgcctatagg

SEQ ID NO: 7798 - DNA, 21 bp, Artificial Sequence
  Description of Artificial Sequence: Synthetic oligonucleotide
tataggcagggccaacaggta

SEQ ID NO: 7799 - DNA, 21 bp, Artificial Sequence
  Description of Artificial Sequence: Synthetic oligonucleotide
ctgttggccctgcctatagga

SEQ ID NO: 7800 - DNA, 21 bp, Artificial Sequence
  Description of Artificial Sequence: Synthetic oligonucleotide
ctataggcagggccaacaggt

SEQ ID NO: 7801 - DNA, 21 bp, Artificial Sequence
  Description of Artificial Sequence: Synthetic oligonucleotide
tgttggccctgcctataggag

SEQ ID NO: 7802 - DNA, 21 bp, Artificial Sequence
  Description of Artificial Sequence: Synthetic oligonucleotide
cctataggcagggccaacagg

SEQ ID NO: 7803 - DNA, 21 bp, Artificial Sequence
  Description of Artificial Sequence: Synthetic oligonucleotide
gttggccctgcctataggaga

SEQ ID NO: 7804 - DNA, 21 bp, Artificial Sequence
  Description of Artificial Sequence: Synthetic oligonucleotide
tcctataggcagggccaacag

SEQ ID NO: 7805 - DNA, 21 bp, Artificial Sequence
  Description of Artificial Sequence: Synthetic oligonucleotide
ttggccctgcctataggagag

SEQ ID NO: 7806 - DNA, 21 bp, Artificial Sequence
  Description of Artificial Sequence: Synthetic oligonucleotide
ctcctataggcagggccaaca

SEQ ID NO: 7807 - DNA, 21 bp, Artificial Sequence
  Description of Artificial Sequence: Synthetic oligonucleotide
tggccctgcctataggagaga

SEQ ID NO: 7808 - DNA, 21 bp, Artificial Sequence
  Description of Artificial Sequence: Synthetic oligonucleotide
tctcctataggcagggccaac

SEQ ID NO: 7809 - DNA, 21 bp, Artificial Sequence
  Description of Artificial Sequence: Synthetic oligonucleotide
ggccctgcctataggagagaa

SEQ ID NO: 7810 - DNA, 21 bp, Artificial Sequence
  Description of Artificial Sequence: Synthetic oligonucleotide
ctctcctataggcagggccaa

SEQ ID NO: 7811 - DNA, 21 bp, Artificial Sequence
  Description of Artificial Sequence: Synthetic oligonucleotide
gccctgcctataggagagaat

SEQ ID NO: 7812 - DNA, 21 bp, Artificial Sequence
  Description of Artificial Sequence: Synthetic oligonucleotide
tctctcctataggcagggcca

SEQ ID NO: 7813 - DNA, 21 bp, Artificial Sequence
  Description of Artificial Sequence: Synthetic oligonucleotide
ccctgcctataggagagaata

SEQ ID NO: 7814 - DNA, 21 bp, Artificial Sequence
  Description of Artificial Sequence: Synthetic oligonucleotide
ttctctcctataggcagggcc

SEQ ID NO: 7815 - DNA, 21 bp, Artificial Sequence
  Description of Artificial Sequence: Synthetic oligonucleotide
cctgcctataggagagaatat

SEQ ID NO: 7816 - DNA, 21 bp, Artificial Sequence
  Description of Artificial Sequence: Synthetic oligonucleotide
attctctcctataggcagggc

SEQ ID NO: 7817 - DNA, 21 bp, Artificial Sequence
  Description of Artificial Sequence: Synthetic oligonucleotide
ctgcctataggagagaatatt

SEQ ID NO: 7818 - DNA, 21 bp, Artificial Sequence
  Description of Artificial Sequence: Synthetic oligonucleotide
tattctctcctataggcaggg

SEQ ID NO: 7819 - DNA, 21 bp, Artificial Sequence
  Description of Artificial Sequence: Synthetic oligonucleotide
tgcctataggagagaatattt

SEQ ID NO: 7820 - DNA, 21 bp, Artificial Sequence
  Description of Artificial Sequence: Synthetic oligonucleotide
atattctctcctataggcagg

SEQ ID NO: 7821 - DNA, 21 bp, Artificial Sequence
  Description of Artificial Sequence: Synthetic oligonucleotide
gcctataggagagaatatttg

SEQ ID NO: 7822 - DNA, 21 bp, Artificial Sequence
  Description of Artificial Sequence: Synthetic oligonucleotide
aatattctctcctataggcag

SEQ ID NO: 7823 - DNA, 21 bp, Artificial Sequence
  Description of Artificial Sequence: Synthetic oligonucleotide
cctataggagagaatatttgg

SEQ ID NO: 7824 - DNA, 21 bp, Artificial Sequence
  Description of Artificial Sequence: Synthetic oligonucleotide
aaatattctctcctataggca

SEQ ID NO: 7825 - DNA, 21 bp, Artificial Sequence
  Description of Artificial Sequence: Synthetic oligonucleotide
ctataggagagaatatttgga

SEQ ID NO: 7826 - DNA, 21 bp, Artificial Sequence
  Description of Artificial Sequence: Synthetic oligonucleotide
caaatattctctcctataggc

SEQ ID NO: 7827 - DNA, 21 bp, Artificial Sequence
  Description of Artificial Sequence: Synthetic oligonucleotide
tataggagagaatatttggag

SEQ ID NO: 7828 - DNA, 21 bp, Artificial Sequence
  Description of Artificial Sequence: Synthetic oligonucleotide
ccaaatattctctcctatagg

SEQ ID NO: 7829 - DNA, 21 bp, Artificial Sequence
  Description of Artificial Sequence: Synthetic oligonucleotide
ataggagagaatatttggaga

SEQ ID NO: 7830 - DNA, 21 bp, Artificial Sequence
  Description of Artificial Sequence: Synthetic oligonucleotide
tccaaatattctctcctatag

SEQ ID NO: 7831 - DNA, 21 bp, Artificial Sequence
  Description of Artificial Sequence: Synthetic oligonucleotide
taggagagaatatttggagat

SEQ ID NO: 7832 - DNA, 21 bp, Artificial Sequence
  Description of Artificial Sequence: Synthetic oligonucleotide
ctccaaatattctctcctata

SEQ ID NO: 7833 - DNA, 21 bp, Artificial Sequence
  Description of Artificial Sequence: Synthetic oligonucleotide
aggagagaatatttggagata

SEQ ID NO: 7834 - DNA, 21 bp, Artificial Sequence
  Description of Artificial Sequence: Synthetic oligonucleotide
tctccaaatattctctcctat

SEQ ID NO: 7835 - DNA, 21 bp, Artificial Sequence
  Description of Artificial Sequence: Synthetic oligonucleotide
ggagagaatatttggagatag

SEQ ID NO: 7836 - DNA, 21 bp, Artificial Sequence
  Description of Artificial Sequence: Synthetic oligonucleotide
atctccaaatattctctccta

SEQ ID NO: 7837 - DNA, 21 bp, Artificial Sequence
  Description of Artificial Sequence: Synthetic oligonucleotide
gagagaatatttggagatagg

SEQ ID NO: 7838 - DNA, 21 bp, Artificial Sequence
  Description of Artificial Sequence: Synthetic oligonucleotide
tatctccaaatattctctcct

SEQ ID NO: 7839 - DNA, 21 bp, Artificial Sequence
  Description of Artificial Sequence: Synthetic oligonucleotide
agagaatatttggagataggc

SEQ ID NO: 7840 - DNA, 21 bp, Artificial Sequence
  Description of Artificial Sequence: Synthetic oligonucleotide
ctatctccaaatattctctcc

SEQ ID NO: 7841 - DNA, 21 bp, Artificial Sequence
  Description of Artificial Sequence: Synthetic oligonucleotide
gagaatatttggagataggca

SEQ ID NO: 7842 - DNA, 21 bp, Artificial Sequence
  Description of Artificial Sequence: Synthetic oligonucleotide
cctatctccaaatattctctc

SEQ ID NO: 7843 - DNA, 21 bp, Artificial Sequence
  Description of Artificial Sequence: Synthetic oligonucleotide
agaatatttggagataggcag

SEQ ID NO: 7844 - DNA, 21 bp, Artificial Sequence
  Description of Artificial Sequence: Synthetic oligonucleotide
gcctatctccaaatattctct

SEQ ID NO: 7845 - DNA, 21 bp, Artificial Sequence
  Description of Artificial Sequence: Synthetic oligonucleotide
gaatatttggagataggcagc

SEQ ID NO: 7846 - DNA, 21 bp, Artificial Sequence
  Description of Artificial Sequence: Synthetic oligonucleotide
tgcctatctccaaatattctc

SEQ ID NO: 7847 - DNA, 21 bp, Artificial Sequence
  Description of Artificial Sequence: Synthetic oligonucleotide
aatatttggagataggcagct

SEQ ID NO: 7848 - DNA, 21 bp, Artificial Sequence
  Description of Artificial Sequence: Synthetic oligonucleotide
ctgcctatctccaaatattct

SEQ ID NO: 7849 - DNA, 21 bp, Artificial Sequence
  Description of Artificial Sequence: Synthetic oligonucleotide
atatttggagataggcagctt

SEQ ID NO: 7850 - DNA, 21 bp, Artificial Sequence
  Description of Artificial Sequence: Synthetic oligonucleotide
gctgcctatctccaaatattc

SEQ ID NO: 7851 - DNA, 21 bp, Artificial Sequence
  Description of Artificial Sequence: Synthetic oligonucleotide
tatttggagataggcagcttc

SEQ ID NO: 7852 - DNA, 21 bp, Artificial Sequence
  Description of Artificial Sequence: Synthetic oligonucleotide
agctgcctatctccaaatatt

SEQ ID NO: 7853 - DNA, 21 bp, Artificial Sequence
  Description of Artificial Sequence: Synthetic oligonucleotide
atttggagataggcagcttca

SEQ ID NO: 7854 - DNA, 21 bp, Artificial Sequence
  Description of Artificial Sequence: Synthetic oligonucleotide
aagctgcctatctccaaatat

SEQ ID NO: 7855 - DNA, 21 bp, Artificial Sequence
  Description of Artificial Sequence: Synthetic oligonucleotide
tttggagataggcagcttcag

SEQ ID NO: 7856 - DNA, 21 bp, Artificial Sequence
  Description of Artificial Sequence: Synthetic oligonucleotide
gaagctgcctatctccaaata

SEQ ID NO: 7857 - DNA, 21 bp, Artificial Sequence
  Description of Artificial Sequence: Synthetic oligonucleotide
ttggagataggcagcttcagg

SEQ ID NO: 7858 - DNA, 21 bp, Artificial Sequence
  Description of Artificial Sequence: Synthetic oligonucleotide
tgaagctgcctatctccaaat

SEQ ID NO: 7859 - DNA, 21 bp, Artificial Sequence
  Description of Artificial Sequence: Synthetic oligonucleotide
tggagataggcagcttcagga

SEQ ID NO: 7860 - DNA, 21 bp, Artificial Sequence
  Description of Artificial Sequence: Synthetic oligonucleotide
ctgaagctgcctatctccaaa

SEQ ID NO: 7861 - DNA, 21 bp, Artificial Sequence
  Description of Artificial Sequence: Synthetic oligonucleotide
ggagataggcagcttcaggat

SEQ ID NO: 7862 - DNA, 21 bp, Artificial Sequence
  Description of Artificial Sequence: Synthetic oligonucleotide
cctgaagctgcctatctccaa

SEQ ID NO: 7863 - DNA, 21 bp, Artificial Sequence
  Description of Artificial Sequence: Synthetic oligonucleotide
gagataggcagcttcaggatg

SEQ ID NO: 7864 - DNA, 21 bp, Artificial Sequence
  Description of Artificial Sequence: Synthetic oligonucleotide
tcctgaagctgcctatctcca

SEQ ID NO: 7865 - DNA, 21 bp, Artificial Sequence
  Description of Artificial Sequence: Synthetic oligonucleotide
agataggcagcttcaggatgc

SEQ ID NO: 7866 - DNA, 21 bp, Artificial Sequence
  Description of Artificial Sequence: Synthetic oligonucleotide
atcctgaagctgcctatctcc

SEQ ID NO: 7867 - DNA, 21 bp, Artificial Sequence
  Description of Artificial Sequence: Synthetic oligonucleotide
gataggcagcttcaggatgca

SEQ ID NO: 7868 - DNA, 21 bp, Artificial Sequence
  Description of Artificial Sequence: Synthetic oligonucleotide
catcctgaagctgcctatctc

SEQ ID NO: 7869 - DNA, 21 bp, Artificial Sequence
  Description of Artificial Sequence: Synthetic oligonucleotide
ataggcagcttcaggatgcat

SEQ ID NO: 7870 - DNA, 21 bp, Artificial Sequence
  Description of Artificial Sequence: Synthetic oligonucleotide
gcatcctgaagctgcctatct

SEQ ID NO: 7871 - DNA, 21 bp, Artificial Sequence
  Description of Artificial Sequence: Synthetic oligonucleotide
taggcagcttcaggatgcatt

SEQ ID NO: 7872 - DNA, 21 bp, Artificial Sequence
  Description of Artificial Sequence: Synthetic oligonucleotide
tgcatcctgaagctgcctatc

SEQ ID NO: 7873 - DNA, 21 bp, Artificial Sequence
  Description of Artificial Sequence: Synthetic oligonucleotide
aggcagcttcaggatgcattg

SEQ ID NO: 7874 - DNA, 21 bp, Artificial Sequence
  Description of Artificial Sequence: Synthetic oligonucleotide
atgcatcctgaagctgcctat

SEQ ID NO: 7875 - DNA, 21 bp, Artificial Sequence
  Description of Artificial Sequence: Synthetic oligonucleotide
ggcagcttcaggatgcattgc

SEQ ID NO: 7876 - DNA, 21 bp, Artificial Sequence
  Description of Artificial Sequence: Synthetic oligonucleotide
aatgcatcctgaagctgccta

SEQ ID NO: 7877 - DNA, 21 bp, Artificial Sequence
  Description of Artificial Sequence: Synthetic oligonucleotide
gcagcttcaggatgcattgca

SEQ ID NO: 7878 - DNA, 21 bp, Artificial Sequence
  Description of Artificial Sequence: Synthetic oligonucleotide
caatgcatcctgaagctgcct

SEQ ID NO: 7879 - DNA, 21 bp, Artificial Sequence
  Description of Artificial Sequence: Synthetic oligonucleotide
cagcttcaggatgcattgcaa

SEQ ID NO: 7880 - DNA, 21 bp, Artificial Sequence
  Description of Artificial Sequence: Synthetic oligonucleotide
gcaatgcatcctgaagctgcc

SEQ ID NO: 7881 - DNA, 21 bp, Artificial Sequence
  Description of Artificial Sequence: Synthetic oligonucleotide
agcttcaggatgcattgcaat

SEQ ID NO: 7882 - DNA, 21 bp, Artificial Sequence
  Description of Artificial Sequence: Synthetic oligonucleotide
tgcaatgcatcctgaagctgc

SEQ ID NO: 7883 - DNA, 21 bp, Artificial Sequence
  Description of Artificial Sequence: Synthetic oligonucleotide
gcttcaggatgcattgcaatc

SEQ ID NO: 7884 - DNA, 21 bp, Artificial Sequence
  Description of Artificial Sequence: Synthetic oligonucleotide
ttgcaatgcatcctgaagctg

SEQ ID NO: 7885 - DNA, 21 bp, Artificial Sequence
  Description of Artificial Sequence: Synthetic oligonucleotide
cttcaggatgcattgcaatca

SEQ ID NO: 7886 - DNA, 21 bp, Artificial Sequence
  Description of Artificial Sequence: Synthetic oligonucleotide
attgcaatgcatcctgaagct

SEQ ID NO: 7887 - DNA, 21 bp, Artificial Sequence
  Description of Artificial Sequence: Synthetic oligonucleotide
ttcaggatgcattgcaatcat

SEQ ID NO: 7888 - DNA, 21 bp, Artificial Sequence
  Description of Artificial Sequence: Synthetic oligonucleotide
gattgcaatgcatcctgaagc

SEQ ID NO: 7889 - DNA, 21 bp, Artificial Sequence
  Description of Artificial Sequence: Synthetic oligonucleotide
tcaggatgcattgcaatcatc

SEQ ID NO: 7890 - DNA, 21 bp, Artificial Sequence
  Description of Artificial Sequence: Synthetic oligonucleotide
tgattgcaatgcatcctgaag

SEQ ID NO: 7891 - DNA, 21 bp, Artificial Sequence
  Description of Artificial Sequence: Synthetic oligonucleotide
caggatgcattgcaatcatcc

SEQ ID NO: 7892 - DNA, 21 bp, Artificial Sequence
  Description of Artificial Sequence: Synthetic oligonucleotide
atgattgcaatgcatcctgaa

SEQ ID NO: 7893 - DNA, 21 bp, Artificial Sequence
  Description of Artificial Sequence: Synthetic oligonucleotide
aggatgcattgcaatcatcct

SEQ ID NO: 7894 - DNA, 21 bp, Artificial Sequence
  Description of Artificial Sequence: Synthetic oligonucleotide
gatgattgcaatgcatcctga

SEQ ID NO: 7895 - DNA, 21 bp, Artificial Sequence
  Description of Artificial Sequence: Synthetic oligonucleotide
ggatgcattgcaatcatcctt

SEQ ID NO: 7896 - DNA, 21 bp, Artificial Sequence
  Description of Artificial Sequence: Synthetic oligonucleotide
ggatgattgcaatgcatcctg

SEQ ID NO: 7897 - DNA, 21 bp, Artificial Sequence
  Description of Artificial Sequence: Synthetic oligonucleotide
gatgcattgcaatcatccttt

SEQ ID NO: 7898 - DNA, 21 bp, Artificial Sequence
  Description of Artificial Sequence: Synthetic oligonucleotide
aggatgattgcaatgcatcct

SEQ ID NO: 7899 - DNA, 21 bp, Artificial Sequence
  Description of Artificial Sequence: Synthetic oligonucleotide
atgcattgcaatcatcctttt

SEQ ID NO: 7900 - DNA, 21 bp, Artificial Sequence
  Description of Artificial Sequence: Synthetic oligonucleotide
aaggatgattgcaatgcatcc

SEQ ID NO: 7901 - DNA, 21 bp, Artificial Sequence
  Description of Artificial Sequence: Synthetic oligonucleotide
tgcattgcaatcatccttttc

SEQ ID NO: 7902 - DNA, 21 bp, Artificial Sequence
  Description of Artificial Sequence: Synthetic oligonucleotide
aaaggatgattgcaatgcatc

SEQ ID NO: 7903 - DNA, 21 bp, Artificial Sequence
  Description of Artificial Sequence: Synthetic oligonucleotide
gcattgcaatcatccttttct

SEQ ID NO: 7904 - DNA, 21 bp, Artificial Sequence
  Description of Artificial Sequence: Synthetic oligonucleotide
aaaaggatgattgcaatgcat

SEQ ID NO: 7905 - DNA, 21 bp, Artificial Sequence
  Description of Artificial Sequence: Synthetic oligonucleotide
cattgcaatcatccttttctt

SEQ ID NO: 7906 - DNA, 21 bp, Artificial Sequence
  Description of Artificial Sequence: Synthetic oligonucleotide
gaaaaggatgattgcaatgca

SEQ ID NO: 7907 - DNA, 21 bp, Artificial Sequence
  Description of Artificial Sequence: Synthetic oligonucleotide
attgcaatcatccttttctta

SEQ ID NO: 7908 - DNA, 21 bp, Artificial Sequence
  Description of Artificial Sequence: Synthetic oligonucleotide
agaaaaggatgattgcaatgc

SEQ ID NO: 7909 - DNA, 21 bp, Artificial Sequence
  Description of Artificial Sequence: Synthetic oligonucleotide
ttgcaatcatccttttcttaa

SEQ ID NO: 7910 - DNA, 21 bp, Artificial Sequence
  Description of Artificial Sequence: Synthetic oligonucleotide
aagaaaaggatgattgcaatg

SEQ ID NO: 7911 - DNA, 21 bp, Artificial Sequence
  Description of Artificial Sequence: Synthetic oligonucleotide
tgcaatcatccttttcttaaa

SEQ ID NO: 7912 - DNA, 21 bp, Artificial Sequence
  Description of Artificial Sequence: Synthetic oligonucleotide
taagaaaaggatgattgcaat

SEQ ID NO: 7913 - DNA, 21 bp, Artificial Sequence
  Description of Artificial Sequence: Synthetic oligonucleotide
gcaatcatccttttcttaaat

SEQ ID NO: 7914 - DNA, 21 bp, Artificial Sequence
  Description of Artificial Sequence: Synthetic oligonucleotide
ttaagaaaaggatgattgcaa

SEQ ID NO: 7915 - DNA, 21 bp, Artificial Sequence
  Description of Artificial Sequence: Synthetic oligonucleotide
caatcatccttttcttaaatt

SEQ ID NO: 7916 - DNA, 21 bp, Artificial Sequence
  Description of Artificial Sequence: Synthetic oligonucleotide
tttaagaaaaggatgattgca

SEQ ID NO: 7917 - DNA, 21 bp, Artificial Sequence
  Description of Artificial Sequence: Synthetic oligonucleotide
aatcatccttttcttaaatta

SEQ ID NO: 7918 - DNA, 21 bp, Artificial Sequence
  Description of Artificial Sequence: Synthetic oligonucleotide
atttaagaaaaggatgattgc

SEQ ID NO: 7919 - DNA, 21 bp, Artificial Sequence
  Description of Artificial Sequence: Synthetic oligonucleotide
atcatccttttcttaaattat

SEQ ID NO: 7920 - DNA, 21 bp, Artificial Sequence
  Description of Artificial Sequence: Synthetic oligonucleotide
aatttaagaaaaggatgattg

SEQ ID NO: 7921 - DNA, 21 bp, Artificial Sequence
  Description of Artificial Sequence: Synthetic oligonucleotide
tcatccttttcttaaattatg

SEQ ID NO: 7922 - DNA, 21 bp, Artificial Sequence
  Description of Artificial Sequence: Synthetic oligonucleotide
taatttaagaaaaggatgatt

SEQ ID NO: 7923 - DNA, 21 bp, Artificial Sequence
  Description of Artificial Sequence: Synthetic oligonucleotide
catccttttcttaaattatgt

SEQ ID NO: 7924 - DNA, 21 bp, Artificial Sequence
  Description of Artificial Sequence: Synthetic oligonucleotide
ataatttaagaaaaggatgat

SEQ ID NO: 7925 - DNA, 21 bp, Artificial Sequence
  Description of Artificial Sequence: Synthetic oligonucleotide
atccttttcttaaattatgtc

SEQ ID NO: 7926 - DNA, 21 bp, Artificial Sequence
  Description of Artificial Sequence: Synthetic oligonucleotide
cataatttaagaaaaggatga

SEQ ID NO: 7927 - DNA, 21 bp, Artificial Sequence
  Description of Artificial Sequence: Synthetic oligonucleotide
tccttttcttaaattatgtca

SEQ ID NO: 7928 - DNA, 21 bp, Artificial Sequence
  Description of Artificial Sequence: Synthetic oligonucleotide
acataatttaagaaaaggatg

SEQ ID NO: 7929 - DNA, 21 bp, Artificial Sequence
  Description of Artificial Sequence: Synthetic oligonucleotide
ccttttcttaaattatgtcac

SEQ ID NO: 7930 - DNA, 21 bp, Artificial Sequence
  Description of Artificial Sequence: Synthetic oligonucleotide
gacataatttaagaaaaggat

SEQ ID NO: 7931 - DNA, 21 bp, Artificial Sequence
  Description of Artificial Sequence: Synthetic oligonucleotide
cttttcttaaattatgtcact

SEQ ID NO: 7932 - DNA, 21 bp, Artificial Sequence
  Description of Artificial Sequence: Synthetic oligonucleotide
tgacataatttaagaaaagga

SEQ ID NO: 7933 - DNA, 21 bp, Artificial Sequence
  Description of Artificial Sequence: Synthetic oligonucleotide
ttttcttaaattatgtcacta

SEQ ID NO: 7934 - DNA, 21 bp, Artificial Sequence
  Description of Artificial Sequence: Synthetic oligonucleotide
gtgacataatttaagaaaagg

SEQ ID NO: 7935 - DNA, 21 bp, Artificial Sequence
  Description of Artificial Sequence: Synthetic oligonucleotide
tttcttaaattatgtcactag

SEQ ID NO: 7936 - DNA, 21 bp, Artificial Sequence
  Description of Artificial Sequence: Synthetic oligonucleotide
agtgacataatttaagaaaag

SEQ ID NO: 7937 - DNA, 21 bp, Artificial Sequence
  Description of Artificial Sequence: Synthetic oligonucleotide
ttcttaaattatgtcactagt

SEQ ID NO: 7938 - DNA, 21 bp, Artificial Sequence
  Description of Artificial Sequence: Synthetic oligonucleotide
tagtgacataatttaagaaaa

SEQ ID NO: 7939 - DNA, 21 bp, Artificial Sequence
  Description of Artificial Sequence: Synthetic oligonucleotide
tcttaaattatgtcactagtc

SEQ ID NO: 7940 - DNA, 21 bp, Artificial Sequence
  Description of Artificial Sequence: Synthetic oligonucleotide
ctagtgacataatttaagaaa

SEQ ID NO: 7941 - DNA, 21 bp, Artificial Sequence
  Description of Artificial Sequence: Synthetic oligonucleotide
cttaaattatgtcactagtct

SEQ ID NO: 7942 - DNA, 21 bp, Artificial Sequence
  Description of Artificial Sequence: Synthetic oligonucleotide
actagtgacataatttaagaa

SEQ ID NO: 7943 - DNA, 21 bp, Artificial Sequence
  Description of Artificial Sequence: Synthetic oligonucleotide
ttaaattatgtcactagtctt

SEQ ID NO: 7944 - DNA, 21 bp, Artificial Sequence
  Description of Artificial Sequence: Synthetic oligonucleotide
gactagtgacataatttaaga

SEQ ID NO: 7945 - DNA, 21 bp, Artificial Sequence
  Description of Artificial Sequence: Synthetic oligonucleotide
taaattatgtcactagtcttt

SEQ ID NO: 7946 - DNA, 21 bp, Artificial Sequence
  Description of Artificial Sequence: Synthetic oligonucleotide
agactagtgacataatttaag

SEQ ID NO: 7947 - DNA, 21 bp, Artificial Sequence
  Description of Artificial Sequence: Synthetic oligonucleotide
aaattatgtcactagtctttt

SEQ ID NO: 7948 - DNA, 21 bp, Artificial Sequence
  Description of Artificial Sequence: Synthetic oligonucleotide
aagactagtgacataatttaa

SEQ ID NO: 7949 - DNA, 21 bp, Artificial Sequence
  Description of Artificial Sequence: Synthetic oligonucleotide
aattatgtcactagtctttta

SEQ ID NO: 7950 - DNA, 21 bp, Artificial Sequence
  Description of Artificial Sequence: Synthetic oligonucleotide
aaagactagtgacataattta

SEQ ID NO: 7951 - DNA, 21 bp, Artificial Sequence
  Description of Artificial Sequence: Synthetic oligonucleotide
attatgtcactagtcttttat

SEQ ID NO: 7952 - DNA, 21 bp, Artificial Sequence
  Description of Artificial Sequence: Synthetic oligonucleotide
aaaagactagtgacataattt

SEQ ID NO: 7953 - DNA, 21 bp, Artificial Sequence
  Description of Artificial Sequence: Synthetic oligonucleotide
ttatgtcactagtcttttatt

SEQ ID NO: 7954 - DNA, 21 bp, Artificial Sequence
  Description of Artificial Sequence: Synthetic oligonucleotide
taaaagactagtgacataatt

SEQ ID NO: 7955 - DNA, 21 bp, Artificial Sequence
  Description of Artificial Sequence: Synthetic oligonucleotide
tatgtcactagtcttttattt

SEQ ID NO: 7956 - DNA, 21 bp, Artificial Sequence
  Description of Artificial Sequence: Synthetic oligonucleotide
ataaaagactagtgacataat

SEQ ID NO: 7957 - DNA, 21 bp, Artificial Sequence
  Description of Artificial Sequence: Synthetic oligonucleotide
atgtcactagtcttttatttt

SEQ ID NO: 7958 - DNA, 21 bp, Artificial Sequence
  Description of Artificial Sequence: Synthetic oligonucleotide
aataaaagactagtgacataa

SEQ ID NO: 7959 - DNA, 21 bp, Artificial Sequence
  Description of Artificial Sequence: Synthetic oligonucleotide
tgtcactagtcttttattttt

SEQ ID NO: 7960 - DNA, 21 bp, Artificial Sequence
  Description of Artificial Sequence: Synthetic oligonucleotide
aaataaaagactagtgacata

SEQ ID NO: 7961 - DNA, 21 bp, Artificial Sequence
  Description of Artificial Sequence: Synthetic oligonucleotide
gtcactagtcttttatttttt

SEQ ID NO: 7962 - DNA, 21 bp, Artificial Sequence
  Description of Artificial Sequence: Synthetic oligonucleotide
aaaataaaagactagtgacat

SEQ ID NO: 7963 - DNA, 21 bp, Artificial Sequence
  Description of Artificial Sequence: Synthetic oligonucleotide
tcactagtcttttattttttc

SEQ ID NO: 7964 - DNA, 21 bp, Artificial Sequence
  Description of Artificial Sequence: Synthetic oligonucleotide
aaaaataaaagactagtgaca

SEQ ID NO: 7965 - DNA, 21 bp, Artificial Sequence
  Description of Artificial Sequence: Synthetic oligonucleotide
cactagtcttttattttttcc

SEQ ID NO: 7966 - DNA, 21 bp, Artificial Sequence
  Description of Artificial Sequence: Synthetic oligonucleotide
aaaaaataaaagactagtgac

SEQ ID NO: 7967 - DNA, 21 bp, Artificial Sequence
  Description of Artificial Sequence: Synthetic oligonucleotide
actagtcttttattttttccc

SEQ ID NO: 7968 - DNA, 21 bp, Artificial Sequence
  Description of Artificial Sequence: Synthetic oligonucleotide
gaaaaaataaaagactagtga

SEQ ID NO: 7969 - DNA, 21 bp, Artificial Sequence
  Description of Artificial Sequence: Synthetic oligonucleotide
ctagtcttttattttttcccc

SEQ ID NO: 7970 - DNA, 21 bp, Artificial Sequence
  Description of Artificial Sequence: Synthetic oligonucleotide
ggaaaaaataaaagactagtg

SEQ ID NO: 7971 - DNA, 21 bp, Artificial Sequence
  Description of Artificial Sequence: Synthetic oligonucleotide
tagtcttttattttttcccct

SEQ ID NO: 7972 - DNA, 21 bp, Artificial Sequence
  Description of Artificial Sequence: Synthetic oligonucleotide
gggaaaaaataaaagactagt

SEQ ID NO: 7973 - DNA, 21 bp, Artificial Sequence
  Description of Artificial Sequence: Synthetic oligonucleotide
agtcttttattttttcccctc

SEQ ID NO: 7974 - DNA, 21 bp, Artificial Sequence
  Description of Artificial Sequence: Synthetic oligonucleotide
ggggaaaaaataaaagactag

SEQ ID NO: 7975 - DNA, 21 bp, Artificial Sequence
  Description of Artificial Sequence: Synthetic oligonucleotide
gtcttttattttttcccctct

SEQ ID NO: 7976 - DNA, 21 bp, Artificial Sequence
  Description of Artificial Sequence: Synthetic oligonucleotide
aggggaaaaaataaaagacta

SEQ ID NO: 7977 - DNA, 21 bp, Artificial Sequence
  Description of Artificial Sequence: Synthetic oligonucleotide
tcttttattttttcccctctt

SEQ ID NO: 7978 - DNA, 21 bp, Artificial Sequence
  Description of Artificial Sequence: Synthetic oligonucleotide
gaggggaaaaaataaaagact

SEQ ID NO: 7979 - DNA, 21 bp, Artificial Sequence
  Description of Artificial Sequence: Synthetic oligonucleotide
cttttattttttcccctcttg

SEQ ID NO: 7980 - DNA, 21 bp, Artificial Sequence
  Description of Artificial Sequence: Synthetic oligonucleotide
agaggggaaaaaataaaagac

SEQ ID NO: 7981 - DNA, 21 bp, Artificial Sequence
  Description of Artificial Sequence: Synthetic oligonucleotide
ttttattttttcccctcttga

SEQ ID NO: 7982 - DNA, 21 bp, Artificial Sequence
  Description of Artificial Sequence: Synthetic oligonucleotide
aagaggggaaaaaataaaaga

SEQ ID NO: 7983 - DNA, 21 bp, Artificial Sequence
  Description of Artificial Sequence: Synthetic oligonucleotide
tttattttttcccctcttgaa

SEQ ID NO: 7984 - DNA, 21 bp, Artificial Sequence
  Description of Artificial Sequence: Synthetic oligonucleotide
caagaggggaaaaaataaaag

SEQ ID NO: 7985 - DNA, 21 bp, Artificial Sequence
  Description of Artificial Sequence: Synthetic oligonucleotide
ttattttttcccctcttgaac

SEQ ID NO: 7986 - DNA, 21 bp, Artificial Sequence
  Description of Artificial Sequence: Synthetic oligonucleotide
tcaagaggggaaaaaataaaa

SEQ ID NO: 7987 - DNA, 21 bp, Artificial Sequence
  Description of Artificial Sequence: Synthetic oligonucleotide
tattttttcccctcttgaact

SEQ ID NO: 7988 - DNA, 21 bp, Artificial Sequence
  Description of Artificial Sequence: Synthetic oligonucleotide
ttcaagaggggaaaaaataaa

SEQ ID NO: 7989 - DNA, 21 bp, Artificial Sequence
  Description of Artificial Sequence: Synthetic oligonucleotide
attttttcccctcttgaactt

SEQ ID NO: 7990 - DNA, 21 bp, Artificial Sequence
  Description of Artificial Sequence: Synthetic oligonucleotide
gttcaagaggggaaaaaataa

SEQ ID NO: 7991 - DNA, 21 bp, Artificial Sequence
  Description of Artificial Sequence: Synthetic oligonucleotide
ttttttcccctcttgaacttt

SEQ ID NO: 7992 - DNA, 21 bp, Artificial Sequence
  Description of Artificial Sequence: Synthetic oligonucleotide
agttcaagaggggaaaaaata

SEQ ID NO: 7993 - DNA, 21 bp, Artificial Sequence
  Description of Artificial Sequence: Synthetic oligonucleotide
tttttcccctcttgaactttc

SEQ ID NO: 7994 - DNA, 21 bp, Artificial Sequence
  Description of Artificial Sequence: Synthetic oligonucleotide
aagttcaagaggggaaaaaat

SEQ ID NO: 7995 - DNA, 21 bp, Artificial Sequence
  Description of Artificial Sequence: Synthetic oligonucleotide
ttttcccctcttgaactttcc

SEQ ID NO: 7996 - DNA, 21 bp, Artificial Sequence
  Description of Artificial Sequence: Synthetic oligonucleotide
aaagttcaagaggggaaaaaa

SEQ ID NO: 7997 - DNA, 21 bp, Artificial Sequence
  Description of Artificial Sequence: Synthetic oligonucleotide
tttcccctcttgaactttcct

SEQ ID NO: 7998 - DNA, 21 bp, Artificial Sequence
  Description of Artificial Sequence: Synthetic oligonucleotide
gaaagttcaagaggggaaaaa

SEQ ID NO: 7999 - DNA, 21 bp, Artificial Sequence
  Description of Artificial Sequence: Synthetic oligonucleotide
ttcccctcttgaactttcctc

SEQ ID NO: 8000 - DNA, 21 bp, Artificial Sequence
  Description of Artificial Sequence: Synthetic oligonucleotide
ggaaagttcaagaggggaaaa

SEQ ID NO: 8001 - DNA, 21 bp, Artificial Sequence
  Description of Artificial Sequence: Synthetic oligonucleotide
tcccctcttgaactttcctca

SEQ ID NO: 8002 - DNA, 21 bp, Artificial Sequence
  Description of Artificial Sequence: Synthetic oligonucleotide
aggaaagttcaagaggggaaa

SEQ ID NO: 8003 - DNA, 21 bp, Artificial Sequence
  Description of Artificial Sequence: Synthetic oligonucleotide
cccctcttgaactttcctcac

SEQ ID NO: 8004 - DNA, 21 bp, Artificial Sequence
  Description of Artificial Sequence: Synthetic oligonucleotide
gaggaaagttcaagaggggaa

SEQ ID NO: 8005 - DNA, 21 bp, Artificial Sequence
  Description of Artificial Sequence: Synthetic oligonucleotide
ccctcttgaactttcctcaca

SEQ ID NO: 8006 - DNA, 21 bp, Artificial Sequence
  Description of Artificial Sequence: Synthetic oligonucleotide
tgaggaaagttcaagagggga

SEQ ID NO: 8007 - DNA, 21 bp, Artificial Sequence
  Description of Artificial Sequence: Synthetic oligonucleotide
cctcttgaactttcctcacac

SEQ ID NO: 8008 - DNA, 21 bp, Artificial Sequence
  Description of Artificial Sequence: Synthetic oligonucleotide
gtgaggaaagttcaagagggg

SEQ ID NO: 8009 - DNA, 21 bp, Artificial Sequence
  Description of Artificial Sequence: Synthetic oligonucleotide
ctcttgaactttcctcacacc

SEQ ID NO: 8010 - DNA, 21 bp, Artificial Sequence
  Description of Artificial Sequence: Synthetic oligonucleotide
tgtgaggaaagttcaagaggg

SEQ ID NO: 8011 - DNA, 21 bp, Artificial Sequence
  Description of Artificial Sequence: Synthetic oligonucleotide
tcttgaactttcctcacacct

SEQ ID NO: 8012 - DNA, 21 bp, Artificial Sequence
  Description of Artificial Sequence: Synthetic oligonucleotide
gtgtgaggaaagttcaagagg

SEQ ID NO: 8013 - DNA, 21 bp, Artificial Sequence
  Description of Artificial Sequence: Synthetic oligonucleotide
cttgaactttcctcacacctg

SEQ ID NO: 8014 - DNA, 21 bp, Artificial Sequence
  Description of Artificial Sequence: Synthetic oligonucleotide
ggtgtgaggaaagttcaagag

SEQ ID NO: 8015 - DNA, 21 bp, Artificial Sequence
  Description of Artificial Sequence: Synthetic oligonucleotide
ttgaactttcctcacacctgg

SEQ ID NO: 8016 - DNA, 21 bp, Artificial Sequence
  Description of Artificial Sequence: Synthetic oligonucleotide
aggtgtgaggaaagttcaaga

SEQ ID NO: 8017 - DNA, 21 bp, Artificial Sequence
  Description of Artificial Sequence: Synthetic oligonucleotide
tgaactttcctcacacctgga

SEQ ID NO: 8018 - DNA, 21 bp, Artificial Sequence
  Description of Artificial Sequence: Synthetic oligonucleotide
caggtgtgaggaaagttcaag

SEQ ID NO: 8019 - DNA, 21 bp, Artificial Sequence
  Description of Artificial Sequence: Synthetic oligonucleotide
gaactttcctcacacctggaa

SEQ ID NO: 8020 - DNA, 21 bp, Artificial Sequence
  Description of Artificial Sequence: Synthetic oligonucleotide
ccaggtgtgaggaaagttcaa

SEQ ID NO: 8021 - DNA, 21 bp, Artificial Sequence
  Description of Artificial Sequence: Synthetic oligonucleotide
aactttcctcacacctggaag

SEQ ID NO: 8022 - DNA, 21 bp, Artificial Sequence
  Description of Artificial Sequence: Synthetic oligonucleotide
tccaggtgtgaggaaagttca

SEQ ID NO: 8023 - DNA, 21 bp, Artificial Sequence
  Description of Artificial Sequence: Synthetic oligonucleotide
actttcctcacacctggaaga

SEQ ID NO: 8024 - DNA, 21 bp, Artificial Sequence
  Description of Artificial Sequence: Synthetic oligonucleotide
ttccaggtgtgaggaaagttc

SEQ ID NO: 8025 - DNA, 21 bp, Artificial Sequence
  Description of Artificial Sequence: Synthetic oligonucleotide
ctttcctcacacctggaagaa

SEQ ID NO: 8026 - DNA, 21 bp, Artificial Sequence
  Description of Artificial Sequence: Synthetic oligonucleotide
cttccaggtgtgaggaaagtt

SEQ ID NO: 8027 - DNA, 21 bp, Artificial Sequence
  Description of Artificial Sequence: Synthetic oligonucleotide
tttcctcacacctggaagaaa

SEQ ID NO: 8028 - DNA, 21 bp, Artificial Sequence
  Description of Artificial Sequence: Synthetic oligonucleotide
tcttccaggtgtgaggaaagt

SEQ ID NO: 8029 - DNA, 21 bp, Artificial Sequence
  Description of Artificial Sequence: Synthetic oligonucleotide
ttcctcacacctggaagaaac

SEQ ID NO: 8030 - DNA, 21 bp, Artificial Sequence
  Description of Artificial Sequence: Synthetic oligonucleotide
ttcttccaggtgtgaggaaag

SEQ ID NO: 8031 - DNA, 21 bp, Artificial Sequence
  Description of Artificial Sequence: Synthetic oligonucleotide
tcctcacacctggaagaaaca

SEQ ID NO: 8032 - DNA, 21 bp, Artificial Sequence
  Description of Artificial Sequence: Synthetic oligonucleotide
tttcttccaggtgtgaggaaa

SEQ ID NO: 8033 - DNA, 21 bp, Artificial Sequence
  Description of Artificial Sequence: Synthetic oligonucleotide
cctcacacctggaagaaacaa

SEQ ID NO: 8034 - DNA, 21 bp, Artificial Sequence
  Description of Artificial Sequence: Synthetic oligonucleotide
gtttcttccaggtgtgaggaa

SEQ ID NO: 8035 - DNA, 21 bp, Artificial Sequence
  Description of Artificial Sequence: Synthetic oligonucleotide
ctcacacctggaagaaacaaa

SEQ ID NO: 8036 - DNA, 21 bp, Artificial Sequence
  Description of Artificial Sequence: Synthetic oligonucleotide
tgtttcttccaggtgtgagga

SEQ ID NO: 8037 - DNA, 21 bp, Artificial Sequence
  Description of Artificial Sequence: Synthetic oligonucleotide
tcacacctggaagaaacaaag

SEQ ID NO: 8038 - DNA, 21 bp, Artificial Sequence
  Description of Artificial Sequence: Synthetic oligonucleotide
ttgtttcttccaggtgtgagg

SEQ ID NO: 8039 - DNA, 21 bp, Artificial Sequence
  Description of Artificial Sequence: Synthetic oligonucleotide
cacacctggaagaaacaaagt

SEQ ID NO: 8040 - DNA, 21 bp, Artificial Sequence
  Description of Artificial Sequence: Synthetic oligonucleotide
tttgtttcttccaggtgtgag

SEQ ID NO: 8041 - DNA, 21 bp, Artificial Sequence
  Description of Artificial Sequence: Synthetic oligonucleotide
acacctggaagaaacaaagta

SEQ ID NO: 8042 - DNA, 21 bp, Artificial Sequence
  Description of Artificial Sequence: Synthetic oligonucleotide
ctttgtttcttccaggtgtga

SEQ ID NO: 8043 - DNA, 21 bp, Artificial Sequence
  Description of Artificial Sequence: Synthetic oligonucleotide
cacctggaagaaacaaagtag

SEQ ID NO: 8044 - DNA, 21 bp, Artificial Sequence
  Description of Artificial Sequence: Synthetic oligonucleotide
actttgtttcttccaggtgtg

SEQ ID NO: 8045 - DNA, 21 bp, Artificial Sequence
  Description of Artificial Sequence: Synthetic oligonucleotide
acctggaagaaacaaagtagg

SEQ ID NO: 8046 - DNA, 21 bp, Artificial Sequence
  Description of Artificial Sequence: Synthetic oligonucleotide
tactttgtttcttccaggtgt

SEQ ID NO: 8047 - DNA, 21 bp, Artificial Sequence
  Description of Artificial Sequence: Synthetic oligonucleotide
cctggaagaaacaaagtagga

SEQ ID NO: 8048 - DNA, 21 bp, Artificial Sequence
  Description of Artificial Sequence: Synthetic oligonucleotide
ctactttgtttcttccaggtg

SEQ ID NO: 8049 - DNA, 21 bp, Artificial Sequence
  Description of Artificial Sequence: Synthetic oligonucleotide
ctggaagaaacaaagtaggaa

SEQ ID NO: 8050 - DNA, 21 bp, Artificial Sequence
  Description of Artificial Sequence: Synthetic oligonucleotide
cctactttgtttcttccaggt

SEQ ID NO: 8051 - DNA, 21 bp, Artificial Sequence
  Description of Artificial Sequence: Synthetic oligonucleotide
tggaagaaacaaagtaggaaa

SEQ ID NO: 8052 - DNA, 21 bp, Artificial Sequence
  Description of Artificial Sequence: Synthetic oligonucleotide
tcctactttgtttcttccagg

SEQ ID NO: 8053 - DNA, 21 bp, Artificial Sequence
  Description of Artificial Sequence: Synthetic oligonucleotide
ggaagaaacaaagtaggaaaa

SEQ ID NO: 8054 - DNA, 21 bp, Artificial Sequence
  Description of Artificial Sequence: Synthetic oligonucleotide
ttcctactttgtttcttccag

SEQ ID NO: 8055 - DNA, 21 bp, Artificial Sequence
  Description of Artificial Sequence: Synthetic oligonucleotide
gaagaaacaaagtaggaaaaa

SEQ ID NO: 8056 - DNA, 21 bp, Artificial Sequence
  Description of Artificial Sequence: Synthetic oligonucleotide
tttcctactttgtttcttcca

SEQ ID NO: 8057 - DNA, 21 bp, Artificial Sequence
  Description of Artificial Sequence: Synthetic oligonucleotide
aagaaacaaagtaggaaaaag

SEQ ID NO: 8058 - DNA, 21 bp, Artificial Sequence
  Description of Artificial Sequence: Synthetic oligonucleotide
ttttcctactttgtttcttcc

SEQ ID NO: 8059 - DNA, 21 bp, Artificial Sequence
  Description of Artificial Sequence: Synthetic oligonucleotide
agaaacaaagtaggaaaaagt

SEQ ID NO: 8060 - DNA, 21 bp, Artificial Sequence
  Description of Artificial Sequence: Synthetic oligonucleotide
tttttcctactttgtttcttc

SEQ ID NO: 8061 - DNA, 21 bp, Artificial Sequence
  Description of Artificial Sequence: Synthetic oligonucleotide
gaaacaaagtaggaaaaagtg

SEQ ID NO: 8062 - DNA, 21 bp, Artificial Sequence
  Description of Artificial Sequence: Synthetic oligonucleotide
ctttttcctactttgtttctt

SEQ ID NO: 8063 - DNA, 21 bp, Artificial Sequence
  Description of Artificial Sequence: Synthetic oligonucleotide
aaacaaagtaggaaaaagtga

SEQ ID NO: 8064 - DNA, 21 bp, Artificial Sequence
  Description of Artificial Sequence: Synthetic oligonucleotide
actttttcctactttgtttct

SEQ ID NO: 8065 - DNA, 21 bp, Artificial Sequence
  Description of Artificial Sequence: Synthetic oligonucleotide
aacaaagtaggaaaaagtgaa

SEQ ID NO: 8066 - DNA, 21 bp, Artificial Sequence
  Description of Artificial Sequence: Synthetic oligonucleotide
cactttttcctactttgtttc

SEQ ID NO: 8067 - DNA, 21 bp, Artificial Sequence
  Description of Artificial Sequence: Synthetic oligonucleotide
acaaagtaggaaaaagtgaac

SEQ ID NO: 8068 - DNA, 21 bp, Artificial Sequence
  Description of Artificial Sequence: Synthetic oligonucleotide
tcactttttcctactttgttt

SEQ ID NO: 8069 - DNA, 21 bp, Artificial Sequence
  Description of Artificial Sequence: Synthetic oligonucleotide
caaagtaggaaaaagtgaaca

SEQ ID NO: 8070 - DNA, 21 bp, Artificial Sequence
  Description of Artificial Sequence: Synthetic oligonucleotide
ttcactttttcctactttgtt

SEQ ID NO: 8071 - DNA, 21 bp, Artificial Sequence
  Description of Artificial Sequence: Synthetic oligonucleotide
aaagtaggaaaaagtgaacag

SEQ ID NO: 8072 - DNA, 21 bp, Artificial Sequence
  Description of Artificial Sequence: Synthetic oligonucleotide
gttcactttttcctactttgt

SEQ ID NO: 8073 - DNA, 21 bp, Artificial Sequence
  Description of Artificial Sequence: Synthetic oligonucleotide
aagtaggaaaaagtgaacagg

SEQ ID NO: 8074 - DNA, 21 bp, Artificial Sequence
  Description of Artificial Sequence: Synthetic oligonucleotide
tgttcactttttcctactttg

SEQ ID NO: 8075 - DNA, 21 bp, Artificial Sequence
  Description of Artificial Sequence: Synthetic oligonucleotide
agtaggaaaaagtgaacaggg

SEQ ID NO: 8076 - DNA, 21 bp, Artificial Sequence
  Description of Artificial Sequence: Synthetic oligonucleotide
ctgttcactttttcctacttt

SEQ ID NO: 8077 - DNA, 21 bp, Artificial Sequence
  Description of Artificial Sequence: Synthetic oligonucleotide
gtaggaaaaagtgaacagggg

SEQ ID NO: 8078 - DNA, 21 bp, Artificial Sequence
  Description of Artificial Sequence: Synthetic oligonucleotide
cctgttcactttttcctactt

SEQ ID NO: 8079 - DNA, 21 bp, Artificial Sequence
  Description of Artificial Sequence: Synthetic oligonucleotide
taggaaaaagtgaacagggga

SEQ ID NO: 8080 - DNA, 21 bp, Artificial Sequence
  Description of Artificial Sequence: Synthetic oligonucleotide
ccctgttcactttttcctact

SEQ ID NO: 8081 - DNA, 21 bp, Artificial Sequence
  Description of Artificial Sequence: Synthetic oligonucleotide
aggaaaaagtgaacaggggat

SEQ ID NO: 8082 - DNA, 21 bp, Artificial Sequence
  Description of Artificial Sequence: Synthetic oligonucleotide
cccctgttcactttttcctac

SEQ ID NO: 8083 - DNA, 21 bp, Artificial Sequence
  Description of Artificial Sequence: Synthetic oligonucleotide
ggaaaaagtgaacaggggatg

SEQ ID NO: 8084 - DNA, 21 bp, Artificial Sequence
  Description of Artificial Sequence: Synthetic oligonucleotide
tcccctgttcactttttccta

SEQ ID NO: 8085 - DNA, 21 bp, Artificial Sequence
  Description of Artificial Sequence: Synthetic oligonucleotide
gaaaaagtgaacaggggatgt

SEQ ID NO: 8086 - DNA, 21 bp, Artificial Sequence
  Description of Artificial Sequence: Synthetic oligonucleotide
atcccctgttcactttttcct

SEQ ID NO: 8087 - DNA, 21 bp, Artificial Sequence
  Description of Artificial Sequence: Synthetic oligonucleotide
aaaaagtgaacaggggatgtc

SEQ ID NO: 8088 - DNA, 21 bp, Artificial Sequence
  Description of Artificial Sequence: Synthetic oligonucleotide
catcccctgttcactttttcc

SEQ ID NO: 8089 - DNA, 21 bp, Artificial Sequence
  Description of Artificial Sequence: Synthetic oligonucleotide
aaaagtgaacaggggatgtca

SEQ ID NO: 8090 - DNA, 21 bp, Artificial Sequence
  Description of Artificial Sequence: Synthetic oligonucleotide
acatcccctgttcactttttc

SEQ ID NO: 8091 - DNA, 21 bp, Artificial Sequence
  Description of Artificial Sequence: Synthetic oligonucleotide
aaagtgaacaggggatgtcaa

SEQ ID NO: 8092 - DNA, 21 bp, Artificial Sequence
  Description of Artificial Sequence: Synthetic oligonucleotide
gacatcccctgttcacttttt

SEQ ID NO: 8093 - DNA, 21 bp, Artificial Sequence
  Description of Artificial Sequence: Synthetic oligonucleotide
aagtgaacaggggatgtcaaa

SEQ ID NO: 8094 - DNA, 21 bp, Artificial Sequence
  Description of Artificial Sequence: Synthetic oligonucleotide
tgacatcccctgttcactttt

SEQ ID NO: 8095 - DNA, 21 bp, Artificial Sequence
  Description of Artificial Sequence: Synthetic oligonucleotide
agtgaacaggggatgtcaaat

SEQ ID NO: 8096 - DNA, 21 bp, Artificial Sequence
  Description of Artificial Sequence: Synthetic oligonucleotide
ttgacatcccctgttcacttt

SEQ ID NO: 8097 - DNA, 21 bp, Artificial Sequence
  Description of Artificial Sequence: Synthetic oligonucleotide
gtgaacaggggatgtcaaatc

SEQ ID NO: 8098 - DNA, 21 bp, Artificial Sequence
  Description of Artificial Sequence: Synthetic oligonucleotide
tttgacatcccctgttcactt

SEQ ID NO: 8099 - DNA, 21 bp, Artificial Sequence
  Description of Artificial Sequence: Synthetic oligonucleotide
tgaacaggggatgtcaaatcg

SEQ ID NO: 8100 - DNA, 21 bp, Artificial Sequence
  Description of Artificial Sequence: Synthetic oligonucleotide
atttgacatcccctgttcact

SEQ ID NO: 8101 - DNA, 21 bp, Artificial Sequence
  Description of Artificial Sequence: Synthetic oligonucleotide
gaacaggggatgtcaaatcga

SEQ ID NO: 8102 - DNA, 21 bp, Artificial Sequence
  Description of Artificial Sequence: Synthetic oligonucleotide
gatttgacatcccctgttcac

SEQ ID NO: 8103 - DNA, 21 bp, Artificial Sequence
  Description of Artificial Sequence: Synthetic oligonucleotide
aacaggggatgtcaaatcgat

SEQ ID NO: 8104 - DNA, 21 bp, Artificial Sequence
  Description of Artificial Sequence: Synthetic oligonucleotide
cgatttgacatcccctgttca

SEQ ID NO: 8105 - DNA, 21 bp, Artificial Sequence
  Description of Artificial Sequence: Synthetic oligonucleotide
acaggggatgtcaaatcgatt

SEQ ID NO: 8106 - DNA, 21 bp, Artificial Sequence
  Description of Artificial Sequence: Synthetic oligonucleotide
tcgatttgacatcccctgttc

SEQ ID NO: 8107 - DNA, 21 bp, Artificial Sequence
  Description of Artificial Sequence: Synthetic oligonucleotide
caggggatgtcaaatcgattc

SEQ ID NO: 8108 - DNA, 21 bp, Artificial Sequence
  Description of Artificial Sequence: Synthetic oligonucleotide
atcgatttgacatcccctgtt

SEQ ID NO: 8109 - DNA, 21 bp, Artificial Sequence
  Description of Artificial Sequence: Synthetic oligonucleotide
aggggatgtcaaatcgattct

SEQ ID NO: 8110 - DNA, 21 bp, Artificial Sequence
  Description of Artificial Sequence: Synthetic oligonucleotide
aatcgatttgacatcccctgt

SEQ ID NO: 8111 - DNA, 21 bp, Artificial Sequence
  Description of Artificial Sequence: Synthetic oligonucleotide
ggggatgtcaaatcgattctt

SEQ ID NO: 8112 - DNA, 21 bp, Artificial Sequence
  Description of Artificial Sequence: Synthetic oligonucleotide
gaatcgatttgacatcccctg

SEQ ID NO: 8113 - DNA, 21 bp, Artificial Sequence
  Description of Artificial Sequence: Synthetic oligonucleotide
gggatgtcaaatcgattcttg

SEQ ID NO: 8114 - DNA, 21 bp, Artificial Sequence
  Description of Artificial Sequence: Synthetic oligonucleotide
agaatcgatttgacatcccct

SEQ ID NO: 8115 - DNA, 21 bp, Artificial Sequence
  Description of Artificial Sequence: Synthetic oligonucleotide
ggatgtcaaatcgattcttga

SEQ ID NO: 8116 - DNA, 21 bp, Artificial Sequence
  Description of Artificial Sequence: Synthetic oligonucleotide
aagaatcgatttgacatcccc

SEQ ID NO: 8117 - DNA, 21 bp, Artificial Sequence
  Description of Artificial Sequence: Synthetic oligonucleotide
gatgtcaaatcgattcttgaa

SEQ ID NO: 8118 - DNA, 21 bp, Artificial Sequence
  Description of Artificial Sequence: Synthetic oligonucleotide
caagaatcgatttgacatccc

SEQ ID NO: 8119 - DNA, 21 bp, Artificial Sequence
  Description of Artificial Sequence: Synthetic oligonucleotide
atgtcaaatcgattcttgaat

SEQ ID NO: 8120 - DNA, 21 bp, Artificial Sequence
  Description of Artificial Sequence: Synthetic oligonucleotide
tcaagaatcgatttgacatcc

SEQ ID NO: 8121 - DNA, 21 bp, Artificial Sequence
  Description of Artificial Sequence: Synthetic oligonucleotide
tgtcaaatcgattcttgaatt

SEQ ID NO: 8122 - DNA, 21 bp, Artificial Sequence
  Description of Artificial Sequence: Synthetic oligonucleotide
ttcaagaatcgatttgacatc

SEQ ID NO: 8123 - DNA, 21 bp, Artificial Sequence
  Description of Artificial Sequence: Synthetic oligonucleotide
gtcaaatcgattcttgaattc

SEQ ID NO: 8124 - DNA, 21 bp, Artificial Sequence
  Description of Artificial Sequence: Synthetic oligonucleotide
attcaagaatcgatttgacat

SEQ ID NO: 8125 - DNA, 21 bp, Artificial Sequence
  Description of Artificial Sequence: Synthetic oligonucleotide
tcaaatcgattcttgaattcc

SEQ ID NO: 8126 - DNA, 21 bp, Artificial Sequence
  Description of Artificial Sequence: Synthetic oligonucleotide
aattcaagaatcgatttgaca

SEQ ID NO: 8127 - DNA, 21 bp, Artificial Sequence
  Description of Artificial Sequence: Synthetic oligonucleotide
caaatcgattcttgaattccc

SEQ ID NO: 8128 - DNA, 21 bp, Artificial Sequence
  Description of Artificial Sequence: Synthetic oligonucleotide
gaattcaagaatcgatttgac

SEQ ID NO: 8129 - DNA, 21 bp, Artificial Sequence
  Description of Artificial Sequence: Synthetic oligonucleotide
aaatcgattcttgaattcccg

SEQ ID NO: 8130 - DNA, 21 bp, Artificial Sequence
  Description of Artificial Sequence: Synthetic oligonucleotide
ggaattcaagaatcgatttga

SEQ ID NO: 8131 - DNA, 21 bp, Artificial Sequence
  Description of Artificial Sequence: Synthetic oligonucleotide
aatcgattcttgaattcccgc

SEQ ID NO: 8132 - DNA, 21 bp, Artificial Sequence
  Description of Artificial Sequence: Synthetic oligonucleotide
gggaattcaagaatcgatttg

SEQ ID NO: 8133 - DNA, 21 bp, Artificial Sequence
  Description of Artificial Sequence: Synthetic oligonucleotide
atcgattcttgaattcccgct

SEQ ID NO: 8134 - DNA, 21 bp, Artificial Sequence
  Description of Artificial Sequence: Synthetic oligonucleotide
cgggaattcaagaatcgattt

SEQ ID NO: 8135 - DNA, 21 bp, Artificial Sequence
  Description of Artificial Sequence: Synthetic oligonucleotide
tcgattcttgaattcccgctg

SEQ ID NO: 8136 - DNA, 21 bp, Artificial Sequence
  Description of Artificial Sequence: Synthetic oligonucleotide
gcgggaattcaagaatcgatt

SEQ ID NO: 8137 - DNA, 21 bp, Artificial Sequence
  Description of Artificial Sequence: Synthetic oligonucleotide
cgattcttgaattcccgctgc

SEQ ID NO: 8138 - DNA, 21 bp, Artificial Sequence
  Description of Artificial Sequence: Synthetic oligonucleotide
agcgggaattcaagaatcgat

SEQ ID NO: 8139 - DNA, 21 bp, Artificial Sequence
  Description of Artificial Sequence: Synthetic oligonucleotide
gattcttgaattcccgctgca

SEQ ID NO: 8140 - DNA, 21 bp, Artificial Sequence
  Description of Artificial Sequence: Synthetic oligonucleotide
cagcgggaattcaagaatcga

SEQ ID NO: 8141 - DNA, 21 bp, Artificial Sequence
  Description of Artificial Sequence: Synthetic oligonucleotide
attcttgaattcccgctgcaa

SEQ ID NO: 8142 - DNA, 21 bp, Artificial Sequence
  Description of Artificial Sequence: Synthetic oligonucleotide
gcagcgggaattcaagaatcg

SEQ ID NO: 8143 - DNA, 21 bp, Artificial Sequence
  Description of Artificial Sequence: Synthetic oligonucleotide
ttcttgaattcccgctgcaag

SEQ ID NO: 8144 - DNA, 21 bp, Artificial Sequence
  Description of Artificial Sequence: Synthetic oligonucleotide
tgcagcgggaattcaagaatc

SEQ ID NO: 8145 - DNA, 21 bp, Artificial Sequence
  Description of Artificial Sequence: Synthetic oligonucleotide
tcttgaattcccgctgcaagc

SEQ ID NO: 8146 - DNA, 21 bp, Artificial Sequence
  Description of Artificial Sequence: Synthetic oligonucleotide
ttgcagcgggaattcaagaat

SEQ ID NO: 8147 - DNA, 21 bp, Artificial Sequence
  Description of Artificial Sequence: Synthetic oligonucleotide
cttgaattcccgctgcaagct

SEQ ID NO: 8148 - DNA, 21 bp, Artificial Sequence
  Description of Artificial Sequence: Synthetic oligonucleotide
cttgcagcgggaattcaagaa

SEQ ID NO: 8149 - DNA, 21 bp, Artificial Sequence
  Description of Artificial Sequence: Synthetic oligonucleotide
ttgaattcccgctgcaagcta

SEQ ID NO: 8150 - DNA, 21 bp, Artificial Sequence
  Description of Artificial Sequence: Synthetic oligonucleotide
gcttgcagcgggaattcaaga

SEQ ID NO: 8151 - DNA, 21 bp, Artificial Sequence
  Description of Artificial Sequence: Synthetic oligonucleotide
tgaattcccgctgcaagctag

SEQ ID NO: 8152 - DNA, 21 bp, Artificial Sequence
  Description of Artificial Sequence: Synthetic oligonucleotide
agcttgcagcgggaattcaag

SEQ ID NO: 8153 - DNA, 21 bp, Artificial Sequence
  Description of Artificial Sequence: Synthetic oligonucleotide
gaattcccgctgcaagctaga

SEQ ID NO: 8154 - DNA, 21 bp, Artificial Sequence
  Description of Artificial Sequence: Synthetic oligonucleotide
tagcttgcagcgggaattcaa

SEQ ID NO: 8155 - DNA, 21 bp, Artificial Sequence
  Description of Artificial Sequence: Synthetic oligonucleotide
aattcccgctgcaagctagag

SEQ ID NO: 8156 - DNA, 21 bp, Artificial Sequence
  Description of Artificial Sequence: Synthetic oligonucleotide
ctagcttgcagcgggaattca

SEQ ID NO: 8157 - DNA, 21 bp, Artificial Sequence
  Description of Artificial Sequence: Synthetic oligonucleotide
attcccgctgcaagctagagc

SEQ ID NO: 8158 - DNA, 21 bp, Artificial Sequence
  Description of Artificial Sequence: Synthetic oligonucleotide
tctagcttgcagcgggaattc

SEQ ID NO: 8159 - DNA, 21 bp, Artificial Sequence
  Description of Artificial Sequence: Synthetic oligonucleotide
ttcccgctgcaagctagagcc

SEQ ID NO: 8160 - DNA, 21 bp, Artificial Sequence
  Description of Artificial Sequence: Synthetic oligonucleotide
ctctagcttgcagcgggaatt

SEQ ID NO: 8161 - DNA, 21 bp, Artificial Sequence
  Description of Artificial Sequence: Synthetic oligonucleotide
tcccgctgcaagctagagccg

SEQ ID NO: 8162 - DNA, 21 bp, Artificial Sequence
  Description of Artificial Sequence: Synthetic oligonucleotide
gctctagcttgcagcgggaat

SEQ ID NO: 8163 - DNA, 21 bp, Artificial Sequence
  Description of Artificial Sequence: Synthetic oligonucleotide
cccgctgcaagctagagccgc

SEQ ID NO: 8164 - DNA, 21 bp, Artificial Sequence
  Description of Artificial Sequence: Synthetic oligonucleotide
ggctctagcttgcagcgggaa

SEQ ID NO: 8165 - DNA, 21 bp, Artificial Sequence
  Description of Artificial Sequence: Synthetic oligonucleotide
ccgctgcaagctagagccgca

SEQ ID NO: 8166 - DNA, 21 bp, Artificial Sequence
  Description of Artificial Sequence: Synthetic oligonucleotide
cggctctagcttgcagcggga

SEQ ID NO: 8167 - DNA, 21 bp, Artificial Sequence
  Description of Artificial Sequence: Synthetic oligonucleotide
cgctgcaagctagagccgcag

SEQ ID NO: 8168 - DNA, 21 bp, Artificial Sequence
  Description of Artificial Sequence: Synthetic oligonucleotide
gcggctctagcttgcagcggg

SEQ ID NO: 8169 - DNA, 21 bp, Artificial Sequence
  Description of Artificial Sequence: Synthetic oligonucleotide
gctgcaagctagagccgcagg

SEQ ID NO: 8170 - DNA, 21 bp, Artificial Sequence
  Description of Artificial Sequence: Synthetic oligonucleotide
tgcggctctagcttgcagcgg

SEQ ID NO: 8171 - DNA, 21 bp, Artificial Sequence
  Description of Artificial Sequence: Synthetic oligonucleotide
ctgcaagctagagccgcaggc

SEQ ID NO: 8172 - DNA, 21 bp, Artificial Sequence
  Description of Artificial Sequence: Synthetic oligonucleotide
ctgcggctctagcttgcagcg

SEQ ID NO: 8173 - DNA, 21 bp, Artificial Sequence
  Description of Artificial Sequence: Synthetic oligonucleotide
tgcaagctagagccgcaggca

SEQ ID NO: 8174 - DNA, 21 bp, Artificial Sequence
  Description of Artificial Sequence: Synthetic oligonucleotide
cctgcggctctagcttgcagc

SEQ ID NO: 8175 - DNA, 21 bp, Artificial Sequence
  Description of Artificial Sequence: Synthetic oligonucleotide
gcaagctagagccgcaggcac

SEQ ID NO: 8176 - DNA, 21 bp, Artificial Sequence
  Description of Artificial Sequence: Synthetic oligonucleotide
gcctgcggctctagcttgcag

SEQ ID NO: 8177 - DNA, 21 bp, Artificial Sequence
  Description of Artificial Sequence: Synthetic oligonucleotide
caagctagagccgcaggcacc

SEQ ID NO: 8178 - DNA, 21 bp, Artificial Sequence
  Description of Artificial Sequence: Synthetic oligonucleotide
tgcctgcggctctagcttgca

SEQ ID NO: 8179 - DNA, 21 bp, Artificial Sequence
  Description of Artificial Sequence: Synthetic oligonucleotide
aagctagagccgcaggcaccc

SEQ ID NO: 8180 - DNA, 21 bp, Artificial Sequence
  Description of Artificial Sequence: Synthetic oligonucleotide
gtgcctgcggctctagcttgc

SEQ ID NO: 8181 - DNA, 21 bp, Artificial Sequence
  Description of Artificial Sequence: Synthetic oligonucleotide
agctagagccgcaggcaccct

SEQ ID NO: 8182 - DNA, 21 bp, Artificial Sequence
  Description of Artificial Sequence: Synthetic oligonucleotide
ggtgcctgcggctctagcttg

SEQ ID NO: 8183 - DNA, 21 bp, Artificial Sequence
  Description of Artificial Sequence: Synthetic oligonucleotide
gctagagccgcaggcaccctc

SEQ ID NO: 8184 - DNA, 21 bp, Artificial Sequence
  Description of Artificial Sequence: Synthetic oligonucleotide
gggtgcctgcggctctagctt

SEQ ID NO: 8185 - DNA, 21 bp, Artificial Sequence
  Description of Artificial Sequence: Synthetic oligonucleotide
ctagagccgcaggcaccctct

SEQ ID NO: 8186 - DNA, 21 bp, Artificial Sequence
  Description of Artificial Sequence: Synthetic oligonucleotide
agggtgcctgcggctctagct

SEQ ID NO: 8187 - DNA, 21 bp, Artificial Sequence
  Description of Artificial Sequence: Synthetic oligonucleotide
tagagccgcaggcaccctctc

SEQ ID NO: 8188 - DNA, 21 bp, Artificial Sequence
  Description of Artificial Sequence: Synthetic oligonucleotide
gagggtgcctgcggctctagc

SEQ ID NO: 8189 - DNA, 21 bp, Artificial Sequence
  Description of Artificial Sequence: Synthetic oligonucleotide
agagccgcaggcaccctctca

SEQ ID NO: 8190 - DNA, 21 bp, Artificial Sequence
  Description of Artificial Sequence: Synthetic oligonucleotide
agagggtgcctgcggctctag

SEQ ID NO: 8191 - DNA, 21 bp, Artificial Sequence
  Description of Artificial Sequence: Synthetic oligonucleotide
gagccgcaggcaccctctcac

SEQ ID NO: 8192 - DNA, 21 bp, Artificial Sequence
  Description of Artificial Sequence: Synthetic oligonucleotide
gagagggtgcctgcggctcta

SEQ ID NO: 8193 - DNA, 21 bp, Artificial Sequence
  Description of Artificial Sequence: Synthetic oligonucleotide
agccgcaggcaccctctcact

SEQ ID NO: 8194 - DNA, 21 bp, Artificial Sequence
  Description of Artificial Sequence: Synthetic oligonucleotide
tgagagggtgcctgcggctct

SEQ ID NO: 8195 - DNA, 21 bp, Artificial Sequence
  Description of Artificial Sequence: Synthetic oligonucleotide
gccgcaggcaccctctcactc

SEQ ID NO: 8196 - DNA, 21 bp, Artificial Sequence
  Description of Artificial Sequence: Synthetic oligonucleotide
gtgagagggtgcctgcggctc

SEQ ID NO: 8197 - DNA, 21 bp, Artificial Sequence
  Description of Artificial Sequence: Synthetic oligonucleotide
ccgcaggcaccctctcactca

SEQ ID NO: 8198 - DNA, 21 bp, Artificial Sequence
  Description of Artificial Sequence: Synthetic oligonucleotide
agtgagagggtgcctgcggct

SEQ ID NO: 8199 - DNA, 21 bp, Artificial Sequence
  Description of Artificial Sequence: Synthetic oligonucleotide
cgcaggcaccctctcactcaa

SEQ ID NO: 8200 - DNA, 21 bp, Artificial Sequence
  Description of Artificial Sequence: Synthetic oligonucleotide
gagtgagagggtgcctgcggc

SEQ ID NO: 8201 - DNA, 21 bp, Artificial Sequence
  Description of Artificial Sequence: Synthetic oligonucleotide
gcaggcaccctctcactcaat

SEQ ID NO: 8202 - DNA, 21 bp, Artificial Sequence
  Description of Artificial Sequence: Synthetic oligonucleotide
tgagtgagagggtgcctgcgg

SEQ ID NO: 8203 - DNA, 21 bp, Artificial Sequence
  Description of Artificial Sequence: Synthetic oligonucleotide
caggcaccctctcactcaatt

SEQ ID NO: 8204 - DNA, 21 bp, Artificial Sequence
  Description of Artificial Sequence: Synthetic oligonucleotide
ttgagtgagagggtgcctgcg

SEQ ID NO: 8205 - DNA, 21 bp, Artificial Sequence
  Description of Artificial Sequence: Synthetic oligonucleotide
aggcaccctctcactcaattt

SEQ ID NO: 8206 - DNA, 21 bp, Artificial Sequence
  Description of Artificial Sequence: Synthetic oligonucleotide
attgagtgagagggtgcctgc

SEQ ID NO: 8207 - DNA, 21 bp, Artificial Sequence
  Description of Artificial Sequence: Synthetic oligonucleotide
ggcaccctctcactcaatttc

SEQ ID NO: 8208 - DNA, 21 bp, Artificial Sequence
  Description of Artificial Sequence: Synthetic oligonucleotide
aattgagtgagagggtgcctg

SEQ ID NO: 8209 - DNA, 21 bp, Artificial Sequence
  Description of Artificial Sequence: Synthetic oligonucleotide
gcaccctctcactcaatttcc

SEQ ID NO: 8210 - DNA, 21 bp, Artificial Sequence
  Description of Artificial Sequence: Synthetic oligonucleotide
aaattgagtgagagggtgcct

SEQ ID NO: 8211 - DNA, 21 bp, Artificial Sequence
  Description of Artificial Sequence: Synthetic oligonucleotide
caccctctcactcaatttcca

SEQ ID NO: 8212 - DNA, 21 bp, Artificial Sequence
  Description of Artificial Sequence: Synthetic oligonucleotide
gaaattgagtgagagggtgcc

SEQ ID NO: 8213 - DNA, 21 bp, Artificial Sequence
  Description of Artificial Sequence: Synthetic oligonucleotide
accctctcactcaatttccac

SEQ ID NO: 8214 - DNA, 21 bp, Artificial Sequence
  Description of Artificial Sequence: Synthetic oligonucleotide
ggaaattgagtgagagggtgc

SEQ ID NO: 8215 - DNA, 21 bp, Artificial Sequence
  Description of Artificial Sequence: Synthetic oligonucleotide
ccctctcactcaatttccact

SEQ ID NO: 8216 - DNA, 21 bp, Artificial Sequence
  Description of Artificial Sequence: Synthetic oligonucleotide
tggaaattgagtgagagggtg

SEQ ID NO: 8217 - DNA, 21 bp, Artificial Sequence
  Description of Artificial Sequence: Synthetic oligonucleotide
cctctcactcaatttccactc

SEQ ID NO: 8218 - DNA, 21 bp, Artificial Sequence
  Description of Artificial Sequence: Synthetic oligonucleotide
gtggaaattgagtgagagggt

SEQ ID NO: 8219 - DNA, 21 bp, Artificial Sequence
  Description of Artificial Sequence: Synthetic oligonucleotide
ctctcactcaatttccactca

SEQ ID NO: 8220 - DNA, 21 bp, Artificial Sequence
  Description of Artificial Sequence: Synthetic oligonucleotide
agtggaaattgagtgagaggg

SEQ ID NO: 8221 - DNA, 21 bp, Artificial Sequence
  Description of Artificial Sequence: Synthetic oligonucleotide
tctcactcaatttccactcag

SEQ ID NO: 8222 - DNA, 21 bp, Artificial Sequence
  Description of Artificial Sequence: Synthetic oligonucleotide
gagtggaaattgagtgagagg

SEQ ID NO: 8223 - DNA, 21 bp, Artificial Sequence
  Description of Artificial Sequence: Synthetic oligonucleotide
ctcactcaatttccactcaga

SEQ ID NO: 8224 - DNA, 21 bp, Artificial Sequence
  Description of Artificial Sequence: Synthetic oligonucleotide
tgagtggaaattgagtgagag

SEQ ID NO: 8225 - DNA, 21 bp, Artificial Sequence
  Description of Artificial Sequence: Synthetic oligonucleotide
tcactcaatttccactcagaa

SEQ ID NO: 8226 - DNA, 21 bp, Artificial Sequence
  Description of Artificial Sequence: Synthetic oligonucleotide
ctgagtggaaattgagtgaga

SEQ ID NO: 8227 - DNA, 21 bp, Artificial Sequence
  Description of Artificial Sequence: Synthetic oligonucleotide
cactcaatttccactcagaac

SEQ ID NO: 8228 - DNA, 21 bp, Artificial Sequence
  Description of Artificial Sequence: Synthetic oligonucleotide
tctgagtggaaattgagtgag

SEQ ID NO: 8229 - DNA, 21 bp, Artificial Sequence
  Description of Artificial Sequence: Synthetic oligonucleotide
actcaatttccactcagaacc

SEQ ID NO: 8230 - DNA, 21 bp, Artificial Sequence
  Description of Artificial Sequence: Synthetic oligonucleotide
ttctgagtggaaattgagtga

SEQ ID NO: 8231 - DNA, 21 bp, Artificial Sequence
  Description of Artificial Sequence: Synthetic oligonucleotide
ctcaatttccactcagaaccc

SEQ ID NO: 8232 - DNA, 21 bp, Artificial Sequence
  Description of Artificial Sequence: Synthetic oligonucleotide
gttctgagtggaaattgagtg

SEQ ID NO: 8233 - DNA, 21 bp, Artificial Sequence
  Description of Artificial Sequence: Synthetic oligonucleotide
tcaatttccactcagaaccct

SEQ ID NO: 8234 - DNA, 21 bp, Artificial Sequence
  Description of Artificial Sequence: Synthetic oligonucleotide
ggttctgagtggaaattgagt

SEQ ID NO: 8235 - DNA, 21 bp, Artificial Sequence
  Description of Artificial Sequence: Synthetic oligonucleotide
caatttccactcagaacccta

SEQ ID NO: 8236 - DNA, 21 bp, Artificial Sequence
  Description of Artificial Sequence: Synthetic oligonucleotide
gggttctgagtggaaattgag

SEQ ID NO: 8237 - DNA, 21 bp, Artificial Sequence
  Description of Artificial Sequence: Synthetic oligonucleotide
aatttccactcagaaccctat

SEQ ID NO: 8238 - DNA, 21 bp, Artificial Sequence
  Description of Artificial Sequence: Synthetic oligonucleotide
agggttctgagtggaaattga

SEQ ID NO: 8239 - DNA, 21 bp, Artificial Sequence
  Description of Artificial Sequence: Synthetic oligonucleotide
atttccactcagaaccctata

SEQ ID NO: 8240 - DNA, 21 bp, Artificial Sequence
  Description of Artificial Sequence: Synthetic oligonucleotide
tagggttctgagtggaaattg

SEQ ID NO: 8241 - DNA, 21 bp, Artificial Sequence
  Description of Artificial Sequence: Synthetic oligonucleotide
tttccactcagaaccctataa

SEQ ID NO: 8242 - DNA, 21 bp, Artificial Sequence
  Description of Artificial Sequence: Synthetic oligonucleotide
atagggttctgagtggaaatt

SEQ ID NO: 8243 - DNA, 21 bp, Artificial Sequence
  Description of Artificial Sequence: Synthetic oligonucleotide
ttccactcagaaccctataaa

SEQ ID NO: 8244 - DNA, 21 bp, Artificial Sequence
  Description of Artificial Sequence: Synthetic oligonucleotide
tatagggttctgagtggaaat

SEQ ID NO: 8245 - DNA, 21 bp, Artificial Sequence
  Description of Artificial Sequence: Synthetic oligonucleotide
tccactcagaaccctataaac

SEQ ID NO: 8246 - DNA, 21 bp, Artificial Sequence
  Description of Artificial Sequence: Synthetic oligonucleotide
ttatagggttctgagtggaaa

SEQ ID NO: 8247 - DNA, 21 bp, Artificial Sequence
  Description of Artificial Sequence: Synthetic oligonucleotide
ccactcagaaccctataaaca

SEQ ID NO: 8248 - DNA, 21 bp, Artificial Sequence
  Description of Artificial Sequence: Synthetic oligonucleotide
tttatagggttctgagtggaa

SEQ ID NO: 8249 - DNA, 21 bp, Artificial Sequence
  Description of Artificial Sequence: Synthetic oligonucleotide
cactcagaaccctataaacac

SEQ ID NO: 8250 - DNA, 21 bp, Artificial Sequence
  Description of Artificial Sequence: Synthetic oligonucleotide
gtttatagggttctgagtgga

SEQ ID NO: 8251 - DNA, 21 bp, Artificial Sequence
  Description of Artificial Sequence: Synthetic oligonucleotide
actcagaaccctataaacacc

SEQ ID NO: 8252 - DNA, 21 bp, Artificial Sequence
  Description of Artificial Sequence: Synthetic oligonucleotide
tgtttatagggttctgagtgg

SEQ ID NO: 8253 - DNA, 21 bp, Artificial Sequence
  Description of Artificial Sequence: Synthetic oligonucleotide
ctcagaaccctataaacacca

SEQ ID NO: 8254 - DNA, 21 bp, Artificial Sequence
  Description of Artificial Sequence: Synthetic oligonucleotide
gtgtttatagggttctgagtg

SEQ ID NO: 8255 - DNA, 21 bp, Artificial Sequence
  Description of Artificial Sequence: Synthetic oligonucleotide
tcagaaccctataaacaccag

SEQ ID NO: 8256 - DNA, 21 bp, Artificial Sequence
  Description of Artificial Sequence: Synthetic oligonucleotide
ggtgtttatagggttctgagt

SEQ ID NO: 8257 - DNA, 21 bp, Artificial Sequence
  Description of Artificial Sequence: Synthetic oligonucleotide
cagaaccctataaacaccagt

SEQ ID NO: 8258 - DNA, 21 bp, Artificial Sequence
  Description of Artificial Sequence: Synthetic oligonucleotide
tggtgtttatagggttctgag

SEQ ID NO: 8259 - DNA, 21 bp, Artificial Sequence
  Description of Artificial Sequence: Synthetic oligonucleotide
agaaccctataaacaccagtg

SEQ ID NO: 8260 - DNA, 21 bp, Artificial Sequence
  Description of Artificial Sequence: Synthetic oligonucleotide
ctggtgtttatagggttctga

SEQ ID NO: 8261 - DNA, 21 bp, Artificial Sequence
  Description of Artificial Sequence: Synthetic oligonucleotide
gaaccctataaacaccagtgg

SEQ ID NO: 8262 - DNA, 21 bp, Artificial Sequence
  Description of Artificial Sequence: Synthetic oligonucleotide
actggtgtttatagggttctg

SEQ ID NO: 8263 - DNA, 21 bp, Artificial Sequence
  Description of Artificial Sequence: Synthetic oligonucleotide
aaccctataaacaccagtggg

SEQ ID NO: 8264 - DNA, 21 bp, Artificial Sequence
  Description of Artificial Sequence: Synthetic oligonucleotide
cactggtgtttatagggttct

SEQ ID NO: 8265 - DNA, 21 bp, Artificial Sequence
  Description of Artificial Sequence: Synthetic oligonucleotide
accctataaacaccagtggga

SEQ ID NO: 8266 - DNA, 21 bp, Artificial Sequence
  Description of Artificial Sequence: Synthetic oligonucleotide
ccactggtgtttatagggttc

SEQ ID NO: 8267 - DNA, 21 bp, Artificial Sequence
  Description of Artificial Sequence: Synthetic oligonucleotide
ccctataaacaccagtgggaa

SEQ ID NO: 8268 - DNA, 21 bp, Artificial Sequence
  Description of Artificial Sequence: Synthetic oligonucleotide
cccactggtgtttatagggtt

SEQ ID NO: 8269 - DNA, 21 bp, Artificial Sequence
  Description of Artificial Sequence: Synthetic oligonucleotide
cctataaacaccagtgggaag

SEQ ID NO: 8270 - DNA, 21 bp, Artificial Sequence
  Description of Artificial Sequence: Synthetic oligonucleotide
tcccactggtgtttatagggt

SEQ ID NO: 8271 - DNA, 21 bp, Artificial Sequence
  Description of Artificial Sequence: Synthetic oligonucleotide
ctataaacaccagtgggaagg

SEQ ID NO: 8272 - DNA, 21 bp, Artificial Sequence
  Description of Artificial Sequence: Synthetic oligonucleotide
ttcccactggtgtttataggg

SEQ ID NO: 8273 - DNA, 21 bp, Artificial Sequence
  Description of Artificial Sequence: Synthetic oligonucleotide
tataaacaccagtgggaaggg

SEQ ID NO: 8274 - DNA, 21 bp, Artificial Sequence
  Description of Artificial Sequence: Synthetic oligonucleotide
cttcccactggtgtttatagg

SEQ ID NO: 8275 - DNA, 21 bp, Artificial Sequence
  Description of Artificial Sequence: Synthetic oligonucleotide
ataaacaccagtgggaagggc

SEQ ID NO: 8276 - DNA, 21 bp, Artificial Sequence
  Description of Artificial Sequence: Synthetic oligonucleotide
ccttcccactggtgtttatag

SEQ ID NO: 8277 - DNA, 21 bp, Artificial Sequence
  Description of Artificial Sequence: Synthetic oligonucleotide
taaacaccagtgggaagggca

SEQ ID NO: 8278 - DNA, 21 bp, Artificial Sequence
  Description of Artificial Sequence: Synthetic oligonucleotide
cccttcccactggtgtttata

SEQ ID NO: 8279 - DNA, 21 bp, Artificial Sequence
  Description of Artificial Sequence: Synthetic oligonucleotide
aaacaccagtgggaagggcaa

SEQ ID NO: 8280 - DNA, 21 bp, Artificial Sequence
  Description of Artificial Sequence: Synthetic oligonucleotide
gcccttcccactggtgtttat

SEQ ID NO: 8281 - DNA, 21 bp, Artificial Sequence
  Description of Artificial Sequence: Synthetic oligonucleotide
aacaccagtgggaagggcaac

SEQ ID NO: 8282 - DNA, 21 bp, Artificial Sequence
  Description of Artificial Sequence: Synthetic oligonucleotide
tgcccttcccactggtgttta

SEQ ID NO: 8283 - DNA, 21 bp, Artificial Sequence
  Description of Artificial Sequence: Synthetic oligonucleotide
acaccagtgggaagggcaacc

SEQ ID NO: 8284 - DNA, 21 bp, Artificial Sequence
  Description of Artificial Sequence: Synthetic oligonucleotide
ttgcccttcccactggtgttt

SEQ ID NO: 8285 - DNA, 21 bp, Artificial Sequence
  Description of Artificial Sequence: Synthetic oligonucleotide
caccagtgggaagggcaaccc

SEQ ID NO: 8286 - DNA, 21 bp, Artificial Sequence
  Description of Artificial Sequence: Synthetic oligonucleotide
gttgcccttcccactggtgtt

SEQ ID NO: 8287 - DNA, 21 bp, Artificial Sequence
  Description of Artificial Sequence: Synthetic oligonucleotide
accagtgggaagggcaaccca

SEQ ID NO: 8288 - DNA, 21 bp, Artificial Sequence
  Description of Artificial Sequence: Synthetic oligonucleotide
ggttgcccttcccactggtgt

SEQ ID NO: 8289 - DNA, 21 bp, Artificial Sequence
  Description of Artificial Sequence: Synthetic oligonucleotide
ccagtgggaagggcaacccac

SEQ ID NO: 8290 - DNA, 21 bp, Artificial Sequence
  Description of Artificial Sequence: Synthetic oligonucleotide
gggttgcccttcccactggtg

SEQ ID NO: 8291 - DNA, 21 bp, Artificial Sequence
  Description of Artificial Sequence: Synthetic oligonucleotide
cagtgggaagggcaacccact

SEQ ID NO: 8292 - DNA, 21 bp, Artificial Sequence
  Description of Artificial Sequence: Synthetic oligonucleotide
tgggttgcccttcccactggt

SEQ ID NO: 8293 - DNA, 21 bp, Artificial Sequence
  Description of Artificial Sequence: Synthetic oligonucleotide
agtgggaagggcaacccactg

SEQ ID NO: 8294 - DNA, 21 bp, Artificial Sequence
  Description of Artificial Sequence: Synthetic oligonucleotide
gtgggttgcccttcccactgg

SEQ ID NO: 8295 - DNA, 21 bp, Artificial Sequence
  Description of Artificial Sequence: Synthetic oligonucleotide
gtgggaagggcaacccactgc

SEQ ID NO: 8296 - DNA, 21 bp, Artificial Sequence
  Description of Artificial Sequence: Synthetic oligonucleotide
agtgggttgcccttcccactg

SEQ ID NO: 8297 - DNA, 21 bp, Artificial Sequence
  Description of Artificial Sequence: Synthetic oligonucleotide
tgggaagggcaacccactgca

SEQ ID NO: 8298 - DNA, 21 bp, Artificial Sequence
  Description of Artificial Sequence: Synthetic oligonucleotide
cagtgggttgcccttcccact

SEQ ID NO: 8299 - DNA, 21 bp, Artificial Sequence
  Description of Artificial Sequence: Synthetic oligonucleotide
gggaagggcaacccactgcac

SEQ ID NO: 8300 - DNA, 21 bp, Artificial Sequence
  Description of Artificial Sequence: Synthetic oligonucleotide
gcagtgggttgcccttcccac

SEQ ID NO: 8301 - DNA, 21 bp, Artificial Sequence
  Description of Artificial Sequence: Synthetic oligonucleotide
ggaagggcaacccactgcacg

SEQ ID NO: 8302 - DNA, 21 bp, Artificial Sequence
  Description of Artificial Sequence: Synthetic oligonucleotide
tgcagtgggttgcccttccca

SEQ ID NO: 8303 - DNA, 21 bp, Artificial Sequence
  Description of Artificial Sequence: Synthetic oligonucleotide
gaagggcaacccactgcacgt

SEQ ID NO: 8304 - DNA, 21 bp, Artificial Sequence
  Description of Artificial Sequence: Synthetic oligonucleotide
gtgcagtgggttgcccttccc

SEQ ID NO: 8305 - DNA, 21 bp, Artificial Sequence
  Description of Artificial Sequence: Synthetic oligonucleotide
aagggcaacccactgcacgtg

SEQ ID NO: 8306 - DNA, 21 bp, Artificial Sequence
  Description of Artificial Sequence: Synthetic oligonucleotide
cgtgcagtgggttgcccttcc

SEQ ID NO: 8307 - DNA, 21 bp, Artificial Sequence
  Description of Artificial Sequence: Synthetic oligonucleotide
agggcaacccactgcacgtgg

SEQ ID NO: 8308 - DNA, 21 bp, Artificial Sequence
  Description of Artificial Sequence: Synthetic oligonucleotide
acgtgcagtgggttgcccttc

SEQ ID NO: 8309 - DNA, 21 bp, Artificial Sequence
  Description of Artificial Sequence: Synthetic oligonucleotide
gggcaacccactgcacgtggg

SEQ ID NO: 8310 - DNA, 21 bp, Artificial Sequence
  Description of Artificial Sequence: Synthetic oligonucleotide
cacgtgcagtgggttgccctt

SEQ ID NO: 8311 - DNA, 21 bp, Artificial Sequence
  Description of Artificial Sequence: Synthetic oligonucleotide
ggcaacccactgcacgtggga

SEQ ID NO: 8312 - DNA, 21 bp, Artificial Sequence
  Description of Artificial Sequence: Synthetic oligonucleotide
ccacgtgcagtgggttgccct

SEQ ID NO: 8313 - DNA, 21 bp, Artificial Sequence
  Description of Artificial Sequence: Synthetic oligonucleotide
gcaacccactgcacgtgggaa

SEQ ID NO: 8314 - DNA, 21 bp, Artificial Sequence
  Description of Artificial Sequence: Synthetic oligonucleotide
cccacgtgcagtgggttgccc

SEQ ID NO: 8315 - DNA, 21 bp, Artificial Sequence
  Description of Artificial Sequence: Synthetic oligonucleotide
caacccactgcacgtgggaat

SEQ ID NO: 8316 - DNA, 21 bp, Artificial Sequence
  Description of Artificial Sequence: Synthetic oligonucleotide
tcccacgtgcagtgggttgcc

SEQ ID NO: 8317 - DNA, 21 bp, Artificial Sequence
  Description of Artificial Sequence: Synthetic oligonucleotide
aacccactgcacgtgggaatg

SEQ ID NO: 8318 - DNA, 21 bp, Artificial Sequence
  Description of Artificial Sequence: Synthetic oligonucleotide
ttcccacgtgcagtgggttgc

SEQ ID NO: 8319 - DNA, 21 bp, Artificial Sequence
  Description of Artificial Sequence: Synthetic oligonucleotide
acccactgcacgtgggaatgc

SEQ ID NO: 8320 - DNA, 21 bp, Artificial Sequence
  Description of Artificial Sequence: Synthetic oligonucleotide
attcccacgtgcagtgggttg

SEQ ID NO: 8321 - DNA, 21 bp, Artificial Sequence
  Description of Artificial Sequence: Synthetic oligonucleotide
cccactgcacgtgggaatgca

SEQ ID NO: 8322 - DNA, 21 bp, Artificial Sequence
  Description of Artificial Sequence: Synthetic oligonucleotide
cattcccacgtgcagtgggtt

SEQ ID NO: 8323 - DNA, 21 bp, Artificial Sequence
  Description of Artificial Sequence: Synthetic oligonucleotide
ccactgcacgtgggaatgcac

SEQ ID NO: 8324 - DNA, 21 bp, Artificial Sequence
  Description of Artificial Sequence: Synthetic oligonucleotide
gcattcccacgtgcagtgggt

SEQ ID NO: 8325 - DNA, 21 bp, Artificial Sequence
  Description of Artificial Sequence: Synthetic oligonucleotide
cactgcacgtgggaatgcact

SEQ ID NO: 8326 - DNA, 21 bp, Artificial Sequence
  Description of Artificial Sequence: Synthetic oligonucleotide
tgcattcccacgtgcagtggg

SEQ ID NO: 8327 - DNA, 21 bp, Artificial Sequence
  Description of Artificial Sequence: Synthetic oligonucleotide
actgcacgtgggaatgcactg

SEQ ID NO: 8328 - DNA, 21 bp, Artificial Sequence
  Description of Artificial Sequence: Synthetic oligonucleotide
gtgcattcccacgtgcagtgg

SEQ ID NO: 8329 - DNA, 21 bp, Artificial Sequence
  Description of Artificial Sequence: Synthetic oligonucleotide
ctgcacgtgggaatgcactga

SEQ ID NO: 8330 - DNA, 21 bp, Artificial Sequence
  Description of Artificial Sequence: Synthetic oligonucleotide
agtgcattcccacgtgcagtg

SEQ ID NO: 8331 - DNA, 21 bp, Artificial Sequence
  Description of Artificial Sequence: Synthetic oligonucleotide
tgcacgtgggaatgcactgat

SEQ ID NO: 8332 - DNA, 21 bp, Artificial Sequence
  Description of Artificial Sequence: Synthetic oligonucleotide
cagtgcattcccacgtgcagt

SEQ ID NO: 8333 - DNA, 21 bp, Artificial Sequence
  Description of Artificial Sequence: Synthetic oligonucleotide
gcacgtgggaatgcactgatt

SEQ ID NO: 8334 - DNA, 21 bp, Artificial Sequence
  Description of Artificial Sequence: Synthetic oligonucleotide
tcagtgcattcccacgtgcag

SEQ ID NO: 8335 - DNA, 21 bp, Artificial Sequence
  Description of Artificial Sequence: Synthetic oligonucleotide
cacgtgggaatgcactgattt

SEQ ID NO: 8336 - DNA, 21 bp, Artificial Sequence
  Description of Artificial Sequence: Synthetic oligonucleotide
atcagtgcattcccacgtgca

SEQ ID NO: 8337 - DNA, 21 bp, Artificial Sequence
  Description of Artificial Sequence: Synthetic oligonucleotide
acgtgggaatgcactgatttt

SEQ ID NO: 8338 - DNA, 21 bp, Artificial Sequence
  Description of Artificial Sequence: Synthetic oligonucleotide
aatcagtgcattcccacgtgc

SEQ ID NO: 8339 - DNA, 21 bp, Artificial Sequence
  Description of Artificial Sequence: Synthetic oligonucleotide
cgtgggaatgcactgattttt

SEQ ID NO: 8340 - DNA, 21 bp, Artificial Sequence
  Description of Artificial Sequence: Synthetic oligonucleotide
aaatcagtgcattcccacgtg

SEQ ID NO: 8341 - DNA, 21 bp, Artificial Sequence
  Description of Artificial Sequence: Synthetic oligonucleotide
gtgggaatgcactgatttttc

SEQ ID NO: 8342 - DNA, 21 bp, Artificial Sequence
  Description of Artificial Sequence: Synthetic oligonucleotide
aaaatcagtgcattcccacgt

SEQ ID NO: 8343 - DNA, 21 bp, Artificial Sequence
  Description of Artificial Sequence: Synthetic oligonucleotide
tgggaatgcactgatttttcc

SEQ ID NO: 8344 - DNA, 21 bp, Artificial Sequence
  Description of Artificial Sequence: Synthetic oligonucleotide
aaaaatcagtgcattcccacg

SEQ ID NO: 8345 - DNA, 21 bp, Artificial Sequence
  Description of Artificial Sequence: Synthetic oligonucleotide
gggaatgcactgatttttcct

SEQ ID NO: 8346 - DNA, 21 bp, Artificial Sequence
  Description of Artificial Sequence: Synthetic oligonucleotide
gaaaaatcagtgcattcccac

SEQ ID NO: 8347 - DNA, 21 bp, Artificial Sequence
  Description of Artificial Sequence: Synthetic oligonucleotide
ggaatgcactgatttttccta

SEQ ID NO: 8348 - DNA, 21 bp, Artificial Sequence
  Description of Artificial Sequence: Synthetic oligonucleotide
ggaaaaatcagtgcattccca

SEQ ID NO: 8349 - DNA, 21 bp, Artificial Sequence
  Description of Artificial Sequence: Synthetic oligonucleotide
gaatgcactgatttttcctag

SEQ ID NO: 8350 - DNA, 21 bp, Artificial Sequence
  Description of Artificial Sequence: Synthetic oligonucleotide
aggaaaaatcagtgcattccc

SEQ ID NO: 8351 - DNA, 21 bp, Artificial Sequence
  Description of Artificial Sequence: Synthetic oligonucleotide
aatgcactgatttttcctagg

SEQ ID NO: 8352 - DNA, 21 bp, Artificial Sequence
  Description of Artificial Sequence: Synthetic oligonucleotide
taggaaaaatcagtgcattcc

SEQ ID NO: 8353 - DNA, 21 bp, Artificial Sequence
  Description of Artificial Sequence: Synthetic oligonucleotide
atgcactgatttttcctagga

SEQ ID NO: 8354 - DNA, 21 bp, Artificial Sequence
  Description of Artificial Sequence: Synthetic oligonucleotide
ctaggaaaaatcagtgcattc

SEQ ID NO: 8355 - DNA, 21 bp, Artificial Sequence
  Description of Artificial Sequence: Synthetic oligonucleotide
tgcactgatttttcctaggag

SEQ ID NO: 8356 - DNA, 21 bp, Artificial Sequence
  Description of Artificial Sequence: Synthetic oligonucleotide
cctaggaaaaatcagtgcatt

SEQ ID NO: 8357 - DNA, 21 bp, Artificial Sequence
  Description of Artificial Sequence: Synthetic oligonucleotide
gcactgatttttcctaggagt

SEQ ID NO: 8358 - DNA, 21 bp, Artificial Sequence
  Description of Artificial Sequence: Synthetic oligonucleotide
tcctaggaaaaatcagtgcat

SEQ ID NO: 8359 - DNA, 21 bp, Artificial Sequence
  Description of Artificial Sequence: Synthetic oligonucleotide
cactgatttttcctaggagta

SEQ ID NO: 8360 - DNA, 21 bp, Artificial Sequence
  Description of Artificial Sequence: Synthetic oligonucleotide
ctcctaggaaaaatcagtgca

SEQ ID NO: 8361 - DNA, 21 bp, Artificial Sequence
  Description of Artificial Sequence: Synthetic oligonucleotide
actgatttttcctaggagtag

SEQ ID NO: 8362 - DNA, 21 bp, Artificial Sequence
  Description of Artificial Sequence: Synthetic oligonucleotide
actcctaggaaaaatcagtgc

SEQ ID NO: 8363 - DNA, 21 bp, Artificial Sequence
  Description of Artificial Sequence: Synthetic oligonucleotide
ctgatttttcctaggagtaga

SEQ ID NO: 8364 - DNA, 21 bp, Artificial Sequence
  Description of Artificial Sequence: Synthetic oligonucleotide
tactcctaggaaaaatcagtg

SEQ ID NO: 8365 - DNA, 21 bp, Artificial Sequence
  Description of Artificial Sequence: Synthetic oligonucleotide
tgatttttcctaggagtagac

SEQ ID NO: 8366 - DNA, 21 bp, Artificial Sequence
  Description of Artificial Sequence: Synthetic oligonucleotide
ctactcctaggaaaaatcagt

SEQ ID NO: 8367 - DNA, 21 bp, Artificial Sequence
  Description of Artificial Sequence: Synthetic oligonucleotide
gatttttcctaggagtagaca

SEQ ID NO: 8368 - DNA, 21 bp, Artificial Sequence
  Description of Artificial Sequence: Synthetic oligonucleotide
tctactcctaggaaaaatcag

SEQ ID NO: 8369 - DNA, 21 bp, Artificial Sequence
  Description of Artificial Sequence: Synthetic oligonucleotide
atttttcctaggagtagacat

SEQ ID NO: 8370 - DNA, 21 bp, Artificial Sequence
  Description of Artificial Sequence: Synthetic oligonucleotide
gtctactcctaggaaaaatca

SEQ ID NO: 8371 - DNA, 21 bp, Artificial Sequence
  Description of Artificial Sequence: Synthetic oligonucleotide
tttttcctaggagtagacatg

SEQ ID NO: 8372 - DNA, 21 bp, Artificial Sequence
  Description of Artificial Sequence: Synthetic oligonucleotide
tgtctactcctaggaaaaatc

SEQ ID NO: 8373 - DNA, 21 bp, Artificial Sequence
  Description of Artificial Sequence: Synthetic oligonucleotide
ttttcctaggagtagacatgt

SEQ ID NO: 8374 - DNA, 21 bp, Artificial Sequence
  Description of Artificial Sequence: Synthetic oligonucleotide
atgtctactcctaggaaaaat

SEQ ID NO: 8375 - DNA, 21 bp, Artificial Sequence
  Description of Artificial Sequence: Synthetic oligonucleotide
tttcctaggagtagacatgtt

SEQ ID NO: 8376 - DNA, 21 bp, Artificial Sequence
  Description of Artificial Sequence: Synthetic oligonucleotide
catgtctactcctaggaaaaa

SEQ ID NO: 8377 - DNA, 21 bp, Artificial Sequence
  Description of Artificial Sequence: Synthetic oligonucleotide
ttcctaggagtagacatgttc

SEQ ID NO: 8378 - DNA, 21 bp, Artificial Sequence
  Description of Artificial Sequence: Synthetic oligonucleotide
acatgtctactcctaggaaaa

SEQ ID NO: 8379 - DNA, 21 bp, Artificial Sequence
  Description of Artificial Sequence: Synthetic oligonucleotide
tcctaggagtagacatgttcc

SEQ ID NO: 8380 - DNA, 21 bp, Artificial Sequence
  Description of Artificial Sequence: Synthetic oligonucleotide
aacatgtctactcctaggaaa

SEQ ID NO: 8381 - DNA, 21 bp, Artificial Sequence
  Description of Artificial Sequence: Synthetic oligonucleotide
cctaggagtagacatgttcct

SEQ ID NO: 8382 - DNA, 21 bp, Artificial Sequence
  Description of Artificial Sequence: Synthetic oligonucleotide
gaacatgtctactcctaggaa

SEQ ID NO: 8383 - DNA, 21 bp, Artificial Sequence
  Description of Artificial Sequence: Synthetic oligonucleotide
ctaggagtagacatgttcctc

SEQ ID NO: 8384 - DNA, 21 bp, Artificial Sequence
  Description of Artificial Sequence: Synthetic oligonucleotide
ggaacatgtctactcctagga

SEQ ID NO: 8385 - DNA, 21 bp, Artificial Sequence
  Description of Artificial Sequence: Synthetic oligonucleotide
taggagtagacatgttcctct

SEQ ID NO: 8386 - DNA, 21 bp, Artificial Sequence
  Description of Artificial Sequence: Synthetic oligonucleotide
aggaacatgtctactcctagg

SEQ ID NO: 8387 - DNA, 21 bp, Artificial Sequence
  Description of Artificial Sequence: Synthetic oligonucleotide
aggagtagacatgttcctcta

SEQ ID NO: 8388 - DNA, 21 bp, Artificial Sequence
  Description of Artificial Sequence: Synthetic oligonucleotide
gaggaacatgtctactcctag

SEQ ID NO: 8389 - DNA, 21 bp, Artificial Sequence
  Description of Artificial Sequence: Synthetic oligonucleotide
ggagtagacatgttcctctaa

SEQ ID NO: 8390 - DNA, 21 bp, Artificial Sequence
  Description of Artificial Sequence: Synthetic oligonucleotide
agaggaacatgtctactccta

SEQ ID NO: 8391 - DNA, 21 bp, Artificial Sequence
  Description of Artificial Sequence: Synthetic oligonucleotide
gagtagacatgttcctctaat

SEQ ID NO: 8392 - DNA, 21 bp, Artificial Sequence
  Description of Artificial Sequence: Synthetic oligonucleotide
tagaggaacatgtctactcct

SEQ ID NO: 8393 - DNA, 21 bp, Artificial Sequence
  Description of Artificial Sequence: Synthetic oligonucleotide
agtagacatgttcctctaatt

SEQ ID NO: 8394 - DNA, 21 bp, Artificial Sequence
  Description of Artificial Sequence: Synthetic oligonucleotide
ttagaggaacatgtctactcc

SEQ ID NO: 8395 - DNA, 21 bp, Artificial Sequence
  Description of Artificial Sequence: Synthetic oligonucleotide
gtagacatgttcctctaatta

SEQ ID NO: 8396 - DNA, 21 bp, Artificial Sequence
  Description of Artificial Sequence: Synthetic oligonucleotide
attagaggaacatgtctactc

SEQ ID NO: 8397 - DNA, 21 bp, Artificial Sequence
  Description of Artificial Sequence: Synthetic oligonucleotide
tagacatgttcctctaattac

SEQ ID NO: 8398 - DNA, 21 bp, Artificial Sequence
  Description of Artificial Sequence: Synthetic oligonucleotide
aattagaggaacatgtctact

SEQ ID NO: 8399 - DNA, 21 bp, Artificial Sequence
  Description of Artificial Sequence: Synthetic oligonucleotide
agacatgttcctctaattact

SEQ ID NO: 8400 - DNA, 21 bp, Artificial Sequence
  Description of Artificial Sequence: Synthetic oligonucleotide
taattagaggaacatgtctac

SEQ ID NO: 8401 - DNA, 21 bp, Artificial Sequence
  Description of Artificial Sequence: Synthetic oligonucleotide
gacatgttcctctaattactc

SEQ ID NO: 8402 - DNA, 21 bp, Artificial Sequence
  Description of Artificial Sequence: Synthetic oligonucleotide
gtaattagaggaacatgtcta

SEQ ID NO: 8403 - DNA, 21 bp, Artificial Sequence
  Description of Artificial Sequence: Synthetic oligonucleotide
acatgttcctctaattactcc

SEQ ID NO: 8404 - DNA, 21 bp, Artificial Sequence
  Description of Artificial Sequence: Synthetic oligonucleotide
agtaattagaggaacatgtct

SEQ ID NO: 8405 - DNA, 21 bp, Artificial Sequence
  Description of Artificial Sequence: Synthetic oligonucleotide
catgttcctctaattactccc

SEQ ID NO: 8406 - DNA, 21 bp, Artificial Sequence
  Description of Artificial Sequence: Synthetic oligonucleotide
gagtaattagaggaacatgtc

SEQ ID NO: 8407 - DNA, 21 bp, Artificial Sequence
  Description of Artificial Sequence: Synthetic oligonucleotide
atgttcctctaattactccct

SEQ ID NO: 8408 - DNA, 21 bp, Artificial Sequence
  Description of Artificial Sequence: Synthetic oligonucleotide
ggagtaattagaggaacatgt

SEQ ID NO: 8409 - DNA, 21 bp, Artificial Sequence
  Description of Artificial Sequence: Synthetic oligonucleotide
tgttcctctaattactccctg

SEQ ID NO: 8410 - DNA, 21 bp, Artificial Sequence
  Description of Artificial Sequence: Synthetic oligonucleotide
gggagtaattagaggaacatg

SEQ ID NO: 8411 - DNA, 21 bp, Artificial Sequence
  Description of Artificial Sequence: Synthetic oligonucleotide
gttcctctaattactccctga

SEQ ID NO: 8412 - DNA, 21 bp, Artificial Sequence
  Description of Artificial Sequence: Synthetic oligonucleotide
agggagtaattagaggaacat

SEQ ID NO: 8413 - DNA, 21 bp, Artificial Sequence
  Description of Artificial Sequence: Synthetic oligonucleotide
ttcctctaattactccctgag

SEQ ID NO: 8414 - DNA, 21 bp, Artificial Sequence
  Description of Artificial Sequence: Synthetic oligonucleotide
cagggagtaattagaggaaca

SEQ ID NO: 8415 - DNA, 21 bp, Artificial Sequence
  Description of Artificial Sequence: Synthetic oligonucleotide
tcctctaattactccctgagg

SEQ ID NO: 8416 - DNA, 21 bp, Artificial Sequence
  Description of Artificial Sequence: Synthetic oligonucleotide
tcagggagtaattagaggaac

SEQ ID NO: 8417 - DNA, 21 bp, Artificial Sequence
  Description of Artificial Sequence: Synthetic oligonucleotide
cctctaattactccctgaggg

SEQ ID NO: 8418 - DNA, 21 bp, Artificial Sequence
  Description of Artificial Sequence: Synthetic oligonucleotide
ctcagggagtaattagaggaa

SEQ ID NO: 8419 - DNA, 21 bp, Artificial Sequence
  Description of Artificial Sequence: Synthetic oligonucleotide
ctctaattactccctgagggt

SEQ ID NO: 8420 - DNA, 21 bp, Artificial Sequence
  Description of Artificial Sequence: Synthetic oligonucleotide
cctcagggagtaattagagga

SEQ ID NO: 8421 - DNA, 21 bp, Artificial Sequence
  Description of Artificial Sequence: Synthetic oligonucleotide
tctaattactccctgagggtt

SEQ ID NO: 8422 - DNA, 21 bp, Artificial Sequence
  Description of Artificial Sequence: Synthetic oligonucleotide
ccctcagggagtaattagagg

SEQ ID NO: 8423 - DNA, 21 bp, Artificial Sequence
  Description of Artificial Sequence: Synthetic oligonucleotide
ctaattactccctgagggtta

SEQ ID NO: 8424 - DNA, 21 bp, Artificial Sequence
  Description of Artificial Sequence: Synthetic oligonucleotide
accctcagggagtaattagag

SEQ ID NO: 8425 - DNA, 21 bp, Artificial Sequence
  Description of Artificial Sequence: Synthetic oligonucleotide
taattactccctgagggttag

SEQ ID NO: 8426 - DNA, 21 bp, Artificial Sequence
  Description of Artificial Sequence: Synthetic oligonucleotide
aaccctcagggagtaattaga

SEQ ID NO: 8427 - DNA, 21 bp, Artificial Sequence
  Description of Artificial Sequence: Synthetic oligonucleotide
aattactccctgagggttagt

SEQ ID NO: 8428 - DNA, 21 bp, Artificial Sequence
  Description of Artificial Sequence: Synthetic oligonucleotide
taaccctcagggagtaattag

SEQ ID NO: 8429 - DNA, 21 bp, Artificial Sequence
  Description of Artificial Sequence: Synthetic oligonucleotide
attactccctgagggttagtt

SEQ ID NO: 8430 - DNA, 21 bp, Artificial Sequence
  Description of Artificial Sequence: Synthetic oligonucleotide
ctaaccctcagggagtaatta

SEQ ID NO: 8431 - DNA, 21 bp, Artificial Sequence
  Description of Artificial Sequence: Synthetic oligonucleotide
ttactccctgagggttagttg

SEQ ID NO: 8432 - DNA, 21 bp, Artificial Sequence
  Description of Artificial Sequence: Synthetic oligonucleotide
actaaccctcagggagtaatt

SEQ ID NO: 8433 - DNA, 21 bp, Artificial Sequence
  Description of Artificial Sequence: Synthetic oligonucleotide
tactccctgagggttagttgg

SEQ ID NO: 8434 - DNA, 21 bp, Artificial Sequence
  Description of Artificial Sequence: Synthetic oligonucleotide
aactaaccctcagggagtaat

SEQ ID NO: 8435 - DNA, 21 bp, Artificial Sequence
  Description of Artificial Sequence: Synthetic oligonucleotide
actccctgagggttagttggg

SEQ ID NO: 8436 - DNA, 21 bp, Artificial Sequence
  Description of Artificial Sequence: Synthetic oligonucleotide
caactaaccctcagggagtaa

SEQ ID NO: 8437 - DNA, 21 bp, Artificial Sequence
  Description of Artificial Sequence: Synthetic oligonucleotide
ctccctgagggttagttgggg

SEQ ID NO: 8438 - DNA, 21 bp, Artificial Sequence
  Description of Artificial Sequence: Synthetic oligonucleotide
ccaactaaccctcagggagta

SEQ ID NO: 8439 - DNA, 21 bp, Artificial Sequence
  Description of Artificial Sequence: Synthetic oligonucleotide
tccctgagggttagttggggc

SEQ ID NO: 8440 - DNA, 21 bp, Artificial Sequence
  Description of Artificial Sequence: Synthetic oligonucleotide
cccaactaaccctcagggagt

SEQ ID NO: 8441 - DNA, 21 bp, Artificial Sequence
  Description of Artificial Sequence: Synthetic oligonucleotide
ccctgagggttagttggggct

SEQ ID NO: 8442 - DNA, 21 bp, Artificial Sequence
  Description of Artificial Sequence: Synthetic oligonucleotide
ccccaactaaccctcagggag

SEQ ID NO: 8443 - DNA, 21 bp, Artificial Sequence
  Description of Artificial Sequence: Synthetic oligonucleotide
cctgagggttagttggggcta

SEQ ID NO: 8444 - DNA, 21 bp, Artificial Sequence
  Description of Artificial Sequence: Synthetic oligonucleotide
gccccaactaaccctcaggga

SEQ ID NO: 8445 - DNA, 21 bp, Artificial Sequence
  Description of Artificial Sequence: Synthetic oligonucleotide
ctgagggttagttggggctaa

SEQ ID NO: 8446 - DNA, 21 bp, Artificial Sequence
  Description of Artificial Sequence: Synthetic oligonucleotide
agccccaactaaccctcaggg

SEQ ID NO: 8447 - DNA, 21 bp, Artificial Sequence
  Description of Artificial Sequence: Synthetic oligonucleotide
tgagggttagttggggctaaa

SEQ ID NO: 8448 - DNA, 21 bp, Artificial Sequence
  Description of Artificial Sequence: Synthetic oligonucleotide
tagccccaactaaccctcagg

SEQ ID NO: 8449 - DNA, 21 bp, Artificial Sequence
  Description of Artificial Sequence: Synthetic oligonucleotide
gagggttagttggggctaaac

SEQ ID NO: 8450 - DNA, 21 bp, Artificial Sequence
  Description of Artificial Sequence: Synthetic oligonucleotide
ttagccccaactaaccctcag

SEQ ID NO: 8451 - DNA, 21 bp, Artificial Sequence
  Description of Artificial Sequence: Synthetic oligonucleotide
agggttagttggggctaaacc

SEQ ID NO: 8452 - DNA, 21 bp, Artificial Sequence
  Description of Artificial Sequence: Synthetic oligonucleotide
tttagccccaactaaccctca

SEQ ID NO: 8453 - DNA, 21 bp, Artificial Sequence
  Description of Artificial Sequence: Synthetic oligonucleotide
gggttagttggggctaaacca

SEQ ID NO: 8454 - DNA, 21 bp, Artificial Sequence
  Description of Artificial Sequence: Synthetic oligonucleotide
gtttagccccaactaaccctc

SEQ ID NO: 8455 - DNA, 21 bp, Artificial Sequence
  Description of Artificial Sequence: Synthetic oligonucleotide
ggttagttggggctaaaccat

SEQ ID NO: 8456 - DNA, 21 bp, Artificial Sequence
  Description of Artificial Sequence: Synthetic oligonucleotide
ggtttagccccaactaaccct

SEQ ID NO: 8457 - DNA, 21 bp, Artificial Sequence
  Description of Artificial Sequence: Synthetic oligonucleotide
gttagttggggctaaaccatg

SEQ ID NO: 8458 - DNA, 21 bp, Artificial Sequence
  Description of Artificial Sequence: Synthetic oligonucleotide
tggtttagccccaactaaccc

SEQ ID NO: 8459 - DNA, 21 bp, Artificial Sequence
  Description of Artificial Sequence: Synthetic oligonucleotide
ttagttggggctaaaccatga

SEQ ID NO: 8460 - DNA, 21 bp, Artificial Sequence
  Description of Artificial Sequence: Synthetic oligonucleotide
atggtttagccccaactaacc

SEQ ID NO: 8461 - DNA, 21 bp, Artificial Sequence
  Description of Artificial Sequence: Synthetic oligonucleotide
tagttggggctaaaccatgac

SEQ ID NO: 8462 - DNA, 21 bp, Artificial Sequence
  Description of Artificial Sequence: Synthetic oligonucleotide
catggtttagccccaactaac

SEQ ID NO: 8463 - DNA, 21 bp, Artificial Sequence
  Description of Artificial Sequence: Synthetic oligonucleotide
agttggggctaaaccatgaca

SEQ ID NO: 8464 - DNA, 21 bp, Artificial Sequence
  Description of Artificial Sequence: Synthetic oligonucleotide
tcatggtttagccccaactaa

SEQ ID NO: 8465 - DNA, 21 bp, Artificial Sequence
  Description of Artificial Sequence: Synthetic oligonucleotide
gttggggctaaaccatgacag

SEQ ID NO: 8466 - DNA, 21 bp, Artificial Sequence
  Description of Artificial Sequence: Synthetic oligonucleotide
gtcatggtttagccccaacta

SEQ ID NO: 8467 - DNA, 21 bp, Artificial Sequence
  Description of Artificial Sequence: Synthetic oligonucleotide
ttggggctaaaccatgacaga

SEQ ID NO: 8468 - DNA, 21 bp, Artificial Sequence
  Description of Artificial Sequence: Synthetic oligonucleotide
tgtcatggtttagccccaact

SEQ ID NO: 8469 - DNA, 21 bp, Artificial Sequence
  Description of Artificial Sequence: Synthetic oligonucleotide
tggggctaaaccatgacagaa

SEQ ID NO: 8470 - DNA, 21 bp, Artificial Sequence
  Description of Artificial Sequence: Synthetic oligonucleotide
ctgtcatggtttagccccaac

SEQ ID NO: 8471 - DNA, 21 bp, Artificial Sequence
  Description of Artificial Sequence: Synthetic oligonucleotide
ggggctaaaccatgacagaag

SEQ ID NO: 8472 - DNA, 21 bp, Artificial Sequence
  Description of Artificial Sequence: Synthetic oligonucleotide
tctgtcatggtttagccccaa

SEQ ID NO: 8473 - DNA, 21 bp, Artificial Sequence
  Description of Artificial Sequence: Synthetic oligonucleotide
gggctaaaccatgacagaagt

SEQ ID NO: 8474 - DNA, 21 bp, Artificial Sequence
  Description of Artificial Sequence: Synthetic oligonucleotide
ttctgtcatggtttagcccca

SEQ ID NO: 8475 - DNA, 21 bp, Artificial Sequence
  Description of Artificial Sequence: Synthetic oligonucleotide
ggctaaaccatgacagaagtg

SEQ ID NO: 8476 - DNA, 21 bp, Artificial Sequence
  Description of Artificial Sequence: Synthetic oligonucleotide
cttctgtcatggtttagcccc

SEQ ID NO: 8477 - DNA, 21 bp, Artificial Sequence
  Description of Artificial Sequence: Synthetic oligonucleotide
gctaaaccatgacagaagtgg

SEQ ID NO: 8478 - DNA, 21 bp, Artificial Sequence
  Description of Artificial Sequence: Synthetic oligonucleotide
acttctgtcatggtttagccc

SEQ ID NO: 8479 - DNA, 21 bp, Artificial Sequence
  Description of Artificial Sequence: Synthetic oligonucleotide
ctaaaccatgacagaagtggg

SEQ ID NO: 8480 - DNA, 21 bp, Artificial Sequence
  Description of Artificial Sequence: Synthetic oligonucleotide
cacttctgtcatggtttagcc

SEQ ID NO: 8481 - DNA, 21 bp, Artificial Sequence
  Description of Artificial Sequence: Synthetic oligonucleotide
taaaccatgacagaagtgggg

SEQ ID NO: 8482 - DNA, 21 bp, Artificial Sequence
  Description of Artificial Sequence: Synthetic oligonucleotide
ccacttctgtcatggtttagc

SEQ ID NO: 8483 - DNA, 21 bp, Artificial Sequence
  Description of Artificial Sequence: Synthetic oligonucleotide
aaaccatgacagaagtgggga

SEQ ID NO: 8484 - DNA, 21 bp, Artificial Sequence
  Description of Artificial Sequence: Synthetic oligonucleotide
cccacttctgtcatggtttag

SEQ ID NO: 8485 - DNA, 21 bp, Artificial Sequence
  Description of Artificial Sequence: Synthetic oligonucleotide
aaccatgacagaagtggggaa

SEQ ID NO: 8486 - DNA, 21 bp, Artificial Sequence
  Description of Artificial Sequence: Synthetic oligonucleotide
ccccacttctgtcatggttta

SEQ ID NO: 8487 - DNA, 21 bp, Artificial Sequence
  Description of Artificial Sequence: Synthetic oligonucleotide
accatgacagaagtggggaag

SEQ ID NO: 8488 - DNA, 21 bp, Artificial Sequence
  Description of Artificial Sequence: Synthetic oligonucleotide
tccccacttctgtcatggttt

SEQ ID NO: 8489 - DNA, 21 bp, Artificial Sequence
  Description of Artificial Sequence: Synthetic oligonucleotide
ccatgacagaagtggggaagt

SEQ ID NO: 8490 - DNA, 21 bp, Artificial Sequence
  Description of Artificial Sequence: Synthetic oligonucleotide
ttccccacttctgtcatggtt

SEQ ID NO: 8491 - DNA, 21 bp, Artificial Sequence
  Description of Artificial Sequence: Synthetic oligonucleotide
catgacagaagtggggaagtt

SEQ ID NO: 8492 - DNA, 21 bp, Artificial Sequence
  Description of Artificial Sequence: Synthetic oligonucleotide
cttccccacttctgtcatggt

SEQ ID NO: 8493 - DNA, 21 bp, Artificial Sequence
  Description of Artificial Sequence: Synthetic oligonucleotide
atgacagaagtggggaagttc

SEQ ID NO: 8494 - DNA, 21 bp, Artificial Sequence
  Description of Artificial Sequence: Synthetic oligonucleotide
acttccccacttctgtcatgg

SEQ ID NO: 8495 - DNA, 21 bp, Artificial Sequence
  Description of Artificial Sequence: Synthetic oligonucleotide
tgacagaagtggggaagttca

SEQ ID NO: 8496 - DNA, 21 bp, Artificial Sequence
  Description of Artificial Sequence: Synthetic oligonucleotide
aacttccccacttctgtcatg

SEQ ID NO: 8497 - DNA, 21 bp, Artificial Sequence
  Description of Artificial Sequence: Synthetic oligonucleotide
gacagaagtggggaagttcaa

SEQ ID NO: 8498 - DNA, 21 bp, Artificial Sequence
  Description of Artificial Sequence: Synthetic oligonucleotide
gaacttccccacttctgtcat

SEQ ID NO: 8499 - DNA, 21 bp, Artificial Sequence
  Description of Artificial Sequence: Synthetic oligonucleotide
acagaagtggggaagttcaat

SEQ ID NO: 8500 - DNA, 21 bp, Artificial Sequence
  Description of Artificial Sequence: Synthetic oligonucleotide
tgaacttccccacttctgtca

SEQ ID NO: 8501 - DNA, 21 bp, Artificial Sequence
  Description of Artificial Sequence: Synthetic oligonucleotide
cagaagtggggaagttcaatg

SEQ ID NO: 8502 - DNA, 21 bp, Artificial Sequence
  Description of Artificial Sequence: Synthetic oligonucleotide
ttgaacttccccacttctgtc

SEQ ID NO: 8503 - DNA, 21 bp, Artificial Sequence
  Description of Artificial Sequence: Synthetic oligonucleotide
agaagtggggaagttcaatgt

SEQ ID NO: 8504 - DNA, 21 bp, Artificial Sequence
  Description of Artificial Sequence: Synthetic oligonucleotide
attgaacttccccacttctgt

SEQ ID NO: 8505 - DNA, 21 bp, Artificial Sequence
  Description of Artificial Sequence: Synthetic oligonucleotide
gaagtggggaagttcaatgtc

SEQ ID NO: 8506 - DNA, 21 bp, Artificial Sequence
  Description of Artificial Sequence: Synthetic oligonucleotide
cattgaacttccccacttctg

SEQ ID NO: 8507 - DNA, 21 bp, Artificial Sequence
  Description of Artificial Sequence: Synthetic oligonucleotide
aagtggggaagttcaatgtcc

SEQ ID NO: 8508 - DNA, 21 bp, Artificial Sequence
  Description of Artificial Sequence: Synthetic oligonucleotide
acattgaacttccccacttct

SEQ ID NO: 8509 - DNA, 21 bp, Artificial Sequence
  Description of Artificial Sequence: Synthetic oligonucleotide
agtggggaagttcaatgtcct

SEQ ID NO: 8510 - DNA, 21 bp, Artificial Sequence
  Description of Artificial Sequence: Synthetic oligonucleotide
gacattgaacttccccacttc

SEQ ID NO: 8511 - DNA, 21 bp, Artificial Sequence
  Description of Artificial Sequence: Synthetic oligonucleotide
gtggggaagttcaatgtcctt

SEQ ID NO: 8512 - DNA, 21 bp, Artificial Sequence
  Description of Artificial Sequence: Synthetic oligonucleotide
ggacattgaacttccccactt

SEQ ID NO: 8513 - DNA, 21 bp, Artificial Sequence
  Description of Artificial Sequence: Synthetic oligonucleotide
tggggaagttcaatgtcctta

SEQ ID NO: 8514 - DNA, 21 bp, Artificial Sequence
  Description of Artificial Sequence: Synthetic oligonucleotide
aggacattgaacttccccact

SEQ ID NO: 8515 - DNA, 21 bp, Artificial Sequence
  Description of Artificial Sequence: Synthetic oligonucleotide
ggggaagttcaatgtccttaa

SEQ ID NO: 8516 - DNA, 21 bp, Artificial Sequence
  Description of Artificial Sequence: Synthetic oligonucleotide
aaggacattgaacttccccac

SEQ ID NO: 8517 - DNA, 21 bp, Artificial Sequence
  Description of Artificial Sequence: Synthetic oligonucleotide
gggaagttcaatgtccttaaa

SEQ ID NO: 8518 - DNA, 21 bp, Artificial Sequence
  Description of Artificial Sequence: Synthetic oligonucleotide
taaggacattgaacttcccca

SEQ ID NO: 8519 - DNA, 21 bp, Artificial Sequence
  Description of Artificial Sequence: Synthetic oligonucleotide
ggaagttcaatgtccttaaat

SEQ ID NO: 8520 - DNA, 21 bp, Artificial Sequence
  Description of Artificial Sequence: Synthetic oligonucleotide
ttaaggacattgaacttcccc

SEQ ID NO: 8521 - DNA, 21 bp, Artificial Sequence
  Description of Artificial Sequence: Synthetic oligonucleotide
gaagttcaatgtccttaaatc

SEQ ID NO: 8522 - DNA, 21 bp, Artificial Sequence
  Description of Artificial Sequence: Synthetic oligonucleotide
tttaaggacattgaacttccc

SEQ ID NO: 8523 - DNA, 21 bp, Artificial Sequence
  Description of Artificial Sequence: Synthetic oligonucleotide
aagttcaatgtccttaaatcc

SEQ ID NO: 8524 - DNA, 21 bp, Artificial Sequence
  Description of Artificial Sequence: Synthetic oligonucleotide
atttaaggacattgaacttcc

SEQ ID NO: 8525 - DNA, 21 bp, Artificial Sequence
  Description of Artificial Sequence: Synthetic oligonucleotide
agttcaatgtccttaaatcca

SEQ ID NO: 8526 - DNA, 21 bp, Artificial Sequence
  Description of Artificial Sequence: Synthetic oligonucleotide
gatttaaggacattgaacttc

SEQ ID NO: 8527 - DNA, 21 bp, Artificial Sequence
  Description of Artificial Sequence: Synthetic oligonucleotide
gttcaatgtccttaaatccat

SEQ ID NO: 8528 - DNA, 21 bp, Artificial Sequence
  Description of Artificial Sequence: Synthetic oligonucleotide
ggatttaaggacattgaactt

SEQ ID NO: 8529 - DNA, 21 bp, Artificial Sequence
  Description of Artificial Sequence: Synthetic oligonucleotide
ttcaatgtccttaaatccatc

SEQ ID NO: 8530 - DNA, 21 bp, Artificial Sequence
  Description of Artificial Sequence: Synthetic oligonucleotide
tggatttaaggacattgaact

SEQ ID NO: 8531 - DNA, 21 bp, Artificial Sequence
  Description of Artificial Sequence: Synthetic oligonucleotide
tcaatgtccttaaatccatct

SEQ ID NO: 8532 - DNA, 21 bp, Artificial Sequence
  Description of Artificial Sequence: Synthetic oligonucleotide
atggatttaaggacattgaac

SEQ ID NO: 8533 - DNA, 21 bp, Artificial Sequence
  Description of Artificial Sequence: Synthetic oligonucleotide
caatgtccttaaatccatctt

SEQ ID NO: 8534 - DNA, 21 bp, Artificial Sequence
  Description of Artificial Sequence: Synthetic oligonucleotide
gatggatttaaggacattgaa

SEQ ID NO: 8535 - DNA, 21 bp, Artificial Sequence
  Description of Artificial Sequence: Synthetic oligonucleotide
aatgtccttaaatccatctta

SEQ ID NO: 8536 - DNA, 21 bp, Artificial Sequence
  Description of Artificial Sequence: Synthetic oligonucleotide
agatggatttaaggacattga

SEQ ID NO: 8537 - DNA, 21 bp, Artificial Sequence
  Description of Artificial Sequence: Synthetic oligonucleotide
atgtccttaaatccatcttac

SEQ ID NO: 8538 - DNA, 21 bp, Artificial Sequence
  Description of Artificial Sequence: Synthetic oligonucleotide
aagatggatttaaggacattg

SEQ ID NO: 8539 - DNA, 21 bp, Artificial Sequence
  Description of Artificial Sequence: Synthetic oligonucleotide
tgtccttaaatccatcttact

SEQ ID NO: 8540 - DNA, 21 bp, Artificial Sequence
  Description of Artificial Sequence: Synthetic oligonucleotide
taagatggatttaaggacatt

SEQ ID NO: 8541 - DNA, 21 bp, Artificial Sequence
  Description of Artificial Sequence: Synthetic oligonucleotide
gtccttaaatccatcttactt

SEQ ID NO: 8542 - DNA, 21 bp, Artificial Sequence
  Description of Artificial Sequence: Synthetic oligonucleotide
gtaagatggatttaaggacat

SEQ ID NO: 8543 - DNA, 21 bp, Artificial Sequence
  Description of Artificial Sequence: Synthetic oligonucleotide
tccttaaatccatcttacttg

SEQ ID NO: 8544 - DNA, 21 bp, Artificial Sequence
  Description of Artificial Sequence: Synthetic oligonucleotide
agtaagatggatttaaggaca

SEQ ID NO: 8545 - DNA, 21 bp, Artificial Sequence
  Description of Artificial Sequence: Synthetic oligonucleotide
ccttaaatccatcttacttgc

SEQ ID NO: 8546 - DNA, 21 bp, Artificial Sequence
  Description of Artificial Sequence: Synthetic oligonucleotide
aagtaagatggatttaaggac

SEQ ID NO: 8547 - DNA, 21 bp, Artificial Sequence
  Description of Artificial Sequence: Synthetic oligonucleotide
cttaaatccatcttacttgcc

SEQ ID NO: 8548 - DNA, 21 bp, Artificial Sequence
  Description of Artificial Sequence: Synthetic oligonucleotide
caagtaagatggatttaagga

SEQ ID NO: 8549 - DNA, 21 bp, Artificial Sequence
  Description of Artificial Sequence: Synthetic oligonucleotide
ttaaatccatcttacttgcca

SEQ ID NO: 8550 - DNA, 21 bp, Artificial Sequence
  Description of Artificial Sequence: Synthetic oligonucleotide
gcaagtaagatggatttaagg

SEQ ID NO: 8551 - DNA, 21 bp, Artificial Sequence
  Description of Artificial Sequence: Synthetic oligonucleotide
taaatccatcttacttgccaa

SEQ ID NO: 8552 - DNA, 21 bp, Artificial Sequence
  Description of Artificial Sequence: Synthetic oligonucleotide
ggcaagtaagatggatttaag

SEQ ID NO: 8553 - DNA, 21 bp, Artificial Sequence
  Description of Artificial Sequence: Synthetic oligonucleotide
aaatccatcttacttgccaac

SEQ ID NO: 8554 - DNA, 21 bp, Artificial Sequence
  Description of Artificial Sequence: Synthetic oligonucleotide
tggcaagtaagatggatttaa

SEQ ID NO: 8555 - DNA, 21 bp, Artificial Sequence
  Description of Artificial Sequence: Synthetic oligonucleotide
aatccatcttacttgccaaca

SEQ ID NO: 8556 - DNA, 21 bp, Artificial Sequence
  Description of Artificial Sequence: Synthetic oligonucleotide
ttggcaagtaagatggattta

SEQ ID NO: 8557 - DNA, 21 bp, Artificial Sequence
  Description of Artificial Sequence: Synthetic oligonucleotide
atccatcttacttgccaacag

SEQ ID NO: 8558 - DNA, 21 bp, Artificial Sequence
  Description of Artificial Sequence: Synthetic oligonucleotide
gttggcaagtaagatggattt

SEQ ID NO: 8559 - DNA, 21 bp, Artificial Sequence
  Description of Artificial Sequence: Synthetic oligonucleotide
tccatcttacttgccaacagg

SEQ ID NO: 8560 - DNA, 21 bp, Artificial Sequence
  Description of Artificial Sequence: Synthetic oligonucleotide
tgttggcaagtaagatggatt

SEQ ID NO: 8561 - DNA, 21 bp, Artificial Sequence
  Description of Artificial Sequence: Synthetic oligonucleotide
ccatcttacttgccaacaggt

SEQ ID NO: 8562 - DNA, 21 bp, Artificial Sequence
  Description of Artificial Sequence: Synthetic oligonucleotide
ctgttggcaagtaagatggat

SEQ ID NO: 8563 - DNA, 21 bp, Artificial Sequence
  Description of Artificial Sequence: Synthetic oligonucleotide
catcttacttgccaacaggta

SEQ ID NO: 8564 - DNA, 21 bp, Artificial Sequence
  Description of Artificial Sequence: Synthetic oligonucleotide
cctgttggcaagtaagatgga

SEQ ID NO: 8565 - DNA, 21 bp, Artificial Sequence
  Description of Artificial Sequence: Synthetic oligonucleotide
atcttacttgccaacaggtaa

SEQ ID NO: 8566 - DNA, 21 bp, Artificial Sequence
  Description of Artificial Sequence: Synthetic oligonucleotide
acctgttggcaagtaagatgg

SEQ ID NO: 8567 - DNA, 21 bp, Artificial Sequence
  Description of Artificial Sequence: Synthetic oligonucleotide
tcttacttgccaacaggtaag

SEQ ID NO: 8568 - DNA, 21 bp, Artificial Sequence
  Description of Artificial Sequence: Synthetic oligonucleotide
tacctgttggcaagtaagatg

SEQ ID NO: 8569 - DNA, 21 bp, Artificial Sequence
  Description of Artificial Sequence: Synthetic oligonucleotide
cttacttgccaacaggtaaga

SEQ ID NO: 8570 - DNA, 21 bp, Artificial Sequence
  Description of Artificial Sequence: Synthetic oligonucleotide
ttacctgttggcaagtaagat

SEQ ID NO: 8571 - DNA, 21 bp, Artificial Sequence
  Description of Artificial Sequence: Synthetic oligonucleotide
ttacttgccaacaggtaagag

SEQ ID NO: 8572 - DNA, 21 bp, Artificial Sequence
  Description of Artificial Sequence: Synthetic oligonucleotide
cttacctgttggcaagtaaga

SEQ ID NO: 8573 - DNA, 21 bp, Artificial Sequence
  Description of Artificial Sequence: Synthetic oligonucleotide
tacttgccaacaggtaagagg

SEQ ID NO: 8574 - DNA, 21 bp, Artificial Sequence
  Description of Artificial Sequence: Synthetic oligonucleotide
tcttacctgttggcaagtaag

SEQ ID NO: 8575 - DNA, 21 bp, Artificial Sequence
  Description of Artificial Sequence: Synthetic oligonucleotide
acttgccaacaggtaagagga

SEQ ID NO: 8576 - DNA, 21 bp, Artificial Sequence
  Description of Artificial Sequence: Synthetic oligonucleotide
ctcttacctgttggcaagtaa

SEQ ID NO: 8577 - DNA, 21 bp, Artificial Sequence
  Description of Artificial Sequence: Synthetic oligonucleotide
cttgccaacaggtaagaggaa

SEQ ID NO: 8578 - DNA, 21 bp, Artificial Sequence
  Description of Artificial Sequence: Synthetic oligonucleotide
cctcttacctgttggcaagta

SEQ ID NO: 8579 - DNA, 21 bp, Artificial Sequence
  Description of Artificial Sequence: Synthetic oligonucleotide
ttgccaacaggtaagaggaag

SEQ ID NO: 8580 - DNA, 21 bp, Artificial Sequence
  Description of Artificial Sequence: Synthetic oligonucleotide
tcctcttacctgttggcaagt

SEQ ID NO: 8581 - DNA, 21 bp, Artificial Sequence
  Description of Artificial Sequence: Synthetic oligonucleotide
tgccaacaggtaagaggaagc

SEQ ID NO: 8582 - DNA, 21 bp, Artificial Sequence
  Description of Artificial Sequence: Synthetic oligonucleotide
ttcctcttacctgttggcaag

SEQ ID NO: 8583 - DNA, 21 bp, Artificial Sequence
  Description of Artificial Sequence: Synthetic oligonucleotide
gccaacaggtaagaggaagct

SEQ ID NO: 8584 - DNA, 21 bp, Artificial Sequence
  Description of Artificial Sequence: Synthetic oligonucleotide
cttcctcttacctgttggcaa

SEQ ID NO: 8585 - DNA, 21 bp, Artificial Sequence
  Description of Artificial Sequence: Synthetic oligonucleotide
ccaacaggtaagaggaagctt

SEQ ID NO: 8586 - DNA, 21 bp, Artificial Sequence
  Description of Artificial Sequence: Synthetic oligonucleotide
gcttcctcttacctgttggca

SEQ ID NO: 8587 - DNA, 21 bp, Artificial Sequence
  Description of Artificial Sequence: Synthetic oligonucleotide
caacaggtaagaggaagctta

SEQ ID NO: 8588 - DNA, 21 bp, Artificial Sequence
  Description of Artificial Sequence: Synthetic oligonucleotide
agcttcctcttacctgttggc

SEQ ID NO: 8589 - DNA, 21 bp, Artificial Sequence
  Description of Artificial Sequence: Synthetic oligonucleotide
aacaggtaagaggaagcttac

SEQ ID NO: 8590 - DNA, 21 bp, Artificial Sequence
  Description of Artificial Sequence: Synthetic oligonucleotide
aagcttcctcttacctgttgg

SEQ ID NO: 8591 - DNA, 21 bp, Artificial Sequence
  Description of Artificial Sequence: Synthetic oligonucleotide
acaggtaagaggaagcttaca

SEQ ID NO: 8592 - DNA, 21 bp, Artificial Sequence
  Description of Artificial Sequence: Synthetic oligonucleotide
taagcttcctcttacctgttg

SEQ ID NO: 8593 - DNA, 21 bp, Artificial Sequence
  Description of Artificial Sequence: Synthetic oligonucleotide
caggtaagaggaagcttacat

SEQ ID NO: 8594 - DNA, 21 bp, Artificial Sequence
  Description of Artificial Sequence: Synthetic oligonucleotide
gtaagcttcctcttacctgtt

SEQ ID NO: 8595 - DNA, 21 bp, Artificial Sequence
  Description of Artificial Sequence: Synthetic oligonucleotide
aggtaagaggaagcttacatt

SEQ ID NO: 8596 - DNA, 21 bp, Artificial Sequence
  Description of Artificial Sequence: Synthetic oligonucleotide
tgtaagcttcctcttacctgt

SEQ ID NO: 8597 - DNA, 21 bp, Artificial Sequence
  Description of Artificial Sequence: Synthetic oligonucleotide
ggtaagaggaagcttacatta

SEQ ID NO: 8598 - DNA, 21 bp, Artificial Sequence
  Description of Artificial Sequence: Synthetic oligonucleotide
atgtaagcttcctcttacctg

SEQ ID NO: 8599 - DNA, 21 bp, Artificial Sequence
  Description of Artificial Sequence: Synthetic oligonucleotide
gtaagaggaagcttacattac

SEQ ID NO: 8600 - DNA, 21 bp, Artificial Sequence
  Description of Artificial Sequence: Synthetic oligonucleotide
aatgtaagcttcctcttacct

SEQ ID NO: 8601 - DNA, 21 bp, Artificial Sequence
  Description of Artificial Sequence: Synthetic oligonucleotide
taagaggaagcttacattaca

SEQ ID NO: 8602 - DNA, 21 bp, Artificial Sequence
  Description of Artificial Sequence: Synthetic oligonucleotide
taatgtaagcttcctcttacc

SEQ ID NO: 8603 - DNA, 21 bp, Artificial Sequence
  Description of Artificial Sequence: Synthetic oligonucleotide
aagaggaagcttacattacat

SEQ ID NO: 8604 - DNA, 21 bp, Artificial Sequence
  Description of Artificial Sequence: Synthetic oligonucleotide
gtaatgtaagcttcctcttac

SEQ ID NO: 8605 - DNA, 21 bp, Artificial Sequence
  Description of Artificial Sequence: Synthetic oligonucleotide
agaggaagcttacattacatg

SEQ ID NO: 8606 - DNA, 21 bp, Artificial Sequence
  Description of Artificial Sequence: Synthetic oligonucleotide
tgtaatgtaagcttcctctta

SEQ ID NO: 8607 - DNA, 21 bp, Artificial Sequence
  Description of Artificial Sequence: Synthetic oligonucleotide
gaggaagcttacattacatgt

SEQ ID NO: 8608 - DNA, 21 bp, Artificial Sequence
  Description of Artificial Sequence: Synthetic oligonucleotide
atgtaatgtaagcttcctctt

SEQ ID NO: 8609 - DNA, 21 bp, Artificial Sequence
  Description of Artificial Sequence: Synthetic oligonucleotide
aggaagcttacattacatgtc

SEQ ID NO: 8610 - DNA, 21 bp, Artificial Sequence
  Description of Artificial Sequence: Synthetic oligonucleotide
catgtaatgtaagcttcctct

SEQ ID NO: 8611 - DNA, 21 bp, Artificial Sequence
  Description of Artificial Sequence: Synthetic oligonucleotide
ggaagcttacattacatgtcc

SEQ ID NO: 8612 - DNA, 21 bp, Artificial Sequence
  Description of Artificial Sequence: Synthetic oligonucleotide
acatgtaatgtaagcttcctc

SEQ ID NO: 8613 - DNA, 21 bp, Artificial Sequence
  Description of Artificial Sequence: Synthetic oligonucleotide
gaagcttacattacatgtcca

SEQ ID NO: 8614 - DNA, 21 bp, Artificial Sequence
  Description of Artificial Sequence: Synthetic oligonucleotide
gacatgtaatgtaagcttcct

SEQ ID NO: 8615 - DNA, 21 bp, Artificial Sequence
  Description of Artificial Sequence: Synthetic oligonucleotide
aagcttacattacatgtccag

SEQ ID NO: 8616 - DNA, 21 bp, Artificial Sequence
  Description of Artificial Sequence: Synthetic oligonucleotide
ggacatgtaatgtaagcttcc

SEQ ID NO: 8617 - DNA, 21 bp, Artificial Sequence
  Description of Artificial Sequence: Synthetic oligonucleotide
agcttacattacatgtccagt

SEQ ID NO: 8618 - DNA, 21 bp, Artificial Sequence
  Description of Artificial Sequence: Synthetic oligonucleotide
tggacatgtaatgtaagcttc

SEQ ID NO: 8619 - DNA, 21 bp, Artificial Sequence
  Description of Artificial Sequence: Synthetic oligonucleotide
gcttacattacatgtccagtc

SEQ ID NO: 8620 - DNA, 21 bp, Artificial Sequence
  Description of Artificial Sequence: Synthetic oligonucleotide
ctggacatgtaatgtaagctt

SEQ ID NO: 8621 - DNA, 21 bp, Artificial Sequence
  Description of Artificial Sequence: Synthetic oligonucleotide
cttacattacatgtccagtcc

SEQ ID NO: 8622 - DNA, 21 bp, Artificial Sequence
  Description of Artificial Sequence: Synthetic oligonucleotide
actggacatgtaatgtaagct

SEQ ID NO: 8623 - DNA, 21 bp, Artificial Sequence
  Description of Artificial Sequence: Synthetic oligonucleotide
ttacattacatgtccagtcca

SEQ ID NO: 8624 - DNA, 21 bp, Artificial Sequence
  Description of Artificial Sequence: Synthetic oligonucleotide
gactggacatgtaatgtaagc

SEQ ID NO: 8625 - DNA, 21 bp, Artificial Sequence
  Description of Artificial Sequence: Synthetic oligonucleotide
tacattacatgtccagtccac

SEQ ID NO: 8626 - DNA, 21 bp, Artificial Sequence
  Description of Artificial Sequence: Synthetic oligonucleotide
ggactggacatgtaatgtaag

SEQ ID NO: 8627 - DNA, 21 bp, Artificial Sequence
  Description of Artificial Sequence: Synthetic oligonucleotide
acattacatgtccagtccaca

SEQ ID NO: 8628 - DNA, 21 bp, Artificial Sequence
  Description of Artificial Sequence: Synthetic oligonucleotide
tggactggacatgtaatgtaa

SEQ ID NO: 8629 - DNA, 21 bp, Artificial Sequence
  Description of Artificial Sequence: Synthetic oligonucleotide
cattacatgtccagtccacat

SEQ ID NO: 8630 - DNA, 21 bp, Artificial Sequence
  Description of Artificial Sequence: Synthetic oligonucleotide
gtggactggacatgtaatgta

SEQ ID NO: 8631 - DNA, 21 bp, Artificial Sequence
  Description of Artificial Sequence: Synthetic oligonucleotide
attacatgtccagtccacatt

SEQ ID NO: 8632 - DNA, 21 bp, Artificial Sequence
  Description of Artificial Sequence: Synthetic oligonucleotide
tgtggactggacatgtaatgt

SEQ ID NO: 8633 - DNA, 21 bp, Artificial Sequence
  Description of Artificial Sequence: Synthetic oligonucleotide
ttacatgtccagtccacattt

SEQ ID NO: 8634 - DNA, 21 bp, Artificial Sequence
  Description of Artificial Sequence: Synthetic oligonucleotide
atgtggactggacatgtaatg

SEQ ID NO: 8635 - DNA, 21 bp, Artificial Sequence
  Description of Artificial Sequence: Synthetic oligonucleotide
tacatgtccagtccacattta

SEQ ID NO: 8636 - DNA, 21 bp, Artificial Sequence
  Description of Artificial Sequence: Synthetic oligonucleotide
aatgtggactggacatgtaat

SEQ ID NO: 8637 - DNA, 21 bp, Artificial Sequence
  Description of Artificial Sequence: Synthetic oligonucleotide
acatgtccagtccacatttaa

SEQ ID NO: 8638 - DNA, 21 bp, Artificial Sequence
  Description of Artificial Sequence: Synthetic oligonucleotide
aaatgtggactggacatgtaa

SEQ ID NO: 8639 - DNA, 21 bp, Artificial Sequence
  Description of Artificial Sequence: Synthetic oligonucleotide
catgtccagtccacatttaaa

SEQ ID NO: 8640 - DNA, 21 bp, Artificial Sequence
  Description of Artificial Sequence: Synthetic oligonucleotide
taaatgtggactggacatgta

SEQ ID NO: 8641 - DNA, 21 bp, Artificial Sequence
  Description of Artificial Sequence: Synthetic oligonucleotide
atgtccagtccacatttaaag

SEQ ID NO: 8642 - DNA, 21 bp, Artificial Sequence
  Description of Artificial Sequence: Synthetic oligonucleotide
ttaaatgtggactggacatgt

SEQ ID NO: 8643 - DNA, 21 bp, Artificial Sequence
  Description of Artificial Sequence: Synthetic oligonucleotide
tgtccagtccacatttaaaga

SEQ ID NO: 8644 - DNA, 21 bp, Artificial Sequence
  Description of Artificial Sequence: Synthetic oligonucleotide
tttaaatgtggactggacatg

SEQ ID NO: 8645 - DNA, 21 bp, Artificial Sequence
  Description of Artificial Sequence: Synthetic oligonucleotide
gtccagtccacatttaaagag

SEQ ID NO: 8646 - DNA, 21 bp, Artificial Sequence
  Description of Artificial Sequence: Synthetic oligonucleotide
ctttaaatgtggactggacat

SEQ ID NO: 8647 - DNA, 21 bp, Artificial Sequence
  Description of Artificial Sequence: Synthetic oligonucleotide
tccagtccacatttaaagagc

SEQ ID NO: 8648 - DNA, 21 bp, Artificial Sequence
  Description of Artificial Sequence: Synthetic oligonucleotide
tctttaaatgtggactggaca

SEQ ID NO: 8649 - DNA, 21 bp, Artificial Sequence
  Description of Artificial Sequence: Synthetic oligonucleotide
ccagtccacatttaaagagca

SEQ ID NO: 8650 - DNA, 21 bp, Artificial Sequence
  Description of Artificial Sequence: Synthetic oligonucleotide
ctctttaaatgtggactggac

SEQ ID NO: 8651 - DNA, 21 bp, Artificial Sequence
  Description of Artificial Sequence: Synthetic oligonucleotide
cagtccacatttaaagagcac

SEQ ID NO: 8652 - DNA, 21 bp, Artificial Sequence
  Description of Artificial Sequence: Synthetic oligonucleotide
gctctttaaatgtggactgga

SEQ ID NO: 8653 - DNA, 21 bp, Artificial Sequence
  Description of Artificial Sequence: Synthetic oligonucleotide
agtccacatttaaagagcact

SEQ ID NO: 8654 - DNA, 21 bp, Artificial Sequence
  Description of Artificial Sequence: Synthetic oligonucleotide
tgctctttaaatgtggactgg

SEQ ID NO: 8655 - DNA, 21 bp, Artificial Sequence
  Description of Artificial Sequence: Synthetic oligonucleotide
gtccacatttaaagagcactt

SEQ ID NO: 8656 - DNA, 21 bp, Artificial Sequence
  Description of Artificial Sequence: Synthetic oligonucleotide
gtgctctttaaatgtggactg

SEQ ID NO: 8657 - DNA, 21 bp, Artificial Sequence
  Description of Artificial Sequence: Synthetic oligonucleotide
tccacatttaaagagcactta

SEQ ID NO: 8658 - DNA, 21 bp, Artificial Sequence
  Description of Artificial Sequence: Synthetic oligonucleotide
agtgctctttaaatgtggact

SEQ ID NO: 8659 - DNA, 21 bp, Artificial Sequence
  Description of Artificial Sequence: Synthetic oligonucleotide
ccacatttaaagagcacttac

SEQ ID NO: 8660 - DNA, 21 bp, Artificial Sequence
  Description of Artificial Sequence: Synthetic oligonucleotide
aagtgctctttaaatgtggac

SEQ ID NO: 8661 - DNA, 21 bp, Artificial Sequence
  Description of Artificial Sequence: Synthetic oligonucleotide
cacatttaaagagcacttact

SEQ ID NO: 8662 - DNA, 21 bp, Artificial Sequence
  Description of Artificial Sequence: Synthetic oligonucleotide
taagtgctctttaaatgtgga

SEQ ID NO: 8663 - DNA, 21 bp, Artificial Sequence
  Description of Artificial Sequence: Synthetic oligonucleotide
acatttaaagagcacttactg

SEQ ID NO: 8664 - DNA, 21 bp, Artificial Sequence
  Description of Artificial Sequence: Synthetic oligonucleotide
gtaagtgctctttaaatgtgg

SEQ ID NO: 8665 - DNA, 21 bp, Artificial Sequence
  Description of Artificial Sequence: Synthetic oligonucleotide
catttaaagagcacttactgt

SEQ ID NO: 8666 - DNA, 21 bp, Artificial Sequence
  Description of Artificial Sequence: Synthetic oligonucleotide
agtaagtgctctttaaatgtg

SEQ ID NO: 8667 - DNA, 21 bp, Artificial Sequence
  Description of Artificial Sequence: Synthetic oligonucleotide
atttaaagagcacttactgtg

SEQ ID NO: 8668 - DNA, 21 bp, Artificial Sequence
  Description of Artificial Sequence: Synthetic oligonucleotide
cagtaagtgctctttaaatgt

SEQ ID NO: 8669 - DNA, 21 bp, Artificial Sequence
  Description of Artificial Sequence: Synthetic oligonucleotide
tttaaagagcacttactgtgg

SEQ ID NO: 8670 - DNA, 21 bp, Artificial Sequence
  Description of Artificial Sequence: Synthetic oligonucleotide
acagtaagtgctctttaaatg

SEQ ID NO: 8671 - DNA, 21 bp, Artificial Sequence
  Description of Artificial Sequence: Synthetic oligonucleotide
ttaaagagcacttactgtgga

SEQ ID NO: 8672 - DNA, 21 bp, Artificial Sequence
  Description of Artificial Sequence: Synthetic oligonucleotide
cacagtaagtgctctttaaat

SEQ ID NO: 8673 - DNA, 21 bp, Artificial Sequence
  Description of Artificial Sequence: Synthetic oligonucleotide
taaagagcacttactgtggaa

SEQ ID NO: 8674 - DNA, 21 bp, Artificial Sequence
  Description of Artificial Sequence: Synthetic oligonucleotide
ccacagtaagtgctctttaaa

SEQ ID NO: 8675 - DNA, 21 bp, Artificial Sequence
  Description of Artificial Sequence: Synthetic oligonucleotide
aaagagcacttactgtggaac

SEQ ID NO: 8676 - DNA, 21 bp, Artificial Sequence
  Description of Artificial Sequence: Synthetic oligonucleotide
tccacagtaagtgctctttaa

SEQ ID NO: 8677 - DNA, 21 bp, Artificial Sequence
  Description of Artificial Sequence: Synthetic oligonucleotide
aagagcacttactgtggaaca

SEQ ID NO: 8678 - DNA, 21 bp, Artificial Sequence
  Description of Artificial Sequence: Synthetic oligonucleotide
ttccacagtaagtgctcttta

SEQ ID NO: 8679 - DNA, 21 bp, Artificial Sequence
  Description of Artificial Sequence: Synthetic oligonucleotide
agagcacttactgtggaacaa

SEQ ID NO: 8680 - DNA, 21 bp, Artificial Sequence
  Description of Artificial Sequence: Synthetic oligonucleotide
gttccacagtaagtgctcttt

SEQ ID NO: 8681 - DNA, 21 bp, Artificial Sequence
  Description of Artificial Sequence: Synthetic oligonucleotide
gagcacttactgtggaacaag

SEQ ID NO: 8682 - DNA, 21 bp, Artificial Sequence
  Description of Artificial Sequence: Synthetic oligonucleotide
tgttccacagtaagtgctctt

SEQ ID NO: 8683 - DNA, 21 bp, Artificial Sequence
  Description of Artificial Sequence: Synthetic oligonucleotide
agcacttactgtggaacaagc

SEQ ID NO: 8684 - DNA, 21 bp, Artificial Sequence
  Description of Artificial Sequence: Synthetic oligonucleotide
ttgttccacagtaagtgctct

SEQ ID NO: 8685 - DNA, 21 bp, Artificial Sequence
  Description of Artificial Sequence: Synthetic oligonucleotide
gcacttactgtggaacaagcc

SEQ ID NO: 8686 - DNA, 21 bp, Artificial Sequence
  Description of Artificial Sequence: Synthetic oligonucleotide
cttgttccacagtaagtgctc

SEQ ID NO: 8687 - DNA, 21 bp, Artificial Sequence
  Description of Artificial Sequence: Synthetic oligonucleotide
cacttactgtggaacaagcct

SEQ ID NO: 8688 - DNA, 21 bp, Artificial Sequence
  Description of Artificial Sequence: Synthetic oligonucleotide
gcttgttccacagtaagtgct

SEQ ID NO: 8689 - DNA, 21 bp, Artificial Sequence
  Description of Artificial Sequence: Synthetic oligonucleotide
acttactgtggaacaagcctt

SEQ ID NO: 8690 - DNA, 21 bp, Artificial Sequence
  Description of Artificial Sequence: Synthetic oligonucleotide
ggcttgttccacagtaagtgc

SEQ ID NO: 8691 - DNA, 21 bp, Artificial Sequence
  Description of Artificial Sequence: Synthetic oligonucleotide
cttactgtggaacaagccttc

SEQ ID NO: 8692 - DNA, 21 bp, Artificial Sequence
  Description of Artificial Sequence: Synthetic oligonucleotide
aggcttgttccacagtaagtg

SEQ ID NO: 8693 - DNA, 21 bp, Artificial Sequence
  Description of Artificial Sequence: Synthetic oligonucleotide
ttactgtggaacaagccttca

SEQ ID NO: 8694 - DNA, 21 bp, Artificial Sequence
  Description of Artificial Sequence: Synthetic oligonucleotide
aaggcttgttccacagtaagt

SEQ ID NO: 8695 - DNA, 21 bp, Artificial Sequence
  Description of Artificial Sequence: Synthetic oligonucleotide
tactgtggaacaagccttcag

SEQ ID NO: 8696 - DNA, 21 bp, Artificial Sequence
  Description of Artificial Sequence: Synthetic oligonucleotide
gaaggcttgttccacagtaag

SEQ ID NO: 8697 - DNA, 21 bp, Artificial Sequence
  Description of Artificial Sequence: Synthetic oligonucleotide
actgtggaacaagccttcagc

SEQ ID NO: 8698 - DNA, 21 bp, Artificial Sequence
  Description of Artificial Sequence: Synthetic oligonucleotide
tgaaggcttgttccacagtaa

SEQ ID NO: 8699 - DNA, 21 bp, Artificial Sequence
  Description of Artificial Sequence: Synthetic oligonucleotide
ctgtggaacaagccttcagcc

SEQ ID NO: 8700 - DNA, 21 bp, Artificial Sequence
  Description of Artificial Sequence: Synthetic oligonucleotide
ctgaaggcttgttccacagta

SEQ ID NO: 8701 - DNA, 21 bp, Artificial Sequence
  Description of Artificial Sequence: Synthetic oligonucleotide
tgtggaacaagccttcagcca

SEQ ID NO: 8702 - DNA, 21 bp, Artificial Sequence
  Description of Artificial Sequence: Synthetic oligonucleotide
gctgaaggcttgttccacagt

SEQ ID NO: 8703 - DNA, 21 bp, Artificial Sequence
  Description of Artificial Sequence: Synthetic oligonucleotide
gtggaacaagccttcagccaa

SEQ ID NO: 8704 - DNA, 21 bp, Artificial Sequence
  Description of Artificial Sequence: Synthetic oligonucleotide
ggctgaaggcttgttccacag

SEQ ID NO: 8705 - DNA, 21 bp, Artificial Sequence
  Description of Artificial Sequence: Synthetic oligonucleotide
tggaacaagccttcagccaaa

SEQ ID NO: 8706 - DNA, 21 bp, Artificial Sequence
  Description of Artificial Sequence: Synthetic oligonucleotide
tggctgaaggcttgttccaca

SEQ ID NO: 8707 - DNA, 21 bp, Artificial Sequence
  Description of Artificial Sequence: Synthetic oligonucleotide
ggaacaagccttcagccaaac

SEQ ID NO: 8708 - DNA, 21 bp, Artificial Sequence
  Description of Artificial Sequence: Synthetic oligonucleotide
ttggctgaaggcttgttccac

SEQ ID NO: 8709 - DNA, 21 bp, Artificial Sequence
  Description of Artificial Sequence: Synthetic oligonucleotide
gaacaagccttcagccaaaca

SEQ ID NO: 8710 - DNA, 21 bp, Artificial Sequence
  Description of Artificial Sequence: Synthetic oligonucleotide
tttggctgaaggcttgttcca

SEQ ID NO: 8711 - DNA, 21 bp, Artificial Sequence
  Description of Artificial Sequence: Synthetic oligonucleotide
aacaagccttcagccaaacaa

SEQ ID NO: 8712 - DNA, 21 bp, Artificial Sequence
  Description of Artificial Sequence: Synthetic oligonucleotide
gtttggctgaaggcttgttcc

SEQ ID NO: 8713 - DNA, 21 bp, Artificial Sequence
  Description of Artificial Sequence: Synthetic oligonucleotide
acaagccttcagccaaacaat

SEQ ID NO: 8714 - DNA, 21 bp, Artificial Sequence
  Description of Artificial Sequence: Synthetic oligonucleotide
tgtttggctgaaggcttgttc

SEQ ID NO: 8715 - DNA, 21 bp, Artificial Sequence
  Description of Artificial Sequence: Synthetic oligonucleotide
caagccttcagccaaacaatg

SEQ ID NO: 8716 - DNA, 21 bp, Artificial Sequence
  Description of Artificial Sequence: Synthetic oligonucleotide
ttgtttggctgaaggcttgtt

SEQ ID NO: 8717 - DNA, 21 bp, Artificial Sequence
  Description of Artificial Sequence: Synthetic oligonucleotide
aagccttcagccaaacaatgg

SEQ ID NO: 8718 - DNA, 21 bp, Artificial Sequence
  Description of Artificial Sequence: Synthetic oligonucleotide
attgtttggctgaaggcttgt

SEQ ID NO: 8719 - DNA, 21 bp, Artificial Sequence
  Description of Artificial Sequence: Synthetic oligonucleotide
agccttcagccaaacaatggg

SEQ ID NO: 8720 - DNA, 21 bp, Artificial Sequence
  Description of Artificial Sequence: Synthetic oligonucleotide
cattgtttggctgaaggcttg

SEQ ID NO: 8721 - DNA, 21 bp, Artificial Sequence
  Description of Artificial Sequence: Synthetic oligonucleotide
gccttcagccaaacaatgggg

SEQ ID NO: 8722 - DNA, 21 bp, Artificial Sequence
  Description of Artificial Sequence: Synthetic oligonucleotide
ccattgtttggctgaaggctt

SEQ ID NO: 8723 - DNA, 21 bp, Artificial Sequence
  Description of Artificial Sequence: Synthetic oligonucleotide
ccttcagccaaacaatgggga

SEQ ID NO: 8724 - DNA, 21 bp, Artificial Sequence
  Description of Artificial Sequence: Synthetic oligonucleotide
cccattgtttggctgaaggct

SEQ ID NO: 8725 - DNA, 21 bp, Artificial Sequence
  Description of Artificial Sequence: Synthetic oligonucleotide
cttcagccaaacaatggggat

SEQ ID NO: 8726 - DNA, 21 bp, Artificial Sequence
  Description of Artificial Sequence: Synthetic oligonucleotide
ccccattgtttggctgaaggc

SEQ ID NO: 8727 - DNA, 21 bp, Artificial Sequence
  Description of Artificial Sequence: Synthetic oligonucleotide
ttcagccaaacaatggggata

SEQ ID NO: 8728 - DNA, 21 bp, Artificial Sequence
  Description of Artificial Sequence: Synthetic oligonucleotide
tccccattgtttggctgaagg

SEQ ID NO: 8729 - DNA, 21 bp, Artificial Sequence
  Description of Artificial Sequence: Synthetic oligonucleotide
tcagccaaacaatggggatag

SEQ ID NO: 8730 - DNA, 21 bp, Artificial Sequence
  Description of Artificial Sequence: Synthetic oligonucleotide
atccccattgtttggctgaag

SEQ ID NO: 8731 - DNA, 21 bp, Artificial Sequence
  Description of Artificial Sequence: Synthetic oligonucleotide
cagccaaacaatggggataga

SEQ ID NO: 8732 - DNA, 21 bp, Artificial Sequence
  Description of Artificial Sequence: Synthetic oligonucleotide
tatccccattgtttggctgaa

SEQ ID NO: 8733 - DNA, 21 bp, Artificial Sequence
  Description of Artificial Sequence: Synthetic oligonucleotide
agccaaacaatggggatagaa

SEQ ID NO: 8734 - DNA, 21 bp, Artificial Sequence
  Description of Artificial Sequence: Synthetic oligonucleotide
ctatccccattgtttggctga

SEQ ID NO: 8735 - DNA, 21 bp, Artificial Sequence
  Description of Artificial Sequence: Synthetic oligonucleotide
gccaaacaatggggatagaaa

SEQ ID NO: 8736 - DNA, 21 bp, Artificial Sequence
  Description of Artificial Sequence: Synthetic oligonucleotide
tctatccccattgtttggctg

SEQ ID NO: 8737 - DNA, 21 bp, Artificial Sequence
  Description of Artificial Sequence: Synthetic oligonucleotide
ccaaacaatggggatagaaaa

SEQ ID NO: 8738 - DNA, 21 bp, Artificial Sequence
  Description of Artificial Sequence: Synthetic oligonucleotide
ttctatccccattgtttggct

SEQ ID NO: 8739 - DNA, 21 bp, Artificial Sequence
  Description of Artificial Sequence: Synthetic oligonucleotide
caaacaatggggatagaaaag

SEQ ID NO: 8740 - DNA, 21 bp, Artificial Sequence
  Description of Artificial Sequence: Synthetic oligonucleotide
tttctatccccattgtttggc

SEQ ID NO: 8741 - DNA, 21 bp, Artificial Sequence
  Description of Artificial Sequence: Synthetic oligonucleotide
aaacaatggggatagaaaagt

SEQ ID NO: 8742 - DNA, 21 bp, Artificial Sequence
  Description of Artificial Sequence: Synthetic oligonucleotide
ttttctatccccattgtttgg

SEQ ID NO: 8743 - DNA, 21 bp, Artificial Sequence
  Description of Artificial Sequence: Synthetic oligonucleotide
aacaatggggatagaaaagta

SEQ ID NO: 8744 - DNA, 21 bp, Artificial Sequence
  Description of Artificial Sequence: Synthetic oligonucleotide
cttttctatccccattgtttg

SEQ ID NO: 8745 - DNA, 21 bp, Artificial Sequence
  Description of Artificial Sequence: Synthetic oligonucleotide
acaatggggatagaaaagtag

SEQ ID NO: 8746 - DNA, 21 bp, Artificial Sequence
  Description of Artificial Sequence: Synthetic oligonucleotide
acttttctatccccattgttt

SEQ ID NO: 8747 - DNA, 21 bp, Artificial Sequence
  Description of Artificial Sequence: Synthetic oligonucleotide
caatggggatagaaaagtagg

SEQ ID NO: 8748 - DNA, 21 bp, Artificial Sequence
  Description of Artificial Sequence: Synthetic oligonucleotide
tacttttctatccccattgtt

SEQ ID NO: 8749 - DNA, 21 bp, Artificial Sequence
  Description of Artificial Sequence: Synthetic oligonucleotide
aatggggatagaaaagtaggt

SEQ ID NO: 8750 - DNA, 21 bp, Artificial Sequence
  Description of Artificial Sequence: Synthetic oligonucleotide
ctacttttctatccccattgt

SEQ ID NO: 8751 - DNA, 21 bp, Artificial Sequence
  Description of Artificial Sequence: Synthetic oligonucleotide
atggggatagaaaagtaggta

SEQ ID NO: 8752 - DNA, 21 bp, Artificial Sequence
  Description of Artificial Sequence: Synthetic oligonucleotide
cctacttttctatccccattg

SEQ ID NO: 8753 - DNA, 21 bp, Artificial Sequence
  Description of Artificial Sequence: Synthetic oligonucleotide
tggggatagaaaagtaggtaa

SEQ ID NO: 8754 - DNA, 21 bp, Artificial Sequence
  Description of Artificial Sequence: Synthetic oligonucleotide
acctacttttctatccccatt

SEQ ID NO: 8755 - DNA, 21 bp, Artificial Sequence
  Description of Artificial Sequence: Synthetic oligonucleotide
ggggatagaaaagtaggtaag

SEQ ID NO: 8756 - DNA, 21 bp, Artificial Sequence
  Description of Artificial Sequence: Synthetic oligonucleotide
tacctacttttctatccccat

SEQ ID NO: 8757 - DNA, 21 bp, Artificial Sequence
  Description of Artificial Sequence: Synthetic oligonucleotide
gggatagaaaagtaggtaaga

SEQ ID NO: 8758 - DNA, 21 bp, Artificial Sequence
  Description of Artificial Sequence: Synthetic oligonucleotide
ttacctacttttctatcccca

SEQ ID NO: 8759 - DNA, 21 bp, Artificial Sequence
  Description of Artificial Sequence: Synthetic oligonucleotide
ggatagaaaagtaggtaagac

SEQ ID NO: 8760 - DNA, 21 bp, Artificial Sequence
  Description of Artificial Sequence: Synthetic oligonucleotide
cttacctacttttctatcccc

SEQ ID NO: 8761 - DNA, 21 bp, Artificial Sequence
  Description of Artificial Sequence: Synthetic oligonucleotide
gatagaaaagtaggtaagact

SEQ ID NO: 8762 - DNA, 21 bp, Artificial Sequence
  Description of Artificial Sequence: Synthetic oligonucleotide
tcttacctacttttctatccc

SEQ ID NO: 8763 - DNA, 21 bp, Artificial Sequence
  Description of Artificial Sequence: Synthetic oligonucleotide
atagaaaagtaggtaagactc

SEQ ID NO: 8764 - DNA, 21 bp, Artificial Sequence
  Description of Artificial Sequence: Synthetic oligonucleotide
gtcttacctacttttctatcc

SEQ ID NO: 8765 - DNA, 21 bp, Artificial Sequence
  Description of Artificial Sequence: Synthetic oligonucleotide
tagaaaagtaggtaagactca

SEQ ID NO: 8766 - DNA, 21 bp, Artificial Sequence
  Description of Artificial Sequence: Synthetic oligonucleotide
agtcttacctacttttctatc

SEQ ID NO: 8767 - DNA, 21 bp, Artificial Sequence
  Description of Artificial Sequence: Synthetic oligonucleotide
agaaaagtaggtaagactcag

SEQ ID NO: 8768 - DNA, 21 bp, Artificial Sequence
  Description of Artificial Sequence: Synthetic oligonucleotide
gagtcttacctacttttctat

SEQ ID NO: 8769 - DNA, 21 bp, Artificial Sequence
  Description of Artificial Sequence: Synthetic oligonucleotide
gaaaagtaggtaagactcagc

SEQ ID NO: 8770 - DNA, 21 bp, Artificial Sequence
  Description of Artificial Sequence: Synthetic oligonucleotide
tgagtcttacctacttttcta

SEQ ID NO: 8771 - DNA, 21 bp, Artificial Sequence
  Description of Artificial Sequence: Synthetic oligonucleotide
aaaagtaggtaagactcagcc

SEQ ID NO: 8772 - DNA, 21 bp, Artificial Sequence
  Description of Artificial Sequence: Synthetic oligonucleotide
ctgagtcttacctacttttct

SEQ ID NO: 8773 - DNA, 21 bp, Artificial Sequence
  Description of Artificial Sequence: Synthetic oligonucleotide
aaagtaggtaagactcagcct

SEQ ID NO: 8774 - DNA, 21 bp, Artificial Sequence
  Description of Artificial Sequence: Synthetic oligonucleotide
gctgagtcttacctacttttc

SEQ ID NO: 8775 - DNA, 21 bp, Artificial Sequence
  Description of Artificial Sequence: Synthetic oligonucleotide
aagtaggtaagactcagcctt

SEQ ID NO: 8776 - DNA, 21 bp, Artificial Sequence
  Description of Artificial Sequence: Synthetic oligonucleotide
ggctgagtcttacctactttt

SEQ ID NO: 8777 - DNA, 21 bp, Artificial Sequence
  Description of Artificial Sequence: Synthetic oligonucleotide
agtaggtaagactcagccttt

SEQ ID NO: 8778 - DNA, 21 bp, Artificial Sequence
  Description of Artificial Sequence: Synthetic oligonucleotide
aggctgagtcttacctacttt

SEQ ID NO: 8779 - DNA, 21 bp, Artificial Sequence
  Description of Artificial Sequence: Synthetic oligonucleotide
gtaggtaagactcagcctttg

SEQ ID NO: 8780 - DNA, 21 bp, Artificial Sequence
  Description of Artificial Sequence: Synthetic oligonucleotide
aaggctgagtcttacctactt

SEQ ID NO: 8781 - DNA, 21 bp, Artificial Sequence
  Description of Artificial Sequence: Synthetic oligonucleotide
taggtaagactcagcctttgt

SEQ ID NO: 8782 - DNA, 21 bp, Artificial Sequence
  Description of Artificial Sequence: Synthetic oligonucleotide
aaaggctgagtcttacctact

SEQ ID NO: 8783 - DNA, 21 bp, Artificial Sequence
  Description of Artificial Sequence: Synthetic oligonucleotide
aggtaagactcagcctttgtc

SEQ ID NO: 8784 - DNA, 21 bp, Artificial Sequence
  Description of Artificial Sequence: Synthetic oligonucleotide
caaaggctgagtcttacctac

SEQ ID NO: 8785 - DNA, 21 bp, Artificial Sequence
  Description of Artificial Sequence: Synthetic oligonucleotide
ggtaagactcagcctttgtcc

SEQ ID NO: 8786 - DNA, 21 bp, Artificial Sequence
  Description of Artificial Sequence: Synthetic oligonucleotide
acaaaggctgagtcttaccta

SEQ ID NO: 8787 - DNA, 21 bp, Artificial Sequence
  Description of Artificial Sequence: Synthetic oligonucleotide
gtaagactcagcctttgtcca

SEQ ID NO: 8788 - DNA, 21 bp, Artificial Sequence
  Description of Artificial Sequence: Synthetic oligonucleotide
gacaaaggctgagtcttacct

SEQ ID NO: 8789 - DNA, 21 bp, Artificial Sequence
  Description of Artificial Sequence: Synthetic oligonucleotide
taagactcagcctttgtccag

SEQ ID NO: 8790 - DNA, 21 bp, Artificial Sequence
  Description of Artificial Sequence: Synthetic oligonucleotide
ggacaaaggctgagtcttacc

SEQ ID NO: 8791 - DNA, 21 bp, Artificial Sequence
  Description of Artificial Sequence: Synthetic oligonucleotide
aagactcagcctttgtccaga

SEQ ID NO: 8792 - DNA, 21 bp, Artificial Sequence
  Description of Artificial Sequence: Synthetic oligonucleotide
tggacaaaggctgagtcttac

SEQ ID NO: 8793 - DNA, 21 bp, Artificial Sequence
  Description of Artificial Sequence: Synthetic oligonucleotide
agactcagcctttgtccagag

SEQ ID NO: 8794 - DNA, 21 bp, Artificial Sequence
  Description of Artificial Sequence: Synthetic oligonucleotide
ctggacaaaggctgagtctta

SEQ ID NO: 8795 - DNA, 21 bp, Artificial Sequence
  Description of Artificial Sequence: Synthetic oligonucleotide
gactcagcctttgtccagaga

SEQ ID NO: 8796 - DNA, 21 bp, Artificial Sequence
  Description of Artificial Sequence: Synthetic oligonucleotide
tctggacaaaggctgagtctt

SEQ ID NO: 8797 - DNA, 21 bp, Artificial Sequence
  Description of Artificial Sequence: Synthetic oligonucleotide
actcagcctttgtccagagaa

SEQ ID NO: 8798 - DNA, 21 bp, Artificial Sequence
  Description of Artificial Sequence: Synthetic oligonucleotide
ctctggacaaaggctgagtct

SEQ ID NO: 8799 - DNA, 21 bp, Artificial Sequence
  Description of Artificial Sequence: Synthetic oligonucleotide
ctcagcctttgtccagagaag

SEQ ID NO: 8800 - DNA, 21 bp, Artificial Sequence
  Description of Artificial Sequence: Synthetic oligonucleotide
tctctggacaaaggctgagtc

SEQ ID NO: 8801 - DNA, 21 bp, Artificial Sequence
  Description of Artificial Sequence: Synthetic oligonucleotide
tcagcctttgtccagagaagc

SEQ ID NO: 8802 - DNA, 21 bp, Artificial Sequence
  Description of Artificial Sequence: Synthetic oligonucleotide
ttctctggacaaaggctgagt

SEQ ID NO: 8803 - DNA, 21 bp, Artificial Sequence
  Description of Artificial Sequence: Synthetic oligonucleotide
cagcctttgtccagagaagct

SEQ ID NO: 8804 - DNA, 21 bp, Artificial Sequence
  Description of Artificial Sequence: Synthetic oligonucleotide
cttctctggacaaaggctgag

SEQ ID NO: 8805 - DNA, 21 bp, Artificial Sequence
  Description of Artificial Sequence: Synthetic oligonucleotide
agcctttgtccagagaagctc

SEQ ID NO: 8806 - DNA, 21 bp, Artificial Sequence
  Description of Artificial Sequence: Synthetic oligonucleotide
gcttctctggacaaaggctga

SEQ ID NO: 8807 - DNA, 21 bp, Artificial Sequence
  Description of Artificial Sequence: Synthetic oligonucleotide
gcctttgtccagagaagctca

SEQ ID NO: 8808 - DNA, 21 bp, Artificial Sequence
  Description of Artificial Sequence: Synthetic oligonucleotide
agcttctctggacaaaggctg

SEQ ID NO: 8809 - DNA, 21 bp, Artificial Sequence
  Description of Artificial Sequence: Synthetic oligonucleotide
cctttgtccagagaagctcag

SEQ ID NO: 8810 - DNA, 21 bp, Artificial Sequence
  Description of Artificial Sequence: Synthetic oligonucleotide
gagcttctctggacaaaggct

SEQ ID NO: 8811 - DNA, 21 bp, Artificial Sequence
  Description of Artificial Sequence: Synthetic oligonucleotide
ctttgtccagagaagctcagg

SEQ ID NO: 8812 - DNA, 21 bp, Artificial Sequence
  Description of Artificial Sequence: Synthetic oligonucleotide
tgagcttctctggacaaaggc

SEQ ID NO: 8813 - DNA, 21 bp, Artificial Sequence
  Description of Artificial Sequence: Synthetic oligonucleotide
tttgtccagagaagctcaggg

SEQ ID NO: 8814 - DNA, 21 bp, Artificial Sequence
  Description of Artificial Sequence: Synthetic oligonucleotide
ctgagcttctctggacaaagg

SEQ ID NO: 8815 - DNA, 21 bp, Artificial Sequence
  Description of Artificial Sequence: Synthetic oligonucleotide
ttgtccagagaagctcagggt

SEQ ID NO: 8816 - DNA, 21 bp, Artificial Sequence
  Description of Artificial Sequence: Synthetic oligonucleotide
cctgagcttctctggacaaag

SEQ ID NO: 8817 - DNA, 21 bp, Artificial Sequence
  Description of Artificial Sequence: Synthetic oligonucleotide
tgtccagagaagctcagggta

SEQ ID NO: 8818 - DNA, 21 bp, Artificial Sequence
  Description of Artificial Sequence: Synthetic oligonucleotide
ccctgagcttctctggacaaa

SEQ ID NO: 8819 - DNA, 21 bp, Artificial Sequence
  Description of Artificial Sequence: Synthetic oligonucleotide
gtccagagaagctcagggtat

SEQ ID NO: 8820 - DNA, 21 bp, Artificial Sequence
  Description of Artificial Sequence: Synthetic oligonucleotide
accctgagcttctctggacaa

SEQ ID NO: 8821 - DNA, 21 bp, Artificial Sequence
  Description of Artificial Sequence: Synthetic oligonucleotide
tccagagaagctcagggtata

SEQ ID NO: 8822 - DNA, 21 bp, Artificial Sequence
  Description of Artificial Sequence: Synthetic oligonucleotide
taccctgagcttctctggaca

SEQ ID NO: 8823 - DNA, 21 bp, Artificial Sequence
  Description of Artificial Sequence: Synthetic oligonucleotide
ccagagaagctcagggtatag

SEQ ID NO: 8824 - DNA, 21 bp, Artificial Sequence
  Description of Artificial Sequence: Synthetic oligonucleotide
ataccctgagcttctctggac

SEQ ID NO: 8825 - DNA, 21 bp, Artificial Sequence
  Description of Artificial Sequence: Synthetic oligonucleotide
cagagaagctcagggtatagc

SEQ ID NO: 8826 - DNA, 21 bp, Artificial Sequence
  Description of Artificial Sequence: Synthetic oligonucleotide
tataccctgagcttctctgga

SEQ ID NO: 8827 - DNA, 21 bp, Artificial Sequence
  Description of Artificial Sequence: Synthetic oligonucleotide
agagaagctcagggtatagct

SEQ ID NO: 8828 - DNA, 21 bp, Artificial Sequence
  Description of Artificial Sequence: Synthetic oligonucleotide
ctataccctgagcttctctgg

SEQ ID NO: 8829 - DNA, 21 bp, Artificial Sequence
  Description of Artificial Sequence: Synthetic oligonucleotide
gagaagctcagggtatagctg

SEQ ID NO: 8830 - DNA, 21 bp, Artificial Sequence
  Description of Artificial Sequence: Synthetic oligonucleotide
gctataccctgagcttctctg

SEQ ID NO: 8831 - DNA, 21 bp, Artificial Sequence
  Description of Artificial Sequence: Synthetic oligonucleotide
agaagctcagggtatagctga

SEQ ID NO: 8832 - DNA, 21 bp, Artificial Sequence
  Description of Artificial Sequence: Synthetic oligonucleotide
agctataccctgagcttctct

SEQ ID NO: 8833 - DNA, 21 bp, Artificial Sequence
  Description of Artificial Sequence: Synthetic oligonucleotide
gaagctcagggtatagctgaa

SEQ ID NO: 8834 - DNA, 21 bp, Artificial Sequence
  Description of Artificial Sequence: Synthetic oligonucleotide
cagctataccctgagcttctc

SEQ ID NO: 8835 - DNA, 21 bp, Artificial Sequence
  Description of Artificial Sequence: Synthetic oligonucleotide
aagctcagggtatagctgaat

SEQ ID NO: 8836 - DNA, 21 bp, Artificial Sequence
  Description of Artificial Sequence: Synthetic oligonucleotide
tcagctataccctgagcttct

SEQ ID NO: 8837 - DNA, 21 bp, Artificial Sequence
  Description of Artificial Sequence: Synthetic oligonucleotide
agctcagggtatagctgaata

SEQ ID NO: 8838 - DNA, 21 bp, Artificial Sequence
  Description of Artificial Sequence: Synthetic oligonucleotide
ttcagctataccctgagcttc

SEQ ID NO: 8839 - DNA, 21 bp, Artificial Sequence
  Description of Artificial Sequence: Synthetic oligonucleotide
gctcagggtatagctgaatag

SEQ ID NO: 8840 - DNA, 21 bp, Artificial Sequence
  Description of Artificial Sequence: Synthetic oligonucleotide
attcagctataccctgagctt

SEQ ID NO: 8841 - DNA, 21 bp, Artificial Sequence
  Description of Artificial Sequence: Synthetic oligonucleotide
ctcagggtatagctgaatagg

SEQ ID NO: 8842 - DNA, 21 bp, Artificial Sequence
  Description of Artificial Sequence: Synthetic oligonucleotide
tattcagctataccctgagct

SEQ ID NO: 8843 - DNA, 21 bp, Artificial Sequence
  Description of Artificial Sequence: Synthetic oligonucleotide
tcagggtatagctgaataggc

SEQ ID NO: 8844 - DNA, 21 bp, Artificial Sequence
  Description of Artificial Sequence: Synthetic oligonucleotide
ctattcagctataccctgagc

SEQ ID NO: 8845 - DNA, 21 bp, Artificial Sequence
  Description of Artificial Sequence: Synthetic oligonucleotide
cagggtatagctgaataggca

SEQ ID NO: 8846 - DNA, 21 bp, Artificial Sequence
  Description of Artificial Sequence: Synthetic oligonucleotide
cctattcagctataccctgag

SEQ ID NO: 8847 - DNA, 21 bp, Artificial Sequence
  Description of Artificial Sequence: Synthetic oligonucleotide
agggtatagctgaataggcag

SEQ ID NO: 8848 - DNA, 21 bp, Artificial Sequence
  Description of Artificial Sequence: Synthetic oligonucleotide
gcctattcagctataccctga

SEQ ID NO: 8849 - DNA, 21 bp, Artificial Sequence
  Description of Artificial Sequence: Synthetic oligonucleotide
gggtatagctgaataggcagt

SEQ ID NO: 8850 - DNA, 21 bp, Artificial Sequence
  Description of Artificial Sequence: Synthetic oligonucleotide
tgcctattcagctataccctg

SEQ ID NO: 8851 - DNA, 21 bp, Artificial Sequence
  Description of Artificial Sequence: Synthetic oligonucleotide
ggtatagctgaataggcagtt

SEQ ID NO: 8852 - DNA, 21 bp, Artificial Sequence
  Description of Artificial Sequence: Synthetic oligonucleotide
ctgcctattcagctataccct

SEQ ID NO: 8853 - DNA, 21 bp, Artificial Sequence
  Description of Artificial Sequence: Synthetic oligonucleotide
gtatagctgaataggcagttt

SEQ ID NO: 8854 - DNA, 21 bp, Artificial Sequence
  Description of Artificial Sequence: Synthetic oligonucleotide
actgcctattcagctataccc

SEQ ID NO: 8855 - DNA, 21 bp, Artificial Sequence
  Description of Artificial Sequence: Synthetic oligonucleotide
tatagctgaataggcagtttc

SEQ ID NO: 8856 - DNA, 21 bp, Artificial Sequence
  Description of Artificial Sequence: Synthetic oligonucleotide
aactgcctattcagctatacc

SEQ ID NO: 8857 - DNA, 21 bp, Artificial Sequence
  Description of Artificial Sequence: Synthetic oligonucleotide
atagctgaataggcagtttct

SEQ ID NO: 8858 - DNA, 21 bp, Artificial Sequence
  Description of Artificial Sequence: Synthetic oligonucleotide
aaactgcctattcagctatac

SEQ ID NO: 8859 - DNA, 21 bp, Artificial Sequence
  Description of Artificial Sequence: Synthetic oligonucleotide
tagctgaataggcagtttctt

SEQ ID NO: 8860 - DNA, 21 bp, Artificial Sequence
  Description of Artificial Sequence: Synthetic oligonucleotide
gaaactgcctattcagctata

SEQ ID NO: 8861 - DNA, 21 bp, Artificial Sequence
  Description of Artificial Sequence: Synthetic oligonucleotide
agctgaataggcagtttcttt

SEQ ID NO: 8862 - DNA, 21 bp, Artificial Sequence
  Description of Artificial Sequence: Synthetic oligonucleotide
agaaactgcctattcagctat

SEQ ID NO: 8863 - DNA, 21 bp, Artificial Sequence
  Description of Artificial Sequence: Synthetic oligonucleotide
gctgaataggcagtttctttt

SEQ ID NO: 8864 - DNA, 21 bp, Artificial Sequence
  Description of Artificial Sequence: Synthetic oligonucleotide
aagaaactgcctattcagcta

SEQ ID NO: 8865 - DNA, 21 bp, Artificial Sequence
  Description of Artificial Sequence: Synthetic oligonucleotide
ctgaataggcagtttcttttg

SEQ ID NO: 8866 - DNA, 21 bp, Artificial Sequence
  Description of Artificial Sequence: Synthetic oligonucleotide
aaagaaactgcctattcagct

SEQ ID NO: 8867 - DNA, 21 bp, Artificial Sequence
  Description of Artificial Sequence: Synthetic oligonucleotide
tgaataggcagtttcttttgt

SEQ ID NO: 8868 - DNA, 21 bp, Artificial Sequence
  Description of Artificial Sequence: Synthetic oligonucleotide
aaaagaaactgcctattcagc

SEQ ID NO: 8869 - DNA, 21 bp, Artificial Sequence
  Description of Artificial Sequence: Synthetic oligonucleotide
gaataggcagtttcttttgtc

SEQ ID NO: 8870 - DNA, 21 bp, Artificial Sequence
  Description of Artificial Sequence: Synthetic oligonucleotide
caaaagaaactgcctattcag

SEQ ID NO: 8871 - DNA, 21 bp, Artificial Sequence
  Description of Artificial Sequence: Synthetic oligonucleotide
aataggcagtttcttttgtcc

SEQ ID NO: 8872 - DNA, 21 bp, Artificial Sequence
  Description of Artificial Sequence: Synthetic oligonucleotide
acaaaagaaactgcctattca

SEQ ID NO: 8873 - DNA, 21 bp, Artificial Sequence
  Description of Artificial Sequence: Synthetic oligonucleotide
ataggcagtttcttttgtcct

SEQ ID NO: 8874 - DNA, 21 bp, Artificial Sequence
  Description of Artificial Sequence: Synthetic oligonucleotide
gacaaaagaaactgcctattc

SEQ ID NO: 8875 - DNA, 21 bp, Artificial Sequence
  Description of Artificial Sequence: Synthetic oligonucleotide
taggcagtttcttttgtcctg

SEQ ID NO: 8876 - DNA, 21 bp, Artificial Sequence
  Description of Artificial Sequence: Synthetic oligonucleotide
ggacaaaagaaactgcctatt

SEQ ID NO: 8877 - DNA, 21 bp, Artificial Sequence
  Description of Artificial Sequence: Synthetic oligonucleotide
aggcagtttcttttgtcctga

SEQ ID NO: 8878 - DNA, 21 bp, Artificial Sequence
  Description of Artificial Sequence: Synthetic oligonucleotide
aggacaaaagaaactgcctat

SEQ ID NO: 8879 - DNA, 21 bp, Artificial Sequence
  Description of Artificial Sequence: Synthetic oligonucleotide
ggcagtttcttttgtcctgag

SEQ ID NO: 8880 - DNA, 21 bp, Artificial Sequence
  Description of Artificial Sequence: Synthetic oligonucleotide
caggacaaaagaaactgccta

SEQ ID NO: 8881 - DNA, 21 bp, Artificial Sequence
  Description of Artificial Sequence: Synthetic oligonucleotide
gcagtttcttttgtcctgagg

SEQ ID NO: 8882 - DNA, 21 bp, Artificial Sequence
  Description of Artificial Sequence: Synthetic oligonucleotide
tcaggacaaaagaaactgcct

SEQ ID NO: 8883 - DNA, 21 bp, Artificial Sequence
  Description of Artificial Sequence: Synthetic oligonucleotide
cagtttcttttgtcctgagga

SEQ ID NO: 8884 - DNA, 21 bp, Artificial Sequence
  Description of Artificial Sequence: Synthetic oligonucleotide
ctcaggacaaaagaaactgcc

SEQ ID NO: 8885 - DNA, 21 bp, Artificial Sequence
  Description of Artificial Sequence: Synthetic oligonucleotide
agtttcttttgtcctgaggaa

SEQ ID NO: 8886 - DNA, 21 bp, Artificial Sequence
  Description of Artificial Sequence: Synthetic oligonucleotide
cctcaggacaaaagaaactgc

SEQ ID NO: 8887 - DNA, 21 bp, Artificial Sequence
  Description of Artificial Sequence: Synthetic oligonucleotide
gtttcttttgtcctgaggaaa

SEQ ID NO: 8888 - DNA, 21 bp, Artificial Sequence
  Description of Artificial Sequence: Synthetic oligonucleotide
tcctcaggacaaaagaaactg

SEQ ID NO: 8889 - DNA, 21 bp, Artificial Sequence
  Description of Artificial Sequence: Synthetic oligonucleotide
tttcttttgtcctgaggaaaa

SEQ ID NO: 8890 - DNA, 21 bp, Artificial Sequence
  Description of Artificial Sequence: Synthetic oligonucleotide
ttcctcaggacaaaagaaact

SEQ ID NO: 8891 - DNA, 21 bp, Artificial Sequence
  Description of Artificial Sequence: Synthetic oligonucleotide
ttcttttgtcctgaggaaaat

SEQ ID NO: 8892 - DNA, 21 bp, Artificial Sequence
  Description of Artificial Sequence: Synthetic oligonucleotide
tttcctcaggacaaaagaaac

SEQ ID NO: 8893 - DNA, 21 bp, Artificial Sequence
  Description of Artificial Sequence: Synthetic oligonucleotide
tcttttgtcctgaggaaaatc

SEQ ID NO: 8894 - DNA, 21 bp, Artificial Sequence
  Description of Artificial Sequence: Synthetic oligonucleotide
ttttcctcaggacaaaagaaa

SEQ ID NO: 8895 - DNA, 21 bp, Artificial Sequence
  Description of Artificial Sequence: Synthetic oligonucleotide
cttttgtcctgaggaaaatca

SEQ ID NO: 8896 - DNA, 21 bp, Artificial Sequence
  Description of Artificial Sequence: Synthetic oligonucleotide
attttcctcaggacaaaagaa

SEQ ID NO: 8897 - DNA, 21 bp, Artificial Sequence
  Description of Artificial Sequence: Synthetic oligonucleotide
ttttgtcctgaggaaaatcag

SEQ ID NO: 8898 - DNA, 21 bp, Artificial Sequence
  Description of Artificial Sequence: Synthetic oligonucleotide
gattttcctcaggacaaaaga

SEQ ID NO: 8899 - DNA, 21 bp, Artificial Sequence
  Description of Artificial Sequence: Synthetic oligonucleotide
tttgtcctgaggaaaatcagg

SEQ ID NO: 8900 - DNA, 21 bp, Artificial Sequence
  Description of Artificial Sequence: Synthetic oligonucleotide
tgattttcctcaggacaaaag

SEQ ID NO: 8901 - DNA, 21 bp, Artificial Sequence
  Description of Artificial Sequence: Synthetic oligonucleotide
ttgtcctgaggaaaatcagga

SEQ ID NO: 8902 - DNA, 21 bp, Artificial Sequence
  Description of Artificial Sequence: Synthetic oligonucleotide
ctgattttcctcaggacaaaa

SEQ ID NO: 8903 - DNA, 21 bp, Artificial Sequence
  Description of Artificial Sequence: Synthetic oligonucleotide
tgtcctgaggaaaatcaggac

SEQ ID NO: 8904 - DNA, 21 bp, Artificial Sequence
  Description of Artificial Sequence: Synthetic oligonucleotide
cctgattttcctcaggacaaa

SEQ ID NO: 8905 - DNA, 21 bp, Artificial Sequence
  Description of Artificial Sequence: Synthetic oligonucleotide
gtcctgaggaaaatcaggaca

SEQ ID NO: 8906 - DNA, 21 bp, Artificial Sequence
  Description of Artificial Sequence: Synthetic oligonucleotide
tcctgattttcctcaggacaa

SEQ ID NO: 8907 - DNA, 21 bp, Artificial Sequence
  Description of Artificial Sequence: Synthetic oligonucleotide
tcctgaggaaaatcaggacat

SEQ ID NO: 8908 - DNA, 21 bp, Artificial Sequence
  Description of Artificial Sequence: Synthetic oligonucleotide
gtcctgattttcctcaggaca

SEQ ID NO: 8909 - DNA, 21 bp, Artificial Sequence
  Description of Artificial Sequence: Synthetic oligonucleotide
cctgaggaaaatcaggacatg

SEQ ID NO: 8910 - DNA, 21 bp, Artificial Sequence
  Description of Artificial Sequence: Synthetic oligonucleotide
tgtcctgattttcctcaggac

SEQ ID NO: 8911 - DNA, 21 bp, Artificial Sequence
  Description of Artificial Sequence: Synthetic oligonucleotide
ctgaggaaaatcaggacatgc

SEQ ID NO: 8912 - DNA, 21 bp, Artificial Sequence
  Description of Artificial Sequence: Synthetic oligonucleotide
atgtcctgattttcctcagga

SEQ ID NO: 8913 - DNA, 21 bp, Artificial Sequence
  Description of Artificial Sequence: Synthetic oligonucleotide
tgaggaaaatcaggacatgcc

SEQ ID NO: 8914 - DNA, 21 bp, Artificial Sequence
  Description of Artificial Sequence: Synthetic oligonucleotide
catgtcctgattttcctcagg

SEQ ID NO: 8915 - DNA, 21 bp, Artificial Sequence
  Description of Artificial Sequence: Synthetic oligonucleotide
gaggaaaatcaggacatgcct

SEQ ID NO: 8916 - DNA, 21 bp, Artificial Sequence
  Description of Artificial Sequence: Synthetic oligonucleotide
gcatgtcctgattttcctcag

SEQ ID NO: 8917 - DNA, 21 bp, Artificial Sequence
  Description of Artificial Sequence: Synthetic oligonucleotide
aggaaaatcaggacatgcctg

SEQ ID NO: 8918 - DNA, 21 bp, Artificial Sequence
  Description of Artificial Sequence: Synthetic oligonucleotide
ggcatgtcctgattttcctca

SEQ ID NO: 8919 - DNA, 21 bp, Artificial Sequence
  Description of Artificial Sequence: Synthetic oligonucleotide
ggaaaatcaggacatgcctgc

SEQ ID NO: 8920 - DNA, 21 bp, Artificial Sequence
  Description of Artificial Sequence: Synthetic oligonucleotide
aggcatgtcctgattttcctc

SEQ ID NO: 8921 - DNA, 21 bp, Artificial Sequence
  Description of Artificial Sequence: Synthetic oligonucleotide
gaaaatcaggacatgcctgct

SEQ ID NO: 8922 - DNA, 21 bp, Artificial Sequence
  Description of Artificial Sequence: Synthetic oligonucleotide
caggcatgtcctgattttcct

SEQ ID NO: 8923 - DNA, 21 bp, Artificial Sequence
  Description of Artificial Sequence: Synthetic oligonucleotide
aaaatcaggacatgcctgctt

SEQ ID NO: 8924 - DNA, 21 bp, Artificial Sequence
  Description of Artificial Sequence: Synthetic oligonucleotide
gcaggcatgtcctgattttcc

SEQ ID NO: 8925 - DNA, 21 bp, Artificial Sequence
  Description of Artificial Sequence: Synthetic oligonucleotide
aaatcaggacatgcctgcttt

SEQ ID NO: 8926 - DNA, 21 bp, Artificial Sequence
  Description of Artificial Sequence: Synthetic oligonucleotide
agcaggcatgtcctgattttc

SEQ ID NO: 8927 - DNA, 21 bp, Artificial Sequence
  Description of Artificial Sequence: Synthetic oligonucleotide
aatcaggacatgcctgctttc

SEQ ID NO: 8928 - DNA, 21 bp, Artificial Sequence
  Description of Artificial Sequence: Synthetic oligonucleotide
aagcaggcatgtcctgatttt

SEQ ID NO: 8929 - DNA, 21 bp, Artificial Sequence
  Description of Artificial Sequence: Synthetic oligonucleotide
atcaggacatgcctgctttct

SEQ ID NO: 8930 - DNA, 21 bp, Artificial Sequence
  Description of Artificial Sequence: Synthetic oligonucleotide
aaagcaggcatgtcctgattt

SEQ ID NO: 8931 - DNA, 21 bp, Artificial Sequence
  Description of Artificial Sequence: Synthetic oligonucleotide
tcaggacatgcctgctttcta

SEQ ID NO: 8932 - DNA, 21 bp, Artificial Sequence
  Description of Artificial Sequence: Synthetic oligonucleotide
gaaagcaggcatgtcctgatt

SEQ ID NO: 8933 - DNA, 21 bp, Artificial Sequence
  Description of Artificial Sequence: Synthetic oligonucleotide
caggacatgcctgctttctaa

SEQ ID NO: 8934 - DNA, 21 bp, Artificial Sequence
  Description of Artificial Sequence: Synthetic oligonucleotide
agaaagcaggcatgtcctgat

SEQ ID NO: 8935 - DNA, 21 bp, Artificial Sequence
  Description of Artificial Sequence: Synthetic oligonucleotide
aggacatgcctgctttctaaa

SEQ ID NO: 8936 - DNA, 21 bp, Artificial Sequence
  Description of Artificial Sequence: Synthetic oligonucleotide
tagaaagcaggcatgtcctga

SEQ ID NO: 8937 - DNA, 21 bp, Artificial Sequence
  Description of Artificial Sequence: Synthetic oligonucleotide
ggacatgcctgctttctaaaa

SEQ ID NO: 8938 - DNA, 21 bp, Artificial Sequence
  Description of Artificial Sequence: Synthetic oligonucleotide
ttagaaagcaggcatgtcctg

SEQ ID NO: 8939 - DNA, 21 bp, Artificial Sequence
  Description of Artificial Sequence: Synthetic oligonucleotide
gacatgcctgctttctaaaaa

SEQ ID NO: 8940 - DNA, 21 bp, Artificial Sequence
  Description of Artificial Sequence: Synthetic oligonucleotide
tttagaaagcaggcatgtcct

SEQ ID NO: 8941 - DNA, 21 bp, Artificial Sequence
  Description of Artificial Sequence: Synthetic oligonucleotide
acatgcctgctttctaaaaat

SEQ ID NO: 8942 - DNA, 21 bp, Artificial Sequence
  Description of Artificial Sequence: Synthetic oligonucleotide
ttttagaaagcaggcatgtcc

SEQ ID NO: 8943 - DNA, 21 bp, Artificial Sequence
  Description of Artificial Sequence: Synthetic oligonucleotide
catgcctgctttctaaaaatc

SEQ ID NO: 8944 - DNA, 21 bp, Artificial Sequence
  Description of Artificial Sequence: Synthetic oligonucleotide
tttttagaaagcaggcatgtc

SEQ ID NO: 8945 - DNA, 21 bp, Artificial Sequence
  Description of Artificial Sequence: Synthetic oligonucleotide
atgcctgctttctaaaaatct

SEQ ID NO: 8946 - DNA, 21 bp, Artificial Sequence
  Description of Artificial Sequence: Synthetic oligonucleotide
atttttagaaagcaggcatgt

SEQ ID NO: 8947 - DNA, 21 bp, Artificial Sequence
  Description of Artificial Sequence: Synthetic oligonucleotide
tgcctgctttctaaaaatctt

SEQ ID NO: 8948 - DNA, 21 bp, Artificial Sequence
  Description of Artificial Sequence: Synthetic oligonucleotide
gatttttagaaagcaggcatg

SEQ ID NO: 8949 - DNA, 21 bp, Artificial Sequence
  Description of Artificial Sequence: Synthetic oligonucleotide
gcctgctttctaaaaatcttc

SEQ ID NO: 8950 - DNA, 21 bp, Artificial Sequence
  Description of Artificial Sequence: Synthetic oligonucleotide
agatttttagaaagcaggcat

SEQ ID NO: 8951 - DNA, 21 bp, Artificial Sequence
  Description of Artificial Sequence: Synthetic oligonucleotide
cctgctttctaaaaatcttcc

SEQ ID NO: 8952 - DNA, 21 bp, Artificial Sequence
  Description of Artificial Sequence: Synthetic oligonucleotide
aagatttttagaaagcaggca

SEQ ID NO: 8953 - DNA, 21 bp, Artificial Sequence
  Description of Artificial Sequence: Synthetic oligonucleotide
ctgctttctaaaaatcttcct

SEQ ID NO: 8954 - DNA, 21 bp, Artificial Sequence
  Description of Artificial Sequence: Synthetic oligonucleotide
gaagatttttagaaagcaggc

SEQ ID NO: 8955 - DNA, 21 bp, Artificial Sequence
  Description of Artificial Sequence: Synthetic oligonucleotide
tgctttctaaaaatcttcctc

SEQ ID NO: 8956 - DNA, 21 bp, Artificial Sequence
  Description of Artificial Sequence: Synthetic oligonucleotide
ggaagatttttagaaagcagg

SEQ ID NO: 8957 - DNA, 21 bp, Artificial Sequence
  Description of Artificial Sequence: Synthetic oligonucleotide
gctttctaaaaatcttcctct

SEQ ID NO: 8958 - DNA, 21 bp, Artificial Sequence
  Description of Artificial Sequence: Synthetic oligonucleotide
aggaagatttttagaaagcag

SEQ ID NO: 8959 - DNA, 21 bp, Artificial Sequence
  Description of Artificial Sequence: Synthetic oligonucleotide
ctttctaaaaatcttcctctg

SEQ ID NO: 8960 - DNA, 21 bp, Artificial Sequence
  Description of Artificial Sequence: Synthetic oligonucleotide
gaggaagatttttagaaagca

SEQ ID NO: 8961 - DNA, 21 bp, Artificial Sequence
  Description of Artificial Sequence: Synthetic oligonucleotide
tttctaaaaatcttcctctga

SEQ ID NO: 8962 - DNA, 21 bp, Artificial Sequence
  Description of Artificial Sequence: Synthetic oligonucleotide
agaggaagatttttagaaagc

SEQ ID NO: 8963 - DNA, 21 bp, Artificial Sequence
  Description of Artificial Sequence: Synthetic oligonucleotide
ttctaaaaatcttcctctgaa

SEQ ID NO: 8964 - DNA, 21 bp, Artificial Sequence
  Description of Artificial Sequence: Synthetic oligonucleotide
cagaggaagatttttagaaag

SEQ ID NO: 8965 - DNA, 21 bp, Artificial Sequence
  Description of Artificial Sequence: Synthetic oligonucleotide
tctaaaaatcttcctctgaag

SEQ ID NO: 8966 - DNA, 21 bp, Artificial Sequence
  Description of Artificial Sequence: Synthetic oligonucleotide
tcagaggaagatttttagaaa

SEQ ID NO: 8967 - DNA, 21 bp, Artificial Sequence
  Description of Artificial Sequence: Synthetic oligonucleotide
ctaaaaatcttcctctgaaga

SEQ ID NO: 8968 - DNA, 21 bp, Artificial Sequence
  Description of Artificial Sequence: Synthetic oligonucleotide
ttcagaggaagatttttagaa

SEQ ID NO: 8969 - DNA, 21 bp, Artificial Sequence
  Description of Artificial Sequence: Synthetic oligonucleotide
taaaaatcttcctctgaagac

SEQ ID NO: 8970 - DNA, 21 bp, Artificial Sequence
  Description of Artificial Sequence: Synthetic oligonucleotide
cttcagaggaagatttttaga

SEQ ID NO: 8971 - DNA, 21 bp, Artificial Sequence
  Description of Artificial Sequence: Synthetic oligonucleotide
aaaaatcttcctctgaagacc

SEQ ID NO: 8972 - DNA, 21 bp, Artificial Sequence
  Description of Artificial Sequence: Synthetic oligonucleotide
tcttcagaggaagatttttag

SEQ ID NO: 8973 - DNA, 21 bp, Artificial Sequence
  Description of Artificial Sequence: Synthetic oligonucleotide
aaaatcttcctctgaagacct

SEQ ID NO: 8974 - DNA, 21 bp, Artificial Sequence
  Description of Artificial Sequence: Synthetic oligonucleotide
gtcttcagaggaagattttta

SEQ ID NO: 8975 - DNA, 21 bp, Artificial Sequence
  Description of Artificial Sequence: Synthetic oligonucleotide
aaatcttcctctgaagacctg

SEQ ID NO: 8976 - DNA, 21 bp, Artificial Sequence
  Description of Artificial Sequence: Synthetic oligonucleotide
ggtcttcagaggaagattttt

SEQ ID NO: 8977 - DNA, 21 bp, Artificial Sequence
  Description of Artificial Sequence: Synthetic oligonucleotide
aatcttcctctgaagacctga

SEQ ID NO: 8978 - DNA, 21 bp, Artificial Sequence
  Description of Artificial Sequence: Synthetic oligonucleotide
aggtcttcagaggaagatttt

SEQ ID NO: 8979 - DNA, 21 bp, Artificial Sequence
  Description of Artificial Sequence: Synthetic oligonucleotide
atcttcctctgaagacctgac

SEQ ID NO: 8980 - DNA, 21 bp, Artificial Sequence
  Description of Artificial Sequence: Synthetic oligonucleotide
caggtcttcagaggaagattt

SEQ ID NO: 8981 - DNA, 21 bp, Artificial Sequence
  Description of Artificial Sequence: Synthetic oligonucleotide
tcttcctctgaagacctgacc

SEQ ID NO: 8982 - DNA, 21 bp, Artificial Sequence
  Description of Artificial Sequence: Synthetic oligonucleotide
tcaggtcttcagaggaagatt

SEQ ID NO: 8983 - DNA, 21 bp, Artificial Sequence
  Description of Artificial Sequence: Synthetic oligonucleotide
cttcctctgaagacctgaccc

SEQ ID NO: 8984 - DNA, 21 bp, Artificial Sequence
  Description of Artificial Sequence: Synthetic oligonucleotide
gtcaggtcttcagaggaagat

SEQ ID NO: 8985 - DNA, 21 bp, Artificial Sequence
  Description of Artificial Sequence: Synthetic oligonucleotide
ttcctctgaagacctgaccca

SEQ ID NO: 8986 - DNA, 21 bp, Artificial Sequence
  Description of Artificial Sequence: Synthetic oligonucleotide
ggtcaggtcttcagaggaaga

SEQ ID NO: 8987 - DNA, 21 bp, Artificial Sequence
  Description of Artificial Sequence: Synthetic oligonucleotide
tcctctgaagacctgacccaa

SEQ ID NO: 8988 - DNA, 21 bp, Artificial Sequence
  Description of Artificial Sequence: Synthetic oligonucleotide
gggtcaggtcttcagaggaag

SEQ ID NO: 8989 - DNA, 21 bp, Artificial Sequence
  Description of Artificial Sequence: Synthetic oligonucleotide
cctctgaagacctgacccaag

SEQ ID NO: 8990 - DNA, 21 bp, Artificial Sequence
  Description of Artificial Sequence: Synthetic oligonucleotide
tgggtcaggtcttcagaggaa

SEQ ID NO: 8991 - DNA, 21 bp, Artificial Sequence
  Description of Artificial Sequence: Synthetic oligonucleotide
ctctgaagacctgacccaagc

SEQ ID NO: 8992 - DNA, 21 bp, Artificial Sequence
  Description of Artificial Sequence: Synthetic oligonucleotide
ttgggtcaggtcttcagagga

SEQ ID NO: 8993 - DNA, 21 bp, Artificial Sequence
  Description of Artificial Sequence: Synthetic oligonucleotide
tctgaagacctgacccaagct

SEQ ID NO: 8994 - DNA, 21 bp, Artificial Sequence
  Description of Artificial Sequence: Synthetic oligonucleotide
cttgggtcaggtcttcagagg

SEQ ID NO: 8995 - DNA, 21 bp, Artificial Sequence
  Description of Artificial Sequence: Synthetic oligonucleotide
ctgaagacctgacccaagctc

SEQ ID NO: 8996 - DNA, 21 bp, Artificial Sequence
  Description of Artificial Sequence: Synthetic oligonucleotide
gcttgggtcaggtcttcagag

SEQ ID NO: 8997 - DNA, 21 bp, Artificial Sequence
  Description of Artificial Sequence: Synthetic oligonucleotide
tgaagacctgacccaagctct

SEQ ID NO: 8998 - DNA, 21 bp, Artificial Sequence
  Description of Artificial Sequence: Synthetic oligonucleotide
agcttgggtcaggtcttcaga

SEQ ID NO: 8999 - DNA, 21 bp, Artificial Sequence
  Description of Artificial Sequence: Synthetic oligonucleotide
gaagacctgacccaagctctt

SEQ ID NO: 9000 - DNA, 21 bp, Artificial Sequence
  Description of Artificial Sequence: Synthetic oligonucleotide
gagcttgggtcaggtcttcag

SEQ ID NO: 9001 - DNA, 21 bp, Artificial Sequence
  Description of Artificial Sequence: Synthetic oligonucleotide
aagacctgacccaagctctta

SEQ ID NO: 9002 - DNA, 21 bp, Artificial Sequence
  Description of Artificial Sequence: Synthetic oligonucleotide
agagcttgggtcaggtcttca

SEQ ID NO: 9003 - DNA, 21 bp, Artificial Sequence
  Description of Artificial Sequence: Synthetic oligonucleotide
agacctgacccaagctcttaa

SEQ ID NO: 9004 - DNA, 21 bp, Artificial Sequence
  Description of Artificial Sequence: Synthetic oligonucleotide
aagagcttgggtcaggtcttc

SEQ ID NO: 9005 - DNA, 21 bp, Artificial Sequence
  Description of Artificial Sequence: Synthetic oligonucleotide
gacctgacccaagctcttaaa

SEQ ID NO: 9006 - DNA, 21 bp, Artificial Sequence
  Description of Artificial Sequence: Synthetic oligonucleotide
taagagcttgggtcaggtctt

SEQ ID NO: 9007 - DNA, 21 bp, Artificial Sequence
  Description of Artificial Sequence: Synthetic oligonucleotide
acctgacccaagctcttaaat

SEQ ID NO: 9008 - DNA, 21 bp, Artificial Sequence
  Description of Artificial Sequence: Synthetic oligonucleotide
ttaagagcttgggtcaggtct

SEQ ID NO: 9009 - DNA, 21 bp, Artificial Sequence
  Description of Artificial Sequence: Synthetic oligonucleotide
cctgacccaagctcttaaatg

SEQ ID NO: 9010 - DNA, 21 bp, Artificial Sequence
  Description of Artificial Sequence: Synthetic oligonucleotide
tttaagagcttgggtcaggtc

SEQ ID NO: 9011 - DNA, 21 bp, Artificial Sequence
  Description of Artificial Sequence: Synthetic oligonucleotide
ctgacccaagctcttaaatgc

SEQ ID NO: 9012 - DNA, 21 bp, Artificial Sequence
  Description of Artificial Sequence: Synthetic oligonucleotide
atttaagagcttgggtcaggt

SEQ ID NO: 9013 - DNA, 21 bp, Artificial Sequence
  Description of Artificial Sequence: Synthetic oligonucleotide
tgacccaagctcttaaatgct

SEQ ID NO: 9014 - DNA, 21 bp, Artificial Sequence
  Description of Artificial Sequence: Synthetic oligonucleotide
catttaagagcttgggtcagg

SEQ ID NO: 9015 - DNA, 21 bp, Artificial Sequence
  Description of Artificial Sequence: Synthetic oligonucleotide
gacccaagctcttaaatgcta

SEQ ID NO: 9016 - DNA, 21 bp, Artificial Sequence
  Description of Artificial Sequence: Synthetic oligonucleotide
gcatttaagagcttgggtcag

SEQ ID NO: 9017 - DNA, 21 bp, Artificial Sequence
  Description of Artificial Sequence: Synthetic oligonucleotide
acccaagctcttaaatgctat

SEQ ID NO: 9018 - DNA, 21 bp, Artificial Sequence
  Description of Artificial Sequence: Synthetic oligonucleotide
agcatttaagagcttgggtca

SEQ ID NO: 9019 - DNA, 21 bp, Artificial Sequence
  Description of Artificial Sequence: Synthetic oligonucleotide
cccaagctcttaaatgctatt

SEQ ID NO: 9020 - DNA, 21 bp, Artificial Sequence
  Description of Artificial Sequence: Synthetic oligonucleotide
tagcatttaagagcttgggtc

SEQ ID NO: 9021 - DNA, 21 bp, Artificial Sequence
  Description of Artificial Sequence: Synthetic oligonucleotide
ccaagctcttaaatgctattg

SEQ ID NO: 9022 - DNA, 21 bp, Artificial Sequence
  Description of Artificial Sequence: Synthetic oligonucleotide
atagcatttaagagcttgggt

SEQ ID NO: 9023 - DNA, 21 bp, Artificial Sequence
  Description of Artificial Sequence: Synthetic oligonucleotide
caagctcttaaatgctattgt

SEQ ID NO: 9024 - DNA, 21 bp, Artificial Sequence
  Description of Artificial Sequence: Synthetic oligonucleotide
aatagcatttaagagcttggg

SEQ ID NO: 9025 - DNA, 21 bp, Artificial Sequence
  Description of Artificial Sequence: Synthetic oligonucleotide
aagctcttaaatgctattgta

SEQ ID NO: 9026 - DNA, 21 bp, Artificial Sequence
  Description of Artificial Sequence: Synthetic oligonucleotide
caatagcatttaagagcttgg

SEQ ID NO: 9027 - DNA, 21 bp, Artificial Sequence
  Description of Artificial Sequence: Synthetic oligonucleotide
agctcttaaatgctattgtaa

SEQ ID NO: 9028 - DNA, 21 bp, Artificial Sequence
  Description of Artificial Sequence: Synthetic oligonucleotide
acaatagcatttaagagcttg

SEQ ID NO: 9029 - DNA, 21 bp, Artificial Sequence
  Description of Artificial Sequence: Synthetic oligonucleotide
gctcttaaatgctattgtaag

SEQ ID NO: 9030 - DNA, 21 bp, Artificial Sequence
  Description of Artificial Sequence: Synthetic oligonucleotide
tacaatagcatttaagagctt

SEQ ID NO: 9031 - DNA, 21 bp, Artificial Sequence
  Description of Artificial Sequence: Synthetic oligonucleotide
ctcttaaatgctattgtaaga

SEQ ID NO: 9032 - DNA, 21 bp, Artificial Sequence
  Description of Artificial Sequence: Synthetic oligonucleotide
ttacaatagcatttaagagct

SEQ ID NO: 9033 - DNA, 21 bp, Artificial Sequence
  Description of Artificial Sequence: Synthetic oligonucleotide
tcttaaatgctattgtaagag

SEQ ID NO: 9034 - DNA, 21 bp, Artificial Sequence
  Description of Artificial Sequence: Synthetic oligonucleotide
cttacaatagcatttaagagc

SEQ ID NO: 9035 - DNA, 21 bp, Artificial Sequence
  Description of Artificial Sequence: Synthetic oligonucleotide
cttaaatgctattgtaagaga

SEQ ID NO: 9036 - DNA, 21 bp, Artificial Sequence
  Description of Artificial Sequence: Synthetic oligonucleotide
tcttacaatagcatttaagag

SEQ ID NO: 9037 - DNA, 21 bp, Artificial Sequence
  Description of Artificial Sequence: Synthetic oligonucleotide
ttaaatgctattgtaagagaa

SEQ ID NO: 9038 - DNA, 21 bp, Artificial Sequence
  Description of Artificial Sequence: Synthetic oligonucleotide
ctcttacaatagcatttaaga

SEQ ID NO: 9039 - DNA, 21 bp, Artificial Sequence
  Description of Artificial Sequence: Synthetic oligonucleotide
taaatgctattgtaagagaaa

SEQ ID NO: 9040 - DNA, 21 bp, Artificial Sequence
  Description of Artificial Sequence: Synthetic oligonucleotide
tctcttacaatagcatttaag

SEQ ID NO: 9041 - DNA, 21 bp, Artificial Sequence
  Description of Artificial Sequence: Synthetic oligonucleotide
aaatgctattgtaagagaaat

SEQ ID NO: 9042 - DNA, 21 bp, Artificial Sequence
  Description of Artificial Sequence: Synthetic oligonucleotide
ttctcttacaatagcatttaa

SEQ ID NO: 9043 - DNA, 21 bp, Artificial Sequence
  Description of Artificial Sequence: Synthetic oligonucleotide
aatgctattgtaagagaaatt

SEQ ID NO: 9044 - DNA, 21 bp, Artificial Sequence
  Description of Artificial Sequence: Synthetic oligonucleotide
tttctcttacaatagcattta

SEQ ID NO: 9045 - DNA, 21 bp, Artificial Sequence
  Description of Artificial Sequence: Synthetic oligonucleotide
atgctattgtaagagaaattt

SEQ ID NO: 9046 - DNA, 21 bp, Artificial Sequence
  Description of Artificial Sequence: Synthetic oligonucleotide
atttctcttacaatagcattt

SEQ ID NO: 9047 - DNA, 21 bp, Artificial Sequence
  Description of Artificial Sequence: Synthetic oligonucleotide
tgctattgtaagagaaatttc

SEQ ID NO: 9048 - DNA, 21 bp, Artificial Sequence
  Description of Artificial Sequence: Synthetic oligonucleotide
aatttctcttacaatagcatt

SEQ ID NO: 9049 - DNA, 21 bp, Artificial Sequence
  Description of Artificial Sequence: Synthetic oligonucleotide
gctattgtaagagaaatttct

SEQ ID NO: 9050 - DNA, 21 bp, Artificial Sequence
  Description of Artificial Sequence: Synthetic oligonucleotide
aaatttctcttacaatagcat

SEQ ID NO: 9051 - DNA, 21 bp, Artificial Sequence
  Description of Artificial Sequence: Synthetic oligonucleotide
ctattgtaagagaaatttctt

SEQ ID NO: 9052 - DNA, 21 bp, Artificial Sequence
  Description of Artificial Sequence: Synthetic oligonucleotide
gaaatttctcttacaatagca

SEQ ID NO: 9053 - DNA, 21 bp, Artificial Sequence
  Description of Artificial Sequence: Synthetic oligonucleotide
tattgtaagagaaatttcttt

SEQ ID NO: 9054 - DNA, 21 bp, Artificial Sequence
  Description of Artificial Sequence: Synthetic oligonucleotide
agaaatttctcttacaatagc

SEQ ID NO: 9055 - DNA, 21 bp, Artificial Sequence
  Description of Artificial Sequence: Synthetic oligonucleotide
attgtaagagaaatttctttg

SEQ ID NO: 9056 - DNA, 21 bp, Artificial Sequence
  Description of Artificial Sequence: Synthetic oligonucleotide
aagaaatttctcttacaatag

SEQ ID NO: 9057 - DNA, 21 bp, Artificial Sequence
  Description of Artificial Sequence: Synthetic oligonucleotide
ttgtaagagaaatttctttgt

SEQ ID NO: 9058 - DNA, 21 bp, Artificial Sequence
  Description of Artificial Sequence: Synthetic oligonucleotide
aaagaaatttctcttacaata

SEQ ID NO: 9059 - DNA, 21 bp, Artificial Sequence
  Description of Artificial Sequence: Synthetic oligonucleotide
tgtaagagaaatttctttgtc

SEQ ID NO: 9060 - DNA, 21 bp, Artificial Sequence
  Description of Artificial Sequence: Synthetic oligonucleotide
caaagaaatttctcttacaat

SEQ ID NO: 9061 - DNA, 21 bp, Artificial Sequence
  Description of Artificial Sequence: Synthetic oligonucleotide
gtaagagaaatttctttgtct

SEQ ID NO: 9062 - DNA, 21 bp, Artificial Sequence
  Description of Artificial Sequence: Synthetic oligonucleotide
acaaagaaatttctcttacaa

SEQ ID NO: 9063 - DNA, 21 bp, Artificial Sequence
  Description of Artificial Sequence: Synthetic oligonucleotide
taagagaaatttctttgtcta

SEQ ID NO: 9064 - DNA, 21 bp, Artificial Sequence
  Description of Artificial Sequence: Synthetic oligonucleotide
gacaaagaaatttctcttaca

SEQ ID NO: 9065 - DNA, 21 bp, Artificial Sequence
  Description of Artificial Sequence: Synthetic oligonucleotide
aagagaaatttctttgtctat

SEQ ID NO: 9066 - DNA, 21 bp, Artificial Sequence
  Description of Artificial Sequence: Synthetic oligonucleotide
agacaaagaaatttctcttac

SEQ ID NO: 9067 - DNA, 21 bp, Artificial Sequence
  Description of Artificial Sequence: Synthetic oligonucleotide
agagaaatttctttgtctatt

SEQ ID NO: 9068 - DNA, 21 bp, Artificial Sequence
  Description of Artificial Sequence: Synthetic oligonucleotide
tagacaaagaaatttctctta

SEQ ID NO: 9069 - DNA, 21 bp, Artificial Sequence
  Description of Artificial Sequence: Synthetic oligonucleotide
gagaaatttctttgtctatta

SEQ ID NO: 9070 - DNA, 21 bp, Artificial Sequence
  Description of Artificial Sequence: Synthetic oligonucleotide
atagacaaagaaatttctctt

SEQ ID NO: 9071 - DNA, 21 bp, Artificial Sequence
  Description of Artificial Sequence: Synthetic oligonucleotide
agaaatttctttgtctattaa

SEQ ID NO: 9072 - DNA, 21 bp, Artificial Sequence
  Description of Artificial Sequence: Synthetic oligonucleotide
aatagacaaagaaatttctct

SEQ ID NO: 9073 - DNA, 21 bp, Artificial Sequence
  Description of Artificial Sequence: Synthetic oligonucleotide
gaaatttctttgtctattaac

SEQ ID NO: 9074 - DNA, 21 bp, Artificial Sequence
  Description of Artificial Sequence: Synthetic oligonucleotide
taatagacaaagaaatttctc

SEQ ID NO: 9075 - DNA, 21 bp, Artificial Sequence
  Description of Artificial Sequence: Synthetic oligonucleotide
aaatttctttgtctattaact

SEQ ID NO: 9076 - DNA, 21 bp, Artificial Sequence
  Description of Artificial Sequence: Synthetic oligonucleotide
ttaatagacaaagaaatttct

SEQ ID NO: 9077 - DNA, 21 bp, Artificial Sequence
  Description of Artificial Sequence: Synthetic oligonucleotide
aatttctttgtctattaactc

SEQ ID NO: 9078 - DNA, 21 bp, Artificial Sequence
  Description of Artificial Sequence: Synthetic oligonucleotide
gttaatagacaaagaaatttc

SEQ ID NO: 9079 - DNA, 21 bp, Artificial Sequence
  Description of Artificial Sequence: Synthetic oligonucleotide
atttctttgtctattaactcc

SEQ ID NO: 9080 - DNA, 21 bp, Artificial Sequence
  Description of Artificial Sequence: Synthetic oligonucleotide
agttaatagacaaagaaattt

SEQ ID NO: 9081 - DNA, 21 bp, Artificial Sequence
  Description of Artificial Sequence: Synthetic oligonucleotide
tttctttgtctattaactcca

SEQ ID NO: 9082 - DNA, 21 bp, Artificial Sequence
  Description of Artificial Sequence: Synthetic oligonucleotide
gagttaatagacaaagaaatt

SEQ ID NO: 9083 - DNA, 21 bp, Artificial Sequence
  Description of Artificial Sequence: Synthetic oligonucleotide
ttctttgtctattaactccat

SEQ ID NO: 9084 - DNA, 21 bp, Artificial Sequence
  Description of Artificial Sequence: Synthetic oligonucleotide
ggagttaatagacaaagaaat

SEQ ID NO: 9085 - DNA, 21 bp, Artificial Sequence
  Description of Artificial Sequence: Synthetic oligonucleotide
tctttgtctattaactccatt

SEQ ID NO: 9086 - DNA, 21 bp, Artificial Sequence
  Description of Artificial Sequence: Synthetic oligonucleotide
tggagttaatagacaaagaaa

SEQ ID NO: 9087 - DNA, 21 bp, Artificial Sequence
  Description of Artificial Sequence: Synthetic oligonucleotide
ctttgtctattaactccattt

SEQ ID NO: 9088 - DNA, 21 bp, Artificial Sequence
  Description of Artificial Sequence: Synthetic oligonucleotide
atggagttaatagacaaagaa

SEQ ID NO: 9089 - DNA, 21 bp, Artificial Sequence
  Description of Artificial Sequence: Synthetic oligonucleotide
tttgtctattaactccatttt

SEQ ID NO: 9090 - DNA, 21 bp, Artificial Sequence
  Description of Artificial Sequence: Synthetic oligonucleotide
aatggagttaatagacaaaga

SEQ ID NO: 9091 - DNA, 21 bp, Artificial Sequence
  Description of Artificial Sequence: Synthetic oligonucleotide
ttgtctattaactccatttta

SEQ ID NO: 9092 - DNA, 21 bp, Artificial Sequence
  Description of Artificial Sequence: Synthetic oligonucleotide
aaatggagttaatagacaaag

SEQ ID NO: 9093 - DNA, 21 bp, Artificial Sequence
  Description of Artificial Sequence: Synthetic oligonucleotide
tgtctattaactccattttag

SEQ ID NO: 9094 - DNA, 21 bp, Artificial Sequence
  Description of Artificial Sequence: Synthetic oligonucleotide
aaaatggagttaatagacaaa

SEQ ID NO: 9095 - DNA, 21 bp, Artificial Sequence
  Description of Artificial Sequence: Synthetic oligonucleotide
gtctattaactccattttagt

SEQ ID NO: 9096 - DNA, 21 bp, Artificial Sequence
  Description of Artificial Sequence: Synthetic oligonucleotide
taaaatggagttaatagacaa

SEQ ID NO: 9097 - DNA, 21 bp, Artificial Sequence
  Description of Artificial Sequence: Synthetic oligonucleotide
tctattaactccattttagta

SEQ ID NO: 9098 - DNA, 21 bp, Artificial Sequence
  Description of Artificial Sequence: Synthetic oligonucleotide
ctaaaatggagttaatagaca

SEQ ID NO: 9099 - DNA, 21 bp, Artificial Sequence
  Description of Artificial Sequence: Synthetic oligonucleotide
ctattaactccattttagtag

SEQ ID NO: 9100 - DNA, 21 bp, Artificial Sequence
  Description of Artificial Sequence: Synthetic oligonucleotide
actaaaatggagttaatagac

SEQ ID NO: 9101 - DNA, 21 bp, Artificial Sequence
  Description of Artificial Sequence: Synthetic oligonucleotide
tattaactccattttagtagg

SEQ ID NO: 9102 - DNA, 21 bp, Artificial Sequence
  Description of Artificial Sequence: Synthetic oligonucleotide
tactaaaatggagttaataga

SEQ ID NO: 9103 - DNA, 21 bp, Artificial Sequence
  Description of Artificial Sequence: Synthetic oligonucleotide
attaactccattttagtaggg

SEQ ID NO: 9104 - DNA, 21 bp, Artificial Sequence
  Description of Artificial Sequence: Synthetic oligonucleotide
ctactaaaatggagttaatag

SEQ ID NO: 9105 - DNA, 21 bp, Artificial Sequence
  Description of Artificial Sequence: Synthetic oligonucleotide
ttaactccattttagtaggga

SEQ ID NO: 9106 - DNA, 21 bp, Artificial Sequence
  Description of Artificial Sequence: Synthetic oligonucleotide
cctactaaaatggagttaata

SEQ ID NO: 9107 - DNA, 21 bp, Artificial Sequence
  Description of Artificial Sequence: Synthetic oligonucleotide
taactccattttagtagggat

SEQ ID NO: 9108 - DNA, 21 bp, Artificial Sequence
  Description of Artificial Sequence: Synthetic oligonucleotide
ccctactaaaatggagttaat

SEQ ID NO: 9109 - DNA, 21 bp, Artificial Sequence
  Description of Artificial Sequence: Synthetic oligonucleotide
aactccattttagtagggatt

SEQ ID NO: 9110 - DNA, 21 bp, Artificial Sequence
  Description of Artificial Sequence: Synthetic oligonucleotide
tccctactaaaatggagttaa

SEQ ID NO: 9111 - DNA, 21 bp, Artificial Sequence
  Description of Artificial Sequence: Synthetic oligonucleotide
actccattttagtagggattc

SEQ ID NO: 9112 - DNA, 21 bp, Artificial Sequence
  Description of Artificial Sequence: Synthetic oligonucleotide
atccctactaaaatggagtta

SEQ ID NO: 9113 - DNA, 21 bp, Artificial Sequence
  Description of Artificial Sequence: Synthetic oligonucleotide
ctccattttagtagggattca

SEQ ID NO: 9114 - DNA, 21 bp, Artificial Sequence
  Description of Artificial Sequence: Synthetic oligonucleotide
aatccctactaaaatggagtt

SEQ ID NO: 9115 - DNA, 21 bp, Artificial Sequence
  Description of Artificial Sequence: Synthetic oligonucleotide
tccattttagtagggattcac

SEQ ID NO: 9116 - DNA, 21 bp, Artificial Sequence
  Description of Artificial Sequence: Synthetic oligonucleotide
gaatccctactaaaatggagt

SEQ ID NO: 9117 - DNA, 21 bp, Artificial Sequence
  Description of Artificial Sequence: Synthetic oligonucleotide
ccattttagtagggattcact

SEQ ID NO: 9118 - DNA, 21 bp, Artificial Sequence
  Description of Artificial Sequence: Synthetic oligonucleotide
tgaatccctactaaaatggag

SEQ ID NO: 9119 - DNA, 21 bp, Artificial Sequence
  Description of Artificial Sequence: Synthetic oligonucleotide
cattttagtagggattcactg

SEQ ID NO: 9120 - DNA, 21 bp, Artificial Sequence
  Description of Artificial Sequence: Synthetic oligonucleotide
gtgaatccctactaaaatgga

SEQ ID NO: 9121 - DNA, 21 bp, Artificial Sequence
  Description of Artificial Sequence: Synthetic oligonucleotide
attttagtagggattcactga

SEQ ID NO: 9122 - DNA, 21 bp, Artificial Sequence
  Description of Artificial Sequence: Synthetic oligonucleotide
agtgaatccctactaaaatgg

SEQ ID NO: 9123 - DNA, 21 bp, Artificial Sequence
  Description of Artificial Sequence: Synthetic oligonucleotide
ttttagtagggattcactgac

SEQ ID NO: 9124 - DNA, 21 bp, Artificial Sequence
  Description of Artificial Sequence: Synthetic oligonucleotide
cagtgaatccctactaaaatg

SEQ ID NO: 9125 - DNA, 21 bp, Artificial Sequence
  Description of Artificial Sequence: Synthetic oligonucleotide
tttagtagggattcactgact

SEQ ID NO: 9126 - DNA, 21 bp, Artificial Sequence
  Description of Artificial Sequence: Synthetic oligonucleotide
tcagtgaatccctactaaaat

SEQ ID NO: 9127 - DNA, 21 bp, Artificial Sequence
  Description of Artificial Sequence: Synthetic oligonucleotide
ttagtagggattcactgacta

SEQ ID NO: 9128 - DNA, 21 bp, Artificial Sequence
  Description of Artificial Sequence: Synthetic oligonucleotide
gtcagtgaatccctactaaaa

SEQ ID NO: 9129 - DNA, 21 bp, Artificial Sequence
  Description of Artificial Sequence: Synthetic oligonucleotide
tagtagggattcactgactag

SEQ ID NO: 9130 - DNA, 21 bp, Artificial Sequence
  Description of Artificial Sequence: Synthetic oligonucleotide
agtcagtgaatccctactaaa

SEQ ID NO: 9131 - DNA, 21 bp, Artificial Sequence
  Description of Artificial Sequence: Synthetic oligonucleotide
agtagggattcactgactaga

SEQ ID NO: 9132 - DNA, 21 bp, Artificial Sequence
  Description of Artificial Sequence: Synthetic oligonucleotide
tagtcagtgaatccctactaa

SEQ ID NO: 9133 - DNA, 21 bp, Artificial Sequence
  Description of Artificial Sequence: Synthetic oligonucleotide
gtagggattcactgactagat

SEQ ID NO: 9134 - DNA, 21 bp, Artificial Sequence
  Description of Artificial Sequence: Synthetic oligonucleotide
ctagtcagtgaatccctacta

SEQ ID NO: 9135 - DNA, 21 bp, Artificial Sequence
  Description of Artificial Sequence: Synthetic oligonucleotide
tagggattcactgactagatt

SEQ ID NO: 9136 - DNA, 21 bp, Artificial Sequence
  Description of Artificial Sequence: Synthetic oligonucleotide
tctagtcagtgaatccctact

SEQ ID NO: 9137 - DNA, 21 bp, Artificial Sequence
  Description of Artificial Sequence: Synthetic oligonucleotide
agggattcactgactagattt

SEQ ID NO: 9138 - DNA, 21 bp, Artificial Sequence
  Description of Artificial Sequence: Synthetic oligonucleotide
atctagtcagtgaatccctac

SEQ ID NO: 9139 - DNA, 21 bp, Artificial Sequence
  Description of Artificial Sequence: Synthetic oligonucleotide
gggattcactgactagatttt

SEQ ID NO: 9140 - DNA, 21 bp, Artificial Sequence
  Description of Artificial Sequence: Synthetic oligonucleotide
aatctagtcagtgaatcccta

SEQ ID NO: 9141 - DNA, 21 bp, Artificial Sequence
  Description of Artificial Sequence: Synthetic oligonucleotide
ggattcactgactagatttta

SEQ ID NO: 9142 - DNA, 21 bp, Artificial Sequence
  Description of Artificial Sequence: Synthetic oligonucleotide
aaatctagtcagtgaatccct

SEQ ID NO: 9143 - DNA, 21 bp, Artificial Sequence
  Description of Artificial Sequence: Synthetic oligonucleotide
gattcactgactagattttac

SEQ ID NO: 9144 - DNA, 21 bp, Artificial Sequence
  Description of Artificial Sequence: Synthetic oligonucleotide
aaaatctagtcagtgaatccc

SEQ ID NO: 9145 - DNA, 21 bp, Artificial Sequence
  Description of Artificial Sequence: Synthetic oligonucleotide
attcactgactagattttact

SEQ ID NO: 9146 - DNA, 21 bp, Artificial Sequence
  Description of Artificial Sequence: Synthetic oligonucleotide
taaaatctagtcagtgaatcc

SEQ ID NO: 9147 - DNA, 21 bp, Artificial Sequence
  Description of Artificial Sequence: Synthetic oligonucleotide
ttcactgactagattttactg

SEQ ID NO: 9148 - DNA, 21 bp, Artificial Sequence
  Description of Artificial Sequence: Synthetic oligonucleotide
gtaaaatctagtcagtgaatc

SEQ ID NO: 9149 - DNA, 21 bp, Artificial Sequence
  Description of Artificial Sequence: Synthetic oligonucleotide
tcactgactagattttactga

SEQ ID NO: 9150 - DNA, 21 bp, Artificial Sequence
  Description of Artificial Sequence: Synthetic oligonucleotide
agtaaaatctagtcagtgaat

SEQ ID NO: 9151 - DNA, 21 bp, Artificial Sequence
  Description of Artificial Sequence: Synthetic oligonucleotide
cactgactagattttactgaa

SEQ ID NO: 9152 - DNA, 21 bp, Artificial Sequence
  Description of Artificial Sequence: Synthetic oligonucleotide
cagtaaaatctagtcagtgaa

SEQ ID NO: 9153 - DNA, 21 bp, Artificial Sequence
  Description of Artificial Sequence: Synthetic oligonucleotide
actgactagattttactgaac

SEQ ID NO: 9154 - DNA, 21 bp, Artificial Sequence
  Description of Artificial Sequence: Synthetic oligonucleotide
tcagtaaaatctagtcagtga

SEQ ID NO: 9155 - DNA, 21 bp, Artificial Sequence
  Description of Artificial Sequence: Synthetic oligonucleotide
ctgactagattttactgaact

SEQ ID NO: 9156 - DNA, 21 bp, Artificial Sequence
  Description of Artificial Sequence: Synthetic oligonucleotide
ttcagtaaaatctagtcagtg

SEQ ID NO: 9157 - DNA, 21 bp, Artificial Sequence
  Description of Artificial Sequence: Synthetic oligonucleotide
tgactagattttactgaacta

SEQ ID NO: 9158 - DNA, 21 bp, Artificial Sequence
  Description of Artificial Sequence: Synthetic oligonucleotide
gttcagtaaaatctagtcagt

SEQ ID NO: 9159 - DNA, 21 bp, Artificial Sequence
  Description of Artificial Sequence: Synthetic oligonucleotide
gactagattttactgaactat

SEQ ID NO: 9160 - DNA, 21 bp, Artificial Sequence
  Description of Artificial Sequence: Synthetic oligonucleotide
agttcagtaaaatctagtcag

SEQ ID NO: 9161 - DNA, 21 bp, Artificial Sequence
  Description of Artificial Sequence: Synthetic oligonucleotide
actagattttactgaactatg

SEQ ID NO: 9162 - DNA, 21 bp, Artificial Sequence
  Description of Artificial Sequence: Synthetic oligonucleotide
tagttcagtaaaatctagtca

SEQ ID NO: 9163 - DNA, 21 bp, Artificial Sequence
  Description of Artificial Sequence: Synthetic oligonucleotide
ctagattttactgaactatga

SEQ ID NO: 9164 - DNA, 21 bp, Artificial Sequence
  Description of Artificial Sequence: Synthetic oligonucleotide
atagttcagtaaaatctagtc

SEQ ID NO: 9165 - DNA, 21 bp, Artificial Sequence
  Description of Artificial Sequence: Synthetic oligonucleotide
tagattttactgaactatgaa

SEQ ID NO: 9166 - DNA, 21 bp, Artificial Sequence
  Description of Artificial Sequence: Synthetic oligonucleotide
catagttcagtaaaatctagt

SEQ ID NO: 9167 - DNA, 21 bp, Artificial Sequence
  Description of Artificial Sequence: Synthetic oligonucleotide
agattttactgaactatgaaa

SEQ ID NO: 9168 - DNA, 21 bp, Artificial Sequence
  Description of Artificial Sequence: Synthetic oligonucleotide
tcatagttcagtaaaatctag

SEQ ID NO: 9169 - DNA, 21 bp, Artificial Sequence
  Description of Artificial Sequence: Synthetic oligonucleotide
gattttactgaactatgaaaa

SEQ ID NO: 9170 - DNA, 21 bp, Artificial Sequence
  Description of Artificial Sequence: Synthetic oligonucleotide
ttcatagttcagtaaaatcta

SEQ ID NO: 9171 - DNA, 21 bp, Artificial Sequence
  Description of Artificial Sequence: Synthetic oligonucleotide
attttactgaactatgaaaat

SEQ ID NO: 9172 - DNA, 21 bp, Artificial Sequence
  Description of Artificial Sequence: Synthetic oligonucleotide
tttcatagttcagtaaaatct

SEQ ID NO: 9173 - DNA, 21 bp, Artificial Sequence
  Description of Artificial Sequence: Synthetic oligonucleotide
ttttactgaactatgaaaata

SEQ ID NO: 9174 - DNA, 21 bp, Artificial Sequence
  Description of Artificial Sequence: Synthetic oligonucleotide
ttttcatagttcagtaaaatc

SEQ ID NO: 9175 - DNA, 21 bp, Artificial Sequence
  Description of Artificial Sequence: Synthetic oligonucleotide
tttactgaactatgaaaataa

SEQ ID NO: 9176 - DNA, 21 bp, Artificial Sequence
  Description of Artificial Sequence: Synthetic oligonucleotide
attttcatagttcagtaaaat

SEQ ID NO: 9177 - DNA, 21 bp, Artificial Sequence
  Description of Artificial Sequence: Synthetic oligonucleotide
ttactgaactatgaaaataaa

SEQ ID NO: 9178 - DNA, 21 bp, Artificial Sequence
  Description of Artificial Sequence: Synthetic oligonucleotide
tattttcatagttcagtaaaa

SEQ ID NO: 9179 - DNA, 21 bp, Artificial Sequence
  Description of Artificial Sequence: Synthetic oligonucleotide
tactgaactatgaaaataaat

SEQ ID NO: 9180 - DNA, 21 bp, Artificial Sequence
  Description of Artificial Sequence: Synthetic oligonucleotide
ttattttcatagttcagtaaa

SEQ ID NO: 9181 - DNA, 21 bp, Artificial Sequence
  Description of Artificial Sequence: Synthetic oligonucleotide
actgaactatgaaaataaata

SEQ ID NO: 9182 - DNA, 21 bp, Artificial Sequence
  Description of Artificial Sequence: Synthetic oligonucleotide
tttattttcatagttcagtaa

SEQ ID NO: 9183 - DNA, 21 bp, Artificial Sequence
  Description of Artificial Sequence: Synthetic oligonucleotide
ctgaactatgaaaataaatac

SEQ ID NO: 9184 - DNA, 21 bp, Artificial Sequence
  Description of Artificial Sequence: Synthetic oligonucleotide
atttattttcatagttcagta

SEQ ID NO: 9185 - DNA, 21 bp, Artificial Sequence
  Description of Artificial Sequence: Synthetic oligonucleotide
tgaactatgaaaataaataca

SEQ ID NO: 9186 - DNA, 21 bp, Artificial Sequence
  Description of Artificial Sequence: Synthetic oligonucleotide
tatttattttcatagttcagt

SEQ ID NO: 9187 - DNA, 21 bp, Artificial Sequence
  Description of Artificial Sequence: Synthetic oligonucleotide
gaactatgaaaataaatacac

SEQ ID NO: 9188 - DNA, 21 bp, Artificial Sequence
  Description of Artificial Sequence: Synthetic oligonucleotide
gtatttattttcatagttcag

SEQ ID NO: 9189 - DNA, 21 bp, Artificial Sequence
  Description of Artificial Sequence: Synthetic oligonucleotide
aactatgaaaataaatacaca

SEQ ID NO: 9190 - DNA, 21 bp, Artificial Sequence
  Description of Artificial Sequence: Synthetic oligonucleotide
tgtatttattttcatagttca

SEQ ID NO: 9191 - DNA, 21 bp, Artificial Sequence
  Description of Artificial Sequence: Synthetic oligonucleotide
actatgaaaataaatacacat

SEQ ID NO: 9192 - DNA, 21 bp, Artificial Sequence
  Description of Artificial Sequence: Synthetic oligonucleotide
gtgtatttattttcatagttc

SEQ ID NO: 9193 - DNA, 21 bp, Artificial Sequence
  Description of Artificial Sequence: Synthetic oligonucleotide
ctatgaaaataaatacacata

SEQ ID NO: 9194 - DNA, 21 bp, Artificial Sequence
  Description of Artificial Sequence: Synthetic oligonucleotide
tgtgtatttattttcatagtt

SEQ ID NO: 9195 - DNA, 21 bp, Artificial Sequence
  Description of Artificial Sequence: Synthetic oligonucleotide
tatgaaaataaatacacataa

SEQ ID NO: 9196 - DNA, 21 bp, Artificial Sequence
  Description of Artificial Sequence: Synthetic oligonucleotide
atgtgtatttattttcatagt

SEQ ID NO: 9197 - DNA, 21 bp, Artificial Sequence
  Description of Artificial Sequence: Synthetic oligonucleotide
atgaaaataaatacacataat

SEQ ID NO: 9198 - DNA, 21 bp, Artificial Sequence
  Description of Artificial Sequence: Synthetic oligonucleotide
tatgtgtatttattttcatag

SEQ ID NO: 9199 - DNA, 21 bp, Artificial Sequence
  Description of Artificial Sequence: Synthetic oligonucleotide
tgaaaataaatacacataatt

SEQ ID NO: 9200 - DNA, 21 bp, Artificial Sequence
  Description of Artificial Sequence: Synthetic oligonucleotide
ttatgtgtatttattttcata

SEQ ID NO: 9201 - DNA, 21 bp, Artificial Sequence
  Description of Artificial Sequence: Synthetic oligonucleotide
gaaaataaatacacataattt

SEQ ID NO: 9202 - DNA, 21 bp, Artificial Sequence
  Description of Artificial Sequence: Synthetic oligonucleotide
attatgtgtatttattttcat

SEQ ID NO: 9203 - DNA, 21 bp, Artificial Sequence
  Description of Artificial Sequence: Synthetic oligonucleotide
aaaataaatacacataatttt

SEQ ID NO: 9204 - DNA, 21 bp, Artificial Sequence
  Description of Artificial Sequence: Synthetic oligonucleotide
aattatgtgtatttattttca

SEQ ID NO: 9205 - DNA, 21 bp, Artificial Sequence
  Description of Artificial Sequence: Synthetic oligonucleotide
aaataaatacacataattttt

SEQ ID NO: 9206 - DNA, 21 bp, Artificial Sequence
  Description of Artificial Sequence: Synthetic oligonucleotide
aaattatgtgtatttattttc

SEQ ID NO: 9207 - DNA, 21 bp, Artificial Sequence
  Description of Artificial Sequence: Synthetic oligonucleotide
aataaatacacataatttttc

SEQ ID NO: 9208 - DNA, 21 bp, Artificial Sequence
  Description of Artificial Sequence: Synthetic oligonucleotide
aaaattatgtgtatttatttt

SEQ ID NO: 9209 - DNA, 21 bp, Artificial Sequence
  Description of Artificial Sequence: Synthetic oligonucleotide
ataaatacacataatttttca

SEQ ID NO: 9210 - DNA, 21 bp, Artificial Sequence
  Description of Artificial Sequence: Synthetic oligonucleotide
aaaaattatgtgtatttattt

SEQ ID NO: 9211 - DNA, 21 bp, Artificial Sequence
  Description of Artificial Sequence: Synthetic oligonucleotide
taaatacacataatttttcac

SEQ ID NO: 9212 - DNA, 21 bp, Artificial Sequence
  Description of Artificial Sequence: Synthetic oligonucleotide
gaaaaattatgtgtatttatt

SEQ ID NO: 9213 - DNA, 21 bp, Artificial Sequence
  Description of Artificial Sequence: Synthetic oligonucleotide
aaatacacataatttttcaca

SEQ ID NO: 9214 - DNA, 21 bp, Artificial Sequence
  Description of Artificial Sequence: Synthetic oligonucleotide
tgaaaaattatgtgtatttat

SEQ ID NO: 9215 - DNA, 21 bp, Artificial Sequence
  Description of Artificial Sequence: Synthetic oligonucleotide
aatacacataatttttcacaa

SEQ ID NO: 9216 - DNA, 21 bp, Artificial Sequence
  Description of Artificial Sequence: Synthetic oligonucleotide
gtgaaaaattatgtgtattta

SEQ ID NO: 9217 - DNA, 21 bp, Artificial Sequence
  Description of Artificial Sequence: Synthetic oligonucleotide
atacacataatttttcacaaa

SEQ ID NO: 9218 - DNA, 21 bp, Artificial Sequence
  Description of Artificial Sequence: Synthetic oligonucleotide
tgtgaaaaattatgtgtattt

SEQ ID NO: 9219 - DNA, 21 bp, Artificial Sequence
  Description of Artificial Sequence: Synthetic oligonucleotide
tacacataatttttcacaaaa

SEQ ID NO: 9220 - DNA, 21 bp, Artificial Sequence
  Description of Artificial Sequence: Synthetic oligonucleotide
ttgtgaaaaattatgtgtatt

SEQ ID NO: 9221 - DNA, 21 bp, Artificial Sequence
  Description of Artificial Sequence: Synthetic oligonucleotide
acacataatttttcacaaaat

SEQ ID NO: 9222 - DNA, 21 bp, Artificial Sequence
  Description of Artificial Sequence: Synthetic oligonucleotide
tttgtgaaaaattatgtgtat

SEQ ID NO: 9223 - DNA, 21 bp, Artificial Sequence
  Description of Artificial Sequence: Synthetic oligonucleotide
cacataatttttcacaaaatt

SEQ ID NO: 9224 - DNA, 21 bp, Artificial Sequence
  Description of Artificial Sequence: Synthetic oligonucleotide
ttttgtgaaaaattatgtgta

SEQ ID NO: 9225 - DNA, 21 bp, Artificial Sequence
  Description of Artificial Sequence: Synthetic oligonucleotide
acataatttttcacaaaattt

SEQ ID NO: 9226 - DNA, 21 bp, Artificial Sequence
  Description of Artificial Sequence: Synthetic oligonucleotide
attttgtgaaaaattatgtgt

SEQ ID NO: 9227 - DNA, 21 bp, Artificial Sequence
  Description of Artificial Sequence: Synthetic oligonucleotide
cataatttttcacaaaatttt

SEQ ID NO: 9228 - DNA, 21 bp, Artificial Sequence
  Description of Artificial Sequence: Synthetic oligonucleotide
aattttgtgaaaaattatgtg

SEQ ID NO: 9229 - DNA, 21 bp, Artificial Sequence
  Description of Artificial Sequence: Synthetic oligonucleotide
ataatttttcacaaaattttg

SEQ ID NO: 9230 - DNA, 21 bp, Artificial Sequence
  Description of Artificial Sequence: Synthetic oligonucleotide
aaattttgtgaaaaattatgt

SEQ ID NO: 9231 - DNA, 21 bp, Artificial Sequence
  Description of Artificial Sequence: Synthetic oligonucleotide
taatttttcacaaaattttgg

SEQ ID NO: 9232 - DNA, 21 bp, Artificial Sequence
  Description of Artificial Sequence: Synthetic oligonucleotide
aaaattttgtgaaaaattatg

SEQ ID NO: 9233 - DNA, 21 bp, Artificial Sequence
  Description of Artificial Sequence: Synthetic oligonucleotide
aatttttcacaaaattttggg

SEQ ID NO: 9234 - DNA, 21 bp, Artificial Sequence
  Description of Artificial Sequence: Synthetic oligonucleotide
caaaattttgtgaaaaattat

SEQ ID NO: 9235 - DNA, 21 bp, Artificial Sequence
  Description of Artificial Sequence: Synthetic oligonucleotide
atttttcacaaaattttgggc

SEQ ID NO: 9236 - DNA, 21 bp, Artificial Sequence
  Description of Artificial Sequence: Synthetic oligonucleotide
ccaaaattttgtgaaaaatta

SEQ ID NO: 9237 - DNA, 21 bp, Artificial Sequence
  Description of Artificial Sequence: Synthetic oligonucleotide
tttttcacaaaattttgggcc

SEQ ID NO: 9238 - DNA, 21 bp, Artificial Sequence
  Description of Artificial Sequence: Synthetic oligonucleotide
cccaaaattttgtgaaaaatt

SEQ ID NO: 9239 - DNA, 21 bp, Artificial Sequence
  Description of Artificial Sequence: Synthetic oligonucleotide
ttttcacaaaattttgggccc

SEQ ID NO: 9240 - DNA, 21 bp, Artificial Sequence
  Description of Artificial Sequence: Synthetic oligonucleotide
gcccaaaattttgtgaaaaat

SEQ ID NO: 9241 - DNA, 21 bp, Artificial Sequence
  Description of Artificial Sequence: Synthetic oligonucleotide
tttcacaaaattttgggccca

SEQ ID NO: 9242 - DNA, 21 bp, Artificial Sequence
  Description of Artificial Sequence: Synthetic oligonucleotide
ggcccaaaattttgtgaaaaa

SEQ ID NO: 9243 - DNA, 21 bp, Artificial Sequence
  Description of Artificial Sequence: Synthetic oligonucleotide
ttcacaaaattttgggcccaa

SEQ ID NO: 9244 - DNA, 21 bp, Artificial Sequence
  Description of Artificial Sequence: Synthetic oligonucleotide
gggcccaaaattttgtgaaaa

SEQ ID NO: 9245 - DNA, 21 bp, Artificial Sequence
  Description of Artificial Sequence: Synthetic oligonucleotide
tcacaaaattttgggcccaat

SEQ ID NO: 9246 - DNA, 21 bp, Artificial Sequence
  Description of Artificial Sequence: Synthetic oligonucleotide
tgggcccaaaattttgtgaaa

SEQ ID NO: 9247 - DNA, 21 bp, Artificial Sequence
  Description of Artificial Sequence: Synthetic oligonucleotide
cacaaaattttgggcccaatt

SEQ ID NO: 9248 - DNA, 21 bp, Artificial Sequence
  Description of Artificial Sequence: Synthetic oligonucleotide
ttgggcccaaaattttgtgaa

SEQ ID NO: 9249 - DNA, 21 bp, Artificial Sequence
  Description of Artificial Sequence: Synthetic oligonucleotide
acaaaattttgggcccaattc

SEQ ID NO: 9250 - DNA, 21 bp, Artificial Sequence
  Description of Artificial Sequence: Synthetic oligonucleotide
attgggcccaaaattttgtga

SEQ ID NO: 9251 - DNA, 21 bp, Artificial Sequence
  Description of Artificial Sequence: Synthetic oligonucleotide
caaaattttgggcccaattcc

SEQ ID NO: 9252 - DNA, 21 bp, Artificial Sequence
  Description of Artificial Sequence: Synthetic oligonucleotide
aattgggcccaaaattttgtg

SEQ ID NO: 9253 - DNA, 21 bp, Artificial Sequence
  Description of Artificial Sequence: Synthetic oligonucleotide
aaaattttgggcccaattccc

SEQ ID NO: 9254 - DNA, 21 bp, Artificial Sequence
  Description of Artificial Sequence: Synthetic oligonucleotide
gaattgggcccaaaattttgt

SEQ ID NO: 9255 - DNA, 21 bp, Artificial Sequence
  Description of Artificial Sequence: Synthetic oligonucleotide
aaattttgggcccaattcccc

SEQ ID NO: 9256 - DNA, 21 bp, Artificial Sequence
  Description of Artificial Sequence: Synthetic oligonucleotide
ggaattgggcccaaaattttg

SEQ ID NO: 9257 - DNA, 21 bp, Artificial Sequence
  Description of Artificial Sequence: Synthetic oligonucleotide
aattttgggcccaattcccct

SEQ ID NO: 9258 - DNA, 21 bp, Artificial Sequence
  Description of Artificial Sequence: Synthetic oligonucleotide
gggaattgggcccaaaatttt

SEQ ID NO: 9259 - DNA, 21 bp, Artificial Sequence
  Description of Artificial Sequence: Synthetic oligonucleotide
attttgggcccaattccccta

SEQ ID NO: 9260 - DNA, 21 bp, Artificial Sequence
  Description of Artificial Sequence: Synthetic oligonucleotide
ggggaattgggcccaaaattt

SEQ ID NO: 9261 - DNA, 21 bp, Artificial Sequence
  Description of Artificial Sequence: Synthetic oligonucleotide
ttttgggcccaattcccctaa

SEQ ID NO: 9262 - DNA, 21 bp, Artificial Sequence
  Description of Artificial Sequence: Synthetic oligonucleotide
aggggaattgggcccaaaatt

SEQ ID NO: 9263 - DNA, 21 bp, Artificial Sequence
  Description of Artificial Sequence: Synthetic oligonucleotide
tttgggcccaattcccctaaa

SEQ ID NO: 9264 - DNA, 21 bp, Artificial Sequence
  Description of Artificial Sequence: Synthetic oligonucleotide
taggggaattgggcccaaaat

SEQ ID NO: 9265 - DNA, 21 bp, Artificial Sequence
  Description of Artificial Sequence: Synthetic oligonucleotide
ttgggcccaattcccctaaaa

SEQ ID NO: 9266 - DNA, 21 bp, Artificial Sequence
  Description of Artificial Sequence: Synthetic oligonucleotide
ttaggggaattgggcccaaaa

SEQ ID NO: 9267 - DNA, 21 bp, Artificial Sequence
  Description of Artificial Sequence: Synthetic oligonucleotide
tgggcccaattcccctaaaag

SEQ ID NO: 9268 - DNA, 21 bp, Artificial Sequence
  Description of Artificial Sequence: Synthetic oligonucleotide
tttaggggaattgggcccaaa

SEQ ID NO: 9269 - DNA, 21 bp, Artificial Sequence
  Description of Artificial Sequence: Synthetic oligonucleotide
gggcccaattcccctaaaaga

SEQ ID NO: 9270 - DNA, 21 bp, Artificial Sequence
  Description of Artificial Sequence: Synthetic oligonucleotide
ttttaggggaattgggcccaa

SEQ ID NO: 9271 - DNA, 21 bp, Artificial Sequence
  Description of Artificial Sequence: Synthetic oligonucleotide
ggcccaattcccctaaaagaa

SEQ ID NO: 9272 - DNA, 21 bp, Artificial Sequence
  Description of Artificial Sequence: Synthetic oligonucleotide
cttttaggggaattgggccca

SEQ ID NO: 9273 - DNA, 21 bp, Artificial Sequence
  Description of Artificial Sequence: Synthetic oligonucleotide
gcccaattcccctaaaagaat

SEQ ID NO: 9274 - DNA, 21 bp, Artificial Sequence
  Description of Artificial Sequence: Synthetic oligonucleotide
tcttttaggggaattgggccc

SEQ ID NO: 9275 - DNA, 21 bp, Artificial Sequence
  Description of Artificial Sequence: Synthetic oligonucleotide
cccaattcccctaaaagaatt

SEQ ID NO: 9276 - DNA, 21 bp, Artificial Sequence
  Description of Artificial Sequence: Synthetic oligonucleotide
ttcttttaggggaattgggcc

SEQ ID NO: 9277 - DNA, 21 bp, Artificial Sequence
  Description of Artificial Sequence: Synthetic oligonucleotide
ccaattcccctaaaagaattg

SEQ ID NO: 9278 - DNA, 21 bp, Artificial Sequence
  Description of Artificial Sequence: Synthetic oligonucleotide
attcttttaggggaattgggc

SEQ ID NO: 9279 - DNA, 21 bp, Artificial Sequence
  Description of Artificial Sequence: Synthetic oligonucleotide
caattcccctaaaagaattga

SEQ ID NO: 9280 - DNA, 21 bp, Artificial Sequence
  Description of Artificial Sequence: Synthetic oligonucleotide
aattcttttaggggaattggg

SEQ ID NO: 9281 - DNA, 21 bp, Artificial Sequence
  Description of Artificial Sequence: Synthetic oligonucleotide
aattcccctaaaagaattgag

SEQ ID NO: 9282 - DNA, 21 bp, Artificial Sequence
  Description of Artificial Sequence: Synthetic oligonucleotide
caattcttttaggggaattgg

SEQ ID NO: 9283 - DNA, 21 bp, Artificial Sequence
  Description of Artificial Sequence: Synthetic oligonucleotide
attcccctaaaagaattgagg

SEQ ID NO: 9284 - DNA, 21 bp, Artificial Sequence
  Description of Artificial Sequence: Synthetic oligonucleotide
tcaattcttttaggggaattg

SEQ ID NO: 9285 - DNA, 21 bp, Artificial Sequence
  Description of Artificial Sequence: Synthetic oligonucleotide
ttcccctaaaagaattgagga

SEQ ID NO: 9286 - DNA, 21 bp, Artificial Sequence
  Description of Artificial Sequence: Synthetic oligonucleotide
ctcaattcttttaggggaatt

SEQ ID NO: 9287 - DNA, 21 bp, Artificial Sequence
  Description of Artificial Sequence: Synthetic oligonucleotide
tcccctaaaagaattgaggat

SEQ ID NO: 9288 - DNA, 21 bp, Artificial Sequence
  Description of Artificial Sequence: Synthetic oligonucleotide
cctcaattcttttaggggaat

SEQ ID NO: 9289 - DNA, 21 bp, Artificial Sequence
  Description of Artificial Sequence: Synthetic oligonucleotide
cccctaaaagaattgaggatt

SEQ ID NO: 9290 - DNA, 21 bp, Artificial Sequence
  Description of Artificial Sequence: Synthetic oligonucleotide
tcctcaattcttttaggggaa

SEQ ID NO: 9291 - DNA, 21 bp, Artificial Sequence
  Description of Artificial Sequence: Synthetic oligonucleotide
ccctaaaagaattgaggatta

SEQ ID NO: 9292 - DNA, 21 bp, Artificial Sequence
  Description of Artificial Sequence: Synthetic oligonucleotide
atcctcaattcttttagggga

SEQ ID NO: 9293 - DNA, 21 bp, Artificial Sequence
  Description of Artificial Sequence: Synthetic oligonucleotide
cctaaaagaattgaggattag

SEQ ID NO: 9294 - DNA, 21 bp, Artificial Sequence
  Description of Artificial Sequence: Synthetic oligonucleotide
aatcctcaattcttttagggg

SEQ ID NO: 9295 - DNA, 21 bp, Artificial Sequence
  Description of Artificial Sequence: Synthetic oligonucleotide
ctaaaagaattgaggattagg

SEQ ID NO: 9296 - DNA, 21 bp, Artificial Sequence
  Description of Artificial Sequence: Synthetic oligonucleotide
taatcctcaattcttttaggg

SEQ ID NO: 9297 - DNA, 21 bp, Artificial Sequence
  Description of Artificial Sequence: Synthetic oligonucleotide
taaaagaattgaggattaggg

SEQ ID NO: 9298 - DNA, 21 bp, Artificial Sequence
  Description of Artificial Sequence: Synthetic oligonucleotide
ctaatcctcaattcttttagg

SEQ ID NO: 9299 - DNA, 21 bp, Artificial Sequence
  Description of Artificial Sequence: Synthetic oligonucleotide
aaaagaattgaggattaggga

SEQ ID NO: 9300 - DNA, 21 bp, Artificial Sequence
  Description of Artificial Sequence: Synthetic oligonucleotide
cctaatcctcaattcttttag

SEQ ID NO: 9301 - DNA, 21 bp, Artificial Sequence
  Description of Artificial Sequence: Synthetic oligonucleotide
aaagaattgaggattagggag

SEQ ID NO: 9302 - DNA, 21 bp, Artificial Sequence
  Description of Artificial Sequence: Synthetic oligonucleotide
ccctaatcctcaattctttta

SEQ ID NO: 9303 - DNA, 21 bp, Artificial Sequence
  Description of Artificial Sequence: Synthetic oligonucleotide
aagaattgaggattagggaga

SEQ ID NO: 9304 - DNA, 21 bp, Artificial Sequence
  Description of Artificial Sequence: Synthetic oligonucleotide
tccctaatcctcaattctttt

SEQ ID NO: 9305 - DNA, 21 bp, Artificial Sequence
  Description of Artificial Sequence: Synthetic oligonucleotide
agaattgaggattagggagaa

SEQ ID NO: 9306 - DNA, 21 bp, Artificial Sequence
  Description of Artificial Sequence: Synthetic oligonucleotide
ctccctaatcctcaattcttt

SEQ ID NO: 9307 - DNA, 21 bp, Artificial Sequence
  Description of Artificial Sequence: Synthetic oligonucleotide
gaattgaggattagggagaaa

SEQ ID NO: 9308 - DNA, 21 bp, Artificial Sequence
  Description of Artificial Sequence: Synthetic oligonucleotide
tctccctaatcctcaattctt

SEQ ID NO: 9309 - DNA, 21 bp, Artificial Sequence
  Description of Artificial Sequence: Synthetic oligonucleotide
aattgaggattagggagaaag

SEQ ID NO: 9310 - DNA, 21 bp, Artificial Sequence
  Description of Artificial Sequence: Synthetic oligonucleotide
ttctccctaatcctcaattct

SEQ ID NO: 9311 - DNA, 21 bp, Artificial Sequence
  Description of Artificial Sequence: Synthetic oligonucleotide
attgaggattagggagaaagg

SEQ ID NO: 9312 - DNA, 21 bp, Artificial Sequence
  Description of Artificial Sequence: Synthetic oligonucleotide
tttctccctaatcctcaattc

SEQ ID NO: 9313 - DNA, 21 bp, Artificial Sequence
  Description of Artificial Sequence: Synthetic oligonucleotide
ttgaggattagggagaaagga

SEQ ID NO: 9314 - DNA, 21 bp, Artificial Sequence
  Description of Artificial Sequence: Synthetic oligonucleotide
ctttctccctaatcctcaatt

SEQ ID NO: 9315 - DNA, 21 bp, Artificial Sequence
  Description of Artificial Sequence: Synthetic oligonucleotide
tgaggattagggagaaaggag

SEQ ID NO: 9316 - DNA, 21 bp, Artificial Sequence
  Description of Artificial Sequence: Synthetic oligonucleotide
cctttctccctaatcctcaat

SEQ ID NO: 9317 - DNA, 21 bp, Artificial Sequence
  Description of Artificial Sequence: Synthetic oligonucleotide
gaggattagggagaaaggaga

SEQ ID NO: 9318 - DNA, 21 bp, Artificial Sequence
  Description of Artificial Sequence: Synthetic oligonucleotide
tcctttctccctaatcctcaa

SEQ ID NO: 9319 - DNA, 21 bp, Artificial Sequence
  Description of Artificial Sequence: Synthetic oligonucleotide
aggattagggagaaaggagac

SEQ ID NO: 9320 - DNA, 21 bp, Artificial Sequence
  Description of Artificial Sequence: Synthetic oligonucleotide
ctcctttctccctaatcctca

SEQ ID NO: 9321 - DNA, 21 bp, Artificial Sequence
  Description of Artificial Sequence: Synthetic oligonucleotide
ggattagggagaaaggagaca

SEQ ID NO: 9322 - DNA, 21 bp, Artificial Sequence
  Description of Artificial Sequence: Synthetic oligonucleotide
tctcctttctccctaatcctc

SEQ ID NO: 9323 - DNA, 21 bp, Artificial Sequence
  Description of Artificial Sequence: Synthetic oligonucleotide
gattagggagaaaggagacaa

SEQ ID NO: 9324 - DNA, 21 bp, Artificial Sequence
  Description of Artificial Sequence: Synthetic oligonucleotide
gtctcctttctccctaatcct

SEQ ID NO: 9325 - DNA, 21 bp, Artificial Sequence
  Description of Artificial Sequence: Synthetic oligonucleotide
attagggagaaaggagacaac

SEQ ID NO: 9326 - DNA, 21 bp, Artificial Sequence
  Description of Artificial Sequence: Synthetic oligonucleotide
tgtctcctttctccctaatcc

SEQ ID NO: 9327 - DNA, 21 bp, Artificial Sequence
  Description of Artificial Sequence: Synthetic oligonucleotide
ttagggagaaaggagacaact

SEQ ID NO: 9328 - DNA, 21 bp, Artificial Sequence
  Description of Artificial Sequence: Synthetic oligonucleotide
ttgtctcctttctccctaatc

SEQ ID NO: 9329 - DNA, 21 bp, Artificial Sequence
  Description of Artificial Sequence: Synthetic oligonucleotide
tagggagaaaggagacaactc

SEQ ID NO: 9330 - DNA, 21 bp, Artificial Sequence
  Description of Artificial Sequence: Synthetic oligonucleotide
gttgtctcctttctccctaat

SEQ ID NO: 9331 - DNA, 21 bp, Artificial Sequence
  Description of Artificial Sequence: Synthetic oligonucleotide
agggagaaaggagacaactca

SEQ ID NO: 9332 - DNA, 21 bp, Artificial Sequence
  Description of Artificial Sequence: Synthetic oligonucleotide
agttgtctcctttctccctaa

SEQ ID NO: 9333 - DNA, 21 bp, Artificial Sequence
  Description of Artificial Sequence: Synthetic oligonucleotide
gggagaaaggagacaactcaa

SEQ ID NO: 9334 - DNA, 21 bp, Artificial Sequence
  Description of Artificial Sequence: Synthetic oligonucleotide
gagttgtctcctttctcccta

SEQ ID NO: 9335 - DNA, 21 bp, Artificial Sequence
  Description of Artificial Sequence: Synthetic oligonucleotide
ggagaaaggagacaactcaaa

SEQ ID NO: 9336 - DNA, 21 bp, Artificial Sequence
  Description of Artificial Sequence: Synthetic oligonucleotide
tgagttgtctcctttctccct

SEQ ID NO: 9337 - DNA, 21 bp, Artificial Sequence
  Description of Artificial Sequence: Synthetic oligonucleotide
gagaaaggagacaactcaaag

SEQ ID NO: 9338 - DNA, 21 bp, Artificial Sequence
  Description of Artificial Sequence: Synthetic oligonucleotide
ttgagttgtctcctttctccc

SEQ ID NO: 9339 - DNA, 21 bp, Artificial Sequence
  Description of Artificial Sequence: Synthetic oligonucleotide
agaaaggagacaactcaaagt

SEQ ID NO: 9340 - DNA, 21 bp, Artificial Sequence
  Description of Artificial Sequence: Synthetic oligonucleotide
tttgagttgtctcctttctcc

SEQ ID NO: 9341 - DNA, 21 bp, Artificial Sequence
  Description of Artificial Sequence: Synthetic oligonucleotide
gaaaggagacaactcaaagtc

SEQ ID NO: 9342 - DNA, 21 bp, Artificial Sequence
  Description of Artificial Sequence: Synthetic oligonucleotide
ctttgagttgtctcctttctc

SEQ ID NO: 9343 - DNA, 21 bp, Artificial Sequence
  Description of Artificial Sequence: Synthetic oligonucleotide
aaaggagacaactcaaagtca

SEQ ID NO: 9344 - DNA, 21 bp, Artificial Sequence
  Description of Artificial Sequence: Synthetic oligonucleotide
actttgagttgtctcctttct

SEQ ID NO: 9345 - DNA, 21 bp, Artificial Sequence
  Description of Artificial Sequence: Synthetic oligonucleotide
aaggagacaactcaaagtcat

SEQ ID NO: 9346 - DNA, 21 bp, Artificial Sequence
  Description of Artificial Sequence: Synthetic oligonucleotide
gactttgagttgtctcctttc

SEQ ID NO: 9347 - DNA, 21 bp, Artificial Sequence
  Description of Artificial Sequence: Synthetic oligonucleotide
aggagacaactcaaagtcatc

SEQ ID NO: 9348 - DNA, 21 bp, Artificial Sequence
  Description of Artificial Sequence: Synthetic oligonucleotide
tgactttgagttgtctccttt

SEQ ID NO: 9349 - DNA, 21 bp, Artificial Sequence
  Description of Artificial Sequence: Synthetic oligonucleotide
ggagacaactcaaagtcatcc

SEQ ID NO: 9350 - DNA, 21 bp, Artificial Sequence
  Description of Artificial Sequence: Synthetic oligonucleotide
atgactttgagttgtctcctt

SEQ ID NO: 9351 - DNA, 21 bp, Artificial Sequence
  Description of Artificial Sequence: Synthetic oligonucleotide
gagacaactcaaagtcatccc

SEQ ID NO: 9352 - DNA, 21 bp, Artificial Sequence
  Description of Artificial Sequence: Synthetic oligonucleotide
gatgactttgagttgtctcct

SEQ ID NO: 9353 - DNA, 21 bp, Artificial Sequence
  Description of Artificial Sequence: Synthetic oligonucleotide
agacaactcaaagtcatccca

SEQ ID NO: 9354 - DNA, 21 bp, Artificial Sequence
  Description of Artificial Sequence: Synthetic oligonucleotide
ggatgactttgagttgtctcc

SEQ ID NO: 9355 - DNA, 21 bp, Artificial Sequence
  Description of Artificial Sequence: Synthetic oligonucleotide
gacaactcaaagtcatcccat

SEQ ID NO: 9356 - DNA, 21 bp, Artificial Sequence
  Description of Artificial Sequence: Synthetic oligonucleotide
gggatgactttgagttgtctc

SEQ ID NO: 9357 - DNA, 21 bp, Artificial Sequence
  Description of Artificial Sequence: Synthetic oligonucleotide
acaactcaaagtcatcccatt

SEQ ID NO: 9358 - DNA, 21 bp, Artificial Sequence
  Description of Artificial Sequence: Synthetic oligonucleotide
tgggatgactttgagttgtct

SEQ ID NO: 9359 - DNA, 21 bp, Artificial Sequence
  Description of Artificial Sequence: Synthetic oligonucleotide
caactcaaagtcatcccatta

SEQ ID NO: 9360 - DNA, 21 bp, Artificial Sequence
  Description of Artificial Sequence: Synthetic oligonucleotide
atgggatgactttgagttgtc

SEQ ID NO: 9361 - DNA, 21 bp, Artificial Sequence
  Description of Artificial Sequence: Synthetic oligonucleotide
aactcaaagtcatcccattaa

SEQ ID NO: 9362 - DNA, 21 bp, Artificial Sequence
  Description of Artificial Sequence: Synthetic oligonucleotide
aatgggatgactttgagttgt

SEQ ID NO: 9363 - DNA, 21 bp, Artificial Sequence
  Description of Artificial Sequence: Synthetic oligonucleotide
actcaaagtcatcccattaag

SEQ ID NO: 9364 - DNA, 21 bp, Artificial Sequence
  Description of Artificial Sequence: Synthetic oligonucleotide
taatgggatgactttgagttg

SEQ ID NO: 9365 - DNA, 21 bp, Artificial Sequence
  Description of Artificial Sequence: Synthetic oligonucleotide
ctcaaagtcatcccattaagt

SEQ ID NO: 9366 - DNA, 21 bp, Artificial Sequence
  Description of Artificial Sequence: Synthetic oligonucleotide
ttaatgggatgactttgagtt

SEQ ID NO: 9367 - DNA, 21 bp, Artificial Sequence
  Description of Artificial Sequence: Synthetic oligonucleotide
tcaaagtcatcccattaagtg

SEQ ID NO: 9368 - DNA, 21 bp, Artificial Sequence
  Description of Artificial Sequence: Synthetic oligonucleotide
cttaatgggatgactttgagt

SEQ ID NO: 9369 - DNA, 21 bp, Artificial Sequence
  Description of Artificial Sequence: Synthetic oligonucleotide
caaagtcatcccattaagtgc

SEQ ID NO: 9370 - DNA, 21 bp, Artificial Sequence
  Description of Artificial Sequence: Synthetic oligonucleotide
acttaatgggatgactttgag

SEQ ID NO: 9371 - DNA, 21 bp, Artificial Sequence
  Description of Artificial Sequence: Synthetic oligonucleotide
aaagtcatcccattaagtgca

SEQ ID NO: 9372 - DNA, 21 bp, Artificial Sequence
  Description of Artificial Sequence: Synthetic oligonucleotide
cacttaatgggatgactttga

SEQ ID NO: 9373 - DNA, 21 bp, Artificial Sequence
  Description of Artificial Sequence: Synthetic oligonucleotide
aagtcatcccattaagtgcag

SEQ ID NO: 9374 - DNA, 21 bp, Artificial Sequence
  Description of Artificial Sequence: Synthetic oligonucleotide
gcacttaatgggatgactttg

SEQ ID NO: 9375 - DNA, 21 bp, Artificial Sequence
  Description of Artificial Sequence: Synthetic oligonucleotide
agtcatcccattaagtgcagt

SEQ ID NO: 9376 - DNA, 21 bp, Artificial Sequence
  Description of Artificial Sequence: Synthetic oligonucleotide
tgcacttaatgggatgacttt

SEQ ID NO: 9377 - DNA, 21 bp, Artificial Sequence
  Description of Artificial Sequence: Synthetic oligonucleotide
gtcatcccattaagtgcagtt

SEQ ID NO: 9378 - DNA, 21 bp, Artificial Sequence
  Description of Artificial Sequence: Synthetic oligonucleotide
ctgcacttaatgggatgactt

SEQ ID NO: 9379 - DNA, 21 bp, Artificial Sequence
  Description of Artificial Sequence: Synthetic oligonucleotide
tcatcccattaagtgcagttt

SEQ ID NO: 9380 - DNA, 21 bp, Artificial Sequence
  Description of Artificial Sequence: Synthetic oligonucleotide
actgcacttaatgggatgact

SEQ ID NO: 9381 - DNA, 21 bp, Artificial Sequence
  Description of Artificial Sequence: Synthetic oligonucleotide
catcccattaagtgcagtttc

SEQ ID NO: 9382 - DNA, 21 bp, Artificial Sequence
  Description of Artificial Sequence: Synthetic oligonucleotide
aactgcacttaatgggatgac

SEQ ID NO: 9383 - DNA, 21 bp, Artificial Sequence
  Description of Artificial Sequence: Synthetic oligonucleotide
atcccattaagtgcagtttct

SEQ ID NO: 9384 - DNA, 21 bp, Artificial Sequence
  Description of Artificial Sequence: Synthetic oligonucleotide
aaactgcacttaatgggatga

SEQ ID NO: 9385 - DNA, 21 bp, Artificial Sequence
  Description of Artificial Sequence: Synthetic oligonucleotide
tcccattaagtgcagtttctt

SEQ ID NO: 9386 - DNA, 21 bp, Artificial Sequence
  Description of Artificial Sequence: Synthetic oligonucleotide
gaaactgcacttaatgggatg

SEQ ID NO: 9387 - DNA, 21 bp, Artificial Sequence
  Description of Artificial Sequence: Synthetic oligonucleotide
cccattaagtgcagtttcttt

SEQ ID NO: 9388 - DNA, 21 bp, Artificial Sequence
  Description of Artificial Sequence: Synthetic oligonucleotide
agaaactgcacttaatgggat

SEQ ID NO: 9389 - DNA, 21 bp, Artificial Sequence
  Description of Artificial Sequence: Synthetic oligonucleotide
ccattaagtgcagtttctttg

SEQ ID NO: 9390 - DNA, 21 bp, Artificial Sequence
  Description of Artificial Sequence: Synthetic oligonucleotide
aagaaactgcacttaatggga

SEQ ID NO: 9391 - DNA, 21 bp, Artificial Sequence
  Description of Artificial Sequence: Synthetic oligonucleotide
cattaagtgcagtttctttga

SEQ ID NO: 9392 - DNA, 21 bp, Artificial Sequence
  Description of Artificial Sequence: Synthetic oligonucleotide
aaagaaactgcacttaatggg

SEQ ID NO: 9393 - DNA, 21 bp, Artificial Sequence
  Description of Artificial Sequence: Synthetic oligonucleotide
attaagtgcagtttctttgaa

SEQ ID NO: 9394 - DNA, 21 bp, Artificial Sequence
  Description of Artificial Sequence: Synthetic oligonucleotide
caaagaaactgcacttaatgg

SEQ ID NO: 9395 - DNA, 21 bp, Artificial Sequence
  Description of Artificial Sequence: Synthetic oligonucleotide
ttaagtgcagtttctttgaat

SEQ ID NO: 9396 - DNA, 21 bp, Artificial Sequence
  Description of Artificial Sequence: Synthetic oligonucleotide
tcaaagaaactgcacttaatg

SEQ ID NO: 9397 - DNA, 21 bp, Artificial Sequence
  Description of Artificial Sequence: Synthetic oligonucleotide
taagtgcagtttctttgaatc

SEQ ID NO: 9398 - DNA, 21 bp, Artificial Sequence
  Description of Artificial Sequence: Synthetic oligonucleotide
ttcaaagaaactgcacttaat

SEQ ID NO: 9399 - DNA, 21 bp, Artificial Sequence
  Description of Artificial Sequence: Synthetic oligonucleotide
aagtgcagtttctttgaatct

SEQ ID NO: 9400 - DNA, 21 bp, Artificial Sequence
  Description of Artificial Sequence: Synthetic oligonucleotide
attcaaagaaactgcacttaa

SEQ ID NO: 9401 - DNA, 21 bp, Artificial Sequence
  Description of Artificial Sequence: Synthetic oligonucleotide
agtgcagtttctttgaatctt

SEQ ID NO: 9402 - DNA, 21 bp, Artificial Sequence
  Description of Artificial Sequence: Synthetic oligonucleotide
gattcaaagaaactgcactta

SEQ ID NO: 9403 - DNA, 21 bp, Artificial Sequence
  Description of Artificial Sequence: Synthetic oligonucleotide
gtgcagtttctttgaatcttc

SEQ ID NO: 9404 - DNA, 21 bp, Artificial Sequence
  Description of Artificial Sequence: Synthetic oligonucleotide
agattcaaagaaactgcactt

SEQ ID NO: 9405 - DNA, 21 bp, Artificial Sequence
  Description of Artificial Sequence: Synthetic oligonucleotide
tgcagtttctttgaatcttct

SEQ ID NO: 9406 - DNA, 21 bp, Artificial Sequence
  Description of Artificial Sequence: Synthetic oligonucleotide
aagattcaaagaaactgcact

SEQ ID NO: 9407 - DNA, 21 bp, Artificial Sequence
  Description of Artificial Sequence: Synthetic oligonucleotide
gcagtttctttgaatcttctg

SEQ ID NO: 9408 - DNA, 21 bp, Artificial Sequence
  Description of Artificial Sequence: Synthetic oligonucleotide
gaagattcaaagaaactgcac

SEQ ID NO: 9409 - DNA, 21 bp, Artificial Sequence
  Description of Artificial Sequence: Synthetic oligonucleotide
cagtttctttgaatcttctgc

SEQ ID NO: 9410 - DNA, 21 bp, Artificial Sequence
  Description of Artificial Sequence: Synthetic oligonucleotide
agaagattcaaagaaactgca

SEQ ID NO: 9411 - DNA, 21 bp, Artificial Sequence
  Description of Artificial Sequence: Synthetic oligonucleotide
agtttctttgaatcttctgct

SEQ ID NO: 9412 - DNA, 21 bp, Artificial Sequence
  Description of Artificial Sequence: Synthetic oligonucleotide
cagaagattcaaagaaactgc

SEQ ID NO: 9413 - DNA, 21 bp, Artificial Sequence
  Description of Artificial Sequence: Synthetic oligonucleotide
gtttctttgaatcttctgctt

SEQ ID NO: 9414 - DNA, 21 bp, Artificial Sequence
  Description of Artificial Sequence: Synthetic oligonucleotide
gcagaagattcaaagaaactg

SEQ ID NO: 9415 - DNA, 21 bp, Artificial Sequence
  Description of Artificial Sequence: Synthetic oligonucleotide
tttctttgaatcttctgcttt

SEQ ID NO: 9416 - DNA, 21 bp, Artificial Sequence
  Description of Artificial Sequence: Synthetic oligonucleotide
agcagaagattcaaagaaact

SEQ ID NO: 9417 - DNA, 21 bp, Artificial Sequence
  Description of Artificial Sequence: Synthetic oligonucleotide
ttctttgaatcttctgcttta

SEQ ID NO: 9418 - DNA, 21 bp, Artificial Sequence
  Description of Artificial Sequence: Synthetic oligonucleotide
aagcagaagattcaaagaaac

SEQ ID NO: 9419 - DNA, 21 bp, Artificial Sequence
  Description of Artificial Sequence: Synthetic oligonucleotide
tctttgaatcttctgctttat

SEQ ID NO: 9420 - DNA, 21 bp, Artificial Sequence
  Description of Artificial Sequence: Synthetic oligonucleotide
aaagcagaagattcaaagaaa

SEQ ID NO: 9421 - DNA, 21 bp, Artificial Sequence
  Description of Artificial Sequence: Synthetic oligonucleotide
ctttgaatcttctgctttatc

SEQ ID NO: 9422 - DNA, 21 bp, Artificial Sequence
  Description of Artificial Sequence: Synthetic oligonucleotide
taaagcagaagattcaaagaa

SEQ ID NO: 9423 - DNA, 21 bp, Artificial Sequence
  Description of Artificial Sequence: Synthetic oligonucleotide
tttgaatcttctgctttatct

SEQ ID NO: 9424 - DNA, 21 bp, Artificial Sequence
  Description of Artificial Sequence: Synthetic oligonucleotide
ataaagcagaagattcaaaga

SEQ ID NO: 9425 - DNA, 21 bp, Artificial Sequence
  Description of Artificial Sequence: Synthetic oligonucleotide
ttgaatcttctgctttatctt

SEQ ID NO: 9426 - DNA, 21 bp, Artificial Sequence
  Description of Artificial Sequence: Synthetic oligonucleotide
gataaagcagaagattcaaag

SEQ ID NO: 9427 - DNA, 21 bp, Artificial Sequence
  Description of Artificial Sequence: Synthetic oligonucleotide
tgaatcttctgctttatcttt

SEQ ID NO: 9428 - DNA, 21 bp, Artificial Sequence
  Description of Artificial Sequence: Synthetic oligonucleotide
agataaagcagaagattcaaa

SEQ ID NO: 9429 - DNA, 21 bp, Artificial Sequence
  Description of Artificial Sequence: Synthetic oligonucleotide
gaatcttctgctttatcttta

SEQ ID NO: 9430 - DNA, 21 bp, Artificial Sequence
  Description of Artificial Sequence: Synthetic oligonucleotide
aagataaagcagaagattcaa

SEQ ID NO: 9431 - DNA, 21 bp, Artificial Sequence
  Description of Artificial Sequence: Synthetic oligonucleotide
aatcttctgctttatctttaa

SEQ ID NO: 9432 - DNA, 21 bp, Artificial Sequence
  Description of Artificial Sequence: Synthetic oligonucleotide
aaagataaagcagaagattca

SEQ ID NO: 9433 - DNA, 21 bp, Artificial Sequence
  Description of Artificial Sequence: Synthetic oligonucleotide
atcttctgctttatctttaaa

SEQ ID NO: 9434 - DNA, 21 bp, Artificial Sequence
  Description of Artificial Sequence: Synthetic oligonucleotide
taaagataaagcagaagattc

SEQ ID NO: 9435 - DNA, 21 bp, Artificial Sequence
  Description of Artificial Sequence: Synthetic oligonucleotide
tcttctgctttatctttaaaa

SEQ ID NO: 9436 - DNA, 21 bp, Artificial Sequence
  Description of Artificial Sequence: Synthetic oligonucleotide
ttaaagataaagcagaagatt

SEQ ID NO: 9437 - DNA, 21 bp, Artificial Sequence
  Description of Artificial Sequence: Synthetic oligonucleotide
cttctgctttatctttaaaaa

SEQ ID NO: 9438 - DNA, 21 bp, Artificial Sequence
  Description of Artificial Sequence: Synthetic oligonucleotide
tttaaagataaagcagaagat

SEQ ID NO: 9439 - DNA, 21 bp, Artificial Sequence
  Description of Artificial Sequence: Synthetic oligonucleotide
ttctgctttatctttaaaaat

SEQ ID NO: 9440 - DNA, 21 bp, Artificial Sequence
  Description of Artificial Sequence: Synthetic oligonucleotide
ttttaaagataaagcagaaga

SEQ ID NO: 9441 - DNA, 21 bp, Artificial Sequence
  Description of Artificial Sequence: Synthetic oligonucleotide
tctgctttatctttaaaaatt

SEQ ID NO: 9442 - DNA, 21 bp, Artificial Sequence
  Description of Artificial Sequence: Synthetic oligonucleotide
tttttaaagataaagcagaag

SEQ ID NO: 9443 - DNA, 21 bp, Artificial Sequence
  Description of Artificial Sequence: Synthetic oligonucleotide
ctgctttatctttaaaaattt

SEQ ID NO: 9444 - DNA, 21 bp, Artificial Sequence
  Description of Artificial Sequence: Synthetic oligonucleotide
atttttaaagataaagcagaa

SEQ ID NO: 9445 - DNA, 21 bp, Artificial Sequence
  Description of Artificial Sequence: Synthetic oligonucleotide
tgctttatctttaaaaatttg

SEQ ID NO: 9446 - DNA, 21 bp, Artificial Sequence
  Description of Artificial Sequence: Synthetic oligonucleotide
aatttttaaagataaagcaga

SEQ ID NO: 9447 - DNA, 21 bp, Artificial Sequence
  Description of Artificial Sequence: Synthetic oligonucleotide
gctttatctttaaaaatttgt

SEQ ID NO: 9448 - DNA, 21 bp, Artificial Sequence
  Description of Artificial Sequence: Synthetic oligonucleotide
aaatttttaaagataaagcag

SEQ ID NO: 9449 - DNA, 21 bp, Artificial Sequence
  Description of Artificial Sequence: Synthetic oligonucleotide
ctttatctttaaaaatttgta

SEQ ID NO: 9450 - DNA, 21 bp, Artificial Sequence
  Description of Artificial Sequence: Synthetic oligonucleotide
caaatttttaaagataaagca

SEQ ID NO: 9451 - DNA, 21 bp, Artificial Sequence
  Description of Artificial Sequence: Synthetic oligonucleotide
tttatctttaaaaatttgtat

SEQ ID NO: 9452 - DNA, 21 bp, Artificial Sequence
  Description of Artificial Sequence: Synthetic oligonucleotide
acaaatttttaaagataaagc

SEQ ID NO: 9453 - DNA, 21 bp, Artificial Sequence
  Description of Artificial Sequence: Synthetic oligonucleotide
ttatctttaaaaatttgtata

SEQ ID NO: 9454 - DNA, 21 bp, Artificial Sequence
  Description of Artificial Sequence: Synthetic oligonucleotide
tacaaatttttaaagataaag

SEQ ID NO: 9455 - DNA, 21 bp, Artificial Sequence
  Description of Artificial Sequence: Synthetic oligonucleotide
tatctttaaaaatttgtataa

SEQ ID NO: 9456 - DNA, 21 bp, Artificial Sequence
  Description of Artificial Sequence: Synthetic oligonucleotide
atacaaatttttaaagataaa

SEQ ID NO: 9457 - DNA, 21 bp, Artificial Sequence
  Description of Artificial Sequence: Synthetic oligonucleotide
atctttaaaaatttgtataat

SEQ ID NO: 9458 - DNA, 21 bp, Artificial Sequence
  Description of Artificial Sequence: Synthetic oligonucleotide
tatacaaatttttaaagataa

SEQ ID NO: 9459 - DNA, 21 bp, Artificial Sequence
  Description of Artificial Sequence: Synthetic oligonucleotide
tctttaaaaatttgtataatt

SEQ ID NO: 9460 - DNA, 21 bp, Artificial Sequence
  Description of Artificial Sequence: Synthetic oligonucleotide
ttatacaaatttttaaagata

SEQ ID NO: 9461 - DNA, 21 bp, Artificial Sequence
  Description of Artificial Sequence: Synthetic oligonucleotide
ctttaaaaatttgtataattt

SEQ ID NO: 9462 - DNA, 21 bp, Artificial Sequence
  Description of Artificial Sequence: Synthetic oligonucleotide
attatacaaatttttaaagat

SEQ ID NO: 9463 - DNA, 21 bp, Artificial Sequence
  Description of Artificial Sequence: Synthetic oligonucleotide
tttaaaaatttgtataattta

SEQ ID NO: 9464 - DNA, 21 bp, Artificial Sequence
  Description of Artificial Sequence: Synthetic oligonucleotide
aattatacaaatttttaaaga

SEQ ID NO: 9465 - DNA, 21 bp, Artificial Sequence
  Description of Artificial Sequence: Synthetic oligonucleotide
ttaaaaatttgtataatttat

SEQ ID NO: 9466 - DNA, 21 bp, Artificial Sequence
  Description of Artificial Sequence: Synthetic oligonucleotide
aaattatacaaatttttaaag

SEQ ID NO: 9467 - DNA, 21 bp, Artificial Sequence
  Description of Artificial Sequence: Synthetic oligonucleotide
taaaaatttgtataatttata

SEQ ID NO: 9468 - DNA, 21 bp, Artificial Sequence
  Description of Artificial Sequence: Synthetic oligonucleotide
taaattatacaaatttttaaa

SEQ ID NO: 9469 - DNA, 21 bp, Artificial Sequence
  Description of Artificial Sequence: Synthetic oligonucleotide
aaaaatttgtataatttatat

SEQ ID NO: 9470 - DNA, 21 bp, Artificial Sequence
  Description of Artificial Sequence: Synthetic oligonucleotide
ataaattatacaaatttttaa

SEQ ID NO: 9471 - DNA, 21 bp, Artificial Sequence
  Description of Artificial Sequence: Synthetic oligonucleotide
aaaatttgtataatttatata

SEQ ID NO: 9472 - DNA, 21 bp, Artificial Sequence
  Description of Artificial Sequence: Synthetic oligonucleotide
tataaattatacaaattttta

SEQ ID NO: 9473 - DNA, 21 bp, Artificial Sequence
  Description of Artificial Sequence: Synthetic oligonucleotide
aaatttgtataatttatatat

SEQ ID NO: 9474 - DNA, 21 bp, Artificial Sequence
  Description of Artificial Sequence: Synthetic oligonucleotide
atataaattatacaaattttt

SEQ ID NO: 9475 - DNA, 21 bp, Artificial Sequence
  Description of Artificial Sequence: Synthetic oligonucleotide
aatttgtataatttatatatt

SEQ ID NO: 9476 - DNA, 21 bp, Artificial Sequence
  Description of Artificial Sequence: Synthetic oligonucleotide
tatataaattatacaaatttt

SEQ ID NO: 9477 - DNA, 21 bp, Artificial Sequence
  Description of Artificial Sequence: Synthetic oligonucleotide
atttgtataatttatatattt

SEQ ID NO: 9478 - DNA, 21 bp, Artificial Sequence
  Description of Artificial Sequence: Synthetic oligonucleotide
atatataaattatacaaattt

SEQ ID NO: 9479 - DNA, 21 bp, Artificial Sequence
  Description of Artificial Sequence: Synthetic oligonucleotide
tttgtataatttatatatttt

SEQ ID NO: 9480 - DNA, 21 bp, Artificial Sequence
  Description of Artificial Sequence: Synthetic oligonucleotide
aatatataaattatacaaatt

SEQ ID NO: 9481 - DNA, 21 bp, Artificial Sequence
  Description of Artificial Sequence: Synthetic oligonucleotide
ttgtataatttatatatttta

SEQ ID NO: 9482 - DNA, 21 bp, Artificial Sequence
  Description of Artificial Sequence: Synthetic oligonucleotide
aaatatataaattatacaaat

SEQ ID NO: 9483 - DNA, 21 bp, Artificial Sequence
  Description of Artificial Sequence: Synthetic oligonucleotide
tgtataatttatatattttat

SEQ ID NO: 9484 - DNA, 21 bp, Artificial Sequence
  Description of Artificial Sequence: Synthetic oligonucleotide
aaaatatataaattatacaaa

SEQ ID NO: 9485 - DNA, 21 bp, Artificial Sequence
  Description of Artificial Sequence: Synthetic oligonucleotide
gtataatttatatattttatt

SEQ ID NO: 9486 - DNA, 21 bp, Artificial Sequence
  Description of Artificial Sequence: Synthetic oligonucleotide
taaaatatataaattatacaa

SEQ ID NO: 9487 - DNA, 21 bp, Artificial Sequence
  Description of Artificial Sequence: Synthetic oligonucleotide
tataatttatatattttattc

SEQ ID NO: 9488 - DNA, 21 bp, Artificial Sequence
  Description of Artificial Sequence: Synthetic oligonucleotide
ataaaatatataaattataca

SEQ ID NO: 9489 - DNA, 21 bp, Artificial Sequence
  Description of Artificial Sequence: Synthetic oligonucleotide
ataatttatatattttattct

SEQ ID NO: 9490 - DNA, 21 bp, Artificial Sequence
  Description of Artificial Sequence: Synthetic oligonucleotide
aataaaatatataaattatac

SEQ ID NO: 9491 - DNA, 21 bp, Artificial Sequence
  Description of Artificial Sequence: Synthetic oligonucleotide
taatttatatattttattcta

SEQ ID NO: 9492 - DNA, 21 bp, Artificial Sequence
  Description of Artificial Sequence: Synthetic oligonucleotide
gaataaaatatataaattata

SEQ ID NO: 9493 - DNA, 21 bp, Artificial Sequence
  Description of Artificial Sequence: Synthetic oligonucleotide
aatttatatattttattctat

SEQ ID NO: 9494 - DNA, 21 bp, Artificial Sequence
  Description of Artificial Sequence: Synthetic oligonucleotide
agaataaaatatataaattat

SEQ ID NO: 9495 - DNA, 21 bp, Artificial Sequence
  Description of Artificial Sequence: Synthetic oligonucleotide
atttatatattttattctatg

SEQ ID NO: 9496 - DNA, 21 bp, Artificial Sequence
  Description of Artificial Sequence: Synthetic oligonucleotide
tagaataaaatatataaatta

SEQ ID NO: 9497 - DNA, 21 bp, Artificial Sequence
  Description of Artificial Sequence: Synthetic oligonucleotide
tttatatattttattctatgt

SEQ ID NO: 9498 - DNA, 21 bp, Artificial Sequence
  Description of Artificial Sequence: Synthetic oligonucleotide
atagaataaaatatataaatt

SEQ ID NO: 9499 - DNA, 21 bp, Artificial Sequence
  Description of Artificial Sequence: Synthetic oligonucleotide
ttatatattttattctatgtg

SEQ ID NO: 9500 - DNA, 21 bp, Artificial Sequence
  Description of Artificial Sequence: Synthetic oligonucleotide
catagaataaaatatataaat

SEQ ID NO: 9501 - DNA, 21 bp, Artificial Sequence
  Description of Artificial Sequence: Synthetic oligonucleotide
tatatattttattctatgtgt

SEQ ID NO: 9502 - DNA, 21 bp, Artificial Sequence
  Description of Artificial Sequence: Synthetic oligonucleotide
acatagaataaaatatataaa

SEQ ID NO: 9503 - DNA, 21 bp, Artificial Sequence
  Description of Artificial Sequence: Synthetic oligonucleotide
atatattttattctatgtgtt

SEQ ID NO: 9504 - DNA, 21 bp, Artificial Sequence
  Description of Artificial Sequence: Synthetic oligonucleotide
cacatagaataaaatatataa

SEQ ID NO: 9505 - DNA, 21 bp, Artificial Sequence
  Description of Artificial Sequence: Synthetic oligonucleotide
tatattttattctatgtgttc

SEQ ID NO: 9506 - DNA, 21 bp, Artificial Sequence
  Description of Artificial Sequence: Synthetic oligonucleotide
acacatagaataaaatatata

SEQ ID NO: 9507 - DNA, 21 bp, Artificial Sequence
  Description of Artificial Sequence: Synthetic oligonucleotide
atattttattctatgtgttcc

SEQ ID NO: 9508 - DNA, 21 bp, Artificial Sequence
  Description of Artificial Sequence: Synthetic oligonucleotide
aacacatagaataaaatatat

SEQ ID NO: 9509 - DNA, 21 bp, Artificial Sequence
  Description of Artificial Sequence: Synthetic oligonucleotide
tattttattctatgtgttcca

SEQ ID NO: 9510 - DNA, 21 bp, Artificial Sequence
  Description of Artificial Sequence: Synthetic oligonucleotide
gaacacatagaataaaatata

SEQ ID NO: 9511 - DNA, 21 bp, Artificial Sequence
  Description of Artificial Sequence: Synthetic oligonucleotide
attttattctatgtgttccat

SEQ ID NO: 9512 - DNA, 21 bp, Artificial Sequence
  Description of Artificial Sequence: Synthetic oligonucleotide
ggaacacatagaataaaatat

SEQ ID NO: 9513 - DNA, 21 bp, Artificial Sequence
  Description of Artificial Sequence: Synthetic oligonucleotide
ttttattctatgtgttccata

SEQ ID NO: 9514 - DNA, 21 bp, Artificial Sequence
  Description of Artificial Sequence: Synthetic oligonucleotide
tggaacacatagaataaaata

SEQ ID NO: 9515 - DNA, 21 bp, Artificial Sequence
  Description of Artificial Sequence: Synthetic oligonucleotide
tttattctatgtgttccatag

SEQ ID NO: 9516 - DNA, 21 bp, Artificial Sequence
  Description of Artificial Sequence: Synthetic oligonucleotide
atggaacacatagaataaaat

SEQ ID NO: 9517 - DNA, 21 bp, Artificial Sequence
  Description of Artificial Sequence: Synthetic oligonucleotide
ttattctatgtgttccataga

SEQ ID NO: 9518 - DNA, 21 bp, Artificial Sequence
  Description of Artificial Sequence: Synthetic oligonucleotide
tatggaacacatagaataaaa

SEQ ID NO: 9519 - DNA, 21 bp, Artificial Sequence
  Description of Artificial Sequence: Synthetic oligonucleotide
tattctatgtgttccatagat

SEQ ID NO: 9520 - DNA, 21 bp, Artificial Sequence
  Description of Artificial Sequence: Synthetic oligonucleotide
ctatggaacacatagaataaa

SEQ ID NO: 9521 - DNA, 21 bp, Artificial Sequence
  Description of Artificial Sequence: Synthetic oligonucleotide
attctatgtgttccatagata

SEQ ID NO: 9522 - DNA, 21 bp, Artificial Sequence
  Description of Artificial Sequence: Synthetic oligonucleotide
tctatggaacacatagaataa

SEQ ID NO: 9523 - DNA, 21 bp, Artificial Sequence
  Description of Artificial Sequence: Synthetic oligonucleotide
ttctatgtgttccatagatat

SEQ ID NO: 9524 - DNA, 21 bp, Artificial Sequence
  Description of Artificial Sequence: Synthetic oligonucleotide
atctatggaacacatagaata

SEQ ID NO: 9525 - DNA, 21 bp, Artificial Sequence
  Description of Artificial Sequence: Synthetic oligonucleotide
tctatgtgttccatagatatc

SEQ ID NO: 9526 - DNA, 21 bp, Artificial Sequence
  Description of Artificial Sequence: Synthetic oligonucleotide
tatctatggaacacatagaat

SEQ ID NO: 9527 - DNA, 21 bp, Artificial Sequence
  Description of Artificial Sequence: Synthetic oligonucleotide
ctatgtgttccatagatatct

SEQ ID NO: 9528 - DNA, 21 bp, Artificial Sequence
  Description of Artificial Sequence: Synthetic oligonucleotide
atatctatggaacacatagaa

SEQ ID NO: 9529 - DNA, 21 bp, Artificial Sequence
  Description of Artificial Sequence: Synthetic oligonucleotide
tatgtgttccatagatatctt

SEQ ID NO: 9530 - DNA, 21 bp, Artificial Sequence
  Description of Artificial Sequence: Synthetic oligonucleotide
gatatctatggaacacataga

SEQ ID NO: 9531 - DNA, 21 bp, Artificial Sequence
  Description of Artificial Sequence: Synthetic oligonucleotide
atgtgttccatagatatctta

SEQ ID NO: 9532 - DNA, 21 bp, Artificial Sequence
  Description of Artificial Sequence: Synthetic oligonucleotide
agatatctatggaacacatag

SEQ ID NO: 9533 - DNA, 21 bp, Artificial Sequence
  Description of Artificial Sequence: Synthetic oligonucleotide
tgtgttccatagatatcttaa

SEQ ID NO: 9534 - DNA, 21 bp, Artificial Sequence
  Description of Artificial Sequence: Synthetic oligonucleotide
aagatatctatggaacacata

SEQ ID NO: 9535 - DNA, 21 bp, Artificial Sequence
  Description of Artificial Sequence: Synthetic oligonucleotide
gtgttccatagatatcttaat

SEQ ID NO: 9536 - DNA, 21 bp, Artificial Sequence
  Description of Artificial Sequence: Synthetic oligonucleotide
taagatatctatggaacacat

SEQ ID NO: 9537 - DNA, 21 bp, Artificial Sequence
  Description of Artificial Sequence: Synthetic oligonucleotide
tgttccatagatatcttaatg

SEQ ID NO: 9538 - DNA, 21 bp, Artificial Sequence
  Description of Artificial Sequence: Synthetic oligonucleotide
ttaagatatctatggaacaca

SEQ ID NO: 9539 - DNA, 21 bp, Artificial Sequence
  Description of Artificial Sequence: Synthetic oligonucleotide
gttccatagatatcttaatgt

SEQ ID NO: 9540 - DNA, 21 bp, Artificial Sequence
  Description of Artificial Sequence: Synthetic oligonucleotide
attaagatatctatggaacac

SEQ ID NO: 9541 - DNA, 21 bp, Artificial Sequence
  Description of Artificial Sequence: Synthetic oligonucleotide
ttccatagatatcttaatgta

SEQ ID NO: 9542 - DNA, 21 bp, Artificial Sequence
  Description of Artificial Sequence: Synthetic oligonucleotide
cattaagatatctatggaaca

SEQ ID NO: 9543 - DNA, 21 bp, Artificial Sequence
  Description of Artificial Sequence: Synthetic oligonucleotide
tccatagatatcttaatgtaa

SEQ ID NO: 9544 - DNA, 21 bp, Artificial Sequence
  Description of Artificial Sequence: Synthetic oligonucleotide
acattaagatatctatggaac

SEQ ID NO: 9545 - DNA, 21 bp, Artificial Sequence
  Description of Artificial Sequence: Synthetic oligonucleotide
ccatagatatcttaatgtaaa

SEQ ID NO: 9546 - DNA, 21 bp, Artificial Sequence
  Description of Artificial Sequence: Synthetic oligonucleotide
tacattaagatatctatggaa

SEQ ID NO: 9547 - DNA, 21 bp, Artificial Sequence
  Description of Artificial Sequence: Synthetic oligonucleotide
catagatatcttaatgtaaaa

SEQ ID NO: 9548 - DNA, 21 bp, Artificial Sequence
  Description of Artificial Sequence: Synthetic oligonucleotide
ttacattaagatatctatgga

SEQ ID NO: 9549 - DNA, 21 bp, Artificial Sequence
  Description of Artificial Sequence: Synthetic oligonucleotide
atagatatcttaatgtaaaat

SEQ ID NO: 9550 - DNA, 21 bp, Artificial Sequence
  Description of Artificial Sequence: Synthetic oligonucleotide
tttacattaagatatctatgg

SEQ ID NO: 9551 - DNA, 21 bp, Artificial Sequence
  Description of Artificial Sequence: Synthetic oligonucleotide
tagatatcttaatgtaaaatt

SEQ ID NO: 9552 - DNA, 21 bp, Artificial Sequence
  Description of Artificial Sequence: Synthetic oligonucleotide
ttttacattaagatatctatg

SEQ ID NO: 9553 - DNA, 21 bp, Artificial Sequence
  Description of Artificial Sequence: Synthetic oligonucleotide
agatatcttaatgtaaaatta

SEQ ID NO: 9554 - DNA, 21 bp, Artificial Sequence
  Description of Artificial Sequence: Synthetic oligonucleotide
attttacattaagatatctat

SEQ ID NO: 9555 - DNA, 21 bp, Artificial Sequence
  Description of Artificial Sequence: Synthetic oligonucleotide
gatatcttaatgtaaaattag

SEQ ID NO: 9556 - DNA, 21 bp, Artificial Sequence
  Description of Artificial Sequence: Synthetic oligonucleotide
aattttacattaagatatcta

SEQ ID NO: 9557 - DNA, 21 bp, Artificial Sequence
  Description of Artificial Sequence: Synthetic oligonucleotide
atatcttaatgtaaaattagt

SEQ ID NO: 9558 - DNA, 21 bp, Artificial Sequence
  Description of Artificial Sequence: Synthetic oligonucleotide
taattttacattaagatatct

SEQ ID NO: 9559 - DNA, 21 bp, Artificial Sequence
  Description of Artificial Sequence: Synthetic oligonucleotide
tatcttaatgtaaaattagtc

SEQ ID NO: 9560 - DNA, 21 bp, Artificial Sequence
  Description of Artificial Sequence: Synthetic oligonucleotide
ctaattttacattaagatatc

SEQ ID NO: 9561 - DNA, 21 bp, Artificial Sequence
  Description of Artificial Sequence: Synthetic oligonucleotide
atcttaatgtaaaattagtca

SEQ ID NO: 9562 - DNA, 21 bp, Artificial Sequence
  Description of Artificial Sequence: Synthetic oligonucleotide
actaattttacattaagatat

SEQ ID NO: 9563 - DNA, 21 bp, Artificial Sequence
  Description of Artificial Sequence: Synthetic oligonucleotide
tcttaatgtaaaattagtcat

SEQ ID NO: 9564 - DNA, 21 bp, Artificial Sequence
  Description of Artificial Sequence: Synthetic oligonucleotide
gactaattttacattaagata

SEQ ID NO: 9565 - DNA, 21 bp, Artificial Sequence
  Description of Artificial Sequence: Synthetic oligonucleotide
cttaatgtaaaattagtcatt

SEQ ID NO: 9566 - DNA, 21 bp, Artificial Sequence
  Description of Artificial Sequence: Synthetic oligonucleotide
tgactaattttacattaagat

SEQ ID NO: 9567 - DNA, 21 bp, Artificial Sequence
  Description of Artificial Sequence: Synthetic oligonucleotide
ttaatgtaaaattagtcattt

SEQ ID NO: 9568 - DNA, 21 bp, Artificial Sequence
  Description of Artificial Sequence: Synthetic oligonucleotide
atgactaattttacattaaga

SEQ ID NO: 9569 - DNA, 21 bp, Artificial Sequence
  Description of Artificial Sequence: Synthetic oligonucleotide
taatgtaaaattagtcattta

SEQ ID NO: 9570 - DNA, 21 bp, Artificial Sequence
  Description of Artificial Sequence: Synthetic oligonucleotide
aatgactaattttacattaag

SEQ ID NO: 9571 - DNA, 21 bp, Artificial Sequence
  Description of Artificial Sequence: Synthetic oligonucleotide
aatgtaaaattagtcatttaa

SEQ ID NO: 9572 - DNA, 21 bp, Artificial Sequence
  Description of Artificial Sequence: Synthetic oligonucleotide
aaatgactaattttacattaa

SEQ ID NO: 9573 - DNA, 21 bp, Artificial Sequence
  Description of Artificial Sequence: Synthetic oligonucleotide
atgtaaaattagtcatttaaa

SEQ ID NO: 9574 - DNA, 21 bp, Artificial Sequence
  Description of Artificial Sequence: Synthetic oligonucleotide
taaatgactaattttacatta

SEQ ID NO: 9575 - DNA, 21 bp, Artificial Sequence
  Description of Artificial Sequence: Synthetic oligonucleotide
tgtaaaattagtcatttaaat

SEQ ID NO: 9576 - DNA, 21 bp, Artificial Sequence
  Description of Artificial Sequence: Synthetic oligonucleotide
ttaaatgactaattttacatt

SEQ ID NO: 9577 - DNA, 21 bp, Artificial Sequence
  Description of Artificial Sequence: Synthetic oligonucleotide
gtaaaattagtcatttaaatt

SEQ ID NO: 9578 - DNA, 21 bp, Artificial Sequence
  Description of Artificial Sequence: Synthetic oligonucleotide
tttaaatgactaattttacat

SEQ ID NO: 9579 - DNA, 21 bp, Artificial Sequence
  Description of Artificial Sequence: Synthetic oligonucleotide
taaaattagtcatttaaatta

SEQ ID NO: 9580 - DNA, 21 bp, Artificial Sequence
  Description of Artificial Sequence: Synthetic oligonucleotide
atttaaatgactaattttaca

SEQ ID NO: 9581 - DNA, 21 bp, Artificial Sequence
  Description of Artificial Sequence: Synthetic oligonucleotide
aaaattagtcatttaaattac

SEQ ID NO: 9582 - DNA, 21 bp, Artificial Sequence
  Description of Artificial Sequence: Synthetic oligonucleotide
aatttaaatgactaattttac

SEQ ID NO: 9583 - DNA, 21 bp, Artificial Sequence
  Description of Artificial Sequence: Synthetic oligonucleotide
aaattagtcatttaaattaca

SEQ ID NO: 9584 - DNA, 21 bp, Artificial Sequence
  Description of Artificial Sequence: Synthetic oligonucleotide
taatttaaatgactaatttta

SEQ ID NO: 9585 - DNA, 21 bp, Artificial Sequence
  Description of Artificial Sequence: Synthetic oligonucleotide
aattagtcatttaaattacac

SEQ ID NO: 9586 - DNA, 21 bp, Artificial Sequence
  Description of Artificial Sequence: Synthetic oligonucleotide
gtaatttaaatgactaatttt

SEQ ID NO: 9587 - DNA, 21 bp, Artificial Sequence
  Description of Artificial Sequence: Synthetic oligonucleotide
attagtcatttaaattacact

SEQ ID NO: 9588 - DNA, 21 bp, Artificial Sequence
  Description of Artificial Sequence: Synthetic oligonucleotide
tgtaatttaaatgactaattt

SEQ ID NO: 9589 - DNA, 21 bp, Artificial Sequence
  Description of Artificial Sequence: Synthetic oligonucleotide
ttagtcatttaaattacactg

SEQ ID NO: 9590 - DNA, 21 bp, Artificial Sequence
  Description of Artificial Sequence: Synthetic oligonucleotide
gtgtaatttaaatgactaatt

SEQ ID NO: 9591 - DNA, 21 bp, Artificial Sequence
  Description of Artificial Sequence: Synthetic oligonucleotide
tagtcatttaaattacactgt

SEQ ID NO: 9592 - DNA, 21 bp, Artificial Sequence
  Description of Artificial Sequence: Synthetic oligonucleotide
agtgtaatttaaatgactaat

SEQ ID NO: 9593 - DNA, 21 bp, Artificial Sequence
  Description of Artificial Sequence: Synthetic oligonucleotide
agtcatttaaattacactgtc

SEQ ID NO: 9594 - DNA, 21 bp, Artificial Sequence
  Description of Artificial Sequence: Synthetic oligonucleotide
cagtgtaatttaaatgactaa

SEQ ID NO: 9595 - DNA, 21 bp, Artificial Sequence
  Description of Artificial Sequence: Synthetic oligonucleotide
gtcatttaaattacactgtca

SEQ ID NO: 9596 - DNA, 21 bp, Artificial Sequence
  Description of Artificial Sequence: Synthetic oligonucleotide
acagtgtaatttaaatgacta

SEQ ID NO: 9597 - DNA, 21 bp, Artificial Sequence
  Description of Artificial Sequence: Synthetic oligonucleotide
tcatttaaattacactgtcaa

SEQ ID NO: 9598 - DNA, 21 bp, Artificial Sequence
  Description of Artificial Sequence: Synthetic oligonucleotide
gacagtgtaatttaaatgact

SEQ ID NO: 9599 - DNA, 21 bp, Artificial Sequence
  Description of Artificial Sequence: Synthetic oligonucleotide
catttaaattacactgtcaat

SEQ ID NO: 9600 - DNA, 21 bp, Artificial Sequence
  Description of Artificial Sequence: Synthetic oligonucleotide
tgacagtgtaatttaaatgac

SEQ ID NO: 9601 - DNA, 21 bp, Artificial Sequence
  Description of Artificial Sequence: Synthetic oligonucleotide
atttaaattacactgtcaatt

SEQ ID NO: 9602 - DNA, 21 bp, Artificial Sequence
  Description of Artificial Sequence: Synthetic oligonucleotide
ttgacagtgtaatttaaatga

SEQ ID NO: 9603 - DNA, 21 bp, Artificial Sequence
  Description of Artificial Sequence: Synthetic oligonucleotide
tttaaattacactgtcaatta

SEQ ID NO: 9604 - DNA, 21 bp, Artificial Sequence
  Description of Artificial Sequence: Synthetic oligonucleotide
attgacagtgtaatttaaatg

SEQ ID NO: 9605 - DNA, 21 bp, Artificial Sequence
  Description of Artificial Sequence: Synthetic oligonucleotide
ttaaattacactgtcaattaa

SEQ ID NO: 9606 - DNA, 21 bp, Artificial Sequence
  Description of Artificial Sequence: Synthetic oligonucleotide
aattgacagtgtaatttaaat

SEQ ID NO: 9607 - DNA, 21 bp, Artificial Sequence
  Description of Artificial Sequence: Synthetic oligonucleotide
taaattacactgtcaattaaa

SEQ ID NO: 9608 - DNA, 21 bp, Artificial Sequence
  Description of Artificial Sequence: Synthetic oligonucleotide
taattgacagtgtaatttaaa

SEQ ID NO: 9609 - DNA, 21 bp, Artificial Sequence
  Description of Artificial Sequence: Synthetic oligonucleotide
aaattacactgtcaattaaaa

SEQ ID NO: 9610 - DNA, 21 bp, Artificial Sequence
  Description of Artificial Sequence: Synthetic oligonucleotide
ttaattgacagtgtaatttaa

SEQ ID NO: 9611 - DNA, 21 bp, Artificial Sequence
  Description of Artificial Sequence: Synthetic oligonucleotide
aattacactgtcaattaaaag

SEQ ID NO: 9612 - DNA, 21 bp, Artificial Sequence
  Description of Artificial Sequence: Synthetic oligonucleotide
tttaattgacagtgtaattta

SEQ ID NO: 9613 - DNA, 21 bp, Artificial Sequence
  Description of Artificial Sequence: Synthetic oligonucleotide
attacactgtcaattaaaagt

SEQ ID NO: 9614 - DNA, 21 bp, Artificial Sequence
  Description of Artificial Sequence: Synthetic oligonucleotide
ttttaattgacagtgtaattt

SEQ ID NO: 9615 - DNA, 21 bp, Artificial Sequence
  Description of Artificial Sequence: Synthetic oligonucleotide
ttacactgtcaattaaaagta

SEQ ID NO: 9616 - DNA, 21 bp, Artificial Sequence
  Description of Artificial Sequence: Synthetic oligonucleotide
cttttaattgacagtgtaatt

SEQ ID NO: 9617 - DNA, 21 bp, Artificial Sequence
  Description of Artificial Sequence: Synthetic oligonucleotide
tacactgtcaattaaaagtaa

SEQ ID NO: 9618 - DNA, 21 bp, Artificial Sequence
  Description of Artificial Sequence: Synthetic oligonucleotide
acttttaattgacagtgtaat

SEQ ID NO: 9619 - DNA, 21 bp, Artificial Sequence
  Description of Artificial Sequence: Synthetic oligonucleotide
acactgtcaattaaaagtaat

SEQ ID NO: 9620 - DNA, 21 bp, Artificial Sequence
  Description of Artificial Sequence: Synthetic oligonucleotide
tacttttaattgacagtgtaa

SEQ ID NO: 9621 - DNA, 21 bp, Artificial Sequence
  Description of Artificial Sequence: Synthetic oligonucleotide
cactgtcaattaaaagtaatg

SEQ ID NO: 9622 - DNA, 21 bp, Artificial Sequence
  Description of Artificial Sequence: Synthetic oligonucleotide
ttacttttaattgacagtgta

SEQ ID NO: 9623 - DNA, 21 bp, Artificial Sequence
  Description of Artificial Sequence: Synthetic oligonucleotide
actgtcaattaaaagtaatgg

SEQ ID NO: 9624 - DNA, 21 bp, Artificial Sequence
  Description of Artificial Sequence: Synthetic oligonucleotide
attacttttaattgacagtgt

SEQ ID NO: 9625 - DNA, 21 bp, Artificial Sequence
  Description of Artificial Sequence: Synthetic oligonucleotide
ctgtcaattaaaagtaatggg

SEQ ID NO: 9626 - DNA, 21 bp, Artificial Sequence
  Description of Artificial Sequence: Synthetic oligonucleotide
cattacttttaattgacagtg

SEQ ID NO: 9627 - DNA, 21 bp, Artificial Sequence
  Description of Artificial Sequence: Synthetic oligonucleotide
tgtcaattaaaagtaatgggc

SEQ ID NO: 9628 - DNA, 21 bp, Artificial Sequence
  Description of Artificial Sequence: Synthetic oligonucleotide
ccattacttttaattgacagt

SEQ ID NO: 9629 - DNA, 21 bp, Artificial Sequence
  Description of Artificial Sequence: Synthetic oligonucleotide
gtcaattaaaagtaatgggca

SEQ ID NO: 9630 - DNA, 21 bp, Artificial Sequence
  Description of Artificial Sequence: Synthetic oligonucleotide
cccattacttttaattgacag

SEQ ID NO: 9631 - DNA, 21 bp, Artificial Sequence
  Description of Artificial Sequence: Synthetic oligonucleotide
tcaattaaaagtaatgggcaa

SEQ ID NO: 9632 - DNA, 21 bp, Artificial Sequence
  Description of Artificial Sequence: Synthetic oligonucleotide
gcccattacttttaattgaca

SEQ ID NO: 9633 - DNA, 21 bp, Artificial Sequence
  Description of Artificial Sequence: Synthetic oligonucleotide
caattaaaagtaatgggcaag

SEQ ID NO: 9634 - DNA, 21 bp, Artificial Sequence
  Description of Artificial Sequence: Synthetic oligonucleotide
tgcccattacttttaattgac

SEQ ID NO: 9635 - DNA, 21 bp, Artificial Sequence
  Description of Artificial Sequence: Synthetic oligonucleotide
aattaaaagtaatgggcaaga

SEQ ID NO: 9636 - DNA, 21 bp, Artificial Sequence
  Description of Artificial Sequence: Synthetic oligonucleotide
ttgcccattacttttaattga

SEQ ID NO: 9637 - DNA, 21 bp, Artificial Sequence
  Description of Artificial Sequence: Synthetic oligonucleotide
attaaaagtaatgggcaagag

SEQ ID NO: 9638 - DNA, 21 bp, Artificial Sequence
  Description of Artificial Sequence: Synthetic oligonucleotide
cttgcccattacttttaattg

SEQ ID NO: 9639 - DNA, 21 bp, Artificial Sequence
  Description of Artificial Sequence: Synthetic oligonucleotide
ttaaaagtaatgggcaagaga

SEQ ID NO: 9640 - DNA, 21 bp, Artificial Sequence
  Description of Artificial Sequence: Synthetic oligonucleotide
tcttgcccattacttttaatt

SEQ ID NO: 9641 - DNA, 21 bp, Artificial Sequence
  Description of Artificial Sequence: Synthetic oligonucleotide
taaaagtaatgggcaagagat

SEQ ID NO: 9642 - DNA, 21 bp, Artificial Sequence
  Description of Artificial Sequence: Synthetic oligonucleotide
ctcttgcccattacttttaat

SEQ ID NO: 9643 - DNA, 21 bp, Artificial Sequence
  Description of Artificial Sequence: Synthetic oligonucleotide
aaaagtaatgggcaagagatt

SEQ ID NO: 9644 - DNA, 21 bp, Artificial Sequence
  Description of Artificial Sequence: Synthetic oligonucleotide
tctcttgcccattacttttaa

SEQ ID NO: 9645 - DNA, 21 bp, Artificial Sequence
  Description of Artificial Sequence: Synthetic oligonucleotide
aaagtaatgggcaagagattg

SEQ ID NO: 9646 - DNA, 21 bp, Artificial Sequence
  Description of Artificial Sequence: Synthetic oligonucleotide
atctcttgcccattactttta

SEQ ID NO: 9647 - DNA, 21 bp, Artificial Sequence
  Description of Artificial Sequence: Synthetic oligonucleotide
aagtaatgggcaagagattgc

SEQ ID NO: 9648 - DNA, 21 bp, Artificial Sequence
  Description of Artificial Sequence: Synthetic oligonucleotide
aatctcttgcccattactttt

SEQ ID NO: 9649 - DNA, 21 bp, Artificial Sequence
  Description of Artificial Sequence: Synthetic oligonucleotide
agtaatgggcaagagattgca

SEQ ID NO: 9650 - DNA, 21 bp, Artificial Sequence
  Description of Artificial Sequence: Synthetic oligonucleotide
caatctcttgcccattacttt

SEQ ID NO: 9651 - DNA, 21 bp, Artificial Sequence
  Description of Artificial Sequence: Synthetic oligonucleotide
gtaatgggcaagagattgcat

SEQ ID NO: 9652 - DNA, 21 bp, Artificial Sequence
  Description of Artificial Sequence: Synthetic oligonucleotide
gcaatctcttgcccattactt

SEQ ID NO: 9653 - DNA, 21 bp, Artificial Sequence
  Description of Artificial Sequence: Synthetic oligonucleotide
taatgggcaagagattgcatc

SEQ ID NO: 9654 - DNA, 21 bp, Artificial Sequence
  Description of Artificial Sequence: Synthetic oligonucleotide
tgcaatctcttgcccattact

SEQ ID NO: 9655 - DNA, 21 bp, Artificial Sequence
  Description of Artificial Sequence: Synthetic oligonucleotide
aatgggcaagagattgcatca

SEQ ID NO: 9656 - DNA, 21 bp, Artificial Sequence
  Description of Artificial Sequence: Synthetic oligonucleotide
atgcaatctcttgcccattac

SEQ ID NO: 9657 - DNA, 21 bp, Artificial Sequence
  Description of Artificial Sequence: Synthetic oligonucleotide
atgggcaagagattgcatcat

SEQ ID NO: 9658 - DNA, 21 bp, Artificial Sequence
  Description of Artificial Sequence: Synthetic oligonucleotide
gatgcaatctcttgcccatta

SEQ ID NO: 9659 - DNA, 21 bp, Artificial Sequence
  Description of Artificial Sequence: Synthetic oligonucleotide
tgggcaagagattgcatcata

SEQ ID NO: 9660 - DNA, 21 bp, Artificial Sequence
  Description of Artificial Sequence: Synthetic oligonucleotide
tgatgcaatctcttgcccatt

SEQ ID NO: 9661 - DNA, 21 bp, Artificial Sequence
  Description of Artificial Sequence: Synthetic oligonucleotide
gggcaagagattgcatcatac

SEQ ID NO: 9662 - DNA, 21 bp, Artificial Sequence
  Description of Artificial Sequence: Synthetic oligonucleotide
atgatgcaatctcttgcccat

SEQ ID NO: 9663 - DNA, 21 bp, Artificial Sequence
  Description of Artificial Sequence: Synthetic oligonucleotide
ggcaagagattgcatcatact

SEQ ID NO: 9664 - DNA, 21 bp, Artificial Sequence
  Description of Artificial Sequence: Synthetic oligonucleotide
tatgatgcaatctcttgccca

SEQ ID NO: 9665 - DNA, 21 bp, Artificial Sequence
  Description of Artificial Sequence: Synthetic oligonucleotide
gcaagagattgcatcatacta

SEQ ID NO: 9666 - DNA, 21 bp, Artificial Sequence
  Description of Artificial Sequence: Synthetic oligonucleotide
gtatgatgcaatctcttgccc

SEQ ID NO: 9667 - DNA, 21 bp, Artificial Sequence
  Description of Artificial Sequence: Synthetic oligonucleotide
caagagattgcatcatactaa

SEQ ID NO: 9668 - DNA, 21 bp, Artificial Sequence
  Description of Artificial Sequence: Synthetic oligonucleotide
agtatgatgcaatctcttgcc

SEQ ID NO: 9669 - DNA, 21 bp, Artificial Sequence
  Description of Artificial Sequence: Synthetic oligonucleotide
aagagattgcatcatactaat

SEQ ID NO: 9670 - DNA, 21 bp, Artificial Sequence
  Description of Artificial Sequence: Synthetic oligonucleotide
tagtatgatgcaatctcttgc

SEQ ID NO: 9671 - DNA, 21 bp, Artificial Sequence
  Description of Artificial Sequence: Synthetic oligonucleotide
agagattgcatcatactaatt

SEQ ID NO: 9672 - DNA, 21 bp, Artificial Sequence
  Description of Artificial Sequence: Synthetic oligonucleotide
ttagtatgatgcaatctcttg

SEQ ID NO: 9673 - DNA, 21 bp, Artificial Sequence
  Description of Artificial Sequence: Synthetic oligonucleotide
gagattgcatcatactaattt

SEQ ID NO: 9674 - DNA, 21 bp, Artificial Sequence
  Description of Artificial Sequence: Synthetic oligonucleotide
attagtatgatgcaatctctt

SEQ ID NO: 9675 - DNA, 21 bp, Artificial Sequence
  Description of Artificial Sequence: Synthetic oligonucleotide
agattgcatcatactaattta

SEQ ID NO: 9676 - DNA, 21 bp, Artificial Sequence
  Description of Artificial Sequence: Synthetic oligonucleotide
aattagtatgatgcaatctct

SEQ ID NO: 9677 - DNA, 21 bp, Artificial Sequence
  Description of Artificial Sequence: Synthetic oligonucleotide
gattgcatcatactaatttag

SEQ ID NO: 9678 - DNA, 21 bp, Artificial Sequence
  Description of Artificial Sequence: Synthetic oligonucleotide
aaattagtatgatgcaatctc

SEQ ID NO: 9679 - DNA, 21 bp, Artificial Sequence
  Description of Artificial Sequence: Synthetic oligonucleotide
attgcatcatactaatttagt

SEQ ID NO: 9680 - DNA, 21 bp, Artificial Sequence
  Description of Artificial Sequence: Synthetic oligonucleotide
taaattagtatgatgcaatct

SEQ ID NO: 9681 - DNA, 21 bp, Artificial Sequence
  Description of Artificial Sequence: Synthetic oligonucleotide
ttgcatcatactaatttagta

SEQ ID NO: 9682 - DNA, 21 bp, Artificial Sequence
  Description of Artificial Sequence: Synthetic oligonucleotide
ctaaattagtatgatgcaatc

SEQ ID NO: 9683 - DNA, 21 bp, Artificial Sequence
  Description of Artificial Sequence: Synthetic oligonucleotide
tgcatcatactaatttagtaa

SEQ ID NO: 9684 - DNA, 21 bp, Artificial Sequence
  Description of Artificial Sequence: Synthetic oligonucleotide
actaaattagtatgatgcaat

SEQ ID NO: 9685 - DNA, 21 bp, Artificial Sequence
  Description of Artificial Sequence: Synthetic oligonucleotide
gcatcatactaatttagtaag

SEQ ID NO: 9686 - DNA, 21 bp, Artificial Sequence
  Description of Artificial Sequence: Synthetic oligonucleotide
tactaaattagtatgatgcaa

SEQ ID NO: 9687 - DNA, 21 bp, Artificial Sequence
  Description of Artificial Sequence: Synthetic oligonucleotide
catcatactaatttagtaaga

SEQ ID NO: 9688 - DNA, 21 bp, Artificial Sequence
  Description of Artificial Sequence: Synthetic oligonucleotide
ttactaaattagtatgatgca

SEQ ID NO: 9689 - DNA, 21 bp, Artificial Sequence
  Description of Artificial Sequence: Synthetic oligonucleotide
atcatactaatttagtaagaa

SEQ ID NO: 9690 - DNA, 21 bp, Artificial Sequence
  Description of Artificial Sequence: Synthetic oligonucleotide
cttactaaattagtatgatgc

SEQ ID NO: 9691 - DNA, 21 bp, Artificial Sequence
  Description of Artificial Sequence: Synthetic oligonucleotide
tcatactaatttagtaagaac

SEQ ID NO: 9692 - DNA, 21 bp, Artificial Sequence
  Description of Artificial Sequence: Synthetic oligonucleotide
tcttactaaattagtatgatg

SEQ ID NO: 9693 - DNA, 21 bp, Artificial Sequence
  Description of Artificial Sequence: Synthetic oligonucleotide
catactaatttagtaagaacg

SEQ ID NO: 9694 - DNA, 21 bp, Artificial Sequence
  Description of Artificial Sequence: Synthetic oligonucleotide
ttcttactaaattagtatgat

SEQ ID NO: 9695 - DNA, 21 bp, Artificial Sequence
  Description of Artificial Sequence: Synthetic oligonucleotide
atactaatttagtaagaacgt

SEQ ID NO: 9696 - DNA, 21 bp, Artificial Sequence
  Description of Artificial Sequence: Synthetic oligonucleotide
gttcttactaaattagtatga

SEQ ID NO: 9697 - DNA, 21 bp, Artificial Sequence
  Description of Artificial Sequence: Synthetic oligonucleotide
tactaatttagtaagaacgtt

SEQ ID NO: 9698 - DNA, 21 bp, Artificial Sequence
  Description of Artificial Sequence: Synthetic oligonucleotide
cgttcttactaaattagtatg

SEQ ID NO: 9699 - DNA, 21 bp, Artificial Sequence
  Description of Artificial Sequence: Synthetic oligonucleotide
actaatttagtaagaacgttc

SEQ ID NO: 9700 - DNA, 21 bp, Artificial Sequence
  Description of Artificial Sequence: Synthetic oligonucleotide
acgttcttactaaattagtat

SEQ ID NO: 9701 - DNA, 21 bp, Artificial Sequence
  Description of Artificial Sequence: Synthetic oligonucleotide
ctaatttagtaagaacgttcc

SEQ ID NO: 9702 - DNA, 21 bp, Artificial Sequence
  Description of Artificial Sequence: Synthetic oligonucleotide
aacgttcttactaaattagta

SEQ ID NO: 9703 - DNA, 21 bp, Artificial Sequence
  Description of Artificial Sequence: Synthetic oligonucleotide
taatttagtaagaacgttccc

SEQ ID NO: 9704 - DNA, 21 bp, Artificial Sequence
  Description of Artificial Sequence: Synthetic oligonucleotide
gaacgttcttactaaattagt

SEQ ID NO: 9705 - DNA, 21 bp, Artificial Sequence
  Description of Artificial Sequence: Synthetic oligonucleotide
aatttagtaagaacgttccca

SEQ ID NO: 9706 - DNA, 21 bp, Artificial Sequence
  Description of Artificial Sequence: Synthetic oligonucleotide
ggaacgttcttactaaattag

SEQ ID NO: 9707 - DNA, 21 bp, Artificial Sequence
  Description of Artificial Sequence: Synthetic oligonucleotide
atttagtaagaacgttcccaa

SEQ ID NO: 9708 - DNA, 21 bp, Artificial Sequence
  Description of Artificial Sequence: Synthetic oligonucleotide
gggaacgttcttactaaatta

SEQ ID NO: 9709 - DNA, 21 bp, Artificial Sequence
  Description of Artificial Sequence: Synthetic oligonucleotide
tttagtaagaacgttcccaaa

SEQ ID NO: 9710 - DNA, 21 bp, Artificial Sequence
  Description of Artificial Sequence: Synthetic oligonucleotide
tgggaacgttcttactaaatt

SEQ ID NO: 9711 - DNA, 21 bp, Artificial Sequence
  Description of Artificial Sequence: Synthetic oligonucleotide
ttagtaagaacgttcccaaat

SEQ ID NO: 9712 - DNA, 21 bp, Artificial Sequence
  Description of Artificial Sequence: Synthetic oligonucleotide
ttgggaacgttcttactaaat

SEQ ID NO: 9713 - DNA, 21 bp, Artificial Sequence
  Description of Artificial Sequence: Synthetic oligonucleotide
tagtaagaacgttcccaaatg

SEQ ID NO: 9714 - DNA, 21 bp, Artificial Sequence
  Description of Artificial Sequence: Synthetic oligonucleotide
tttgggaacgttcttactaaa

SEQ ID NO: 9715 - DNA, 21 bp, Artificial Sequence
  Description of Artificial Sequence: Synthetic oligonucleotide
agtaagaacgttcccaaatgt

SEQ ID NO: 9716 - DNA, 21 bp, Artificial Sequence
  Description of Artificial Sequence: Synthetic oligonucleotide
atttgggaacgttcttactaa

SEQ ID NO: 9717 - DNA, 21 bp, Artificial Sequence
  Description of Artificial Sequence: Synthetic oligonucleotide
gtaagaacgttcccaaatgtt

SEQ ID NO: 9718 - DNA, 21 bp, Artificial Sequence
  Description of Artificial Sequence: Synthetic oligonucleotide
catttgggaacgttcttacta

SEQ ID NO: 9719 - DNA, 21 bp, Artificial Sequence
  Description of Artificial Sequence: Synthetic oligonucleotide
taagaacgttcccaaatgttg

SEQ ID NO: 9720 - DNA, 21 bp, Artificial Sequence
  Description of Artificial Sequence: Synthetic oligonucleotide
acatttgggaacgttcttact

SEQ ID NO: 9721 - DNA, 21 bp, Artificial Sequence
  Description of Artificial Sequence: Synthetic oligonucleotide
aagaacgttcccaaatgttgt

SEQ ID NO: 9722 - DNA, 21 bp, Artificial Sequence
  Description of Artificial Sequence: Synthetic oligonucleotide
aacatttgggaacgttcttac

SEQ ID NO: 9723 - DNA, 21 bp, Artificial Sequence
  Description of Artificial Sequence: Synthetic oligonucleotide
agaacgttcccaaatgttgta

SEQ ID NO: 9724 - DNA, 21 bp, Artificial Sequence
  Description of Artificial Sequence: Synthetic oligonucleotide
caacatttgggaacgttctta

SEQ ID NO: 9725 - DNA, 21 bp, Artificial Sequence
  Description of Artificial Sequence: Synthetic oligonucleotide
gaacgttcccaaatgttgtaa

SEQ ID NO: 9726 - DNA, 21 bp, Artificial Sequence
  Description of Artificial Sequence: Synthetic oligonucleotide
acaacatttgggaacgttctt

SEQ ID NO: 9727 - DNA, 21 bp, Artificial Sequence
  Description of Artificial Sequence: Synthetic oligonucleotide
aacgttcccaaatgttgtaac

SEQ ID NO: 9728 - DNA, 21 bp, Artificial Sequence
  Description of Artificial Sequence: Synthetic oligonucleotide
tacaacatttgggaacgttct

SEQ ID NO: 9729 - DNA, 21 bp, Artificial Sequence
  Description of Artificial Sequence: Synthetic oligonucleotide
acgttcccaaatgttgtaaca

SEQ ID NO: 9730 - DNA, 21 bp, Artificial Sequence
  Description of Artificial Sequence: Synthetic oligonucleotide
ttacaacatttgggaacgttc

SEQ ID NO: 9731 - DNA, 21 bp, Artificial Sequence
  Description of Artificial Sequence: Synthetic oligonucleotide
cgttcccaaatgttgtaacaa

SEQ ID NO: 9732 - DNA, 21 bp, Artificial Sequence
  Description of Artificial Sequence: Synthetic oligonucleotide
gttacaacatttgggaacgtt

SEQ ID NO: 9733 - DNA, 21 bp, Artificial Sequence
  Description of Artificial Sequence: Synthetic oligonucleotide
gttcccaaatgttgtaacaat

SEQ ID NO: 9734 - DNA, 21 bp, Artificial Sequence
  Description of Artificial Sequence: Synthetic oligonucleotide
tgttacaacatttgggaacgt

SEQ ID NO: 9735 - DNA, 21 bp, Artificial Sequence
  Description of Artificial Sequence: Synthetic oligonucleotide
ttcccaaatgttgtaacaatg

SEQ ID NO: 9736 - DNA, 21 bp, Artificial Sequence
  Description of Artificial Sequence: Synthetic oligonucleotide
ttgttacaacatttgggaacg

SEQ ID NO: 9737 - DNA, 21 bp, Artificial Sequence
  Description of Artificial Sequence: Synthetic oligonucleotide
tcccaaatgttgtaacaatgt

SEQ ID NO: 9738 - DNA, 21 bp, Artificial Sequence
  Description of Artificial Sequence: Synthetic oligonucleotide
attgttacaacatttgggaac

SEQ ID NO: 9739 - DNA, 21 bp, Artificial Sequence
  Description of Artificial Sequence: Synthetic oligonucleotide
cccaaatgttgtaacaatgtg

SEQ ID NO: 9740 - DNA, 21 bp, Artificial Sequence
  Description of Artificial Sequence: Synthetic oligonucleotide
cattgttacaacatttgggaa

SEQ ID NO: 9741 - DNA, 21 bp, Artificial Sequence
  Description of Artificial Sequence: Synthetic oligonucleotide
ccaaatgttgtaacaatgtgg

SEQ ID NO: 9742 - DNA, 21 bp, Artificial Sequence
  Description of Artificial Sequence: Synthetic oligonucleotide
acattgttacaacatttggga

SEQ ID NO: 9743 - DNA, 21 bp, Artificial Sequence
  Description of Artificial Sequence: Synthetic oligonucleotide
caaatgttgtaacaatgtgga

SEQ ID NO: 9744 - DNA, 21 bp, Artificial Sequence
  Description of Artificial Sequence: Synthetic oligonucleotide
cacattgttacaacatttggg

SEQ ID NO: 9745 - DNA, 21 bp, Artificial Sequence
  Description of Artificial Sequence: Synthetic oligonucleotide
aaatgttgtaacaatgtggat

SEQ ID NO: 9746 - DNA, 21 bp, Artificial Sequence
  Description of Artificial Sequence: Synthetic oligonucleotide
ccacattgttacaacatttgg

SEQ ID NO: 9747 - DNA, 21 bp, Artificial Sequence
  Description of Artificial Sequence: Synthetic oligonucleotide
aatgttgtaacaatgtggatc

SEQ ID NO: 9748 - DNA, 21 bp, Artificial Sequence
  Description of Artificial Sequence: Synthetic oligonucleotide
tccacattgttacaacatttg

SEQ ID NO: 9749 - DNA, 21 bp, Artificial Sequence
  Description of Artificial Sequence: Synthetic oligonucleotide
atgttgtaacaatgtggatca

SEQ ID NO: 9750 - DNA, 21 bp, Artificial Sequence
  Description of Artificial Sequence: Synthetic oligonucleotide
atccacattgttacaacattt

SEQ ID NO: 9751 - DNA, 21 bp, Artificial Sequence
  Description of Artificial Sequence: Synthetic oligonucleotide
tgttgtaacaatgtggatcat

SEQ ID NO: 9752 - DNA, 21 bp, Artificial Sequence
  Description of Artificial Sequence: Synthetic oligonucleotide
gatccacattgttacaacatt

SEQ ID NO: 9753 - DNA, 21 bp, Artificial Sequence
  Description of Artificial Sequence: Synthetic oligonucleotide
gttgtaacaatgtggatcata

SEQ ID NO: 9754 - DNA, 21 bp, Artificial Sequence
  Description of Artificial Sequence: Synthetic oligonucleotide
tgatccacattgttacaacat

SEQ ID NO: 9755 - DNA, 21 bp, Artificial Sequence
  Description of Artificial Sequence: Synthetic oligonucleotide
ttgtaacaatgtggatcatac

SEQ ID NO: 9756 - DNA, 21 bp, Artificial Sequence
  Description of Artificial Sequence: Synthetic oligonucleotide
atgatccacattgttacaaca

SEQ ID NO: 9757 - DNA, 21 bp, Artificial Sequence
  Description of Artificial Sequence: Synthetic oligonucleotide
tgtaacaatgtggatcataca

SEQ ID NO: 9758 - DNA, 21 bp, Artificial Sequence
  Description of Artificial Sequence: Synthetic oligonucleotide
tatgatccacattgttacaac

SEQ ID NO: 9759 - DNA, 21 bp, Artificial Sequence
  Description of Artificial Sequence: Synthetic oligonucleotide
gtaacaatgtggatcatacat

SEQ ID NO: 9760 - DNA, 21 bp, Artificial Sequence
  Description of Artificial Sequence: Synthetic oligonucleotide
gtatgatccacattgttacaa

SEQ ID NO: 9761 - DNA, 21 bp, Artificial Sequence
  Description of Artificial Sequence: Synthetic oligonucleotide
taacaatgtggatcatacatc

SEQ ID NO: 9762 - DNA, 21 bp, Artificial Sequence
  Description of Artificial Sequence: Synthetic oligonucleotide
tgtatgatccacattgttaca

SEQ ID NO: 9763 - DNA, 21 bp, Artificial Sequence
  Description of Artificial Sequence: Synthetic oligonucleotide
aacaatgtggatcatacatct

SEQ ID NO: 9764 - DNA, 21 bp, Artificial Sequence
  Description of Artificial Sequence: Synthetic oligonucleotide
atgtatgatccacattgttac

SEQ ID NO: 9765 - DNA, 21 bp, Artificial Sequence
  Description of Artificial Sequence: Synthetic oligonucleotide
acaatgtggatcatacatctc

SEQ ID NO: 9766 - DNA, 21 bp, Artificial Sequence
  Description of Artificial Sequence: Synthetic oligonucleotide
gatgtatgatccacattgtta

SEQ ID NO: 9767 - DNA, 21 bp, Artificial Sequence
  Description of Artificial Sequence: Synthetic oligonucleotide
caatgtggatcatacatctct

SEQ ID NO: 9768 - DNA, 21 bp, Artificial Sequence
  Description of Artificial Sequence: Synthetic oligonucleotide
agatgtatgatccacattgtt

SEQ ID NO: 9769 - DNA, 21 bp, Artificial Sequence
  Description of Artificial Sequence: Synthetic oligonucleotide
aatgtggatcatacatctctg

SEQ ID NO: 9770 - DNA, 21 bp, Artificial Sequence
  Description of Artificial Sequence: Synthetic oligonucleotide
gagatgtatgatccacattgt

SEQ ID NO: 9771 - DNA, 21 bp, Artificial Sequence
  Description of Artificial Sequence: Synthetic oligonucleotide
atgtggatcatacatctctgg

SEQ ID NO: 9772 - DNA, 21 bp, Artificial Sequence
  Description of Artificial Sequence: Synthetic oligonucleotide
agagatgtatgatccacattg

SEQ ID NO: 9773 - DNA, 21 bp, Artificial Sequence
  Description of Artificial Sequence: Synthetic oligonucleotide
tgtggatcatacatctctggt

SEQ ID NO: 9774 - DNA, 21 bp, Artificial Sequence
  Description of Artificial Sequence: Synthetic oligonucleotide
cagagatgtatgatccacatt

SEQ ID NO: 9775 - DNA, 21 bp, Artificial Sequence
  Description of Artificial Sequence: Synthetic oligonucleotide
gtggatcatacatctctggtt

SEQ ID NO: 9776 - DNA, 21 bp, Artificial Sequence
  Description of Artificial Sequence: Synthetic oligonucleotide
ccagagatgtatgatccacat

SEQ ID NO: 9777 - DNA, 21 bp, Artificial Sequence
  Description of Artificial Sequence: Synthetic oligonucleotide
tggatcatacatctctggttt

SEQ ID NO: 9778 - DNA, 21 bp, Artificial Sequence
  Description of Artificial Sequence: Synthetic oligonucleotide
accagagatgtatgatccaca

SEQ ID NO: 9779 - DNA, 21 bp, Artificial Sequence
  Description of Artificial Sequence: Synthetic oligonucleotide
ggatcatacatctctggtttt

SEQ ID NO: 9780 - DNA, 21 bp, Artificial Sequence
  Description of Artificial Sequence: Synthetic oligonucleotide
aaccagagatgtatgatccac

SEQ ID NO: 9781 - DNA, 21 bp, Artificial Sequence
  Description of Artificial Sequence: Synthetic oligonucleotide
gatcatacatctctggttttt

SEQ ID NO: 9782 - DNA, 21 bp, Artificial Sequence
  Description of Artificial Sequence: Synthetic oligonucleotide
aaaccagagatgtatgatcca

SEQ ID NO: 9783 - DNA, 21 bp, Artificial Sequence
  Description of Artificial Sequence: Synthetic oligonucleotide
atcatacatctctggtttttt

SEQ ID NO: 9784 - DNA, 21 bp, Artificial Sequence
  Description of Artificial Sequence: Synthetic oligonucleotide
aaaaccagagatgtatgatcc

SEQ ID NO: 9785 - DNA, 21 bp, Artificial Sequence
  Description of Artificial Sequence: Synthetic oligonucleotide
tcatacatctctggtttttta

SEQ ID NO: 9786 - DNA, 21 bp, Artificial Sequence
  Description of Artificial Sequence: Synthetic oligonucleotide
aaaaaccagagatgtatgatc

SEQ ID NO: 9787 - DNA, 21 bp, Artificial Sequence
  Description of Artificial Sequence: Synthetic oligonucleotide
catacatctctggttttttaa

SEQ ID NO: 9788 - DNA, 21 bp, Artificial Sequence
  Description of Artificial Sequence: Synthetic oligonucleotide
aaaaaaccagagatgtatgat

SEQ ID NO: 9789 - DNA, 21 bp, Artificial Sequence
  Description of Artificial Sequence: Synthetic oligonucleotide
atacatctctggttttttaaa

SEQ ID NO: 9790 - DNA, 21 bp, Artificial Sequence
  Description of Artificial Sequence: Synthetic oligonucleotide
taaaaaaccagagatgtatga

SEQ ID NO: 9791 - DNA, 21 bp, Artificial Sequence
  Description of Artificial Sequence: Synthetic oligonucleotide
tacatctctggttttttaaat

SEQ ID NO: 9792 - DNA, 21 bp, Artificial Sequence
  Description of Artificial Sequence: Synthetic oligonucleotide
ttaaaaaaccagagatgtatg

SEQ ID NO: 9793 - DNA, 21 bp, Artificial Sequence
  Description of Artificial Sequence: Synthetic oligonucleotide
acatctctggttttttaaatg

SEQ ID NO: 9794 - DNA, 21 bp, Artificial Sequence
  Description of Artificial Sequence: Synthetic oligonucleotide
tttaaaaaaccagagatgtat

SEQ ID NO: 9795 - DNA, 21 bp, Artificial Sequence
  Description of Artificial Sequence: Synthetic oligonucleotide
catctctggttttttaaatgt

SEQ ID NO: 9796 - DNA, 21 bp, Artificial Sequence
  Description of Artificial Sequence: Synthetic oligonucleotide
atttaaaaaaccagagatgta

SEQ ID NO: 9797 - DNA, 21 bp, Artificial Sequence
  Description of Artificial Sequence: Synthetic oligonucleotide
atctctggttttttaaatgta

SEQ ID NO: 9798 - DNA, 21 bp, Artificial Sequence
  Description of Artificial Sequence: Synthetic oligonucleotide
catttaaaaaaccagagatgt

SEQ ID NO: 9799 - DNA, 21 bp, Artificial Sequence
  Description of Artificial Sequence: Synthetic oligonucleotide
tctctggttttttaaatgtat

SEQ ID NO: 9800 - DNA, 21 bp, Artificial Sequence
  Description of Artificial Sequence: Synthetic oligonucleotide
acatttaaaaaaccagagatg

SEQ ID NO: 9801 - DNA, 21 bp, Artificial Sequence
  Description of Artificial Sequence: Synthetic oligonucleotide
ctctggttttttaaatgtatt

SEQ ID NO: 9802 - DNA, 21 bp, Artificial Sequence
  Description of Artificial Sequence: Synthetic oligonucleotide
tacatttaaaaaaccagagat

SEQ ID NO: 9803 - DNA, 21 bp, Artificial Sequence
  Description of Artificial Sequence: Synthetic oligonucleotide
tctggttttttaaatgtattg

SEQ ID NO: 9804 - DNA, 21 bp, Artificial Sequence
  Description of Artificial Sequence: Synthetic oligonucleotide
atacatttaaaaaaccagaga

SEQ ID NO: 9805 - DNA, 21 bp, Artificial Sequence
  Description of Artificial Sequence: Synthetic oligonucleotide
ctggttttttaaatgtattga

SEQ ID NO: 9806 - DNA, 21 bp, Artificial Sequence
  Description of Artificial Sequence: Synthetic oligonucleotide
aatacatttaaaaaaccagag

SEQ ID NO: 9807 - DNA, 21 bp, Artificial Sequence
  Description of Artificial Sequence: Synthetic oligonucleotide
tggttttttaaatgtattgag

SEQ ID NO: 9808 - DNA, 21 bp, Artificial Sequence
  Description of Artificial Sequence: Synthetic oligonucleotide
caatacatttaaaaaaccaga

SEQ ID NO: 9809 - DNA, 21 bp, Artificial Sequence
  Description of Artificial Sequence: Synthetic oligonucleotide
ggttttttaaatgtattgagg

SEQ ID NO: 9810 - DNA, 21 bp, Artificial Sequence
  Description of Artificial Sequence: Synthetic oligonucleotide
tcaatacatttaaaaaaccag

SEQ ID NO: 9811 - DNA, 21 bp, Artificial Sequence
  Description of Artificial Sequence: Synthetic oligonucleotide
gttttttaaatgtattgaggc

SEQ ID NO: 9812 - DNA, 21 bp, Artificial Sequence
  Description of Artificial Sequence: Synthetic oligonucleotide
ctcaatacatttaaaaaacca

SEQ ID NO: 9813 - DNA, 21 bp, Artificial Sequence
  Description of Artificial Sequence: Synthetic oligonucleotide
ttttttaaatgtattgaggct

SEQ ID NO: 9814 - DNA, 21 bp, Artificial Sequence
  Description of Artificial Sequence: Synthetic oligonucleotide
cctcaatacatttaaaaaacc

SEQ ID NO: 9815 - DNA, 21 bp, Artificial Sequence
  Description of Artificial Sequence: Synthetic oligonucleotide
tttttaaatgtattgaggctt

SEQ ID NO: 9816 - DNA, 21 bp, Artificial Sequence
  Description of Artificial Sequence: Synthetic oligonucleotide
gcctcaatacatttaaaaaac

SEQ ID NO: 9817 - DNA, 21 bp, Artificial Sequence
  Description of Artificial Sequence: Synthetic oligonucleotide
ttttaaatgtattgaggcttt

SEQ ID NO: 9818 - DNA, 21 bp, Artificial Sequence
  Description of Artificial Sequence: Synthetic oligonucleotide
agcctcaatacatttaaaaaa

SEQ ID NO: 9819 - DNA, 21 bp, Artificial Sequence
  Description of Artificial Sequence: Synthetic oligonucleotide
tttaaatgtattgaggctttc

SEQ ID NO: 9820 - DNA, 21 bp, Artificial Sequence
  Description of Artificial Sequence: Synthetic oligonucleotide
aagcctcaatacatttaaaaa

SEQ ID NO: 9821 - DNA, 21 bp, Artificial Sequence
  Description of Artificial Sequence: Synthetic oligonucleotide
ttaaatgtattgaggctttct

SEQ ID NO: 9822 - DNA, 21 bp, Artificial Sequence
  Description of Artificial Sequence: Synthetic oligonucleotide
aaagcctcaatacatttaaaa

SEQ ID NO: 9823 - DNA, 21 bp, Artificial Sequence
  Description of Artificial Sequence: Synthetic oligonucleotide
taaatgtattgaggctttctt

SEQ ID NO: 9824 - DNA, 21 bp, Artificial Sequence
  Description of Artificial Sequence: Synthetic oligonucleotide
gaaagcctcaatacatttaaa

SEQ ID NO: 9825 - DNA, 21 bp, Artificial Sequence
  Description of Artificial Sequence: Synthetic oligonucleotide
aaatgtattgaggctttcttg

SEQ ID NO: 9826 - DNA, 21 bp, Artificial Sequence
  Description of Artificial Sequence: Synthetic oligonucleotide
agaaagcctcaatacatttaa

SEQ ID NO: 9827 - DNA, 21 bp, Artificial Sequence
  Description of Artificial Sequence: Synthetic oligonucleotide
aatgtattgaggctttcttgg

SEQ ID NO: 9828 - DNA, 21 bp, Artificial Sequence
  Description of Artificial Sequence: Synthetic oligonucleotide
aagaaagcctcaatacattta

SEQ ID NO: 9829 - DNA, 21 bp, Artificial Sequence
  Description of Artificial Sequence: Synthetic oligonucleotide
atgtattgaggctttcttggt

SEQ ID NO: 9830 - DNA, 21 bp, Artificial Sequence
  Description of Artificial Sequence: Synthetic oligonucleotide
caagaaagcctcaatacattt

SEQ ID NO: 9831 - DNA, 21 bp, Artificial Sequence
  Description of Artificial Sequence: Synthetic oligonucleotide
tgtattgaggctttcttggtg

SEQ ID NO: 9832 - DNA, 21 bp, Artificial Sequence
  Description of Artificial Sequence: Synthetic oligonucleotide
ccaagaaagcctcaatacatt

SEQ ID NO: 9833 - DNA, 21 bp, Artificial Sequence
  Description of Artificial Sequence: Synthetic oligonucleotide
gtattgaggctttcttggtgg

SEQ ID NO: 9834 - DNA, 21 bp, Artificial Sequence
  Description of Artificial Sequence: Synthetic oligonucleotide
accaagaaagcctcaatacat

SEQ ID NO: 9835 - DNA, 21 bp, Artificial Sequence
  Description of Artificial Sequence: Synthetic oligonucleotide
tattgaggctttcttggtgga

SEQ ID NO: 9836 - DNA, 21 bp, Artificial Sequence
  Description of Artificial Sequence: Synthetic oligonucleotide
caccaagaaagcctcaataca

SEQ ID NO: 9837 - DNA, 21 bp, Artificial Sequence
  Description of Artificial Sequence: Synthetic oligonucleotide
attgaggctttcttggtggac

SEQ ID NO: 9838 - DNA, 21 bp, Artificial Sequence
  Description of Artificial Sequence: Synthetic oligonucleotide
ccaccaagaaagcctcaatac

SEQ ID NO: 9839 - DNA, 21 bp, Artificial Sequence
  Description of Artificial Sequence: Synthetic oligonucleotide
ttgaggctttcttggtggact

SEQ ID NO: 9840 - DNA, 21 bp, Artificial Sequence
  Description of Artificial Sequence: Synthetic oligonucleotide
tccaccaagaaagcctcaata

SEQ ID NO: 9841 - DNA, 21 bp, Artificial Sequence
  Description of Artificial Sequence: Synthetic oligonucleotide
tgaggctttcttggtggacta

SEQ ID NO: 9842 - DNA, 21 bp, Artificial Sequence
  Description of Artificial Sequence: Synthetic oligonucleotide
gtccaccaagaaagcctcaat

SEQ ID NO: 9843 - DNA, 21 bp, Artificial Sequence
  Description of Artificial Sequence: Synthetic oligonucleotide
gaggctttcttggtggactag

SEQ ID NO: 9844 - DNA, 21 bp, Artificial Sequence
  Description of Artificial Sequence: Synthetic oligonucleotide
agtccaccaagaaagcctcaa

SEQ ID NO: 9845 - DNA, 21 bp, Artificial Sequence
  Description of Artificial Sequence: Synthetic oligonucleotide
aggctttcttggtggactagt

SEQ ID NO: 9846 - DNA, 21 bp, Artificial Sequence
  Description of Artificial Sequence: Synthetic oligonucleotide
tagtccaccaagaaagcctca

SEQ ID NO: 9847 - DNA, 21 bp, Artificial Sequence
  Description of Artificial Sequence: Synthetic oligonucleotide
ggctttcttggtggactagta

SEQ ID NO: 9848 - DNA, 21 bp, Artificial Sequence
  Description of Artificial Sequence: Synthetic oligonucleotide
ctagtccaccaagaaagcctc

SEQ ID NO: 9849 - DNA, 21 bp, Artificial Sequence
  Description of Artificial Sequence: Synthetic oligonucleotide
gctttcttggtggactagtat

SEQ ID NO: 9850 - DNA, 21 bp, Artificial Sequence
  Description of Artificial Sequence: Synthetic oligonucleotide
actagtccaccaagaaagcct

SEQ ID NO: 9851 - DNA, 21 bp, Artificial Sequence
  Description of Artificial Sequence: Synthetic oligonucleotide
ctttcttggtggactagtata

SEQ ID NO: 9852 - DNA, 21 bp, Artificial Sequence
  Description of Artificial Sequence: Synthetic oligonucleotide
tactagtccaccaagaaagcc

SEQ ID NO: 9853 - DNA, 21 bp, Artificial Sequence
  Description of Artificial Sequence: Synthetic oligonucleotide
tttcttggtggactagtatag

SEQ ID NO: 9854 - DNA, 21 bp, Artificial Sequence
  Description of Artificial Sequence: Synthetic oligonucleotide
atactagtccaccaagaaagc

SEQ ID NO: 9855 - DNA, 21 bp, Artificial Sequence
  Description of Artificial Sequence: Synthetic oligonucleotide
ttcttggtggactagtatagt

SEQ ID NO: 9856 - DNA, 21 bp, Artificial Sequence
  Description of Artificial Sequence: Synthetic oligonucleotide
tatactagtccaccaagaaag

SEQ ID NO: 9857 - DNA, 21 bp, Artificial Sequence
  Description of Artificial Sequence: Synthetic oligonucleotide
tcttggtggactagtatagta

SEQ ID NO: 9858 - DNA, 21 bp, Artificial Sequence
  Description of Artificial Sequence: Synthetic oligonucleotide
ctatactagtccaccaagaaa

SEQ ID NO: 9859 - DNA, 21 bp, Artificial Sequence
  Description of Artificial Sequence: Synthetic oligonucleotide
cttggtggactagtatagtat

SEQ ID NO: 9860 - DNA, 21 bp, Artificial Sequence
  Description of Artificial Sequence: Synthetic oligonucleotide
actatactagtccaccaagaa

SEQ ID NO: 9861 - DNA, 21 bp, Artificial Sequence
  Description of Artificial Sequence: Synthetic oligonucleotide
ttggtggactagtatagtata

SEQ ID NO: 9862 - DNA, 21 bp, Artificial Sequence
  Description of Artificial Sequence: Synthetic oligonucleotide
tactatactagtccaccaaga

SEQ ID NO: 9863 - DNA, 21 bp, Artificial Sequence
  Description of Artificial Sequence: Synthetic oligonucleotide
tggtggactagtatagtatac

SEQ ID NO: 9864 - DNA, 21 bp, Artificial Sequence
  Description of Artificial Sequence: Synthetic oligonucleotide
atactatactagtccaccaag

SEQ ID NO: 9865 - DNA, 21 bp, Artificial Sequence
  Description of Artificial Sequence: Synthetic oligonucleotide
ggtggactagtatagtatacg

SEQ ID NO: 9866 - DNA, 21 bp, Artificial Sequence
  Description of Artificial Sequence: Synthetic oligonucleotide
tatactatactagtccaccaa

SEQ ID NO: 9867 - DNA, 21 bp, Artificial Sequence
  Description of Artificial Sequence: Synthetic oligonucleotide
gtggactagtatagtatacgg

SEQ ID NO: 9868 - DNA, 21 bp, Artificial Sequence
  Description of Artificial Sequence: Synthetic oligonucleotide
gtatactatactagtccacca

SEQ ID NO: 9869 - DNA, 21 bp, Artificial Sequence
  Description of Artificial Sequence: Synthetic oligonucleotide
tggactagtatagtatacggt

SEQ ID NO: 9870 - DNA, 21 bp, Artificial Sequence
  Description of Artificial Sequence: Synthetic oligonucleotide
cgtatactatactagtccacc

SEQ ID NO: 9871 - DNA, 21 bp, Artificial Sequence
  Description of Artificial Sequence: Synthetic oligonucleotide
ggactagtatagtatacggtc

SEQ ID NO: 9872 - DNA, 21 bp, Artificial Sequence
  Description of Artificial Sequence: Synthetic oligonucleotide
ccgtatactatactagtccac

SEQ ID NO: 9873 - DNA, 21 bp, Artificial Sequence
  Description of Artificial Sequence: Synthetic oligonucleotide
gactagtatagtatacggtca

SEQ ID NO: 9874 - DNA, 21 bp, Artificial Sequence
  Description of Artificial Sequence: Synthetic oligonucleotide
accgtatactatactagtcca

SEQ ID NO: 9875 - DNA, 21 bp, Artificial Sequence
  Description of Artificial Sequence: Synthetic oligonucleotide
actagtatagtatacggtcag

SEQ ID NO: 9876 - DNA, 21 bp, Artificial Sequence
  Description of Artificial Sequence: Synthetic oligonucleotide
gaccgtatactatactagtcc

SEQ ID NO: 9877 - DNA, 21 bp, Artificial Sequence
  Description of Artificial Sequence: Synthetic oligonucleotide
ctagtatagtatacggtcagt

SEQ ID NO: 9878 - DNA, 21 bp, Artificial Sequence
  Description of Artificial Sequence: Synthetic oligonucleotide
tgaccgtatactatactagtc

SEQ ID NO: 9879 - DNA, 21 bp, Artificial Sequence
  Description of Artificial Sequence: Synthetic oligonucleotide
tagtatagtatacggtcagtt

SEQ ID NO: 9880 - DNA, 21 bp, Artificial Sequence
  Description of Artificial Sequence: Synthetic oligonucleotide
ctgaccgtatactatactagt

SEQ ID NO: 9881 - DNA, 21 bp, Artificial Sequence
  Description of Artificial Sequence: Synthetic oligonucleotide
agtatagtatacggtcagtta

SEQ ID NO: 9882 - DNA, 21 bp, Artificial Sequence
  Description of Artificial Sequence: Synthetic oligonucleotide
actgaccgtatactatactag

SEQ ID NO: 9883 - DNA, 21 bp, Artificial Sequence
  Description of Artificial Sequence: Synthetic oligonucleotide
gtatagtatacggtcagttat

SEQ ID NO: 9884 - DNA, 21 bp, Artificial Sequence
  Description of Artificial Sequence: Synthetic oligonucleotide
aactgaccgtatactatacta

SEQ ID NO: 9885 - DNA, 21 bp, Artificial Sequence
  Description of Artificial Sequence: Synthetic oligonucleotide
tatagtatacggtcagttatg

SEQ ID NO: 9886 - DNA, 21 bp, Artificial Sequence
  Description of Artificial Sequence: Synthetic oligonucleotide
taactgaccgtatactatact

SEQ ID NO: 9887 - DNA, 21 bp, Artificial Sequence
  Description of Artificial Sequence: Synthetic oligonucleotide
atagtatacggtcagttatgt

SEQ ID NO: 9888 - DNA, 21 bp, Artificial Sequence
  Description of Artificial Sequence: Synthetic oligonucleotide
ataactgaccgtatactatac

SEQ ID NO: 9889 - DNA, 21 bp, Artificial Sequence
  Description of Artificial Sequence: Synthetic oligonucleotide
tagtatacggtcagttatgtc

SEQ ID NO: 9890 - DNA, 21 bp, Artificial Sequence
  Description of Artificial Sequence: Synthetic oligonucleotide
cataactgaccgtatactata

SEQ ID NO: 9891 - DNA, 21 bp, Artificial Sequence
  Description of Artificial Sequence: Synthetic oligonucleotide
agtatacggtcagttatgtca

SEQ ID NO: 9892 - DNA, 21 bp, Artificial Sequence
  Description of Artificial Sequence: Synthetic oligonucleotide
acataactgaccgtatactat

SEQ ID NO: 9893 - DNA, 21 bp, Artificial Sequence
  Description of Artificial Sequence: Synthetic oligonucleotide
gtatacggtcagttatgtcaa

SEQ ID NO: 9894 - DNA, 21 bp, Artificial Sequence
  Description of Artificial Sequence: Synthetic oligonucleotide
gacataactgaccgtatacta

SEQ ID NO: 9895 - DNA, 21 bp, Artificial Sequence
  Description of Artificial Sequence: Synthetic oligonucleotide
tatacggtcagttatgtcaat

SEQ ID NO: 9896 - DNA, 21 bp, Artificial Sequence
  Description of Artificial Sequence: Synthetic oligonucleotide
tgacataactgaccgtatact

SEQ ID NO: 9897 - DNA, 21 bp, Artificial Sequence
  Description of Artificial Sequence: Synthetic oligonucleotide
atacggtcagttatgtcaatg

SEQ ID NO: 9898 - DNA, 21 bp, Artificial Sequence
  Description of Artificial Sequence: Synthetic oligonucleotide
ttgacataactgaccgtatac

SEQ ID NO: 9899 - DNA, 21 bp, Artificial Sequence
  Description of Artificial Sequence: Synthetic oligonucleotide
tacggtcagttatgtcaatgt

SEQ ID NO: 9900 - DNA, 21 bp, Artificial Sequence
  Description of Artificial Sequence: Synthetic oligonucleotide
attgacataactgaccgtata

SEQ ID NO: 9901 - DNA, 21 bp, Artificial Sequence
  Description of Artificial Sequence: Synthetic oligonucleotide
acggtcagttatgtcaatgtt

SEQ ID NO: 9902 - DNA, 21 bp, Artificial Sequence
  Description of Artificial Sequence: Synthetic oligonucleotide
cattgacataactgaccgtat

SEQ ID NO: 9903 - DNA, 21 bp, Artificial Sequence
  Description of Artificial Sequence: Synthetic oligonucleotide
cggtcagttatgtcaatgttt

SEQ ID NO: 9904 - DNA, 21 bp, Artificial Sequence
  Description of Artificial Sequence: Synthetic oligonucleotide
acattgacataactgaccgta

SEQ ID NO: 9905 - DNA, 21 bp, Artificial Sequence
  Description of Artificial Sequence: Synthetic oligonucleotide
ggtcagttatgtcaatgtttc

SEQ ID NO: 9906 - DNA, 21 bp, Artificial Sequence
  Description of Artificial Sequence: Synthetic oligonucleotide
aacattgacataactgaccgt

SEQ ID NO: 9907 - DNA, 21 bp, Artificial Sequence
  Description of Artificial Sequence: Synthetic oligonucleotide
gtcagttatgtcaatgtttca

SEQ ID NO: 9908 - DNA, 21 bp, Artificial Sequence
  Description of Artificial Sequence: Synthetic oligonucleotide
aaacattgacataactgaccg

SEQ ID NO: 9909 - DNA, 21 bp, Artificial Sequence
  Description of Artificial Sequence: Synthetic oligonucleotide
tcagttatgtcaatgtttcat

SEQ ID NO: 9910 - DNA, 21 bp, Artificial Sequence
  Description of Artificial Sequence: Synthetic oligonucleotide
gaaacattgacataactgacc

SEQ ID NO: 9911 - DNA, 21 bp, Artificial Sequence
  Description of Artificial Sequence: Synthetic oligonucleotide
cagttatgtcaatgtttcatg

SEQ ID NO: 9912 - DNA, 21 bp, Artificial Sequence
  Description of Artificial Sequence: Synthetic oligonucleotide
tgaaacattgacataactgac

SEQ ID NO: 9913 - DNA, 21 bp, Artificial Sequence
  Description of Artificial Sequence: Synthetic oligonucleotide
agttatgtcaatgtttcatgg

SEQ ID NO: 9914 - DNA, 21 bp, Artificial Sequence
  Description of Artificial Sequence: Synthetic oligonucleotide
atgaaacattgacataactga

SEQ ID NO: 9915 - DNA, 21 bp, Artificial Sequence
  Description of Artificial Sequence: Synthetic oligonucleotide
gttatgtcaatgtttcatggt

SEQ ID NO: 9916 - DNA, 21 bp, Artificial Sequence
  Description of Artificial Sequence: Synthetic oligonucleotide
catgaaacattgacataactg

SEQ ID NO: 9917 - DNA, 21 bp, Artificial Sequence
  Description of Artificial Sequence: Synthetic oligonucleotide
ttatgtcaatgtttcatggtc

SEQ ID NO: 9918 - DNA, 21 bp, Artificial Sequence
  Description of Artificial Sequence: Synthetic oligonucleotide
ccatgaaacattgacataact

SEQ ID NO: 9919 - DNA, 21 bp, Artificial Sequence
  Description of Artificial Sequence: Synthetic oligonucleotide
tatgtcaatgtttcatggtca

SEQ ID NO: 9920 - DNA, 21 bp, Artificial Sequence
  Description of Artificial Sequence: Synthetic oligonucleotide
accatgaaacattgacataac

SEQ ID NO: 9921 - DNA, 21 bp, Artificial Sequence
  Description of Artificial Sequence: Synthetic oligonucleotide
atgtcaatgtttcatggtcaa

SEQ ID NO: 9922 - DNA, 21 bp, Artificial Sequence
  Description of Artificial Sequence: Synthetic oligonucleotide
gaccatgaaacattgacataa

SEQ ID NO: 9923 - DNA, 21 bp, Artificial Sequence
  Description of Artificial Sequence: Synthetic oligonucleotide
tgtcaatgtttcatggtcaat

SEQ ID NO: 9924 - DNA, 21 bp, Artificial Sequence
  Description of Artificial Sequence: Synthetic oligonucleotide
tgaccatgaaacattgacata

SEQ ID NO: 9925 - DNA, 21 bp, Artificial Sequence
  Description of Artificial Sequence: Synthetic oligonucleotide
gtcaatgtttcatggtcaata

SEQ ID NO: 9926 - DNA, 21 bp, Artificial Sequence
  Description of Artificial Sequence: Synthetic oligonucleotide
ttgaccatgaaacattgacat

SEQ ID NO: 9927 - DNA, 21 bp, Artificial Sequence
  Description of Artificial Sequence: Synthetic oligonucleotide
tcaatgtttcatggtcaataa

SEQ ID NO: 9928 - DNA, 21 bp, Artificial Sequence
  Description of Artificial Sequence: Synthetic oligonucleotide
attgaccatgaaacattgaca

SEQ ID NO: 9929 - DNA, 21 bp, Artificial Sequence
  Description of Artificial Sequence: Synthetic oligonucleotide
caatgtttcatggtcaataaa

SEQ ID NO: 9930 - DNA, 21 bp, Artificial Sequence
  Description of Artificial Sequence: Synthetic oligonucleotide
tattgaccatgaaacattgac

SEQ ID NO: 9931 - DNA, 21 bp, Artificial Sequence
  Description of Artificial Sequence: Synthetic oligonucleotide
aatgtttcatggtcaataaaa

SEQ ID NO: 9932 - DNA, 21 bp, Artificial Sequence
  Description of Artificial Sequence: Synthetic oligonucleotide
ttattgaccatgaaacattga

SEQ ID NO: 9933 - DNA, 21 bp, Artificial Sequence
  Description of Artificial Sequence: Synthetic oligonucleotide
atgtttcatggtcaataaaaa

SEQ ID NO: 9934 - DNA, 21 bp, Artificial Sequence
  Description of Artificial Sequence: Synthetic oligonucleotide
tttattgaccatgaaacattg

SEQ ID NO: 9935 - DNA, 21 bp, Artificial Sequence
  Description of Artificial Sequence: Synthetic oligonucleotide
tgtttcatggtcaataaaaag

SEQ ID NO: 9936 - DNA, 21 bp, Artificial Sequence
  Description of Artificial Sequence: Synthetic oligonucleotide
ttttattgaccatgaaacatt

SEQ ID NO: 9937 - DNA, 21 bp, Artificial Sequence
  Description of Artificial Sequence: Synthetic oligonucleotide
gtttcatggtcaataaaaagg

SEQ ID NO: 9938 - DNA, 21 bp, Artificial Sequence
  Description of Artificial Sequence: Synthetic oligonucleotide
tttttattgaccatgaaacat

SEQ ID NO: 9939 - DNA, 21 bp, Artificial Sequence
  Description of Artificial Sequence: Synthetic oligonucleotide
tttcatggtcaataaaaagga

SEQ ID NO: 9940 - DNA, 21 bp, Artificial Sequence
  Description of Artificial Sequence: Synthetic oligonucleotide
ctttttattgaccatgaaaca

SEQ ID NO: 9941 - DNA, 21 bp, Artificial Sequence
  Description of Artificial Sequence: Synthetic oligonucleotide
ttcatggtcaataaaaaggaa

SEQ ID NO: 9942 - DNA, 21 bp, Artificial Sequence
  Description of Artificial Sequence: Synthetic oligonucleotide
cctttttattgaccatgaaac

SEQ ID NO: 9943 - DNA, 21 bp, Artificial Sequence
  Description of Artificial Sequence: Synthetic oligonucleotide
tcatggtcaataaaaaggaag

SEQ ID NO: 9944 - DNA, 21 bp, Artificial Sequence
  Description of Artificial Sequence: Synthetic oligonucleotide
tcctttttattgaccatgaaa

SEQ ID NO: 9945 - DNA, 21 bp, Artificial Sequence
  Description of Artificial Sequence: Synthetic oligonucleotide
catggtcaataaaaaggaagt

SEQ ID NO: 9946 - DNA, 21 bp, Artificial Sequence
  Description of Artificial Sequence: Synthetic oligonucleotide
ttcctttttattgaccatgaa

SEQ ID NO: 9947 - DNA, 21 bp, Artificial Sequence
  Description of Artificial Sequence: Synthetic oligonucleotide
atggtcaataaaaaggaagtt

SEQ ID NO: 9948 - DNA, 21 bp, Artificial Sequence
  Description of Artificial Sequence: Synthetic oligonucleotide
cttcctttttattgaccatga

SEQ ID NO: 9949 - DNA, 21 bp, Artificial Sequence
  Description of Artificial Sequence: Synthetic oligonucleotide
tggtcaataaaaaggaagttg

SEQ ID NO: 9950 - DNA, 21 bp, Artificial Sequence
  Description of Artificial Sequence: Synthetic oligonucleotide
acttcctttttattgaccatg

SEQ ID NO: 9951 - DNA, 21 bp, Artificial Sequence
  Description of Artificial Sequence: Synthetic oligonucleotide
ggtcaataaaaaggaagttgc

SEQ ID NO: 9952 - DNA, 21 bp, Artificial Sequence
  Description of Artificial Sequence: Synthetic oligonucleotide
aacttcctttttattgaccat

SEQ ID NO: 9953 - DNA, 21 bp, Artificial Sequence
  Description of Artificial Sequence: Synthetic oligonucleotide
gtcaataaaaaggaagttgca

SEQ ID NO: 9954 - DNA, 21 bp, Artificial Sequence
  Description of Artificial Sequence: Synthetic oligonucleotide
caacttcctttttattgacca

SEQ ID NO: 9955 - DNA, 21 bp, Artificial Sequence
  Description of Artificial Sequence: Synthetic oligonucleotide
tcaataaaaaggaagttgcaa

SEQ ID NO: 9956 - DNA, 21 bp, Artificial Sequence
  Description of Artificial Sequence: Synthetic oligonucleotide
gcaacttcctttttattgacc

SEQ ID NO: 9957 - DNA, 21 bp, Artificial Sequence
  Description of Artificial Sequence: Synthetic oligonucleotide
caataaaaaggaagttgcaaa

SEQ ID NO: 9958 - DNA, 21 bp, Artificial Sequence
  Description of Artificial Sequence: Synthetic oligonucleotide
tgcaacttcctttttattgac

SEQ ID NO: 9959 - DNA, 21 bp, Artificial Sequence
  Description of Artificial Sequence: Synthetic oligonucleotide
aataaaaaggaagttgcaaat

SEQ ID NO: 9960 - DNA, 21 bp, Artificial Sequence
  Description of Artificial Sequence: Synthetic oligonucleotide
ttgcaacttcctttttattga

SEQ ID NO: 9961 - DNA, 21 bp, Artificial Sequence
  Description of Artificial Sequence: Synthetic oligonucleotide
ataaaaaggaagttgcaaatt

SEQ ID NO: 9962 - DNA, 21 bp, Artificial Sequence
  Description of Artificial Sequence: Synthetic oligonucleotide
tttgcaacttcctttttattg

SEQ ID NO: 9963 - DNA, 21 bp, Artificial Sequence
  Description of Artificial Sequence: Synthetic oligonucleotide
taaaaaggaagttgcaaattg

SEQ ID NO: 9964 - DNA, 21 bp, Artificial Sequence
  Description of Artificial Sequence: Synthetic oligonucleotide
atttgcaacttcctttttatt

SEQ ID NO: 9965 - DNA, 21 bp, Artificial Sequence
  Description of Artificial Sequence: Synthetic oligonucleotide
aaaaaggaagttgcaaattgt

SEQ ID NO: 9966 - DNA, 21 bp, Artificial Sequence
  Description of Artificial Sequence: Synthetic oligonucleotide
aatttgcaacttcctttttat

SEQ ID NO: 9967 - DNA, 21 bp, Artificial Sequence
  Description of Artificial Sequence: Synthetic oligonucleotide
aaaaggaagttgcaaattgtt

SEQ ID NO: 9968 - DNA, 21 bp, Artificial Sequence
  Description of Artificial Sequence: Synthetic oligonucleotide
caatttgcaacttccttttta

SEQ ID NO: 9969 - DNA, 21 bp, Artificial Sequence
  Description of Artificial Sequence: Synthetic oligonucleotide
aaaggaagttgcaaattgttt

SEQ ID NO: 9970 - DNA, 21 bp, Artificial Sequence
  Description of Artificial Sequence: Synthetic oligonucleotide
acaatttgcaacttccttttt

SEQ ID NO: 9971 - DNA, 20 bp, Artificial Sequence
  Description of Artificial Sequence: Synthetic oligonucleotide
taagttggagtctccctgat

SEQ ID NO: 9972 - DNA, 20 bp, Artificial Sequence
  Description of Artificial Sequence: Synthetic oligonucleotide
ttaagttggagtctccctga

SEQ ID NO: 9973 - DNA, 20 bp, Artificial Sequence
  Description of Artificial Sequence: Synthetic oligonucleotide
cttaagttggagtctccctg

SEQ ID NO: 9974 - DNA, 20 bp, Artificial Sequence
  Description of Artificial Sequence: Synthetic oligonucleotide
ccttaagttggagtctccct

SEQ ID NO: 9975 - DNA, 20 bp, Artificial Sequence
  Description of Artificial Sequence: Synthetic oligonucleotide
gccttaagttggagtctccc

SEQ ID NO: 9976 - DNA, 20 bp, Artificial Sequence
  Description of Artificial Sequence: Synthetic oligonucleotide
tgccttaagttggagtctcc

SEQ ID NO: 9977 - DNA, 20 bp, Artificial Sequence
  Description of Artificial Sequence: Synthetic oligonucleotide
ttgccttaagttggagtctc

SEQ ID NO: 9978 - DNA, 20 bp, Artificial Sequence
  Description of Artificial Sequence: Synthetic oligonucleotide
gttgccttaagttggagtct

SEQ ID NO: 9979 - DNA, 20 bp, Artificial Sequence
  Description of Artificial Sequence: Synthetic oligonucleotide
tgttgccttaagttggagtc

SEQ ID NO: 9980 - DNA, 20 bp, Artificial Sequence
  Description of Artificial Sequence: Synthetic oligonucleotide
ctgttgccttaagttggagt

SEQ ID NO: 9981 - DNA, 20 bp, Artificial Sequence
  Description of Artificial Sequence: Synthetic oligonucleotide
gctgttgccttaagttggag

SEQ ID NO: 9982 - DNA, 20 bp, Artificial Sequence
  Description of Artificial Sequence: Synthetic oligonucleotide
tgctgttgccttaagttgga

SEQ ID NO: 9983 - DNA, 20 bp, Artificial Sequence
  Description of Artificial Sequence: Synthetic oligonucleotide
atgctgttgccttaagttgg

SEQ ID NO: 9984 - DNA, 20 bp, Artificial Sequence
  Description of Artificial Sequence: Synthetic oligonucleotide
catgctgttgccttaagttg

SEQ ID NO: 9985 - DNA, 20 bp, Artificial Sequence
  Description of Artificial Sequence: Synthetic oligonucleotide
ccatgctgttgccttaagtt

SEQ ID NO: 9986 - DNA, 20 bp, Artificial Sequence
  Description of Artificial Sequence: Synthetic oligonucleotide
cccatgctgttgccttaagt

SEQ ID NO: 9987 - DNA, 20 bp, Artificial Sequence
  Description of Artificial Sequence: Synthetic oligonucleotide
acccatgctgttgccttaag

SEQ ID NO: 9988 - DNA, 20 bp, Artificial Sequence
  Description of Artificial Sequence: Synthetic oligonucleotide
cacccatgctgttgccttaa

SEQ ID NO: 9989 - DNA, 20 bp, Artificial Sequence
  Description of Artificial Sequence: Synthetic oligonucleotide
tcacccatgctgttgcctta

SEQ ID NO: 9990 - DNA, 20 bp, Artificial Sequence
  Description of Artificial Sequence: Synthetic oligonucleotide
ttcacccatgctgttgcctt

SEQ ID NO: 9991 - DNA, 20 bp, Artificial Sequence
  Description of Artificial Sequence: Synthetic oligonucleotide
attcacccatgctgttgcct

SEQ ID NO: 9992 - DNA, 20 bp, Artificial Sequence
  Description of Artificial Sequence: Synthetic oligonucleotide
tattcacccatgctgttgcc

SEQ ID NO: 9993 - DNA, 20 bp, Artificial Sequence
  Description of Artificial Sequence: Synthetic oligonucleotide
ttattcacccatgctgttgc

SEQ ID NO: 9994 - DNA, 20 bp, Artificial Sequence
  Description of Artificial Sequence: Synthetic oligonucleotide
cttattcacccatgctgttg

SEQ ID NO: 9995 - DNA, 20 bp, Artificial Sequence
  Description of Artificial Sequence: Synthetic oligonucleotide
ccttattcacccatgctgtt

SEQ ID NO: 9996 - DNA, 20 bp, Artificial Sequence
  Description of Artificial Sequence: Synthetic oligonucleotide
cccttattcacccatgctgt

SEQ ID NO: 9997 - DNA, 20 bp, Artificial Sequence
  Description of Artificial Sequence: Synthetic oligonucleotide
gcccttattcacccatgctg

SEQ ID NO: 9998 - DNA, 20 bp, Artificial Sequence
  Description of Artificial Sequence: Synthetic oligonucleotide
agcccttattcacccatgct

SEQ ID NO: 9999 - DNA, 20 bp, Artificial Sequence
  Description of Artificial Sequence: Synthetic oligonucleotide
aagcccttattcacccatgc

SEQ ID NO: 10000 - DNA, 20 bp, Artificial Sequence
  Description of Artificial Sequence: Synthetic oligonucleotide
gaagcccttattcacccatg

SEQ ID NO: 10001 - DNA, 20 bp, Artificial Sequence
  Description of Artificial Sequence: Synthetic oligonucleotide
ggaagcccttattcacccat

SEQ ID NO: 10002 - DNA, 20 bp, Artificial Sequence
  Description of Artificial Sequence: Synthetic oligonucleotide
aggaagcccttattcaccca

SEQ ID NO: 10003 - DNA, 20 bp, Artificial Sequence
  Description of Artificial Sequence: Synthetic oligonucleotide
caggaagcccttattcaccc

SEQ ID NO: 10004 - DNA, 20 bp, Artificial Sequence
  Description of Artificial Sequence: Synthetic oligonucleotide
acaggaagcccttattcacc

SEQ ID NO: 10005 - DNA, 20 bp, Artificial Sequence
  Description of Artificial Sequence: Synthetic oligonucleotide
cacaggaagcccttattcac

SEQ ID NO: 10006 - DNA, 20 bp, Artificial Sequence
  Description of Artificial Sequence: Synthetic oligonucleotide
ccacaggaagcccttattca

SEQ ID NO: 10007 - DNA, 20 bp, Artificial Sequence
  Description of Artificial Sequence: Synthetic oligonucleotide
tccacaggaagcccttattc

SEQ ID NO: 10008 - DNA, 20 bp, Artificial Sequence
  Description of Artificial Sequence: Synthetic oligonucleotide
gtccacaggaagcccttatt

SEQ ID NO: 10009 - DNA, 20 bp, Artificial Sequence
  Description of Artificial Sequence: Synthetic oligonucleotide
agtccacaggaagcccttat

SEQ ID NO: 10010 - DNA, 20 bp, Artificial Sequence
  Description of Artificial Sequence: Synthetic oligonucleotide
cagtccacaggaagccctta

SEQ ID NO: 10011 - DNA, 20 bp, Artificial Sequence
  Description of Artificial Sequence: Synthetic oligonucleotide
ccagtccacaggaagccctt

SEQ ID NO: 10012 - DNA, 20 bp, Artificial Sequence
  Description of Artificial Sequence: Synthetic oligonucleotide
gccagtccacaggaagccct

SEQ ID NO: 10013 - DNA, 20 bp, Artificial Sequence
  Description of Artificial Sequence: Synthetic oligonucleotide
tgccagtccacaggaagccc

SEQ ID NO: 10014 - DNA, 20 bp, Artificial Sequence
  Description of Artificial Sequence: Synthetic oligonucleotide
ttgccagtccacaggaagcc

SEQ ID NO: 10015 - DNA, 20 bp, Artificial Sequence
  Description of Artificial Sequence: Synthetic oligonucleotide
attgccagtccacaggaagc

SEQ ID NO: 10016 - DNA, 20 bp, Artificial Sequence
  Description of Artificial Sequence: Synthetic oligonucleotide
cattgccagtccacaggaag

SEQ ID NO: 10017 - DNA, 20 bp, Artificial Sequence
  Description of Artificial Sequence: Synthetic oligonucleotide
tcattgccagtccacaggaa

SEQ ID NO: 10018 - DNA, 20 bp, Artificial Sequence
  Description of Artificial Sequence: Synthetic oligonucleotide
ctcattgccagtccacagga

SEQ ID NO: 10019 - DNA, 20 bp, Artificial Sequence
  Description of Artificial Sequence: Synthetic oligonucleotide
tctcattgccagtccacagg

SEQ ID NO: 10020 - DNA, 20 bp, Artificial Sequence
  Description of Artificial Sequence: Synthetic oligonucleotide
ctctcattgccagtccacag

SEQ ID NO: 10021 - DNA, 20 bp, Artificial Sequence
  Description of Artificial Sequence: Synthetic oligonucleotide
cctctcattgccagtccaca

SEQ ID NO: 10022 - DNA, 20 bp, Artificial Sequence
  Description of Artificial Sequence: Synthetic oligonucleotide
gcctctcattgccagtccac

SEQ ID NO: 10023 - DNA, 20 bp, Artificial Sequence
  Description of Artificial Sequence: Synthetic oligonucleotide
tgcctctcattgccagtcca

SEQ ID NO: 10024 - DNA, 20 bp, Artificial Sequence
  Description of Artificial Sequence: Synthetic oligonucleotide
ttgcctctcattgccagtcc

SEQ ID NO: 10025 - DNA, 20 bp, Artificial Sequence
  Description of Artificial Sequence: Synthetic oligonucleotide
tttgcctctcattgccagtc

SEQ ID NO: 10026 - DNA, 20 bp, Artificial Sequence
  Description of Artificial Sequence: Synthetic oligonucleotide
ttttgcctctcattgccagt

SEQ ID NO: 10027 - DNA, 20 bp, Artificial Sequence
  Description of Artificial Sequence: Synthetic oligonucleotide
gttttgcctctcattgccag

SEQ ID NO: 10028 - DNA, 20 bp, Artificial Sequence
  Description of Artificial Sequence: Synthetic oligonucleotide
ggttttgcctctcattgcca

SEQ ID NO: 10029 - DNA, 20 bp, Artificial Sequence
  Description of Artificial Sequence: Synthetic oligonucleotide
aggttttgcctctcattgcc

SEQ ID NO: 10030 - DNA, 20 bp, Artificial Sequence
  Description of Artificial Sequence: Synthetic oligonucleotide
caggttttgcctctcattgc

SEQ ID NO: 10031 - DNA, 20 bp, Artificial Sequence
  Description of Artificial Sequence: Synthetic oligonucleotide
ccaggttttgcctctcattg

SEQ ID NO: 10032 - DNA, 20 bp, Artificial Sequence
  Description of Artificial Sequence: Synthetic oligonucleotide
accaggttttgcctctcatt

SEQ ID NO: 10033 - DNA, 20 bp, Artificial Sequence
  Description of Artificial Sequence: Synthetic oligonucleotide
caccaggttttgcctctcat

SEQ ID NO: 10034 - DNA, 20 bp, Artificial Sequence
  Description of Artificial Sequence: Synthetic oligonucleotide
gcaccaggttttgcctctca

SEQ ID NO: 10035 - DNA, 20 bp, Artificial Sequence
  Description of Artificial Sequence: Synthetic oligonucleotide
agcaccaggttttgcctctc

SEQ ID NO: 10036 - DNA, 20 bp, Artificial Sequence
  Description of Artificial Sequence: Synthetic oligonucleotide
aagcaccaggttttgcctct

SEQ ID NO: 10037 - DNA, 20 bp, Artificial Sequence
  Description of Artificial Sequence: Synthetic oligonucleotide
caagcaccaggttttgcctc

SEQ ID NO: 10038 - DNA, 20 bp, Artificial Sequence
  Description of Artificial Sequence: Synthetic oligonucleotide
tcaagcaccaggttttgcct

SEQ ID NO: 10039 - DNA, 20 bp, Artificial Sequence
  Description of Artificial Sequence: Synthetic oligonucleotide
ctcaagcaccaggttttgcc

SEQ ID NO: 10040 - DNA, 20 bp, Artificial Sequence
  Description of Artificial Sequence: Synthetic oligonucleotide
gctcaagcaccaggttttgc

SEQ ID NO: 10041 - DNA, 20 bp, Artificial Sequence
  Description of Artificial Sequence: Synthetic oligonucleotide
tgctcaagcaccaggttttg

SEQ ID NO: 10042 - DNA, 20 bp, Artificial Sequence
  Description of Artificial Sequence: Synthetic oligonucleotide
gtgctcaagcaccaggtttt

SEQ ID NO: 10043 - DNA, 20 bp, Artificial Sequence
  Description of Artificial Sequence: Synthetic oligonucleotide
agtgctcaagcaccaggttt

SEQ ID NO: 10044 - DNA, 20 bp, Artificial Sequence
  Description of Artificial Sequence: Synthetic oligonucleotide
cagtgctcaagcaccaggtt

SEQ ID NO: 10045 - DNA, 20 bp, Artificial Sequence
  Description of Artificial Sequence: Synthetic oligonucleotide
ccagtgctcaagcaccaggt

SEQ ID NO: 10046 - DNA, 20 bp, Artificial Sequence
  Description of Artificial Sequence: Synthetic oligonucleotide
gccagtgctcaagcaccagg

SEQ ID NO: 10047 - DNA, 20 bp, Artificial Sequence
  Description of Artificial Sequence: Synthetic oligonucleotide
ggccagtgctcaagcaccag

SEQ ID NO: 10048 - DNA, 20 bp, Artificial Sequence
  Description of Artificial Sequence: Synthetic oligonucleotide
gggccagtgctcaagcacca

SEQ ID NO: 10049 - DNA, 20 bp, Artificial Sequence
  Description of Artificial Sequence: Synthetic oligonucleotide
ggggccagtgctcaagcacc

SEQ ID NO: 10050 - DNA, 20 bp, Artificial Sequence
  Description of Artificial Sequence: Synthetic oligonucleotide
aggggccagtgctcaagcac

SEQ ID NO: 10051 - DNA, 20 bp, Artificial Sequence
  Description of Artificial Sequence: Synthetic oligonucleotide
taggggccagtgctcaagca

SEQ ID NO: 10052 - DNA, 20 bp, Artificial Sequence
  Description of Artificial Sequence: Synthetic oligonucleotide
ttaggggccagtgctcaagc

SEQ ID NO: 10053 - DNA, 20 bp, Artificial Sequence
  Description of Artificial Sequence: Synthetic oligonucleotide
cttaggggccagtgctcaag

SEQ ID NO: 10054 - DNA, 20 bp, Artificial Sequence
  Description of Artificial Sequence: Synthetic oligonucleotide
ccttaggggccagtgctcaa

SEQ ID NO: 10055 - DNA, 20 bp, Artificial Sequence
  Description of Artificial Sequence: Synthetic oligonucleotide
gccttaggggccagtgctca

SEQ ID NO: 10056 - DNA, 20 bp, Artificial Sequence
  Description of Artificial Sequence: Synthetic oligonucleotide
tgccttaggggccagtgctc

SEQ ID NO: 10057 - DNA, 20 bp, Artificial Sequence
  Description of Artificial Sequence: Synthetic oligonucleotide
ctgccttaggggccagtgct

SEQ ID NO: 10058 - DNA, 20 bp, Artificial Sequence
  Description of Artificial Sequence: Synthetic oligonucleotide
cctgccttaggggccagtgc

SEQ ID NO: 10059 - DNA, 20 bp, Artificial Sequence
  Description of Artificial Sequence: Synthetic oligonucleotide
gcctgccttaggggccagtg

SEQ ID NO: 10060 - DNA, 20 bp, Artificial Sequence
  Description of Artificial Sequence: Synthetic oligonucleotide
ggcctgccttaggggccagt

SEQ ID NO: 10061 - DNA, 20 bp, Artificial Sequence
  Description of Artificial Sequence: Synthetic oligonucleotide
aggcctgccttaggggccag

SEQ ID NO: 10062 - DNA, 20 bp, Artificial Sequence
  Description of Artificial Sequence: Synthetic oligonucleotide
aaggcctgccttaggggcca

SEQ ID NO: 10063 - DNA, 20 bp, Artificial Sequence
  Description of Artificial Sequence: Synthetic oligonucleotide
taaggcctgccttaggggcc

SEQ ID NO: 10064 - DNA, 20 bp, Artificial Sequence
  Description of Artificial Sequence: Synthetic oligonucleotide
gtaaggcctgccttaggggc

SEQ ID NO: 10065 - DNA, 20 bp, Artificial Sequence
  Description of Artificial Sequence: Synthetic oligonucleotide
tgtaaggcctgccttagggg

SEQ ID NO: 10066 - DNA, 20 bp, Artificial Sequence
  Description of Artificial Sequence: Synthetic oligonucleotide
ctgtaaggcctgccttaggg

SEQ ID NO: 10067 - DNA, 20 bp, Artificial Sequence
  Description of Artificial Sequence: Synthetic oligonucleotide
tctgtaaggcctgccttagg

SEQ ID NO: 10068 - DNA, 20 bp, Artificial Sequence
  Description of Artificial Sequence: Synthetic oligonucleotide
atctgtaaggcctgccttag

SEQ ID NO: 10069 - DNA, 20 bp, Artificial Sequence
  Description of Artificial Sequence: Synthetic oligonucleotide
gatctgtaaggcctgcctta

SEQ ID NO: 10070 - DNA, 20 bp, Artificial Sequence
  Description of Artificial Sequence: Synthetic oligonucleotide
agatctgtaaggcctgcctt

SEQ ID NO: 10071 - DNA, 20 bp, Artificial Sequence
  Description of Artificial Sequence: Synthetic oligonucleotide
gagatctgtaaggcctgcct

SEQ ID NO: 10072 - DNA, 20 bp, Artificial Sequence
  Description of Artificial Sequence: Synthetic oligonucleotide
agagatctgtaaggcctgcc

SEQ ID NO: 10073 - DNA, 20 bp, Artificial Sequence
  Description of Artificial Sequence: Synthetic oligonucleotide
aagagatctgtaaggcctgc

SEQ ID NO: 10074 - DNA, 20 bp, Artificial Sequence
  Description of Artificial Sequence: Synthetic oligonucleotide
taagagatctgtaaggcctg

SEQ ID NO: 10075 - DNA, 20 bp, Artificial Sequence
  Description of Artificial Sequence: Synthetic oligonucleotide
gtaagagatctgtaaggcct

SEQ ID NO: 10076 - DNA, 20 bp, Artificial Sequence
  Description of Artificial Sequence: Synthetic oligonucleotide
tgtaagagatctgtaaggcc

SEQ ID NO: 10077 - DNA, 20 bp, Artificial Sequence
  Description of Artificial Sequence: Synthetic oligonucleotide
gtgtaagagatctgtaaggc

SEQ ID NO: 10078 - DNA, 20 bp, Artificial Sequence
  Description of Artificial Sequence: Synthetic oligonucleotide
agtgtaagagatctgtaagg

SEQ ID NO: 10079 - DNA, 20 bp, Artificial Sequence
  Description of Artificial Sequence: Synthetic oligonucleotide
gagtgtaagagatctgtaag

SEQ ID NO: 10080 - DNA, 20 bp, Artificial Sequence
  Description of Artificial Sequence: Synthetic oligonucleotide
cgagtgtaagagatctgtaa

SEQ ID NO: 10081 - DNA, 20 bp, Artificial Sequence
  Description of Artificial Sequence: Synthetic oligonucleotide
acgagtgtaagagatctgta

SEQ ID NO: 10082 - DNA, 20 bp, Artificial Sequence
  Description of Artificial Sequence: Synthetic oligonucleotide
cacgagtgtaagagatctgt

SEQ ID NO: 10083 - DNA, 20 bp, Artificial Sequence
  Description of Artificial Sequence: Synthetic oligonucleotide
ccacgagtgtaagagatctg

SEQ ID NO: 10084 - DNA, 20 bp, Artificial Sequence
  Description of Artificial Sequence: Synthetic oligonucleotide
accacgagtgtaagagatct

SEQ ID NO: 10085 - DNA, 20 bp, Artificial Sequence
  Description of Artificial Sequence: Synthetic oligonucleotide
caccacgagtgtaagagatc

SEQ ID NO: 10086 - DNA, 20 bp, Artificial Sequence
  Description of Artificial Sequence: Synthetic oligonucleotide
ccaccacgagtgtaagagat

SEQ ID NO: 10087 - DNA, 20 bp, Artificial Sequence
  Description of Artificial Sequence: Synthetic oligonucleotide
cccaccacgagtgtaagaga

SEQ ID NO: 10088 - DNA, 20 bp, Artificial Sequence
  Description of Artificial Sequence: Synthetic oligonucleotide
tcccaccacgagtgtaagag

SEQ ID NO: 10089 - DNA, 20 bp, Artificial Sequence
  Description of Artificial Sequence: Synthetic oligonucleotide
ttcccaccacgagtgtaaga

SEQ ID NO: 10090 - DNA, 20 bp, Artificial Sequence
  Description of Artificial Sequence: Synthetic oligonucleotide
cttcccaccacgagtgtaag

SEQ ID NO: 10091 - DNA, 20 bp, Artificial Sequence
  Description of Artificial Sequence: Synthetic oligonucleotide
tcttcccaccacgagtgtaa

SEQ ID NO: 10092 - DNA, 20 bp, Artificial Sequence
  Description of Artificial Sequence: Synthetic oligonucleotide
ctcttcccaccacgagtgta

SEQ ID NO: 10093 - DNA, 20 bp, Artificial Sequence
  Description of Artificial Sequence: Synthetic oligonucleotide
actcttcccaccacgagtgt

SEQ ID NO: 10094 - DNA, 20 bp, Artificial Sequence
  Description of Artificial Sequence: Synthetic oligonucleotide
aactcttcccaccacgagtg

SEQ ID NO: 10095 - DNA, 20 bp, Artificial Sequence
  Description of Artificial Sequence: Synthetic oligonucleotide
aaactcttcccaccacgagt

SEQ ID NO: 10096 - DNA, 20 bp, Artificial Sequence
  Description of Artificial Sequence: Synthetic oligonucleotide
taaactcttcccaccacgag

SEQ ID NO: 10097 - DNA, 20 bp, Artificial Sequence
  Description of Artificial Sequence: Synthetic oligonucleotide
ctaaactcttcccaccacga

SEQ ID NO: 10098 - DNA, 20 bp, Artificial Sequence
  Description of Artificial Sequence: Synthetic oligonucleotide
actaaactcttcccaccacg

SEQ ID NO: 10099 - DNA, 20 bp, Artificial Sequence
  Description of Artificial Sequence: Synthetic oligonucleotide
cactaaactcttcccaccac

SEQ ID NO: 10100 - DNA, 20 bp, Artificial Sequence
  Description of Artificial Sequence: Synthetic oligonucleotide
acactaaactcttcccacca

SEQ ID NO: 10101 - DNA, 20 bp, Artificial Sequence
  Description of Artificial Sequence: Synthetic oligonucleotide
cacactaaactcttcccacc

SEQ ID NO: 10102 - DNA, 20 bp, Artificial Sequence
  Description of Artificial Sequence: Synthetic oligonucleotide
tcacactaaactcttcccac

SEQ ID NO: 10103 - DNA, 20 bp, Artificial Sequence
  Description of Artificial Sequence: Synthetic oligonucleotide
ttcacactaaactcttccca

SEQ ID NO: 10104 - DNA, 20 bp, Artificial Sequence
  Description of Artificial Sequence: Synthetic oligonucleotide
tttcacactaaactcttccc

SEQ ID NO: 10105 - DNA, 20 bp, Artificial Sequence
  Description of Artificial Sequence: Synthetic oligonucleotide
gtttcacactaaactcttcc

SEQ ID NO: 10106 - DNA, 20 bp, Artificial Sequence
  Description of Artificial Sequence: Synthetic oligonucleotide
agtttcacactaaactcttc

SEQ ID NO: 10107 - DNA, 20 bp, Artificial Sequence
  Description of Artificial Sequence: Synthetic oligonucleotide
cagtttcacactaaactctt

SEQ ID NO: 10108 - DNA, 20 bp, Artificial Sequence
  Description of Artificial Sequence: Synthetic oligonucleotide
ccagtttcacactaaactct

SEQ ID NO: 10109 - DNA, 20 bp, Artificial Sequence
  Description of Artificial Sequence: Synthetic oligonucleotide
cccagtttcacactaaactc

SEQ ID NO: 10110 - DNA, 20 bp, Artificial Sequence
  Description of Artificial Sequence: Synthetic oligonucleotide
ccccagtttcacactaaact

SEQ ID NO: 10111 - DNA, 20 bp, Artificial Sequence
  Description of Artificial Sequence: Synthetic oligonucleotide
accccagtttcacactaaac

SEQ ID NO: 10112 - DNA, 20 bp, Artificial Sequence
  Description of Artificial Sequence: Synthetic oligonucleotide
caccccagtttcacactaaa

SEQ ID NO: 10113 - DNA, 20 bp, Artificial Sequence
  Description of Artificial Sequence: Synthetic oligonucleotide
ccaccccagtttcacactaa

SEQ ID NO: 10114 - DNA, 20 bp, Artificial Sequence
  Description of Artificial Sequence: Synthetic oligonucleotide
tccaccccagtttcacacta

SEQ ID NO: 10115 - DNA, 20 bp, Artificial Sequence
  Description of Artificial Sequence: Synthetic oligonucleotide
ttccaccccagtttcacact

SEQ ID NO: 10116 - DNA, 20 bp, Artificial Sequence
  Description of Artificial Sequence: Synthetic oligonucleotide
attccaccccagtttcacac

SEQ ID NO: 10117 - DNA, 20 bp, Artificial Sequence
  Description of Artificial Sequence: Synthetic oligonucleotide
aattccaccccagtttcaca

SEQ ID NO: 10118 - DNA, 20 bp, Artificial Sequence
  Description of Artificial Sequence: Synthetic oligonucleotide
caattccaccccagtttcac

SEQ ID NO: 10119 - DNA, 20 bp, Artificial Sequence
  Description of Artificial Sequence: Synthetic oligonucleotide
ccaattccaccccagtttca

SEQ ID NO: 10120 - DNA, 20 bp, Artificial Sequence
  Description of Artificial Sequence: Synthetic oligonucleotide
cccaattccaccccagtttc

SEQ ID NO: 10121 - DNA, 20 bp, Artificial Sequence
  Description of Artificial Sequence: Synthetic oligonucleotide
acccaattccaccccagttt

SEQ ID NO: 10122 - DNA, 20 bp, Artificial Sequence
  Description of Artificial Sequence: Synthetic oligonucleotide
cacccaattccaccccagtt

SEQ ID NO: 10123 - DNA, 20 bp, Artificial Sequence
  Description of Artificial Sequence: Synthetic oligonucleotide
acacccaattccaccccagt

SEQ ID NO: 10124 - DNA, 20 bp, Artificial Sequence
  Description of Artificial Sequence: Synthetic oligonucleotide
gacacccaattccaccccag

SEQ ID NO: 10125 - DNA, 20 bp, Artificial Sequence
  Description of Artificial Sequence: Synthetic oligonucleotide
ggacacccaattccacccca

SEQ ID NO: 10126 - DNA, 20 bp, Artificial Sequence
  Description of Artificial Sequence: Synthetic oligonucleotide
tggacacccaattccacccc

SEQ ID NO: 10127 - DNA, 20 bp, Artificial Sequence
  Description of Artificial Sequence: Synthetic oligonucleotide
gtggacacccaattccaccc

SEQ ID NO: 10128 - DNA, 20 bp, Artificial Sequence
  Description of Artificial Sequence: Synthetic oligonucleotide
cgtggacacccaattccacc

SEQ ID NO: 10129 - DNA, 20 bp, Artificial Sequence
  Description of Artificial Sequence: Synthetic oligonucleotide
acgtggacacccaattccac

SEQ ID NO: 10130 - DNA, 20 bp, Artificial Sequence
  Description of Artificial Sequence: Synthetic oligonucleotide
tacgtggacacccaattcca

SEQ ID NO: 10131 - DNA, 20 bp, Artificial Sequence
  Description of Artificial Sequence: Synthetic oligonucleotide
atacgtggacacccaattcc

SEQ ID NO: 10132 - DNA, 20 bp, Artificial Sequence
  Description of Artificial Sequence: Synthetic oligonucleotide
catacgtggacacccaattc

SEQ ID NO: 10133 - DNA, 20 bp, Artificial Sequence
  Description of Artificial Sequence: Synthetic oligonucleotide
acatacgtggacacccaatt

SEQ ID NO: 10134 - DNA, 20 bp, Artificial Sequence
  Description of Artificial Sequence: Synthetic oligonucleotide
aacatacgtggacacccaat

SEQ ID NO: 10135 - DNA, 20 bp, Artificial Sequence
  Description of Artificial Sequence: Synthetic oligonucleotide
gaacatacgtggacacccaa

SEQ ID NO: 10136 - DNA, 20 bp, Artificial Sequence
  Description of Artificial Sequence: Synthetic oligonucleotide
ggaacatacgtggacaccca

SEQ ID NO: 10137 - DNA, 20 bp, Artificial Sequence
  Description of Artificial Sequence: Synthetic oligonucleotide
gggaacatacgtggacaccc

SEQ ID NO: 10138 - DNA, 20 bp, Artificial Sequence
  Description of Artificial Sequence: Synthetic oligonucleotide
agggaacatacgtggacacc

SEQ ID NO: 10139 - DNA, 20 bp, Artificial Sequence
  Description of Artificial Sequence: Synthetic oligonucleotide
aagggaacatacgtggacac

SEQ ID NO: 10140 - DNA, 20 bp, Artificial Sequence
  Description of Artificial Sequence: Synthetic oligonucleotide
aaagggaacatacgtggaca

SEQ ID NO: 10141 - DNA, 20 bp, Artificial Sequence
  Description of Artificial Sequence: Synthetic oligonucleotide
aaaagggaacatacgtggac

SEQ ID NO: 10142 - DNA, 20 bp, Artificial Sequence
  Description of Artificial Sequence: Synthetic oligonucleotide
caaaagggaacatacgtgga

SEQ ID NO: 10143 - DNA, 20 bp, Artificial Sequence
  Description of Artificial Sequence: Synthetic oligonucleotide
gcaaaagggaacatacgtgg

SEQ ID NO: 10144 - DNA, 20 bp, Artificial Sequence
  Description of Artificial Sequence: Synthetic oligonucleotide
ggcaaaagggaacatacgtg

SEQ ID NO: 10145 - DNA, 20 bp, Artificial Sequence
  Description of Artificial Sequence: Synthetic oligonucleotide
aggcaaaagggaacatacgt

SEQ ID NO: 10146 - DNA, 20 bp, Artificial Sequence
  Description of Artificial Sequence: Synthetic oligonucleotide
aaggcaaaagggaacatacg

SEQ ID NO: 10147 - DNA, 20 bp, Artificial Sequence
  Description of Artificial Sequence: Synthetic oligonucleotide
taaggcaaaagggaacatac

SEQ ID NO: 10148 - DNA, 20 bp, Artificial Sequence
  Description of Artificial Sequence: Synthetic oligonucleotide
gtaaggcaaaagggaacata

SEQ ID NO: 10149 - DNA, 20 bp, Artificial Sequence
  Description of Artificial Sequence: Synthetic oligonucleotide
agtaaggcaaaagggaacat

SEQ ID NO: 10150 - DNA, 20 bp, Artificial Sequence
  Description of Artificial Sequence: Synthetic oligonucleotide
tagtaaggcaaaagggaaca

SEQ ID NO: 10151 - DNA, 20 bp, Artificial Sequence
  Description of Artificial Sequence: Synthetic oligonucleotide
atagtaaggcaaaagggaac

SEQ ID NO: 10152 - DNA, 20 bp, Artificial Sequence
  Description of Artificial Sequence: Synthetic oligonucleotide
tatagtaaggcaaaagggaa

SEQ ID NO: 10153 - DNA, 20 bp, Artificial Sequence
  Description of Artificial Sequence: Synthetic oligonucleotide
atatagtaaggcaaaaggga

SEQ ID NO: 10154 - DNA, 20 bp, Artificial Sequence
  Description of Artificial Sequence: Synthetic oligonucleotide
catatagtaaggcaaaaggg

SEQ ID NO: 10155 - DNA, 20 bp, Artificial Sequence
  Description of Artificial Sequence: Synthetic oligonucleotide
acatatagtaaggcaaaagg

SEQ ID NO: 10156 - DNA, 20 bp, Artificial Sequence
  Description of Artificial Sequence: Synthetic oligonucleotide
aacatatagtaaggcaaaag

SEQ ID NO: 10157 - DNA, 20 bp, Artificial Sequence
  Description of Artificial Sequence: Synthetic oligonucleotide
gaacatatagtaaggcaaaa

SEQ ID NO: 10158 - DNA, 20 bp, Artificial Sequence
  Description of Artificial Sequence: Synthetic oligonucleotide
agaacatatagtaaggcaaa

SEQ ID NO: 10159 - DNA, 20 bp, Artificial Sequence
  Description of Artificial Sequence: Synthetic oligonucleotide
cagaacatatagtaaggcaa

SEQ ID NO: 10160 - DNA, 20 bp, Artificial Sequence
  Description of Artificial Sequence: Synthetic oligonucleotide
acagaacatatagtaaggca

SEQ ID NO: 10161 - DNA, 20 bp, Artificial Sequence
  Description of Artificial Sequence: Synthetic oligonucleotide
gacagaacatatagtaaggc

SEQ ID NO: 10162 - DNA, 20 bp, Artificial Sequence
  Description of Artificial Sequence: Synthetic oligonucleotide
tgacagaacatatagtaagg

SEQ ID NO: 10163 - DNA, 20 bp, Artificial Sequence
  Description of Artificial Sequence: Synthetic oligonucleotide
ctgacagaacatatagtaag

SEQ ID NO: 10164 - DNA, 20 bp, Artificial Sequence
  Description of Artificial Sequence: Synthetic oligonucleotide
actgacagaacatatagtaa

SEQ ID NO: 10165 - DNA, 20 bp, Artificial Sequence
  Description of Artificial Sequence: Synthetic oligonucleotide
aactgacagaacatatagta

SEQ ID NO: 10166 - DNA, 20 bp, Artificial Sequence
  Description of Artificial Sequence: Synthetic oligonucleotide
aaactgacagaacatatagt

SEQ ID NO: 10167 - DNA, 20 bp, Artificial Sequence
  Description of Artificial Sequence: Synthetic oligonucleotide
gaaactgacagaacatatag

SEQ ID NO: 10168 - DNA, 20 bp, Artificial Sequence
  Description of Artificial Sequence: Synthetic oligonucleotide
agaaactgacagaacatata

SEQ ID NO: 10169 - DNA, 20 bp, Artificial Sequence
  Description of Artificial Sequence: Synthetic oligonucleotide
aagaaactgacagaacatat

SEQ ID NO: 10170 - DNA, 20 bp, Artificial Sequence
  Description of Artificial Sequence: Synthetic oligonucleotide
aaagaaactgacagaacata

SEQ ID NO: 10171 - DNA, 20 bp, Artificial Sequence
  Description of Artificial Sequence: Synthetic oligonucleotide
gaaagaaactgacagaacat

SEQ ID NO: 10172 - DNA, 20 bp, Artificial Sequence
  Description of Artificial Sequence: Synthetic oligonucleotide
tgaaagaaactgacagaaca

SEQ ID NO: 10173 - DNA, 20 bp, Artificial Sequence
  Description of Artificial Sequence: Synthetic oligonucleotide
ctgaaagaaactgacagaac

SEQ ID NO: 10174 - DNA, 20 bp, Artificial Sequence
  Description of Artificial Sequence: Synthetic oligonucleotide
cctgaaagaaactgacagaa

SEQ ID NO: 10175 - DNA, 20 bp, Artificial Sequence
  Description of Artificial Sequence: Synthetic oligonucleotide
tcctgaaagaaactgacaga

SEQ ID NO: 10176 - DNA, 20 bp, Artificial Sequence
  Description of Artificial Sequence: Synthetic oligonucleotide
ttcctgaaagaaactgacag

SEQ ID NO: 10177 - DNA, 20 bp, Artificial Sequence
  Description of Artificial Sequence: Synthetic oligonucleotide
tttcctgaaagaaactgaca

SEQ ID NO: 10178 - DNA, 20 bp, Artificial Sequence
  Description of Artificial Sequence: Synthetic oligonucleotide
ttttcctgaaagaaactgac

SEQ ID NO: 10179 - DNA, 20 bp, Artificial Sequence
  Description of Artificial Sequence: Synthetic oligonucleotide
attttcctgaaagaaactga

SEQ ID NO: 10180 - DNA, 20 bp, Artificial Sequence
  Description of Artificial Sequence: Synthetic oligonucleotide
gattttcctgaaagaaactg

SEQ ID NO: 10181 - DNA, 20 bp, Artificial Sequence
  Description of Artificial Sequence: Synthetic oligonucleotide
agattttcctgaaagaaact

SEQ ID NO: 10182 - DNA, 20 bp, Artificial Sequence
  Description of Artificial Sequence: Synthetic oligonucleotide
aagattttcctgaaagaaac

SEQ ID NO: 10183 - DNA, 20 bp, Artificial Sequence
  Description of Artificial Sequence: Synthetic oligonucleotide
gaagattttcctgaaagaaa

SEQ ID NO: 10184 - DNA, 20 bp, Artificial Sequence
  Description of Artificial Sequence: Synthetic oligonucleotide
tgaagattttcctgaaagaa

SEQ ID NO: 10185 - DNA, 20 bp, Artificial Sequence
  Description of Artificial Sequence: Synthetic oligonucleotide
atgaagattttcctgaaaga

SEQ ID NO: 10186 - DNA, 20 bp, Artificial Sequence
  Description of Artificial Sequence: Synthetic oligonucleotide
gatgaagattttcctgaaag

SEQ ID NO: 10187 - DNA, 20 bp, Artificial Sequence
  Description of Artificial Sequence: Synthetic oligonucleotide
agatgaagattttcctgaaa

SEQ ID NO: 10188 - DNA, 20 bp, Artificial Sequence
  Description of Artificial Sequence: Synthetic oligonucleotide
aagatgaagattttcctgaa

SEQ ID NO: 10189 - DNA, 20 bp, Artificial Sequence
  Description of Artificial Sequence: Synthetic oligonucleotide
taagatgaagattttcctga

SEQ ID NO: 10190 - DNA, 20 bp, Artificial Sequence
  Description of Artificial Sequence: Synthetic oligonucleotide
gtaagatgaagattttcctg

SEQ ID NO: 10191 - DNA, 20 bp, Artificial Sequence
  Description of Artificial Sequence: Synthetic oligonucleotide
tgtaagatgaagattttcct

SEQ ID NO: 10192 - DNA, 20 bp, Artificial Sequence
  Description of Artificial Sequence: Synthetic oligonucleotide
ttgtaagatgaagattttcc

SEQ ID NO: 10193 - DNA, 20 bp, Artificial Sequence
  Description of Artificial Sequence: Synthetic oligonucleotide
gttgtaagatgaagattttc

SEQ ID NO: 10194 - DNA, 20 bp, Artificial Sequence
  Description of Artificial Sequence: Synthetic oligonucleotide
agttgtaagatgaagatttt

SEQ ID NO: 10195 - DNA, 20 bp, Artificial Sequence
  Description of Artificial Sequence: Synthetic oligonucleotide
aagttgtaagatgaagattt

SEQ ID NO: 10196 - DNA, 20 bp, Artificial Sequence
  Description of Artificial Sequence: Synthetic oligonucleotide
caagttgtaagatgaagatt

SEQ ID NO: 10197 - DNA, 20 bp, Artificial Sequence
  Description of Artificial Sequence: Synthetic oligonucleotide
acaagttgtaagatgaagat

SEQ ID NO: 10198 - DNA, 20 bp, Artificial Sequence
  Description of Artificial Sequence: Synthetic oligonucleotide
tacaagttgtaagatgaaga

SEQ ID NO: 10199 - DNA, 20 bp, Artificial Sequence
  Description of Artificial Sequence: Synthetic oligonucleotide
ctacaagttgtaagatgaag

SEQ ID NO: 10200 - DNA, 20 bp, Artificial Sequence
  Description of Artificial Sequence: Synthetic oligonucleotide
cctacaagttgtaagatgaa

SEQ ID NO: 10201 - DNA, 20 bp, Artificial Sequence
  Description of Artificial Sequence: Synthetic oligonucleotide
ccctacaagttgtaagatga

SEQ ID NO: 10202 - DNA, 20 bp, Artificial Sequence
  Description of Artificial Sequence: Synthetic oligonucleotide
gccctacaagttgtaagatg

SEQ ID NO: 10203 - DNA, 20 bp, Artificial Sequence
  Description of Artificial Sequence: Synthetic oligonucleotide
agccctacaagttgtaagat

SEQ ID NO: 10204 - DNA, 20 bp, Artificial Sequence
  Description of Artificial Sequence: Synthetic oligonucleotide
cagccctacaagttgtaaga

SEQ ID NO: 10205 - DNA, 20 bp, Artificial Sequence
  Description of Artificial Sequence: Synthetic oligonucleotide
ccagccctacaagttgtaag

SEQ ID NO: 10206 - DNA, 20 bp, Artificial Sequence
  Description of Artificial Sequence: Synthetic oligonucleotide
accagccctacaagttgtaa

SEQ ID NO: 10207 - DNA, 20 bp, Artificial Sequence
  Description of Artificial Sequence: Synthetic oligonucleotide
caccagccctacaagttgta

SEQ ID NO: 10208 - DNA, 20 bp, Artificial Sequence
  Description of Artificial Sequence: Synthetic oligonucleotide
acaccagccctacaagttgt

SEQ ID NO: 10209 - DNA, 20 bp, Artificial Sequence
  Description of Artificial Sequence: Synthetic oligonucleotide
aacaccagccctacaagttg

SEQ ID NO: 10210 - DNA, 20 bp, Artificial Sequence
  Description of Artificial Sequence: Synthetic oligonucleotide
taacaccagccctacaagtt

SEQ ID NO: 10211 - DNA, 20 bp, Artificial Sequence
  Description of Artificial Sequence: Synthetic oligonucleotide
ttaacaccagccctacaagt

SEQ ID NO: 10212 - DNA, 20 bp, Artificial Sequence
  Description of Artificial Sequence: Synthetic oligonucleotide
gttaacaccagccctacaag

SEQ ID NO: 10213 - DNA, 20 bp, Artificial Sequence
  Description of Artificial Sequence: Synthetic oligonucleotide
agttaacaccagccctacaa

SEQ ID NO: 10214 - DNA, 20 bp, Artificial Sequence
  Description of Artificial Sequence: Synthetic oligonucleotide
aagttaacaccagccctaca

SEQ ID NO: 10215 - DNA, 20 bp, Artificial Sequence
  Description of Artificial Sequence: Synthetic oligonucleotide
taagttaacaccagccctac

SEQ ID NO: 10216 - DNA, 20 bp, Artificial Sequence
  Description of Artificial Sequence: Synthetic oligonucleotide
gtaagttaacaccagcccta

SEQ ID NO: 10217 - DNA, 20 bp, Artificial Sequence
  Description of Artificial Sequence: Synthetic oligonucleotide
cgtaagttaacaccagccct

SEQ ID NO: 10218 - DNA, 20 bp, Artificial Sequence
  Description of Artificial Sequence: Synthetic oligonucleotide
tcgtaagttaacaccagccc

SEQ ID NO: 10219 - DNA, 20 bp, Artificial Sequence
  Description of Artificial Sequence: Synthetic oligonucleotide
gtcgtaagttaacaccagcc

SEQ ID NO: 10220 - DNA, 20 bp, Artificial Sequence
  Description of Artificial Sequence: Synthetic oligonucleotide
agtcgtaagttaacaccagc

SEQ ID NO: 10221 - DNA, 20 bp, Artificial Sequence
  Description of Artificial Sequence: Synthetic oligonucleotide
aagtcgtaagttaacaccag

SEQ ID NO: 10222 - DNA, 20 bp, Artificial Sequence
  Description of Artificial Sequence: Synthetic oligonucleotide
gaagtcgtaagttaacacca

SEQ ID NO: 10223 - DNA, 20 bp, Artificial Sequence
  Description of Artificial Sequence: Synthetic oligonucleotide
tgaagtcgtaagttaacacc

SEQ ID NO: 10224 - DNA, 20 bp, Artificial Sequence
  Description of Artificial Sequence: Synthetic oligonucleotide
gtgaagtcgtaagttaacac

SEQ ID NO: 10225 - DNA, 20 bp, Artificial Sequence
  Description of Artificial Sequence: Synthetic oligonucleotide
agtgaagtcgtaagttaaca

SEQ ID NO: 10226 - DNA, 20 bp, Artificial Sequence
  Description of Artificial Sequence: Synthetic oligonucleotide
tagtgaagtcgtaagttaac

SEQ ID NO: 10227 - DNA, 20 bp, Artificial Sequence
  Description of Artificial Sequence: Synthetic oligonucleotide
ttagtgaagtcgtaagttaa

SEQ ID NO: 10228 - DNA, 20 bp, Artificial Sequence
  Description of Artificial Sequence: Synthetic oligonucleotide
gttagtgaagtcgtaagtta

SEQ ID NO: 10229 - DNA, 20 bp, Artificial Sequence
  Description of Artificial Sequence: Synthetic oligonucleotide
agttagtgaagtcgtaagtt

SEQ ID NO: 10230 - DNA, 20 bp, Artificial Sequence
  Description of Artificial Sequence: Synthetic oligonucleotide
cagttagtgaagtcgtaagt

SEQ ID NO: 10231 - DNA, 20 bp, Artificial Sequence
  Description of Artificial Sequence: Synthetic oligonucleotide
acagttagtgaagtcgtaag

SEQ ID NO: 10232 - DNA, 20 bp, Artificial Sequence
  Description of Artificial Sequence: Synthetic oligonucleotide
cacagttagtgaagtcgtaa

SEQ ID NO: 10233 - DNA, 20 bp, Artificial Sequence
  Description of Artificial Sequence: Synthetic oligonucleotide
tcacagttagtgaagtcgta

SEQ ID NO: 10234 - DNA, 20 bp, Artificial Sequence
  Description of Artificial Sequence: Synthetic oligonucleotide
gtcacagttagtgaagtcgt

SEQ ID NO: 10235 - DNA, 20 bp, Artificial Sequence
  Description of Artificial Sequence: Synthetic oligonucleotide
agtcacagttagtgaagtcg

SEQ ID NO: 10236 - DNA, 20 bp, Artificial Sequence
  Description of Artificial Sequence: Synthetic oligonucleotide
aagtcacagttagtgaagtc

SEQ ID NO: 10237 - DNA, 20 bp, Artificial Sequence
  Description of Artificial Sequence: Synthetic oligonucleotide
aaagtcacagttagtgaagt

SEQ ID NO: 10238 - DNA, 20 bp, Artificial Sequence
  Description of Artificial Sequence: Synthetic oligonucleotide
caaagtcacagttagtgaag

SEQ ID NO: 10239 - DNA, 20 bp, Artificial Sequence
  Description of Artificial Sequence: Synthetic oligonucleotide
tcaaagtcacagttagtgaa

SEQ ID NO: 10240 - DNA, 20 bp, Artificial Sequence
  Description of Artificial Sequence: Synthetic oligonucleotide
ctcaaagtcacagttagtga

SEQ ID NO: 10241 - DNA, 20 bp, Artificial Sequence
  Description of Artificial Sequence: Synthetic oligonucleotide
tctcaaagtcacagttagtg

SEQ ID NO: 10242 - DNA, 20 bp, Artificial Sequence
  Description of Artificial Sequence: Synthetic oligonucleotide
ttctcaaagtcacagttagt

SEQ ID NO: 10243 - DNA, 20 bp, Artificial Sequence
  Description of Artificial Sequence: Synthetic oligonucleotide
cttctcaaagtcacagttag

SEQ ID NO: 10244 - DNA, 20 bp, Artificial Sequence
  Description of Artificial Sequence: Synthetic oligonucleotide
tcttctcaaagtcacagtta

SEQ ID NO: 10245 - DNA, 20 bp, Artificial Sequence
  Description of Artificial Sequence: Synthetic oligonucleotide
atcttctcaaagtcacagtt

SEQ ID NO: 10246 - DNA, 20 bp, Artificial Sequence
  Description of Artificial Sequence: Synthetic oligonucleotide
aatcttctcaaagtcacagt

SEQ ID NO: 10247 - DNA, 20 bp, Artificial Sequence
  Description of Artificial Sequence: Synthetic oligonucleotide
taatcttctcaaagtcacag

SEQ ID NO: 10248 - DNA, 20 bp, Artificial Sequence
  Description of Artificial Sequence: Synthetic oligonucleotide
ttaatcttctcaaagtcaca

SEQ ID NO: 10249 - DNA, 20 bp, Artificial Sequence
  Description of Artificial Sequence: Synthetic oligonucleotide
tttaatcttctcaaagtcac

SEQ ID NO: 10250 - DNA, 20 bp, Artificial Sequence
  Description of Artificial Sequence: Synthetic oligonucleotide
ctttaatcttctcaaagtca

SEQ ID NO: 10251 - DNA, 20 bp, Artificial Sequence
  Description of Artificial Sequence: Synthetic oligonucleotide
gctttaatcttctcaaagtc

SEQ ID NO: 10252 - DNA, 20 bp, Artificial Sequence
  Description of Artificial Sequence: Synthetic oligonucleotide
tgctttaatcttctcaaagt

SEQ ID NO: 10253 - DNA, 20 bp, Artificial Sequence
  Description of Artificial Sequence: Synthetic oligonucleotide
ctgctttaatcttctcaaag

SEQ ID NO: 10254 - DNA, 20 bp, Artificial Sequence
  Description of Artificial Sequence: Synthetic oligonucleotide
gctgctttaatcttctcaaa

SEQ ID NO: 10255 - DNA, 20 bp, Artificial Sequence
  Description of Artificial Sequence: Synthetic oligonucleotide
ggctgctttaatcttctcaa

SEQ ID NO: 10256 - DNA, 20 bp, Artificial Sequence
  Description of Artificial Sequence: Synthetic oligonucleotide
aggctgctttaatcttctca

SEQ ID NO: 10257 - DNA, 20 bp, Artificial Sequence
  Description of Artificial Sequence: Synthetic oligonucleotide
taggctgctttaatcttctc

SEQ ID NO: 10258 - DNA, 20 bp, Artificial Sequence
  Description of Artificial Sequence: Synthetic oligonucleotide
ataggctgctttaatcttct

SEQ ID NO: 10259 - DNA, 20 bp, Artificial Sequence
  Description of Artificial Sequence: Synthetic oligonucleotide
gataggctgctttaatcttc

SEQ ID NO: 10260 - DNA, 20 bp, Artificial Sequence
  Description of Artificial Sequence: Synthetic oligonucleotide
agataggctgctttaatctt

SEQ ID NO: 10261 - DNA, 20 bp, Artificial Sequence
  Description of Artificial Sequence: Synthetic oligonucleotide
gagataggctgctttaatct

SEQ ID NO: 10262 - DNA, 20 bp, Artificial Sequence
  Description of Artificial Sequence: Synthetic oligonucleotide
tgagataggctgctttaatc

SEQ ID NO: 10263 - DNA, 20 bp, Artificial Sequence
  Description of Artificial Sequence: Synthetic oligonucleotide
ctgagataggctgctttaat

SEQ ID NO: 10264 - DNA, 20 bp, Artificial Sequence
  Description of Artificial Sequence: Synthetic oligonucleotide
actgagataggctgctttaa

SEQ ID NO: 10265 - DNA, 20 bp, Artificial Sequence
  Description of Artificial Sequence: Synthetic oligonucleotide
tactgagataggctgcttta

SEQ ID NO: 10266 - DNA, 20 bp, Artificial Sequence
  Description of Artificial Sequence: Synthetic oligonucleotide
gtactgagataggctgcttt

SEQ ID NO: 10267 - DNA, 20 bp, Artificial Sequence
  Description of Artificial Sequence: Synthetic oligonucleotide
agtactgagataggctgctt

SEQ ID NO: 10268 - DNA, 20 bp, Artificial Sequence
  Description of Artificial Sequence: Synthetic oligonucleotide
tagtactgagataggctgct

SEQ ID NO: 10269 - DNA, 20 bp, Artificial Sequence
  Description of Artificial Sequence: Synthetic oligonucleotide
atagtactgagataggctgc

SEQ ID NO: 10270 - DNA, 20 bp, Artificial Sequence
  Description of Artificial Sequence: Synthetic oligonucleotide
aatagtactgagataggctg

SEQ ID NO: 10271 - DNA, 20 bp, Artificial Sequence
  Description of Artificial Sequence: Synthetic oligonucleotide
aaatagtactgagataggct

SEQ ID NO: 10272 - DNA, 20 bp, Artificial Sequence
  Description of Artificial Sequence: Synthetic oligonucleotide
gaaatagtactgagataggc

SEQ ID NO: 10273 - DNA, 20 bp, Artificial Sequence
  Description of Artificial Sequence: Synthetic oligonucleotide
agaaatagtactgagatagg

SEQ ID NO: 10274 - DNA, 20 bp, Artificial Sequence
  Description of Artificial Sequence: Synthetic oligonucleotide
tagaaatagtactgagatag

SEQ ID NO: 10275 - DNA, 20 bp, Artificial Sequence
  Description of Artificial Sequence: Synthetic oligonucleotide
ttagaaatagtactgagata

SEQ ID NO: 10276 - DNA, 20 bp, Artificial Sequence
  Description of Artificial Sequence: Synthetic oligonucleotide
tttagaaatagtactgagat

SEQ ID NO: 10277 - DNA, 20 bp, Artificial Sequence
  Description of Artificial Sequence: Synthetic oligonucleotide
ctttagaaatagtactgaga

SEQ ID NO: 10278 - DNA, 20 bp, Artificial Sequence
  Description of Artificial Sequence: Synthetic oligonucleotide
tctttagaaatagtactgag

SEQ ID NO: 10279 - DNA, 20 bp, Artificial Sequence
  Description of Artificial Sequence: Synthetic oligonucleotide
gtctttagaaatagtactga

SEQ ID NO: 10280 - DNA, 20 bp, Artificial Sequence
  Description of Artificial Sequence: Synthetic oligonucleotide
ggtctttagaaatagtactg

SEQ ID NO: 10281 - DNA, 20 bp, Artificial Sequence
  Description of Artificial Sequence: Synthetic oligonucleotide
aggtctttagaaatagtact

SEQ ID NO: 10282 - DNA, 20 bp, Artificial Sequence
  Description of Artificial Sequence: Synthetic oligonucleotide
caggtctttagaaatagtac

SEQ ID NO: 10283 - DNA, 20 bp, Artificial Sequence
  Description of Artificial Sequence: Synthetic oligonucleotide
tcaggtctttagaaatagta

SEQ ID NO: 10284 - DNA, 20 bp, Artificial Sequence
  Description of Artificial Sequence: Synthetic oligonucleotide
atcaggtctttagaaatagt

SEQ ID NO: 10285 - DNA, 20 bp, Artificial Sequence
  Description of Artificial Sequence: Synthetic oligonucleotide
aatcaggtctttagaaatag

SEQ ID NO: 10286 - DNA, 20 bp, Artificial Sequence
  Description of Artificial Sequence: Synthetic oligonucleotide
taatcaggtctttagaaata

SEQ ID NO: 10287 - DNA, 20 bp, Artificial Sequence
  Description of Artificial Sequence: Synthetic oligonucleotide
gtaatcaggtctttagaaat

SEQ ID NO: 10288 - DNA, 20 bp, Artificial Sequence
  Description of Artificial Sequence: Synthetic oligonucleotide
tgtaatcaggtctttagaaa

SEQ ID NO: 10289 - DNA, 20 bp, Artificial Sequence
  Description of Artificial Sequence: Synthetic oligonucleotide
atgtaatcaggtctttagaa

SEQ ID NO: 10290 - DNA, 20 bp, Artificial Sequence
  Description of Artificial Sequence: Synthetic oligonucleotide
tatgtaatcaggtctttaga

SEQ ID NO: 10291 - DNA, 20 bp, Artificial Sequence
  Description of Artificial Sequence: Synthetic oligonucleotide
atatgtaatcaggtctttag

SEQ ID NO: 10292 - DNA, 20 bp, Artificial Sequence
  Description of Artificial Sequence: Synthetic oligonucleotide
tatatgtaatcaggtcttta

SEQ ID NO: 10293 - DNA, 20 bp, Artificial Sequence
  Description of Artificial Sequence: Synthetic oligonucleotide
atatatgtaatcaggtcttt

SEQ ID NO: 10294 - DNA, 20 bp, Artificial Sequence
  Description of Artificial Sequence: Synthetic oligonucleotide
catatatgtaatcaggtctt

SEQ ID NO: 10295 - DNA, 20 bp, Artificial Sequence
  Description of Artificial Sequence: Synthetic oligonucleotide
tcatatatgtaatcaggtct

SEQ ID NO: 10296 - DNA, 20 bp, Artificial Sequence
  Description of Artificial Sequence: Synthetic oligonucleotide
ctcatatatgtaatcaggtc

SEQ ID NO: 10297 - DNA, 20 bp, Artificial Sequence
  Description of Artificial Sequence: Synthetic oligonucleotide
actcatatatgtaatcaggt

SEQ ID NO: 10298 - DNA, 20 bp, Artificial Sequence
  Description of Artificial Sequence: Synthetic oligonucleotide
cactcatatatgtaatcagg

SEQ ID NO: 10299 - DNA, 20 bp, Artificial Sequence
  Description of Artificial Sequence: Synthetic oligonucleotide
ccactcatatatgtaatcag

SEQ ID NO: 10300 - DNA, 20 bp, Artificial Sequence
  Description of Artificial Sequence: Synthetic oligonucleotide
cccactcatatatgtaatca

SEQ ID NO: 10301 - DNA, 20 bp, Artificial Sequence
  Description of Artificial Sequence: Synthetic oligonucleotide
tcccactcatatatgtaatc

SEQ ID NO: 10302 - DNA, 20 bp, Artificial Sequence
  Description of Artificial Sequence: Synthetic oligonucleotide
gtcccactcatatatgtaat

SEQ ID NO: 10303 - DNA, 20 bp, Artificial Sequence
  Description of Artificial Sequence: Synthetic oligonucleotide
ggtcccactcatatatgtaa

SEQ ID NO: 10304 - DNA, 20 bp, Artificial Sequence
  Description of Artificial Sequence: Synthetic oligonucleotide
tggtcccactcatatatgta

SEQ ID NO: 10305 - DNA, 20 bp, Artificial Sequence
  Description of Artificial Sequence: Synthetic oligonucleotide
ttggtcccactcatatatgt

SEQ ID NO: 10306 - DNA, 20 bp, Artificial Sequence
  Description of Artificial Sequence: Synthetic oligonucleotide
tttggtcccactcatatatg

SEQ ID NO: 10307 - DNA, 20 bp, Artificial Sequence
  Description of Artificial Sequence: Synthetic oligonucleotide
ttttggtcccactcatatat

SEQ ID NO: 10308 - DNA, 20 bp, Artificial Sequence
  Description of Artificial Sequence: Synthetic oligonucleotide
cttttggtcccactcatata

SEQ ID NO: 10309 - DNA, 20 bp, Artificial Sequence
  Description of Artificial Sequence: Synthetic oligonucleotide
acttttggtcccactcatat

SEQ ID NO: 10310 - DNA, 20 bp, Artificial Sequence
  Description of Artificial Sequence: Synthetic oligonucleotide
tacttttggtcccactcata

SEQ ID NO: 10311 - DNA, 20 bp, Artificial Sequence
  Description of Artificial Sequence: Synthetic oligonucleotide
gtacttttggtcccactcat

SEQ ID NO: 10312 - DNA, 20 bp, Artificial Sequence
  Description of Artificial Sequence: Synthetic oligonucleotide
ggtacttttggtcccactca

SEQ ID NO: 10313 - DNA, 20 bp, Artificial Sequence
  Description of Artificial Sequence: Synthetic oligonucleotide
cggtacttttggtcccactc

SEQ ID NO: 10314 - DNA, 20 bp, Artificial Sequence
  Description of Artificial Sequence: Synthetic oligonucleotide
tcggtacttttggtcccact

SEQ ID NO: 10315 - DNA, 20 bp, Artificial Sequence
  Description of Artificial Sequence: Synthetic oligonucleotide
ctcggtacttttggtcccac

SEQ ID NO: 10316 - DNA, 20 bp, Artificial Sequence
  Description of Artificial Sequence: Synthetic oligonucleotide
actcggtacttttggtccca

SEQ ID NO: 10317 - DNA, 20 bp, Artificial Sequence
  Description of Artificial Sequence: Synthetic oligonucleotide
aactcggtacttttggtccc

SEQ ID NO: 10318 - DNA, 20 bp, Artificial Sequence
  Description of Artificial Sequence: Synthetic oligonucleotide
gaactcggtacttttggtcc

SEQ ID NO: 10319 - DNA, 20 bp, Artificial Sequence
  Description of Artificial Sequence: Synthetic oligonucleotide
tgaactcggtacttttggtc

SEQ ID NO: 10320 - DNA, 20 bp, Artificial Sequence
  Description of Artificial Sequence: Synthetic oligonucleotide
ttgaactcggtacttttggt

SEQ ID NO: 10321 - DNA, 20 bp, Artificial Sequence
  Description of Artificial Sequence: Synthetic oligonucleotide
gttgaactcggtacttttgg

SEQ ID NO: 10322 - DNA, 20 bp, Artificial Sequence
  Description of Artificial Sequence: Synthetic oligonucleotide
tgttgaactcggtacttttg

SEQ ID NO: 10323 - DNA, 20 bp, Artificial Sequence
  Description of Artificial Sequence: Synthetic oligonucleotide
ttgttgaactcggtactttt

SEQ ID NO: 10324 - DNA, 20 bp, Artificial Sequence
  Description of Artificial Sequence: Synthetic oligonucleotide
gttgttgaactcggtacttt

SEQ ID NO: 10325 - DNA, 20 bp, Artificial Sequence
  Description of Artificial Sequence: Synthetic oligonucleotide
tgttgttgaactcggtactt

SEQ ID NO: 10326 - DNA, 20 bp, Artificial Sequence
  Description of Artificial Sequence: Synthetic oligonucleotide
gtgttgttgaactcggtact

SEQ ID NO: 10327 - DNA, 20 bp, Artificial Sequence
  Description of Artificial Sequence: Synthetic oligonucleotide
ggtgttgttgaactcggtac

SEQ ID NO: 10328 - DNA, 20 bp, Artificial Sequence
  Description of Artificial Sequence: Synthetic oligonucleotide
cggtgttgttgaactcggta

SEQ ID NO: 10329 - DNA, 20 bp, Artificial Sequence
  Description of Artificial Sequence: Synthetic oligonucleotide
acggtgttgttgaactcggt

SEQ ID NO: 10330 - DNA, 20 bp, Artificial Sequence
  Description of Artificial Sequence: Synthetic oligonucleotide
gacggtgttgttgaactcgg

SEQ ID NO: 10331 - DNA, 20 bp, Artificial Sequence
  Description of Artificial Sequence: Synthetic oligonucleotide
agacggtgttgttgaactcg

SEQ ID NO: 10332 - DNA, 20 bp, Artificial Sequence
  Description of Artificial Sequence: Synthetic oligonucleotide
gagacggtgttgttgaactc

SEQ ID NO: 10333 - DNA, 20 bp, Artificial Sequence
  Description of Artificial Sequence: Synthetic oligonucleotide
agagacggtgttgttgaact

SEQ ID NO: 10334 - DNA, 20 bp, Artificial Sequence
  Description of Artificial Sequence: Synthetic oligonucleotide
aagagacggtgttgttgaac

SEQ ID NO: 10335 - DNA, 20 bp, Artificial Sequence
  Description of Artificial Sequence: Synthetic oligonucleotide
caagagacggtgttgttgaa

SEQ ID NO: 10336 - DNA, 20 bp, Artificial Sequence
  Description of Artificial Sequence: Synthetic oligonucleotide
acaagagacggtgttgttga

SEQ ID NO: 10337 - DNA, 20 bp, Artificial Sequence
  Description of Artificial Sequence: Synthetic oligonucleotide
tacaagagacggtgttgttg

SEQ ID NO: 10338 - DNA, 20 bp, Artificial Sequence
  Description of Artificial Sequence: Synthetic oligonucleotide
ctacaagagacggtgttgtt

SEQ ID NO: 10339 - DNA, 20 bp, Artificial Sequence
  Description of Artificial Sequence: Synthetic oligonucleotide
gctacaagagacggtgttgt

SEQ ID NO: 10340 - DNA, 20 bp, Artificial Sequence
  Description of Artificial Sequence: Synthetic oligonucleotide
tgctacaagagacggtgttg

SEQ ID NO: 10341 - DNA, 20 bp, Artificial Sequence
  Description of Artificial Sequence: Synthetic oligonucleotide
ttgctacaagagacggtgtt

SEQ ID NO: 10342 - DNA, 20 bp, Artificial Sequence
  Description of Artificial Sequence: Synthetic oligonucleotide
attgctacaagagacggtgt

SEQ ID NO: 10343 - DNA, 20 bp, Artificial Sequence
  Description of Artificial Sequence: Synthetic oligonucleotide
gattgctacaagagacggtg

SEQ ID NO: 10344 - DNA, 20 bp, Artificial Sequence
  Description of Artificial Sequence: Synthetic oligonucleotide
cgattgctacaagagacggt

SEQ ID NO: 10345 - DNA, 20 bp, Artificial Sequence
  Description of Artificial Sequence: Synthetic oligonucleotide
ccgattgctacaagagacgg

SEQ ID NO: 10346 - DNA, 20 bp, Artificial Sequence
  Description of Artificial Sequence: Synthetic oligonucleotide
gccgattgctacaagagacg

SEQ ID NO: 10347 - DNA, 20 bp, Artificial Sequence
  Description of Artificial Sequence: Synthetic oligonucleotide
ggccgattgctacaagagac

SEQ ID NO: 10348 - DNA, 20 bp, Artificial Sequence
  Description of Artificial Sequence: Synthetic oligonucleotide
tggccgattgctacaagaga

SEQ ID NO: 10349 - DNA, 20 bp, Artificial Sequence
  Description of Artificial Sequence: Synthetic oligonucleotide
gtggccgattgctacaagag

SEQ ID NO: 10350 - DNA, 20 bp, Artificial Sequence
  Description of Artificial Sequence: Synthetic oligonucleotide
tgtggccgattgctacaaga

SEQ ID NO: 10351 - DNA, 20 bp, Artificial Sequence
  Description of Artificial Sequence: Synthetic oligonucleotide
atgtggccgattgctacaag

SEQ ID NO: 10352 - DNA, 20 bp, Artificial Sequence
  Description of Artificial Sequence: Synthetic oligonucleotide
aatgtggccgattgctacaa

SEQ ID NO: 10353 - DNA, 20 bp, Artificial Sequence
  Description of Artificial Sequence: Synthetic oligonucleotide
caatgtggccgattgctaca

SEQ ID NO: 10354 - DNA, 20 bp, Artificial Sequence
  Description of Artificial Sequence: Synthetic oligonucleotide
gcaatgtggccgattgctac

SEQ ID NO: 10355 - DNA, 20 bp, Artificial Sequence
  Description of Artificial Sequence: Synthetic oligonucleotide
ggcaatgtggccgattgcta

SEQ ID NO: 10356 - DNA, 20 bp, Artificial Sequence
  Description of Artificial Sequence: Synthetic oligonucleotide
aggcaatgtggccgattgct

SEQ ID NO: 10357 - DNA, 20 bp, Artificial Sequence
  Description of Artificial Sequence: Synthetic oligonucleotide
aaggcaatgtggccgattgc

SEQ ID NO: 10358 - DNA, 20 bp, Artificial Sequence
  Description of Artificial Sequence: Synthetic oligonucleotide
taaggcaatgtggccgattg

SEQ ID NO: 10359 - DNA, 20 bp, Artificial Sequence
  Description of Artificial Sequence: Synthetic oligonucleotide
gtaaggcaatgtggccgatt

SEQ ID NO: 10360 - DNA, 20 bp, Artificial Sequence
  Description of Artificial Sequence: Synthetic oligonucleotide
agtaaggcaatgtggccgat

SEQ ID NO: 10361 - DNA, 20 bp, Artificial Sequence
  Description of Artificial Sequence: Synthetic oligonucleotide
cagtaaggcaatgtggccga

SEQ ID NO: 10362 - DNA, 20 bp, Artificial Sequence
  Description of Artificial Sequence: Synthetic oligonucleotide
tcagtaaggcaatgtggccg

SEQ ID NO: 10363 - DNA, 20 bp, Artificial Sequence
  Description of Artificial Sequence: Synthetic oligonucleotide
ttcagtaaggcaatgtggcc

SEQ ID NO: 10364 - DNA, 20 bp, Artificial Sequence
  Description of Artificial Sequence: Synthetic oligonucleotide
tttcagtaaggcaatgtggc

SEQ ID NO: 10365 - DNA, 20 bp, Artificial Sequence
  Description of Artificial Sequence: Synthetic oligonucleotide
atttcagtaaggcaatgtgg

SEQ ID NO: 10366 - DNA, 20 bp, Artificial Sequence
  Description of Artificial Sequence: Synthetic oligonucleotide
gatttcagtaaggcaatgtg

SEQ ID NO: 10367 - DNA, 20 bp, Artificial Sequence
  Description of Artificial Sequence: Synthetic oligonucleotide
ggatttcagtaaggcaatgt

SEQ ID NO: 10368 - DNA, 20 bp, Artificial Sequence
  Description of Artificial Sequence: Synthetic oligonucleotide
tggatttcagtaaggcaatg

SEQ ID NO: 10369 - DNA, 20 bp, Artificial Sequence
  Description of Artificial Sequence: Synthetic oligonucleotide
ctggatttcagtaaggcaat

SEQ ID NO: 10370 - DNA, 20 bp, Artificial Sequence
  Description of Artificial Sequence: Synthetic oligonucleotide
tctggatttcagtaaggcaa

SEQ ID NO: 10371 - DNA, 20 bp, Artificial Sequence
  Description of Artificial Sequence: Synthetic oligonucleotide
ctctggatttcagtaaggca

SEQ ID NO: 10372 - DNA, 20 bp, Artificial Sequence
  Description of Artificial Sequence: Synthetic oligonucleotide
gctctggatttcagtaaggc

SEQ ID NO: 10373 - DNA, 20 bp, Artificial Sequence
  Description of Artificial Sequence: Synthetic oligonucleotide
ggctctggatttcagtaagg

SEQ ID NO: 10374 - DNA, 20 bp, Artificial Sequence
  Description of Artificial Sequence: Synthetic oligonucleotide
aggctctggatttcagtaag

SEQ ID NO: 10375 - DNA, 20 bp, Artificial Sequence
  Description of Artificial Sequence: Synthetic oligonucleotide
taggctctggatttcagtaa

SEQ ID NO: 10376 - DNA, 20 bp, Artificial Sequence
  Description of Artificial Sequence: Synthetic oligonucleotide
ttaggctctggatttcagta

SEQ ID NO: 10377 - DNA, 20 bp, Artificial Sequence
  Description of Artificial Sequence: Synthetic oligonucleotide
gttaggctctggatttcagt

SEQ ID NO: 10378 - DNA, 20 bp, Artificial Sequence
  Description of Artificial Sequence: Synthetic oligonucleotide
ggttaggctctggatttcag

SEQ ID NO: 10379 - DNA, 20 bp, Artificial Sequence
  Description of Artificial Sequence: Synthetic oligonucleotide
aggttaggctctggatttca

SEQ ID NO: 10380 - DNA, 20 bp, Artificial Sequence
  Description of Artificial Sequence: Synthetic oligonucleotide
aaggttaggctctggatttc

SEQ ID NO: 10381 - DNA, 20 bp, Artificial Sequence
  Description of Artificial Sequence: Synthetic oligonucleotide
gaaggttaggctctggattt

SEQ ID NO: 10382 - DNA, 20 bp, Artificial Sequence
  Description of Artificial Sequence: Synthetic oligonucleotide
tgaaggttaggctctggatt

SEQ ID NO: 10383 - DNA, 20 bp, Artificial Sequence
  Description of Artificial Sequence: Synthetic oligonucleotide
ttgaaggttaggctctggat

SEQ ID NO: 10384 - DNA, 20 bp, Artificial Sequence
  Description of Artificial Sequence: Synthetic oligonucleotide
attgaaggttaggctctgga

SEQ ID NO: 10385 - DNA, 20 bp, Artificial Sequence
  Description of Artificial Sequence: Synthetic oligonucleotide
gattgaaggttaggctctgg

SEQ ID NO: 10386 - DNA, 20 bp, Artificial Sequence
  Description of Artificial Sequence: Synthetic oligonucleotide
ggattgaaggttaggctctg

SEQ ID NO: 10387 - DNA, 20 bp, Artificial Sequence
  Description of Artificial Sequence: Synthetic oligonucleotide
gggattgaaggttaggctct

SEQ ID NO: 10388 - DNA, 20 bp, Artificial Sequence
  Description of Artificial Sequence: Synthetic oligonucleotide
tgggattgaaggttaggctc

SEQ ID NO: 10389 - DNA, 20 bp, Artificial Sequence
  Description of Artificial Sequence: Synthetic oligonucleotide
gtgggattgaaggttaggct

SEQ ID NO: 10390 - DNA, 20 bp, Artificial Sequence
  Description of Artificial Sequence: Synthetic oligonucleotide
ggtgggattgaaggttaggc

SEQ ID NO: 10391 - DNA, 20 bp, Artificial Sequence
  Description of Artificial Sequence: Synthetic oligonucleotide
cggtgggattgaaggttagg

SEQ ID NO: 10392 - DNA, 20 bp, Artificial Sequence
  Description of Artificial Sequence: Synthetic oligonucleotide
gcggtgggattgaaggttag

SEQ ID NO: 10393 - DNA, 20 bp, Artificial Sequence
  Description of Artificial Sequence: Synthetic oligonucleotide
ggcggtgggattgaaggtta

SEQ ID NO: 10394 - DNA, 20 bp, Artificial Sequence
  Description of Artificial Sequence: Synthetic oligonucleotide
cggcggtgggattgaaggtt

SEQ ID NO: 10395 - DNA, 20 bp, Artificial Sequence
  Description of Artificial Sequence: Synthetic oligonucleotide
ccggcggtgggattgaaggt

SEQ ID NO: 10396 - DNA, 20 bp, Artificial Sequence
  Description of Artificial Sequence: Synthetic oligonucleotide
gccggcggtgggattgaagg

SEQ ID NO: 10397 - DNA, 20 bp, Artificial Sequence
  Description of Artificial Sequence: Synthetic oligonucleotide
agccggcggtgggattgaag

SEQ ID NO: 10398 - DNA, 20 bp, Artificial Sequence
  Description of Artificial Sequence: Synthetic oligonucleotide
cagccggcggtgggattgaa

SEQ ID NO: 10399 - DNA, 20 bp, Artificial Sequence
  Description of Artificial Sequence: Synthetic oligonucleotide
gcagccggcggtgggattga

SEQ ID NO: 10400 - DNA, 20 bp, Artificial Sequence
  Description of Artificial Sequence: Synthetic oligonucleotide
cgcagccggcggtgggattg

SEQ ID NO: 10401 - DNA, 20 bp, Artificial Sequence
  Description of Artificial Sequence: Synthetic oligonucleotide
gcgcagccggcggtgggatt

SEQ ID NO: 10402 - DNA, 20 bp, Artificial Sequence
  Description of Artificial Sequence: Synthetic oligonucleotide
cgcgcagccggcggtgggat

SEQ ID NO: 10403 - DNA, 20 bp, Artificial Sequence
  Description of Artificial Sequence: Synthetic oligonucleotide
acgcgcagccggcggtggga

SEQ ID NO: 10404 - DNA, 20 bp, Artificial Sequence
  Description of Artificial Sequence: Synthetic oligonucleotide
gacgcgcagccggcggtggg

SEQ ID NO: 10405 - DNA, 20 bp, Artificial Sequence
  Description of Artificial Sequence: Synthetic oligonucleotide
cgacgcgcagccggcggtgg

SEQ ID NO: 10406 - DNA, 20 bp, Artificial Sequence
  Description of Artificial Sequence: Synthetic oligonucleotide
gcgacgcgcagccggcggtg

SEQ ID NO: 10407 - DNA, 20 bp, Artificial Sequence
  Description of Artificial Sequence: Synthetic oligonucleotide
agcgacgcgcagccggcggt

SEQ ID NO: 10408 - DNA, 20 bp, Artificial Sequence
  Description of Artificial Sequence: Synthetic oligonucleotide
gagcgacgcgcagccggcgg

SEQ ID NO: 10409 - DNA, 20 bp, Artificial Sequence
  Description of Artificial Sequence: Synthetic oligonucleotide
cgagcgacgcgcagccggcg

SEQ ID NO: 10410 - DNA, 20 bp, Artificial Sequence
  Description of Artificial Sequence: Synthetic oligonucleotide
gcgagcgacgcgcagccggc

SEQ ID NO: 10411 - DNA, 20 bp, Artificial Sequence
  Description of Artificial Sequence: Synthetic oligonucleotide
ggcgagcgacgcgcagccgg

SEQ ID NO: 10412 - DNA, 20 bp, Artificial Sequence
  Description of Artificial Sequence: Synthetic oligonucleotide
tggcgagcgacgcgcagccg

SEQ ID NO: 10413 - DNA, 20 bp, Artificial Sequence
  Description of Artificial Sequence: Synthetic oligonucleotide
ttggcgagcgacgcgcagcc

SEQ ID NO: 10414 - DNA, 20 bp, Artificial Sequence
  Description of Artificial Sequence: Synthetic oligonucleotide
tttggcgagcgacgcgcagc

SEQ ID NO: 10415 - DNA, 20 bp, Artificial Sequence
  Description of Artificial Sequence: Synthetic oligonucleotide
ctttggcgagcgacgcgcag

SEQ ID NO: 10416 - DNA, 20 bp, Artificial Sequence
  Description of Artificial Sequence: Synthetic oligonucleotide
tctttggcgagcgacgcgca

SEQ ID NO: 10417 - DNA, 20 bp, Artificial Sequence
  Description of Artificial Sequence: Synthetic oligonucleotide
ttctttggcgagcgacgcgc

SEQ ID NO: 10418 - DNA, 20 bp, Artificial Sequence
  Description of Artificial Sequence: Synthetic oligonucleotide
tttctttggcgagcgacgcg

SEQ ID NO: 10419 - DNA, 20 bp, Artificial Sequence
  Description of Artificial Sequence: Synthetic oligonucleotide
atttctttggcgagcgacgc

SEQ ID NO: 10420 - DNA, 20 bp, Artificial Sequence
  Description of Artificial Sequence: Synthetic oligonucleotide
catttctttggcgagcgacg

SEQ ID NO: 10421 - DNA, 20 bp, Artificial Sequence
  Description of Artificial Sequence: Synthetic oligonucleotide
acatttctttggcgagcgac

SEQ ID NO: 10422 - DNA, 20 bp, Artificial Sequence
  Description of Artificial Sequence: Synthetic oligonucleotide
aacatttctttggcgagcga

SEQ ID NO: 10423 - DNA, 20 bp, Artificial Sequence
  Description of Artificial Sequence: Synthetic oligonucleotide
gaacatttctttggcgagcg

SEQ ID NO: 10424 - DNA, 20 bp, Artificial Sequence
  Description of Artificial Sequence: Synthetic oligonucleotide
cgaacatttctttggcgagc

SEQ ID NO: 10425 - DNA, 20 bp, Artificial Sequence
  Description of Artificial Sequence: Synthetic oligonucleotide
gcgaacatttctttggcgag

SEQ ID NO: 10426 - DNA, 20 bp, Artificial Sequence
  Description of Artificial Sequence: Synthetic oligonucleotide
ggcgaacatttctttggcga

SEQ ID NO: 10427 - DNA, 20 bp, Artificial Sequence
  Description of Artificial Sequence: Synthetic oligonucleotide
tggcgaacatttctttggcg

SEQ ID NO: 10428 - DNA, 20 bp, Artificial Sequence
  Description of Artificial Sequence: Synthetic oligonucleotide
atggcgaacatttctttggc

SEQ ID NO: 10429 - DNA, 20 bp, Artificial Sequence
  Description of Artificial Sequence: Synthetic oligonucleotide
catggcgaacatttctttgg

SEQ ID NO: 10430 - DNA, 20 bp, Artificial Sequence
  Description of Artificial Sequence: Synthetic oligonucleotide
tcatggcgaacatttctttg

SEQ ID NO: 10431 - DNA, 20 bp, Artificial Sequence
  Description of Artificial Sequence: Synthetic oligonucleotide
ttcatggcgaacatttcttt

SEQ ID NO: 10432 - DNA, 20 bp, Artificial Sequence
  Description of Artificial Sequence: Synthetic oligonucleotide
tttcatggcgaacatttctt

SEQ ID NO: 10433 - DNA, 20 bp, Artificial Sequence
  Description of Artificial Sequence: Synthetic oligonucleotide
ttttcatggcgaacatttct

SEQ ID NO: 10434 - DNA, 20 bp, Artificial Sequence
  Description of Artificial Sequence: Synthetic oligonucleotide
gttttcatggcgaacatttc

SEQ ID NO: 10435 - DNA, 20 bp, Artificial Sequence
  Description of Artificial Sequence: Synthetic oligonucleotide
agttttcatggcgaacattt

SEQ ID NO: 10436 - DNA, 20 bp, Artificial Sequence
  Description of Artificial Sequence: Synthetic oligonucleotide
tagttttcatggcgaacatt

SEQ ID NO: 10437 - DNA, 20 bp, Artificial Sequence
  Description of Artificial Sequence: Synthetic oligonucleotide
ttagttttcatggcgaacat

SEQ ID NO: 10438 - DNA, 20 bp, Artificial Sequence
  Description of Artificial Sequence: Synthetic oligonucleotide
cttagttttcatggcgaaca

SEQ ID NO: 10439 - DNA, 20 bp, Artificial Sequence
  Description of Artificial Sequence: Synthetic oligonucleotide
ccttagttttcatggcgaac

SEQ ID NO: 10440 - DNA, 20 bp, Artificial Sequence
  Description of Artificial Sequence: Synthetic oligonucleotide
gccttagttttcatggcgaa

SEQ ID NO: 10441 - DNA, 20 bp, Artificial Sequence
  Description of Artificial Sequence: Synthetic oligonucleotide
agccttagttttcatggcga

SEQ ID NO: 10442 - DNA, 20 bp, Artificial Sequence
  Description of Artificial Sequence: Synthetic oligonucleotide
cagccttagttttcatggcg

SEQ ID NO: 10443 - DNA, 20 bp, Artificial Sequence
  Description of Artificial Sequence: Synthetic oligonucleotide
gcagccttagttttcatggc

SEQ ID NO: 10444 - DNA, 20 bp, Artificial Sequence
  Description of Artificial Sequence: Synthetic oligonucleotide
ggcagccttagttttcatgg

SEQ ID NO: 10445 - DNA, 20 bp, Artificial Sequence
  Description of Artificial Sequence: Synthetic oligonucleotide
aggcagccttagttttcatg

SEQ ID NO: 10446 - DNA, 20 bp, Artificial Sequence
  Description of Artificial Sequence: Synthetic oligonucleotide
aaggcagccttagttttcat

SEQ ID NO: 10447 - DNA, 20 bp, Artificial Sequence
  Description of Artificial Sequence: Synthetic oligonucleotide
taaggcagccttagttttca

SEQ ID NO: 10448 - DNA, 20 bp, Artificial Sequence
  Description of Artificial Sequence: Synthetic oligonucleotide
ctaaggcagccttagttttc

SEQ ID NO: 10449 - DNA, 20 bp, Artificial Sequence
  Description of Artificial Sequence: Synthetic oligonucleotide
gctaaggcagccttagtttt

SEQ ID NO: 10450 - DNA, 20 bp, Artificial Sequence
  Description of Artificial Sequence: Synthetic oligonucleotide
agctaaggcagccttagttt

SEQ ID NO: 10451 - DNA, 20 bp, Artificial Sequence
  Description of Artificial Sequence: Synthetic oligonucleotide
tagctaaggcagccttagtt

SEQ ID NO: 10452 - DNA, 20 bp, Artificial Sequence
  Description of Artificial Sequence: Synthetic oligonucleotide
atagctaaggcagccttagt

SEQ ID NO: 10453 - DNA, 20 bp, Artificial Sequence
  Description of Artificial Sequence: Synthetic oligonucleotide
gatagctaaggcagccttag

SEQ ID NO: 10454 - DNA, 20 bp, Artificial Sequence
  Description of Artificial Sequence: Synthetic oligonucleotide
agatagctaaggcagcctta

SEQ ID NO: 10455 - DNA, 20 bp, Artificial Sequence
  Description of Artificial Sequence: Synthetic oligonucleotide
cagatagctaaggcagcctt

SEQ ID NO: 10456 - DNA, 20 bp, Artificial Sequence
  Description of Artificial Sequence: Synthetic oligonucleotide
ccagatagctaaggcagcct

SEQ ID NO: 10457 - DNA, 20 bp, Artificial Sequence
  Description of Artificial Sequence: Synthetic oligonucleotide
accagatagctaaggcagcc

SEQ ID NO: 10458 - DNA, 20 bp, Artificial Sequence
  Description of Artificial Sequence: Synthetic oligonucleotide
caccagatagctaaggcagc

SEQ ID NO: 10459 - DNA, 20 bp, Artificial Sequence
  Description of Artificial Sequence: Synthetic oligonucleotide
gcaccagatagctaaggcag

SEQ ID NO: 10460 - DNA, 20 bp, Artificial Sequence
  Description of Artificial Sequence: Synthetic oligonucleotide
ggcaccagatagctaaggca

SEQ ID NO: 10461 - DNA, 20 bp, Artificial Sequence
  Description of Artificial Sequence: Synthetic oligonucleotide
gggcaccagatagctaaggc

SEQ ID NO: 10462 - DNA, 20 bp, Artificial Sequence
  Description of Artificial Sequence: Synthetic oligonucleotide
tgggcaccagatagctaagg

SEQ ID NO: 10463 - DNA, 20 bp, Artificial Sequence
  Description of Artificial Sequence: Synthetic oligonucleotide
ctgggcaccagatagctaag

SEQ ID NO: 10464 - DNA, 20 bp, Artificial Sequence
  Description of Artificial Sequence: Synthetic oligonucleotide
cctgggcaccagatagctaa

SEQ ID NO: 10465 - DNA, 20 bp, Artificial Sequence
  Description of Artificial Sequence: Synthetic oligonucleotide
gcctgggcaccagatagcta

SEQ ID NO: 10466 - DNA, 20 bp, Artificial Sequence
  Description of Artificial Sequence: Synthetic oligonucleotide
agcctgggcaccagatagct

SEQ ID NO: 10467 - DNA, 20 bp, Artificial Sequence
  Description of Artificial Sequence: Synthetic oligonucleotide
tagcctgggcaccagatagc

SEQ ID NO: 10468 - DNA, 20 bp, Artificial Sequence
  Description of Artificial Sequence: Synthetic oligonucleotide
atagcctgggcaccagatag

SEQ ID NO: 10469 - DNA, 20 bp, Artificial Sequence
  Description of Artificial Sequence: Synthetic oligonucleotide
aatagcctgggcaccagata

SEQ ID NO: 10470 - DNA, 20 bp, Artificial Sequence
  Description of Artificial Sequence: Synthetic oligonucleotide
gaatagcctgggcaccagat

SEQ ID NO: 10471 - DNA, 20 bp, Artificial Sequence
  Description of Artificial Sequence: Synthetic oligonucleotide
cgaatagcctgggcaccaga

SEQ ID NO: 10472 - DNA, 20 bp, Artificial Sequence
  Description of Artificial Sequence: Synthetic oligonucleotide
ccgaatagcctgggcaccag

SEQ ID NO: 10473 - DNA, 20 bp, Artificial Sequence
  Description of Artificial Sequence: Synthetic oligonucleotide
tccgaatagcctgggcacca

SEQ ID NO: 10474 - DNA, 20 bp, Artificial Sequence
  Description of Artificial Sequence: Synthetic oligonucleotide
ttccgaatagcctgggcacc

SEQ ID NO: 10475 - DNA, 20 bp, Artificial Sequence
  Description of Artificial Sequence: Synthetic oligonucleotide
tttccgaatagcctgggcac

SEQ ID NO: 10476 - DNA, 20 bp, Artificial Sequence
  Description of Artificial Sequence: Synthetic oligonucleotide
gtttccgaatagcctgggca

SEQ ID NO: 10477 - DNA, 20 bp, Artificial Sequence
  Description of Artificial Sequence: Synthetic oligonucleotide
agtttccgaatagcctgggc

SEQ ID NO: 10478 - DNA, 20 bp, Artificial Sequence
  Description of Artificial Sequence: Synthetic oligonucleotide
gagtttccgaatagcctggg

SEQ ID NO: 10479 - DNA, 20 bp, Artificial Sequence
  Description of Artificial Sequence: Synthetic oligonucleotide
tgagtttccgaatagcctgg

SEQ ID NO: 10480 - DNA, 20 bp, Artificial Sequence
  Description of Artificial Sequence: Synthetic oligonucleotide
ctgagtttccgaatagcctg

SEQ ID NO: 10481 - DNA, 20 bp, Artificial Sequence
  Description of Artificial Sequence: Synthetic oligonucleotide
tctgagtttccgaatagcct

SEQ ID NO: 10482 - DNA, 20 bp, Artificial Sequence
  Description of Artificial Sequence: Synthetic oligonucleotide
atctgagtttccgaatagcc

SEQ ID NO: 10483 - DNA, 20 bp, Artificial Sequence
  Description of Artificial Sequence: Synthetic oligonucleotide
tatctgagtttccgaatagc

SEQ ID NO: 10484 - DNA, 20 bp, Artificial Sequence
  Description of Artificial Sequence: Synthetic oligonucleotide
ttatctgagtttccgaatag

SEQ ID NO: 10485 - DNA, 20 bp, Artificial Sequence
  Description of Artificial Sequence: Synthetic oligonucleotide
tttatctgagtttccgaata

SEQ ID NO: 10486 - DNA, 20 bp, Artificial Sequence
  Description of Artificial Sequence: Synthetic oligonucleotide
atttatctgagtttccgaat

SEQ ID NO: 10487 - DNA, 20 bp, Artificial Sequence
  Description of Artificial Sequence: Synthetic oligonucleotide
catttatctgagtttccgaa

SEQ ID NO: 10488 - DNA, 20 bp, Artificial Sequence
  Description of Artificial Sequence: Synthetic oligonucleotide
gcatttatctgagtttccga

SEQ ID NO: 10489 - DNA, 20 bp, Artificial Sequence
  Description of Artificial Sequence: Synthetic oligonucleotide
agcatttatctgagtttccg

SEQ ID NO: 10490 - DNA, 20 bp, Artificial Sequence
  Description of Artificial Sequence: Synthetic oligonucleotide
tagcatttatctgagtttcc

SEQ ID NO: 10491 - DNA, 20 bp, Artificial Sequence
  Description of Artificial Sequence: Synthetic oligonucleotide
gtagcatttatctgagtttc

SEQ ID NO: 10492 - DNA, 20 bp, Artificial Sequence
  Description of Artificial Sequence: Synthetic oligonucleotide
agtagcatttatctgagttt

SEQ ID NO: 10493 - DNA, 20 bp, Artificial Sequence
  Description of Artificial Sequence: Synthetic oligonucleotide
gagtagcatttatctgagtt

SEQ ID NO: 10494 - DNA, 20 bp, Artificial Sequence
  Description of Artificial Sequence: Synthetic oligonucleotide
tgagtagcatttatctgagt

SEQ ID NO: 10495 - DNA, 20 bp, Artificial Sequence
  Description of Artificial Sequence: Synthetic oligonucleotide
ctgagtagcatttatctgag

SEQ ID NO: 10496 - DNA, 20 bp, Artificial Sequence
  Description of Artificial Sequence: Synthetic oligonucleotide
cctgagtagcatttatctga

SEQ ID NO: 10497 - DNA, 20 bp, Artificial Sequence
  Description of Artificial Sequence: Synthetic oligonucleotide
gcctgagtagcatttatctg

SEQ ID NO: 10498 - DNA, 20 bp, Artificial Sequence
  Description of Artificial Sequence: Synthetic oligonucleotide
tgcctgagtagcatttatct

SEQ ID NO: 10499 - DNA, 20 bp, Artificial Sequence
  Description of Artificial Sequence: Synthetic oligonucleotide
ttgcctgagtagcatttatc

SEQ ID NO: 10500 - DNA, 20 bp, Artificial Sequence
  Description of Artificial Sequence: Synthetic oligonucleotide
attgcctgagtagcatttat

SEQ ID NO: 10501 - DNA, 20 bp, Artificial Sequence
  Description of Artificial Sequence: Synthetic oligonucleotide
cattgcctgagtagcattta

SEQ ID NO: 10502 - DNA, 20 bp, Artificial Sequence
  Description of Artificial Sequence: Synthetic oligonucleotide
tcattgcctgagtagcattt

SEQ ID NO: 10503 - DNA, 20 bp, Artificial Sequence
  Description of Artificial Sequence: Synthetic oligonucleotide
ttcattgcctgagtagcatt

SEQ ID NO: 10504 - DNA, 20 bp, Artificial Sequence
  Description of Artificial Sequence: Synthetic oligonucleotide
cttcattgcctgagtagcat

SEQ ID NO: 10505 - DNA, 20 bp, Artificial Sequence
  Description of Artificial Sequence: Synthetic oligonucleotide
tcttcattgcctgagtagca

SEQ ID NO: 10506 - DNA, 20 bp, Artificial Sequence
  Description of Artificial Sequence: Synthetic oligonucleotide
ttcttcattgcctgagtagc

SEQ ID NO: 10507 - DNA, 20 bp, Artificial Sequence
  Description of Artificial Sequence: Synthetic oligonucleotide
cttcttcattgcctgagtag

SEQ ID NO: 10508 - DNA, 20 bp, Artificial Sequence
  Description of Artificial Sequence: Synthetic oligonucleotide
tcttcttcattgcctgagta

SEQ ID NO: 10509 - DNA, 20 bp, Artificial Sequence
  Description of Artificial Sequence: Synthetic oligonucleotide
ctcttcttcattgcctgagt

SEQ ID NO: 10510 - DNA, 20 bp, Artificial Sequence
  Description of Artificial Sequence: Synthetic oligonucleotide
cctcttcttcattgcctgag

SEQ ID NO: 10511 - DNA, 20 bp, Artificial Sequence
  Description of Artificial Sequence: Synthetic oligonucleotide
tcctcttcttcattgcctga

SEQ ID NO: 10512 - DNA, 20 bp, Artificial Sequence
  Description of Artificial Sequence: Synthetic oligonucleotide
ctcctcttcttcattgcctg

SEQ ID NO: 10513 - DNA, 20 bp, Artificial Sequence
  Description of Artificial Sequence: Synthetic oligonucleotide
tctcctcttcttcattgcct

SEQ ID NO: 10514 - DNA, 20 bp, Artificial Sequence
  Description of Artificial Sequence: Synthetic oligonucleotide
ttctcctcttcttcattgcc

SEQ ID NO: 10515 - DNA, 20 bp, Artificial Sequence
  Description of Artificial Sequence: Synthetic oligonucleotide
tttctcctcttcttcattgc

SEQ ID NO: 10516 - DNA, 20 bp, Artificial Sequence
  Description of Artificial Sequence: Synthetic oligonucleotide
ttttctcctcttcttcattg

SEQ ID NO: 10517 - DNA, 20 bp, Artificial Sequence
  Description of Artificial Sequence: Synthetic oligonucleotide
tttttctcctcttcttcatt

SEQ ID NO: 10518 - DNA, 20 bp, Artificial Sequence
  Description of Artificial Sequence: Synthetic oligonucleotide
ctttttctcctcttcttcat

SEQ ID NO: 10519 - DNA, 20 bp, Artificial Sequence
  Description of Artificial Sequence: Synthetic oligonucleotide
cctttttctcctcttcttca

SEQ ID NO: 10520 - DNA, 20 bp, Artificial Sequence
  Description of Artificial Sequence: Synthetic oligonucleotide
tcctttttctcctcttcttc

SEQ ID NO: 10521 - DNA, 20 bp, Artificial Sequence
  Description of Artificial Sequence: Synthetic oligonucleotide
ttcctttttctcctcttctt

SEQ ID NO: 10522 - DNA, 20 bp, Artificial Sequence
  Description of Artificial Sequence: Synthetic oligonucleotide
tttcctttttctcctcttct

SEQ ID NO: 10523 - DNA, 20 bp, Artificial Sequence
  Description of Artificial Sequence: Synthetic oligonucleotide
ctttcctttttctcctcttc

SEQ ID NO: 10524 - DNA, 20 bp, Artificial Sequence
  Description of Artificial Sequence: Synthetic oligonucleotide
actttcctttttctcctctt

SEQ ID NO: 10525 - DNA, 20 bp, Artificial Sequence
  Description of Artificial Sequence: Synthetic oligonucleotide
gactttcctttttctcctct

SEQ ID NO: 10526 - DNA, 20 bp, Artificial Sequence
  Description of Artificial Sequence: Synthetic oligonucleotide
tgactttcctttttctcctc

SEQ ID NO: 10527 - DNA, 20 bp, Artificial Sequence
  Description of Artificial Sequence: Synthetic oligonucleotide
gtgactttcctttttctcct

SEQ ID NO: 10528 - DNA, 20 bp, Artificial Sequence
  Description of Artificial Sequence: Synthetic oligonucleotide
tgtgactttcctttttctcc

SEQ ID NO: 10529 - DNA, 20 bp, Artificial Sequence
  Description of Artificial Sequence: Synthetic oligonucleotide
ttgtgactttcctttttctc

SEQ ID NO: 10530 - DNA, 20 bp, Artificial Sequence
  Description of Artificial Sequence: Synthetic oligonucleotide
gttgtgactttcctttttct

SEQ ID NO: 10531 - DNA, 20 bp, Artificial Sequence
  Description of Artificial Sequence: Synthetic oligonucleotide
ggttgtgactttcctttttc

SEQ ID NO: 10532 - DNA, 20 bp, Artificial Sequence
  Description of Artificial Sequence: Synthetic oligonucleotide
tggttgtgactttccttttt

SEQ ID NO: 10533 - DNA, 20 bp, Artificial Sequence
  Description of Artificial Sequence: Synthetic oligonucleotide
ttggttgtgactttcctttt

SEQ ID NO: 10534 - DNA, 20 bp, Artificial Sequence
  Description of Artificial Sequence: Synthetic oligonucleotide
attggttgtgactttccttt

SEQ ID NO: 10535 - DNA, 20 bp, Artificial Sequence
  Description of Artificial Sequence: Synthetic oligonucleotide
tattggttgtgactttcctt

SEQ ID NO: 10536 - DNA, 20 bp, Artificial Sequence
  Description of Artificial Sequence: Synthetic oligonucleotide
ttattggttgtgactttcct

SEQ ID NO: 10537 - DNA, 20 bp, Artificial Sequence
  Description of Artificial Sequence: Synthetic oligonucleotide
tttattggttgtgactttcc

SEQ ID NO: 10538 - DNA, 20 bp, Artificial Sequence
  Description of Artificial Sequence: Synthetic oligonucleotide
atttattggttgtgactttc

SEQ ID NO: 10539 - DNA, 20 bp, Artificial Sequence
  Description of Artificial Sequence: Synthetic oligonucleotide
catttattggttgtgacttt

SEQ ID NO: 10540 - DNA, 20 bp, Artificial Sequence
  Description of Artificial Sequence: Synthetic oligonucleotide
acatttattggttgtgactt

SEQ ID NO: 10541 - DNA, 20 bp, Artificial Sequence
  Description of Artificial Sequence: Synthetic oligonucleotide
gacatttattggttgtgact

SEQ ID NO: 10542 - DNA, 20 bp, Artificial Sequence
  Description of Artificial Sequence: Synthetic oligonucleotide
agacatttattggttgtgac

SEQ ID NO: 10543 - DNA, 20 bp, Artificial Sequence
  Description of Artificial Sequence: Synthetic oligonucleotide
cagacatttattggttgtga

SEQ ID NO: 10544 - DNA, 20 bp, Artificial Sequence
  Description of Artificial Sequence: Synthetic oligonucleotide
ccagacatttattggttgtg

SEQ ID NO: 10545 - DNA, 20 bp, Artificial Sequence
  Description of Artificial Sequence: Synthetic oligonucleotide
tccagacatttattggttgt

SEQ ID NO: 10546 - DNA, 20 bp, Artificial Sequence
  Description of Artificial Sequence: Synthetic oligonucleotide
ttccagacatttattggttg

SEQ ID NO: 10547 - DNA, 20 bp, Artificial Sequence
  Description of Artificial Sequence: Synthetic oligonucleotide
gttccagacatttattggtt

SEQ ID NO: 10548 - DNA, 20 bp, Artificial Sequence
  Description of Artificial Sequence: Synthetic oligonucleotide
tgttccagacatttattggt

SEQ ID NO: 10549 - DNA, 20 bp, Artificial Sequence
  Description of Artificial Sequence: Synthetic oligonucleotide
ttgttccagacatttattgg

SEQ ID NO: 10550 - DNA, 20 bp, Artificial Sequence
  Description of Artificial Sequence: Synthetic oligonucleotide
cttgttccagacatttattg

SEQ ID NO: 10551 - DNA, 20 bp, Artificial Sequence
  Description of Artificial Sequence: Synthetic oligonucleotide
acttgttccagacatttatt

SEQ ID NO: 10552 - DNA, 20 bp, Artificial Sequence
  Description of Artificial Sequence: Synthetic oligonucleotide
cacttgttccagacatttat

SEQ ID NO: 10553 - DNA, 20 bp, Artificial Sequence
  Description of Artificial Sequence: Synthetic oligonucleotide
acacttgttccagacattta

SEQ ID NO: 10554 - DNA, 20 bp, Artificial Sequence
  Description of Artificial Sequence: Synthetic oligonucleotide
gacacttgttccagacattt

SEQ ID NO: 10555 - DNA, 20 bp, Artificial Sequence
  Description of Artificial Sequence: Synthetic oligonucleotide
tgacacttgttccagacatt

SEQ ID NO: 10556 - DNA, 20 bp, Artificial Sequence
  Description of Artificial Sequence: Synthetic oligonucleotide
gtgacacttgttccagacat

SEQ ID NO: 10557 - DNA, 20 bp, Artificial Sequence
  Description of Artificial Sequence: Synthetic oligonucleotide
tgtgacacttgttccagaca

SEQ ID NO: 10558 - DNA, 20 bp, Artificial Sequence
  Description of Artificial Sequence: Synthetic oligonucleotide
ttgtgacacttgttccagac

SEQ ID NO: 10559 - DNA, 20 bp, Artificial Sequence
  Description of Artificial Sequence: Synthetic oligonucleotide
attgtgacacttgttccaga

SEQ ID NO: 10560 - DNA, 20 bp, Artificial Sequence
  Description of Artificial Sequence: Synthetic oligonucleotide
aattgtgacacttgttccag

SEQ ID NO: 10561 - DNA, 20 bp, Artificial Sequence
  Description of Artificial Sequence: Synthetic oligonucleotide
taattgtgacacttgttcca

SEQ ID NO: 10562 - DNA, 20 bp, Artificial Sequence
  Description of Artificial Sequence: Synthetic oligonucleotide
gtaattgtgacacttgttcc

SEQ ID NO: 10563 - DNA, 20 bp, Artificial Sequence
  Description of Artificial Sequence: Synthetic oligonucleotide
tgtaattgtgacacttgttc

SEQ ID NO: 10564 - DNA, 20 bp, Artificial Sequence
  Description of Artificial Sequence: Synthetic oligonucleotide
ttgtaattgtgacacttgtt

SEQ ID NO: 10565 - DNA, 20 bp, Artificial Sequence
  Description of Artificial Sequence: Synthetic oligonucleotide
cttgtaattgtgacacttgt

SEQ ID NO: 10566 - DNA, 20 bp, Artificial Sequence
  Description of Artificial Sequence: Synthetic oligonucleotide
ccttgtaattgtgacacttg

SEQ ID NO: 10567 - DNA, 20 bp, Artificial Sequence
  Description of Artificial Sequence: Synthetic oligonucleotide
tccttgtaattgtgacactt

SEQ ID NO: 10568 - DNA, 20 bp, Artificial Sequence
  Description of Artificial Sequence: Synthetic oligonucleotide
atccttgtaattgtgacact

SEQ ID NO: 10569 - DNA, 20 bp, Artificial Sequence
  Description of Artificial Sequence: Synthetic oligonucleotide
aatccttgtaattgtgacac

SEQ ID NO: 10570 - DNA, 20 bp, Artificial Sequence
  Description of Artificial Sequence: Synthetic oligonucleotide
caatccttgtaattgtgaca

SEQ ID NO: 10571 - DNA, 20 bp, Artificial Sequence
  Description of Artificial Sequence: Synthetic oligonucleotide
acaatccttgtaattgtgac

SEQ ID NO: 10572 - DNA, 20 bp, Artificial Sequence
  Description of Artificial Sequence: Synthetic oligonucleotide
cacaatccttgtaattgtga

SEQ ID NO: 10573 - DNA, 20 bp, Artificial Sequence
  Description of Artificial Sequence: Synthetic oligonucleotide
ccacaatccttgtaattgtg

SEQ ID NO: 10574 - DNA, 20 bp, Artificial Sequence
  Description of Artificial Sequence: Synthetic oligonucleotide
gccacaatccttgtaattgt

SEQ ID NO: 10575 - DNA, 20 bp, Artificial Sequence
  Description of Artificial Sequence: Synthetic oligonucleotide
cgccacaatccttgtaattg

SEQ ID NO: 10576 - DNA, 20 bp, Artificial Sequence
  Description of Artificial Sequence: Synthetic oligonucleotide
acgccacaatccttgtaatt

SEQ ID NO: 10577 - DNA, 20 bp, Artificial Sequence
  Description of Artificial Sequence: Synthetic oligonucleotide
gacgccacaatccttgtaat

SEQ ID NO: 10578 - DNA, 20 bp, Artificial Sequence
  Description of Artificial Sequence: Synthetic oligonucleotide
cgacgccacaatccttgtaa

SEQ ID NO: 10579 - DNA, 20 bp, Artificial Sequence
  Description of Artificial Sequence: Synthetic oligonucleotide
gcgacgccacaatccttgta

SEQ ID NO: 10580 - DNA, 20 bp, Artificial Sequence
  Description of Artificial Sequence: Synthetic oligonucleotide
agcgacgccacaatccttgt

SEQ ID NO: 10581 - DNA, 20 bp, Artificial Sequence
  Description of Artificial Sequence: Synthetic oligonucleotide
aagcgacgccacaatccttg

SEQ ID NO: 10582 - DNA, 20 bp, Artificial Sequence
  Description of Artificial Sequence: Synthetic oligonucleotide
gaagcgacgccacaatcctt

SEQ ID NO: 10583 - DNA, 20 bp, Artificial Sequence
  Description of Artificial Sequence: Synthetic oligonucleotide
tgaagcgacgccacaatcct

SEQ ID NO: 10584 - DNA, 20 bp, Artificial Sequence
  Description of Artificial Sequence: Synthetic oligonucleotide
ttgaagcgacgccacaatcc

SEQ ID NO: 10585 - DNA, 20 bp, Artificial Sequence
  Description of Artificial Sequence: Synthetic oligonucleotide
attgaagcgacgccacaatc

SEQ ID NO: 10586 - DNA, 20 bp, Artificial Sequence
  Description of Artificial Sequence: Synthetic oligonucleotide
gattgaagcgacgccacaat

SEQ ID NO: 10587 - DNA, 20 bp, Artificial Sequence
  Description of Artificial Sequence: Synthetic oligonucleotide
cgattgaagcgacgccacaa

SEQ ID NO: 10588 - DNA, 20 bp, Artificial Sequence
  Description of Artificial Sequence: Synthetic oligonucleotide
tcgattgaagcgacgccaca

SEQ ID NO: 10589 - DNA, 20 bp, Artificial Sequence
  Description of Artificial Sequence: Synthetic oligonucleotide
gtcgattgaagcgacgccac

SEQ ID NO: 10590 - DNA, 20 bp, Artificial Sequence
  Description of Artificial Sequence: Synthetic oligonucleotide
ggtcgattgaagcgacgcca

SEQ ID NO: 10591 - DNA, 20 bp, Artificial Sequence
  Description of Artificial Sequence: Synthetic oligonucleotide
aggtcgattgaagcgacgcc

SEQ ID NO: 10592 - DNA, 20 bp, Artificial Sequence
  Description of Artificial Sequence: Synthetic oligonucleotide
aaggtcgattgaagcgacgc

SEQ ID NO: 10593 - DNA, 20 bp, Artificial Sequence
  Description of Artificial Sequence: Synthetic oligonucleotide
aaaggtcgattgaagcgacg

SEQ ID NO: 10594 - DNA, 20 bp, Artificial Sequence
  Description of Artificial Sequence: Synthetic oligonucleotide
taaaggtcgattgaagcgac

SEQ ID NO: 10595 - DNA, 20 bp, Artificial Sequence
  Description of Artificial Sequence: Synthetic oligonucleotide
gtaaaggtcgattgaagcga

SEQ ID NO: 10596 - DNA, 20 bp, Artificial Sequence
  Description of Artificial Sequence: Synthetic oligonucleotide
agtaaaggtcgattgaagcg

SEQ ID NO: 10597 - DNA, 20 bp, Artificial Sequence
  Description of Artificial Sequence: Synthetic oligonucleotide
cagtaaaggtcgattgaagc

SEQ ID NO: 10598 - DNA, 20 bp, Artificial Sequence
  Description of Artificial Sequence: Synthetic oligonucleotide
tcagtaaaggtcgattgaag

SEQ ID NO: 10599 - DNA, 20 bp, Artificial Sequence
  Description of Artificial Sequence: Synthetic oligonucleotide
ttcagtaaaggtcgattgaa

SEQ ID NO: 10600 - DNA, 20 bp, Artificial Sequence
  Description of Artificial Sequence: Synthetic oligonucleotide
tttcagtaaaggtcgattga

SEQ ID NO: 10601 - DNA, 20 bp, Artificial Sequence
  Description of Artificial Sequence: Synthetic oligonucleotide
gtttcagtaaaggtcgattg

SEQ ID NO: 10602 - DNA, 20 bp, Artificial Sequence
  Description of Artificial Sequence: Synthetic oligonucleotide
tgtttcagtaaaggtcgatt

SEQ ID NO: 10603 - DNA, 20 bp, Artificial Sequence
  Description of Artificial Sequence: Synthetic oligonucleotide
ttgtttcagtaaaggtcgat

SEQ ID NO: 10604 - DNA, 20 bp, Artificial Sequence
  Description of Artificial Sequence: Synthetic oligonucleotide
gttgtttcagtaaaggtcga

SEQ ID NO: 10605 - DNA, 20 bp, Artificial Sequence
  Description of Artificial Sequence: Synthetic oligonucleotide
tgttgtttcagtaaaggtcg

SEQ ID NO: 10606 - DNA, 20 bp, Artificial Sequence
  Description of Artificial Sequence: Synthetic oligonucleotide
ctgttgtttcagtaaaggtc

SEQ ID NO: 10607 - DNA, 20 bp, Artificial Sequence
  Description of Artificial Sequence: Synthetic oligonucleotide
actgttgtttcagtaaaggt

SEQ ID NO: 10608 - DNA, 20 bp, Artificial Sequence
  Description of Artificial Sequence: Synthetic oligonucleotide
tactgttgtttcagtaaagg

SEQ ID NO: 10609 - DNA, 20 bp, Artificial Sequence
  Description of Artificial Sequence: Synthetic oligonucleotide
ttactgttgtttcagtaaag

SEQ ID NO: 10610 - DNA, 20 bp, Artificial Sequence
  Description of Artificial Sequence: Synthetic oligonucleotide
tttactgttgtttcagtaaa

SEQ ID NO: 10611 - DNA, 20 bp, Artificial Sequence
  Description of Artificial Sequence: Synthetic oligonucleotide
gtttactgttgtttcagtaa

SEQ ID NO: 10612 - DNA, 20 bp, Artificial Sequence
  Description of Artificial Sequence: Synthetic oligonucleotide
ggtttactgttgtttcagta

SEQ ID NO: 10613 - DNA, 20 bp, Artificial Sequence
  Description of Artificial Sequence: Synthetic oligonucleotide
tggtttactgttgtttcagt

SEQ ID NO: 10614 - DNA, 20 bp, Artificial Sequence
  Description of Artificial Sequence: Synthetic oligonucleotide
atggtttactgttgtttcag

SEQ ID NO: 10615 - DNA, 20 bp, Artificial Sequence
  Description of Artificial Sequence: Synthetic oligonucleotide
gatggtttactgttgtttca

SEQ ID NO: 10616 - DNA, 20 bp, Artificial Sequence
  Description of Artificial Sequence: Synthetic oligonucleotide
agatggtttactgttgtttc

SEQ ID NO: 10617 - DNA, 20 bp, Artificial Sequence
  Description of Artificial Sequence: Synthetic oligonucleotide
aagatggtttactgttgttt

SEQ ID NO: 10618 - DNA, 20 bp, Artificial Sequence
  Description of Artificial Sequence: Synthetic oligonucleotide
aaagatggtttactgttgtt

SEQ ID NO: 10619 - DNA, 20 bp, Artificial Sequence
  Description of Artificial Sequence: Synthetic oligonucleotide
taaagatggtttactgttgt

SEQ ID NO: 10620 - DNA, 20 bp, Artificial Sequence
  Description of Artificial Sequence: Synthetic oligonucleotide
ataaagatggtttactgttg

SEQ ID NO: 10621 - DNA, 20 bp, Artificial Sequence
  Description of Artificial Sequence: Synthetic oligonucleotide
aataaagatggtttactgtt

SEQ ID NO: 10622 - DNA, 20 bp, Artificial Sequence
  Description of Artificial Sequence: Synthetic oligonucleotide
taataaagatggtttactgt

SEQ ID NO: 10623 - DNA, 20 bp, Artificial Sequence
  Description of Artificial Sequence: Synthetic oligonucleotide
ataataaagatggtttactg

SEQ ID NO: 10624 - DNA, 20 bp, Artificial Sequence
  Description of Artificial Sequence: Synthetic oligonucleotide
cataataaagatggtttact

SEQ ID NO: 10625 - DNA, 20 bp, Artificial Sequence
  Description of Artificial Sequence: Synthetic oligonucleotide
ccataataaagatggtttac

SEQ ID NO: 10626 - DNA, 20 bp, Artificial Sequence
  Description of Artificial Sequence: Synthetic oligonucleotide
accataataaagatggttta

SEQ ID NO: 10627 - DNA, 20 bp, Artificial Sequence
  Description of Artificial Sequence: Synthetic oligonucleotide
gaccataataaagatggttt

SEQ ID NO: 10628 - DNA, 20 bp, Artificial Sequence
  Description of Artificial Sequence: Synthetic oligonucleotide
tgaccataataaagatggtt

SEQ ID NO: 10629 - DNA, 20 bp, Artificial Sequence
  Description of Artificial Sequence: Synthetic oligonucleotide
atgaccataataaagatggt

SEQ ID NO: 10630 - DNA, 20 bp, Artificial Sequence
  Description of Artificial Sequence: Synthetic oligonucleotide
tatgaccataataaagatgg

SEQ ID NO: 10631 - DNA, 20 bp, Artificial Sequence
  Description of Artificial Sequence: Synthetic oligonucleotide
atatgaccataataaagatg

SEQ ID NO: 10632 - DNA, 20 bp, Artificial Sequence
  Description of Artificial Sequence: Synthetic oligonucleotide
aatatgaccataataaagat

SEQ ID NO: 10633 - DNA, 20 bp, Artificial Sequence
  Description of Artificial Sequence: Synthetic oligonucleotide
aaatatgaccataataaaga

SEQ ID NO: 10634 - DNA, 20 bp, Artificial Sequence
  Description of Artificial Sequence: Synthetic oligonucleotide
gaaatatgaccataataaag

SEQ ID NO: 10635 - DNA, 20 bp, Artificial Sequence
  Description of Artificial Sequence: Synthetic oligonucleotide
tgaaatatgaccataataaa

SEQ ID NO: 10636 - DNA, 20 bp, Artificial Sequence
  Description of Artificial Sequence: Synthetic oligonucleotide
gtgaaatatgaccataataa

SEQ ID NO: 10637 - DNA, 20 bp, Artificial Sequence
  Description of Artificial Sequence: Synthetic oligonucleotide
tgtgaaatatgaccataata

SEQ ID NO: 10638 - DNA, 20 bp, Artificial Sequence
  Description of Artificial Sequence: Synthetic oligonucleotide
ctgtgaaatatgaccataat

SEQ ID NO: 10639 - DNA, 20 bp, Artificial Sequence
  Description of Artificial Sequence: Synthetic oligonucleotide
gctgtgaaatatgaccataa

SEQ ID NO: 10640 - DNA, 20 bp, Artificial Sequence
  Description of Artificial Sequence: Synthetic oligonucleotide
tgctgtgaaatatgaccata

SEQ ID NO: 10641 - DNA, 20 bp, Artificial Sequence
  Description of Artificial Sequence: Synthetic oligonucleotide
gtgctgtgaaatatgaccat

SEQ ID NO: 10642 - DNA, 20 bp, Artificial Sequence
  Description of Artificial Sequence: Synthetic oligonucleotide
ggtgctgtgaaatatgacca

SEQ ID NO: 10643 - DNA, 20 bp, Artificial Sequence
  Description of Artificial Sequence: Synthetic oligonucleotide
tggtgctgtgaaatatgacc

SEQ ID NO: 10644 - DNA, 20 bp, Artificial Sequence
  Description of Artificial Sequence: Synthetic oligonucleotide
ttggtgctgtgaaatatgac

SEQ ID NO: 10645 - DNA, 20 bp, Artificial Sequence
  Description of Artificial Sequence: Synthetic oligonucleotide
tttggtgctgtgaaatatga

SEQ ID NO: 10646 - DNA, 20 bp, Artificial Sequence
  Description of Artificial Sequence: Synthetic oligonucleotide
ttttggtgctgtgaaatatg

SEQ ID NO: 10647 - DNA, 20 bp, Artificial Sequence
  Description of Artificial Sequence: Synthetic oligonucleotide
attttggtgctgtgaaatat

SEQ ID NO: 10648 - DNA, 20 bp, Artificial Sequence
  Description of Artificial Sequence: Synthetic oligonucleotide
tattttggtgctgtgaaata

SEQ ID NO: 10649 - DNA, 20 bp, Artificial Sequence
  Description of Artificial Sequence: Synthetic oligonucleotide
ttattttggtgctgtgaaat

SEQ ID NO: 10650 - DNA, 20 bp, Artificial Sequence
  Description of Artificial Sequence: Synthetic oligonucleotide
tttattttggtgctgtgaaa

SEQ ID NO: 10651 - DNA, 20 bp, Artificial Sequence
  Description of Artificial Sequence: Synthetic oligonucleotide
atttattttggtgctgtgaa

SEQ ID NO: 10652 - DNA, 20 bp, Artificial Sequence
  Description of Artificial Sequence: Synthetic oligonucleotide
gatttattttggtgctgtga

SEQ ID NO: 10653 - DNA, 20 bp, Artificial Sequence
  Description of Artificial Sequence: Synthetic oligonucleotide
tgatttattttggtgctgtg

SEQ ID NO: 10654 - DNA, 20 bp, Artificial Sequence
  Description of Artificial Sequence: Synthetic oligonucleotide
atgatttattttggtgctgt

SEQ ID NO: 10655 - DNA, 20 bp, Artificial Sequence
  Description of Artificial Sequence: Synthetic oligonucleotide
gatgatttattttggtgctg

SEQ ID NO: 10656 - DNA, 20 bp, Artificial Sequence
  Description of Artificial Sequence: Synthetic oligonucleotide
agatgatttattttggtgct

SEQ ID NO: 10657 - DNA, 20 bp, Artificial Sequence
  Description of Artificial Sequence: Synthetic oligonucleotide
aagatgatttattttggtgc

SEQ ID NO: 10658 - DNA, 20 bp, Artificial Sequence
  Description of Artificial Sequence: Synthetic oligonucleotide
aaagatgatttattttggtg

SEQ ID NO: 10659 - DNA, 20 bp, Artificial Sequence
  Description of Artificial Sequence: Synthetic oligonucleotide
taaagatgatttattttggt

SEQ ID NO: 10660 - DNA, 20 bp, Artificial Sequence
  Description of Artificial Sequence: Synthetic oligonucleotide
ataaagatgatttattttgg

SEQ ID NO: 10661 - DNA, 20 bp, Artificial Sequence
  Description of Artificial Sequence: Synthetic oligonucleotide
aataaagatgatttattttg

SEQ ID NO: 10662 - DNA, 20 bp, Artificial Sequence
  Description of Artificial Sequence: Synthetic oligonucleotide
taataaagatgatttatttt

SEQ ID NO: 10663 - DNA, 20 bp, Artificial Sequence
  Description of Artificial Sequence: Synthetic oligonucleotide
ttaataaagatgatttattt

SEQ ID NO: 10664 - DNA, 20 bp, Artificial Sequence
  Description of Artificial Sequence: Synthetic oligonucleotide
cttaataaagatgatttatt

SEQ ID NO: 10665 - DNA, 20 bp, Artificial Sequence
  Description of Artificial Sequence: Synthetic oligonucleotide
acttaataaagatgatttat

SEQ ID NO: 10666 - DNA, 20 bp, Artificial Sequence
  Description of Artificial Sequence: Synthetic oligonucleotide
tacttaataaagatgattta

SEQ ID NO: 10667 - DNA, 20 bp, Artificial Sequence
  Description of Artificial Sequence: Synthetic oligonucleotide
ctacttaataaagatgattt

SEQ ID NO: 10668 - DNA, 20 bp, Artificial Sequence
  Description of Artificial Sequence: Synthetic oligonucleotide
tctacttaataaagatgatt

SEQ ID NO: 10669 - DNA, 20 bp, Artificial Sequence
  Description of Artificial Sequence: Synthetic oligonucleotide
atctacttaataaagatgat

SEQ ID NO: 10670 - DNA, 20 bp, Artificial Sequence
  Description of Artificial Sequence: Synthetic oligonucleotide
catctacttaataaagatga

SEQ ID NO: 10671 - DNA, 20 bp, Artificial Sequence
  Description of Artificial Sequence: Synthetic oligonucleotide
tcatctacttaataaagatg

SEQ ID NO: 10672 - DNA, 20 bp, Artificial Sequence
  Description of Artificial Sequence: Synthetic oligonucleotide
ttcatctacttaataaagat

SEQ ID NO: 10673 - DNA, 20 bp, Artificial Sequence
  Description of Artificial Sequence: Synthetic oligonucleotide
tttcatctacttaataaaga

SEQ ID NO: 10674 - DNA, 20 bp, Artificial Sequence
  Description of Artificial Sequence: Synthetic oligonucleotide
gtttcatctacttaataaag

SEQ ID NO: 10675 - DNA, 20 bp, Artificial Sequence
  Description of Artificial Sequence: Synthetic oligonucleotide
tgtttcatctacttaataaa

SEQ ID NO: 10676 - DNA, 20 bp, Artificial Sequence
  Description of Artificial Sequence: Synthetic oligonucleotide
atgtttcatctacttaataa

SEQ ID NO: 10677 - DNA, 20 bp, Artificial Sequence
  Description of Artificial Sequence: Synthetic oligonucleotide
aatgtttcatctacttaata

SEQ ID NO: 10678 - DNA, 20 bp, Artificial Sequence
  Description of Artificial Sequence: Synthetic oligonucleotide
taatgtttcatctacttaat

SEQ ID NO: 10679 - DNA, 20 bp, Artificial Sequence
  Description of Artificial Sequence: Synthetic oligonucleotide
ttaatgtttcatctacttaa

SEQ ID NO: 10680 - DNA, 20 bp, Artificial Sequence
  Description of Artificial Sequence: Synthetic oligonucleotide
gttaatgtttcatctactta

SEQ ID NO: 10681 - DNA, 20 bp, Artificial Sequence
  Description of Artificial Sequence: Synthetic oligonucleotide
agttaatgtttcatctactt

SEQ ID NO: 10682 - DNA, 20 bp, Artificial Sequence
  Description of Artificial Sequence: Synthetic oligonucleotide
gagttaatgtttcatctact

SEQ ID NO: 10683 - DNA, 20 bp, Artificial Sequence
  Description of Artificial Sequence: Synthetic oligonucleotide
agagttaatgtttcatctac

SEQ ID NO: 10684 - DNA, 20 bp, Artificial Sequence
  Description of Artificial Sequence: Synthetic oligonucleotide
tagagttaatgtttcatcta

SEQ ID NO: 10685 - DNA, 20 bp, Artificial Sequence
  Description of Artificial Sequence: Synthetic oligonucleotide
ttagagttaatgtttcatct

SEQ ID NO: 10686 - DNA, 20 bp, Artificial Sequence
  Description of Artificial Sequence: Synthetic oligonucleotide
gttagagttaatgtttcatc

SEQ ID NO: 10687 - DNA, 20 bp, Artificial Sequence
  Description of Artificial Sequence: Synthetic oligonucleotide
agttagagttaatgtttcat

SEQ ID NO: 10688 - DNA, 20 bp, Artificial Sequence
  Description of Artificial Sequence: Synthetic oligonucleotide
cagttagagttaatgtttca

SEQ ID NO: 10689 - DNA, 20 bp, Artificial Sequence
  Description of Artificial Sequence: Synthetic oligonucleotide
acagttagagttaatgtttc

SEQ ID NO: 10690 - DNA, 20 bp, Artificial Sequence
  Description of Artificial Sequence: Synthetic oligonucleotide
cacagttagagttaatgttt

SEQ ID NO: 10691 - DNA, 20 bp, Artificial Sequence
  Description of Artificial Sequence: Synthetic oligonucleotide
tcacagttagagttaatgtt

SEQ ID NO: 10692 - DNA, 20 bp, Artificial Sequence
  Description of Artificial Sequence: Synthetic oligonucleotide
gtcacagttagagttaatgt

SEQ ID NO: 10693 - DNA, 20 bp, Artificial Sequence
  Description of Artificial Sequence: Synthetic oligonucleotide
tgtcacagttagagttaatg

SEQ ID NO: 10694 - DNA, 20 bp, Artificial Sequence
  Description of Artificial Sequence: Synthetic oligonucleotide
ttgtcacagttagagttaat

SEQ ID NO: 10695 - DNA, 20 bp, Artificial Sequence
  Description of Artificial Sequence: Synthetic oligonucleotide
tttgtcacagttagagttaa

SEQ ID NO: 10696 - DNA, 20 bp, Artificial Sequence
  Description of Artificial Sequence: Synthetic oligonucleotide
ctttgtcacagttagagtta

SEQ ID NO: 10697 - DNA, 20 bp, Artificial Sequence
  Description of Artificial Sequence: Synthetic oligonucleotide
tctttgtcacagttagagtt

SEQ ID NO: 10698 - DNA, 20 bp, Artificial Sequence
  Description of Artificial Sequence: Synthetic oligonucleotide
ttctttgtcacagttagagt

SEQ ID NO: 10699 - DNA, 20 bp, Artificial Sequence
  Description of Artificial Sequence: Synthetic oligonucleotide
cttctttgtcacagttagag

SEQ ID NO: 10700 - DNA, 20 bp, Artificial Sequence
  Description of Artificial Sequence: Synthetic oligonucleotide
tcttctttgtcacagttaga

SEQ ID NO: 10701 - DNA, 20 bp, Artificial Sequence
  Description of Artificial Sequence: Synthetic oligonucleotide
gtcttctttgtcacagttag

SEQ ID NO: 10702 - DNA, 20 bp, Artificial Sequence
  Description of Artificial Sequence: Synthetic oligonucleotide
ggtcttctttgtcacagtta

SEQ ID NO: 10703 - DNA, 20 bp, Artificial Sequence
  Description of Artificial Sequence: Synthetic oligonucleotide
tggtcttctttgtcacagtt

SEQ ID NO: 10704 - DNA, 20 bp, Artificial Sequence
  Description of Artificial Sequence: Synthetic oligonucleotide
gtggtcttctttgtcacagt

SEQ ID NO: 10705 - DNA, 20 bp, Artificial Sequence
  Description of Artificial Sequence: Synthetic oligonucleotide
tgtggtcttctttgtcacag

SEQ ID NO: 10706 - DNA, 20 bp, Artificial Sequence
  Description of Artificial Sequence: Synthetic oligonucleotide
ttgtggtcttctttgtcaca

SEQ ID NO: 10707 - DNA, 20 bp, Artificial Sequence
  Description of Artificial Sequence: Synthetic oligonucleotide
tttgtggtcttctttgtcac

SEQ ID NO: 10708 - DNA, 20 bp, Artificial Sequence
  Description of Artificial Sequence: Synthetic oligonucleotide
atttgtggtcttctttgtca

SEQ ID NO: 10709 - DNA, 20 bp, Artificial Sequence
  Description of Artificial Sequence: Synthetic oligonucleotide
tatttgtggtcttctttgtc

SEQ ID NO: 10710 - DNA, 20 bp, Artificial Sequence
  Description of Artificial Sequence: Synthetic oligonucleotide
ctatttgtggtcttctttgt

SEQ ID NO: 10711 - DNA, 20 bp, Artificial Sequence
  Description of Artificial Sequence: Synthetic oligonucleotide
actatttgtggtcttctttg

SEQ ID NO: 10712 - DNA, 20 bp, Artificial Sequence
  Description of Artificial Sequence: Synthetic oligonucleotide
aactatttgtggtcttcttt

SEQ ID NO: 10713 - DNA, 20 bp, Artificial Sequence
  Description of Artificial Sequence: Synthetic oligonucleotide
taactatttgtggtcttctt

SEQ ID NO: 10714 - DNA, 20 bp, Artificial Sequence
  Description of Artificial Sequence: Synthetic oligonucleotide
ataactatttgtggtcttct

SEQ ID NO: 10715 - DNA, 20 bp, Artificial Sequence
  Description of Artificial Sequence: Synthetic oligonucleotide
gataactatttgtggtcttc

SEQ ID NO: 10716 - DNA, 20 bp, Artificial Sequence
  Description of Artificial Sequence: Synthetic oligonucleotide
agataactatttgtggtctt

SEQ ID NO: 10717 - DNA, 20 bp, Artificial Sequence
  Description of Artificial Sequence: Synthetic oligonucleotide
aagataactatttgtggtct

SEQ ID NO: 10718 - DNA, 20 bp, Artificial Sequence
  Description of Artificial Sequence: Synthetic oligonucleotide
aaagataactatttgtggtc

SEQ ID NO: 10719 - DNA, 20 bp, Artificial Sequence
  Description of Artificial Sequence: Synthetic oligonucleotide
aaaagataactatttgtggt

SEQ ID NO: 10720 - DNA, 20 bp, Artificial Sequence
  Description of Artificial Sequence: Synthetic oligonucleotide
taaaagataactatttgtgg

SEQ ID NO: 10721 - DNA, 20 bp, Artificial Sequence
  Description of Artificial Sequence: Synthetic oligonucleotide
ttaaaagataactatttgtg

SEQ ID NO: 10722 - DNA, 20 bp, Artificial Sequence
  Description of Artificial Sequence: Synthetic oligonucleotide
attaaaagataactatttgt

SEQ ID NO: 10723 - DNA, 20 bp, Artificial Sequence
  Description of Artificial Sequence: Synthetic oligonucleotide
aattaaaagataactatttg

SEQ ID NO: 10724 - DNA, 20 bp, Artificial Sequence
  Description of Artificial Sequence: Synthetic oligonucleotide
taattaaaagataactattt

SEQ ID NO: 10725 - DNA, 20 bp, Artificial Sequence
  Description of Artificial Sequence: Synthetic oligonucleotide
gtaattaaaagataactatt

SEQ ID NO: 10726 - DNA, 20 bp, Artificial Sequence
  Description of Artificial Sequence: Synthetic oligonucleotide
tgtaattaaaagataactat

SEQ ID NO: 10727 - DNA, 20 bp, Artificial Sequence
  Description of Artificial Sequence: Synthetic oligonucleotide
ctgtaattaaaagataacta

SEQ ID NO: 10728 - DNA, 20 bp, Artificial Sequence
  Description of Artificial Sequence: Synthetic oligonucleotide
tctgtaattaaaagataact

SEQ ID NO: 10729 - DNA, 20 bp, Artificial Sequence
  Description of Artificial Sequence: Synthetic oligonucleotide
ttctgtaattaaaagataac

SEQ ID NO: 10730 - DNA, 20 bp, Artificial Sequence
  Description of Artificial Sequence: Synthetic oligonucleotide
cttctgtaattaaaagataa

SEQ ID NO: 10731 - DNA, 20 bp, Artificial Sequence
  Description of Artificial Sequence: Synthetic oligonucleotide
tcttctgtaattaaaagata

SEQ ID NO: 10732 - DNA, 20 bp, Artificial Sequence
  Description of Artificial Sequence: Synthetic oligonucleotide
ctcttctgtaattaaaagat

SEQ ID NO: 10733 - DNA, 20 bp, Artificial Sequence
  Description of Artificial Sequence: Synthetic oligonucleotide
actcttctgtaattaaaaga

SEQ ID NO: 10734 - DNA, 20 bp, Artificial Sequence
  Description of Artificial Sequence: Synthetic oligonucleotide
aactcttctgtaattaaaag

SEQ ID NO: 10735 - DNA, 20 bp, Artificial Sequence
  Description of Artificial Sequence: Synthetic oligonucleotide
aaactcttctgtaattaaaa

SEQ ID NO: 10736 - DNA, 20 bp, Artificial Sequence
  Description of Artificial Sequence: Synthetic oligonucleotide
gaaactcttctgtaattaaa

SEQ ID NO: 10737 - DNA, 20 bp, Artificial Sequence
  Description of Artificial Sequence: Synthetic oligonucleotide
agaaactcttctgtaattaa

SEQ ID NO: 10738 - DNA, 20 bp, Artificial Sequence
  Description of Artificial Sequence: Synthetic oligonucleotide
aagaaactcttctgtaatta

SEQ ID NO: 10739 - DNA, 20 bp, Artificial Sequence
  Description of Artificial Sequence: Synthetic oligonucleotide
taagaaactcttctgtaatt

SEQ ID NO: 10740 - DNA, 20 bp, Artificial Sequence
  Description of Artificial Sequence: Synthetic oligonucleotide
ttaagaaactcttctgtaat

SEQ ID NO: 10741 - DNA, 20 bp, Artificial Sequence
  Description of Artificial Sequence: Synthetic oligonucleotide
gttaagaaactcttctgtaa

SEQ ID NO: 10742 - DNA, 20 bp, Artificial Sequence
  Description of Artificial Sequence: Synthetic oligonucleotide
agttaagaaactcttctgta

SEQ ID NO: 10743 - DNA, 20 bp, Artificial Sequence
  Description of Artificial Sequence: Synthetic oligonucleotide
aagttaagaaactcttctgt

SEQ ID NO: 10744 - DNA, 20 bp, Artificial Sequence
  Description of Artificial Sequence: Synthetic oligonucleotide
taagttaagaaactcttctg

SEQ ID NO: 10745 - DNA, 20 bp, Artificial Sequence
  Description of Artificial Sequence: Synthetic oligonucleotide
gtaagttaagaaactcttct

SEQ ID NO: 10746 - DNA, 20 bp, Artificial Sequence
  Description of Artificial Sequence: Synthetic oligonucleotide
agtaagttaagaaactcttc

SEQ ID NO: 10747 - DNA, 20 bp, Artificial Sequence
  Description of Artificial Sequence: Synthetic oligonucleotide
aagtaagttaagaaactctt

SEQ ID NO: 10748 - DNA, 20 bp, Artificial Sequence
  Description of Artificial Sequence: Synthetic oligonucleotide
aaagtaagttaagaaactct

SEQ ID NO: 10749 - DNA, 20 bp, Artificial Sequence
  Description of Artificial Sequence: Synthetic oligonucleotide
aaaagtaagttaagaaactc

SEQ ID NO: 10750 - DNA, 20 bp, Artificial Sequence
  Description of Artificial Sequence: Synthetic oligonucleotide
caaaagtaagttaagaaact

SEQ ID NO: 10751 - DNA, 20 bp, Artificial Sequence
  Description of Artificial Sequence: Synthetic oligonucleotide
acaaaagtaagttaagaaac

SEQ ID NO: 10752 - DNA, 20 bp, Artificial Sequence
  Description of Artificial Sequence: Synthetic oligonucleotide
tacaaaagtaagttaagaaa

SEQ ID NO: 10753 - DNA, 20 bp, Artificial Sequence
  Description of Artificial Sequence: Synthetic oligonucleotide
ttacaaaagtaagttaagaa

SEQ ID NO: 10754 - DNA, 20 bp, Artificial Sequence
  Description of Artificial Sequence: Synthetic oligonucleotide
cttacaaaagtaagttaaga

SEQ ID NO: 10755 - DNA, 20 bp, Artificial Sequence
  Description of Artificial Sequence: Synthetic oligonucleotide
acttacaaaagtaagttaag

SEQ ID NO: 10756 - DNA, 20 bp, Artificial Sequence
  Description of Artificial Sequence: Synthetic oligonucleotide
aacttacaaaagtaagttaa

SEQ ID NO: 10757 - DNA, 20 bp, Artificial Sequence
  Description of Artificial Sequence: Synthetic oligonucleotide
aaacttacaaaagtaagtta

SEQ ID NO: 10758 - DNA, 20 bp, Artificial Sequence
  Description of Artificial Sequence: Synthetic oligonucleotide
aaaacttacaaaagtaagtt

SEQ ID NO: 10759 - DNA, 20 bp, Artificial Sequence
  Description of Artificial Sequence: Synthetic oligonucleotide
aaaaacttacaaaagtaagt

SEQ ID NO: 10760 - DNA, 20 bp, Artificial Sequence
  Description of Artificial Sequence: Synthetic oligonucleotide
taaaaacttacaaaagtaag

SEQ ID NO: 10761 - DNA, 20 bp, Artificial Sequence
  Description of Artificial Sequence: Synthetic oligonucleotide
ataaaaacttacaaaagtaa

SEQ ID NO: 10762 - DNA, 20 bp, Artificial Sequence
  Description of Artificial Sequence: Synthetic oligonucleotide
aataaaaacttacaaaagta

SEQ ID NO: 10763 - DNA, 20 bp, Artificial Sequence
  Description of Artificial Sequence: Synthetic oligonucleotide
caataaaaacttacaaaagt

SEQ ID NO: 10764 - DNA, 20 bp, Artificial Sequence
  Description of Artificial Sequence: Synthetic oligonucleotide
acaataaaaacttacaaaag

SEQ ID NO: 10765 - DNA, 20 bp, Artificial Sequence
  Description of Artificial Sequence: Synthetic oligonucleotide
cacaataaaaacttacaaaa

SEQ ID NO: 10766 - DNA, 20 bp, Artificial Sequence
  Description of Artificial Sequence: Synthetic oligonucleotide
acacaataaaaacttacaaa

SEQ ID NO: 10767 - DNA, 20 bp, Artificial Sequence
  Description of Artificial Sequence: Synthetic oligonucleotide
tacacaataaaaacttacaa

SEQ ID NO: 10768 - DNA, 20 bp, Artificial Sequence
  Description of Artificial Sequence: Synthetic oligonucleotide
ttacacaataaaaacttaca

SEQ ID NO: 10769 - DNA, 20 bp, Artificial Sequence
  Description of Artificial Sequence: Synthetic oligonucleotide
cttacacaataaaaacttac

SEQ ID NO: 10770 - DNA, 20 bp, Artificial Sequence
  Description of Artificial Sequence: Synthetic oligonucleotide
acttacacaataaaaactta

SEQ ID NO: 10771 - DNA, 20 bp, Artificial Sequence
  Description of Artificial Sequence: Synthetic oligonucleotide
aacttacacaataaaaactt

SEQ ID NO: 10772 - DNA, 20 bp, Artificial Sequence
  Description of Artificial Sequence: Synthetic oligonucleotide
aaacttacacaataaaaact

SEQ ID NO: 10773 - DNA, 20 bp, Artificial Sequence
  Description of Artificial Sequence: Synthetic oligonucleotide
taaacttacacaataaaaac

SEQ ID NO: 10774 - DNA, 20 bp, Artificial Sequence
  Description of Artificial Sequence: Synthetic oligonucleotide
ataaacttacacaataaaaa

SEQ ID NO: 10775 - DNA, 20 bp, Artificial Sequence
  Description of Artificial Sequence: Synthetic oligonucleotide
tataaacttacacaataaaa

SEQ ID NO: 10776 - DNA, 20 bp, Artificial Sequence
  Description of Artificial Sequence: Synthetic oligonucleotide
ttataaacttacacaataaa

SEQ ID NO: 10777 - DNA, 20 bp, Artificial Sequence
  Description of Artificial Sequence: Synthetic oligonucleotide
attataaacttacacaataa

SEQ ID NO: 10778 - DNA, 20 bp, Artificial Sequence
  Description of Artificial Sequence: Synthetic oligonucleotide
cattataaacttacacaata

SEQ ID NO: 10779 - DNA, 20 bp, Artificial Sequence
  Description of Artificial Sequence: Synthetic oligonucleotide
gcattataaacttacacaat

SEQ ID NO: 10780 - DNA, 20 bp, Artificial Sequence
  Description of Artificial Sequence: Synthetic oligonucleotide
tgcattataaacttacacaa

SEQ ID NO: 10781 - DNA, 20 bp, Artificial Sequence
  Description of Artificial Sequence: Synthetic oligonucleotide
ctgcattataaacttacaca

SEQ ID NO: 10782 - DNA, 20 bp, Artificial Sequence
  Description of Artificial Sequence: Synthetic oligonucleotide
cctgcattataaacttacac

SEQ ID NO: 10783 - DNA, 20 bp, Artificial Sequence
  Description of Artificial Sequence: Synthetic oligonucleotide
ccctgcattataaacttaca

SEQ ID NO: 10784 - DNA, 20 bp, Artificial Sequence
  Description of Artificial Sequence: Synthetic oligonucleotide
cccctgcattataaacttac

SEQ ID NO: 10785 - DNA, 20 bp, Artificial Sequence
  Description of Artificial Sequence: Synthetic oligonucleotide
tcccctgcattataaactta

SEQ ID NO: 10786 - DNA, 20 bp, Artificial Sequence
  Description of Artificial Sequence: Synthetic oligonucleotide
ttcccctgcattataaactt

SEQ ID NO: 10787 - DNA, 20 bp, Artificial Sequence
  Description of Artificial Sequence: Synthetic oligonucleotide
cttcccctgcattataaact

SEQ ID NO: 10788 - DNA, 20 bp, Artificial Sequence
  Description of Artificial Sequence: Synthetic oligonucleotide
acttcccctgcattataaac

SEQ ID NO: 10789 - DNA, 20 bp, Artificial Sequence
  Description of Artificial Sequence: Synthetic oligonucleotide
tacttcccctgcattataaa

SEQ ID NO: 10790 - DNA, 20 bp, Artificial Sequence
  Description of Artificial Sequence: Synthetic oligonucleotide
gtacttcccctgcattataa

SEQ ID NO: 10791 - DNA, 20 bp, Artificial Sequence
  Description of Artificial Sequence: Synthetic oligonucleotide
agtacttcccctgcattata

SEQ ID NO: 10792 - DNA, 20 bp, Artificial Sequence
  Description of Artificial Sequence: Synthetic oligonucleotide
tagtacttcccctgcattat

SEQ ID NO: 10793 - DNA, 20 bp, Artificial Sequence
  Description of Artificial Sequence: Synthetic oligonucleotide
gtagtacttcccctgcatta

SEQ ID NO: 10794 - DNA, 20 bp, Artificial Sequence
  Description of Artificial Sequence: Synthetic oligonucleotide
agtagtacttcccctgcatt

SEQ ID NO: 10795 - DNA, 20 bp, Artificial Sequence
  Description of Artificial Sequence: Synthetic oligonucleotide
gagtagtacttcccctgcat

SEQ ID NO: 10796 - DNA, 20 bp, Artificial Sequence
  Description of Artificial Sequence: Synthetic oligonucleotide
ggagtagtacttcccctgca

SEQ ID NO: 10797 - DNA, 20 bp, Artificial Sequence
  Description of Artificial Sequence: Synthetic oligonucleotide
aggagtagtacttcccctgc

SEQ ID NO: 10798 - DNA, 20 bp, Artificial Sequence
  Description of Artificial Sequence: Synthetic oligonucleotide
gaggagtagtacttcccctg

SEQ ID NO: 10799 - DNA, 20 bp, Artificial Sequence
  Description of Artificial Sequence: Synthetic oligonucleotide
tgaggagtagtacttcccct

SEQ ID NO: 10800 - DNA, 20 bp, Artificial Sequence
  Description of Artificial Sequence: Synthetic oligonucleotide
ttgaggagtagtacttcccc

SEQ ID NO: 10801 - DNA, 20 bp, Artificial Sequence
  Description of Artificial Sequence: Synthetic oligonucleotide
tttgaggagtagtacttccc

SEQ ID NO: 10802 - DNA, 20 bp, Artificial Sequence
  Description of Artificial Sequence: Synthetic oligonucleotide
atttgaggagtagtacttcc

SEQ ID NO: 10803 - DNA, 20 bp, Artificial Sequence
  Description of Artificial Sequence: Synthetic oligonucleotide
catttgaggagtagtacttc

SEQ ID NO: 10804 - DNA, 20 bp, Artificial Sequence
  Description of Artificial Sequence: Synthetic oligonucleotide
acatttgaggagtagtactt

SEQ ID NO: 10805 - DNA, 20 bp, Artificial Sequence
  Description of Artificial Sequence: Synthetic oligonucleotide
aacatttgaggagtagtact

SEQ ID NO: 10806 - DNA, 20 bp, Artificial Sequence
  Description of Artificial Sequence: Synthetic oligonucleotide
caacatttgaggagtagtac

SEQ ID NO: 10807 - DNA, 20 bp, Artificial Sequence
  Description of Artificial Sequence: Synthetic oligonucleotide
tcaacatttgaggagtagta

SEQ ID NO: 10808 - DNA, 20 bp, Artificial Sequence
  Description of Artificial Sequence: Synthetic oligonucleotide
ctcaacatttgaggagtagt

SEQ ID NO: 10809 - DNA, 20 bp, Artificial Sequence
  Description of Artificial Sequence: Synthetic oligonucleotide
cctcaacatttgaggagtag

SEQ ID NO: 10810 - DNA, 20 bp, Artificial Sequence
  Description of Artificial Sequence: Synthetic oligonucleotide
ccctcaacatttgaggagta

SEQ ID NO: 10811 - DNA, 20 bp, Artificial Sequence
  Description of Artificial Sequence: Synthetic oligonucleotide
tccctcaacatttgaggagt

SEQ ID NO: 10812 - DNA, 20 bp, Artificial Sequence
  Description of Artificial Sequence: Synthetic oligonucleotide
ttccctcaacatttgaggag

SEQ ID NO: 10813 - DNA, 20 bp, Artificial Sequence
  Description of Artificial Sequence: Synthetic oligonucleotide
cttccctcaacatttgagga

SEQ ID NO: 10814 - DNA, 20 bp, Artificial Sequence
  Description of Artificial Sequence: Synthetic oligonucleotide
gcttccctcaacatttgagg

SEQ ID NO: 10815 - DNA, 20 bp, Artificial Sequence
  Description of Artificial Sequence: Synthetic oligonucleotide
agcttccctcaacatttgag

SEQ ID NO: 10816 - DNA, 20 bp, Artificial Sequence
  Description of Artificial Sequence: Synthetic oligonucleotide
aagcttccctcaacatttga

SEQ ID NO: 10817 - DNA, 20 bp, Artificial Sequence
  Description of Artificial Sequence: Synthetic oligonucleotide
gaagcttccctcaacatttg

SEQ ID NO: 10818 - DNA, 20 bp, Artificial Sequence
  Description of Artificial Sequence: Synthetic oligonucleotide
ggaagcttccctcaacattt

SEQ ID NO: 10819 - DNA, 20 bp, Artificial Sequence
  Description of Artificial Sequence: Synthetic oligonucleotide
tggaagcttccctcaacatt

SEQ ID NO: 10820 - DNA, 20 bp, Artificial Sequence
  Description of Artificial Sequence: Synthetic oligonucleotide
atggaagcttccctcaacat

SEQ ID NO: 10821 - DNA, 20 bp, Artificial Sequence
  Description of Artificial Sequence: Synthetic oligonucleotide
tatggaagcttccctcaaca

SEQ ID NO: 10822 - DNA, 20 bp, Artificial Sequence
  Description of Artificial Sequence: Synthetic oligonucleotide
ttatggaagcttccctcaac

SEQ ID NO: 10823 - DNA, 20 bp, Artificial Sequence
  Description of Artificial Sequence: Synthetic oligonucleotide
gttatggaagcttccctcaa

SEQ ID NO: 10824 - DNA, 20 bp, Artificial Sequence
  Description of Artificial Sequence: Synthetic oligonucleotide
tgttatggaagcttccctca

SEQ ID NO: 10825 - DNA, 20 bp, Artificial Sequence
  Description of Artificial Sequence: Synthetic oligonucleotide
atgttatggaagcttccctc

SEQ ID NO: 10826 - DNA, 20 bp, Artificial Sequence
  Description of Artificial Sequence: Synthetic oligonucleotide
aatgttatggaagcttccct

SEQ ID NO: 10827 - DNA, 20 bp, Artificial Sequence
  Description of Artificial Sequence: Synthetic oligonucleotide
caatgttatggaagcttccc

SEQ ID NO: 10828 - DNA, 20 bp, Artificial Sequence
  Description of Artificial Sequence: Synthetic oligonucleotide
tcaatgttatggaagcttcc

SEQ ID NO: 10829 - DNA, 20 bp, Artificial Sequence
  Description of Artificial Sequence: Synthetic oligonucleotide
atcaatgttatggaagcttc

SEQ ID NO: 10830 - DNA, 20 bp, Artificial Sequence
  Description of Artificial Sequence: Synthetic oligonucleotide
catcaatgttatggaagctt

SEQ ID NO: 10831 - DNA, 20 bp, Artificial Sequence
  Description of Artificial Sequence: Synthetic oligonucleotide
tcatcaatgttatggaagct

SEQ ID NO: 10832 - DNA, 20 bp, Artificial Sequence
  Description of Artificial Sequence: Synthetic oligonucleotide
gtcatcaatgttatggaagc

SEQ ID NO: 10833 - DNA, 20 bp, Artificial Sequence
  Description of Artificial Sequence: Synthetic oligonucleotide
agtcatcaatgttatggaag

SEQ ID NO: 10834 - DNA, 20 bp, Artificial Sequence
  Description of Artificial Sequence: Synthetic oligonucleotide
cagtcatcaatgttatggaa

SEQ ID NO: 10835 - DNA, 20 bp, Artificial Sequence
  Description of Artificial Sequence: Synthetic oligonucleotide
ccagtcatcaatgttatgga

SEQ ID NO: 10836 - DNA, 20 bp, Artificial Sequence
  Description of Artificial Sequence: Synthetic oligonucleotide
gccagtcatcaatgttatgg

SEQ ID NO: 10837 - DNA, 20 bp, Artificial Sequence
  Description of Artificial Sequence: Synthetic oligonucleotide
agccagtcatcaatgttatg

SEQ ID NO: 10838 - DNA, 20 bp, Artificial Sequence
  Description of Artificial Sequence: Synthetic oligonucleotide
aagccagtcatcaatgttat

SEQ ID NO: 10839 - DNA, 20 bp, Artificial Sequence
  Description of Artificial Sequence: Synthetic oligonucleotide
gaagccagtcatcaatgtta

SEQ ID NO: 10840 - DNA, 20 bp, Artificial Sequence
  Description of Artificial Sequence: Synthetic oligonucleotide
tgaagccagtcatcaatgtt

SEQ ID NO: 10841 - DNA, 20 bp, Artificial Sequence
  Description of Artificial Sequence: Synthetic oligonucleotide
atgaagccagtcatcaatgt

SEQ ID NO: 10842 - DNA, 20 bp, Artificial Sequence
  Description of Artificial Sequence: Synthetic oligonucleotide
catgaagccagtcatcaatg

SEQ ID NO: 10843 - DNA, 20 bp, Artificial Sequence
  Description of Artificial Sequence: Synthetic oligonucleotide
ccatgaagccagtcatcaat

SEQ ID NO: 10844 - DNA, 20 bp, Artificial Sequence
  Description of Artificial Sequence: Synthetic oligonucleotide
gccatgaagccagtcatcaa

SEQ ID NO: 10845 - DNA, 20 bp, Artificial Sequence
  Description of Artificial Sequence: Synthetic oligonucleotide
tgccatgaagccagtcatca

SEQ ID NO: 10846 - DNA, 20 bp, Artificial Sequence
  Description of Artificial Sequence: Synthetic oligonucleotide
ctgccatgaagccagtcatc

SEQ ID NO: 10847 - DNA, 20 bp, Artificial Sequence
  Description of Artificial Sequence: Synthetic oligonucleotide
actgccatgaagccagtcat

SEQ ID NO: 10848 - DNA, 20 bp, Artificial Sequence
  Description of Artificial Sequence: Synthetic oligonucleotide
tactgccatgaagccagtca

SEQ ID NO: 10849 - DNA, 20 bp, Artificial Sequence
  Description of Artificial Sequence: Synthetic oligonucleotide
ttactgccatgaagccagtc

SEQ ID NO: 10850 - DNA, 20 bp, Artificial Sequence
  Description of Artificial Sequence: Synthetic oligonucleotide
attactgccatgaagccagt

SEQ ID NO: 10851 - DNA, 20 bp, Artificial Sequence
  Description of Artificial Sequence: Synthetic oligonucleotide
aattactgccatgaagccag

SEQ ID NO: 10852 - DNA, 20 bp, Artificial Sequence
  Description of Artificial Sequence: Synthetic oligonucleotide
gaattactgccatgaagcca

SEQ ID NO: 10853 - DNA, 20 bp, Artificial Sequence
  Description of Artificial Sequence: Synthetic oligonucleotide
agaattactgccatgaagcc

SEQ ID NO: 10854 - DNA, 20 bp, Artificial Sequence
  Description of Artificial Sequence: Synthetic oligonucleotide
gagaattactgccatgaagc

SEQ ID NO: 10855 - DNA, 20 bp, Artificial Sequence
  Description of Artificial Sequence: Synthetic oligonucleotide
cgagaattactgccatgaag

SEQ ID NO: 10856 - DNA, 20 bp, Artificial Sequence
  Description of Artificial Sequence: Synthetic oligonucleotide
ccgagaattactgccatgaa

SEQ ID NO: 10857 - DNA, 20 bp, Artificial Sequence
  Description of Artificial Sequence: Synthetic oligonucleotide
gccgagaattactgccatga

SEQ ID NO: 10858 - DNA, 20 bp, Artificial Sequence
  Description of Artificial Sequence: Synthetic oligonucleotide
agccgagaattactgccatg

SEQ ID NO: 10859 - DNA, 20 bp, Artificial Sequence
  Description of Artificial Sequence: Synthetic oligonucleotide
cagccgagaattactgccat

SEQ ID NO: 10860 - DNA, 20 bp, Artificial Sequence
  Description of Artificial Sequence: Synthetic oligonucleotide
acagccgagaattactgcca

SEQ ID NO: 10861 - DNA, 20 bp, Artificial Sequence
  Description of Artificial Sequence: Synthetic oligonucleotide
tacagccgagaattactgcc

SEQ ID NO: 10862 - DNA, 20 bp, Artificial Sequence
  Description of Artificial Sequence: Synthetic oligonucleotide
ctacagccgagaattactgc

SEQ ID NO: 10863 - DNA, 20 bp, Artificial Sequence
  Description of Artificial Sequence: Synthetic oligonucleotide
actacagccgagaattactg

SEQ ID NO: 10864 - DNA, 20 bp, Artificial Sequence
  Description of Artificial Sequence: Synthetic oligonucleotide
aactacagccgagaattact

SEQ ID NO: 10865 - DNA, 20 bp, Artificial Sequence
  Description of Artificial Sequence: Synthetic oligonucleotide
caactacagccgagaattac

SEQ ID NO: 10866 - DNA, 20 bp, Artificial Sequence
  Description of Artificial Sequence: Synthetic oligonucleotide
gcaactacagccgagaatta

SEQ ID NO: 10867 - DNA, 20 bp, Artificial Sequence
  Description of Artificial Sequence: Synthetic oligonucleotide
tgcaactacagccgagaatt

SEQ ID NO: 10868 - DNA, 20 bp, Artificial Sequence
  Description of Artificial Sequence: Synthetic oligonucleotide
atgcaactacagccgagaat

SEQ ID NO: 10869 - DNA, 20 bp, Artificial Sequence
  Description of Artificial Sequence: Synthetic oligonucleotide
tatgcaactacagccgagaa

SEQ ID NO: 10870 - DNA, 20 bp, Artificial Sequence
  Description of Artificial Sequence: Synthetic oligonucleotide
ttatgcaactacagccgaga

SEQ ID NO: 10871 - DNA, 20 bp, Artificial Sequence
  Description of Artificial Sequence: Synthetic oligonucleotide
cttatgcaactacagccgag

SEQ ID NO: 10872 - DNA, 20 bp, Artificial Sequence
  Description of Artificial Sequence: Synthetic oligonucleotide
gcttatgcaactacagccga

SEQ ID NO: 10873 - DNA, 20 bp, Artificial Sequence
  Description of Artificial Sequence: Synthetic oligonucleotide
tgcttatgcaactacagccg

SEQ ID NO: 10874 - DNA, 20 bp, Artificial Sequence
  Description of Artificial Sequence: Synthetic oligonucleotide
atgcttatgcaactacagcc

SEQ ID NO: 10875 - DNA, 20 bp, Artificial Sequence
  Description of Artificial Sequence: Synthetic oligonucleotide
aatgcttatgcaactacagc

SEQ ID NO: 10876 - DNA, 20 bp, Artificial Sequence
  Description of Artificial Sequence: Synthetic oligonucleotide
caatgcttatgcaactacag

SEQ ID NO: 10877 - DNA, 20 bp, Artificial Sequence
  Description of Artificial Sequence: Synthetic oligonucleotide
gcaatgcttatgcaactaca

SEQ ID NO: 10878 - DNA, 20 bp, Artificial Sequence
  Description of Artificial Sequence: Synthetic oligonucleotide
agcaatgcttatgcaactac

SEQ ID NO: 10879 - DNA, 20 bp, Artificial Sequence
  Description of Artificial Sequence: Synthetic oligonucleotide
gagcaatgcttatgcaacta

SEQ ID NO: 10880 - DNA, 20 bp, Artificial Sequence
  Description of Artificial Sequence: Synthetic oligonucleotide
tgagcaatgcttatgcaact

SEQ ID NO: 10881 - DNA, 20 bp, Artificial Sequence
  Description of Artificial Sequence: Synthetic oligonucleotide
ttgagcaatgcttatgcaac

SEQ ID NO: 10882 - DNA, 20 bp, Artificial Sequence
  Description of Artificial Sequence: Synthetic oligonucleotide
cttgagcaatgcttatgcaa

SEQ ID NO: 10883 - DNA, 20 bp, Artificial Sequence
  Description of Artificial Sequence: Synthetic oligonucleotide
tcttgagcaatgcttatgca

SEQ ID NO: 10884 - DNA, 20 bp, Artificial Sequence
  Description of Artificial Sequence: Synthetic oligonucleotide
ctcttgagcaatgcttatgc

SEQ ID NO: 10885 - DNA, 20 bp, Artificial Sequence
  Description of Artificial Sequence: Synthetic oligonucleotide
cctcttgagcaatgcttatg

SEQ ID NO: 10886 - DNA, 20 bp, Artificial Sequence
  Description of Artificial Sequence: Synthetic oligonucleotide
tcctcttgagcaatgcttat

SEQ ID NO: 10887 - DNA, 20 bp, Artificial Sequence
  Description of Artificial Sequence: Synthetic oligonucleotide
ttcctcttgagcaatgctta

SEQ ID NO: 10888 - DNA, 20 bp, Artificial Sequence
  Description of Artificial Sequence: Synthetic oligonucleotide
tttcctcttgagcaatgctt

SEQ ID NO: 10889 - DNA, 20 bp, Artificial Sequence
  Description of Artificial Sequence: Synthetic oligonucleotide
ttttcctcttgagcaatgct

SEQ ID NO: 10890 - DNA, 20 bp, Artificial Sequence
  Description of Artificial Sequence: Synthetic oligonucleotide
attttcctcttgagcaatgc

SEQ ID NO: 10891 - DNA, 20 bp, Artificial Sequence
  Description of Artificial Sequence: Synthetic oligonucleotide
gattttcctcttgagcaatg

SEQ ID NO: 10892 - DNA, 20 bp, Artificial Sequence
  Description of Artificial Sequence: Synthetic oligonucleotide
ggattttcctcttgagcaat

SEQ ID NO: 10893 - DNA, 20 bp, Artificial Sequence
  Description of Artificial Sequence: Synthetic oligonucleotide
tggattttcctcttgagcaa

SEQ ID NO: 10894 - DNA, 20 bp, Artificial Sequence
  Description of Artificial Sequence: Synthetic oligonucleotide
ttggattttcctcttgagca

SEQ ID NO: 10895 - DNA, 20 bp, Artificial Sequence
  Description of Artificial Sequence: Synthetic oligonucleotide
tttggattttcctcttgagc

SEQ ID NO: 10896 - DNA, 20 bp, Artificial Sequence
  Description of Artificial Sequence: Synthetic oligonucleotide
ttttggattttcctcttgag

SEQ ID NO: 10897 - DNA, 20 bp, Artificial Sequence
  Description of Artificial Sequence: Synthetic oligonucleotide
cttttggattttcctcttga

SEQ ID NO: 10898 - DNA, 20 bp, Artificial Sequence
  Description of Artificial Sequence: Synthetic oligonucleotide
acttttggattttcctcttg

SEQ ID NO: 10899 - DNA, 20 bp, Artificial Sequence
  Description of Artificial Sequence: Synthetic oligonucleotide
cacttttggattttcctctt

SEQ ID NO: 10900 - DNA, 20 bp, Artificial Sequence
  Description of Artificial Sequence: Synthetic oligonucleotide
gcacttttggattttcctct

SEQ ID NO: 10901 - DNA, 20 bp, Artificial Sequence
  Description of Artificial Sequence: Synthetic oligonucleotide
tgcacttttggattttcctc

SEQ ID NO: 10902 - DNA, 20 bp, Artificial Sequence
  Description of Artificial Sequence: Synthetic oligonucleotide
ctgcacttttggattttcct

SEQ ID NO: 10903 - DNA, 20 bp, Artificial Sequence
  Description of Artificial Sequence: Synthetic oligonucleotide
gctgcacttttggattttcc

SEQ ID NO: 10904 - DNA, 20 bp, Artificial Sequence
  Description of Artificial Sequence: Synthetic oligonucleotide
tgctgcacttttggattttc

SEQ ID NO: 10905 - DNA, 20 bp, Artificial Sequence
  Description of Artificial Sequence: Synthetic oligonucleotide
ctgctgcacttttggatttt

SEQ ID NO: 10906 - DNA, 20 bp, Artificial Sequence
  Description of Artificial Sequence: Synthetic oligonucleotide
cctgctgcacttttggattt

SEQ ID NO: 10907 - DNA, 20 bp, Artificial Sequence
  Description of Artificial Sequence: Synthetic oligonucleotide
tcctgctgcacttttggatt

SEQ ID NO: 10908 - DNA, 20 bp, Artificial Sequence
  Description of Artificial Sequence: Synthetic oligonucleotide
ctcctgctgcacttttggat

SEQ ID NO: 10909 - DNA, 20 bp, Artificial Sequence
  Description of Artificial Sequence: Synthetic oligonucleotide
tctcctgctgcacttttgga

SEQ ID NO: 10910 - DNA, 20 bp, Artificial Sequence
  Description of Artificial Sequence: Synthetic oligonucleotide
ttctcctgctgcacttttgg

SEQ ID NO: 10911 - DNA, 20 bp, Artificial Sequence
  Description of Artificial Sequence: Synthetic oligonucleotide
gttctcctgctgcacttttg

SEQ ID NO: 10912 - DNA, 20 bp, Artificial Sequence
  Description of Artificial Sequence: Synthetic oligonucleotide
agttctcctgctgcactttt

SEQ ID NO: 10913 - DNA, 20 bp, Artificial Sequence
  Description of Artificial Sequence: Synthetic oligonucleotide
gagttctcctgctgcacttt

SEQ ID NO: 10914 - DNA, 20 bp, Artificial Sequence
  Description of Artificial Sequence: Synthetic oligonucleotide
agagttctcctgctgcactt

SEQ ID NO: 10915 - DNA, 20 bp, Artificial Sequence
  Description of Artificial Sequence: Synthetic oligonucleotide
aagagttctcctgctgcact

SEQ ID NO: 10916 - DNA, 20 bp, Artificial Sequence
  Description of Artificial Sequence: Synthetic oligonucleotide
aaagagttctcctgctgcac

SEQ ID NO: 10917 - DNA, 20 bp, Artificial Sequence
  Description of Artificial Sequence: Synthetic oligonucleotide
aaaagagttctcctgctgca

SEQ ID NO: 10918 - DNA, 20 bp, Artificial Sequence
  Description of Artificial Sequence: Synthetic oligonucleotide
gaaaagagttctcctgctgc

SEQ ID NO: 10919 - DNA, 20 bp, Artificial Sequence
  Description of Artificial Sequence: Synthetic oligonucleotide
ggaaaagagttctcctgctg

SEQ ID NO: 10920 - DNA, 20 bp, Artificial Sequence
  Description of Artificial Sequence: Synthetic oligonucleotide
gggaaaagagttctcctgct

SEQ ID NO: 10921 - DNA, 20 bp, Artificial Sequence
  Description of Artificial Sequence: Synthetic oligonucleotide
agggaaaagagttctcctgc

SEQ ID NO: 10922 - DNA, 20 bp, Artificial Sequence
  Description of Artificial Sequence: Synthetic oligonucleotide
cagggaaaagagttctcctg

SEQ ID NO: 10923 - DNA, 20 bp, Artificial Sequence
  Description of Artificial Sequence: Synthetic oligonucleotide
tcagggaaaagagttctcct

SEQ ID NO: 10924 - DNA, 20 bp, Artificial Sequence
  Description of Artificial Sequence: Synthetic oligonucleotide
ttcagggaaaagagttctcc

SEQ ID NO: 10925 - DNA, 20 bp, Artificial Sequence
  Description of Artificial Sequence: Synthetic oligonucleotide
tttcagggaaaagagttctc

SEQ ID NO: 10926 - DNA, 20 bp, Artificial Sequence
  Description of Artificial Sequence: Synthetic oligonucleotide
ttttcagggaaaagagttct

SEQ ID NO: 10927 - DNA, 20 bp, Artificial Sequence
  Description of Artificial Sequence: Synthetic oligonucleotide
tttttcagggaaaagagttc

SEQ ID NO: 10928 - DNA, 20 bp, Artificial Sequence
  Description of Artificial Sequence: Synthetic oligonucleotide
ctttttcagggaaaagagtt

SEQ ID NO: 10929 - DNA, 20 bp, Artificial Sequence
  Description of Artificial Sequence: Synthetic oligonucleotide
cctttttcagggaaaagagt

SEQ ID NO: 10930 - DNA, 20 bp, Artificial Sequence
  Description of Artificial Sequence: Synthetic oligonucleotide
tcctttttcagggaaaagag

SEQ ID NO: 10931 - DNA, 20 bp, Artificial Sequence
  Description of Artificial Sequence: Synthetic oligonucleotide
ttcctttttcagggaaaaga

SEQ ID NO: 10932 - DNA, 20 bp, Artificial Sequence
  Description of Artificial Sequence: Synthetic oligonucleotide
tttcctttttcagggaaaag

SEQ ID NO: 10933 - DNA, 20 bp, Artificial Sequence
  Description of Artificial Sequence: Synthetic oligonucleotide
ttttcctttttcagggaaaa

SEQ ID NO: 10934 - DNA, 20 bp, Artificial Sequence
  Description of Artificial Sequence: Synthetic oligonucleotide
tttttcctttttcagggaaa

SEQ ID NO: 10935 - DNA, 20 bp, Artificial Sequence
  Description of Artificial Sequence: Synthetic oligonucleotide
atttttcctttttcagggaa

SEQ ID NO: 10936 - DNA, 20 bp, Artificial Sequence
  Description of Artificial Sequence: Synthetic oligonucleotide
tatttttcctttttcaggga

SEQ ID NO: 10937 - DNA, 20 bp, Artificial Sequence
  Description of Artificial Sequence: Synthetic oligonucleotide
atatttttcctttttcaggg

SEQ ID NO: 10938 - DNA, 20 bp, Artificial Sequence
  Description of Artificial Sequence: Synthetic oligonucleotide
aatatttttcctttttcagg

SEQ ID NO: 10939 - DNA, 20 bp, Artificial Sequence
  Description of Artificial Sequence: Synthetic oligonucleotide
caatatttttcctttttcag

SEQ ID NO: 10940 - DNA, 20 bp, Artificial Sequence
  Description of Artificial Sequence: Synthetic oligonucleotide
tcaatatttttcctttttca

SEQ ID NO: 10941 - DNA, 20 bp, Artificial Sequence
  Description of Artificial Sequence: Synthetic oligonucleotide
ttcaatatttttcctttttc

SEQ ID NO: 10942 - DNA, 20 bp, Artificial Sequence
  Description of Artificial Sequence: Synthetic oligonucleotide
gttcaatatttttccttttt

SEQ ID NO: 10943 - DNA, 20 bp, Artificial Sequence
  Description of Artificial Sequence: Synthetic oligonucleotide
agttcaatatttttcctttt

SEQ ID NO: 10944 - DNA, 20 bp, Artificial Sequence
  Description of Artificial Sequence: Synthetic oligonucleotide
gagttcaatatttttccttt

SEQ ID NO: 10945 - DNA, 20 bp, Artificial Sequence
  Description of Artificial Sequence: Synthetic oligonucleotide
tgagttcaatatttttcctt

SEQ ID NO: 10946 - DNA, 20 bp, Artificial Sequence
  Description of Artificial Sequence: Synthetic oligonucleotide
ttgagttcaatatttttcct

SEQ ID NO: 10947 - DNA, 20 bp, Artificial Sequence
  Description of Artificial Sequence: Synthetic oligonucleotide
attgagttcaatatttttcc

SEQ ID NO: 10948 - DNA, 20 bp, Artificial Sequence
  Description of Artificial Sequence: Synthetic oligonucleotide
cattgagttcaatatttttc

SEQ ID NO: 10949 - DNA, 20 bp, Artificial Sequence
  Description of Artificial Sequence: Synthetic oligonucleotide
tcattgagttcaatattttt

SEQ ID NO: 10950 - DNA, 20 bp, Artificial Sequence
  Description of Artificial Sequence: Synthetic oligonucleotide
atcattgagttcaatatttt

SEQ ID NO: 10951 - DNA, 20 bp, Artificial Sequence
  Description of Artificial Sequence: Synthetic oligonucleotide
tatcattgagttcaatattt

SEQ ID NO: 10952 - DNA, 20 bp, Artificial Sequence
  Description of Artificial Sequence: Synthetic oligonucleotide
ctatcattgagttcaatatt

SEQ ID NO: 10953 - DNA, 20 bp, Artificial Sequence
  Description of Artificial Sequence: Synthetic oligonucleotide
gctatcattgagttcaatat

SEQ ID NO: 10954 - DNA, 20 bp, Artificial Sequence
  Description of Artificial Sequence: Synthetic oligonucleotide
tgctatcattgagttcaata

SEQ ID NO: 10955 - DNA, 20 bp, Artificial Sequence
  Description of Artificial Sequence: Synthetic oligonucleotide
gtgctatcattgagttcaat

SEQ ID NO: 10956 - DNA, 20 bp, Artificial Sequence
  Description of Artificial Sequence: Synthetic oligonucleotide
ggtgctatcattgagttcaa

SEQ ID NO: 10957 - DNA, 20 bp, Artificial Sequence
  Description of Artificial Sequence: Synthetic oligonucleotide
aggtgctatcattgagttca

SEQ ID NO: 10958 - DNA, 20 bp, Artificial Sequence
  Description of Artificial Sequence: Synthetic oligonucleotide
taggtgctatcattgagttc

SEQ ID NO: 10959 - DNA, 20 bp, Artificial Sequence
  Description of Artificial Sequence: Synthetic oligonucleotide
ttaggtgctatcattgagtt

SEQ ID NO: 10960 - DNA, 20 bp, Artificial Sequence
  Description of Artificial Sequence: Synthetic oligonucleotide
tttaggtgctatcattgagt

SEQ ID NO: 10961 - DNA, 20 bp, Artificial Sequence
  Description of Artificial Sequence: Synthetic oligonucleotide
gtttaggtgctatcattgag

SEQ ID NO: 10962 - DNA, 20 bp, Artificial Sequence
  Description of Artificial Sequence: Synthetic oligonucleotide
agtttaggtgctatcattga

SEQ ID NO: 10963 - DNA, 20 bp, Artificial Sequence
  Description of Artificial Sequence: Synthetic oligonucleotide
aagtttaggtgctatcattg

SEQ ID NO: 10964 - DNA, 20 bp, Artificial Sequence
  Description of Artificial Sequence: Synthetic oligonucleotide
taagtttaggtgctatcatt

SEQ ID NO: 10965 - DNA, 20 bp, Artificial Sequence
  Description of Artificial Sequence: Synthetic oligonucleotide
gtaagtttaggtgctatcat

SEQ ID NO: 10966 - DNA, 20 bp, Artificial Sequence
  Description of Artificial Sequence: Synthetic oligonucleotide
tgtaagtttaggtgctatca

SEQ ID NO: 10967 - DNA, 20 bp, Artificial Sequence
  Description of Artificial Sequence: Synthetic oligonucleotide
atgtaagtttaggtgctatc

SEQ ID NO: 10968 - DNA, 20 bp, Artificial Sequence
  Description of Artificial Sequence: Synthetic oligonucleotide
aatgtaagtttaggtgctat

SEQ ID NO: 10969 - DNA, 20 bp, Artificial Sequence
  Description of Artificial Sequence: Synthetic oligonucleotide
aaatgtaagtttaggtgcta

SEQ ID NO: 10970 - DNA, 20 bp, Artificial Sequence
  Description of Artificial Sequence: Synthetic oligonucleotide
taaatgtaagtttaggtgct

SEQ ID NO: 10971 - DNA, 20 bp, Artificial Sequence
  Description of Artificial Sequence: Synthetic oligonucleotide
ttaaatgtaagtttaggtgc

SEQ ID NO: 10972 - DNA, 20 bp, Artificial Sequence
  Description of Artificial Sequence: Synthetic oligonucleotide
tttaaatgtaagtttaggtg

SEQ ID NO: 10973 - DNA, 20 bp, Artificial Sequence
  Description of Artificial Sequence: Synthetic oligonucleotide
ttttaaatgtaagtttaggt

SEQ ID NO: 10974 - DNA, 20 bp, Artificial Sequence
  Description of Artificial Sequence: Synthetic oligonucleotide
cttttaaatgtaagtttagg

SEQ ID NO: 10975 - DNA, 20 bp, Artificial Sequence
  Description of Artificial Sequence: Synthetic oligonucleotide
tcttttaaatgtaagtttag

SEQ ID NO: 10976 - DNA, 20 bp, Artificial Sequence
  Description of Artificial Sequence: Synthetic oligonucleotide
gtcttttaaatgtaagttta

SEQ ID NO: 10977 - DNA, 20 bp, Artificial Sequence
  Description of Artificial Sequence: Synthetic oligonucleotide
tgtcttttaaatgtaagttt

SEQ ID NO: 10978 - DNA, 20 bp, Artificial Sequence
  Description of Artificial Sequence: Synthetic oligonucleotide
ctgtcttttaaatgtaagtt

SEQ ID NO: 10979 - DNA, 20 bp, Artificial Sequence
  Description of Artificial Sequence: Synthetic oligonucleotide
tctgtcttttaaatgtaagt

SEQ ID NO: 10980 - DNA, 20 bp, Artificial Sequence
  Description of Artificial Sequence: Synthetic oligonucleotide
gtctgtcttttaaatgtaag

SEQ ID NO: 10981 - DNA, 20 bp, Artificial Sequence
  Description of Artificial Sequence: Synthetic oligonucleotide
tgtctgtcttttaaatgtaa

SEQ ID NO: 10982 - DNA, 20 bp, Artificial Sequence
  Description of Artificial Sequence: Synthetic oligonucleotide
atgtctgtcttttaaatgta

SEQ ID NO: 10983 - DNA, 20 bp, Artificial Sequence
  Description of Artificial Sequence: Synthetic oligonucleotide
aatgtctgtcttttaaatgt

SEQ ID NO: 10984 - DNA, 20 bp, Artificial Sequence
  Description of Artificial Sequence: Synthetic oligonucleotide
gaatgtctgtcttttaaatg

SEQ ID NO: 10985 - DNA, 20 bp, Artificial Sequence
  Description of Artificial Sequence: Synthetic oligonucleotide
ggaatgtctgtcttttaaat

SEQ ID NO: 10986 - DNA, 20 bp, Artificial Sequence
  Description of Artificial Sequence: Synthetic oligonucleotide
aggaatgtctgtcttttaaa

SEQ ID NO: 10987 - DNA, 20 bp, Artificial Sequence
  Description of Artificial Sequence: Synthetic oligonucleotide
aaggaatgtctgtcttttaa

SEQ ID NO: 10988 - DNA, 20 bp, Artificial Sequence
  Description of Artificial Sequence: Synthetic oligonucleotide
gaaggaatgtctgtctttta

SEQ ID NO: 10989 - DNA, 20 bp, Artificial Sequence
  Description of Artificial Sequence: Synthetic oligonucleotide
agaaggaatgtctgtctttt

SEQ ID NO: 10990 - DNA, 20 bp, Artificial Sequence
  Description of Artificial Sequence: Synthetic oligonucleotide
tagaaggaatgtctgtcttt

SEQ ID NO: 10991 - DNA, 20 bp, Artificial Sequence
  Description of Artificial Sequence: Synthetic oligonucleotide
gtagaaggaatgtctgtctt

SEQ ID NO: 10992 - DNA, 20 bp, Artificial Sequence
  Description of Artificial Sequence: Synthetic oligonucleotide
tgtagaaggaatgtctgtct

SEQ ID NO: 10993 - DNA, 20 bp, Artificial Sequence
  Description of Artificial Sequence: Synthetic oligonucleotide
atgtagaaggaatgtctgtc

SEQ ID NO: 10994 - DNA, 20 bp, Artificial Sequence
  Description of Artificial Sequence: Synthetic oligonucleotide
catgtagaaggaatgtctgt

SEQ ID NO: 10995 - DNA, 20 bp, Artificial Sequence
  Description of Artificial Sequence: Synthetic oligonucleotide
acatgtagaaggaatgtctg

SEQ ID NO: 10996 - DNA, 20 bp, Artificial Sequence
  Description of Artificial Sequence: Synthetic oligonucleotide
tacatgtagaaggaatgtct

SEQ ID NO: 10997 - DNA, 20 bp, Artificial Sequence
  Description of Artificial Sequence: Synthetic oligonucleotide
ttacatgtagaaggaatgtc

SEQ ID NO: 10998 - DNA, 20 bp, Artificial Sequence
  Description of Artificial Sequence: Synthetic oligonucleotide
attacatgtagaaggaatgt

SEQ ID NO: 10999 - DNA, 20 bp, Artificial Sequence
  Description of Artificial Sequence: Synthetic oligonucleotide
cattacatgtagaaggaatg

SEQ ID NO: 11000 - DNA, 20 bp, Artificial Sequence
  Description of Artificial Sequence: Synthetic oligonucleotide
tcattacatgtagaaggaat

SEQ ID NO: 11001 - DNA, 20 bp, Artificial Sequence
  Description of Artificial Sequence: Synthetic oligonucleotide
gtcattacatgtagaaggaa

SEQ ID NO: 11002 - DNA, 20 bp, Artificial Sequence
  Description of Artificial Sequence: Synthetic oligonucleotide
tgtcattacatgtagaagga

SEQ ID NO: 11003 - DNA, 20 bp, Artificial Sequence
  Description of Artificial Sequence: Synthetic oligonucleotide
gtgtcattacatgtagaagg

SEQ ID NO: 11004 - DNA, 20 bp, Artificial Sequence
  Description of Artificial Sequence: Synthetic oligonucleotide
agtgtcattacatgtagaag

SEQ ID NO: 11005 - DNA, 20 bp, Artificial Sequence
  Description of Artificial Sequence: Synthetic oligonucleotide
aagtgtcattacatgtagaa

SEQ ID NO: 11006 - DNA, 20 bp, Artificial Sequence
  Description of Artificial Sequence: Synthetic oligonucleotide
gaagtgtcattacatgtaga

SEQ ID NO: 11007 - DNA, 20 bp, Artificial Sequence
  Description of Artificial Sequence: Synthetic oligonucleotide
agaagtgtcattacatgtag

SEQ ID NO: 11008 - DNA, 20 bp, Artificial Sequence
  Description of Artificial Sequence: Synthetic oligonucleotide
aagaagtgtcattacatgta

SEQ ID NO: 11009 - DNA, 20 bp, Artificial Sequence
  Description of Artificial Sequence: Synthetic oligonucleotide
caagaagtgtcattacatgt

SEQ ID NO: 11010 - DNA, 20 bp, Artificial Sequence
  Description of Artificial Sequence: Synthetic oligonucleotide
acaagaagtgtcattacatg

SEQ ID NO: 11011 - DNA, 20 bp, Artificial Sequence
  Description of Artificial Sequence: Synthetic oligonucleotide
cacaagaagtgtcattacat

SEQ ID NO: 11012 - DNA, 20 bp, Artificial Sequence
  Description of Artificial Sequence: Synthetic oligonucleotide
acacaagaagtgtcattaca

SEQ ID NO: 11013 - DNA, 20 bp, Artificial Sequence
  Description of Artificial Sequence: Synthetic oligonucleotide
aacacaagaagtgtcattac

SEQ ID NO: 11014 - DNA, 20 bp, Artificial Sequence
  Description of Artificial Sequence: Synthetic oligonucleotide
taacacaagaagtgtcatta

SEQ ID NO: 11015 - DNA, 20 bp, Artificial Sequence
  Description of Artificial Sequence: Synthetic oligonucleotide
ttaacacaagaagtgtcatt

SEQ ID NO: 11016 - DNA, 20 bp, Artificial Sequence
  Description of Artificial Sequence: Synthetic oligonucleotide
tttaacacaagaagtgtcat

SEQ ID NO: 11017 - DNA, 20 bp, Artificial Sequence
  Description of Artificial Sequence: Synthetic oligonucleotide
gtttaacacaagaagtgtca

SEQ ID NO: 11018 - DNA, 20 bp, Artificial Sequence
  Description of Artificial Sequence: Synthetic oligonucleotide
agtttaacacaagaagtgtc

SEQ ID NO: 11019 - DNA, 20 bp, Artificial Sequence
  Description of Artificial Sequence: Synthetic oligonucleotide
tagtttaacacaagaagtgt

SEQ ID NO: 11020 - DNA, 20 bp, Artificial Sequence
  Description of Artificial Sequence: Synthetic oligonucleotide
ttagtttaacacaagaagtg

SEQ ID NO: 11021 - DNA, 20 bp, Artificial Sequence
  Description of Artificial Sequence: Synthetic oligonucleotide
tttagtttaacacaagaagt

SEQ ID NO: 11022 - DNA, 20 bp, Artificial Sequence
  Description of Artificial Sequence: Synthetic oligonucleotide
ttttagtttaacacaagaag

SEQ ID NO: 11023 - DNA, 20 bp, Artificial Sequence
  Description of Artificial Sequence: Synthetic oligonucleotide
tttttagtttaacacaagaa

SEQ ID NO: 11024 - DNA, 20 bp, Artificial Sequence
  Description of Artificial Sequence: Synthetic oligonucleotide
atttttagtttaacacaaga

SEQ ID NO: 11025 - DNA, 20 bp, Artificial Sequence
  Description of Artificial Sequence: Synthetic oligonucleotide
aatttttagtttaacacaag

SEQ ID NO: 11026 - DNA, 20 bp, Artificial Sequence
  Description of Artificial Sequence: Synthetic oligonucleotide
aaatttttagtttaacacaa

SEQ ID NO: 11027 - DNA, 20 bp, Artificial Sequence
  Description of Artificial Sequence: Synthetic oligonucleotide
taaatttttagtttaacaca

SEQ ID NO: 11028 - DNA, 20 bp, Artificial Sequence
  Description of Artificial Sequence: Synthetic oligonucleotide
gtaaatttttagtttaacac

SEQ ID NO: 11029 - DNA, 20 bp, Artificial Sequence
  Description of Artificial Sequence: Synthetic oligonucleotide
tgtaaatttttagtttaaca

SEQ ID NO: 11030 - DNA, 20 bp, Artificial Sequence
  Description of Artificial Sequence: Synthetic oligonucleotide
ttgtaaatttttagtttaac

SEQ ID NO: 11031 - DNA, 20 bp, Artificial Sequence
  Description of Artificial Sequence: Synthetic oligonucleotide
cttgtaaatttttagtttaa

SEQ ID NO: 11032 - DNA, 20 bp, Artificial Sequence
  Description of Artificial Sequence: Synthetic oligonucleotide
tcttgtaaatttttagttta

SEQ ID NO: 11033 - DNA, 20 bp, Artificial Sequence
  Description of Artificial Sequence: Synthetic oligonucleotide
ctcttgtaaatttttagttt

SEQ ID NO: 11034 - DNA, 20 bp, Artificial Sequence
  Description of Artificial Sequence: Synthetic oligonucleotide
tctcttgtaaatttttagtt

SEQ ID NO: 11035 - DNA, 20 bp, Artificial Sequence
  Description of Artificial Sequence: Synthetic oligonucleotide
ttctcttgtaaatttttagt

SEQ ID NO: 11036 - DNA, 20 bp, Artificial Sequence
  Description of Artificial Sequence: Synthetic oligonucleotide
cttctcttgtaaatttttag

SEQ ID NO: 11037 - DNA, 20 bp, Artificial Sequence
  Description of Artificial Sequence: Synthetic oligonucleotide
tcttctcttgtaaattttta

SEQ ID NO: 11038 - DNA, 20 bp, Artificial Sequence
  Description of Artificial Sequence: Synthetic oligonucleotide
ttcttctcttgtaaattttt

SEQ ID NO: 11039 - DNA, 20 bp, Artificial Sequence
  Description of Artificial Sequence: Synthetic oligonucleotide
tttcttctcttgtaaatttt

SEQ ID NO: 11040 - DNA, 20 bp, Artificial Sequence
  Description of Artificial Sequence: Synthetic oligonucleotide
ctttcttctcttgtaaattt

SEQ ID NO: 11041 - DNA, 20 bp, Artificial Sequence
  Description of Artificial Sequence: Synthetic oligonucleotide
actttcttctcttgtaaatt

SEQ ID NO: 11042 - DNA, 20 bp, Artificial Sequence
  Description of Artificial Sequence: Synthetic oligonucleotide
cactttcttctcttgtaaat

SEQ ID NO: 11043 - DNA, 20 bp, Artificial Sequence
  Description of Artificial Sequence: Synthetic oligonucleotide
tcactttcttctcttgtaaa

SEQ ID NO: 11044 - DNA, 20 bp, Artificial Sequence
  Description of Artificial Sequence: Synthetic oligonucleotide
ttcactttcttctcttgtaa

SEQ ID NO: 11045 - DNA, 20 bp, Artificial Sequence
  Description of Artificial Sequence: Synthetic oligonucleotide
tttcactttcttctcttgta

SEQ ID NO: 11046 - DNA, 20 bp, Artificial Sequence
  Description of Artificial Sequence: Synthetic oligonucleotide
ctttcactttcttctcttgt

SEQ ID NO: 11047 - DNA, 20 bp, Artificial Sequence
  Description of Artificial Sequence: Synthetic oligonucleotide
gctttcactttcttctcttg

SEQ ID NO: 11048 - DNA, 20 bp, Artificial Sequence
  Description of Artificial Sequence: Synthetic oligonucleotide
tgctttcactttcttctctt

SEQ ID NO: 11049 - DNA, 20 bp, Artificial Sequence
  Description of Artificial Sequence: Synthetic oligonucleotide
ttgctttcactttcttctct

SEQ ID NO: 11050 - DNA, 20 bp, Artificial Sequence
  Description of Artificial Sequence: Synthetic oligonucleotide
tttgctttcactttcttctc

SEQ ID NO: 11051 - DNA, 20 bp, Artificial Sequence
  Description of Artificial Sequence: Synthetic oligonucleotide
atttgctttcactttcttct

SEQ ID NO: 11052 - DNA, 20 bp, Artificial Sequence
  Description of Artificial Sequence: Synthetic oligonucleotide
catttgctttcactttcttc

SEQ ID NO: 11053 - DNA, 20 bp, Artificial Sequence
  Description of Artificial Sequence: Synthetic oligonucleotide
ccatttgctttcactttctt

SEQ ID NO: 11054 - DNA, 20 bp, Artificial Sequence
  Description of Artificial Sequence: Synthetic oligonucleotide
cccatttgctttcactttct

SEQ ID NO: 11055 - DNA, 20 bp, Artificial Sequence
  Description of Artificial Sequence: Synthetic oligonucleotide
ccccatttgctttcactttc

SEQ ID NO: 11056 - DNA, 20 bp, Artificial Sequence
  Description of Artificial Sequence: Synthetic oligonucleotide
accccatttgctttcacttt

SEQ ID NO: 11057 - DNA, 20 bp, Artificial Sequence
  Description of Artificial Sequence: Synthetic oligonucleotide
aaccccatttgctttcactt

SEQ ID NO: 11058 - DNA, 20 bp, Artificial Sequence
  Description of Artificial Sequence: Synthetic oligonucleotide
aaaccccatttgctttcact

SEQ ID NO: 11059 - DNA, 20 bp, Artificial Sequence
  Description of Artificial Sequence: Synthetic oligonucleotide
gaaaccccatttgctttcac

SEQ ID NO: 11060 - DNA, 20 bp, Artificial Sequence
  Description of Artificial Sequence: Synthetic oligonucleotide
tgaaaccccatttgctttca

SEQ ID NO: 11061 - DNA, 20 bp, Artificial Sequence
  Description of Artificial Sequence: Synthetic oligonucleotide
gtgaaaccccatttgctttc

SEQ ID NO: 11062 - DNA, 20 bp, Artificial Sequence
  Description of Artificial Sequence: Synthetic oligonucleotide
tgtgaaaccccatttgcttt

SEQ ID NO: 11063 - DNA, 20 bp, Artificial Sequence
  Description of Artificial Sequence: Synthetic oligonucleotide
ttgtgaaaccccatttgctt

SEQ ID NO: 11064 - DNA, 20 bp, Artificial Sequence
  Description of Artificial Sequence: Synthetic oligonucleotide
tttgtgaaaccccatttgct

SEQ ID NO: 11065 - DNA, 20 bp, Artificial Sequence
  Description of Artificial Sequence: Synthetic oligonucleotide
atttgtgaaaccccatttgc

SEQ ID NO: 11066 - DNA, 20 bp, Artificial Sequence
  Description of Artificial Sequence: Synthetic oligonucleotide
tatttgtgaaaccccatttg

SEQ ID NO: 11067 - DNA, 20 bp, Artificial Sequence
  Description of Artificial Sequence: Synthetic oligonucleotide
ctatttgtgaaaccccattt

SEQ ID NO: 11068 - DNA, 20 bp, Artificial Sequence
  Description of Artificial Sequence: Synthetic oligonucleotide
actatttgtgaaaccccatt

SEQ ID NO: 11069 - DNA, 20 bp, Artificial Sequence
  Description of Artificial Sequence: Synthetic oligonucleotide
aactatttgtgaaaccccat

SEQ ID NO: 11070 - DNA, 20 bp, Artificial Sequence
  Description of Artificial Sequence: Synthetic oligonucleotide
caactatttgtgaaacccca

SEQ ID NO: 11071 - DNA, 20 bp, Artificial Sequence
  Description of Artificial Sequence: Synthetic oligonucleotide
acaactatttgtgaaacccc

SEQ ID NO: 11072 - DNA, 20 bp, Artificial Sequence
  Description of Artificial Sequence: Synthetic oligonucleotide
tacaactatttgtgaaaccc

SEQ ID NO: 11073 - DNA, 20 bp, Artificial Sequence
  Description of Artificial Sequence: Synthetic oligonucleotide
ttacaactatttgtgaaacc

SEQ ID NO: 11074 - DNA, 20 bp, Artificial Sequence
  Description of Artificial Sequence: Synthetic oligonucleotide
tttacaactatttgtgaaac

SEQ ID NO: 11075 - DNA, 20 bp, Artificial Sequence
  Description of Artificial Sequence: Synthetic oligonucleotide
atttacaactatttgtgaaa

SEQ ID NO: 11076 - DNA, 20 bp, Artificial Sequence
  Description of Artificial Sequence: Synthetic oligonucleotide
tatttacaactatttgtgaa

SEQ ID NO: 11077 - DNA, 20 bp, Artificial Sequence
  Description of Artificial Sequence: Synthetic oligonucleotide
atatttacaactatttgtga

SEQ ID NO: 11078 - DNA, 20 bp, Artificial Sequence
  Description of Artificial Sequence: Synthetic oligonucleotide
tatatttacaactatttgtg

SEQ ID NO: 11079 - DNA, 20 bp, Artificial Sequence
  Description of Artificial Sequence: Synthetic oligonucleotide
ctatatttacaactatttgt

SEQ ID NO: 11080 - DNA, 20 bp, Artificial Sequence
  Description of Artificial Sequence: Synthetic oligonucleotide
actatatttacaactatttg

SEQ ID NO: 11081 - DNA, 20 bp, Artificial Sequence
  Description of Artificial Sequence: Synthetic oligonucleotide
cactatatttacaactattt

SEQ ID NO: 11082 - DNA, 20 bp, Artificial Sequence
  Description of Artificial Sequence: Synthetic oligonucleotide
tcactatatttacaactatt

SEQ ID NO: 11083 - DNA, 20 bp, Artificial Sequence
  Description of Artificial Sequence: Synthetic oligonucleotide
ttcactatatttacaactat

SEQ ID NO: 11084 - DNA, 20 bp, Artificial Sequence
  Description of Artificial Sequence: Synthetic oligonucleotide
cttcactatatttacaacta

SEQ ID NO: 11085 - DNA, 20 bp, Artificial Sequence
  Description of Artificial Sequence: Synthetic oligonucleotide
gcttcactatatttacaact

SEQ ID NO: 11086 - DNA, 20 bp, Artificial Sequence
  Description of Artificial Sequence: Synthetic oligonucleotide
tgcttcactatatttacaac

SEQ ID NO: 11087 - DNA, 20 bp, Artificial Sequence
  Description of Artificial Sequence: Synthetic oligonucleotide
ttgcttcactatatttacaa

SEQ ID NO: 11088 - DNA, 20 bp, Artificial Sequence
  Description of Artificial Sequence: Synthetic oligonucleotide
attgcttcactatatttaca

SEQ ID NO: 11089 - DNA, 20 bp, Artificial Sequence
  Description of Artificial Sequence: Synthetic oligonucleotide
aattgcttcactatatttac

SEQ ID NO: 11090 - DNA, 20 bp, Artificial Sequence
  Description of Artificial Sequence: Synthetic oligonucleotide
aaattgcttcactatattta

SEQ ID NO: 11091 - DNA, 20 bp, Artificial Sequence
  Description of Artificial Sequence: Synthetic oligonucleotide
caaattgcttcactatattt

SEQ ID NO: 11092 - DNA, 20 bp, Artificial Sequence
  Description of Artificial Sequence: Synthetic oligonucleotide
tcaaattgcttcactatatt

SEQ ID NO: 11093 - DNA, 20 bp, Artificial Sequence
  Description of Artificial Sequence: Synthetic oligonucleotide
ttcaaattgcttcactatat

SEQ ID NO: 11094 - DNA, 20 bp, Artificial Sequence
  Description of Artificial Sequence: Synthetic oligonucleotide
tttcaaattgcttcactata

SEQ ID NO: 11095 - DNA, 20 bp, Artificial Sequence
  Description of Artificial Sequence: Synthetic oligonucleotide
atttcaaattgcttcactat

SEQ ID NO: 11096 - DNA, 20 bp, Artificial Sequence
  Description of Artificial Sequence: Synthetic oligonucleotide
tatttcaaattgcttcacta

SEQ ID NO: 11097 - DNA, 20 bp, Artificial Sequence
  Description of Artificial Sequence: Synthetic oligonucleotide
ttatttcaaattgcttcact

SEQ ID NO: 11098 - DNA, 20 bp, Artificial Sequence
  Description of Artificial Sequence: Synthetic oligonucleotide
attatttcaaattgcttcac

SEQ ID NO: 11099 - DNA, 20 bp, Artificial Sequence
  Description of Artificial Sequence: Synthetic oligonucleotide
aattatttcaaattgcttca

SEQ ID NO: 11100 - DNA, 20 bp, Artificial Sequence
  Description of Artificial Sequence: Synthetic oligonucleotide
aaattatttcaaattgcttc

SEQ ID NO: 11101 - DNA, 20 bp, Artificial Sequence
  Description of Artificial Sequence: Synthetic oligonucleotide
aaaattatttcaaattgctt

SEQ ID NO: 11102 - DNA, 20 bp, Artificial Sequence
  Description of Artificial Sequence: Synthetic oligonucleotide
gaaaattatttcaaattgct

SEQ ID NO: 11103 - DNA, 20 bp, Artificial Sequence
  Description of Artificial Sequence: Synthetic oligonucleotide
tgaaaattatttcaaattgc

SEQ ID NO: 11104 - DNA, 20 bp, Artificial Sequence
  Description of Artificial Sequence: Synthetic oligonucleotide
ttgaaaattatttcaaattg

SEQ ID NO: 11105 - DNA, 20 bp, Artificial Sequence
  Description of Artificial Sequence: Synthetic oligonucleotide
cttgaaaattatttcaaatt

SEQ ID NO: 11106 - DNA, 20 bp, Artificial Sequence
  Description of Artificial Sequence: Synthetic oligonucleotide
gcttgaaaattatttcaaat

SEQ ID NO: 11107 - DNA, 20 bp, Artificial Sequence
  Description of Artificial Sequence: Synthetic oligonucleotide
tgcttgaaaattatttcaaa

SEQ ID NO: 11108 - DNA, 20 bp, Artificial Sequence
  Description of Artificial Sequence: Synthetic oligonucleotide
ttgcttgaaaattatttcaa

SEQ ID NO: 11109 - DNA, 20 bp, Artificial Sequence
  Description of Artificial Sequence: Synthetic oligonucleotide
tttgcttgaaaattatttca

SEQ ID NO: 11110 - DNA, 20 bp, Artificial Sequence
  Description of Artificial Sequence: Synthetic oligonucleotide
ctttgcttgaaaattatttc

SEQ ID NO: 11111 - DNA, 20 bp, Artificial Sequence
  Description of Artificial Sequence: Synthetic oligonucleotide
actttgcttgaaaattattt

SEQ ID NO: 11112 - DNA, 20 bp, Artificial Sequence
  Description of Artificial Sequence: Synthetic oligonucleotide
tactttgcttgaaaattatt

SEQ ID NO: 11113 - DNA, 20 bp, Artificial Sequence
  Description of Artificial Sequence: Synthetic oligonucleotide
atactttgcttgaaaattat

SEQ ID NO: 11114 - DNA, 20 bp, Artificial Sequence
  Description of Artificial Sequence: Synthetic oligonucleotide
aatactttgcttgaaaatta

SEQ ID NO: 11115 - DNA, 20 bp, Artificial Sequence
  Description of Artificial Sequence: Synthetic oligonucleotide
caatactttgcttgaaaatt

SEQ ID NO: 11116 - DNA, 20 bp, Artificial Sequence
  Description of Artificial Sequence: Synthetic oligonucleotide
acaatactttgcttgaaaat

SEQ ID NO: 11117 - DNA, 20 bp, Artificial Sequence
  Description of Artificial Sequence: Synthetic oligonucleotide
cacaatactttgcttgaaaa

SEQ ID NO: 11118 - DNA, 20 bp, Artificial Sequence
  Description of Artificial Sequence: Synthetic oligonucleotide
tcacaatactttgcttgaaa

SEQ ID NO: 11119 - DNA, 20 bp, Artificial Sequence
  Description of Artificial Sequence: Synthetic oligonucleotide
ttcacaatactttgcttgaa

SEQ ID NO: 11120 - DNA, 20 bp, Artificial Sequence
  Description of Artificial Sequence: Synthetic oligonucleotide
tttcacaatactttgcttga

SEQ ID NO: 11121 - DNA, 20 bp, Artificial Sequence
  Description of Artificial Sequence: Synthetic oligonucleotide
ctttcacaatactttgcttg

SEQ ID NO: 11122 - DNA, 20 bp, Artificial Sequence
  Description of Artificial Sequence: Synthetic oligonucleotide
actttcacaatactttgctt

SEQ ID NO: 11123 - DNA, 20 bp, Artificial Sequence
  Description of Artificial Sequence: Synthetic oligonucleotide
tactttcacaatactttgct

SEQ ID NO: 11124 - DNA, 20 bp, Artificial Sequence
  Description of Artificial Sequence: Synthetic oligonucleotide
atactttcacaatactttgc

SEQ ID NO: 11125 - DNA, 20 bp, Artificial Sequence
  Description of Artificial Sequence: Synthetic oligonucleotide
aatactttcacaatactttg

SEQ ID NO: 11126 - DNA, 20 bp, Artificial Sequence
  Description of Artificial Sequence: Synthetic oligonucleotide
gaatactttcacaatacttt

SEQ ID NO: 11127 - DNA, 20 bp, Artificial Sequence
  Description of Artificial Sequence: Synthetic oligonucleotide
agaatactttcacaatactt

SEQ ID NO: 11128 - DNA, 20 bp, Artificial Sequence
  Description of Artificial Sequence: Synthetic oligonucleotide
tagaatactttcacaatact

SEQ ID NO: 11129 - DNA, 20 bp, Artificial Sequence
  Description of Artificial Sequence: Synthetic oligonucleotide
ttagaatactttcacaatac

SEQ ID NO: 11130 - DNA, 20 bp, Artificial Sequence
  Description of Artificial Sequence: Synthetic oligonucleotide
cttagaatactttcacaata

SEQ ID NO: 11131 - DNA, 20 bp, Artificial Sequence
  Description of Artificial Sequence: Synthetic oligonucleotide
gcttagaatactttcacaat

SEQ ID NO: 11132 - DNA, 20 bp, Artificial Sequence
  Description of Artificial Sequence: Synthetic oligonucleotide
ggcttagaatactttcacaa

SEQ ID NO: 11133 - DNA, 20 bp, Artificial Sequence
  Description of Artificial Sequence: Synthetic oligonucleotide
tggcttagaatactttcaca

SEQ ID NO: 11134 - DNA, 20 bp, Artificial Sequence
  Description of Artificial Sequence: Synthetic oligonucleotide
ttggcttagaatactttcac

SEQ ID NO: 11135 - DNA, 20 bp, Artificial Sequence
  Description of Artificial Sequence: Synthetic oligonucleotide
cttggcttagaatactttca

SEQ ID NO: 11136 - DNA, 20 bp, Artificial Sequence
  Description of Artificial Sequence: Synthetic oligonucleotide
acttggcttagaatactttc

SEQ ID NO: 11137 - DNA, 20 bp, Artificial Sequence
  Description of Artificial Sequence: Synthetic oligonucleotide
aacttggcttagaatacttt

SEQ ID NO: 11138 - DNA, 20 bp, Artificial Sequence
  Description of Artificial Sequence: Synthetic oligonucleotide
aaacttggcttagaatactt

SEQ ID NO: 11139 - DNA, 20 bp, Artificial Sequence
  Description of Artificial Sequence: Synthetic oligonucleotide
aaaacttggcttagaatact

SEQ ID NO: 11140 - DNA, 20 bp, Artificial Sequence
  Description of Artificial Sequence: Synthetic oligonucleotide
taaaacttggcttagaatac

SEQ ID NO: 11141 - DNA, 20 bp, Artificial Sequence
  Description of Artificial Sequence: Synthetic oligonucleotide
ttaaaacttggcttagaata

SEQ ID NO: 11142 - DNA, 20 bp, Artificial Sequence
  Description of Artificial Sequence: Synthetic oligonucleotide
tttaaaacttggcttagaat

SEQ ID NO: 11143 - DNA, 20 bp, Artificial Sequence
  Description of Artificial Sequence: Synthetic oligonucleotide
atttaaaacttggcttagaa

SEQ ID NO: 11144 - DNA, 20 bp, Artificial Sequence
  Description of Artificial Sequence: Synthetic oligonucleotide
tatttaaaacttggcttaga

SEQ ID NO: 11145 - DNA, 20 bp, Artificial Sequence
  Description of Artificial Sequence: Synthetic oligonucleotide
atatttaaaacttggcttag

SEQ ID NO: 11146 - DNA, 20 bp, Artificial Sequence
  Description of Artificial Sequence: Synthetic oligonucleotide
aatatttaaaacttggctta

SEQ ID NO: 11147 - DNA, 20 bp, Artificial Sequence
  Description of Artificial Sequence: Synthetic oligonucleotide
taatatttaaaacttggctt

SEQ ID NO: 11148 - DNA, 20 bp, Artificial Sequence
  Description of Artificial Sequence: Synthetic oligonucleotide
ataatatttaaaacttggct

SEQ ID NO: 11149 - DNA, 20 bp, Artificial Sequence
  Description of Artificial Sequence: Synthetic oligonucleotide
gataatatttaaaacttggc

SEQ ID NO: 11150 - DNA, 20 bp, Artificial Sequence
  Description of Artificial Sequence: Synthetic oligonucleotide
agataatatttaaaacttgg

SEQ ID NO: 11151 - DNA, 20 bp, Artificial Sequence
  Description of Artificial Sequence: Synthetic oligonucleotide
tagataatatttaaaacttg

SEQ ID NO: 11152 - DNA, 20 bp, Artificial Sequence
  Description of Artificial Sequence: Synthetic oligonucleotide
ttagataatatttaaaactt

SEQ ID NO: 11153 - DNA, 20 bp, Artificial Sequence
  Description of Artificial Sequence: Synthetic oligonucleotide
gttagataatatttaaaact

SEQ ID NO: 11154 - DNA, 20 bp, Artificial Sequence
  Description of Artificial Sequence: Synthetic oligonucleotide
tgttagataatatttaaaac

SEQ ID NO: 11155 - DNA, 20 bp, Artificial Sequence
  Description of Artificial Sequence: Synthetic oligonucleotide
ctgttagataatatttaaaa

SEQ ID NO: 11156 - DNA, 20 bp, Artificial Sequence
  Description of Artificial Sequence: Synthetic oligonucleotide
tctgttagataatatttaaa

SEQ ID NO: 11157 - DNA, 20 bp, Artificial Sequence
  Description of Artificial Sequence: Synthetic oligonucleotide
gtctgttagataatatttaa

SEQ ID NO: 11158 - DNA, 20 bp, Artificial Sequence
  Description of Artificial Sequence: Synthetic oligonucleotide
tgtctgttagataatattta

SEQ ID NO: 11159 - DNA, 20 bp, Artificial Sequence
  Description of Artificial Sequence: Synthetic oligonucleotide
ttgtctgttagataatattt

SEQ ID NO: 11160 - DNA, 20 bp, Artificial Sequence
  Description of Artificial Sequence: Synthetic oligonucleotide
cttgtctgttagataatatt

SEQ ID NO: 11161 - DNA, 20 bp, Artificial Sequence
  Description of Artificial Sequence: Synthetic oligonucleotide
tcttgtctgttagataatat

SEQ ID NO: 11162 - DNA, 20 bp, Artificial Sequence
  Description of Artificial Sequence: Synthetic oligonucleotide
ctcttgtctgttagataata

SEQ ID NO: 11163 - DNA, 20 bp, Artificial Sequence
  Description of Artificial Sequence: Synthetic oligonucleotide
actcttgtctgttagataat

SEQ ID NO: 11164 - DNA, 20 bp, Artificial Sequence
  Description of Artificial Sequence: Synthetic oligonucleotide
cactcttgtctgttagataa

SEQ ID NO: 11165 - DNA, 20 bp, Artificial Sequence
  Description of Artificial Sequence: Synthetic oligonucleotide
ccactcttgtctgttagata

SEQ ID NO: 11166 - DNA, 20 bp, Artificial Sequence
  Description of Artificial Sequence: Synthetic oligonucleotide
accactcttgtctgttagat

SEQ ID NO: 11167 - DNA, 20 bp, Artificial Sequence
  Description of Artificial Sequence: Synthetic oligonucleotide
taccactcttgtctgttaga

SEQ ID NO: 11168 - DNA, 20 bp, Artificial Sequence
  Description of Artificial Sequence: Synthetic oligonucleotide
ataccactcttgtctgttag

SEQ ID NO: 11169 - DNA, 20 bp, Artificial Sequence
  Description of Artificial Sequence: Synthetic oligonucleotide
tataccactcttgtctgtta

SEQ ID NO: 11170 - DNA, 20 bp, Artificial Sequence
  Description of Artificial Sequence: Synthetic oligonucleotide
atataccactcttgtctgtt

SEQ ID NO: 11171 - DNA, 20 bp, Artificial Sequence
  Description of Artificial Sequence: Synthetic oligonucleotide
tatataccactcttgtctgt

SEQ ID NO: 11172 - DNA, 20 bp, Artificial Sequence
  Description of Artificial Sequence: Synthetic oligonucleotide
gtatataccactcttgtctg

SEQ ID NO: 11173 - DNA, 20 bp, Artificial Sequence
  Description of Artificial Sequence: Synthetic oligonucleotide
tgtatataccactcttgtct

SEQ ID NO: 11174 - DNA, 20 bp, Artificial Sequence
  Description of Artificial Sequence: Synthetic oligonucleotide
ttgtatataccactcttgtc

SEQ ID NO: 11175 - DNA, 20 bp, Artificial Sequence
  Description of Artificial Sequence: Synthetic oligonucleotide
cttgtatataccactcttgt

SEQ ID NO: 11176 - DNA, 20 bp, Artificial Sequence
  Description of Artificial Sequence: Synthetic oligonucleotide
acttgtatataccactcttg

SEQ ID NO: 11177 - DNA, 20 bp, Artificial Sequence
  Description of Artificial Sequence: Synthetic oligonucleotide
tacttgtatataccactctt

SEQ ID NO: 11178 - DNA, 20 bp, Artificial Sequence
  Description of Artificial Sequence: Synthetic oligonucleotide
ctacttgtatataccactct

SEQ ID NO: 11179 - DNA, 20 bp, Artificial Sequence
  Description of Artificial Sequence: Synthetic oligonucleotide
tctacttgtatataccactc

SEQ ID NO: 11180 - DNA, 20 bp, Artificial Sequence
  Description of Artificial Sequence: Synthetic oligonucleotide
atctacttgtatataccact

SEQ ID NO: 11181 - DNA, 20 bp, Artificial Sequence
  Description of Artificial Sequence: Synthetic oligonucleotide
gatctacttgtatataccac

SEQ ID NO: 11182 - DNA, 20 bp, Artificial Sequence
  Description of Artificial Sequence: Synthetic oligonucleotide
ggatctacttgtatatacca

SEQ ID NO: 11183 - DNA, 20 bp, Artificial Sequence
  Description of Artificial Sequence: Synthetic oligonucleotide
aggatctacttgtatatacc

SEQ ID NO: 11184 - DNA, 20 bp, Artificial Sequence
  Description of Artificial Sequence: Synthetic oligonucleotide
caggatctacttgtatatac

SEQ ID NO: 11185 - DNA, 20 bp, Artificial Sequence
  Description of Artificial Sequence: Synthetic oligonucleotide
tcaggatctacttgtatata

SEQ ID NO: 11186 - DNA, 20 bp, Artificial Sequence
  Description of Artificial Sequence: Synthetic oligonucleotide
ctcaggatctacttgtatat

SEQ ID NO: 11187 - DNA, 20 bp, Artificial Sequence
  Description of Artificial Sequence: Synthetic oligonucleotide
tctcaggatctacttgtata

SEQ ID NO: 11188 - DNA, 20 bp, Artificial Sequence
  Description of Artificial Sequence: Synthetic oligonucleotide
ttctcaggatctacttgtat

SEQ ID NO: 11189 - DNA, 20 bp, Artificial Sequence
  Description of Artificial Sequence: Synthetic oligonucleotide
cttctcaggatctacttgta

SEQ ID NO: 11190 - DNA, 20 bp, Artificial Sequence
  Description of Artificial Sequence: Synthetic oligonucleotide
acttctcaggatctacttgt

SEQ ID NO: 11191 - DNA, 20 bp, Artificial Sequence
  Description of Artificial Sequence: Synthetic oligonucleotide
tacttctcaggatctacttg

SEQ ID NO: 11192 - DNA, 20 bp, Artificial Sequence
  Description of Artificial Sequence: Synthetic oligonucleotide
gtacttctcaggatctactt

SEQ ID NO: 11193 - DNA, 20 bp, Artificial Sequence
  Description of Artificial Sequence: Synthetic oligonucleotide
ggtacttctcaggatctact

SEQ ID NO: 11194 - DNA, 20 bp, Artificial Sequence
  Description of Artificial Sequence: Synthetic oligonucleotide
aggtacttctcaggatctac

SEQ ID NO: 11195 - DNA, 20 bp, Artificial Sequence
  Description of Artificial Sequence: Synthetic oligonucleotide
aaggtacttctcaggatcta

SEQ ID NO: 11196 - DNA, 20 bp, Artificial Sequence
  Description of Artificial Sequence: Synthetic oligonucleotide
aaaggtacttctcaggatct

SEQ ID NO: 11197 - DNA, 20 bp, Artificial Sequence
  Description of Artificial Sequence: Synthetic oligonucleotide
caaaggtacttctcaggatc

SEQ ID NO: 11198 - DNA, 20 bp, Artificial Sequence
  Description of Artificial Sequence: Synthetic oligonucleotide
acaaaggtacttctcaggat

SEQ ID NO: 11199 - DNA, 20 bp, Artificial Sequence
  Description of Artificial Sequence: Synthetic oligonucleotide
aacaaaggtacttctcagga

SEQ ID NO: 11200 - DNA, 20 bp, Artificial Sequence
  Description of Artificial Sequence: Synthetic oligonucleotide
taacaaaggtacttctcagg

SEQ ID NO: 11201 - DNA, 20 bp, Artificial Sequence
  Description of Artificial Sequence: Synthetic oligonucleotide
gtaacaaaggtacttctcag

SEQ ID NO: 11202 - DNA, 20 bp, Artificial Sequence
  Description of Artificial Sequence: Synthetic oligonucleotide
tgtaacaaaggtacttctca

SEQ ID NO: 11203 - DNA, 20 bp, Artificial Sequence
  Description of Artificial Sequence: Synthetic oligonucleotide
ctgtaacaaaggtacttctc

SEQ ID NO: 11204 - DNA, 20 bp, Artificial Sequence
  Description of Artificial Sequence: Synthetic oligonucleotide
gctgtaacaaaggtacttct

SEQ ID NO: 11205 - DNA, 20 bp, Artificial Sequence
  Description of Artificial Sequence: Synthetic oligonucleotide
agctgtaacaaaggtacttc

SEQ ID NO: 11206 - DNA, 20 bp, Artificial Sequence
  Description of Artificial Sequence: Synthetic oligonucleotide
tagctgtaacaaaggtactt

SEQ ID NO: 11207 - DNA, 20 bp, Artificial Sequence
  Description of Artificial Sequence: Synthetic oligonucleotide
gtagctgtaacaaaggtact

SEQ ID NO: 11208 - DNA, 20 bp, Artificial Sequence
  Description of Artificial Sequence: Synthetic oligonucleotide
agtagctgtaacaaaggtac

SEQ ID NO: 11209 - DNA, 20 bp, Artificial Sequence
  Description of Artificial Sequence: Synthetic oligonucleotide
tagtagctgtaacaaaggta

SEQ ID NO: 11210 - DNA, 20 bp, Artificial Sequence
  Description of Artificial Sequence: Synthetic oligonucleotide
atagtagctgtaacaaaggt

SEQ ID NO: 11211 - DNA, 20 bp, Artificial Sequence
  Description of Artificial Sequence: Synthetic oligonucleotide
tatagtagctgtaacaaagg

SEQ ID NO: 11212 - DNA, 20 bp, Artificial Sequence
  Description of Artificial Sequence: Synthetic oligonucleotide
ttatagtagctgtaacaaag

SEQ ID NO: 11213 - DNA, 20 bp, Artificial Sequence
  Description of Artificial Sequence: Synthetic oligonucleotide
tttatagtagctgtaacaaa

SEQ ID NO: 11214 - DNA, 20 bp, Artificial Sequence
  Description of Artificial Sequence: Synthetic oligonucleotide
atttatagtagctgtaacaa

SEQ ID NO: 11215 - DNA, 20 bp, Artificial Sequence
  Description of Artificial Sequence: Synthetic oligonucleotide
tatttatagtagctgtaaca

SEQ ID NO: 11216 - DNA, 20 bp, Artificial Sequence
  Description of Artificial Sequence: Synthetic oligonucleotide
atatttatagtagctgtaac

SEQ ID NO: 11217 - DNA, 20 bp, Artificial Sequence
  Description of Artificial Sequence: Synthetic oligonucleotide
tatatttatagtagctgtaa

SEQ ID NO: 11218 - DNA, 20 bp, Artificial Sequence
  Description of Artificial Sequence: Synthetic oligonucleotide
gtatatttatagtagctgta

SEQ ID NO: 11219 - DNA, 20 bp, Artificial Sequence
  Description of Artificial Sequence: Synthetic oligonucleotide
tgtatatttatagtagctgt

SEQ ID NO: 11220 - DNA, 20 bp, Artificial Sequence
  Description of Artificial Sequence: Synthetic oligonucleotide
atgtatatttatagtagctg

SEQ ID NO: 11221 - DNA, 20 bp, Artificial Sequence
  Description of Artificial Sequence: Synthetic oligonucleotide
tatgtatatttatagtagct

SEQ ID NO: 11222 - DNA, 20 bp, Artificial Sequence
  Description of Artificial Sequence: Synthetic oligonucleotide
atatgtatatttatagtagc

SEQ ID NO: 11223 - DNA, 20 bp, Artificial Sequence
  Description of Artificial Sequence: Synthetic oligonucleotide
tatatgtatatttatagtag

SEQ ID NO: 11224 - DNA, 20 bp, Artificial Sequence
  Description of Artificial Sequence: Synthetic oligonucleotide
ttatatgtatatttatagta

SEQ ID NO: 11225 - DNA, 20 bp, Artificial Sequence
  Description of Artificial Sequence: Synthetic oligonucleotide
tttatatgtatatttatagt

SEQ ID NO: 11226 - DNA, 20 bp, Artificial Sequence
  Description of Artificial Sequence: Synthetic oligonucleotide
atttatatgtatatttatag

SEQ ID NO: 11227 - DNA, 20 bp, Artificial Sequence
  Description of Artificial Sequence: Synthetic oligonucleotide
aatttatatgtatatttata

SEQ ID NO: 11228 - DNA, 20 bp, Artificial Sequence
  Description of Artificial Sequence: Synthetic oligonucleotide
taatttatatgtatatttat

SEQ ID NO: 11229 - DNA, 20 bp, Artificial Sequence
  Description of Artificial Sequence: Synthetic oligonucleotide
ataatttatatgtatattta

SEQ ID NO: 11230 - DNA, 20 bp, Artificial Sequence
  Description of Artificial Sequence: Synthetic oligonucleotide
tataatttatatgtatattt

SEQ ID NO: 11231 - DNA, 20 bp, Artificial Sequence
  Description of Artificial Sequence: Synthetic oligonucleotide
ctataatttatatgtatatt

SEQ ID NO: 11232 - DNA, 20 bp, Artificial Sequence
  Description of Artificial Sequence: Synthetic oligonucleotide
tctataatttatatgtatat

SEQ ID NO: 11233 - DNA, 20 bp, Artificial Sequence
  Description of Artificial Sequence: Synthetic oligonucleotide
ttctataatttatatgtata

SEQ ID NO: 11234 - DNA, 20 bp, Artificial Sequence
  Description of Artificial Sequence: Synthetic oligonucleotide
attctataatttatatgtat

SEQ ID NO: 11235 - DNA, 20 bp, Artificial Sequence
  Description of Artificial Sequence: Synthetic oligonucleotide
gattctataatttatatgta

SEQ ID NO: 11236 - DNA, 20 bp, Artificial Sequence
  Description of Artificial Sequence: Synthetic oligonucleotide
agattctataatttatatgt

SEQ ID NO: 11237 - DNA, 20 bp, Artificial Sequence
  Description of Artificial Sequence: Synthetic oligonucleotide
tagattctataatttatatg

SEQ ID NO: 11238 - DNA, 20 bp, Artificial Sequence
  Description of Artificial Sequence: Synthetic oligonucleotide
gtagattctataatttatat

SEQ ID NO: 11239 - DNA, 20 bp, Artificial Sequence
  Description of Artificial Sequence: Synthetic oligonucleotide
agtagattctataatttata

SEQ ID NO: 11240 - DNA, 20 bp, Artificial Sequence
  Description of Artificial Sequence: Synthetic oligonucleotide
aagtagattctataatttat

SEQ ID NO: 11241 - DNA, 20 bp, Artificial Sequence
  Description of Artificial Sequence: Synthetic oligonucleotide
aaagtagattctataattta

SEQ ID NO: 11242 - DNA, 20 bp, Artificial Sequence
  Description of Artificial Sequence: Synthetic oligonucleotide
taaagtagattctataattt

SEQ ID NO: 11243 - DNA, 20 bp, Artificial Sequence
  Description of Artificial Sequence: Synthetic oligonucleotide
ttaaagtagattctataatt

SEQ ID NO: 11244 - DNA, 20 bp, Artificial Sequence
  Description of Artificial Sequence: Synthetic oligonucleotide
attaaagtagattctataat

SEQ ID NO: 11245 - DNA, 20 bp, Artificial Sequence
  Description of Artificial Sequence: Synthetic oligonucleotide
aattaaagtagattctataa

SEQ ID NO: 11246 - DNA, 20 bp, Artificial Sequence
  Description of Artificial Sequence: Synthetic oligonucleotide
aaattaaagtagattctata

SEQ ID NO: 11247 - DNA, 20 bp, Artificial Sequence
  Description of Artificial Sequence: Synthetic oligonucleotide
taaattaaagtagattctat

SEQ ID NO: 11248 - DNA, 20 bp, Artificial Sequence
  Description of Artificial Sequence: Synthetic oligonucleotide
ataaattaaagtagattcta

SEQ ID NO: 11249 - DNA, 20 bp, Artificial Sequence
  Description of Artificial Sequence: Synthetic oligonucleotide
aataaattaaagtagattct

SEQ ID NO: 11250 - DNA, 20 bp, Artificial Sequence
  Description of Artificial Sequence: Synthetic oligonucleotide
aaataaattaaagtagattc

SEQ ID NO: 11251 - DNA, 20 bp, Artificial Sequence
  Description of Artificial Sequence: Synthetic oligonucleotide
aaaataaattaaagtagatt

SEQ ID NO: 11252 - DNA, 20 bp, Artificial Sequence
  Description of Artificial Sequence: Synthetic oligonucleotide
caaaataaattaaagtagat

SEQ ID NO: 11253 - DNA, 20 bp, Artificial Sequence
  Description of Artificial Sequence: Synthetic oligonucleotide
acaaaataaattaaagtaga

SEQ ID NO: 11254 - DNA, 20 bp, Artificial Sequence
  Description of Artificial Sequence: Synthetic oligonucleotide
cacaaaataaattaaagtag

SEQ ID NO: 11255 - DNA, 20 bp, Artificial Sequence
  Description of Artificial Sequence: Synthetic oligonucleotide
tcacaaaataaattaaagta

SEQ ID NO: 11256 - DNA, 20 bp, Artificial Sequence
  Description of Artificial Sequence: Synthetic oligonucleotide
ttcacaaaataaattaaagt

SEQ ID NO: 11257 - DNA, 20 bp, Artificial Sequence
  Description of Artificial Sequence: Synthetic oligonucleotide
gttcacaaaataaattaaag

SEQ ID NO: 11258 - DNA, 20 bp, Artificial Sequence
  Description of Artificial Sequence: Synthetic oligonucleotide
tgttcacaaaataaattaaa

SEQ ID NO: 11259 - DNA, 20 bp, Artificial Sequence
  Description of Artificial Sequence: Synthetic oligonucleotide
gtgttcacaaaataaattaa

SEQ ID NO: 11260 - DNA, 20 bp, Artificial Sequence
  Description of Artificial Sequence: Synthetic oligonucleotide
agtgttcacaaaataaatta

SEQ ID NO: 11261 - DNA, 20 bp, Artificial Sequence
  Description of Artificial Sequence: Synthetic oligonucleotide
aagtgttcacaaaataaatt

SEQ ID NO: 11262 - DNA, 20 bp, Artificial Sequence
  Description of Artificial Sequence: Synthetic oligonucleotide
aaagtgttcacaaaataaat

SEQ ID NO: 11263 - DNA, 20 bp, Artificial Sequence
  Description of Artificial Sequence: Synthetic oligonucleotide
aaaagtgttcacaaaataaa

SEQ ID NO: 11264 - DNA, 20 bp, Artificial Sequence
  Description of Artificial Sequence: Synthetic oligonucleotide
caaaagtgttcacaaaataa

SEQ ID NO: 11265 - DNA, 20 bp, Artificial Sequence
  Description of Artificial Sequence: Synthetic oligonucleotide
tcaaaagtgttcacaaaata

SEQ ID NO: 11266 - DNA, 20 bp, Artificial Sequence
  Description of Artificial Sequence: Synthetic oligonucleotide
ttcaaaagtgttcacaaaat

SEQ ID NO: 11267 - DNA, 20 bp, Artificial Sequence
  Description of Artificial Sequence: Synthetic oligonucleotide
tttcaaaagtgttcacaaaa

SEQ ID NO: 11268 - DNA, 20 bp, Artificial Sequence
  Description of Artificial Sequence: Synthetic oligonucleotide
ttttcaaaagtgttcacaaa

SEQ ID NO: 11269 - DNA, 20 bp, Artificial Sequence
  Description of Artificial Sequence: Synthetic oligonucleotide
attttcaaaagtgttcacaa

SEQ ID NO: 11270 - DNA, 20 bp, Artificial Sequence
  Description of Artificial Sequence: Synthetic oligonucleotide
cattttcaaaagtgttcaca

SEQ ID NO: 11271 - DNA, 20 bp, Artificial Sequence
  Description of Artificial Sequence: Synthetic oligonucleotide
acattttcaaaagtgttcac

SEQ ID NO: 11272 - DNA, 20 bp, Artificial Sequence
  Description of Artificial Sequence: Synthetic oligonucleotide
tacattttcaaaagtgttca

SEQ ID NO: 11273 - DNA, 20 bp, Artificial Sequence
  Description of Artificial Sequence: Synthetic oligonucleotide
gtacattttcaaaagtgttc

SEQ ID NO: 11274 - DNA, 20 bp, Artificial Sequence
  Description of Artificial Sequence: Synthetic oligonucleotide
tgtacattttcaaaagtgtt

SEQ ID NO: 11275 - DNA, 20 bp, Artificial Sequence
  Description of Artificial Sequence: Synthetic oligonucleotide
atgtacattttcaaaagtgt

SEQ ID NO: 11276 - DNA, 20 bp, Artificial Sequence
  Description of Artificial Sequence: Synthetic oligonucleotide
catgtacattttcaaaagtg

SEQ ID NO: 11277 - DNA, 20 bp, Artificial Sequence
  Description of Artificial Sequence: Synthetic oligonucleotide
acatgtacattttcaaaagt

SEQ ID NO: 11278 - DNA, 20 bp, Artificial Sequence
  Description of Artificial Sequence: Synthetic oligonucleotide
aacatgtacattttcaaaag

SEQ ID NO: 11279 - DNA, 20 bp, Artificial Sequence
  Description of Artificial Sequence: Synthetic oligonucleotide
gaacatgtacattttcaaaa

SEQ ID NO: 11280 - DNA, 20 bp, Artificial Sequence
  Description of Artificial Sequence: Synthetic oligonucleotide
ggaacatgtacattttcaaa

SEQ ID NO: 11281 - DNA, 20 bp, Artificial Sequence
  Description of Artificial Sequence: Synthetic oligonucleotide
aggaacatgtacattttcaa

SEQ ID NO: 11282 - DNA, 20 bp, Artificial Sequence
  Description of Artificial Sequence: Synthetic oligonucleotide
aaggaacatgtacattttca

SEQ ID NO: 11283 - DNA, 20 bp, Artificial Sequence
  Description of Artificial Sequence: Synthetic oligonucleotide
aaaggaacatgtacattttc

SEQ ID NO: 11284 - DNA, 20 bp, Artificial Sequence
  Description of Artificial Sequence: Synthetic oligonucleotide
caaaggaacatgtacatttt

SEQ ID NO: 11285 - DNA, 20 bp, Artificial Sequence
  Description of Artificial Sequence: Synthetic oligonucleotide
acaaaggaacatgtacattt

SEQ ID NO: 11286 - DNA, 20 bp, Artificial Sequence
  Description of Artificial Sequence: Synthetic oligonucleotide
tacaaaggaacatgtacatt

SEQ ID NO: 11287 - DNA, 20 bp, Artificial Sequence
  Description of Artificial Sequence: Synthetic oligonucleotide
ttacaaaggaacatgtacat

SEQ ID NO: 11288 - DNA, 20 bp, Artificial Sequence
  Description of Artificial Sequence: Synthetic oligonucleotide
attacaaaggaacatgtaca

SEQ ID NO: 11289 - DNA, 20 bp, Artificial Sequence
  Description of Artificial Sequence: Synthetic oligonucleotide
aattacaaaggaacatgtac

SEQ ID NO: 11290 - DNA, 20 bp, Artificial Sequence
  Description of Artificial Sequence: Synthetic oligonucleotide
caattacaaaggaacatgta

SEQ ID NO: 11291 - DNA, 20 bp, Artificial Sequence
  Description of Artificial Sequence: Synthetic oligonucleotide
tcaattacaaaggaacatgt

SEQ ID NO: 11292 - DNA, 20 bp, Artificial Sequence
  Description of Artificial Sequence: Synthetic oligonucleotide
gtcaattacaaaggaacatg

SEQ ID NO: 11293 - DNA, 20 bp, Artificial Sequence
  Description of Artificial Sequence: Synthetic oligonucleotide
tgtcaattacaaaggaacat

SEQ ID NO: 11294 - DNA, 20 bp, Artificial Sequence
  Description of Artificial Sequence: Synthetic oligonucleotide
gtgtcaattacaaaggaaca

SEQ ID NO: 11295 - DNA, 20 bp, Artificial Sequence
  Description of Artificial Sequence: Synthetic oligonucleotide
agtgtcaattacaaaggaac

SEQ ID NO: 11296 - DNA, 20 bp, Artificial Sequence
  Description of Artificial Sequence: Synthetic oligonucleotide
tagtgtcaattacaaaggaa

SEQ ID NO: 11297 - DNA, 20 bp, Artificial Sequence
  Description of Artificial Sequence: Synthetic oligonucleotide
atagtgtcaattacaaagga

SEQ ID NO: 11298 - DNA, 20 bp, Artificial Sequence
  Description of Artificial Sequence: Synthetic oligonucleotide
tatagtgtcaattacaaagg

SEQ ID NO: 11299 - DNA, 20 bp, Artificial Sequence
  Description of Artificial Sequence: Synthetic oligonucleotide
atatagtgtcaattacaaag

SEQ ID NO: 11300 - DNA, 20 bp, Artificial Sequence
  Description of Artificial Sequence: Synthetic oligonucleotide
tatatagtgtcaattacaaa

SEQ ID NO: 11301 - DNA, 20 bp, Artificial Sequence
  Description of Artificial Sequence: Synthetic oligonucleotide
atatatagtgtcaattacaa

SEQ ID NO: 11302 - DNA, 20 bp, Artificial Sequence
  Description of Artificial Sequence: Synthetic oligonucleotide
aatatatagtgtcaattaca

SEQ ID NO: 11303 - DNA, 20 bp, Artificial Sequence
  Description of Artificial Sequence: Synthetic oligonucleotide
aaatatatagtgtcaattac

SEQ ID NO: 11304 - DNA, 20 bp, Artificial Sequence
  Description of Artificial Sequence: Synthetic oligonucleotide
gaaatatatagtgtcaatta

SEQ ID NO: 11305 - DNA, 20 bp, Artificial Sequence
  Description of Artificial Sequence: Synthetic oligonucleotide
agaaatatatagtgtcaatt

SEQ ID NO: 11306 - DNA, 20 bp, Artificial Sequence
  Description of Artificial Sequence: Synthetic oligonucleotide
aagaaatatatagtgtcaat

SEQ ID NO: 11307 - DNA, 20 bp, Artificial Sequence
  Description of Artificial Sequence: Synthetic oligonucleotide
taagaaatatatagtgtcaa

SEQ ID NO: 11308 - DNA, 20 bp, Artificial Sequence
  Description of Artificial Sequence: Synthetic oligonucleotide
ttaagaaatatatagtgtca

SEQ ID NO: 11309 - DNA, 20 bp, Artificial Sequence
  Description of Artificial Sequence: Synthetic oligonucleotide
attaagaaatatatagtgtc

SEQ ID NO: 11310 - DNA, 20 bp, Artificial Sequence
  Description of Artificial Sequence: Synthetic oligonucleotide
tattaagaaatatatagtgt

SEQ ID NO: 11311 - DNA, 20 bp, Artificial Sequence
  Description of Artificial Sequence: Synthetic oligonucleotide
ttattaagaaatatatagtg

SEQ ID NO: 11312 - DNA, 20 bp, Artificial Sequence
  Description of Artificial Sequence: Synthetic oligonucleotide
tttattaagaaatatatagt

SEQ ID NO: 11313 - DNA, 20 bp, Artificial Sequence
  Description of Artificial Sequence: Synthetic oligonucleotide
ttttattaagaaatatatag

SEQ ID NO: 11314 - DNA, 20 bp, Artificial Sequence
  Description of Artificial Sequence: Synthetic oligonucleotide
attttattaagaaatatata

SEQ ID NO: 11315 - DNA, 20 bp, Artificial Sequence
  Description of Artificial Sequence: Synthetic oligonucleotide
tattttattaagaaatatat

SEQ ID NO: 11316 - DNA, 20 bp, Artificial Sequence
  Description of Artificial Sequence: Synthetic oligonucleotide
ttattttattaagaaatata

SEQ ID NO: 11317 - DNA, 20 bp, Artificial Sequence
  Description of Artificial Sequence: Synthetic oligonucleotide
attattttattaagaaatat

SEQ ID NO: 11318 - DNA, 20 bp, Artificial Sequence
  Description of Artificial Sequence: Synthetic oligonucleotide
aattattttattaagaaata

SEQ ID NO: 11319 - DNA, 20 bp, Artificial Sequence
  Description of Artificial Sequence: Synthetic oligonucleotide
gaattattttattaagaaat

SEQ ID NO: 11320 - DNA, 20 bp, Artificial Sequence
  Description of Artificial Sequence: Synthetic oligonucleotide
agaattattttattaagaaa

SEQ ID NO: 11321 - DNA, 20 bp, Artificial Sequence
  Description of Artificial Sequence: Synthetic oligonucleotide
gagaattattttattaagaa

SEQ ID NO: 11322 - DNA, 20 bp, Artificial Sequence
  Description of Artificial Sequence: Synthetic oligonucleotide
tgagaattattttattaaga

SEQ ID NO: 11323 - DNA, 20 bp, Artificial Sequence
  Description of Artificial Sequence: Synthetic oligonucleotide
ttgagaattattttattaag

SEQ ID NO: 11324 - DNA, 20 bp, Artificial Sequence
  Description of Artificial Sequence: Synthetic oligonucleotide
tttgagaattattttattaa

SEQ ID NO: 11325 - DNA, 20 bp, Artificial Sequence
  Description of Artificial Sequence: Synthetic oligonucleotide
atttgagaattattttatta

SEQ ID NO: 11326 - DNA, 20 bp, Artificial Sequence
  Description of Artificial Sequence: Synthetic oligonucleotide
aatttgagaattattttatt

SEQ ID NO: 11327 - DNA, 20 bp, Artificial Sequence
  Description of Artificial Sequence: Synthetic oligonucleotide
aaatttgagaattattttat

SEQ ID NO: 11328 - DNA, 20 bp, Artificial Sequence
  Description of Artificial Sequence: Synthetic oligonucleotide
caaatttgagaattatttta

SEQ ID NO: 11329 - DNA, 20 bp, Artificial Sequence
  Description of Artificial Sequence: Synthetic oligonucleotide
acaaatttgagaattatttt

SEQ ID NO: 11330 - DNA, 20 bp, Artificial Sequence
  Description of Artificial Sequence: Synthetic oligonucleotide
aacaaatttgagaattattt

SEQ ID NO: 11331 - DNA, 20 bp, Artificial Sequence
  Description of Artificial Sequence: Synthetic oligonucleotide
aaacaaatttgagaattatt

SEQ ID NO: 11332 - DNA, 20 bp, Artificial Sequence
  Description of Artificial Sequence: Synthetic oligonucleotide
gaaacaaatttgagaattat

SEQ ID NO: 11333 - DNA, 20 bp, Artificial Sequence
  Description of Artificial Sequence: Synthetic oligonucleotide
agaaacaaatttgagaatta

SEQ ID NO: 11334 - DNA, 20 bp, Artificial Sequence
  Description of Artificial Sequence: Synthetic oligonucleotide
aagaaacaaatttgagaatt

SEQ ID NO: 11335 - DNA, 20 bp, Artificial Sequence
  Description of Artificial Sequence: Synthetic oligonucleotide
taagaaacaaatttgagaat

SEQ ID NO: 11336 - DNA, 20 bp, Artificial Sequence
  Description of Artificial Sequence: Synthetic oligonucleotide
ataagaaacaaatttgagaa

SEQ ID NO: 11337 - DNA, 20 bp, Artificial Sequence
  Description of Artificial Sequence: Synthetic oligonucleotide
cataagaaacaaatttgaga

SEQ ID NO: 11338 - DNA, 20 bp, Artificial Sequence
  Description of Artificial Sequence: Synthetic oligonucleotide
tcataagaaacaaatttgag

SEQ ID NO: 11339 - DNA, 20 bp, Artificial Sequence
  Description of Artificial Sequence: Synthetic oligonucleotide
ttcataagaaacaaatttga

SEQ ID NO: 11340 - DNA, 20 bp, Artificial Sequence
  Description of Artificial Sequence: Synthetic oligonucleotide
attcataagaaacaaatttg

SEQ ID NO: 11341 - DNA, 20 bp, Artificial Sequence
  Description of Artificial Sequence: Synthetic oligonucleotide
gattcataagaaacaaattt

SEQ ID NO: 11342 - DNA, 20 bp, Artificial Sequence
  Description of Artificial Sequence: Synthetic oligonucleotide
tgattcataagaaacaaatt

SEQ ID NO: 11343 - DNA, 20 bp, Artificial Sequence
  Description of Artificial Sequence: Synthetic oligonucleotide
atgattcataagaaacaaat

SEQ ID NO: 11344 - DNA, 20 bp, Artificial Sequence
  Description of Artificial Sequence: Synthetic oligonucleotide
gatgattcataagaaacaaa

SEQ ID NO: 11345 - DNA, 20 bp, Artificial Sequence
  Description of Artificial Sequence: Synthetic oligonucleotide
agatgattcataagaaacaa

SEQ ID NO: 11346 - DNA, 20 bp, Artificial Sequence
  Description of Artificial Sequence: Synthetic oligonucleotide
gagatgattcataagaaaca

SEQ ID NO: 11347 - DNA, 20 bp, Artificial Sequence
  Description of Artificial Sequence: Synthetic oligonucleotide
agagatgattcataagaaac

SEQ ID NO: 11348 - DNA, 20 bp, Artificial Sequence
  Description of Artificial Sequence: Synthetic oligonucleotide
gagagatgattcataagaaa

SEQ ID NO: 11349 - DNA, 20 bp, Artificial Sequence
  Description of Artificial Sequence: Synthetic oligonucleotide
tgagagatgattcataagaa

SEQ ID NO: 11350 - DNA, 20 bp, Artificial Sequence
  Description of Artificial Sequence: Synthetic oligonucleotide
ttgagagatgattcataaga

SEQ ID NO: 11351 - DNA, 20 bp, Artificial Sequence
  Description of Artificial Sequence: Synthetic oligonucleotide
tttgagagatgattcataag

SEQ ID NO: 11352 - DNA, 20 bp, Artificial Sequence
  Description of Artificial Sequence: Synthetic oligonucleotide
atttgagagatgattcataa

SEQ ID NO: 11353 - DNA, 20 bp, Artificial Sequence
  Description of Artificial Sequence: Synthetic oligonucleotide
gatttgagagatgattcata

SEQ ID NO: 11354 - DNA, 20 bp, Artificial Sequence
  Description of Artificial Sequence: Synthetic oligonucleotide
agatttgagagatgattcat

SEQ ID NO: 11355 - DNA, 20 bp, Artificial Sequence
  Description of Artificial Sequence: Synthetic oligonucleotide
tagatttgagagatgattca

SEQ ID NO: 11356 - DNA, 20 bp, Artificial Sequence
  Description of Artificial Sequence: Synthetic oligonucleotide
ctagatttgagagatgattc

SEQ ID NO: 11357 - DNA, 20 bp, Artificial Sequence
  Description of Artificial Sequence: Synthetic oligonucleotide
actagatttgagagatgatt

SEQ ID NO: 11358 - DNA, 20 bp, Artificial Sequence
  Description of Artificial Sequence: Synthetic oligonucleotide
aactagatttgagagatgat

SEQ ID NO: 11359 - DNA, 20 bp, Artificial Sequence
  Description of Artificial Sequence: Synthetic oligonucleotide
taactagatttgagagatga

SEQ ID NO: 11360 - DNA, 20 bp, Artificial Sequence
  Description of Artificial Sequence: Synthetic oligonucleotide
ctaactagatttgagagatg

SEQ ID NO: 11361 - DNA, 20 bp, Artificial Sequence
  Description of Artificial Sequence: Synthetic oligonucleotide
tctaactagatttgagagat

SEQ ID NO: 11362 - DNA, 20 bp, Artificial Sequence
  Description of Artificial Sequence: Synthetic oligonucleotide
gtctaactagatttgagaga

SEQ ID NO: 11363 - DNA, 20 bp, Artificial Sequence
  Description of Artificial Sequence: Synthetic oligonucleotide
tgtctaactagatttgagag

SEQ ID NO: 11364 - DNA, 20 bp, Artificial Sequence
  Description of Artificial Sequence: Synthetic oligonucleotide
ttgtctaactagatttgaga

SEQ ID NO: 11365 - DNA, 20 bp, Artificial Sequence
  Description of Artificial Sequence: Synthetic oligonucleotide
attgtctaactagatttgag

SEQ ID NO: 11366 - DNA, 20 bp, Artificial Sequence
  Description of Artificial Sequence: Synthetic oligonucleotide
aattgtctaactagatttga

SEQ ID NO: 11367 - DNA, 20 bp, Artificial Sequence
  Description of Artificial Sequence: Synthetic oligonucleotide
aaattgtctaactagatttg

SEQ ID NO: 11368 - DNA, 20 bp, Artificial Sequence
  Description of Artificial Sequence: Synthetic oligonucleotide
caaattgtctaactagattt

SEQ ID NO: 11369 - DNA, 20 bp, Artificial Sequence
  Description of Artificial Sequence: Synthetic oligonucleotide
gcaaattgtctaactagatt

SEQ ID NO: 11370 - DNA, 20 bp, Artificial Sequence
  Description of Artificial Sequence: Synthetic oligonucleotide
tgcaaattgtctaactagat

SEQ ID NO: 11371 - DNA, 20 bp, Artificial Sequence
  Description of Artificial Sequence: Synthetic oligonucleotide
gtgcaaattgtctaactaga

SEQ ID NO: 11372 - DNA, 20 bp, Artificial Sequence
  Description of Artificial Sequence: Synthetic oligonucleotide
tgtgcaaattgtctaactag

SEQ ID NO: 11373 - DNA, 20 bp, Artificial Sequence
  Description of Artificial Sequence: Synthetic oligonucleotide
gtgtgcaaattgtctaacta

SEQ ID NO: 11374 - DNA, 20 bp, Artificial Sequence
  Description of Artificial Sequence: Synthetic oligonucleotide
tgtgtgcaaattgtctaact

SEQ ID NO: 11375 - DNA, 20 bp, Artificial Sequence
  Description of Artificial Sequence: Synthetic oligonucleotide
atgtgtgcaaattgtctaac

SEQ ID NO: 11376 - DNA, 20 bp, Artificial Sequence
  Description of Artificial Sequence: Synthetic oligonucleotide
tatgtgtgcaaattgtctaa

SEQ ID NO: 11377 - DNA, 20 bp, Artificial Sequence
  Description of Artificial Sequence: Synthetic oligonucleotide
gtatgtgtgcaaattgtcta

SEQ ID NO: 11378 - DNA, 20 bp, Artificial Sequence
  Description of Artificial Sequence: Synthetic oligonucleotide
agtatgtgtgcaaattgtct

SEQ ID NO: 11379 - DNA, 20 bp, Artificial Sequence
  Description of Artificial Sequence: Synthetic oligonucleotide
aagtatgtgtgcaaattgtc

SEQ ID NO: 11380 - DNA, 20 bp, Artificial Sequence
  Description of Artificial Sequence: Synthetic oligonucleotide
aaagtatgtgtgcaaattgt

SEQ ID NO: 11381 - DNA, 20 bp, Artificial Sequence
  Description of Artificial Sequence: Synthetic oligonucleotide
aaaagtatgtgtgcaaattg

SEQ ID NO: 11382 - DNA, 20 bp, Artificial Sequence
  Description of Artificial Sequence: Synthetic oligonucleotide
gaaaagtatgtgtgcaaatt

SEQ ID NO: 11383 - DNA, 20 bp, Artificial Sequence
  Description of Artificial Sequence: Synthetic oligonucleotide
agaaaagtatgtgtgcaaat

SEQ ID NO: 11384 - DNA, 20 bp, Artificial Sequence
  Description of Artificial Sequence: Synthetic oligonucleotide
tagaaaagtatgtgtgcaaa

SEQ ID NO: 11385 - DNA, 20 bp, Artificial Sequence
  Description of Artificial Sequence: Synthetic oligonucleotide
ttagaaaagtatgtgtgcaa

SEQ ID NO: 11386 - DNA, 20 bp, Artificial Sequence
  Description of Artificial Sequence: Synthetic oligonucleotide
cttagaaaagtatgtgtgca

SEQ ID NO: 11387 - DNA, 20 bp, Artificial Sequence
  Description of Artificial Sequence: Synthetic oligonucleotide
ccttagaaaagtatgtgtgc

SEQ ID NO: 11388 - DNA, 20 bp, Artificial Sequence
  Description of Artificial Sequence: Synthetic oligonucleotide
cccttagaaaagtatgtgtg

SEQ ID NO: 11389 - DNA, 20 bp, Artificial Sequence
  Description of Artificial Sequence: Synthetic oligonucleotide
tcccttagaaaagtatgtgt

SEQ ID NO: 11390 - DNA, 20 bp, Artificial Sequence
  Description of Artificial Sequence: Synthetic oligonucleotide
gtcccttagaaaagtatgtg

SEQ ID NO: 11391 - DNA, 20 bp, Artificial Sequence
  Description of Artificial Sequence: Synthetic oligonucleotide
tgtcccttagaaaagtatgt

SEQ ID NO: 11392 - DNA, 20 bp, Artificial Sequence
  Description of Artificial Sequence: Synthetic oligonucleotide
atgtcccttagaaaagtatg

SEQ ID NO: 11393 - DNA, 20 bp, Artificial Sequence
  Description of Artificial Sequence: Synthetic oligonucleotide
aatgtcccttagaaaagtat

SEQ ID NO: 11394 - DNA, 20 bp, Artificial Sequence
  Description of Artificial Sequence: Synthetic oligonucleotide
taatgtcccttagaaaagta

SEQ ID NO: 11395 - DNA, 20 bp, Artificial Sequence
  Description of Artificial Sequence: Synthetic oligonucleotide
ataatgtcccttagaaaagt

SEQ ID NO: 11396 - DNA, 20 bp, Artificial Sequence
  Description of Artificial Sequence: Synthetic oligonucleotide
gataatgtcccttagaaaag

SEQ ID NO: 11397 - DNA, 20 bp, Artificial Sequence
  Description of Artificial Sequence: Synthetic oligonucleotide
agataatgtcccttagaaaa

SEQ ID NO: 11398 - DNA, 20 bp, Artificial Sequence
  Description of Artificial Sequence: Synthetic oligonucleotide
aagataatgtcccttagaaa

SEQ ID NO: 11399 - DNA, 20 bp, Artificial Sequence
  Description of Artificial Sequence: Synthetic oligonucleotide
gaagataatgtcccttagaa

SEQ ID NO: 11400 - DNA, 20 bp, Artificial Sequence
  Description of Artificial Sequence: Synthetic oligonucleotide
ggaagataatgtcccttaga

SEQ ID NO: 11401 - DNA, 20 bp, Artificial Sequence
  Description of Artificial Sequence: Synthetic oligonucleotide
aggaagataatgtcccttag

SEQ ID NO: 11402 - DNA, 20 bp, Artificial Sequence
  Description of Artificial Sequence: Synthetic oligonucleotide
aaggaagataatgtccctta

SEQ ID NO: 11403 - DNA, 20 bp, Artificial Sequence
  Description of Artificial Sequence: Synthetic oligonucleotide
gaaggaagataatgtccctt

SEQ ID NO: 11404 - DNA, 20 bp, Artificial Sequence
  Description of Artificial Sequence: Synthetic oligonucleotide
tgaaggaagataatgtccct

SEQ ID NO: 11405 - DNA, 20 bp, Artificial Sequence
  Description of Artificial Sequence: Synthetic oligonucleotide
ctgaaggaagataatgtccc

SEQ ID NO: 11406 - DNA, 20 bp, Artificial Sequence
  Description of Artificial Sequence: Synthetic oligonucleotide
cctgaaggaagataatgtcc

SEQ ID NO: 11407 - DNA, 20 bp, Artificial Sequence
  Description of Artificial Sequence: Synthetic oligonucleotide
acctgaaggaagataatgtc

SEQ ID NO: 11408 - DNA, 20 bp, Artificial Sequence
  Description of Artificial Sequence: Synthetic oligonucleotide
aacctgaaggaagataatgt

SEQ ID NO: 11409 - DNA, 20 bp, Artificial Sequence
  Description of Artificial Sequence: Synthetic oligonucleotide
aaacctgaaggaagataatg

SEQ ID NO: 11410 - DNA, 20 bp, Artificial Sequence
  Description of Artificial Sequence: Synthetic oligonucleotide
aaaacctgaaggaagataat

SEQ ID NO: 11411 - DNA, 20 bp, Artificial Sequence
  Description of Artificial Sequence: Synthetic oligonucleotide
aaaaacctgaaggaagataa

SEQ ID NO: 11412 - DNA, 20 bp, Artificial Sequence
  Description of Artificial Sequence: Synthetic oligonucleotide
taaaaacctgaaggaagata

SEQ ID NO: 11413 - DNA, 20 bp, Artificial Sequence
  Description of Artificial Sequence: Synthetic oligonucleotide
gtaaaaacctgaaggaagat

SEQ ID NO: 11414 - DNA, 20 bp, Artificial Sequence
  Description of Artificial Sequence: Synthetic oligonucleotide
ggtaaaaacctgaaggaaga

SEQ ID NO: 11415 - DNA, 20 bp, Artificial Sequence
  Description of Artificial Sequence: Synthetic oligonucleotide
aggtaaaaacctgaaggaag

SEQ ID NO: 11416 - DNA, 20 bp, Artificial Sequence
  Description of Artificial Sequence: Synthetic oligonucleotide
gaggtaaaaacctgaaggaa

SEQ ID NO: 11417 - DNA, 20 bp, Artificial Sequence
  Description of Artificial Sequence: Synthetic oligonucleotide
ggaggtaaaaacctgaagga

SEQ ID NO: 11418 - DNA, 20 bp, Artificial Sequence
  Description of Artificial Sequence: Synthetic oligonucleotide
tggaggtaaaaacctgaagg

SEQ ID NO: 11419 - DNA, 20 bp, Artificial Sequence
  Description of Artificial Sequence: Synthetic oligonucleotide
gtggaggtaaaaacctgaag

SEQ ID NO: 11420 - DNA, 20 bp, Artificial Sequence
  Description of Artificial Sequence: Synthetic oligonucleotide
agtggaggtaaaaacctgaa

SEQ ID NO: 11421 - DNA, 20 bp, Artificial Sequence
  Description of Artificial Sequence: Synthetic oligonucleotide
gagtggaggtaaaaacctga

SEQ ID NO: 11422 - DNA, 20 bp, Artificial Sequence
  Description of Artificial Sequence: Synthetic oligonucleotide
tgagtggaggtaaaaacctg

SEQ ID NO: 11423 - DNA, 20 bp, Artificial Sequence
  Description of Artificial Sequence: Synthetic oligonucleotide
atgagtggaggtaaaaacct

SEQ ID NO: 11424 - DNA, 20 bp, Artificial Sequence
  Description of Artificial Sequence: Synthetic oligonucleotide
gatgagtggaggtaaaaacc

SEQ ID NO: 11425 - DNA, 20 bp, Artificial Sequence
  Description of Artificial Sequence: Synthetic oligonucleotide
ggatgagtggaggtaaaaac

SEQ ID NO: 11426 - DNA, 20 bp, Artificial Sequence
  Description of Artificial Sequence: Synthetic oligonucleotide
aggatgagtggaggtaaaaa

SEQ ID NO: 11427 - DNA, 20 bp, Artificial Sequence
  Description of Artificial Sequence: Synthetic oligonucleotide
aaggatgagtggaggtaaaa

SEQ ID NO: 11428 - DNA, 20 bp, Artificial Sequence
  Description of Artificial Sequence: Synthetic oligonucleotide
taaggatgagtggaggtaaa

SEQ ID NO: 11429 - DNA, 20 bp, Artificial Sequence
  Description of Artificial Sequence: Synthetic oligonucleotide
ctaaggatgagtggaggtaa

SEQ ID NO: 11430 - DNA, 20 bp, Artificial Sequence
  Description of Artificial Sequence: Synthetic oligonucleotide
tctaaggatgagtggaggta

SEQ ID NO: 11431 - DNA, 20 bp, Artificial Sequence
  Description of Artificial Sequence: Synthetic oligonucleotide
ctctaaggatgagtggaggt

SEQ ID NO: 11432 - DNA, 20 bp, Artificial Sequence
  Description of Artificial Sequence: Synthetic oligonucleotide
gctctaaggatgagtggagg

SEQ ID NO: 11433 - DNA, 20 bp, Artificial Sequence
  Description of Artificial Sequence: Synthetic oligonucleotide
ggctctaaggatgagtggag

SEQ ID NO: 11434 - DNA, 20 bp, Artificial Sequence
  Description of Artificial Sequence: Synthetic oligonucleotide
gggctctaaggatgagtgga

SEQ ID NO: 11435 - DNA, 20 bp, Artificial Sequence
  Description of Artificial Sequence: Synthetic oligonucleotide
tgggctctaaggatgagtgg

SEQ ID NO: 11436 - DNA, 20 bp, Artificial Sequence
  Description of Artificial Sequence: Synthetic oligonucleotide
gtgggctctaaggatgagtg

SEQ ID NO: 11437 - DNA, 20 bp, Artificial Sequence
  Description of Artificial Sequence: Synthetic oligonucleotide
agtgggctctaaggatgagt

SEQ ID NO: 11438 - DNA, 20 bp, Artificial Sequence
  Description of Artificial Sequence: Synthetic oligonucleotide
cagtgggctctaaggatgag

SEQ ID NO: 11439 - DNA, 20 bp, Artificial Sequence
  Description of Artificial Sequence: Synthetic oligonucleotide
tcagtgggctctaaggatga

SEQ ID NO: 11440 - DNA, 20 bp, Artificial Sequence
  Description of Artificial Sequence: Synthetic oligonucleotide
gtcagtgggctctaaggatg

SEQ ID NO: 11441 - DNA, 20 bp, Artificial Sequence
  Description of Artificial Sequence: Synthetic oligonucleotide
agtcagtgggctctaaggat

SEQ ID NO: 11442 - DNA, 20 bp, Artificial Sequence
  Description of Artificial Sequence: Synthetic oligonucleotide
cagtcagtgggctctaagga

SEQ ID NO: 11443 - DNA, 20 bp, Artificial Sequence
  Description of Artificial Sequence: Synthetic oligonucleotide
gcagtcagtgggctctaagg

SEQ ID NO: 11444 - DNA, 20 bp, Artificial Sequence
  Description of Artificial Sequence: Synthetic oligonucleotide
agcagtcagtgggctctaag

SEQ ID NO: 11445 - DNA, 20 bp, Artificial Sequence
  Description of Artificial Sequence: Synthetic oligonucleotide
gagcagtcagtgggctctaa

SEQ ID NO: 11446 - DNA, 20 bp, Artificial Sequence
  Description of Artificial Sequence: Synthetic oligonucleotide
ggagcagtcagtgggctcta

SEQ ID NO: 11447 - DNA, 20 bp, Artificial Sequence
  Description of Artificial Sequence: Synthetic oligonucleotide
gggagcagtcagtgggctct

SEQ ID NO: 11448 - DNA, 20 bp, Artificial Sequence
  Description of Artificial Sequence: Synthetic oligonucleotide
ggggagcagtcagtgggctc

SEQ ID NO: 11449 - DNA, 20 bp, Artificial Sequence
  Description of Artificial Sequence: Synthetic oligonucleotide
aggggagcagtcagtgggct

SEQ ID NO: 11450 - DNA, 20 bp, Artificial Sequence
  Description of Artificial Sequence: Synthetic oligonucleotide
aaggggagcagtcagtgggc

SEQ ID NO: 11451 - DNA, 20 bp, Artificial Sequence
  Description of Artificial Sequence: Synthetic oligonucleotide
aaaggggagcagtcagtggg

SEQ ID NO: 11452 - DNA, 20 bp, Artificial Sequence
  Description of Artificial Sequence: Synthetic oligonucleotide
taaaggggagcagtcagtgg

SEQ ID NO: 11453 - DNA, 20 bp, Artificial Sequence
  Description of Artificial Sequence: Synthetic oligonucleotide
ataaaggggagcagtcagtg

SEQ ID NO: 11454 - DNA, 20 bp, Artificial Sequence
  Description of Artificial Sequence: Synthetic oligonucleotide
tataaaggggagcagtcagt

SEQ ID NO: 11455 - DNA, 20 bp, Artificial Sequence
  Description of Artificial Sequence: Synthetic oligonucleotide
gtataaaggggagcagtcag

SEQ ID NO: 11456 - DNA, 20 bp, Artificial Sequence
  Description of Artificial Sequence: Synthetic oligonucleotide
ggtataaaggggagcagtca

SEQ ID NO: 11457 - DNA, 20 bp, Artificial Sequence
  Description of Artificial Sequence: Synthetic oligonucleotide
aggtataaaggggagcagtc

SEQ ID NO: 11458 - DNA, 20 bp, Artificial Sequence
  Description of Artificial Sequence: Synthetic oligonucleotide
caggtataaaggggagcagt

SEQ ID NO: 11459 - DNA, 20 bp, Artificial Sequence
  Description of Artificial Sequence: Synthetic oligonucleotide
acaggtataaaggggagcag

SEQ ID NO: 11460 - DNA, 20 bp, Artificial Sequence
  Description of Artificial Sequence: Synthetic oligonucleotide
aacaggtataaaggggagca

SEQ ID NO: 11461 - DNA, 20 bp, Artificial Sequence
  Description of Artificial Sequence: Synthetic oligonucleotide
caacaggtataaaggggagc

SEQ ID NO: 11462 - DNA, 20 bp, Artificial Sequence
  Description of Artificial Sequence: Synthetic oligonucleotide
ccaacaggtataaaggggag

SEQ ID NO: 11463 - DNA, 20 bp, Artificial Sequence
  Description of Artificial Sequence: Synthetic oligonucleotide
gccaacaggtataaagggga

SEQ ID NO: 11464 - DNA, 20 bp, Artificial Sequence
  Description of Artificial Sequence: Synthetic oligonucleotide
ggccaacaggtataaagggg

SEQ ID NO: 11465 - DNA, 20 bp, Artificial Sequence
  Description of Artificial Sequence: Synthetic oligonucleotide
gggccaacaggtataaaggg

SEQ ID NO: 11466 - DNA, 20 bp, Artificial Sequence
  Description of Artificial Sequence: Synthetic oligonucleotide
agggccaacaggtataaagg

SEQ ID NO: 11467 - DNA, 20 bp, Artificial Sequence
  Description of Artificial Sequence: Synthetic oligonucleotide
cagggccaacaggtataaag

SEQ ID NO: 11468 - DNA, 20 bp, Artificial Sequence
  Description of Artificial Sequence: Synthetic oligonucleotide
gcagggccaacaggtataaa

SEQ ID NO: 11469 - DNA, 20 bp, Artificial Sequence
  Description of Artificial Sequence: Synthetic oligonucleotide
ggcagggccaacaggtataa

SEQ ID NO: 11470 - DNA, 20 bp, Artificial Sequence
  Description of Artificial Sequence: Synthetic oligonucleotide
aggcagggccaacaggtata

SEQ ID NO: 11471 - DNA, 20 bp, Artificial Sequence
  Description of Artificial Sequence: Synthetic oligonucleotide
taggcagggccaacaggtat

SEQ ID NO: 11472 - DNA, 20 bp, Artificial Sequence
  Description of Artificial Sequence: Synthetic oligonucleotide
ataggcagggccaacaggta

SEQ ID NO: 11473 - DNA, 20 bp, Artificial Sequence
  Description of Artificial Sequence: Synthetic oligonucleotide
tataggcagggccaacaggt

SEQ ID NO: 11474 - DNA, 20 bp, Artificial Sequence
  Description of Artificial Sequence: Synthetic oligonucleotide
ctataggcagggccaacagg

SEQ ID NO: 11475 - DNA, 20 bp, Artificial Sequence
  Description of Artificial Sequence: Synthetic oligonucleotide
cctataggcagggccaacag

SEQ ID NO: 11476 - DNA, 20 bp, Artificial Sequence
  Description of Artificial Sequence: Synthetic oligonucleotide
tcctataggcagggccaaca

SEQ ID NO: 11477 - DNA, 20 bp, Artificial Sequence
  Description of Artificial Sequence: Synthetic oligonucleotide
ctcctataggcagggccaac

SEQ ID NO: 11478 - DNA, 20 bp, Artificial Sequence
  Description of Artificial Sequence: Synthetic oligonucleotide
tctcctataggcagggccaa

SEQ ID NO: 11479 - DNA, 20 bp, Artificial Sequence
  Description of Artificial Sequence: Synthetic oligonucleotide
ctctcctataggcagggcca

SEQ ID NO: 11480 - DNA, 20 bp, Artificial Sequence
  Description of Artificial Sequence: Synthetic oligonucleotide
tctctcctataggcagggcc

SEQ ID NO: 11481 - DNA, 20 bp, Artificial Sequence
  Description of Artificial Sequence: Synthetic oligonucleotide
ttctctcctataggcagggc

SEQ ID NO: 11482 - DNA, 20 bp, Artificial Sequence
  Description of Artificial Sequence: Synthetic oligonucleotide
attctctcctataggcaggg

SEQ ID NO: 11483 - DNA, 20 bp, Artificial Sequence
  Description of Artificial Sequence: Synthetic oligonucleotide
tattctctcctataggcagg

SEQ ID NO: 11484 - DNA, 20 bp, Artificial Sequence
  Description of Artificial Sequence: Synthetic oligonucleotide
atattctctcctataggcag

SEQ ID NO: 11485 - DNA, 20 bp, Artificial Sequence
  Description of Artificial Sequence: Synthetic oligonucleotide
aatattctctcctataggca

SEQ ID NO: 11486 - DNA, 20 bp, Artificial Sequence
  Description of Artificial Sequence: Synthetic oligonucleotide
aaatattctctcctataggc

SEQ ID NO: 11487 - DNA, 20 bp, Artificial Sequence
  Description of Artificial Sequence: Synthetic oligonucleotide
caaatattctctcctatagg

SEQ ID NO: 11488 - DNA, 20 bp, Artificial Sequence
  Description of Artificial Sequence: Synthetic oligonucleotide
ccaaatattctctcctatag

SEQ ID NO: 11489 - DNA, 20 bp, Artificial Sequence
  Description of Artificial Sequence: Synthetic oligonucleotide
tccaaatattctctcctata

SEQ ID NO: 11490 - DNA, 20 bp, Artificial Sequence
  Description of Artificial Sequence: Synthetic oligonucleotide
ctccaaatattctctcctat

SEQ ID NO: 11491 - DNA, 20 bp, Artificial Sequence
  Description of Artificial Sequence: Synthetic oligonucleotide
tctccaaatattctctccta

SEQ ID NO: 11492 - DNA, 20 bp, Artificial Sequence
  Description of Artificial Sequence: Synthetic oligonucleotide
atctccaaatattctctcct

SEQ ID NO: 11493 - DNA, 20 bp, Artificial Sequence
  Description of Artificial Sequence: Synthetic oligonucleotide
tatctccaaatattctctcc

SEQ ID NO: 11494 - DNA, 20 bp, Artificial Sequence
  Description of Artificial Sequence: Synthetic oligonucleotide
ctatctccaaatattctctc

SEQ ID NO: 11495 - DNA, 20 bp, Artificial Sequence
  Description of Artificial Sequence: Synthetic oligonucleotide
cctatctccaaatattctct

SEQ ID NO: 11496 - DNA, 20 bp, Artificial Sequence
  Description of Artificial Sequence: Synthetic oligonucleotide
gcctatctccaaatattctc

SEQ ID NO: 11497 - DNA, 20 bp, Artificial Sequence
  Description of Artificial Sequence: Synthetic oligonucleotide
tgcctatctccaaatattct

SEQ ID NO: 11498 - DNA, 20 bp, Artificial Sequence
  Description of Artificial Sequence: Synthetic oligonucleotide
ctgcctatctccaaatattc

SEQ ID NO: 11499 - DNA, 20 bp, Artificial Sequence
  Description of Artificial Sequence: Synthetic oligonucleotide
gctgcctatctccaaatatt

SEQ ID NO: 11500 - DNA, 20 bp, Artificial Sequence
  Description of Artificial Sequence: Synthetic oligonucleotide
agctgcctatctccaaatat

SEQ ID NO: 11501 - DNA, 20 bp, Artificial Sequence
  Description of Artificial Sequence: Synthetic oligonucleotide
aagctgcctatctccaaata

SEQ ID NO: 11502 - DNA, 20 bp, Artificial Sequence
  Description of Artificial Sequence: Synthetic oligonucleotide
gaagctgcctatctccaaat

SEQ ID NO: 11503 - DNA, 20 bp, Artificial Sequence
  Description of Artificial Sequence: Synthetic oligonucleotide
tgaagctgcctatctccaaa

SEQ ID NO: 11504 - DNA, 20 bp, Artificial Sequence
  Description of Artificial Sequence: Synthetic oligonucleotide
ctgaagctgcctatctccaa

SEQ ID NO: 11505 - DNA, 20 bp, Artificial Sequence
  Description of Artificial Sequence: Synthetic oligonucleotide
cctgaagctgcctatctcca

SEQ ID NO: 11506 - DNA, 20 bp, Artificial Sequence
  Description of Artificial Sequence: Synthetic oligonucleotide
tcctgaagctgcctatctcc

SEQ ID NO: 11507 - DNA, 20 bp, Artificial Sequence
  Description of Artificial Sequence: Synthetic oligonucleotide
atcctgaagctgcctatctc

SEQ ID NO: 11508 - DNA, 20 bp, Artificial Sequence
  Description of Artificial Sequence: Synthetic oligonucleotide
catcctgaagctgcctatct

SEQ ID NO: 11509 - DNA, 20 bp, Artificial Sequence
  Description of Artificial Sequence: Synthetic oligonucleotide
gcatcctgaagctgcctatc

SEQ ID NO: 11510 - DNA, 20 bp, Artificial Sequence
  Description of Artificial Sequence: Synthetic oligonucleotide
tgcatcctgaagctgcctat

SEQ ID NO: 11511 - DNA, 20 bp, Artificial Sequence
  Description of Artificial Sequence: Synthetic oligonucleotide
atgcatcctgaagctgccta

SEQ ID NO: 11512 - DNA, 20 bp, Artificial Sequence
  Description of Artificial Sequence: Synthetic oligonucleotide
aatgcatcctgaagctgcct

SEQ ID NO: 11513 - DNA, 20 bp, Artificial Sequence
  Description of Artificial Sequence: Synthetic oligonucleotide
caatgcatcctgaagctgcc

SEQ ID NO: 11514 - DNA, 20 bp, Artificial Sequence
  Description of Artificial Sequence: Synthetic oligonucleotide
gcaatgcatcctgaagctgc

SEQ ID NO: 11515 - DNA, 20 bp, Artificial Sequence
  Description of Artificial Sequence: Synthetic oligonucleotide
tgcaatgcatcctgaagctg

SEQ ID NO: 11516 - DNA, 20 bp, Artificial Sequence
  Description of Artificial Sequence: Synthetic oligonucleotide
ttgcaatgcatcctgaagct

SEQ ID NO: 11517 - DNA, 20 bp, Artificial Sequence
  Description of Artificial Sequence: Synthetic oligonucleotide
attgcaatgcatcctgaagc

SEQ ID NO: 11518 - DNA, 20 bp, Artificial Sequence
  Description of Artificial Sequence: Synthetic oligonucleotide
gattgcaatgcatcctgaag

SEQ ID NO: 11519 - DNA, 20 bp, Artificial Sequence
  Description of Artificial Sequence: Synthetic oligonucleotide
tgattgcaatgcatcctgaa

SEQ ID NO: 11520 - DNA, 20 bp, Artificial Sequence
  Description of Artificial Sequence: Synthetic oligonucleotide
atgattgcaatgcatcctga

SEQ ID NO: 11521 - DNA, 20 bp, Artificial Sequence
  Description of Artificial Sequence: Synthetic oligonucleotide
gatgattgcaatgcatcctg

SEQ ID NO: 11522 - DNA, 20 bp, Artificial Sequence
  Description of Artificial Sequence: Synthetic oligonucleotide
ggatgattgcaatgcatcct

SEQ ID NO: 11523 - DNA, 20 bp, Artificial Sequence
  Description of Artificial Sequence: Synthetic oligonucleotide
aggatgattgcaatgcatcc

SEQ ID NO: 11524 - DNA, 20 bp, Artificial Sequence
  Description of Artificial Sequence: Synthetic oligonucleotide
aaggatgattgcaatgcatc

SEQ ID NO: 11525 - DNA, 20 bp, Artificial Sequence
  Description of Artificial Sequence: Synthetic oligonucleotide
aaaggatgattgcaatgcat

SEQ ID NO: 11526 - DNA, 20 bp, Artificial Sequence
  Description of Artificial Sequence: Synthetic oligonucleotide
aaaaggatgattgcaatgca

SEQ ID NO: 11527 - DNA, 20 bp, Artificial Sequence
  Description of Artificial Sequence: Synthetic oligonucleotide
gaaaaggatgattgcaatgc

SEQ ID NO: 11528 - DNA, 20 bp, Artificial Sequence
  Description of Artificial Sequence: Synthetic oligonucleotide
agaaaaggatgattgcaatg

SEQ ID NO: 11529 - DNA, 20 bp, Artificial Sequence
  Description of Artificial Sequence: Synthetic oligonucleotide
aagaaaaggatgattgcaat

SEQ ID NO: 11530 - DNA, 20 bp, Artificial Sequence
  Description of Artificial Sequence: Synthetic oligonucleotide
taagaaaaggatgattgcaa

SEQ ID NO: 11531 - DNA, 20 bp, Artificial Sequence
  Description of Artificial Sequence: Synthetic oligonucleotide
ttaagaaaaggatgattgca

SEQ ID NO: 11532 - DNA, 20 bp, Artificial Sequence
  Description of Artificial Sequence: Synthetic oligonucleotide
tttaagaaaaggatgattgc

SEQ ID NO: 11533 - DNA, 20 bp, Artificial Sequence
  Description of Artificial Sequence: Synthetic oligonucleotide
atttaagaaaaggatgattg

SEQ ID NO: 11534 - DNA, 20 bp, Artificial Sequence
  Description of Artificial Sequence: Synthetic oligonucleotide
aatttaagaaaaggatgatt

SEQ ID NO: 11535 - DNA, 20 bp, Artificial Sequence
  Description of Artificial Sequence: Synthetic oligonucleotide
taatttaagaaaaggatgat

SEQ ID NO: 11536 - DNA, 20 bp, Artificial Sequence
  Description of Artificial Sequence: Synthetic oligonucleotide
ataatttaagaaaaggatga

SEQ ID NO: 11537 - DNA, 20 bp, Artificial Sequence
  Description of Artificial Sequence: Synthetic oligonucleotide
cataatttaagaaaaggatg

SEQ ID NO: 11538 - DNA, 20 bp, Artificial Sequence
  Description of Artificial Sequence: Synthetic oligonucleotide
acataatttaagaaaaggat

SEQ ID NO: 11539 - DNA, 20 bp, Artificial Sequence
  Description of Artificial Sequence: Synthetic oligonucleotide
gacataatttaagaaaagga

SEQ ID NO: 11540 - DNA, 20 bp, Artificial Sequence
  Description of Artificial Sequence: Synthetic oligonucleotide
tgacataatttaagaaaagg

SEQ ID NO: 11541 - DNA, 20 bp, Artificial Sequence
  Description of Artificial Sequence: Synthetic oligonucleotide
gtgacataatttaagaaaag

SEQ ID NO: 11542 - DNA, 20 bp, Artificial Sequence
  Description of Artificial Sequence: Synthetic oligonucleotide
agtgacataatttaagaaaa

SEQ ID NO: 11543 - DNA, 20 bp, Artificial Sequence
  Description of Artificial Sequence: Synthetic oligonucleotide
tagtgacataatttaagaaa

SEQ ID NO: 11544 - DNA, 20 bp, Artificial Sequence
  Description of Artificial Sequence: Synthetic oligonucleotide
ctagtgacataatttaagaa

SEQ ID NO: 11545 - DNA, 20 bp, Artificial Sequence
  Description of Artificial Sequence: Synthetic oligonucleotide
actagtgacataatttaaga

SEQ ID NO: 11546 - DNA, 20 bp, Artificial Sequence
  Description of Artificial Sequence: Synthetic oligonucleotide
gactagtgacataatttaag

SEQ ID NO: 11547 - DNA, 20 bp, Artificial Sequence
  Description of Artificial Sequence: Synthetic oligonucleotide
agactagtgacataatttaa

SEQ ID NO: 11548 - DNA, 20 bp, Artificial Sequence
  Description of Artificial Sequence: Synthetic oligonucleotide
aagactagtgacataattta

SEQ ID NO: 11549 - DNA, 20 bp, Artificial Sequence
  Description of Artificial Sequence: Synthetic oligonucleotide
aaagactagtgacataattt

SEQ ID NO: 11550 - DNA, 20 bp, Artificial Sequence
  Description of Artificial Sequence: Synthetic oligonucleotide
aaaagactagtgacataatt

SEQ ID NO: 11551 - DNA, 20 bp, Artificial Sequence
  Description of Artificial Sequence: Synthetic oligonucleotide
taaaagactagtgacataat

SEQ ID NO: 11552 - DNA, 20 bp, Artificial Sequence
  Description of Artificial Sequence: Synthetic oligonucleotide
ataaaagactagtgacataa

SEQ ID NO: 11553 - DNA, 20 bp, Artificial Sequence
  Description of Artificial Sequence: Synthetic oligonucleotide
aataaaagactagtgacata

SEQ ID NO: 11554 - DNA, 20 bp, Artificial Sequence
  Description of Artificial Sequence: Synthetic oligonucleotide
aaataaaagactagtgacat

SEQ ID NO: 11555 - DNA, 20 bp, Artificial Sequence
  Description of Artificial Sequence: Synthetic oligonucleotide
aaaataaaagactagtgaca

SEQ ID NO: 11556 - DNA, 20 bp, Artificial Sequence
  Description of Artificial Sequence: Synthetic oligonucleotide
aaaaataaaagactagtgac

SEQ ID NO: 11557 - DNA, 20 bp, Artificial Sequence
  Description of Artificial Sequence: Synthetic oligonucleotide
aaaaaataaaagactagtga

SEQ ID NO: 11558 - DNA, 20 bp, Artificial Sequence
  Description of Artificial Sequence: Synthetic oligonucleotide
gaaaaaataaaagactagtg

SEQ ID NO: 11559 - DNA, 20 bp, Artificial Sequence
  Description of Artificial Sequence: Synthetic oligonucleotide
ggaaaaaataaaagactagt

SEQ ID NO: 11560 - DNA, 20 bp, Artificial Sequence
  Description of Artificial Sequence: Synthetic oligonucleotide
gggaaaaaataaaagactag

SEQ ID NO: 11561 - DNA, 20 bp, Artificial Sequence
  Description of Artificial Sequence: Synthetic oligonucleotide
ggggaaaaaataaaagacta

SEQ ID NO: 11562 - DNA, 20 bp, Artificial Sequence
  Description of Artificial Sequence: Synthetic oligonucleotide
aggggaaaaaataaaagact

SEQ ID NO: 11563 - DNA, 20 bp, Artificial Sequence
  Description of Artificial Sequence: Synthetic oligonucleotide
gaggggaaaaaataaaagac

SEQ ID NO: 11564 - DNA, 20 bp, Artificial Sequence
  Description of Artificial Sequence: Synthetic oligonucleotide
agaggggaaaaaataaaaga

SEQ ID NO: 11565 - DNA, 20 bp, Artificial Sequence
  Description of Artificial Sequence: Synthetic oligonucleotide
aagaggggaaaaaataaaag

SEQ ID NO: 11566 - DNA, 20 bp, Artificial Sequence
  Description of Artificial Sequence: Synthetic oligonucleotide
caagaggggaaaaaataaaa

SEQ ID NO: 11567 - DNA, 20 bp, Artificial Sequence
  Description of Artificial Sequence: Synthetic oligonucleotide
tcaagaggggaaaaaataaa

SEQ ID NO: 11568 - DNA, 20 bp, Artificial Sequence
  Description of Artificial Sequence: Synthetic oligonucleotide
ttcaagaggggaaaaaataa

SEQ ID NO: 11569 - DNA, 20 bp, Artificial Sequence
  Description of Artificial Sequence: Synthetic oligonucleotide
gttcaagaggggaaaaaata

SEQ ID NO: 11570 - DNA, 20 bp, Artificial Sequence
  Description of Artificial Sequence: Synthetic oligonucleotide
agttcaagaggggaaaaaat

SEQ ID NO: 11571 - DNA, 20 bp, Artificial Sequence
  Description of Artificial Sequence: Synthetic oligonucleotide
aagttcaagaggggaaaaaa

SEQ ID NO: 11572 - DNA, 20 bp, Artificial Sequence
  Description of Artificial Sequence: Synthetic oligonucleotide
aaagttcaagaggggaaaaa

SEQ ID NO: 11573 - DNA, 20 bp, Artificial Sequence
  Description of Artificial Sequence: Synthetic oligonucleotide
gaaagttcaagaggggaaaa

SEQ ID NO: 11574 - DNA, 20 bp, Artificial Sequence
  Description of Artificial Sequence: Synthetic oligonucleotide
ggaaagttcaagaggggaaa

SEQ ID NO: 11575 - DNA, 20 bp, Artificial Sequence
  Description of Artificial Sequence: Synthetic oligonucleotide
aggaaagttcaagaggggaa

SEQ ID NO: 11576 - DNA, 20 bp, Artificial Sequence
  Description of Artificial Sequence: Synthetic oligonucleotide
gaggaaagttcaagagggga

SEQ ID NO: 11577 - DNA, 20 bp, Artificial Sequence
  Description of Artificial Sequence: Synthetic oligonucleotide
tgaggaaagttcaagagggg

SEQ ID NO: 11578 - DNA, 20 bp, Artificial Sequence
  Description of Artificial Sequence: Synthetic oligonucleotide
gtgaggaaagttcaagaggg

SEQ ID NO: 11579 - DNA, 20 bp, Artificial Sequence
  Description of Artificial Sequence: Synthetic oligonucleotide
tgtgaggaaagttcaagagg

SEQ ID NO: 11580 - DNA, 20 bp, Artificial Sequence
  Description of Artificial Sequence: Synthetic oligonucleotide
gtgtgaggaaagttcaagag

SEQ ID NO: 11581 - DNA, 20 bp, Artificial Sequence
  Description of Artificial Sequence: Synthetic oligonucleotide
ggtgtgaggaaagttcaaga

SEQ ID NO: 11582 - DNA, 20 bp, Artificial Sequence
  Description of Artificial Sequence: Synthetic oligonucleotide
aggtgtgaggaaagttcaag

SEQ ID NO: 11583 - DNA, 20 bp, Artificial Sequence
  Description of Artificial Sequence: Synthetic oligonucleotide
caggtgtgaggaaagttcaa

SEQ ID NO: 11584 - DNA, 20 bp, Artificial Sequence
  Description of Artificial Sequence: Synthetic oligonucleotide
ccaggtgtgaggaaagttca

SEQ ID NO: 11585 - DNA, 20 bp, Artificial Sequence
  Description of Artificial Sequence: Synthetic oligonucleotide
tccaggtgtgaggaaagttc

SEQ ID NO: 11586 - DNA, 20 bp, Artificial Sequence
  Description of Artificial Sequence: Synthetic oligonucleotide
ttccaggtgtgaggaaagtt

SEQ ID NO: 11587 - DNA, 20 bp, Artificial Sequence
  Description of Artificial Sequence: Synthetic oligonucleotide
cttccaggtgtgaggaaagt

SEQ ID NO: 11588 - DNA, 20 bp, Artificial Sequence
  Description of Artificial Sequence: Synthetic oligonucleotide
tcttccaggtgtgaggaaag

SEQ ID NO: 11589 - DNA, 20 bp, Artificial Sequence
  Description of Artificial Sequence: Synthetic oligonucleotide
ttcttccaggtgtgaggaaa

SEQ ID NO: 11590 - DNA, 20 bp, Artificial Sequence
  Description of Artificial Sequence: Synthetic oligonucleotide
tttcttccaggtgtgaggaa

SEQ ID NO: 11591 - DNA, 20 bp, Artificial Sequence
  Description of Artificial Sequence: Synthetic oligonucleotide
gtttcttccaggtgtgagga

SEQ ID NO: 11592 - DNA, 20 bp, Artificial Sequence
  Description of Artificial Sequence: Synthetic oligonucleotide
tgtttcttccaggtgtgagg

SEQ ID NO: 11593 - DNA, 20 bp, Artificial Sequence
  Description of Artificial Sequence: Synthetic oligonucleotide
ttgtttcttccaggtgtgag

SEQ ID NO: 11594 - DNA, 20 bp, Artificial Sequence
  Description of Artificial Sequence: Synthetic oligonucleotide
tttgtttcttccaggtgtga

SEQ ID NO: 11595 - DNA, 20 bp, Artificial Sequence
  Description of Artificial Sequence: Synthetic oligonucleotide
ctttgtttcttccaggtgtg

SEQ ID NO: 11596 - DNA, 20 bp, Artificial Sequence
  Description of Artificial Sequence: Synthetic oligonucleotide
actttgtttcttccaggtgt

SEQ ID NO: 11597 - DNA, 20 bp, Artificial Sequence
  Description of Artificial Sequence: Synthetic oligonucleotide
tactttgtttcttccaggtg

SEQ ID NO: 11598 - DNA, 20 bp, Artificial Sequence
  Description of Artificial Sequence: Synthetic oligonucleotide
ctactttgtttcttccaggt

SEQ ID NO: 11599 - DNA, 20 bp, Artificial Sequence
  Description of Artificial Sequence: Synthetic oligonucleotide
cctactttgtttcttccagg

SEQ ID NO: 11600 - DNA, 20 bp, Artificial Sequence
  Description of Artificial Sequence: Synthetic oligonucleotide
tcctactttgtttcttccag

SEQ ID NO: 11601 - DNA, 20 bp, Artificial Sequence
  Description of Artificial Sequence: Synthetic oligonucleotide
ttcctactttgtttcttcca

SEQ ID NO: 11602 - DNA, 20 bp, Artificial Sequence
  Description of Artificial Sequence: Synthetic oligonucleotide
tttcctactttgtttcttcc

SEQ ID NO: 11603 - DNA, 20 bp, Artificial Sequence
  Description of Artificial Sequence: Synthetic oligonucleotide
ttttcctactttgtttcttc

SEQ ID NO: 11604 - DNA, 20 bp, Artificial Sequence
  Description of Artificial Sequence: Synthetic oligonucleotide
tttttcctactttgtttctt

SEQ ID NO: 11605 - DNA, 20 bp, Artificial Sequence
  Description of Artificial Sequence: Synthetic oligonucleotide
ctttttcctactttgtttct

SEQ ID NO: 11606 - DNA, 20 bp, Artificial Sequence
  Description of Artificial Sequence: Synthetic oligonucleotide
actttttcctactttgtttc

SEQ ID NO: 11607 - DNA, 20 bp, Artificial Sequence
  Description of Artificial Sequence: Synthetic oligonucleotide
cactttttcctactttgttt

SEQ ID NO: 11608 - DNA, 20 bp, Artificial Sequence
  Description of Artificial Sequence: Synthetic oligonucleotide
tcactttttcctactttgtt

SEQ ID NO: 11609 - DNA, 20 bp, Artificial Sequence
  Description of Artificial Sequence: Synthetic oligonucleotide
ttcactttttcctactttgt

SEQ ID NO: 11610 - DNA, 20 bp, Artificial Sequence
  Description of Artificial Sequence: Synthetic oligonucleotide
gttcactttttcctactttg

SEQ ID NO: 11611 - DNA, 20 bp, Artificial Sequence
  Description of Artificial Sequence: Synthetic oligonucleotide
tgttcactttttcctacttt

SEQ ID NO: 11612 - DNA, 20 bp, Artificial Sequence
  Description of Artificial Sequence: Synthetic oligonucleotide
ctgttcactttttcctactt

SEQ ID NO: 11613 - DNA, 20 bp, Artificial Sequence
  Description of Artificial Sequence: Synthetic oligonucleotide
cctgttcactttttcctact

SEQ ID NO: 11614 - DNA, 20 bp, Artificial Sequence
  Description of Artificial Sequence: Synthetic oligonucleotide
ccctgttcactttttcctac

SEQ ID NO: 11615 - DNA, 20 bp, Artificial Sequence
  Description of Artificial Sequence: Synthetic oligonucleotide
cccctgttcactttttccta

SEQ ID NO: 11616 - DNA, 20 bp, Artificial Sequence
  Description of Artificial Sequence: Synthetic oligonucleotide
tcccctgttcactttttcct

SEQ ID NO: 11617 - DNA, 20 bp, Artificial Sequence
  Description of Artificial Sequence: Synthetic oligonucleotide
atcccctgttcactttttcc

SEQ ID NO: 11618 - DNA, 20 bp, Artificial Sequence
  Description of Artificial Sequence: Synthetic oligonucleotide
catcccctgttcactttttc

SEQ ID NO: 11619 - DNA, 20 bp, Artificial Sequence
  Description of Artificial Sequence: Synthetic oligonucleotide
acatcccctgttcacttttt

SEQ ID NO: 11620 - DNA, 20 bp, Artificial Sequence
  Description of Artificial Sequence: Synthetic oligonucleotide
gacatcccctgttcactttt

SEQ ID NO: 11621 - DNA, 20 bp, Artificial Sequence
  Description of Artificial Sequence: Synthetic oligonucleotide
tgacatcccctgttcacttt

SEQ ID NO: 11622 - DNA, 20 bp, Artificial Sequence
  Description of Artificial Sequence: Synthetic oligonucleotide
ttgacatcccctgttcactt

SEQ ID NO: 11623 - DNA, 20 bp, Artificial Sequence
  Description of Artificial Sequence: Synthetic oligonucleotide
tttgacatcccctgttcact

SEQ ID NO: 11624 - DNA, 20 bp, Artificial Sequence
  Description of Artificial Sequence: Synthetic oligonucleotide
atttgacatcccctgttcac

SEQ ID NO: 11625 - DNA, 20 bp, Artificial Sequence
  Description of Artificial Sequence: Synthetic oligonucleotide
gatttgacatcccctgttca

SEQ ID NO: 11626 - DNA, 20 bp, Artificial Sequence
  Description of Artificial Sequence: Synthetic oligonucleotide
cgatttgacatcccctgttc

SEQ ID NO: 11627 - DNA, 20 bp, Artificial Sequence
  Description of Artificial Sequence: Synthetic oligonucleotide
tcgatttgacatcccctgtt

SEQ ID NO: 11628 - DNA, 20 bp, Artificial Sequence
  Description of Artificial Sequence: Synthetic oligonucleotide
atcgatttgacatcccctgt

SEQ ID NO: 11629 - DNA, 20 bp, Artificial Sequence
  Description of Artificial Sequence: Synthetic oligonucleotide
aatcgatttgacatcccctg

SEQ ID NO: 11630 - DNA, 20 bp, Artificial Sequence
  Description of Artificial Sequence: Synthetic oligonucleotide
gaatcgatttgacatcccct

SEQ ID NO: 11631 - DNA, 20 bp, Artificial Sequence
  Description of Artificial Sequence: Synthetic oligonucleotide
agaatcgatttgacatcccc

SEQ ID NO: 11632 - DNA, 20 bp, Artificial Sequence
  Description of Artificial Sequence: Synthetic oligonucleotide
aagaatcgatttgacatccc

SEQ ID NO: 11633 - DNA, 20 bp, Artificial Sequence
  Description of Artificial Sequence: Synthetic oligonucleotide
caagaatcgatttgacatcc

SEQ ID NO: 11634 - DNA, 20 bp, Artificial Sequence
  Description of Artificial Sequence: Synthetic oligonucleotide
tcaagaatcgatttgacatc

SEQ ID NO: 11635 - DNA, 20 bp, Artificial Sequence
  Description of Artificial Sequence: Synthetic oligonucleotide
ttcaagaatcgatttgacat

SEQ ID NO: 11636 - DNA, 20 bp, Artificial Sequence
  Description of Artificial Sequence: Synthetic oligonucleotide
attcaagaatcgatttgaca

SEQ ID NO: 11637 - DNA, 20 bp, Artificial Sequence
  Description of Artificial Sequence: Synthetic oligonucleotide
aattcaagaatcgatttgac

SEQ ID NO: 11638 - DNA, 20 bp, Artificial Sequence
  Description of Artificial Sequence: Synthetic oligonucleotide
gaattcaagaatcgatttga

SEQ ID NO: 11639 - DNA, 20 bp, Artificial Sequence
  Description of Artificial Sequence: Synthetic oligonucleotide
ggaattcaagaatcgatttg

SEQ ID NO: 11640 - DNA, 20 bp, Artificial Sequence
  Description of Artificial Sequence: Synthetic oligonucleotide
gggaattcaagaatcgattt

SEQ ID NO: 11641 - DNA, 20 bp, Artificial Sequence
  Description of Artificial Sequence: Synthetic oligonucleotide
cgggaattcaagaatcgatt

SEQ ID NO: 11642 - DNA, 20 bp, Artificial Sequence
  Description of Artificial Sequence: Synthetic oligonucleotide
gcgggaattcaagaatcgat

SEQ ID NO: 11643 - DNA, 20 bp, Artificial Sequence
  Description of Artificial Sequence: Synthetic oligonucleotide
agcgggaattcaagaatcga

SEQ ID NO: 11644 - DNA, 20 bp, Artificial Sequence
  Description of Artificial Sequence: Synthetic oligonucleotide
cagcgggaattcaagaatcg

SEQ ID NO: 11645 - DNA, 20 bp, Artificial Sequence
  Description of Artificial Sequence: Synthetic oligonucleotide
gcagcgggaattcaagaatc

SEQ ID NO: 11646 - DNA, 20 bp, Artificial Sequence
  Description of Artificial Sequence: Synthetic oligonucleotide
tgcagcgggaattcaagaat

SEQ ID NO: 11647 - DNA, 20 bp, Artificial Sequence
  Description of Artificial Sequence: Synthetic oligonucleotide
ttgcagcgggaattcaagaa

SEQ ID NO: 11648 - DNA, 20 bp, Artificial Sequence
  Description of Artificial Sequence: Synthetic oligonucleotide
cttgcagcgggaattcaaga

SEQ ID NO: 11649 - DNA, 20 bp, Artificial Sequence
  Description of Artificial Sequence: Synthetic oligonucleotide
gcttgcagcgggaattcaag

SEQ ID NO: 11650 - DNA, 20 bp, Artificial Sequence
  Description of Artificial Sequence: Synthetic oligonucleotide
agcttgcagcgggaattcaa

SEQ ID NO: 11651 - DNA, 20 bp, Artificial Sequence
  Description of Artificial Sequence: Synthetic oligonucleotide
tagcttgcagcgggaattca

SEQ ID NO: 11652 - DNA, 20 bp, Artificial Sequence
  Description of Artificial Sequence: Synthetic oligonucleotide
ctagcttgcagcgggaattc

SEQ ID NO: 11653 - DNA, 20 bp, Artificial Sequence
  Description of Artificial Sequence: Synthetic oligonucleotide
tctagcttgcagcgggaatt

SEQ ID NO: 11654 - DNA, 20 bp, Artificial Sequence
  Description of Artificial Sequence: Synthetic oligonucleotide
ctctagcttgcagcgggaat

SEQ ID NO: 11655 - DNA, 20 bp, Artificial Sequence
  Description of Artificial Sequence: Synthetic oligonucleotide
gctctagcttgcagcgggaa

SEQ ID NO: 11656 - DNA, 20 bp, Artificial Sequence
  Description of Artificial Sequence: Synthetic oligonucleotide
ggctctagcttgcagcggga

SEQ ID NO: 11657 - DNA, 20 bp, Artificial Sequence
  Description of Artificial Sequence: Synthetic oligonucleotide
cggctctagcttgcagcggg

SEQ ID NO: 11658 - DNA, 20 bp, Artificial Sequence
  Description of Artificial Sequence: Synthetic oligonucleotide
gcggctctagcttgcagcgg

SEQ ID NO: 11659 - DNA, 20 bp, Artificial Sequence
  Description of Artificial Sequence: Synthetic oligonucleotide
tgcggctctagcttgcagcg

SEQ ID NO: 11660 - DNA, 20 bp, Artificial Sequence
  Description of Artificial Sequence: Synthetic oligonucleotide
ctgcggctctagcttgcagc

SEQ ID NO: 11661 - DNA, 20 bp, Artificial Sequence
  Description of Artificial Sequence: Synthetic oligonucleotide
cctgcggctctagcttgcag

SEQ ID NO: 11662 - DNA, 20 bp, Artificial Sequence
  Description of Artificial Sequence: Synthetic oligonucleotide
gcctgcggctctagcttgca

SEQ ID NO: 11663 - DNA, 20 bp, Artificial Sequence
  Description of Artificial Sequence: Synthetic oligonucleotide
tgcctgcggctctagcttgc

SEQ ID NO: 11664 - DNA, 20 bp, Artificial Sequence
  Description of Artificial Sequence: Synthetic oligonucleotide
gtgcctgcggctctagcttg

SEQ ID NO: 11665 - DNA, 20 bp, Artificial Sequence
  Description of Artificial Sequence: Synthetic oligonucleotide
ggtgcctgcggctctagctt

SEQ ID NO: 11666 - DNA, 20 bp, Artificial Sequence
  Description of Artificial Sequence: Synthetic oligonucleotide
gggtgcctgcggctctagct

SEQ ID NO: 11667 - DNA, 20 bp, Artificial Sequence
  Description of Artificial Sequence: Synthetic oligonucleotide
agggtgcctgcggctctagc

SEQ ID NO: 11668 - DNA, 20 bp, Artificial Sequence
  Description of Artificial Sequence: Synthetic oligonucleotide
gagggtgcctgcggctctag

SEQ ID NO: 11669 - DNA, 20 bp, Artificial Sequence
  Description of Artificial Sequence: Synthetic oligonucleotide
agagggtgcctgcggctcta

SEQ ID NO: 11670 - DNA, 20 bp, Artificial Sequence
  Description of Artificial Sequence: Synthetic oligonucleotide
gagagggtgcctgcggctct

SEQ ID NO: 11671 - DNA, 20 bp, Artificial Sequence
  Description of Artificial Sequence: Synthetic oligonucleotide
tgagagggtgcctgcggctc

SEQ ID NO: 11672 - DNA, 20 bp, Artificial Sequence
  Description of Artificial Sequence: Synthetic oligonucleotide
gtgagagggtgcctgcggct

SEQ ID NO: 11673 - DNA, 20 bp, Artificial Sequence
  Description of Artificial Sequence: Synthetic oligonucleotide
agtgagagggtgcctgcggc

SEQ ID NO: 11674 - DNA, 20 bp, Artificial Sequence
  Description of Artificial Sequence: Synthetic oligonucleotide
gagtgagagggtgcctgcgg

SEQ ID NO: 11675 - DNA, 20 bp, Artificial Sequence
  Description of Artificial Sequence: Synthetic oligonucleotide
tgagtgagagggtgcctgcg

SEQ ID NO: 11676 - DNA, 20 bp, Artificial Sequence
  Description of Artificial Sequence: Synthetic oligonucleotide
ttgagtgagagggtgcctgc

SEQ ID NO: 11677 - DNA, 20 bp, Artificial Sequence
  Description of Artificial Sequence: Synthetic oligonucleotide
attgagtgagagggtgcctg

SEQ ID NO: 11678 - DNA, 20 bp, Artificial Sequence
  Description of Artificial Sequence: Synthetic oligonucleotide
aattgagtgagagggtgcct

SEQ ID NO: 11679 - DNA, 20 bp, Artificial Sequence
  Description of Artificial Sequence: Synthetic oligonucleotide
aaattgagtgagagggtgcc

SEQ ID NO: 11680 - DNA, 20 bp, Artificial Sequence
  Description of Artificial Sequence: Synthetic oligonucleotide
gaaattgagtgagagggtgc

SEQ ID NO: 11681 - DNA, 20 bp, Artificial Sequence
  Description of Artificial Sequence: Synthetic oligonucleotide
ggaaattgagtgagagggtg

SEQ ID NO: 11682 - DNA, 20 bp, Artificial Sequence
  Description of Artificial Sequence: Synthetic oligonucleotide
tggaaattgagtgagagggt

SEQ ID NO: 11683 - DNA, 20 bp, Artificial Sequence
  Description of Artificial Sequence: Synthetic oligonucleotide
gtggaaattgagtgagaggg

SEQ ID NO: 11684 - DNA, 20 bp, Artificial Sequence
  Description of Artificial Sequence: Synthetic oligonucleotide
agtggaaattgagtgagagg

SEQ ID NO: 11685 - DNA, 20 bp, Artificial Sequence
  Description of Artificial Sequence: Synthetic oligonucleotide
gagtggaaattgagtgagag

SEQ ID NO: 11686 - DNA, 20 bp, Artificial Sequence
  Description of Artificial Sequence: Synthetic oligonucleotide
tgagtggaaattgagtgaga

SEQ ID NO: 11687 - DNA, 20 bp, Artificial Sequence
  Description of Artificial Sequence: Synthetic oligonucleotide
ctgagtggaaattgagtgag

SEQ ID NO: 11688 - DNA, 20 bp, Artificial Sequence
  Description of Artificial Sequence: Synthetic oligonucleotide
tctgagtggaaattgagtga

SEQ ID NO: 11689 - DNA, 20 bp, Artificial Sequence
  Description of Artificial Sequence: Synthetic oligonucleotide
ttctgagtggaaattgagtg

SEQ ID NO: 11690 - DNA, 20 bp, Artificial Sequence
  Description of Artificial Sequence: Synthetic oligonucleotide
gttctgagtggaaattgagt

SEQ ID NO: 11691 - DNA, 20 bp, Artificial Sequence
  Description of Artificial Sequence: Synthetic oligonucleotide
ggttctgagtggaaattgag

SEQ ID NO: 11692 - DNA, 20 bp, Artificial Sequence
  Description of Artificial Sequence: Synthetic oligonucleotide
gggttctgagtggaaattga

SEQ ID NO: 11693 - DNA, 20 bp, Artificial Sequence
  Description of Artificial Sequence: Synthetic oligonucleotide
agggttctgagtggaaattg

SEQ ID NO: 11694 - DNA, 20 bp, Artificial Sequence
  Description of Artificial Sequence: Synthetic oligonucleotide
tagggttctgagtggaaatt

SEQ ID NO: 11695 - DNA, 20 bp, Artificial Sequence
  Description of Artificial Sequence: Synthetic oligonucleotide
atagggttctgagtggaaat

SEQ ID NO: 11696 - DNA, 20 bp, Artificial Sequence
  Description of Artificial Sequence: Synthetic oligonucleotide
tatagggttctgagtggaaa

SEQ ID NO: 11697 - DNA, 20 bp, Artificial Sequence
  Description of Artificial Sequence: Synthetic oligonucleotide
ttatagggttctgagtggaa

SEQ ID NO: 11698 - DNA, 20 bp, Artificial Sequence
  Description of Artificial Sequence: Synthetic oligonucleotide
tttatagggttctgagtgga

SEQ ID NO: 11699 - DNA, 20 bp, Artificial Sequence
  Description of Artificial Sequence: Synthetic oligonucleotide
gtttatagggttctgagtgg

SEQ ID NO: 11700 - DNA, 20 bp, Artificial Sequence
  Description of Artificial Sequence: Synthetic oligonucleotide
tgtttatagggttctgagtg

SEQ ID NO: 11701 - DNA, 20 bp, Artificial Sequence
  Description of Artificial Sequence: Synthetic oligonucleotide
gtgtttatagggttctgagt

SEQ ID NO: 11702 - DNA, 20 bp, Artificial Sequence
  Description of Artificial Sequence: Synthetic oligonucleotide
ggtgtttatagggttctgag

SEQ ID NO: 11703 - DNA, 20 bp, Artificial Sequence
  Description of Artificial Sequence: Synthetic oligonucleotide
tggtgtttatagggttctga

SEQ ID NO: 11704 - DNA, 20 bp, Artificial Sequence
  Description of Artificial Sequence: Synthetic oligonucleotide
ctggtgtttatagggttctg

SEQ ID NO: 11705 - DNA, 20 bp, Artificial Sequence
  Description of Artificial Sequence: Synthetic oligonucleotide
actggtgtttatagggttct

SEQ ID NO: 11706 - DNA, 20 bp, Artificial Sequence
  Description of Artificial Sequence: Synthetic oligonucleotide
cactggtgtttatagggttc

SEQ ID NO: 11707 - DNA, 20 bp, Artificial Sequence
  Description of Artificial Sequence: Synthetic oligonucleotide
ccactggtgtttatagggtt

SEQ ID NO: 11708 - DNA, 20 bp, Artificial Sequence
  Description of Artificial Sequence: Synthetic oligonucleotide
cccactggtgtttatagggt

SEQ ID NO: 11709 - DNA, 20 bp, Artificial Sequence
  Description of Artificial Sequence: Synthetic oligonucleotide
tcccactggtgtttataggg

SEQ ID NO: 11710 - DNA, 20 bp, Artificial Sequence
  Description of Artificial Sequence: Synthetic oligonucleotide
ttcccactggtgtttatagg

SEQ ID NO: 11711 - DNA, 20 bp, Artificial Sequence
  Description of Artificial Sequence: Synthetic oligonucleotide
cttcccactggtgtttatag

SEQ ID NO: 11712 - DNA, 20 bp, Artificial Sequence
  Description of Artificial Sequence: Synthetic oligonucleotide
ccttcccactggtgtttata

SEQ ID NO: 11713 - DNA, 20 bp, Artificial Sequence
  Description of Artificial Sequence: Synthetic oligonucleotide
cccttcccactggtgtttat

SEQ ID NO: 11714 - DNA, 20 bp, Artificial Sequence
  Description of Artificial Sequence: Synthetic oligonucleotide
gcccttcccactggtgttta

SEQ ID NO: 11715 - DNA, 20 bp, Artificial Sequence
  Description of Artificial Sequence: Synthetic oligonucleotide
tgcccttcccactggtgttt

SEQ ID NO: 11716 - DNA, 20 bp, Artificial Sequence
  Description of Artificial Sequence: Synthetic oligonucleotide
ttgcccttcccactggtgtt

SEQ ID NO: 11717 - DNA, 20 bp, Artificial Sequence
  Description of Artificial Sequence: Synthetic oligonucleotide
gttgcccttcccactggtgt

SEQ ID NO: 11718 - DNA, 20 bp, Artificial Sequence
  Description of Artificial Sequence: Synthetic oligonucleotide
ggttgcccttcccactggtg

SEQ ID NO: 11719 - DNA, 20 bp, Artificial Sequence
  Description of Artificial Sequence: Synthetic oligonucleotide
gggttgcccttcccactggt

SEQ ID NO: 11720 - DNA, 20 bp, Artificial Sequence
  Description of Artificial Sequence: Synthetic oligonucleotide
tgggttgcccttcccactgg

SEQ ID NO: 11721 - DNA, 20 bp, Artificial Sequence
  Description of Artificial Sequence: Synthetic oligonucleotide
gtgggttgcccttcccactg

SEQ ID NO: 11722 - DNA, 20 bp, Artificial Sequence
  Description of Artificial Sequence: Synthetic oligonucleotide
agtgggttgcccttcccact

SEQ ID NO: 11723 - DNA, 20 bp, Artificial Sequence
  Description of Artificial Sequence: Synthetic oligonucleotide
cagtgggttgcccttcccac

SEQ ID NO: 11724 - DNA, 20 bp, Artificial Sequence
  Description of Artificial Sequence: Synthetic oligonucleotide
gcagtgggttgcccttccca

SEQ ID NO: 11725 - DNA, 20 bp, Artificial Sequence
  Description of Artificial Sequence: Synthetic oligonucleotide
tgcagtgggttgcccttccc

SEQ ID NO: 11726 - DNA, 20 bp, Artificial Sequence
  Description of Artificial Sequence: Synthetic oligonucleotide
gtgcagtgggttgcccttcc

SEQ ID NO: 11727 - DNA, 20 bp, Artificial Sequence
  Description of Artificial Sequence: Synthetic oligonucleotide
cgtgcagtgggttgcccttc

SEQ ID NO: 11728 - DNA, 20 bp, Artificial Sequence
  Description of Artificial Sequence: Synthetic oligonucleotide
acgtgcagtgggttgccctt

SEQ ID NO: 11729 - DNA, 20 bp, Artificial Sequence
  Description of Artificial Sequence: Synthetic oligonucleotide
cacgtgcagtgggttgccct

SEQ ID NO: 11730 - DNA, 20 bp, Artificial Sequence
  Description of Artificial Sequence: Synthetic oligonucleotide
ccacgtgcagtgggttgccc

SEQ ID NO: 11731 - DNA, 20 bp, Artificial Sequence
  Description of Artificial Sequence: Synthetic oligonucleotide
cccacgtgcagtgggttgcc

SEQ ID NO: 11732 - DNA, 20 bp, Artificial Sequence
  Description of Artificial Sequence: Synthetic oligonucleotide
tcccacgtgcagtgggttgc

SEQ ID NO: 11733 - DNA, 20 bp, Artificial Sequence
  Description of Artificial Sequence: Synthetic oligonucleotide
ttcccacgtgcagtgggttg

SEQ ID NO: 11734 - DNA, 20 bp, Artificial Sequence
  Description of Artificial Sequence: Synthetic oligonucleotide
attcccacgtgcagtgggtt

SEQ ID NO: 11735 - DNA, 20 bp, Artificial Sequence
  Description of Artificial Sequence: Synthetic oligonucleotide
cattcccacgtgcagtgggt

SEQ ID NO: 11736 - DNA, 20 bp, Artificial Sequence
  Description of Artificial Sequence: Synthetic oligonucleotide
gcattcccacgtgcagtggg

SEQ ID NO: 11737 - DNA, 20 bp, Artificial Sequence
  Description of Artificial Sequence: Synthetic oligonucleotide
tgcattcccacgtgcagtgg

SEQ ID NO: 11738 - DNA, 20 bp, Artificial Sequence
  Description of Artificial Sequence: Synthetic oligonucleotide
gtgcattcccacgtgcagtg

SEQ ID NO: 11739 - DNA, 20 bp, Artificial Sequence
  Description of Artificial Sequence: Synthetic oligonucleotide
agtgcattcccacgtgcagt

SEQ ID NO: 11740 - DNA, 20 bp, Artificial Sequence
  Description of Artificial Sequence: Synthetic oligonucleotide
cagtgcattcccacgtgcag

SEQ ID NO: 11741 - DNA, 20 bp, Artificial Sequence
  Description of Artificial Sequence: Synthetic oligonucleotide
tcagtgcattcccacgtgca

SEQ ID NO: 11742 - DNA, 20 bp, Artificial Sequence
  Description of Artificial Sequence: Synthetic oligonucleotide
atcagtgcattcccacgtgc

SEQ ID NO: 11743 - DNA, 20 bp, Artificial Sequence
  Description of Artificial Sequence: Synthetic oligonucleotide
aatcagtgcattcccacgtg

SEQ ID NO: 11744 - DNA, 20 bp, Artificial Sequence
  Description of Artificial Sequence: Synthetic oligonucleotide
aaatcagtgcattcccacgt

SEQ ID NO: 11745 - DNA, 20 bp, Artificial Sequence
  Description of Artificial Sequence: Synthetic oligonucleotide
aaaatcagtgcattcccacg

SEQ ID NO: 11746 - DNA, 20 bp, Artificial Sequence
  Description of Artificial Sequence: Synthetic oligonucleotide
aaaaatcagtgcattcccac

SEQ ID NO: 11747 - DNA, 20 bp, Artificial Sequence
  Description of Artificial Sequence: Synthetic oligonucleotide
gaaaaatcagtgcattccca

SEQ ID NO: 11748 - DNA, 20 bp, Artificial Sequence
  Description of Artificial Sequence: Synthetic oligonucleotide
ggaaaaatcagtgcattccc

SEQ ID NO: 11749 - DNA, 20 bp, Artificial Sequence
  Description of Artificial Sequence: Synthetic oligonucleotide
aggaaaaatcagtgcattcc

SEQ ID NO: 11750 - DNA, 20 bp, Artificial Sequence
  Description of Artificial Sequence: Synthetic oligonucleotide
taggaaaaatcagtgcattc

SEQ ID NO: 11751 - DNA, 20 bp, Artificial Sequence
  Description of Artificial Sequence: Synthetic oligonucleotide
ctaggaaaaatcagtgcatt

SEQ ID NO: 11752 - DNA, 20 bp, Artificial Sequence
  Description of Artificial Sequence: Synthetic oligonucleotide
cctaggaaaaatcagtgcat

SEQ ID NO: 11753 - DNA, 20 bp, Artificial Sequence
  Description of Artificial Sequence: Synthetic oligonucleotide
tcctaggaaaaatcagtgca

SEQ ID NO: 11754 - DNA, 20 bp, Artificial Sequence
  Description of Artificial Sequence: Synthetic oligonucleotide
ctcctaggaaaaatcagtgc

SEQ ID NO: 11755 - DNA, 20 bp, Artificial Sequence
  Description of Artificial Sequence: Synthetic oligonucleotide
actcctaggaaaaatcagtg

SEQ ID NO: 11756 - DNA, 20 bp, Artificial Sequence
  Description of Artificial Sequence: Synthetic oligonucleotide
tactcctaggaaaaatcagt

SEQ ID NO: 11757 - DNA, 20 bp, Artificial Sequence
  Description of Artificial Sequence: Synthetic oligonucleotide
ctactcctaggaaaaatcag

SEQ ID NO: 11758 - DNA, 20 bp, Artificial Sequence
  Description of Artificial Sequence: Synthetic oligonucleotide
tctactcctaggaaaaatca

SEQ ID NO: 11759 - DNA, 20 bp, Artificial Sequence
  Description of Artificial Sequence: Synthetic oligonucleotide
gtctactcctaggaaaaatc

SEQ ID NO: 11760 - DNA, 20 bp, Artificial Sequence
  Description of Artificial Sequence: Synthetic oligonucleotide
tgtctactcctaggaaaaat

SEQ ID NO: 11761 - DNA, 20 bp, Artificial Sequence
  Description of Artificial Sequence: Synthetic oligonucleotide
atgtctactcctaggaaaaa

SEQ ID NO: 11762 - DNA, 20 bp, Artificial Sequence
  Description of Artificial Sequence: Synthetic oligonucleotide
catgtctactcctaggaaaa

SEQ ID NO: 11763 - DNA, 20 bp, Artificial Sequence
  Description of Artificial Sequence: Synthetic oligonucleotide
acatgtctactcctaggaaa

SEQ ID NO: 11764 - DNA, 20 bp, Artificial Sequence
  Description of Artificial Sequence: Synthetic oligonucleotide
aacatgtctactcctaggaa

SEQ ID NO: 11765 - DNA, 20 bp, Artificial Sequence
  Description of Artificial Sequence: Synthetic oligonucleotide
gaacatgtctactcctagga

SEQ ID NO: 11766 - DNA, 20 bp, Artificial Sequence
  Description of Artificial Sequence: Synthetic oligonucleotide
ggaacatgtctactcctagg

SEQ ID NO: 11767 - DNA, 20 bp, Artificial Sequence
  Description of Artificial Sequence: Synthetic oligonucleotide
aggaacatgtctactcctag

SEQ ID NO: 11768 - DNA, 20 bp, Artificial Sequence
  Description of Artificial Sequence: Synthetic oligonucleotide
gaggaacatgtctactccta

SEQ ID NO: 11769 - DNA, 20 bp, Artificial Sequence
  Description of Artificial Sequence: Synthetic oligonucleotide
agaggaacatgtctactcct

SEQ ID NO: 11770 - DNA, 20 bp, Artificial Sequence
  Description of Artificial Sequence: Synthetic oligonucleotide
tagaggaacatgtctactcc

SEQ ID NO: 11771 - DNA, 20 bp, Artificial Sequence
  Description of Artificial Sequence: Synthetic oligonucleotide
ttagaggaacatgtctactc

SEQ ID NO: 11772 - DNA, 20 bp, Artificial Sequence
  Description of Artificial Sequence: Synthetic oligonucleotide
attagaggaacatgtctact

SEQ ID NO: 11773 - DNA, 20 bp, Artificial Sequence
  Description of Artificial Sequence: Synthetic oligonucleotide
aattagaggaacatgtctac

SEQ ID NO: 11774 - DNA, 20 bp, Artificial Sequence
  Description of Artificial Sequence: Synthetic oligonucleotide
taattagaggaacatgtcta

SEQ ID NO: 11775 - DNA, 20 bp, Artificial Sequence
  Description of Artificial Sequence: Synthetic oligonucleotide
gtaattagaggaacatgtct

SEQ ID NO: 11776 - DNA, 20 bp, Artificial Sequence
  Description of Artificial Sequence: Synthetic oligonucleotide
agtaattagaggaacatgtc

SEQ ID NO: 11777 - DNA, 20 bp, Artificial Sequence
  Description of Artificial Sequence: Synthetic oligonucleotide
gagtaattagaggaacatgt

SEQ ID NO: 11778 - DNA, 20 bp, Artificial Sequence
  Description of Artificial Sequence: Synthetic oligonucleotide
ggagtaattagaggaacatg

SEQ ID NO: 11779 - DNA, 20 bp, Artificial Sequence
  Description of Artificial Sequence: Synthetic oligonucleotide
gggagtaattagaggaacat

SEQ ID NO: 11780 - DNA, 20 bp, Artificial Sequence
  Description of Artificial Sequence: Synthetic oligonucleotide
agggagtaattagaggaaca

SEQ ID NO: 11781 - DNA, 20 bp, Artificial Sequence
  Description of Artificial Sequence: Synthetic oligonucleotide
cagggagtaattagaggaac

SEQ ID NO: 11782 - DNA, 20 bp, Artificial Sequence
  Description of Artificial Sequence: Synthetic oligonucleotide
tcagggagtaattagaggaa

SEQ ID NO: 11783 - DNA, 20 bp, Artificial Sequence
  Description of Artificial Sequence: Synthetic oligonucleotide
ctcagggagtaattagagga

SEQ ID NO: 11784 - DNA, 20 bp, Artificial Sequence
  Description of Artificial Sequence: Synthetic oligonucleotide
cctcagggagtaattagagg

SEQ ID NO: 11785 - DNA, 20 bp, Artificial Sequence
  Description of Artificial Sequence: Synthetic oligonucleotide
ccctcagggagtaattagag

SEQ ID NO: 11786 - DNA, 20 bp, Artificial Sequence
  Description of Artificial Sequence: Synthetic oligonucleotide
accctcagggagtaattaga

SEQ ID NO: 11787 - DNA, 20 bp, Artificial Sequence
  Description of Artificial Sequence: Synthetic oligonucleotide
aaccctcagggagtaattag

SEQ ID NO: 11788 - DNA, 20 bp, Artificial Sequence
  Description of Artificial Sequence: Synthetic oligonucleotide
taaccctcagggagtaatta

SEQ ID NO: 11789 - DNA, 20 bp, Artificial Sequence
  Description of Artificial Sequence: Synthetic oligonucleotide
ctaaccctcagggagtaatt

SEQ ID NO: 11790 - DNA, 20 bp, Artificial Sequence
  Description of Artificial Sequence: Synthetic oligonucleotide
actaaccctcagggagtaat

SEQ ID NO: 11791 - DNA, 20 bp, Artificial Sequence
  Description of Artificial Sequence: Synthetic oligonucleotide
aactaaccctcagggagtaa

SEQ ID NO: 11792 - DNA, 20 bp, Artificial Sequence
  Description of Artificial Sequence: Synthetic oligonucleotide
caactaaccctcagggagta

SEQ ID NO: 11793 - DNA, 20 bp, Artificial Sequence
  Description of Artificial Sequence: Synthetic oligonucleotide
ccaactaaccctcagggagt

SEQ ID NO: 11794 - DNA, 20 bp, Artificial Sequence
  Description of Artificial Sequence: Synthetic oligonucleotide
cccaactaaccctcagggag

SEQ ID NO: 11795 - DNA, 20 bp, Artificial Sequence
  Description of Artificial Sequence: Synthetic oligonucleotide
ccccaactaaccctcaggga

SEQ ID NO: 11796 - DNA, 20 bp, Artificial Sequence
  Description of Artificial Sequence: Synthetic oligonucleotide
gccccaactaaccctcaggg

SEQ ID NO: 11797 - DNA, 20 bp, Artificial Sequence
  Description of Artificial Sequence: Synthetic oligonucleotide
agccccaactaaccctcagg

SEQ ID NO: 11798 - DNA, 20 bp, Artificial Sequence
  Description of Artificial Sequence: Synthetic oligonucleotide
tagccccaactaaccctcag

SEQ ID NO: 11799 - DNA, 20 bp, Artificial Sequence
  Description of Artificial Sequence: Synthetic oligonucleotide
ttagccccaactaaccctca

SEQ ID NO: 11800 - DNA, 20 bp, Artificial Sequence
  Description of Artificial Sequence: Synthetic oligonucleotide
tttagccccaactaaccctc

SEQ ID NO: 11801 - DNA, 20 bp, Artificial Sequence
  Description of Artificial Sequence: Synthetic oligonucleotide
gtttagccccaactaaccct

SEQ ID NO: 11802 - DNA, 20 bp, Artificial Sequence
  Description of Artificial Sequence: Synthetic oligonucleotide
ggtttagccccaactaaccc

SEQ ID NO: 11803 - DNA, 20 bp, Artificial Sequence
  Description of Artificial Sequence: Synthetic oligonucleotide
tggtttagccccaactaacc

SEQ ID NO: 11804 - DNA, 20 bp, Artificial Sequence
  Description of Artificial Sequence: Synthetic oligonucleotide
atggtttagccccaactaac

SEQ ID NO: 11805 - DNA, 20 bp, Artificial Sequence
  Description of Artificial Sequence: Synthetic oligonucleotide
catggtttagccccaactaa

SEQ ID NO: 11806 - DNA, 20 bp, Artificial Sequence
  Description of Artificial Sequence: Synthetic oligonucleotide
tcatggtttagccccaacta

SEQ ID NO: 11807 - DNA, 20 bp, Artificial Sequence
  Description of Artificial Sequence: Synthetic oligonucleotide
gtcatggtttagccccaact

SEQ ID NO: 11808 - DNA, 20 bp, Artificial Sequence
  Description of Artificial Sequence: Synthetic oligonucleotide
tgtcatggtttagccccaac

SEQ ID NO: 11809 - DNA, 20 bp, Artificial Sequence
  Description of Artificial Sequence: Synthetic oligonucleotide
ctgtcatggtttagccccaa

SEQ ID NO: 11810 - DNA, 20 bp, Artificial Sequence
  Description of Artificial Sequence: Synthetic oligonucleotide
tctgtcatggtttagcccca

SEQ ID NO: 11811 - DNA, 20 bp, Artificial Sequence
  Description of Artificial Sequence: Synthetic oligonucleotide
ttctgtcatggtttagcccc

SEQ ID NO: 11812 - DNA, 20 bp, Artificial Sequence
  Description of Artificial Sequence: Synthetic oligonucleotide
cttctgtcatggtttagccc

SEQ ID NO: 11813 - DNA, 20 bp, Artificial Sequence
  Description of Artificial Sequence: Synthetic oligonucleotide
acttctgtcatggtttagcc

SEQ ID NO: 11814 - DNA, 20 bp, Artificial Sequence
  Description of Artificial Sequence: Synthetic oligonucleotide
cacttctgtcatggtttagc

SEQ ID NO: 11815 - DNA, 20 bp, Artificial Sequence
  Description of Artificial Sequence: Synthetic oligonucleotide
ccacttctgtcatggtttag

SEQ ID NO: 11816 - DNA, 20 bp, Artificial Sequence
  Description of Artificial Sequence: Synthetic oligonucleotide
cccacttctgtcatggttta

SEQ ID NO: 11817 - DNA, 20 bp, Artificial Sequence
  Description of Artificial Sequence: Synthetic oligonucleotide
ccccacttctgtcatggttt

SEQ ID NO: 11818 - DNA, 20 bp, Artificial Sequence
  Description of Artificial Sequence: Synthetic oligonucleotide
tccccacttctgtcatggtt

SEQ ID NO: 11819 - DNA, 20 bp, Artificial Sequence
  Description of Artificial Sequence: Synthetic oligonucleotide
ttccccacttctgtcatggt

SEQ ID NO: 11820 - DNA, 20 bp, Artificial Sequence
  Description of Artificial Sequence: Synthetic oligonucleotide
cttccccacttctgtcatgg

SEQ ID NO: 11821 - DNA, 20 bp, Artificial Sequence
  Description of Artificial Sequence: Synthetic oligonucleotide
acttccccacttctgtcatg

SEQ ID NO: 11822 - DNA, 20 bp, Artificial Sequence
  Description of Artificial Sequence: Synthetic oligonucleotide
aacttccccacttctgtcat

SEQ ID NO: 11823 - DNA, 20 bp, Artificial Sequence
  Description of Artificial Sequence: Synthetic oligonucleotide
gaacttccccacttctgtca

SEQ ID NO: 11824 - DNA, 20 bp, Artificial Sequence
  Description of Artificial Sequence: Synthetic oligonucleotide
tgaacttccccacttctgtc

SEQ ID NO: 11825 - DNA, 20 bp, Artificial Sequence
  Description of Artificial Sequence: Synthetic oligonucleotide
ttgaacttccccacttctgt

SEQ ID NO: 11826 - DNA, 20 bp, Artificial Sequence
  Description of Artificial Sequence: Synthetic oligonucleotide
attgaacttccccacttctg

SEQ ID NO: 11827 - DNA, 20 bp, Artificial Sequence
  Description of Artificial Sequence: Synthetic oligonucleotide
cattgaacttccccacttct

SEQ ID NO: 11828 - DNA, 20 bp, Artificial Sequence
  Description of Artificial Sequence: Synthetic oligonucleotide
acattgaacttccccacttc

SEQ ID NO: 11829 - DNA, 20 bp, Artificial Sequence
  Description of Artificial Sequence: Synthetic oligonucleotide
gacattgaacttccccactt

SEQ ID NO: 11830 - DNA, 20 bp, Artificial Sequence
  Description of Artificial Sequence: Synthetic oligonucleotide
ggacattgaacttccccact

SEQ ID NO: 11831 - DNA, 20 bp, Artificial Sequence
  Description of Artificial Sequence: Synthetic oligonucleotide
aggacattgaacttccccac

SEQ ID NO: 11832 - DNA, 20 bp, Artificial Sequence
  Description of Artificial Sequence: Synthetic oligonucleotide
aaggacattgaacttcccca

SEQ ID NO: 11833 - DNA, 20 bp, Artificial Sequence
  Description of Artificial Sequence: Synthetic oligonucleotide
taaggacattgaacttcccc

SEQ ID NO: 11834 - DNA, 20 bp, Artificial Sequence
  Description of Artificial Sequence: Synthetic oligonucleotide
ttaaggacattgaacttccc

SEQ ID NO: 11835 - DNA, 20 bp, Artificial Sequence
  Description of Artificial Sequence: Synthetic oligonucleotide
tttaaggacattgaacttcc

SEQ ID NO: 11836 - DNA, 20 bp, Artificial Sequence
  Description of Artificial Sequence: Synthetic oligonucleotide
atttaaggacattgaacttc

SEQ ID NO: 11837 - DNA, 20 bp, Artificial Sequence
  Description of Artificial Sequence: Synthetic oligonucleotide
gatttaaggacattgaactt

SEQ ID NO: 11838 - DNA, 20 bp, Artificial Sequence
  Description of Artificial Sequence: Synthetic oligonucleotide
ggatttaaggacattgaact

SEQ ID NO: 11839 - DNA, 20 bp, Artificial Sequence
  Description of Artificial Sequence: Synthetic oligonucleotide
tggatttaaggacattgaac

SEQ ID NO: 11840 - DNA, 20 bp, Artificial Sequence
  Description of Artificial Sequence: Synthetic oligonucleotide
atggatttaaggacattgaa

SEQ ID NO: 11841 - DNA, 20 bp, Artificial Sequence
  Description of Artificial Sequence: Synthetic oligonucleotide
gatggatttaaggacattga

SEQ ID NO: 11842 - DNA, 20 bp, Artificial Sequence
  Description of Artificial Sequence: Synthetic oligonucleotide
agatggatttaaggacattg

SEQ ID NO: 11843 - DNA, 20 bp, Artificial Sequence
  Description of Artificial Sequence: Synthetic oligonucleotide
aagatggatttaaggacatt

SEQ ID NO: 11844 - DNA, 20 bp, Artificial Sequence
  Description of Artificial Sequence: Synthetic oligonucleotide
taagatggatttaaggacat

SEQ ID NO: 11845 - DNA, 20 bp, Artificial Sequence
  Description of Artificial Sequence: Synthetic oligonucleotide
gtaagatggatttaaggaca

SEQ ID NO: 11846 - DNA, 20 bp, Artificial Sequence
  Description of Artificial Sequence: Synthetic oligonucleotide
agtaagatggatttaaggac

SEQ ID NO: 11847 - DNA, 20 bp, Artificial Sequence
  Description of Artificial Sequence: Synthetic oligonucleotide
aagtaagatggatttaagga

SEQ ID NO: 11848 - DNA, 20 bp, Artificial Sequence
  Description of Artificial Sequence: Synthetic oligonucleotide
caagtaagatggatttaagg

SEQ ID NO: 11849 - DNA, 20 bp, Artificial Sequence
  Description of Artificial Sequence: Synthetic oligonucleotide
gcaagtaagatggatttaag

SEQ ID NO: 11850 - DNA, 20 bp, Artificial Sequence
  Description of Artificial Sequence: Synthetic oligonucleotide
ggcaagtaagatggatttaa

SEQ ID NO: 11851 - DNA, 20 bp, Artificial Sequence
  Description of Artificial Sequence: Synthetic oligonucleotide
tggcaagtaagatggattta

SEQ ID NO: 11852 - DNA, 20 bp, Artificial Sequence
  Description of Artificial Sequence: Synthetic oligonucleotide
ttggcaagtaagatggattt

SEQ ID NO: 11853 - DNA, 20 bp, Artificial Sequence
  Description of Artificial Sequence: Synthetic oligonucleotide
gttggcaagtaagatggatt

SEQ ID NO: 11854 - DNA, 20 bp, Artificial Sequence
  Description of Artificial Sequence: Synthetic oligonucleotide
tgttggcaagtaagatggat

SEQ ID NO: 11855 - DNA, 20 bp, Artificial Sequence
  Description of Artificial Sequence: Synthetic oligonucleotide
ctgttggcaagtaagatgga

SEQ ID NO: 11856 - DNA, 20 bp, Artificial Sequence
  Description of Artificial Sequence: Synthetic oligonucleotide
cctgttggcaagtaagatgg

SEQ ID NO: 11857 - DNA, 20 bp, Artificial Sequence
  Description of Artificial Sequence: Synthetic oligonucleotide
acctgttggcaagtaagatg

SEQ ID NO: 11858 - DNA, 20 bp, Artificial Sequence
  Description of Artificial Sequence: Synthetic oligonucleotide
tacctgttggcaagtaagat

SEQ ID NO: 11859 - DNA, 20 bp, Artificial Sequence
  Description of Artificial Sequence: Synthetic oligonucleotide
ttacctgttggcaagtaaga

SEQ ID NO: 11860 - DNA, 20 bp, Artificial Sequence
  Description of Artificial Sequence: Synthetic oligonucleotide
cttacctgttggcaagtaag

SEQ ID NO: 11861 - DNA, 20 bp, Artificial Sequence
  Description of Artificial Sequence: Synthetic oligonucleotide
tcttacctgttggcaagtaa

SEQ ID NO: 11862 - DNA, 20 bp, Artificial Sequence
  Description of Artificial Sequence: Synthetic oligonucleotide
ctcttacctgttggcaagta

SEQ ID NO: 11863 - DNA, 20 bp, Artificial Sequence
  Description of Artificial Sequence: Synthetic oligonucleotide
cctcttacctgttggcaagt

SEQ ID NO: 11864 - DNA, 20 bp, Artificial Sequence
  Description of Artificial Sequence: Synthetic oligonucleotide
tcctcttacctgttggcaag

SEQ ID NO: 11865 - DNA, 20 bp, Artificial Sequence
  Description of Artificial Sequence: Synthetic oligonucleotide
ttcctcttacctgttggcaa

SEQ ID NO: 11866 - DNA, 20 bp, Artificial Sequence
  Description of Artificial Sequence: Synthetic oligonucleotide
cttcctcttacctgttggca

SEQ ID NO: 11867 - DNA, 20 bp, Artificial Sequence
  Description of Artificial Sequence: Synthetic oligonucleotide
gcttcctcttacctgttggc

SEQ ID NO: 11868 - DNA, 20 bp, Artificial Sequence
  Description of Artificial Sequence: Synthetic oligonucleotide
agcttcctcttacctgttgg

SEQ ID NO: 11869 - DNA, 20 bp, Artificial Sequence
  Description of Artificial Sequence: Synthetic oligonucleotide
aagcttcctcttacctgttg

SEQ ID NO: 11870 - DNA, 20 bp, Artificial Sequence
  Description of Artificial Sequence: Synthetic oligonucleotide
taagcttcctcttacctgtt

SEQ ID NO: 11871 - DNA, 20 bp, Artificial Sequence
  Description of Artificial Sequence: Synthetic oligonucleotide
gtaagcttcctcttacctgt

SEQ ID NO: 11872 - DNA, 20 bp, Artificial Sequence
  Description of Artificial Sequence: Synthetic oligonucleotide
tgtaagcttcctcttacctg

SEQ ID NO: 11873 - DNA, 20 bp, Artificial Sequence
  Description of Artificial Sequence: Synthetic oligonucleotide
atgtaagcttcctcttacct

SEQ ID NO: 11874 - DNA, 20 bp, Artificial Sequence
  Description of Artificial Sequence: Synthetic oligonucleotide
aatgtaagcttcctcttacc

SEQ ID NO: 11875 - DNA, 20 bp, Artificial Sequence
  Description of Artificial Sequence: Synthetic oligonucleotide
taatgtaagcttcctcttac

SEQ ID NO: 11876 - DNA, 20 bp, Artificial Sequence
  Description of Artificial Sequence: Synthetic oligonucleotide
gtaatgtaagcttcctctta

SEQ ID NO: 11877 - DNA, 20 bp, Artificial Sequence
  Description of Artificial Sequence: Synthetic oligonucleotide
tgtaatgtaagcttcctctt

SEQ ID NO: 11878 - DNA, 20 bp, Artificial Sequence
  Description of Artificial Sequence: Synthetic oligonucleotide
atgtaatgtaagcttcctct

SEQ ID NO: 11879 - DNA, 20 bp, Artificial Sequence
  Description of Artificial Sequence: Synthetic oligonucleotide
catgtaatgtaagcttcctc

SEQ ID NO: 11880 - DNA, 20 bp, Artificial Sequence
  Description of Artificial Sequence: Synthetic oligonucleotide
acatgtaatgtaagcttcct

SEQ ID NO: 11881 - DNA, 20 bp, Artificial Sequence
  Description of Artificial Sequence: Synthetic oligonucleotide
gacatgtaatgtaagcttcc

SEQ ID NO: 11882 - DNA, 20 bp, Artificial Sequence
  Description of Artificial Sequence: Synthetic oligonucleotide
ggacatgtaatgtaagcttc

SEQ ID NO: 11883 - DNA, 20 bp, Artificial Sequence
  Description of Artificial Sequence: Synthetic oligonucleotide
tggacatgtaatgtaagctt

SEQ ID NO: 11884 - DNA, 20 bp, Artificial Sequence
  Description of Artificial Sequence: Synthetic oligonucleotide
ctggacatgtaatgtaagct

SEQ ID NO: 11885 - DNA, 20 bp, Artificial Sequence
  Description of Artificial Sequence: Synthetic oligonucleotide
actggacatgtaatgtaagc

SEQ ID NO: 11886 - DNA, 20 bp, Artificial Sequence
  Description of Artificial Sequence: Synthetic oligonucleotide
gactggacatgtaatgtaag

SEQ ID NO: 11887 - DNA, 20 bp, Artificial Sequence
  Description of Artificial Sequence: Synthetic oligonucleotide
ggactggacatgtaatgtaa

SEQ ID NO: 11888 - DNA, 20 bp, Artificial Sequence
  Description of Artificial Sequence: Synthetic oligonucleotide
tggactggacatgtaatgta

SEQ ID NO: 11889 - DNA, 20 bp, Artificial Sequence
  Description of Artificial Sequence: Synthetic oligonucleotide
gtggactggacatgtaatgt

SEQ ID NO: 11890 - DNA, 20 bp, Artificial Sequence
  Description of Artificial Sequence: Synthetic oligonucleotide
tgtggactggacatgtaatg

SEQ ID NO: 11891 - DNA, 20 bp, Artificial Sequence
  Description of Artificial Sequence: Synthetic oligonucleotide
atgtggactggacatgtaat

SEQ ID NO: 11892 - DNA, 20 bp, Artificial Sequence
  Description of Artificial Sequence: Synthetic oligonucleotide
aatgtggactggacatgtaa

SEQ ID NO: 11893 - DNA, 20 bp, Artificial Sequence
  Description of Artificial Sequence: Synthetic oligonucleotide
aaatgtggactggacatgta

SEQ ID NO: 11894 - DNA, 20 bp, Artificial Sequence
  Description of Artificial Sequence: Synthetic oligonucleotide
taaatgtggactggacatgt

SEQ ID NO: 11895 - DNA, 20 bp, Artificial Sequence
  Description of Artificial Sequence: Synthetic oligonucleotide
ttaaatgtggactggacatg

SEQ ID NO: 11896 - DNA, 20 bp, Artificial Sequence
  Description of Artificial Sequence: Synthetic oligonucleotide
tttaaatgtggactggacat

SEQ ID NO: 11897 - DNA, 20 bp, Artificial Sequence
  Description of Artificial Sequence: Synthetic oligonucleotide
ctttaaatgtggactggaca

SEQ ID NO: 11898 - DNA, 20 bp, Artificial Sequence
  Description of Artificial Sequence: Synthetic oligonucleotide
tctttaaatgtggactggac

SEQ ID NO: 11899 - DNA, 20 bp, Artificial Sequence
  Description of Artificial Sequence: Synthetic oligonucleotide
ctctttaaatgtggactgga

SEQ ID NO: 11900 - DNA, 20 bp, Artificial Sequence
  Description of Artificial Sequence: Synthetic oligonucleotide
gctctttaaatgtggactgg

SEQ ID NO: 11901 - DNA, 20 bp, Artificial Sequence
  Description of Artificial Sequence: Synthetic oligonucleotide
tgctctttaaatgtggactg

SEQ ID NO: 11902 - DNA, 20 bp, Artificial Sequence
  Description of Artificial Sequence: Synthetic oligonucleotide
gtgctctttaaatgtggact

SEQ ID NO: 11903 - DNA, 20 bp, Artificial Sequence
  Description of Artificial Sequence: Synthetic oligonucleotide
agtgctctttaaatgtggac

SEQ ID NO: 11904 - DNA, 20 bp, Artificial Sequence
  Description of Artificial Sequence: Synthetic oligonucleotide
aagtgctctttaaatgtgga

SEQ ID NO: 11905 - DNA, 20 bp, Artificial Sequence
  Description of Artificial Sequence: Synthetic oligonucleotide
taagtgctctttaaatgtgg

SEQ ID NO: 11906 - DNA, 20 bp, Artificial Sequence
  Description of Artificial Sequence: Synthetic oligonucleotide
gtaagtgctctttaaatgtg

SEQ ID NO: 11907 - DNA, 20 bp, Artificial Sequence
  Description of Artificial Sequence: Synthetic oligonucleotide
agtaagtgctctttaaatgt

SEQ ID NO: 11908 - DNA, 20 bp, Artificial Sequence
  Description of Artificial Sequence: Synthetic oligonucleotide
cagtaagtgctctttaaatg

SEQ ID NO: 11909 - DNA, 20 bp, Artificial Sequence
  Description of Artificial Sequence: Synthetic oligonucleotide
acagtaagtgctctttaaat

SEQ ID NO: 11910 - DNA, 20 bp, Artificial Sequence
  Description of Artificial Sequence: Synthetic oligonucleotide
cacagtaagtgctctttaaa

SEQ ID NO: 11911 - DNA, 20 bp, Artificial Sequence
  Description of Artificial Sequence: Synthetic oligonucleotide
ccacagtaagtgctctttaa

SEQ ID NO: 11912 - DNA, 20 bp, Artificial Sequence
  Description of Artificial Sequence: Synthetic oligonucleotide
tccacagtaagtgctcttta

SEQ ID NO: 11913 - DNA, 20 bp, Artificial Sequence
  Description of Artificial Sequence: Synthetic oligonucleotide
ttccacagtaagtgctcttt

SEQ ID NO: 11914 - DNA, 20 bp, Artificial Sequence
  Description of Artificial Sequence: Synthetic oligonucleotide
gttccacagtaagtgctctt

SEQ ID NO: 11915 - DNA, 20 bp, Artificial Sequence
  Description of Artificial Sequence: Synthetic oligonucleotide
tgttccacagtaagtgctct

SEQ ID NO: 11916 - DNA, 20 bp, Artificial Sequence
  Description of Artificial Sequence: Synthetic oligonucleotide
ttgttccacagtaagtgctc

SEQ ID NO: 11917 - DNA, 20 bp, Artificial Sequence
  Description of Artificial Sequence: Synthetic oligonucleotide
cttgttccacagtaagtgct

SEQ ID NO: 11918 - DNA, 20 bp, Artificial Sequence
  Description of Artificial Sequence: Synthetic oligonucleotide
gcttgttccacagtaagtgc

SEQ ID NO: 11919 - DNA, 20 bp, Artificial Sequence
  Description of Artificial Sequence: Synthetic oligonucleotide
ggcttgttccacagtaagtg

SEQ ID NO: 11920 - DNA, 20 bp, Artificial Sequence
  Description of Artificial Sequence: Synthetic oligonucleotide
aggcttgttccacagtaagt

SEQ ID NO: 11921 - DNA, 20 bp, Artificial Sequence
  Description of Artificial Sequence: Synthetic oligonucleotide
aaggcttgttccacagtaag

SEQ ID NO: 11922 - DNA, 20 bp, Artificial Sequence
  Description of Artificial Sequence: Synthetic oligonucleotide
gaaggcttgttccacagtaa

SEQ ID NO: 11923 - DNA, 20 bp, Artificial Sequence
  Description of Artificial Sequence: Synthetic oligonucleotide
tgaaggcttgttccacagta

SEQ ID NO: 11924 - DNA, 20 bp, Artificial Sequence
  Description of Artificial Sequence: Synthetic oligonucleotide
ctgaaggcttgttccacagt

SEQ ID NO: 11925 - DNA, 20 bp, Artificial Sequence
  Description of Artificial Sequence: Synthetic oligonucleotide
gctgaaggcttgttccacag

SEQ ID NO: 11926 - DNA, 20 bp, Artificial Sequence
  Description of Artificial Sequence: Synthetic oligonucleotide
ggctgaaggcttgttccaca

SEQ ID NO: 11927 - DNA, 20 bp, Artificial Sequence
  Description of Artificial Sequence: Synthetic oligonucleotide
tggctgaaggcttgttccac

SEQ ID NO: 11928 - DNA, 20 bp, Artificial Sequence
  Description of Artificial Sequence: Synthetic oligonucleotide
ttggctgaaggcttgttcca

SEQ ID NO: 11929 - DNA, 20 bp, Artificial Sequence
  Description of Artificial Sequence: Synthetic oligonucleotide
tttggctgaaggcttgttcc

SEQ ID NO: 11930 - DNA, 20 bp, Artificial Sequence
  Description of Artificial Sequence: Synthetic oligonucleotide
gtttggctgaaggcttgttc

SEQ ID NO: 11931 - DNA, 20 bp, Artificial Sequence
  Description of Artificial Sequence: Synthetic oligonucleotide
tgtttggctgaaggcttgtt

SEQ ID NO: 11932 - DNA, 20 bp, Artificial Sequence
  Description of Artificial Sequence: Synthetic oligonucleotide
ttgtttggctgaaggcttgt

SEQ ID NO: 11933 - DNA, 20 bp, Artificial Sequence
  Description of Artificial Sequence: Synthetic oligonucleotide
attgtttggctgaaggcttg

SEQ ID NO: 11934 - DNA, 20 bp, Artificial Sequence
  Description of Artificial Sequence: Synthetic oligonucleotide
cattgtttggctgaaggctt

SEQ ID NO: 11935 - DNA, 20 bp, Artificial Sequence
  Description of Artificial Sequence: Synthetic oligonucleotide
ccattgtttggctgaaggct

SEQ ID NO: 11936 - DNA, 20 bp, Artificial Sequence
  Description of Artificial Sequence: Synthetic oligonucleotide
cccattgtttggctgaaggc

SEQ ID NO: 11937 - DNA, 20 bp, Artificial Sequence
  Description of Artificial Sequence: Synthetic oligonucleotide
ccccattgtttggctgaagg

SEQ ID NO: 11938 - DNA, 20 bp, Artificial Sequence
  Description of Artificial Sequence: Synthetic oligonucleotide
tccccattgtttggctgaag

SEQ ID NO: 11939 - DNA, 20 bp, Artificial Sequence
  Description of Artificial Sequence: Synthetic oligonucleotide
atccccattgtttggctgaa

SEQ ID NO: 11940 - DNA, 20 bp, Artificial Sequence
  Description of Artificial Sequence: Synthetic oligonucleotide
tatccccattgtttggctga

SEQ ID NO: 11941 - DNA, 20 bp, Artificial Sequence
  Description of Artificial Sequence: Synthetic oligonucleotide
ctatccccattgtttggctg

SEQ ID NO: 11942 - DNA, 20 bp, Artificial Sequence
  Description of Artificial Sequence: Synthetic oligonucleotide
tctatccccattgtttggct

SEQ ID NO: 11943 - DNA, 20 bp, Artificial Sequence
  Description of Artificial Sequence: Synthetic oligonucleotide
ttctatccccattgtttggc

SEQ ID NO: 11944 - DNA, 20 bp, Artificial Sequence
  Description of Artificial Sequence: Synthetic oligonucleotide
tttctatccccattgtttgg

SEQ ID NO: 11945 - DNA, 20 bp, Artificial Sequence
  Description of Artificial Sequence: Synthetic oligonucleotide
ttttctatccccattgtttg

SEQ ID NO: 11946 - DNA, 20 bp, Artificial Sequence
  Description of Artificial Sequence: Synthetic oligonucleotide
cttttctatccccattgttt

SEQ ID NO: 11947 - DNA, 20 bp, Artificial Sequence
  Description of Artificial Sequence: Synthetic oligonucleotide
acttttctatccccattgtt

SEQ ID NO: 11948 - DNA, 20 bp, Artificial Sequence
  Description of Artificial Sequence: Synthetic oligonucleotide
tacttttctatccccattgt

SEQ ID NO: 11949 - DNA, 20 bp, Artificial Sequence
  Description of Artificial Sequence: Synthetic oligonucleotide
ctacttttctatccccattg

SEQ ID NO: 11950 - DNA, 20 bp, Artificial Sequence
  Description of Artificial Sequence: Synthetic oligonucleotide
cctacttttctatccccatt

SEQ ID NO: 11951 - DNA, 20 bp, Artificial Sequence
  Description of Artificial Sequence: Synthetic oligonucleotide
acctacttttctatccccat

SEQ ID NO: 11952 - DNA, 20 bp, Artificial Sequence
  Description of Artificial Sequence: Synthetic oligonucleotide
tacctacttttctatcccca

SEQ ID NO: 11953 - DNA, 20 bp, Artificial Sequence
  Description of Artificial Sequence: Synthetic oligonucleotide
ttacctacttttctatcccc

SEQ ID NO: 11954 - DNA, 20 bp, Artificial Sequence
  Description of Artificial Sequence: Synthetic oligonucleotide
cttacctacttttctatccc

SEQ ID NO: 11955 - DNA, 20 bp, Artificial Sequence
  Description of Artificial Sequence: Synthetic oligonucleotide
tcttacctacttttctatcc

SEQ ID NO: 11956 - DNA, 20 bp, Artificial Sequence
  Description of Artificial Sequence: Synthetic oligonucleotide
gtcttacctacttttctatc

SEQ ID NO: 11957 - DNA, 20 bp, Artificial Sequence
  Description of Artificial Sequence: Synthetic oligonucleotide
agtcttacctacttttctat

SEQ ID NO: 11958 - DNA, 20 bp, Artificial Sequence
  Description of Artificial Sequence: Synthetic oligonucleotide
gagtcttacctacttttcta

SEQ ID NO: 11959 - DNA, 20 bp, Artificial Sequence
  Description of Artificial Sequence: Synthetic oligonucleotide
tgagtcttacctacttttct

SEQ ID NO: 11960 - DNA, 20 bp, Artificial Sequence
  Description of Artificial Sequence: Synthetic oligonucleotide
ctgagtcttacctacttttc

SEQ ID NO: 11961 - DNA, 20 bp, Artificial Sequence
  Description of Artificial Sequence: Synthetic oligonucleotide
gctgagtcttacctactttt

SEQ ID NO: 11962 - DNA, 20 bp, Artificial Sequence
  Description of Artificial Sequence: Synthetic oligonucleotide
ggctgagtcttacctacttt

SEQ ID NO: 11963 - DNA, 20 bp, Artificial Sequence
  Description of Artificial Sequence: Synthetic oligonucleotide
aggctgagtcttacctactt

SEQ ID NO: 11964 - DNA, 20 bp, Artificial Sequence
  Description of Artificial Sequence: Synthetic oligonucleotide
aaggctgagtcttacctact

SEQ ID NO: 11965 - DNA, 20 bp, Artificial Sequence
  Description of Artificial Sequence: Synthetic oligonucleotide
aaaggctgagtcttacctac

SEQ ID NO: 11966 - DNA, 20 bp, Artificial Sequence
  Description of Artificial Sequence: Synthetic oligonucleotide
caaaggctgagtcttaccta

SEQ ID NO: 11967 - DNA, 20 bp, Artificial Sequence
  Description of Artificial Sequence: Synthetic oligonucleotide
acaaaggctgagtcttacct

SEQ ID NO: 11968 - DNA, 20 bp, Artificial Sequence
  Description of Artificial Sequence: Synthetic oligonucleotide
gacaaaggctgagtcttacc

SEQ ID NO: 11969 - DNA, 20 bp, Artificial Sequence
  Description of Artificial Sequence: Synthetic oligonucleotide
ggacaaaggctgagtcttac

SEQ ID NO: 11970 - DNA, 20 bp, Artificial Sequence
  Description of Artificial Sequence: Synthetic oligonucleotide
tggacaaaggctgagtctta

SEQ ID NO: 11971 - DNA, 20 bp, Artificial Sequence
  Description of Artificial Sequence: Synthetic oligonucleotide
ctggacaaaggctgagtctt

SEQ ID NO: 11972 - DNA, 20 bp, Artificial Sequence
  Description of Artificial Sequence: Synthetic oligonucleotide
tctggacaaaggctgagtct

SEQ ID NO: 11973 - DNA, 20 bp, Artificial Sequence
  Description of Artificial Sequence: Synthetic oligonucleotide
ctctggacaaaggctgagtc

SEQ ID NO: 11974 - DNA, 20 bp, Artificial Sequence
  Description of Artificial Sequence: Synthetic oligonucleotide
tctctggacaaaggctgagt

SEQ ID NO: 11975 - DNA, 20 bp, Artificial Sequence
  Description of Artificial Sequence: Synthetic oligonucleotide
ttctctggacaaaggctgag

SEQ ID NO: 11976 - DNA, 20 bp, Artificial Sequence
  Description of Artificial Sequence: Synthetic oligonucleotide
cttctctggacaaaggctga

SEQ ID NO: 11977 - DNA, 20 bp, Artificial Sequence
  Description of Artificial Sequence: Synthetic oligonucleotide
gcttctctggacaaaggctg

SEQ ID NO: 11978 - DNA, 20 bp, Artificial Sequence
  Description of Artificial Sequence: Synthetic oligonucleotide
agcttctctggacaaaggct

SEQ ID NO: 11979 - DNA, 20 bp, Artificial Sequence
  Description of Artificial Sequence: Synthetic oligonucleotide
gagcttctctggacaaaggc

SEQ ID NO: 11980 - DNA, 20 bp, Artificial Sequence
  Description of Artificial Sequence: Synthetic oligonucleotide
tgagcttctctggacaaagg

SEQ ID NO: 11981 - DNA, 20 bp, Artificial Sequence
  Description of Artificial Sequence: Synthetic oligonucleotide
ctgagcttctctggacaaag

SEQ ID NO: 11982 - DNA, 20 bp, Artificial Sequence
  Description of Artificial Sequence: Synthetic oligonucleotide
cctgagcttctctggacaaa

SEQ ID NO: 11983 - DNA, 20 bp, Artificial Sequence
  Description of Artificial Sequence: Synthetic oligonucleotide
ccctgagcttctctggacaa

SEQ ID NO: 11984 - DNA, 20 bp, Artificial Sequence
  Description of Artificial Sequence: Synthetic oligonucleotide
accctgagcttctctggaca

SEQ ID NO: 11985 - DNA, 20 bp, Artificial Sequence
  Description of Artificial Sequence: Synthetic oligonucleotide
taccctgagcttctctggac

SEQ ID NO: 11986 - DNA, 20 bp, Artificial Sequence
  Description of Artificial Sequence: Synthetic oligonucleotide
ataccctgagcttctctgga

SEQ ID NO: 11987 - DNA, 20 bp, Artificial Sequence
  Description of Artificial Sequence: Synthetic oligonucleotide
tataccctgagcttctctgg

SEQ ID NO: 11988 - DNA, 20 bp, Artificial Sequence
  Description of Artificial Sequence: Synthetic oligonucleotide
ctataccctgagcttctctg

SEQ ID NO: 11989 - DNA, 20 bp, Artificial Sequence
  Description of Artificial Sequence: Synthetic oligonucleotide
gctataccctgagcttctct

SEQ ID NO: 11990 - DNA, 20 bp, Artificial Sequence
  Description of Artificial Sequence: Synthetic oligonucleotide
agctataccctgagcttctc

SEQ ID NO: 11991 - DNA, 20 bp, Artificial Sequence
  Description of Artificial Sequence: Synthetic oligonucleotide
cagctataccctgagcttct

SEQ ID NO: 11992 - DNA, 20 bp, Artificial Sequence
  Description of Artificial Sequence: Synthetic oligonucleotide
tcagctataccctgagcttc

SEQ ID NO: 11993 - DNA, 20 bp, Artificial Sequence
  Description of Artificial Sequence: Synthetic oligonucleotide
ttcagctataccctgagctt

SEQ ID NO: 11994 - DNA, 20 bp, Artificial Sequence
  Description of Artificial Sequence: Synthetic oligonucleotide
attcagctataccctgagct

SEQ ID NO: 11995 - DNA, 20 bp, Artificial Sequence
  Description of Artificial Sequence: Synthetic oligonucleotide
tattcagctataccctgagc

SEQ ID NO: 11996 - DNA, 20 bp, Artificial Sequence
  Description of Artificial Sequence: Synthetic oligonucleotide
ctattcagctataccctgag

SEQ ID NO: 11997 - DNA, 20 bp, Artificial Sequence
  Description of Artificial Sequence: Synthetic oligonucleotide
cctattcagctataccctga

SEQ ID NO: 11998 - DNA, 20 bp, Artificial Sequence
  Description of Artificial Sequence: Synthetic oligonucleotide
gcctattcagctataccctg

SEQ ID NO: 11999 - DNA, 20 bp, Artificial Sequence
  Description of Artificial Sequence: Synthetic oligonucleotide
tgcctattcagctataccct

SEQ ID NO: 12000 - DNA, 20 bp, Artificial Sequence
  Description of Artificial Sequence: Synthetic oligonucleotide
ctgcctattcagctataccc

SEQ ID NO: 12001 - DNA, 20 bp, Artificial Sequence
  Description of Artificial Sequence: Synthetic oligonucleotide
actgcctattcagctatacc

SEQ ID NO: 12002 - DNA, 20 bp, Artificial Sequence
  Description of Artificial Sequence: Synthetic oligonucleotide
aactgcctattcagctatac

SEQ ID NO: 12003 - DNA, 20 bp, Artificial Sequence
  Description of Artificial Sequence: Synthetic oligonucleotide
aaactgcctattcagctata

SEQ ID NO: 12004 - DNA, 20 bp, Artificial Sequence
  Description of Artificial Sequence: Synthetic oligonucleotide
gaaactgcctattcagctat

SEQ ID NO: 12005 - DNA, 20 bp, Artificial Sequence
  Description of Artificial Sequence: Synthetic oligonucleotide
agaaactgcctattcagcta

SEQ ID NO: 12006 - DNA, 20 bp, Artificial Sequence
  Description of Artificial Sequence: Synthetic oligonucleotide
aagaaactgcctattcagct

SEQ ID NO: 12007 - DNA, 20 bp, Artificial Sequence
  Description of Artificial Sequence: Synthetic oligonucleotide
aaagaaactgcctattcagc

SEQ ID NO: 12008 - DNA, 20 bp, Artificial Sequence
  Description of Artificial Sequence: Synthetic oligonucleotide
aaaagaaactgcctattcag

SEQ ID NO: 12009 - DNA, 20 bp, Artificial Sequence
  Description of Artificial Sequence: Synthetic oligonucleotide
caaaagaaactgcctattca

SEQ ID NO: 12010 - DNA, 20 bp, Artificial Sequence
  Description of Artificial Sequence: Synthetic oligonucleotide
acaaaagaaactgcctattc

SEQ ID NO: 12011 - DNA, 20 bp, Artificial Sequence
  Description of Artificial Sequence: Synthetic oligonucleotide
gacaaaagaaactgcctatt

SEQ ID NO: 12012 - DNA, 20 bp, Artificial Sequence
  Description of Artificial Sequence: Synthetic oligonucleotide
ggacaaaagaaactgcctat

SEQ ID NO: 12013 - DNA, 20 bp, Artificial Sequence
  Description of Artificial Sequence: Synthetic oligonucleotide
aggacaaaagaaactgccta

SEQ ID NO: 12014 - DNA, 20 bp, Artificial Sequence
  Description of Artificial Sequence: Synthetic oligonucleotide
caggacaaaagaaactgcct

SEQ ID NO: 12015 - DNA, 20 bp, Artificial Sequence
  Description of Artificial Sequence: Synthetic oligonucleotide
tcaggacaaaagaaactgcc

SEQ ID NO: 12016 - DNA, 20 bp, Artificial Sequence
  Description of Artificial Sequence: Synthetic oligonucleotide
ctcaggacaaaagaaactgc

SEQ ID NO: 12017 - DNA, 20 bp, Artificial Sequence
  Description of Artificial Sequence: Synthetic oligonucleotide
cctcaggacaaaagaaactg

SEQ ID NO: 12018 - DNA, 20 bp, Artificial Sequence
  Description of Artificial Sequence: Synthetic oligonucleotide
tcctcaggacaaaagaaact

SEQ ID NO: 12019 - DNA, 20 bp, Artificial Sequence
  Description of Artificial Sequence: Synthetic oligonucleotide
ttcctcaggacaaaagaaac

SEQ ID NO: 12020 - DNA, 20 bp, Artificial Sequence
  Description of Artificial Sequence: Synthetic oligonucleotide
tttcctcaggacaaaagaaa

SEQ ID NO: 12021 - DNA, 20 bp, Artificial Sequence
  Description of Artificial Sequence: Synthetic oligonucleotide
ttttcctcaggacaaaagaa

SEQ ID NO: 12022 - DNA, 20 bp, Artificial Sequence
  Description of Artificial Sequence: Synthetic oligonucleotide
attttcctcaggacaaaaga

SEQ ID NO: 12023 - DNA, 20 bp, Artificial Sequence
  Description of Artificial Sequence: Synthetic oligonucleotide
gattttcctcaggacaaaag

SEQ ID NO: 12024 - DNA, 20 bp, Artificial Sequence
  Description of Artificial Sequence: Synthetic oligonucleotide
tgattttcctcaggacaaaa

SEQ ID NO: 12025 - DNA, 20 bp, Artificial Sequence
  Description of Artificial Sequence: Synthetic oligonucleotide
ctgattttcctcaggacaaa

SEQ ID NO: 12026 - DNA, 20 bp, Artificial Sequence
  Description of Artificial Sequence: Synthetic oligonucleotide
cctgattttcctcaggacaa

SEQ ID NO: 12027 - DNA, 20 bp, Artificial Sequence
  Description of Artificial Sequence: Synthetic oligonucleotide
tcctgattttcctcaggaca

SEQ ID NO: 12028 - DNA, 20 bp, Artificial Sequence
  Description of Artificial Sequence: Synthetic oligonucleotide
gtcctgattttcctcaggac

SEQ ID NO: 12029 - DNA, 20 bp, Artificial Sequence
  Description of Artificial Sequence: Synthetic oligonucleotide
tgtcctgattttcctcagga

SEQ ID NO: 12030 - DNA, 20 bp, Artificial Sequence
  Description of Artificial Sequence: Synthetic oligonucleotide
atgtcctgattttcctcagg

SEQ ID NO: 12031 - DNA, 20 bp, Artificial Sequence
  Description of Artificial Sequence: Synthetic oligonucleotide
catgtcctgattttcctcag

SEQ ID NO: 12032 - DNA, 20 bp, Artificial Sequence
  Description of Artificial Sequence: Synthetic oligonucleotide
gcatgtcctgattttcctca

SEQ ID NO: 12033 - DNA, 20 bp, Artificial Sequence
  Description of Artificial Sequence: Synthetic oligonucleotide
ggcatgtcctgattttcctc

SEQ ID NO: 12034 - DNA, 20 bp, Artificial Sequence
  Description of Artificial Sequence: Synthetic oligonucleotide
aggcatgtcctgattttcct

SEQ ID NO: 12035 - DNA, 20 bp, Artificial Sequence
  Description of Artificial Sequence: Synthetic oligonucleotide
caggcatgtcctgattttcc

SEQ ID NO: 12036 - DNA, 20 bp, Artificial Sequence
  Description of Artificial Sequence: Synthetic oligonucleotide
gcaggcatgtcctgattttc

SEQ ID NO: 12037 - DNA, 20 bp, Artificial Sequence
  Description of Artificial Sequence: Synthetic oligonucleotide
agcaggcatgtcctgatttt

SEQ ID NO: 12038 - DNA, 20 bp, Artificial Sequence
  Description of Artificial Sequence: Synthetic oligonucleotide
aagcaggcatgtcctgattt

SEQ ID NO: 12039 - DNA, 20 bp, Artificial Sequence
  Description of Artificial Sequence: Synthetic oligonucleotide
aaagcaggcatgtcctgatt

SEQ ID NO: 12040 - DNA, 20 bp, Artificial Sequence
  Description of Artificial Sequence: Synthetic oligonucleotide
gaaagcaggcatgtcctgat

SEQ ID NO: 12041 - DNA, 20 bp, Artificial Sequence
  Description of Artificial Sequence: Synthetic oligonucleotide
agaaagcaggcatgtcctga

SEQ ID NO: 12042 - DNA, 20 bp, Artificial Sequence
  Description of Artificial Sequence: Synthetic oligonucleotide
tagaaagcaggcatgtcctg

SEQ ID NO: 12043 - DNA, 20 bp, Artificial Sequence
  Description of Artificial Sequence: Synthetic oligonucleotide
ttagaaagcaggcatgtcct

SEQ ID NO: 12044 - DNA, 20 bp, Artificial Sequence
  Description of Artificial Sequence: Synthetic oligonucleotide
tttagaaagcaggcatgtcc

SEQ ID NO: 12045 - DNA, 20 bp, Artificial Sequence
  Description of Artificial Sequence: Synthetic oligonucleotide
ttttagaaagcaggcatgtc

SEQ ID NO: 12046 - DNA, 20 bp, Artificial Sequence
  Description of Artificial Sequence: Synthetic oligonucleotide
tttttagaaagcaggcatgt

SEQ ID NO: 12047 - DNA, 20 bp, Artificial Sequence
  Description of Artificial Sequence: Synthetic oligonucleotide
atttttagaaagcaggcatg

SEQ ID NO: 12048 - DNA, 20 bp, Artificial Sequence
  Description of Artificial Sequence: Synthetic oligonucleotide
gatttttagaaagcaggcat

SEQ ID NO: 12049 - DNA, 20 bp, Artificial Sequence
  Description of Artificial Sequence: Synthetic oligonucleotide
agatttttagaaagcaggca

SEQ ID NO: 12050 - DNA, 20 bp, Artificial Sequence
  Description of Artificial Sequence: Synthetic oligonucleotide
aagatttttagaaagcaggc

SEQ ID NO: 12051 - DNA, 20 bp, Artificial Sequence
  Description of Artificial Sequence: Synthetic oligonucleotide
gaagatttttagaaagcagg

SEQ ID NO: 12052 - DNA, 20 bp, Artificial Sequence
  Description of Artificial Sequence: Synthetic oligonucleotide
ggaagatttttagaaagcag

SEQ ID NO: 12053 - DNA, 20 bp, Artificial Sequence
  Description of Artificial Sequence: Synthetic oligonucleotide
aggaagatttttagaaagca

SEQ ID NO: 12054 - DNA, 20 bp, Artificial Sequence
  Description of Artificial Sequence: Synthetic oligonucleotide
gaggaagatttttagaaagc

SEQ ID NO: 12055 - DNA, 20 bp, Artificial Sequence
  Description of Artificial Sequence: Synthetic oligonucleotide
agaggaagatttttagaaag

SEQ ID NO: 12056 - DNA, 20 bp, Artificial Sequence
  Description of Artificial Sequence: Synthetic oligonucleotide
cagaggaagatttttagaaa

SEQ ID NO: 12057 - DNA, 20 bp, Artificial Sequence
  Description of Artificial Sequence: Synthetic oligonucleotide
tcagaggaagatttttagaa

SEQ ID NO: 12058 - DNA, 20 bp, Artificial Sequence
  Description of Artificial Sequence: Synthetic oligonucleotide
ttcagaggaagatttttaga

SEQ ID NO: 12059 - DNA, 20 bp, Artificial Sequence
  Description of Artificial Sequence: Synthetic oligonucleotide
cttcagaggaagatttttag

SEQ ID NO: 12060 - DNA, 20 bp, Artificial Sequence
  Description of Artificial Sequence: Synthetic oligonucleotide
tcttcagaggaagattttta

SEQ ID NO: 12061 - DNA, 20 bp, Artificial Sequence
  Description of Artificial Sequence: Synthetic oligonucleotide
gtcttcagaggaagattttt

SEQ ID NO: 12062 - DNA, 20 bp, Artificial Sequence
  Description of Artificial Sequence: Synthetic oligonucleotide
ggtcttcagaggaagatttt

SEQ ID NO: 12063 - DNA, 20 bp, Artificial Sequence
  Description of Artificial Sequence: Synthetic oligonucleotide
aggtcttcagaggaagattt

SEQ ID NO: 12064 - DNA, 20 bp, Artificial Sequence
  Description of Artificial Sequence: Synthetic oligonucleotide
caggtcttcagaggaagatt

SEQ ID NO: 12065 - DNA, 20 bp, Artificial Sequence
  Description of Artificial Sequence: Synthetic oligonucleotide
tcaggtcttcagaggaagat

SEQ ID NO: 12066 - DNA, 20 bp, Artificial Sequence
  Description of Artificial Sequence: Synthetic oligonucleotide
gtcaggtcttcagaggaaga

SEQ ID NO: 12067 - DNA, 20 bp, Artificial Sequence
  Description of Artificial Sequence: Synthetic oligonucleotide
ggtcaggtcttcagaggaag

SEQ ID NO: 12068 - DNA, 20 bp, Artificial Sequence
  Description of Artificial Sequence: Synthetic oligonucleotide
gggtcaggtcttcagaggaa

SEQ ID NO: 12069 - DNA, 20 bp, Artificial Sequence
  Description of Artificial Sequence: Synthetic oligonucleotide
tgggtcaggtcttcagagga

SEQ ID NO: 12070 - DNA, 20 bp, Artificial Sequence
  Description of Artificial Sequence: Synthetic oligonucleotide
ttgggtcaggtcttcagagg

SEQ ID NO: 12071 - DNA, 20 bp, Artificial Sequence
  Description of Artificial Sequence: Synthetic oligonucleotide
cttgggtcaggtcttcagag

SEQ ID NO: 12072 - DNA, 20 bp, Artificial Sequence
  Description of Artificial Sequence: Synthetic oligonucleotide
gcttgggtcaggtcttcaga

SEQ ID NO: 12073 - DNA, 20 bp, Artificial Sequence
  Description of Artificial Sequence: Synthetic oligonucleotide
agcttgggtcaggtcttcag

SEQ ID NO: 12074 - DNA, 20 bp, Artificial Sequence
  Description of Artificial Sequence: Synthetic oligonucleotide
gagcttgggtcaggtcttca

SEQ ID NO: 12075 - DNA, 20 bp, Artificial Sequence
  Description of Artificial Sequence: Synthetic oligonucleotide
agagcttgggtcaggtcttc

SEQ ID NO: 12076 - DNA, 20 bp, Artificial Sequence
  Description of Artificial Sequence: Synthetic oligonucleotide
aagagcttgggtcaggtctt

SEQ ID NO: 12077 - DNA, 20 bp, Artificial Sequence
  Description of Artificial Sequence: Synthetic oligonucleotide
taagagcttgggtcaggtct

SEQ ID NO: 12078 - DNA, 20 bp, Artificial Sequence
  Description of Artificial Sequence: Synthetic oligonucleotide
ttaagagcttgggtcaggtc

SEQ ID NO: 12079 - DNA, 20 bp, Artificial Sequence
  Description of Artificial Sequence: Synthetic oligonucleotide
tttaagagcttgggtcaggt

SEQ ID NO: 12080 - DNA, 20 bp, Artificial Sequence
  Description of Artificial Sequence: Synthetic oligonucleotide
atttaagagcttgggtcagg

SEQ ID NO: 12081 - DNA, 20 bp, Artificial Sequence
  Description of Artificial Sequence: Synthetic oligonucleotide
catttaagagcttgggtcag

SEQ ID NO: 12082 - DNA, 20 bp, Artificial Sequence
  Description of Artificial Sequence: Synthetic oligonucleotide
gcatttaagagcttgggtca

SEQ ID NO: 12083 - DNA, 20 bp, Artificial Sequence
  Description of Artificial Sequence: Synthetic oligonucleotide
agcatttaagagcttgggtc

SEQ ID NO: 12084 - DNA, 20 bp, Artificial Sequence
  Description of Artificial Sequence: Synthetic oligonucleotide
tagcatttaagagcttgggt

SEQ ID NO: 12085 - DNA, 20 bp, Artificial Sequence
  Description of Artificial Sequence: Synthetic oligonucleotide
atagcatttaagagcttggg

SEQ ID NO: 12086 - DNA, 20 bp, Artificial Sequence
  Description of Artificial Sequence: Synthetic oligonucleotide
aatagcatttaagagcttgg

SEQ ID NO: 12087 - DNA, 20 bp, Artificial Sequence
  Description of Artificial Sequence: Synthetic oligonucleotide
caatagcatttaagagcttg

SEQ ID NO: 12088 - DNA, 20 bp, Artificial Sequence
  Description of Artificial Sequence: Synthetic oligonucleotide
acaatagcatttaagagctt

SEQ ID NO: 12089 - DNA, 20 bp, Artificial Sequence
  Description of Artificial Sequence: Synthetic oligonucleotide
tacaatagcatttaagagct

SEQ ID NO: 12090 - DNA, 20 bp, Artificial Sequence
  Description of Artificial Sequence: Synthetic oligonucleotide
ttacaatagcatttaagagc

SEQ ID NO: 12091 - DNA, 20 bp, Artificial Sequence
  Description of Artificial Sequence: Synthetic oligonucleotide
cttacaatagcatttaagag

SEQ ID NO: 12092 - DNA, 20 bp, Artificial Sequence
  Description of Artificial Sequence: Synthetic oligonucleotide
tcttacaatagcatttaaga

SEQ ID NO: 12093 - DNA, 20 bp, Artificial Sequence
  Description of Artificial Sequence: Synthetic oligonucleotide
ctcttacaatagcatttaag

SEQ ID NO: 12094 - DNA, 20 bp, Artificial Sequence
  Description of Artificial Sequence: Synthetic oligonucleotide
tctcttacaatagcatttaa

SEQ ID NO: 12095 - DNA, 20 bp, Artificial Sequence
  Description of Artificial Sequence: Synthetic oligonucleotide
ttctcttacaatagcattta

SEQ ID NO: 12096 - DNA, 20 bp, Artificial Sequence
  Description of Artificial Sequence: Synthetic oligonucleotide
tttctcttacaatagcattt

SEQ ID NO: 12097 - DNA, 20 bp, Artificial Sequence
  Description of Artificial Sequence: Synthetic oligonucleotide
atttctcttacaatagcatt

SEQ ID NO: 12098 - DNA, 20 bp, Artificial Sequence
  Description of Artificial Sequence: Synthetic oligonucleotide
aatttctcttacaatagcat

SEQ ID NO: 12099 - DNA, 20 bp, Artificial Sequence
  Description of Artificial Sequence: Synthetic oligonucleotide
aaatttctcttacaatagca

SEQ ID NO: 12100 - DNA, 20 bp, Artificial Sequence
  Description of Artificial Sequence: Synthetic oligonucleotide
gaaatttctcttacaatagc

SEQ ID NO: 12101 - DNA, 20 bp, Artificial Sequence
  Description of Artificial Sequence: Synthetic oligonucleotide
agaaatttctcttacaatag

SEQ ID NO: 12102 - DNA, 20 bp, Artificial Sequence
  Description of Artificial Sequence: Synthetic oligonucleotide
aagaaatttctcttacaata

SEQ ID NO: 12103 - DNA, 20 bp, Artificial Sequence
  Description of Artificial Sequence: Synthetic oligonucleotide
aaagaaatttctcttacaat

SEQ ID NO: 12104 - DNA, 20 bp, Artificial Sequence
  Description of Artificial Sequence: Synthetic oligonucleotide
caaagaaatttctcttacaa

SEQ ID NO: 12105 - DNA, 20 bp, Artificial Sequence
  Description of Artificial Sequence: Synthetic oligonucleotide
acaaagaaatttctcttaca

SEQ ID NO: 12106 - DNA, 20 bp, Artificial Sequence
  Description of Artificial Sequence: Synthetic oligonucleotide
gacaaagaaatttctcttac

SEQ ID NO: 12107 - DNA, 20 bp, Artificial Sequence
  Description of Artificial Sequence: Synthetic oligonucleotide
agacaaagaaatttctctta

SEQ ID NO: 12108 - DNA, 20 bp, Artificial Sequence
  Description of Artificial Sequence: Synthetic oligonucleotide
tagacaaagaaatttctctt

SEQ ID NO: 12109 - DNA, 20 bp, Artificial Sequence
  Description of Artificial Sequence: Synthetic oligonucleotide
atagacaaagaaatttctct

SEQ ID NO: 12110 - DNA, 20 bp, Artificial Sequence
  Description of Artificial Sequence: Synthetic oligonucleotide
aatagacaaagaaatttctc

SEQ ID NO: 12111 - DNA, 20 bp, Artificial Sequence
  Description of Artificial Sequence: Synthetic oligonucleotide
taatagacaaagaaatttct

SEQ ID NO: 12112 - DNA, 20 bp, Artificial Sequence
  Description of Artificial Sequence: Synthetic oligonucleotide
ttaatagacaaagaaatttc

SEQ ID NO: 12113 - DNA, 20 bp, Artificial Sequence
  Description of Artificial Sequence: Synthetic oligonucleotide
gttaatagacaaagaaattt

SEQ ID NO: 12114 - DNA, 20 bp, Artificial Sequence
  Description of Artificial Sequence: Synthetic oligonucleotide
agttaatagacaaagaaatt

SEQ ID NO: 12115 - DNA, 20 bp, Artificial Sequence
  Description of Artificial Sequence: Synthetic oligonucleotide
gagttaatagacaaagaaat

SEQ ID NO: 12116 - DNA, 20 bp, Artificial Sequence
  Description of Artificial Sequence: Synthetic oligonucleotide
ggagttaatagacaaagaaa

SEQ ID NO: 12117 - DNA, 20 bp, Artificial Sequence
  Description of Artificial Sequence: Synthetic oligonucleotide
tggagttaatagacaaagaa

SEQ ID NO: 12118 - DNA, 20 bp, Artificial Sequence
  Description of Artificial Sequence: Synthetic oligonucleotide
atggagttaatagacaaaga

SEQ ID NO: 12119 - DNA, 20 bp, Artificial Sequence
  Description of Artificial Sequence: Synthetic oligonucleotide
aatggagttaatagacaaag

SEQ ID NO: 12120 - DNA, 20 bp, Artificial Sequence
  Description of Artificial Sequence: Synthetic oligonucleotide
aaatggagttaatagacaaa

SEQ ID NO: 12121 - DNA, 20 bp, Artificial Sequence
  Description of Artificial Sequence: Synthetic oligonucleotide
aaaatggagttaatagacaa

SEQ ID NO: 12122 - DNA, 20 bp, Artificial Sequence
  Description of Artificial Sequence: Synthetic oligonucleotide
taaaatggagttaatagaca

SEQ ID NO: 12123 - DNA, 20 bp, Artificial Sequence
  Description of Artificial Sequence: Synthetic oligonucleotide
ctaaaatggagttaatagac

SEQ ID NO: 12124 - DNA, 20 bp, Artificial Sequence
  Description of Artificial Sequence: Synthetic oligonucleotide
actaaaatggagttaataga

SEQ ID NO: 12125 - DNA, 20 bp, Artificial Sequence
  Description of Artificial Sequence: Synthetic oligonucleotide
tactaaaatggagttaatag

SEQ ID NO: 12126 - DNA, 20 bp, Artificial Sequence
  Description of Artificial Sequence: Synthetic oligonucleotide
ctactaaaatggagttaata

SEQ ID NO: 12127 - DNA, 20 bp, Artificial Sequence
  Description of Artificial Sequence: Synthetic oligonucleotide
cctactaaaatggagttaat

SEQ ID NO: 12128 - DNA, 20 bp, Artificial Sequence
  Description of Artificial Sequence: Synthetic oligonucleotide
ccctactaaaatggagttaa

SEQ ID NO: 12129 - DNA, 20 bp, Artificial Sequence
  Description of Artificial Sequence: Synthetic oligonucleotide
tccctactaaaatggagtta

SEQ ID NO: 12130 - DNA, 20 bp, Artificial Sequence
  Description of Artificial Sequence: Synthetic oligonucleotide
atccctactaaaatggagtt

SEQ ID NO: 12131 - DNA, 20 bp, Artificial Sequence
  Description of Artificial Sequence: Synthetic oligonucleotide
aatccctactaaaatggagt

SEQ ID NO: 12132 - DNA, 20 bp, Artificial Sequence
  Description of Artificial Sequence: Synthetic oligonucleotide
gaatccctactaaaatggag

SEQ ID NO: 12133 - DNA, 20 bp, Artificial Sequence
  Description of Artificial Sequence: Synthetic oligonucleotide
tgaatccctactaaaatgga

SEQ ID NO: 12134 - DNA, 20 bp, Artificial Sequence
  Description of Artificial Sequence: Synthetic oligonucleotide
gtgaatccctactaaaatgg

SEQ ID NO: 12135 - DNA, 20 bp, Artificial Sequence
  Description of Artificial Sequence: Synthetic oligonucleotide
agtgaatccctactaaaatg

SEQ ID NO: 12136 - DNA, 20 bp, Artificial Sequence
  Description of Artificial Sequence: Synthetic oligonucleotide
cagtgaatccctactaaaat

SEQ ID NO: 12137 - DNA, 20 bp, Artificial Sequence
  Description of Artificial Sequence: Synthetic oligonucleotide
tcagtgaatccctactaaaa

SEQ ID NO: 12138 - DNA, 20 bp, Artificial Sequence
  Description of Artificial Sequence: Synthetic oligonucleotide
gtcagtgaatccctactaaa

SEQ ID NO: 12139 - DNA, 20 bp, Artificial Sequence
  Description of Artificial Sequence: Synthetic oligonucleotide
agtcagtgaatccctactaa

SEQ ID NO: 12140 - DNA, 20 bp, Artificial Sequence
  Description of Artificial Sequence: Synthetic oligonucleotide
tagtcagtgaatccctacta

SEQ ID NO: 12141 - DNA, 20 bp, Artificial Sequence
  Description of Artificial Sequence: Synthetic oligonucleotide
ctagtcagtgaatccctact

SEQ ID NO: 12142 - DNA, 20 bp, Artificial Sequence
  Description of Artificial Sequence: Synthetic oligonucleotide
tctagtcagtgaatccctac

SEQ ID NO: 12143 - DNA, 20 bp, Artificial Sequence
  Description of Artificial Sequence: Synthetic oligonucleotide
atctagtcagtgaatcccta

SEQ ID NO: 12144 - DNA, 20 bp, Artificial Sequence
  Description of Artificial Sequence: Synthetic oligonucleotide
aatctagtcagtgaatccct

SEQ ID NO: 12145 - DNA, 20 bp, Artificial Sequence
  Description of Artificial Sequence: Synthetic oligonucleotide
aaatctagtcagtgaatccc

SEQ ID NO: 12146 - DNA, 20 bp, Artificial Sequence
  Description of Artificial Sequence: Synthetic oligonucleotide
aaaatctagtcagtgaatcc

SEQ ID NO: 12147 - DNA, 20 bp, Artificial Sequence
  Description of Artificial Sequence: Synthetic oligonucleotide
taaaatctagtcagtgaatc

SEQ ID NO: 12148 - DNA, 20 bp, Artificial Sequence
  Description of Artificial Sequence: Synthetic oligonucleotide
gtaaaatctagtcagtgaat

SEQ ID NO: 12149 - DNA, 20 bp, Artificial Sequence
  Description of Artificial Sequence: Synthetic oligonucleotide
agtaaaatctagtcagtgaa

SEQ ID NO: 12150 - DNA, 20 bp, Artificial Sequence
  Description of Artificial Sequence: Synthetic oligonucleotide
cagtaaaatctagtcagtga

SEQ ID NO: 12151 - DNA, 20 bp, Artificial Sequence
  Description of Artificial Sequence: Synthetic oligonucleotide
tcagtaaaatctagtcagtg

SEQ ID NO: 12152 - DNA, 20 bp, Artificial Sequence
  Description of Artificial Sequence: Synthetic oligonucleotide
ttcagtaaaatctagtcagt

SEQ ID NO: 12153 - DNA, 20 bp, Artificial Sequence
  Description of Artificial Sequence: Synthetic oligonucleotide
gttcagtaaaatctagtcag

SEQ ID NO: 12154 - DNA, 20 bp, Artificial Sequence
  Description of Artificial Sequence: Synthetic oligonucleotide
agttcagtaaaatctagtca

SEQ ID NO: 12155 - DNA, 20 bp, Artificial Sequence
  Description of Artificial Sequence: Synthetic oligonucleotide
tagttcagtaaaatctagtc

SEQ ID NO: 12156 - DNA, 20 bp, Artificial Sequence
  Description of Artificial Sequence: Synthetic oligonucleotide
atagttcagtaaaatctagt

SEQ ID NO: 12157 - DNA, 20 bp, Artificial Sequence
  Description of Artificial Sequence: Synthetic oligonucleotide
catagttcagtaaaatctag

SEQ ID NO: 12158 - DNA, 20 bp, Artificial Sequence
  Description of Artificial Sequence: Synthetic oligonucleotide
tcatagttcagtaaaatcta

SEQ ID NO: 12159 - DNA, 20 bp, Artificial Sequence
  Description of Artificial Sequence: Synthetic oligonucleotide
ttcatagttcagtaaaatct

SEQ ID NO: 12160 - DNA, 20 bp, Artificial Sequence
  Description of Artificial Sequence: Synthetic oligonucleotide
tttcatagttcagtaaaatc

SEQ ID NO: 12161 - DNA, 20 bp, Artificial Sequence
  Description of Artificial Sequence: Synthetic oligonucleotide
ttttcatagttcagtaaaat

SEQ ID NO: 12162 - DNA, 20 bp, Artificial Sequence
  Description of Artificial Sequence: Synthetic oligonucleotide
attttcatagttcagtaaaa

SEQ ID NO: 12163 - DNA, 20 bp, Artificial Sequence
  Description of Artificial Sequence: Synthetic oligonucleotide
tattttcatagttcagtaaa

SEQ ID NO: 12164 - DNA, 20 bp, Artificial Sequence
  Description of Artificial Sequence: Synthetic oligonucleotide
ttattttcatagttcagtaa

SEQ ID NO: 12165 - DNA, 20 bp, Artificial Sequence
  Description of Artificial Sequence: Synthetic oligonucleotide
tttattttcatagttcagta

SEQ ID NO: 12166 - DNA, 20 bp, Artificial Sequence
  Description of Artificial Sequence: Synthetic oligonucleotide
atttattttcatagttcagt

SEQ ID NO: 12167 - DNA, 20 bp, Artificial Sequence
  Description of Artificial Sequence: Synthetic oligonucleotide
tatttattttcatagttcag

SEQ ID NO: 12168 - DNA, 20 bp, Artificial Sequence
  Description of Artificial Sequence: Synthetic oligonucleotide
gtatttattttcatagttca

SEQ ID NO: 12169 - DNA, 20 bp, Artificial Sequence
  Description of Artificial Sequence: Synthetic oligonucleotide
tgtatttattttcatagttc

SEQ ID NO: 12170 - DNA, 20 bp, Artificial Sequence
  Description of Artificial Sequence: Synthetic oligonucleotide
gtgtatttattttcatagtt

SEQ ID NO: 12171 - DNA, 20 bp, Artificial Sequence
  Description of Artificial Sequence: Synthetic oligonucleotide
tgtgtatttattttcatagt

SEQ ID NO: 12172 - DNA, 20 bp, Artificial Sequence
  Description of Artificial Sequence: Synthetic oligonucleotide
atgtgtatttattttcatag

SEQ ID NO: 12173 - DNA, 20 bp, Artificial Sequence
  Description of Artificial Sequence: Synthetic oligonucleotide
tatgtgtatttattttcata

SEQ ID NO: 12174 - DNA, 20 bp, Artificial Sequence
  Description of Artificial Sequence: Synthetic oligonucleotide
ttatgtgtatttattttcat

SEQ ID NO: 12175 - DNA, 20 bp, Artificial Sequence
  Description of Artificial Sequence: Synthetic oligonucleotide
attatgtgtatttattttca

SEQ ID NO: 12176 - DNA, 20 bp, Artificial Sequence
  Description of Artificial Sequence: Synthetic oligonucleotide
aattatgtgtatttattttc

SEQ ID NO: 12177 - DNA, 20 bp, Artificial Sequence
  Description of Artificial Sequence: Synthetic oligonucleotide
aaattatgtgtatttatttt

SEQ ID NO: 12178 - DNA, 20 bp, Artificial Sequence
  Description of Artificial Sequence: Synthetic oligonucleotide
aaaattatgtgtatttattt

SEQ ID NO: 12179 - DNA, 20 bp, Artificial Sequence
  Description of Artificial Sequence: Synthetic oligonucleotide
aaaaattatgtgtatttatt

SEQ ID NO: 12180 - DNA, 20 bp, Artificial Sequence
  Description of Artificial Sequence: Synthetic oligonucleotide
gaaaaattatgtgtatttat

SEQ ID NO: 12181 - DNA, 20 bp, Artificial Sequence
  Description of Artificial Sequence: Synthetic oligonucleotide
tgaaaaattatgtgtattta

SEQ ID NO: 12182 - DNA, 20 bp, Artificial Sequence
  Description of Artificial Sequence: Synthetic oligonucleotide
gtgaaaaattatgtgtattt

SEQ ID NO: 12183 - DNA, 20 bp, Artificial Sequence
  Description of Artificial Sequence: Synthetic oligonucleotide
tgtgaaaaattatgtgtatt

SEQ ID NO: 12184 - DNA, 20 bp, Artificial Sequence
  Description of Artificial Sequence: Synthetic oligonucleotide
ttgtgaaaaattatgtgtat

SEQ ID NO: 12185 - DNA, 20 bp, Artificial Sequence
  Description of Artificial Sequence: Synthetic oligonucleotide
tttgtgaaaaattatgtgta

SEQ ID NO: 12186 - DNA, 20 bp, Artificial Sequence
  Description of Artificial Sequence: Synthetic oligonucleotide
ttttgtgaaaaattatgtgt

SEQ ID NO: 12187 - DNA, 20 bp, Artificial Sequence
  Description of Artificial Sequence: Synthetic oligonucleotide
attttgtgaaaaattatgtg

SEQ ID NO: 12188 - DNA, 20 bp, Artificial Sequence
  Description of Artificial Sequence: Synthetic oligonucleotide
aattttgtgaaaaattatgt

SEQ ID NO: 12189 - DNA, 20 bp, Artificial Sequence
  Description of Artificial Sequence: Synthetic oligonucleotide
aaattttgtgaaaaattatg

SEQ ID NO: 12190 - DNA, 20 bp, Artificial Sequence
  Description of Artificial Sequence: Synthetic oligonucleotide
aaaattttgtgaaaaattat

SEQ ID NO: 12191 - DNA, 20 bp, Artificial Sequence
  Description of Artificial Sequence: Synthetic oligonucleotide
caaaattttgtgaaaaatta

SEQ ID NO: 12192 - DNA, 20 bp, Artificial Sequence
  Description of Artificial Sequence: Synthetic oligonucleotide
ccaaaattttgtgaaaaatt

SEQ ID NO: 12193 - DNA, 20 bp, Artificial Sequence
  Description of Artificial Sequence: Synthetic oligonucleotide
cccaaaattttgtgaaaaat

SEQ ID NO: 12194 - DNA, 20 bp, Artificial Sequence
  Description of Artificial Sequence: Synthetic oligonucleotide
gcccaaaattttgtgaaaaa

SEQ ID NO: 12195 - DNA, 20 bp, Artificial Sequence
  Description of Artificial Sequence: Synthetic oligonucleotide
ggcccaaaattttgtgaaaa

SEQ ID NO: 12196 - DNA, 20 bp, Artificial Sequence
  Description of Artificial Sequence: Synthetic oligonucleotide
gggcccaaaattttgtgaaa

SEQ ID NO: 12197 - DNA, 20 bp, Artificial Sequence
  Description of Artificial Sequence: Synthetic oligonucleotide
tgggcccaaaattttgtgaa

SEQ ID NO: 12198 - DNA, 20 bp, Artificial Sequence
  Description of Artificial Sequence: Synthetic oligonucleotide
ttgggcccaaaattttgtga

SEQ ID NO: 12199 - DNA, 20 bp, Artificial Sequence
  Description of Artificial Sequence: Synthetic oligonucleotide
attgggcccaaaattttgtg

SEQ ID NO: 12200 - DNA, 20 bp, Artificial Sequence
  Description of Artificial Sequence: Synthetic oligonucleotide
aattgggcccaaaattttgt

SEQ ID NO: 12201 - DNA, 20 bp, Artificial Sequence
  Description of Artificial Sequence: Synthetic oligonucleotide
gaattgggcccaaaattttg

SEQ ID NO: 12202 - DNA, 20 bp, Artificial Sequence
  Description of Artificial Sequence: Synthetic oligonucleotide
ggaattgggcccaaaatttt

SEQ ID NO: 12203 - DNA, 20 bp, Artificial Sequence
  Description of Artificial Sequence: Synthetic oligonucleotide
gggaattgggcccaaaattt

SEQ ID NO: 12204 - DNA, 20 bp, Artificial Sequence
  Description of Artificial Sequence: Synthetic oligonucleotide
ggggaattgggcccaaaatt

SEQ ID NO: 12205 - DNA, 20 bp, Artificial Sequence
  Description of Artificial Sequence: Synthetic oligonucleotide
aggggaattgggcccaaaat

SEQ ID NO: 12206 - DNA, 20 bp, Artificial Sequence
  Description of Artificial Sequence: Synthetic oligonucleotide
taggggaattgggcccaaaa

SEQ ID NO: 12207 - DNA, 20 bp, Artificial Sequence
  Description of Artificial Sequence: Synthetic oligonucleotide
ttaggggaattgggcccaaa

SEQ ID NO: 12208 - DNA, 20 bp, Artificial Sequence
  Description of Artificial Sequence: Synthetic oligonucleotide
tttaggggaattgggcccaa

SEQ ID NO: 12209 - DNA, 20 bp, Artificial Sequence
  Description of Artificial Sequence: Synthetic oligonucleotide
ttttaggggaattgggccca

SEQ ID NO: 12210 - DNA, 20 bp, Artificial Sequence
  Description of Artificial Sequence: Synthetic oligonucleotide
cttttaggggaattgggccc

SEQ ID NO: 12211 - DNA, 20 bp, Artificial Sequence
  Description of Artificial Sequence: Synthetic oligonucleotide
tcttttaggggaattgggcc

SEQ ID NO: 12212 - DNA, 20 bp, Artificial Sequence
  Description of Artificial Sequence: Synthetic oligonucleotide
ttcttttaggggaattgggc

SEQ ID NO: 12213 - DNA, 20 bp, Artificial Sequence
  Description of Artificial Sequence: Synthetic oligonucleotide
attcttttaggggaattggg

SEQ ID NO: 12214 - DNA, 20 bp, Artificial Sequence
  Description of Artificial Sequence: Synthetic oligonucleotide
aattcttttaggggaattgg

SEQ ID NO: 12215 - DNA, 20 bp, Artificial Sequence
  Description of Artificial Sequence: Synthetic oligonucleotide
caattcttttaggggaattg

SEQ ID NO: 12216 - DNA, 20 bp, Artificial Sequence
  Description of Artificial Sequence: Synthetic oligonucleotide
tcaattcttttaggggaatt

SEQ ID NO: 12217 - DNA, 20 bp, Artificial Sequence
  Description of Artificial Sequence: Synthetic oligonucleotide
ctcaattcttttaggggaat

SEQ ID NO: 12218 - DNA, 20 bp, Artificial Sequence
  Description of Artificial Sequence: Synthetic oligonucleotide
cctcaattcttttaggggaa

SEQ ID NO: 12219 - DNA, 20 bp, Artificial Sequence
  Description of Artificial Sequence: Synthetic oligonucleotide
tcctcaattcttttagggga

SEQ ID NO: 12220 - DNA, 20 bp, Artificial Sequence
  Description of Artificial Sequence: Synthetic oligonucleotide
atcctcaattcttttagggg

SEQ ID NO: 12221 - DNA, 20 bp, Artificial Sequence
  Description of Artificial Sequence: Synthetic oligonucleotide
aatcctcaattcttttaggg

SEQ ID NO: 12222 - DNA, 20 bp, Artificial Sequence
  Description of Artificial Sequence: Synthetic oligonucleotide
taatcctcaattcttttagg

SEQ ID NO: 12223 - DNA, 20 bp, Artificial Sequence
  Description of Artificial Sequence: Synthetic oligonucleotide
ctaatcctcaattcttttag

SEQ ID NO: 12224 - DNA, 20 bp, Artificial Sequence
  Description of Artificial Sequence: Synthetic oligonucleotide
cctaatcctcaattctttta

SEQ ID NO: 12225 - DNA, 20 bp, Artificial Sequence
  Description of Artificial Sequence: Synthetic oligonucleotide
ccctaatcctcaattctttt

SEQ ID NO: 12226 - DNA, 20 bp, Artificial Sequence
  Description of Artificial Sequence: Synthetic oligonucleotide
tccctaatcctcaattcttt

SEQ ID NO: 12227 - DNA, 20 bp, Artificial Sequence
  Description of Artificial Sequence: Synthetic oligonucleotide
ctccctaatcctcaattctt

SEQ ID NO: 12228 - DNA, 20 bp, Artificial Sequence
  Description of Artificial Sequence: Synthetic oligonucleotide
tctccctaatcctcaattct

SEQ ID NO: 12229 - DNA, 20 bp, Artificial Sequence
  Description of Artificial Sequence: Synthetic oligonucleotide
ttctccctaatcctcaattc

SEQ ID NO: 12230 - DNA, 20 bp, Artificial Sequence
  Description of Artificial Sequence: Synthetic oligonucleotide
tttctccctaatcctcaatt

SEQ ID NO: 12231 - DNA, 20 bp, Artificial Sequence
  Description of Artificial Sequence: Synthetic oligonucleotide
ctttctccctaatcctcaat

SEQ ID NO: 12232 - DNA, 20 bp, Artificial Sequence
  Description of Artificial Sequence: Synthetic oligonucleotide
cctttctccctaatcctcaa

SEQ ID NO: 12233 - DNA, 20 bp, Artificial Sequence
  Description of Artificial Sequence: Synthetic oligonucleotide
tcctttctccctaatcctca

SEQ ID NO: 12234 - DNA, 20 bp, Artificial Sequence
  Description of Artificial Sequence: Synthetic oligonucleotide
ctcctttctccctaatcctc

SEQ ID NO: 12235 - DNA, 20 bp, Artificial Sequence
  Description of Artificial Sequence: Synthetic oligonucleotide
tctcctttctccctaatcct

SEQ ID NO: 12236 - DNA, 20 bp, Artificial Sequence
  Description of Artificial Sequence: Synthetic oligonucleotide
gtctcctttctccctaatcc

SEQ ID NO: 12237 - DNA, 20 bp, Artificial Sequence
  Description of Artificial Sequence: Synthetic oligonucleotide
tgtctcctttctccctaatc

SEQ ID NO: 12238 - DNA, 20 bp, Artificial Sequence
  Description of Artificial Sequence: Synthetic oligonucleotide
ttgtctcctttctccctaat

SEQ ID NO: 12239 - DNA, 20 bp, Artificial Sequence
  Description of Artificial Sequence: Synthetic oligonucleotide
gttgtctcctttctccctaa

SEQ ID NO: 12240 - DNA, 20 bp, Artificial Sequence
  Description of Artificial Sequence: Synthetic oligonucleotide
agttgtctcctttctcccta

SEQ ID NO: 12241 - DNA, 20 bp, Artificial Sequence
  Description of Artificial Sequence: Synthetic oligonucleotide
gagttgtctcctttctccct

SEQ ID NO: 12242 - DNA, 20 bp, Artificial Sequence
  Description of Artificial Sequence: Synthetic oligonucleotide
tgagttgtctcctttctccc

SEQ ID NO: 12243 - DNA, 20 bp, Artificial Sequence
  Description of Artificial Sequence: Synthetic oligonucleotide
ttgagttgtctcctttctcc

SEQ ID NO: 12244 - DNA, 20 bp, Artificial Sequence
  Description of Artificial Sequence: Synthetic oligonucleotide
tttgagttgtctcctttctc

SEQ ID NO: 12245 - DNA, 20 bp, Artificial Sequence
  Description of Artificial Sequence: Synthetic oligonucleotide
ctttgagttgtctcctttct

SEQ ID NO: 12246 - DNA, 20 bp, Artificial Sequence
  Description of Artificial Sequence: Synthetic oligonucleotide
actttgagttgtctcctttc

SEQ ID NO: 12247 - DNA, 20 bp, Artificial Sequence
  Description of Artificial Sequence: Synthetic oligonucleotide
gactttgagttgtctccttt

SEQ ID NO: 12248 - DNA, 20 bp, Artificial Sequence
  Description of Artificial Sequence: Synthetic oligonucleotide
tgactttgagttgtctcctt

SEQ ID NO: 12249 - DNA, 20 bp, Artificial Sequence
  Description of Artificial Sequence: Synthetic oligonucleotide
atgactttgagttgtctcct

SEQ ID NO: 12250 - DNA, 20 bp, Artificial Sequence
  Description of Artificial Sequence: Synthetic oligonucleotide
gatgactttgagttgtctcc

SEQ ID NO: 12251 - DNA, 20 bp, Artificial Sequence
  Description of Artificial Sequence: Synthetic oligonucleotide
ggatgactttgagttgtctc

SEQ ID NO: 12252 - DNA, 20 bp, Artificial Sequence
  Description of Artificial Sequence: Synthetic oligonucleotide
gggatgactttgagttgtct

SEQ ID NO: 12253 - DNA, 20 bp, Artificial Sequence
  Description of Artificial Sequence: Synthetic oligonucleotide
tgggatgactttgagttgtc

SEQ ID NO: 12254 - DNA, 20 bp, Artificial Sequence
  Description of Artificial Sequence: Synthetic oligonucleotide
atgggatgactttgagttgt

SEQ ID NO: 12255 - DNA, 20 bp, Artificial Sequence
  Description of Artificial Sequence: Synthetic oligonucleotide
aatgggatgactttgagttg

SEQ ID NO: 12256 - DNA, 20 bp, Artificial Sequence
  Description of Artificial Sequence: Synthetic oligonucleotide
taatgggatgactttgagtt

SEQ ID NO: 12257 - DNA, 20 bp, Artificial Sequence
  Description of Artificial Sequence: Synthetic oligonucleotide
ttaatgggatgactttgagt

SEQ ID NO: 12258 - DNA, 20 bp, Artificial Sequence
  Description of Artificial Sequence: Synthetic oligonucleotide
cttaatgggatgactttgag

SEQ ID NO: 12259 - DNA, 20 bp, Artificial Sequence
  Description of Artificial Sequence: Synthetic oligonucleotide
acttaatgggatgactttga

SEQ ID NO: 12260 - DNA, 20 bp, Artificial Sequence
  Description of Artificial Sequence: Synthetic oligonucleotide
cacttaatgggatgactttg

SEQ ID NO: 12261 - DNA, 20 bp, Artificial Sequence
  Description of Artificial Sequence: Synthetic oligonucleotide
gcacttaatgggatgacttt

SEQ ID NO: 12262 - DNA, 20 bp, Artificial Sequence
  Description of Artificial Sequence: Synthetic oligonucleotide
tgcacttaatgggatgactt

SEQ ID NO: 12263 - DNA, 20 bp, Artificial Sequence
  Description of Artificial Sequence: Synthetic oligonucleotide
ctgcacttaatgggatgact

SEQ ID NO: 12264 - DNA, 20 bp, Artificial Sequence
  Description of Artificial Sequence: Synthetic oligonucleotide
actgcacttaatgggatgac

SEQ ID NO: 12265 - DNA, 20 bp, Artificial Sequence
  Description of Artificial Sequence: Synthetic oligonucleotide
aactgcacttaatgggatga

SEQ ID NO: 12266 - DNA, 20 bp, Artificial Sequence
  Description of Artificial Sequence: Synthetic oligonucleotide
aaactgcacttaatgggatg

SEQ ID NO: 12267 - DNA, 20 bp, Artificial Sequence
  Description of Artificial Sequence: Synthetic oligonucleotide
gaaactgcacttaatgggat

SEQ ID NO: 12268 - DNA, 20 bp, Artificial Sequence
  Description of Artificial Sequence: Synthetic oligonucleotide
agaaactgcacttaatggga

SEQ ID NO: 12269 - DNA, 20 bp, Artificial Sequence
  Description of Artificial Sequence: Synthetic oligonucleotide
aagaaactgcacttaatggg

SEQ ID NO: 12270 - DNA, 20 bp, Artificial Sequence
  Description of Artificial Sequence: Synthetic oligonucleotide
aaagaaactgcacttaatgg

SEQ ID NO: 12271 - DNA, 20 bp, Artificial Sequence
  Description of Artificial Sequence: Synthetic oligonucleotide
caaagaaactgcacttaatg

SEQ ID NO: 12272 - DNA, 20 bp, Artificial Sequence
  Description of Artificial Sequence: Synthetic oligonucleotide
tcaaagaaactgcacttaat

SEQ ID NO: 12273 - DNA, 20 bp, Artificial Sequence
  Description of Artificial Sequence: Synthetic oligonucleotide
ttcaaagaaactgcacttaa

SEQ ID NO: 12274 - DNA, 20 bp, Artificial Sequence
  Description of Artificial Sequence: Synthetic oligonucleotide
attcaaagaaactgcactta

SEQ ID NO: 12275 - DNA, 20 bp, Artificial Sequence
  Description of Artificial Sequence: Synthetic oligonucleotide
gattcaaagaaactgcactt

SEQ ID NO: 12276 - DNA, 20 bp, Artificial Sequence
  Description of Artificial Sequence: Synthetic oligonucleotide
agattcaaagaaactgcact

SEQ ID NO: 12277 - DNA, 20 bp, Artificial Sequence
  Description of Artificial Sequence: Synthetic oligonucleotide
aagattcaaagaaactgcac

SEQ ID NO: 12278 - DNA, 20 bp, Artificial Sequence
  Description of Artificial Sequence: Synthetic oligonucleotide
gaagattcaaagaaactgca

SEQ ID NO: 12279 - DNA, 20 bp, Artificial Sequence
  Description of Artificial Sequence: Synthetic oligonucleotide
agaagattcaaagaaactgc

SEQ ID NO: 12280 - DNA, 20 bp, Artificial Sequence
  Description of Artificial Sequence: Synthetic oligonucleotide
cagaagattcaaagaaactg

SEQ ID NO: 12281 - DNA, 20 bp, Artificial Sequence
  Description of Artificial Sequence: Synthetic oligonucleotide
gcagaagattcaaagaaact

SEQ ID NO: 12282 - DNA, 20 bp, Artificial Sequence
  Description of Artificial Sequence: Synthetic oligonucleotide
agcagaagattcaaagaaac

SEQ ID NO: 12283 - DNA, 20 bp, Artificial Sequence
  Description of Artificial Sequence: Synthetic oligonucleotide
aagcagaagattcaaagaaa

SEQ ID NO: 12284 - DNA, 20 bp, Artificial Sequence
  Description of Artificial Sequence: Synthetic oligonucleotide
aaagcagaagattcaaagaa

SEQ ID NO: 12285 - DNA, 20 bp, Artificial Sequence
  Description of Artificial Sequence: Synthetic oligonucleotide
taaagcagaagattcaaaga

SEQ ID NO: 12286 - DNA, 20 bp, Artificial Sequence
  Description of Artificial Sequence: Synthetic oligonucleotide
ataaagcagaagattcaaag

SEQ ID NO: 12287 - DNA, 20 bp, Artificial Sequence
  Description of Artificial Sequence: Synthetic oligonucleotide
gataaagcagaagattcaaa

SEQ ID NO: 12288 - DNA, 20 bp, Artificial Sequence
  Description of Artificial Sequence: Synthetic oligonucleotide
agataaagcagaagattcaa

SEQ ID NO: 12289 - DNA, 20 bp, Artificial Sequence
  Description of Artificial Sequence: Synthetic oligonucleotide
aagataaagcagaagattca

SEQ ID NO: 12290 - DNA, 20 bp, Artificial Sequence
  Description of Artificial Sequence: Synthetic oligonucleotide
aaagataaagcagaagattc

SEQ ID NO: 12291 - DNA, 20 bp, Artificial Sequence
  Description of Artificial Sequence: Synthetic oligonucleotide
taaagataaagcagaagatt

SEQ ID NO: 12292 - DNA, 20 bp, Artificial Sequence
  Description of Artificial Sequence: Synthetic oligonucleotide
ttaaagataaagcagaagat

SEQ ID NO: 12293 - DNA, 20 bp, Artificial Sequence
  Description of Artificial Sequence: Synthetic oligonucleotide
tttaaagataaagcagaaga

SEQ ID NO: 12294 - DNA, 20 bp, Artificial Sequence
  Description of Artificial Sequence: Synthetic oligonucleotide
ttttaaagataaagcagaag

SEQ ID NO: 12295 - DNA, 20 bp, Artificial Sequence
  Description of Artificial Sequence: Synthetic oligonucleotide
tttttaaagataaagcagaa

SEQ ID NO: 12296 - DNA, 20 bp, Artificial Sequence
  Description of Artificial Sequence: Synthetic oligonucleotide
atttttaaagataaagcaga

SEQ ID NO: 12297 - DNA, 20 bp, Artificial Sequence
  Description of Artificial Sequence: Synthetic oligonucleotide
aatttttaaagataaagcag

SEQ ID NO: 12298 - DNA, 20 bp, Artificial Sequence
  Description of Artificial Sequence: Synthetic oligonucleotide
aaatttttaaagataaagca

SEQ ID NO: 12299 - DNA, 20 bp, Artificial Sequence
  Description of Artificial Sequence: Synthetic oligonucleotide
caaatttttaaagataaagc

SEQ ID NO: 12300 - DNA, 20 bp, Artificial Sequence
  Description of Artificial Sequence: Synthetic oligonucleotide
acaaatttttaaagataaag

SEQ ID NO: 12301 - DNA, 20 bp, Artificial Sequence
  Description of Artificial Sequence: Synthetic oligonucleotide
tacaaatttttaaagataaa

SEQ ID NO: 12302 - DNA, 20 bp, Artificial Sequence
  Description of Artificial Sequence: Synthetic oligonucleotide
atacaaatttttaaagataa

SEQ ID NO: 12303 - DNA, 20 bp, Artificial Sequence
  Description of Artificial Sequence: Synthetic oligonucleotide
tatacaaatttttaaagata

SEQ ID NO: 12304 - DNA, 20 bp, Artificial Sequence
  Description of Artificial Sequence: Synthetic oligonucleotide
ttatacaaatttttaaagat

SEQ ID NO: 12305 - DNA, 20 bp, Artificial Sequence
  Description of Artificial Sequence: Synthetic oligonucleotide
attatacaaatttttaaaga

SEQ ID NO: 12306 - DNA, 20 bp, Artificial Sequence
  Description of Artificial Sequence: Synthetic oligonucleotide
aattatacaaatttttaaag

SEQ ID NO: 12307 - DNA, 20 bp, Artificial Sequence
  Description of Artificial Sequence: Synthetic oligonucleotide
aaattatacaaatttttaaa

SEQ ID NO: 12308 - DNA, 20 bp, Artificial Sequence
  Description of Artificial Sequence: Synthetic oligonucleotide
taaattatacaaatttttaa

SEQ ID NO: 12309 - DNA, 20 bp, Artificial Sequence
  Description of Artificial Sequence: Synthetic oligonucleotide
ataaattatacaaattttta

SEQ ID NO: 12310 - DNA, 20 bp, Artificial Sequence
  Description of Artificial Sequence: Synthetic oligonucleotide
tataaattatacaaattttt

SEQ ID NO: 12311 - DNA, 20 bp, Artificial Sequence
  Description of Artificial Sequence: Synthetic oligonucleotide
atataaattatacaaatttt

SEQ ID NO: 12312 - DNA, 20 bp, Artificial Sequence
  Description of Artificial Sequence: Synthetic oligonucleotide
tatataaattatacaaattt

SEQ ID NO: 12313 - DNA, 20 bp, Artificial Sequence
  Description of Artificial Sequence: Synthetic oligonucleotide
atatataaattatacaaatt

SEQ ID NO: 12314 - DNA, 20 bp, Artificial Sequence
  Description of Artificial Sequence: Synthetic oligonucleotide
aatatataaattatacaaat

SEQ ID NO: 12315 - DNA, 20 bp, Artificial Sequence
  Description of Artificial Sequence: Synthetic oligonucleotide
aaatatataaattatacaaa

SEQ ID NO: 12316 - DNA, 20 bp, Artificial Sequence
  Description of Artificial Sequence: Synthetic oligonucleotide
aaaatatataaattatacaa

SEQ ID NO: 12317 - DNA, 20 bp, Artificial Sequence
  Description of Artificial Sequence: Synthetic oligonucleotide
taaaatatataaattataca

SEQ ID NO: 12318 - DNA, 20 bp, Artificial Sequence
  Description of Artificial Sequence: Synthetic oligonucleotide
ataaaatatataaattatac

SEQ ID NO: 12319 - DNA, 20 bp, Artificial Sequence
  Description of Artificial Sequence: Synthetic oligonucleotide
aataaaatatataaattata

SEQ ID NO: 12320 - DNA, 20 bp, Artificial Sequence
  Description of Artificial Sequence: Synthetic oligonucleotide
gaataaaatatataaattat

SEQ ID NO: 12321 - DNA, 20 bp, Artificial Sequence
  Description of Artificial Sequence: Synthetic oligonucleotide
agaataaaatatataaatta

SEQ ID NO: 12322 - DNA, 20 bp, Artificial Sequence
  Description of Artificial Sequence: Synthetic oligonucleotide
tagaataaaatatataaatt

SEQ ID NO: 12323 - DNA, 20 bp, Artificial Sequence
  Description of Artificial Sequence: Synthetic oligonucleotide
atagaataaaatatataaat

SEQ ID NO: 12324 - DNA, 20 bp, Artificial Sequence
  Description of Artificial Sequence: Synthetic oligonucleotide
catagaataaaatatataaa

SEQ ID NO: 12325 - DNA, 20 bp, Artificial Sequence
  Description of Artificial Sequence: Synthetic oligonucleotide
acatagaataaaatatataa

SEQ ID NO: 12326 - DNA, 20 bp, Artificial Sequence
  Description of Artificial Sequence: Synthetic oligonucleotide
cacatagaataaaatatata

SEQ ID NO: 12327 - DNA, 20 bp, Artificial Sequence
  Description of Artificial Sequence: Synthetic oligonucleotide
acacatagaataaaatatat

SEQ ID NO: 12328 - DNA, 20 bp, Artificial Sequence
  Description of Artificial Sequence: Synthetic oligonucleotide
aacacatagaataaaatata

SEQ ID NO: 12329 - DNA, 20 bp, Artificial Sequence
  Description of Artificial Sequence: Synthetic oligonucleotide
gaacacatagaataaaatat

SEQ ID NO: 12330 - DNA, 20 bp, Artificial Sequence
  Description of Artificial Sequence: Synthetic oligonucleotide
ggaacacatagaataaaata

SEQ ID NO: 12331 - DNA, 20 bp, Artificial Sequence
  Description of Artificial Sequence: Synthetic oligonucleotide
tggaacacatagaataaaat

SEQ ID NO: 12332 - DNA, 20 bp, Artificial Sequence
  Description of Artificial Sequence: Synthetic oligonucleotide
atggaacacatagaataaaa

SEQ ID NO: 12333 - DNA, 20 bp, Artificial Sequence
  Description of Artificial Sequence: Synthetic oligonucleotide
tatggaacacatagaataaa

SEQ ID NO: 12334 - DNA, 20 bp, Artificial Sequence
  Description of Artificial Sequence: Synthetic oligonucleotide
ctatggaacacatagaataa

SEQ ID NO: 12335 - DNA, 20 bp, Artificial Sequence
  Description of Artificial Sequence: Synthetic oligonucleotide
tctatggaacacatagaata

SEQ ID NO: 12336 - DNA, 20 bp, Artificial Sequence
  Description of Artificial Sequence: Synthetic oligonucleotide
atctatggaacacatagaat

SEQ ID NO: 12337 - DNA, 20 bp, Artificial Sequence
  Description of Artificial Sequence: Synthetic oligonucleotide
tatctatggaacacatagaa

SEQ ID NO: 12338 - DNA, 20 bp, Artificial Sequence
  Description of Artificial Sequence: Synthetic oligonucleotide
atatctatggaacacataga

SEQ ID NO: 12339 - DNA, 20 bp, Artificial Sequence
  Description of Artificial Sequence: Synthetic oligonucleotide
gatatctatggaacacatag

SEQ ID NO: 12340 - DNA, 20 bp, Artificial Sequence
  Description of Artificial Sequence: Synthetic oligonucleotide
agatatctatggaacacata

SEQ ID NO: 12341 - DNA, 20 bp, Artificial Sequence
  Description of Artificial Sequence: Synthetic oligonucleotide
aagatatctatggaacacat

SEQ ID NO: 12342 - DNA, 20 bp, Artificial Sequence
  Description of Artificial Sequence: Synthetic oligonucleotide
taagatatctatggaacaca

SEQ ID NO: 12343 - DNA, 20 bp, Artificial Sequence
  Description of Artificial Sequence: Synthetic oligonucleotide
ttaagatatctatggaacac

SEQ ID NO: 12344 - DNA, 20 bp, Artificial Sequence
  Description of Artificial Sequence: Synthetic oligonucleotide
attaagatatctatggaaca

SEQ ID NO: 12345 - DNA, 20 bp, Artificial Sequence
  Description of Artificial Sequence: Synthetic oligonucleotide
cattaagatatctatggaac

SEQ ID NO: 12346 - DNA, 20 bp, Artificial Sequence
  Description of Artificial Sequence: Synthetic oligonucleotide
acattaagatatctatggaa

SEQ ID NO: 12347 - DNA, 20 bp, Artificial Sequence
  Description of Artificial Sequence: Synthetic oligonucleotide
tacattaagatatctatgga

SEQ ID NO: 12348 - DNA, 20 bp, Artificial Sequence
  Description of Artificial Sequence: Synthetic oligonucleotide
ttacattaagatatctatgg

SEQ ID NO: 12349 - DNA, 20 bp, Artificial Sequence
  Description of Artificial Sequence: Synthetic oligonucleotide
tttacattaagatatctatg

SEQ ID NO: 12350 - DNA, 20 bp, Artificial Sequence
  Description of Artificial Sequence: Synthetic oligonucleotide
ttttacattaagatatctat

SEQ ID NO: 12351 - DNA, 20 bp, Artificial Sequence
  Description of Artificial Sequence: Synthetic oligonucleotide
attttacattaagatatcta

SEQ ID NO: 12352 - DNA, 20 bp, Artificial Sequence
  Description of Artificial Sequence: Synthetic oligonucleotide
aattttacattaagatatct

SEQ ID NO: 12353 - DNA, 20 bp, Artificial Sequence
  Description of Artificial Sequence: Synthetic oligonucleotide
taattttacattaagatatc

SEQ ID NO: 12354 - DNA, 20 bp, Artificial Sequence
  Description of Artificial Sequence: Synthetic oligonucleotide
ctaattttacattaagatat

SEQ ID NO: 12355 - DNA, 20 bp, Artificial Sequence
  Description of Artificial Sequence: Synthetic oligonucleotide
actaattttacattaagata

SEQ ID NO: 12356 - DNA, 20 bp, Artificial Sequence
  Description of Artificial Sequence: Synthetic oligonucleotide
gactaattttacattaagat

SEQ ID NO: 12357 - DNA, 20 bp, Artificial Sequence
  Description of Artificial Sequence: Synthetic oligonucleotide
tgactaattttacattaaga

SEQ ID NO: 12358 - DNA, 20 bp, Artificial Sequence
  Description of Artificial Sequence: Synthetic oligonucleotide
atgactaattttacattaag

SEQ ID NO: 12359 - DNA, 20 bp, Artificial Sequence
  Description of Artificial Sequence: Synthetic oligonucleotide
aatgactaattttacattaa

SEQ ID NO: 12360 - DNA, 20 bp, Artificial Sequence
  Description of Artificial Sequence: Synthetic oligonucleotide
aaatgactaattttacatta

SEQ ID NO: 12361 - DNA, 20 bp, Artificial Sequence
  Description of Artificial Sequence: Synthetic oligonucleotide
taaatgactaattttacatt

SEQ ID NO: 12362 - DNA, 20 bp, Artificial Sequence
  Description of Artificial Sequence: Synthetic oligonucleotide
ttaaatgactaattttacat

SEQ ID NO: 12363 - DNA, 20 bp, Artificial Sequence
  Description of Artificial Sequence: Synthetic oligonucleotide
tttaaatgactaattttaca

SEQ ID NO: 12364 - DNA, 20 bp, Artificial Sequence
  Description of Artificial Sequence: Synthetic oligonucleotide
atttaaatgactaattttac

SEQ ID NO: 12365 - DNA, 20 bp, Artificial Sequence
  Description of Artificial Sequence: Synthetic oligonucleotide
aatttaaatgactaatttta

SEQ ID NO: 12366 - DNA, 20 bp, Artificial Sequence
  Description of Artificial Sequence: Synthetic oligonucleotide
taatttaaatgactaatttt

SEQ ID NO: 12367 - DNA, 20 bp, Artificial Sequence
  Description of Artificial Sequence: Synthetic oligonucleotide
gtaatttaaatgactaattt

SEQ ID NO: 12368 - DNA, 20 bp, Artificial Sequence
  Description of Artificial Sequence: Synthetic oligonucleotide
tgtaatttaaatgactaatt

SEQ ID NO: 12369 - DNA, 20 bp, Artificial Sequence
  Description of Artificial Sequence: Synthetic oligonucleotide
gtgtaatttaaatgactaat

SEQ ID NO: 12370 - DNA, 20 bp, Artificial Sequence
  Description of Artificial Sequence: Synthetic oligonucleotide
agtgtaatttaaatgactaa

SEQ ID NO: 12371 - DNA, 20 bp, Artificial Sequence
  Description of Artificial Sequence: Synthetic oligonucleotide
cagtgtaatttaaatgacta

SEQ ID NO: 12372 - DNA, 20 bp, Artificial Sequence
  Description of Artificial Sequence: Synthetic oligonucleotide
acagtgtaatttaaatgact

SEQ ID NO: 12373 - DNA, 20 bp, Artificial Sequence
  Description of Artificial Sequence: Synthetic oligonucleotide
gacagtgtaatttaaatgac

SEQ ID NO: 12374 - DNA, 20 bp, Artificial Sequence
  Description of Artificial Sequence: Synthetic oligonucleotide
tgacagtgtaatttaaatga

SEQ ID NO: 12375 - DNA, 20 bp, Artificial Sequence
  Description of Artificial Sequence: Synthetic oligonucleotide
ttgacagtgtaatttaaatg

SEQ ID NO: 12376 - DNA, 20 bp, Artificial Sequence
  Description of Artificial Sequence: Synthetic oligonucleotide
attgacagtgtaatttaaat

SEQ ID NO: 12377 - DNA, 20 bp, Artificial Sequence
  Description of Artificial Sequence: Synthetic oligonucleotide
aattgacagtgtaatttaaa

SEQ ID NO: 12378 - DNA, 20 bp, Artificial Sequence
  Description of Artificial Sequence: Synthetic oligonucleotide
taattgacagtgtaatttaa

SEQ ID NO: 12379 - DNA, 20 bp, Artificial Sequence
  Description of Artificial Sequence: Synthetic oligonucleotide
ttaattgacagtgtaattta

SEQ ID NO: 12380 - DNA, 20 bp, Artificial Sequence
  Description of Artificial Sequence: Synthetic oligonucleotide
tttaattgacagtgtaattt

SEQ ID NO: 12381 - DNA, 20 bp, Artificial Sequence
  Description of Artificial Sequence: Synthetic oligonucleotide
ttttaattgacagtgtaatt

SEQ ID NO: 12382 - DNA, 20 bp, Artificial Sequence
  Description of Artificial Sequence: Synthetic oligonucleotide
cttttaattgacagtgtaat

SEQ ID NO: 12383 - DNA, 20 bp, Artificial Sequence
  Description of Artificial Sequence: Synthetic oligonucleotide
acttttaattgacagtgtaa

SEQ ID NO: 12384 - DNA, 20 bp, Artificial Sequence
  Description of Artificial Sequence: Synthetic oligonucleotide
tacttttaattgacagtgta

SEQ ID NO: 12385 - DNA, 20 bp, Artificial Sequence
  Description of Artificial Sequence: Synthetic oligonucleotide
ttacttttaattgacagtgt

SEQ ID NO: 12386 - DNA, 20 bp, Artificial Sequence
  Description of Artificial Sequence: Synthetic oligonucleotide
attacttttaattgacagtg

SEQ ID NO: 12387 - DNA, 20 bp, Artificial Sequence
  Description of Artificial Sequence: Synthetic oligonucleotide
cattacttttaattgacagt

SEQ ID NO: 12388 - DNA, 20 bp, Artificial Sequence
  Description of Artificial Sequence: Synthetic oligonucleotide
ccattacttttaattgacag

SEQ ID NO: 12389 - DNA, 20 bp, Artificial Sequence
  Description of Artificial Sequence: Synthetic oligonucleotide
cccattacttttaattgaca

SEQ ID NO: 12390 - DNA, 20 bp, Artificial Sequence
  Description of Artificial Sequence: Synthetic oligonucleotide
gcccattacttttaattgac

SEQ ID NO: 12391 - DNA, 20 bp, Artificial Sequence
  Description of Artificial Sequence: Synthetic oligonucleotide
tgcccattacttttaattga

SEQ ID NO: 12392 - DNA, 20 bp, Artificial Sequence
  Description of Artificial Sequence: Synthetic oligonucleotide
ttgcccattacttttaattg

SEQ ID NO: 12393 - DNA, 20 bp, Artificial Sequence
  Description of Artificial Sequence: Synthetic oligonucleotide
cttgcccattacttttaatt

SEQ ID NO: 12394 - DNA, 20 bp, Artificial Sequence
  Description of Artificial Sequence: Synthetic oligonucleotide
tcttgcccattacttttaat

SEQ ID NO: 12395 - DNA, 20 bp, Artificial Sequence
  Description of Artificial Sequence: Synthetic oligonucleotide
ctcttgcccattacttttaa

SEQ ID NO: 12396 - DNA, 20 bp, Artificial Sequence
  Description of Artificial Sequence: Synthetic oligonucleotide
tctcttgcccattactttta

SEQ ID NO: 12397 - DNA, 20 bp, Artificial Sequence
  Description of Artificial Sequence: Synthetic oligonucleotide
atctcttgcccattactttt

SEQ ID NO: 12398 - DNA, 20 bp, Artificial Sequence
  Description of Artificial Sequence: Synthetic oligonucleotide
aatctcttgcccattacttt

SEQ ID NO: 12399 - DNA, 20 bp, Artificial Sequence
  Description of Artificial Sequence: Synthetic oligonucleotide
caatctcttgcccattactt

SEQ ID NO: 12400 - DNA, 20 bp, Artificial Sequence
  Description of Artificial Sequence: Synthetic oligonucleotide
gcaatctcttgcccattact

SEQ ID NO: 12401 - DNA, 20 bp, Artificial Sequence
  Description of Artificial Sequence: Synthetic oligonucleotide
tgcaatctcttgcccattac

SEQ ID NO: 12402 - DNA, 20 bp, Artificial Sequence
  Description of Artificial Sequence: Synthetic oligonucleotide
atgcaatctcttgcccatta

SEQ ID NO: 12403 - DNA, 20 bp, Artificial Sequence
  Description of Artificial Sequence: Synthetic oligonucleotide
gatgcaatctcttgcccatt

SEQ ID NO: 12404 - DNA, 20 bp, Artificial Sequence
  Description of Artificial Sequence: Synthetic oligonucleotide
tgatgcaatctcttgcccat

SEQ ID NO: 12405 - DNA, 20 bp, Artificial Sequence
  Description of Artificial Sequence: Synthetic oligonucleotide
atgatgcaatctcttgccca

SEQ ID NO: 12406 - DNA, 20 bp, Artificial Sequence
  Description of Artificial Sequence: Synthetic oligonucleotide
tatgatgcaatctcttgccc

SEQ ID NO: 12407 - DNA, 20 bp, Artificial Sequence
  Description of Artificial Sequence: Synthetic oligonucleotide
gtatgatgcaatctcttgcc

SEQ ID NO: 12408 - DNA, 20 bp, Artificial Sequence
  Description of Artificial Sequence: Synthetic oligonucleotide
agtatgatgcaatctcttgc

SEQ ID NO: 12409 - DNA, 20 bp, Artificial Sequence
  Description of Artificial Sequence: Synthetic oligonucleotide
tagtatgatgcaatctcttg

SEQ ID NO: 12410 - DNA, 20 bp, Artificial Sequence
  Description of Artificial Sequence: Synthetic oligonucleotide
ttagtatgatgcaatctctt

SEQ ID NO: 12411 - DNA, 20 bp, Artificial Sequence
  Description of Artificial Sequence: Synthetic oligonucleotide
attagtatgatgcaatctct

SEQ ID NO: 12412 - DNA, 20 bp, Artificial Sequence
  Description of Artificial Sequence: Synthetic oligonucleotide
aattagtatgatgcaatctc

SEQ ID NO: 12413 - DNA, 20 bp, Artificial Sequence
  Description of Artificial Sequence: Synthetic oligonucleotide
aaattagtatgatgcaatct

SEQ ID NO: 12414 - DNA, 20 bp, Artificial Sequence
  Description of Artificial Sequence: Synthetic oligonucleotide
taaattagtatgatgcaatc

SEQ ID NO: 12415 - DNA, 20 bp, Artificial Sequence
  Description of Artificial Sequence: Synthetic oligonucleotide
ctaaattagtatgatgcaat

SEQ ID NO: 12416 - DNA, 20 bp, Artificial Sequence
  Description of Artificial Sequence: Synthetic oligonucleotide
actaaattagtatgatgcaa

SEQ ID NO: 12417 - DNA, 20 bp, Artificial Sequence
  Description of Artificial Sequence: Synthetic oligonucleotide
tactaaattagtatgatgca

SEQ ID NO: 12418 - DNA, 20 bp, Artificial Sequence
  Description of Artificial Sequence: Synthetic oligonucleotide
ttactaaattagtatgatgc

SEQ ID NO: 12419 - DNA, 20 bp, Artificial Sequence
  Description of Artificial Sequence: Synthetic oligonucleotide
cttactaaattagtatgatg

SEQ ID NO: 12420 - DNA, 20 bp, Artificial Sequence
  Description of Artificial Sequence: Synthetic oligonucleotide
tcttactaaattagtatgat

SEQ ID NO: 12421 - DNA, 20 bp, Artificial Sequence
  Description of Artificial Sequence: Synthetic oligonucleotide
ttcttactaaattagtatga

SEQ ID NO: 12422 - DNA, 20 bp, Artificial Sequence
  Description of Artificial Sequence: Synthetic oligonucleotide
gttcttactaaattagtatg

SEQ ID NO: 12423 - DNA, 20 bp, Artificial Sequence
  Description of Artificial Sequence: Synthetic oligonucleotide
cgttcttactaaattagtat

SEQ ID NO: 12424 - DNA, 20 bp, Artificial Sequence
  Description of Artificial Sequence: Synthetic oligonucleotide
acgttcttactaaattagta

SEQ ID NO: 12425 - DNA, 20 bp, Artificial Sequence
  Description of Artificial Sequence: Synthetic oligonucleotide
aacgttcttactaaattagt

SEQ ID NO: 12426 - DNA, 20 bp, Artificial Sequence
  Description of Artificial Sequence: Synthetic oligonucleotide
gaacgttcttactaaattag

SEQ ID NO: 12427 - DNA, 20 bp, Artificial Sequence
  Description of Artificial Sequence: Synthetic oligonucleotide
ggaacgttcttactaaatta

SEQ ID NO: 12428 - DNA, 20 bp, Artificial Sequence
  Description of Artificial Sequence: Synthetic oligonucleotide
gggaacgttcttactaaatt

SEQ ID NO: 12429 - DNA, 20 bp, Artificial Sequence
  Description of Artificial Sequence: Synthetic oligonucleotide
tgggaacgttcttactaaat

SEQ ID NO: 12430 - DNA, 20 bp, Artificial Sequence
  Description of Artificial Sequence: Synthetic oligonucleotide
ttgggaacgttcttactaaa

SEQ ID NO: 12431 - DNA, 20 bp, Artificial Sequence
  Description of Artificial Sequence: Synthetic oligonucleotide
tttgggaacgttcttactaa

SEQ ID NO: 12432 - DNA, 20 bp, Artificial Sequence
  Description of Artificial Sequence: Synthetic oligonucleotide
atttgggaacgttcttacta

SEQ ID NO: 12433 - DNA, 20 bp, Artificial Sequence
  Description of Artificial Sequence: Synthetic oligonucleotide
catttgggaacgttcttact

SEQ ID NO: 12434 - DNA, 20 bp, Artificial Sequence
  Description of Artificial Sequence: Synthetic oligonucleotide
acatttgggaacgttcttac

SEQ ID NO: 12435 - DNA, 20 bp, Artificial Sequence
  Description of Artificial Sequence: Synthetic oligonucleotide
aacatttgggaacgttctta

SEQ ID NO: 12436 - DNA, 20 bp, Artificial Sequence
  Description of Artificial Sequence: Synthetic oligonucleotide
caacatttgggaacgttctt

SEQ ID NO: 12437 - DNA, 20 bp, Artificial Sequence
  Description of Artificial Sequence: Synthetic oligonucleotide
acaacatttgggaacgttct

SEQ ID NO: 12438 - DNA, 20 bp, Artificial Sequence
  Description of Artificial Sequence: Synthetic oligonucleotide
tacaacatttgggaacgttc

SEQ ID NO: 12439 - DNA, 20 bp, Artificial Sequence
  Description of Artificial Sequence: Synthetic oligonucleotide
ttacaacatttgggaacgtt

SEQ ID NO: 12440 - DNA, 20 bp, Artificial Sequence
  Description of Artificial Sequence: Synthetic oligonucleotide
gttacaacatttgggaacgt

SEQ ID NO: 12441 - DNA, 20 bp, Artificial Sequence
  Description of Artificial Sequence: Synthetic oligonucleotide
tgttacaacatttgggaacg

SEQ ID NO: 12442 - DNA, 20 bp, Artificial Sequence
  Description of Artificial Sequence: Synthetic oligonucleotide
ttgttacaacatttgggaac

SEQ ID NO: 12443 - DNA, 20 bp, Artificial Sequence
  Description of Artificial Sequence: Synthetic oligonucleotide
attgttacaacatttgggaa

SEQ ID NO: 12444 - DNA, 20 bp, Artificial Sequence
  Description of Artificial Sequence: Synthetic oligonucleotide
cattgttacaacatttggga

SEQ ID NO: 12445 - DNA, 20 bp, Artificial Sequence
  Description of Artificial Sequence: Synthetic oligonucleotide
acattgttacaacatttggg

SEQ ID NO: 12446 - DNA, 20 bp, Artificial Sequence
  Description of Artificial Sequence: Synthetic oligonucleotide
cacattgttacaacatttgg

SEQ ID NO: 12447 - DNA, 20 bp, Artificial Sequence
  Description of Artificial Sequence: Synthetic oligonucleotide
ccacattgttacaacatttg

SEQ ID NO: 12448 - DNA, 20 bp, Artificial Sequence
  Description of Artificial Sequence: Synthetic oligonucleotide
tccacattgttacaacattt

SEQ ID NO: 12449 - DNA, 20 bp, Artificial Sequence
  Description of Artificial Sequence: Synthetic oligonucleotide
atccacattgttacaacatt

SEQ ID NO: 12450 - DNA, 20 bp, Artificial Sequence
  Description of Artificial Sequence: Synthetic oligonucleotide
gatccacattgttacaacat

SEQ ID NO: 12451 - DNA, 20 bp, Artificial Sequence
  Description of Artificial Sequence: Synthetic oligonucleotide
tgatccacattgttacaaca

SEQ ID NO: 12452 - DNA, 20 bp, Artificial Sequence
  Description of Artificial Sequence: Synthetic oligonucleotide
atgatccacattgttacaac

SEQ ID NO: 12453 - DNA, 20 bp, Artificial Sequence
  Description of Artificial Sequence: Synthetic oligonucleotide
tatgatccacattgttacaa

SEQ ID NO: 12454 - DNA, 20 bp, Artificial Sequence
  Description of Artificial Sequence: Synthetic oligonucleotide
gtatgatccacattgttaca

SEQ ID NO: 12455 - DNA, 20 bp, Artificial Sequence
  Description of Artificial Sequence: Synthetic oligonucleotide
tgtatgatccacattgttac

SEQ ID NO: 12456 - DNA, 20 bp, Artificial Sequence
  Description of Artificial Sequence: Synthetic oligonucleotide
atgtatgatccacattgtta

SEQ ID NO: 12457 - DNA, 20 bp, Artificial Sequence
  Description of Artificial Sequence: Synthetic oligonucleotide
gatgtatgatccacattgtt

SEQ ID NO: 12458 - DNA, 20 bp, Artificial Sequence
  Description of Artificial Sequence: Synthetic oligonucleotide
agatgtatgatccacattgt

SEQ ID NO: 12459 - DNA, 20 bp, Artificial Sequence
  Description of Artificial Sequence: Synthetic oligonucleotide
gagatgtatgatccacattg

SEQ ID NO: 12460 - DNA, 20 bp, Artificial Sequence
  Description of Artificial Sequence: Synthetic oligonucleotide
agagatgtatgatccacatt

SEQ ID NO: 12461 - DNA, 20 bp, Artificial Sequence
  Description of Artificial Sequence: Synthetic oligonucleotide
cagagatgtatgatccacat

SEQ ID NO: 12462 - DNA, 20 bp, Artificial Sequence
  Description of Artificial Sequence: Synthetic oligonucleotide
ccagagatgtatgatccaca

SEQ ID NO: 12463 - DNA, 20 bp, Artificial Sequence
  Description of Artificial Sequence: Synthetic oligonucleotide
accagagatgtatgatccac

SEQ ID NO: 12464 - DNA, 20 bp, Artificial Sequence
  Description of Artificial Sequence: Synthetic oligonucleotide
aaccagagatgtatgatcca

SEQ ID NO: 12465 - DNA, 20 bp, Artificial Sequence
  Description of Artificial Sequence: Synthetic oligonucleotide
aaaccagagatgtatgatcc

SEQ ID NO: 12466 - DNA, 20 bp, Artificial Sequence
  Description of Artificial Sequence: Synthetic oligonucleotide
aaaaccagagatgtatgatc

SEQ ID NO: 12467 - DNA, 20 bp, Artificial Sequence
  Description of Artificial Sequence: Synthetic oligonucleotide
aaaaaccagagatgtatgat

SEQ ID NO: 12468 - DNA, 20 bp, Artificial Sequence
  Description of Artificial Sequence: Synthetic oligonucleotide
aaaaaaccagagatgtatga

SEQ ID NO: 12469 - DNA, 20 bp, Artificial Sequence
  Description of Artificial Sequence: Synthetic oligonucleotide
taaaaaaccagagatgtatg

SEQ ID NO: 12470 - DNA, 20 bp, Artificial Sequence
  Description of Artificial Sequence: Synthetic oligonucleotide
ttaaaaaaccagagatgtat

SEQ ID NO: 12471 - DNA, 20 bp, Artificial Sequence
  Description of Artificial Sequence: Synthetic oligonucleotide
tttaaaaaaccagagatgta

SEQ ID NO: 12472 - DNA, 20 bp, Artificial Sequence
  Description of Artificial Sequence: Synthetic oligonucleotide
atttaaaaaaccagagatgt

SEQ ID NO: 12473 - DNA, 20 bp, Artificial Sequence
  Description of Artificial Sequence: Synthetic oligonucleotide
catttaaaaaaccagagatg

SEQ ID NO: 12474 - DNA, 20 bp, Artificial Sequence
  Description of Artificial Sequence: Synthetic oligonucleotide
acatttaaaaaaccagagat

SEQ ID NO: 12475 - DNA, 20 bp, Artificial Sequence
  Description of Artificial Sequence: Synthetic oligonucleotide
tacatttaaaaaaccagaga

SEQ ID NO: 12476 - DNA, 20 bp, Artificial Sequence
  Description of Artificial Sequence: Synthetic oligonucleotide
atacatttaaaaaaccagag

SEQ ID NO: 12477 - DNA, 20 bp, Artificial Sequence
  Description of Artificial Sequence: Synthetic oligonucleotide
aatacatttaaaaaaccaga

SEQ ID NO: 12478 - DNA, 20 bp, Artificial Sequence
  Description of Artificial Sequence: Synthetic oligonucleotide
caatacatttaaaaaaccag

SEQ ID NO: 12479 - DNA, 20 bp, Artificial Sequence
  Description of Artificial Sequence: Synthetic oligonucleotide
tcaatacatttaaaaaacca

SEQ ID NO: 12480 - DNA, 20 bp, Artificial Sequence
  Description of Artificial Sequence: Synthetic oligonucleotide
ctcaatacatttaaaaaacc

SEQ ID NO: 12481 - DNA, 20 bp, Artificial Sequence
  Description of Artificial Sequence: Synthetic oligonucleotide
cctcaatacatttaaaaaac

SEQ ID NO: 12482 - DNA, 20 bp, Artificial Sequence
  Description of Artificial Sequence: Synthetic oligonucleotide
gcctcaatacatttaaaaaa

SEQ ID NO: 12483 - DNA, 20 bp, Artificial Sequence
  Description of Artificial Sequence: Synthetic oligonucleotide
agcctcaatacatttaaaaa

SEQ ID NO: 12484 - DNA, 20 bp, Artificial Sequence
  Description of Artificial Sequence: Synthetic oligonucleotide
aagcctcaatacatttaaaa

SEQ ID NO: 12485 - DNA, 20 bp, Artificial Sequence
  Description of Artificial Sequence: Synthetic oligonucleotide
aaagcctcaatacatttaaa

SEQ ID NO: 12486 - DNA, 20 bp, Artificial Sequence
  Description of Artificial Sequence: Synthetic oligonucleotide
gaaagcctcaatacatttaa

SEQ ID NO: 12487 - DNA, 20 bp, Artificial Sequence
  Description of Artificial Sequence: Synthetic oligonucleotide
agaaagcctcaatacattta

SEQ ID NO: 12488 - DNA, 20 bp, Artificial Sequence
  Description of Artificial Sequence: Synthetic oligonucleotide
aagaaagcctcaatacattt

SEQ ID NO: 12489 - DNA, 20 bp, Artificial Sequence
  Description of Artificial Sequence: Synthetic oligonucleotide
caagaaagcctcaatacatt

SEQ ID NO: 12490 - DNA, 20 bp, Artificial Sequence
  Description of Artificial Sequence: Synthetic oligonucleotide
ccaagaaagcctcaatacat

SEQ ID NO: 12491 - DNA, 20 bp, Artificial Sequence
  Description of Artificial Sequence: Synthetic oligonucleotide
accaagaaagcctcaataca

SEQ ID NO: 12492 - DNA, 20 bp, Artificial Sequence
  Description of Artificial Sequence: Synthetic oligonucleotide
caccaagaaagcctcaatac

SEQ ID NO: 12493 - DNA, 20 bp, Artificial Sequence
  Description of Artificial Sequence: Synthetic oligonucleotide
ccaccaagaaagcctcaata

SEQ ID NO: 12494 - DNA, 20 bp, Artificial Sequence
  Description of Artificial Sequence: Synthetic oligonucleotide
tccaccaagaaagcctcaat

SEQ ID NO: 12495 - DNA, 20 bp, Artificial Sequence
  Description of Artificial Sequence: Synthetic oligonucleotide
gtccaccaagaaagcctcaa

SEQ ID NO: 12496 - DNA, 20 bp, Artificial Sequence
  Description of Artificial Sequence: Synthetic oligonucleotide
agtccaccaagaaagcctca

SEQ ID NO: 12497 - DNA, 20 bp, Artificial Sequence
  Description of Artificial Sequence: Synthetic oligonucleotide
tagtccaccaagaaagcctc

SEQ ID NO: 12498 - DNA, 20 bp, Artificial Sequence
  Description of Artificial Sequence: Synthetic oligonucleotide
ctagtccaccaagaaagcct

SEQ ID NO: 12499 - DNA, 20 bp, Artificial Sequence
  Description of Artificial Sequence: Synthetic oligonucleotide
actagtccaccaagaaagcc

SEQ ID NO: 12500 - DNA, 20 bp, Artificial Sequence
  Description of Artificial Sequence: Synthetic oligonucleotide
tactagtccaccaagaaagc

SEQ ID NO: 12501 - DNA, 20 bp, Artificial Sequence
  Description of Artificial Sequence: Synthetic oligonucleotide
atactagtccaccaagaaag

SEQ ID NO: 12502 - DNA, 20 bp, Artificial Sequence
  Description of Artificial Sequence: Synthetic oligonucleotide
tatactagtccaccaagaaa

SEQ ID NO: 12503 - DNA, 20 bp, Artificial Sequence
  Description of Artificial Sequence: Synthetic oligonucleotide
ctatactagtccaccaagaa

SEQ ID NO: 12504 - DNA, 20 bp, Artificial Sequence
  Description of Artificial Sequence: Synthetic oligonucleotide
actatactagtccaccaaga

SEQ ID NO: 12505 - DNA, 20 bp, Artificial Sequence
  Description of Artificial Sequence: Synthetic oligonucleotide
tactatactagtccaccaag

SEQ ID NO: 12506 - DNA, 20 bp, Artificial Sequence
  Description of Artificial Sequence: Synthetic oligonucleotide
atactatactagtccaccaa

SEQ ID NO: 12507 - DNA, 20 bp, Artificial Sequence
  Description of Artificial Sequence: Synthetic oligonucleotide
tatactatactagtccacca

SEQ ID NO: 12508 - DNA, 20 bp, Artificial Sequence
  Description of Artificial Sequence: Synthetic oligonucleotide
gtatactatactagtccacc

SEQ ID NO: 12509 - DNA, 20 bp, Artificial Sequence
  Description of Artificial Sequence: Synthetic oligonucleotide
cgtatactatactagtccac

SEQ ID NO: 12510 - DNA, 20 bp, Artificial Sequence
  Description of Artificial Sequence: Synthetic oligonucleotide
ccgtatactatactagtcca

SEQ ID NO: 12511 - DNA, 20 bp, Artificial Sequence
  Description of Artificial Sequence: Synthetic oligonucleotide
accgtatactatactagtcc

SEQ ID NO: 12512 - DNA, 20 bp, Artificial Sequence
  Description of Artificial Sequence: Synthetic oligonucleotide
gaccgtatactatactagtc

SEQ ID NO: 12513 - DNA, 20 bp, Artificial Sequence
  Description of Artificial Sequence: Synthetic oligonucleotide
tgaccgtatactatactagt

SEQ ID NO: 12514 - DNA, 20 bp, Artificial Sequence
  Description of Artificial Sequence: Synthetic oligonucleotide
ctgaccgtatactatactag

SEQ ID NO: 12515 - DNA, 20 bp, Artificial Sequence
  Description of Artificial Sequence: Synthetic oligonucleotide
actgaccgtatactatacta

SEQ ID NO: 12516 - DNA, 20 bp, Artificial Sequence
  Description of Artificial Sequence: Synthetic oligonucleotide
aactgaccgtatactatact

SEQ ID NO: 12517 - DNA, 20 bp, Artificial Sequence
  Description of Artificial Sequence: Synthetic oligonucleotide
taactgaccgtatactatac

SEQ ID NO: 12518 - DNA, 20 bp, Artificial Sequence
  Description of Artificial Sequence: Synthetic oligonucleotide
ataactgaccgtatactata

SEQ ID NO: 12519 - DNA, 20 bp, Artificial Sequence
  Description of Artificial Sequence: Synthetic oligonucleotide
cataactgaccgtatactat

SEQ ID NO: 12520 - DNA, 20 bp, Artificial Sequence
  Description of Artificial Sequence: Synthetic oligonucleotide
acataactgaccgtatacta

SEQ ID NO: 12521 - DNA, 20 bp, Artificial Sequence
  Description of Artificial Sequence: Synthetic oligonucleotide
gacataactgaccgtatact

SEQ ID NO: 12522 - DNA, 20 bp, Artificial Sequence
  Description of Artificial Sequence: Synthetic oligonucleotide
tgacataactgaccgtatac

SEQ ID NO: 12523 - DNA, 20 bp, Artificial Sequence
  Description of Artificial Sequence: Synthetic oligonucleotide
ttgacataactgaccgtata

SEQ ID NO: 12524 - DNA, 20 bp, Artificial Sequence
  Description of Artificial Sequence: Synthetic oligonucleotide
attgacataactgaccgtat

SEQ ID NO: 12525 - DNA, 20 bp, Artificial Sequence
  Description of Artificial Sequence: Synthetic oligonucleotide
cattgacataactgaccgta

SEQ ID NO: 12526 - DNA, 20 bp, Artificial Sequence
  Description of Artificial Sequence: Synthetic oligonucleotide
acattgacataactgaccgt

SEQ ID NO: 12527 - DNA, 20 bp, Artificial Sequence
  Description of Artificial Sequence: Synthetic oligonucleotide
aacattgacataactgaccg

SEQ ID NO: 12528 - DNA, 20 bp, Artificial Sequence
  Description of Artificial Sequence: Synthetic oligonucleotide
aaacattgacataactgacc

SEQ ID NO: 12529 - DNA, 20 bp, Artificial Sequence
  Description of Artificial Sequence: Synthetic oligonucleotide
gaaacattgacataactgac

SEQ ID NO: 12530 - DNA, 20 bp, Artificial Sequence
  Description of Artificial Sequence: Synthetic oligonucleotide
tgaaacattgacataactga

SEQ ID NO: 12531 - DNA, 20 bp, Artificial Sequence
  Description of Artificial Sequence: Synthetic oligonucleotide
atgaaacattgacataactg

SEQ ID NO: 12532 - DNA, 20 bp, Artificial Sequence
  Description of Artificial Sequence: Synthetic oligonucleotide
catgaaacattgacataact

SEQ ID NO: 12533 - DNA, 20 bp, Artificial Sequence
  Description of Artificial Sequence: Synthetic oligonucleotide
ccatgaaacattgacataac

SEQ ID NO: 12534 - DNA, 20 bp, Artificial Sequence
  Description of Artificial Sequence: Synthetic oligonucleotide
accatgaaacattgacataa

SEQ ID NO: 12535 - DNA, 20 bp, Artificial Sequence
  Description of Artificial Sequence: Synthetic oligonucleotide
gaccatgaaacattgacata

SEQ ID NO: 12536 - DNA, 20 bp, Artificial Sequence
  Description of Artificial Sequence: Synthetic oligonucleotide
tgaccatgaaacattgacat

SEQ ID NO: 12537 - DNA, 20 bp, Artificial Sequence
  Description of Artificial Sequence: Synthetic oligonucleotide
ttgaccatgaaacattgaca

SEQ ID NO: 12538 - DNA, 20 bp, Artificial Sequence
  Description of Artificial Sequence: Synthetic oligonucleotide
attgaccatgaaacattgac

SEQ ID NO: 12539 - DNA, 20 bp, Artificial Sequence
  Description of Artificial Sequence: Synthetic oligonucleotide
tattgaccatgaaacattga

SEQ ID NO: 12540 - DNA, 20 bp, Artificial Sequence
  Description of Artificial Sequence: Synthetic oligonucleotide
ttattgaccatgaaacattg

SEQ ID NO: 12541 - DNA, 20 bp, Artificial Sequence
  Description of Artificial Sequence: Synthetic oligonucleotide
tttattgaccatgaaacatt

SEQ ID NO: 12542 - DNA, 20 bp, Artificial Sequence
  Description of Artificial Sequence: Synthetic oligonucleotide
ttttattgaccatgaaacat

SEQ ID NO: 12543 - DNA, 20 bp, Artificial Sequence
  Description of Artificial Sequence: Synthetic oligonucleotide
tttttattgaccatgaaaca

SEQ ID NO: 12544 - DNA, 20 bp, Artificial Sequence
  Description of Artificial Sequence: Synthetic oligonucleotide
ctttttattgaccatgaaac

SEQ ID NO: 12545 - DNA, 20 bp, Artificial Sequence
  Description of Artificial Sequence: Synthetic oligonucleotide
cctttttattgaccatgaaa

SEQ ID NO: 12546 - DNA, 20 bp, Artificial Sequence
  Description of Artificial Sequence: Synthetic oligonucleotide
tcctttttattgaccatgaa

SEQ ID NO: 12547 - DNA, 20 bp, Artificial Sequence
  Description of Artificial Sequence: Synthetic oligonucleotide
ttcctttttattgaccatga

SEQ ID NO: 12548 - DNA, 20 bp, Artificial Sequence
  Description of Artificial Sequence: Synthetic oligonucleotide
cttcctttttattgaccatg

SEQ ID NO: 12549 - DNA, 20 bp, Artificial Sequence
  Description of Artificial Sequence: Synthetic oligonucleotide
acttcctttttattgaccat

SEQ ID NO: 12550 - DNA, 20 bp, Artificial Sequence
  Description of Artificial Sequence: Synthetic oligonucleotide
aacttcctttttattgacca

SEQ ID NO: 12551 - DNA, 20 bp, Artificial Sequence
  Description of Artificial Sequence: Synthetic oligonucleotide
caacttcctttttattgacc

SEQ ID NO: 12552 - DNA, 20 bp, Artificial Sequence
  Description of Artificial Sequence: Synthetic oligonucleotide
gcaacttcctttttattgac

SEQ ID NO: 12553 - DNA, 20 bp, Artificial Sequence
  Description of Artificial Sequence: Synthetic oligonucleotide
tgcaacttcctttttattga

SEQ ID NO: 12554 - DNA, 20 bp, Artificial Sequence
  Description of Artificial Sequence: Synthetic oligonucleotide
ttgcaacttcctttttattg

SEQ ID NO: 12555 - DNA, 20 bp, Artificial Sequence
  Description of Artificial Sequence: Synthetic oligonucleotide
tttgcaacttcctttttatt

SEQ ID NO: 12556 - DNA, 20 bp, Artificial Sequence
  Description of Artificial Sequence: Synthetic oligonucleotide
atttgcaacttcctttttat

SEQ ID NO: 12557 - DNA, 20 bp, Artificial Sequence
  Description of Artificial Sequence: Synthetic oligonucleotide
aatttgcaacttccttttta

SEQ ID NO: 12558 - DNA, 20 bp, Artificial Sequence
  Description of Artificial Sequence: Synthetic oligonucleotide
caatttgcaacttccttttt

SEQ ID NO: 12559 - DNA, 20 bp, Artificial Sequence
  Description of Artificial Sequence: Synthetic oligonucleotide
acaatttgcaacttcctttt

SEQ ID NO: 12560 - DNA, 20 bp, Artificial Sequence
  Description of Artificial Sequence: Synthetic oligonucleotide
cacaatttgcaacttccttt

SEQ ID NO: 12561 - DNA, 20 bp, Artificial Sequence
  Description of Artificial Sequence: Synthetic oligonucleotide
tcacaatttgcaacttcctt

SEQ ID NO: 12562 - DNA, 20 bp, Artificial Sequence
  Description of Artificial Sequence: Synthetic oligonucleotide
agcaggggcgtggcgagggt

SEQ ID NO: 12563 - DNA, 20 bp, Artificial Sequence
  Description of Artificial Sequence: Synthetic oligonucleotide
gagcaggggcgtggcgaggg

SEQ ID NO: 12564 - DNA, 20 bp, Artificial Sequence
  Description of Artificial Sequence: Synthetic oligonucleotide
ggagcaggggcgtggcgagg

SEQ ID NO: 12565 - DNA, 20 bp, Artificial Sequence
  Description of Artificial Sequence: Synthetic oligonucleotide
gggagcaggggcgtggcgag

SEQ ID NO: 12566 - DNA, 20 bp, Artificial Sequence
  Description of Artificial Sequence: Synthetic oligonucleotide
ggggagcaggggcgtggcga

SEQ ID NO: 12567 - DNA, 20 bp, Artificial Sequence
  Description of Artificial Sequence: Synthetic oligonucleotide
gggggagcaggggcgtggcg

SEQ ID NO: 12568 - DNA, 20 bp, Artificial Sequence
  Description of Artificial Sequence: Synthetic oligonucleotide
cgggggagcaggggcgtggc

SEQ ID NO: 12569 - DNA, 20 bp, Artificial Sequence
  Description of Artificial Sequence: Synthetic oligonucleotide
gcgggggagcaggggcgtgg

SEQ ID NO: 12570 - DNA, 20 bp, Artificial Sequence
  Description of Artificial Sequence: Synthetic oligonucleotide
cgcgggggagcaggggcgtg

SEQ ID NO: 12571 - DNA, 20 bp, Artificial Sequence
  Description of Artificial Sequence: Synthetic oligonucleotide
ccgcgggggagcaggggcgt

SEQ ID NO: 12572 - DNA, 20 bp, Artificial Sequence
  Description of Artificial Sequence: Synthetic oligonucleotide
accgcgggggagcaggggcg

SEQ ID NO: 12573 - DNA, 20 bp, Artificial Sequence
  Description of Artificial Sequence: Synthetic oligonucleotide
aaccgcgggggagcaggggc

SEQ ID NO: 12574 - DNA, 20 bp, Artificial Sequence
  Description of Artificial Sequence: Synthetic oligonucleotide
caaccgcgggggagcagggg

SEQ ID NO: 12575 - DNA, 20 bp, Artificial Sequence
  Description of Artificial Sequence: Synthetic oligonucleotide
ccaaccgcgggggagcaggg

SEQ ID NO: 12576 - DNA, 20 bp, Artificial Sequence
  Description of Artificial Sequence: Synthetic oligonucleotide
accaaccgcgggggagcagg

SEQ ID NO: 12577 - DNA, 20 bp, Artificial Sequence
  Description of Artificial Sequence: Synthetic oligonucleotide
aaccaaccgcgggggagcag

SEQ ID NO: 12578 - DNA, 20 bp, Artificial Sequence
  Description of Artificial Sequence: Synthetic oligonucleotide
gaaccaaccgcgggggagca

SEQ ID NO: 12579 - DNA, 20 bp, Artificial Sequence
  Description of Artificial Sequence: Synthetic oligonucleotide
agaaccaaccgcgggggagc

SEQ ID NO: 12580 - DNA, 20 bp, Artificial Sequence
  Description of Artificial Sequence: Synthetic oligonucleotide
aagaaccaaccgcgggggag

SEQ ID NO: 12581 - DNA, 20 bp, Artificial Sequence
  Description of Artificial Sequence: Synthetic oligonucleotide
gaagaaccaaccgcggggga

SEQ ID NO: 12582 - DNA, 20 bp, Artificial Sequence
  Description of Artificial Sequence: Synthetic oligonucleotide
ggaagaaccaaccgcggggg

SEQ ID NO: 12583 - DNA, 20 bp, Artificial Sequence
  Description of Artificial Sequence: Synthetic oligonucleotide
aggaagaaccaaccgcgggg

SEQ ID NO: 12584 - DNA, 20 bp, Artificial Sequence
  Description of Artificial Sequence: Synthetic oligonucleotide
aaggaagaaccaaccgcggg

SEQ ID NO: 12585 - DNA, 20 bp, Artificial Sequence
  Description of Artificial Sequence: Synthetic oligonucleotide
caaggaagaaccaaccgcgg

SEQ ID NO: 12586 - DNA, 20 bp, Artificial Sequence
  Description of Artificial Sequence: Synthetic oligonucleotide
gcaaggaagaaccaaccgcg

SEQ ID NO: 12587 - DNA, 20 bp, Artificial Sequence
  Description of Artificial Sequence: Synthetic oligonucleotide
agcaaggaagaaccaaccgc

SEQ ID NO: 12588 - DNA, 20 bp, Artificial Sequence
  Description of Artificial Sequence: Synthetic oligonucleotide
gagcaaggaagaaccaaccg

SEQ ID NO: 12589 - DNA, 20 bp, Artificial Sequence
  Description of Artificial Sequence: Synthetic oligonucleotide
agagcaaggaagaaccaacc

SEQ ID NO: 12590 - DNA, 20 bp, Artificial Sequence
  Description of Artificial Sequence: Synthetic oligonucleotide
tagagcaaggaagaaccaac

SEQ ID NO: 12591 - DNA, 20 bp, Artificial Sequence
  Description of Artificial Sequence: Synthetic oligonucleotide
gtagagcaaggaagaaccaa

SEQ ID NO: 12592 - DNA, 20 bp, Artificial Sequence
  Description of Artificial Sequence: Synthetic oligonucleotide
agtagagcaaggaagaacca

SEQ ID NO: 12593 - DNA, 20 bp, Artificial Sequence
  Description of Artificial Sequence: Synthetic oligonucleotide
gagtagagcaaggaagaacc

SEQ ID NO: 12594 - DNA, 20 bp, Artificial Sequence
  Description of Artificial Sequence: Synthetic oligonucleotide
tgagtagagcaaggaagaac

SEQ ID NO: 12595 - DNA, 20 bp, Artificial Sequence
  Description of Artificial Sequence: Synthetic oligonucleotide
ttgagtagagcaaggaagaa

SEQ ID NO: 12596 - DNA, 20 bp, Artificial Sequence
  Description of Artificial Sequence: Synthetic oligonucleotide
gttgagtagagcaaggaaga

SEQ ID NO: 12597 - DNA, 20 bp, Artificial Sequence
  Description of Artificial Sequence: Synthetic oligonucleotide
ggttgagtagagcaaggaag

SEQ ID NO: 12598 - DNA, 20 bp, Artificial Sequence
  Description of Artificial Sequence: Synthetic oligonucleotide
gggttgagtagagcaaggaa

SEQ ID NO: 12599 - DNA, 20 bp, Artificial Sequence
  Description of Artificial Sequence: Synthetic oligonucleotide
agggttgagtagagcaagga

SEQ ID NO: 12600 - DNA, 20 bp, Artificial Sequence
  Description of Artificial Sequence: Synthetic oligonucleotide
cagggttgagtagagcaagg

SEQ ID NO: 12601 - DNA, 20 bp, Artificial Sequence
  Description of Artificial Sequence: Synthetic oligonucleotide
tcagggttgagtagagcaag

SEQ ID NO: 12602 - DNA, 20 bp, Artificial Sequence
  Description of Artificial Sequence: Synthetic oligonucleotide
gtcagggttgagtagagcaa

SEQ ID NO: 12603 - DNA, 20 bp, Artificial Sequence
  Description of Artificial Sequence: Synthetic oligonucleotide
ggtcagggttgagtagagca

SEQ ID NO: 12604 - DNA, 20 bp, Artificial Sequence
  Description of Artificial Sequence: Synthetic oligonucleotide
aggtcagggttgagtagagc

SEQ ID NO: 12605 - DNA, 20 bp, Artificial Sequence
  Description of Artificial Sequence: Synthetic oligonucleotide
gaggtcagggttgagtagag

SEQ ID NO: 12606 - DNA, 20 bp, Artificial Sequence
  Description of Artificial Sequence: Synthetic oligonucleotide
agaggtcagggttgagtaga

SEQ ID NO: 12607 - DNA, 20 bp, Artificial Sequence
  Description of Artificial Sequence: Synthetic oligonucleotide
aagaggtcagggttgagtag

SEQ ID NO: 12608 - DNA, 20 bp, Artificial Sequence
  Description of Artificial Sequence: Synthetic oligonucleotide
gaagaggtcagggttgagta

SEQ ID NO: 12609 - DNA, 20 bp, Artificial Sequence
  Description of Artificial Sequence: Synthetic oligonucleotide
agaagaggtcagggttgagt

SEQ ID NO: 12610 - DNA, 20 bp, Artificial Sequence
  Description of Artificial Sequence: Synthetic oligonucleotide
gagaagaggtcagggttgag

SEQ ID NO: 12611 - DNA, 20 bp, Artificial Sequence
  Description of Artificial Sequence: Synthetic oligonucleotide
agagaagaggtcagggttga

SEQ ID NO: 12612 - DNA, 20 bp, Artificial Sequence
  Description of Artificial Sequence: Synthetic oligonucleotide
gagagaagaggtcagggttg

SEQ ID NO: 12613 - DNA, 20 bp, Artificial Sequence
  Description of Artificial Sequence: Synthetic oligonucleotide
agagagaagaggtcagggtt

SEQ ID NO: 12614 - DNA, 20 bp, Artificial Sequence
  Description of Artificial Sequence: Synthetic oligonucleotide
cagagagaagaggtcagggt

SEQ ID NO: 12615 - DNA, 20 bp, Artificial Sequence
  Description of Artificial Sequence: Synthetic oligonucleotide
tcagagagaagaggtcaggg

SEQ ID NO: 12616 - DNA, 20 bp, Artificial Sequence
  Description of Artificial Sequence: Synthetic oligonucleotide
gtcagagagaagaggtcagg

SEQ ID NO: 12617 - DNA, 20 bp, Artificial Sequence
  Description of Artificial Sequence: Synthetic oligonucleotide
agtcagagagaagaggtcag

SEQ ID NO: 12618 - DNA, 20 bp, Artificial Sequence
  Description of Artificial Sequence: Synthetic oligonucleotide
gagtcagagagaagaggtca

SEQ ID NO: 12619 - DNA, 20 bp, Artificial Sequence
  Description of Artificial Sequence: Synthetic oligonucleotide
agagtcagagagaagaggtc

SEQ ID NO: 12620 - DNA, 20 bp, Artificial Sequence
  Description of Artificial Sequence: Synthetic oligonucleotide
gagagtcagagagaagaggt

SEQ ID NO: 12621 - DNA, 20 bp, Artificial Sequence
  Description of Artificial Sequence: Synthetic oligonucleotide
cgagagtcagagagaagagg

SEQ ID NO: 12622 - DNA, 20 bp, Artificial Sequence
  Description of Artificial Sequence: Synthetic oligonucleotide
tcgagagtcagagagaagag

SEQ ID NO: 12623 - DNA, 20 bp, Artificial Sequence
  Description of Artificial Sequence: Synthetic oligonucleotide
gtcgagagtcagagagaaga

SEQ ID NO: 12624 - DNA, 20 bp, Artificial Sequence
  Description of Artificial Sequence: Synthetic oligonucleotide
agtcgagagtcagagagaag

SEQ ID NO: 12625 - DNA, 20 bp, Artificial Sequence
  Description of Artificial Sequence: Synthetic oligonucleotide
aagtcgagagtcagagagaa

SEQ ID NO: 12626 - DNA, 20 bp, Artificial Sequence
  Description of Artificial Sequence: Synthetic oligonucleotide
caagtcgagagtcagagaga

SEQ ID NO: 12627 - DNA, 20 bp, Artificial Sequence
  Description of Artificial Sequence: Synthetic oligonucleotide
acaagtcgagagtcagagag

SEQ ID NO: 12628 - DNA, 20 bp, Artificial Sequence
  Description of Artificial Sequence: Synthetic oligonucleotide
cacaagtcgagagtcagaga

SEQ ID NO: 12629 - DNA, 20 bp, Artificial Sequence
  Description of Artificial Sequence: Synthetic oligonucleotide
acacaagtcgagagtcagag

SEQ ID NO: 12630 - DNA, 20 bp, Artificial Sequence
  Description of Artificial Sequence: Synthetic oligonucleotide
aacacaagtcgagagtcaga

SEQ ID NO: 12631 - DNA, 20 bp, Artificial Sequence
  Description of Artificial Sequence: Synthetic oligonucleotide
gaacacaagtcgagagtcag

SEQ ID NO: 12632 - DNA, 20 bp, Artificial Sequence
  Description of Artificial Sequence: Synthetic oligonucleotide
ggaacacaagtcgagagtca

SEQ ID NO: 12633 - DNA, 20 bp, Artificial Sequence
  Description of Artificial Sequence: Synthetic oligonucleotide
gggaacacaagtcgagagtc

SEQ ID NO: 12634 - DNA, 20 bp, Artificial Sequence
  Description of Artificial Sequence: Synthetic oligonucleotide
ggggaacacaagtcgagagt

SEQ ID NO: 12635 - DNA, 20 bp, Artificial Sequence
  Description of Artificial Sequence: Synthetic oligonucleotide
cggggaacacaagtcgagag

SEQ ID NO: 12636 - DNA, 20 bp, Artificial Sequence
  Description of Artificial Sequence: Synthetic oligonucleotide
gcggggaacacaagtcgaga

SEQ ID NO: 12637 - DNA, 20 bp, Artificial Sequence
  Description of Artificial Sequence: Synthetic oligonucleotide
agcggggaacacaagtcgag

SEQ ID NO: 12638 - DNA, 20 bp, Artificial Sequence
  Description of Artificial Sequence: Synthetic oligonucleotide
gagcggggaacacaagtcga

SEQ ID NO: 12639 - DNA, 20 bp, Artificial Sequence
  Description of Artificial Sequence: Synthetic oligonucleotide
ggagcggggaacacaagtcg

SEQ ID NO: 12640 - DNA, 20 bp, Artificial Sequence
  Description of Artificial Sequence: Synthetic oligonucleotide
aggagcggggaacacaagtc

SEQ ID NO: 12641 - DNA, 20 bp, Artificial Sequence
  Description of Artificial Sequence: Synthetic oligonucleotide
gaggagcggggaacacaagt

SEQ ID NO: 12642 - DNA, 20 bp, Artificial Sequence
  Description of Artificial Sequence: Synthetic oligonucleotide
ggaggagcggggaacacaag

SEQ ID NO: 12643 - DNA, 20 bp, Artificial Sequence
  Description of Artificial Sequence: Synthetic oligonucleotide
gggaggagcggggaacacaa

SEQ ID NO: 12644 - DNA, 20 bp, Artificial Sequence
  Description of Artificial Sequence: Synthetic oligonucleotide
agggaggagcggggaacaca

SEQ ID NO: 12645 - DNA, 20 bp, Artificial Sequence
  Description of Artificial Sequence: Synthetic oligonucleotide
cagggaggagcggggaacac

SEQ ID NO: 12646 - DNA, 20 bp, Artificial Sequence
  Description of Artificial Sequence: Synthetic oligonucleotide
tcagggaggagcggggaaca

SEQ ID NO: 12647 - DNA, 20 bp, Artificial Sequence
  Description of Artificial Sequence: Synthetic oligonucleotide
gtcagggaggagcggggaac

SEQ ID NO: 12648 - DNA, 20 bp, Artificial Sequence
  Description of Artificial Sequence: Synthetic oligonucleotide
ggtcagggaggagcggggaa

SEQ ID NO: 12649 - DNA, 20 bp, Artificial Sequence
  Description of Artificial Sequence: Synthetic oligonucleotide
aggtcagggaggagcgggga

SEQ ID NO: 12650 - DNA, 20 bp, Artificial Sequence
  Description of Artificial Sequence: Synthetic oligonucleotide
aaggtcagggaggagcgggg

SEQ ID NO: 12651 - DNA, 20 bp, Artificial Sequence
  Description of Artificial Sequence: Synthetic oligonucleotide
gaaggtcagggaggagcggg

SEQ ID NO: 12652 - DNA, 20 bp, Artificial Sequence
  Description of Artificial Sequence: Synthetic oligonucleotide
ggaaggtcagggaggagcgg

SEQ ID NO: 12653 - DNA, 20 bp, Artificial Sequence
  Description of Artificial Sequence: Synthetic oligonucleotide
aggaaggtcagggaggagcg

SEQ ID NO: 12654 - DNA, 20 bp, Artificial Sequence
  Description of Artificial Sequence: Synthetic oligonucleotide
gaggaaggtcagggaggagc

SEQ ID NO: 12655 - DNA, 20 bp, Artificial Sequence
  Description of Artificial Sequence: Synthetic oligonucleotide
ggaggaaggtcagggaggag

SEQ ID NO: 12656 - DNA, 20 bp, Artificial Sequence
  Description of Artificial Sequence: Synthetic oligonucleotide
gggaggaaggtcagggagga

SEQ ID NO: 12657 - DNA, 20 bp, Artificial Sequence
  Description of Artificial Sequence: Synthetic oligonucleotide
ggggaggaaggtcagggagg

SEQ ID NO: 12658 - DNA, 20 bp, Artificial Sequence
  Description of Artificial Sequence: Synthetic oligonucleotide
aggggaggaaggtcagggag

SEQ ID NO: 12659 - DNA, 20 bp, Artificial Sequence
  Description of Artificial Sequence: Synthetic oligonucleotide
gaggggaggaaggtcaggga

SEQ ID NO: 12660 - DNA, 20 bp, Artificial Sequence
  Description of Artificial Sequence: Synthetic oligonucleotide
ggaggggaggaaggtcaggg

SEQ ID NO: 12661 - DNA, 20 bp, Artificial Sequence
  Description of Artificial Sequence: Synthetic oligonucleotide
gggaggggaggaaggtcagg

SEQ ID NO: 12662 - DNA, 20 bp, Artificial Sequence
  Description of Artificial Sequence: Synthetic oligonucleotide
ggggaggggaggaaggtcag

SEQ ID NO: 12663 - DNA, 20 bp, Artificial Sequence
  Description of Artificial Sequence: Synthetic oligonucleotide
aggggaggggaggaaggtca

SEQ ID NO: 12664 - DNA, 20 bp, Artificial Sequence
  Description of Artificial Sequence: Synthetic oligonucleotide
aaggggaggggaggaaggtc

SEQ ID NO: 12665 - DNA, 20 bp, Artificial Sequence
  Description of Artificial Sequence: Synthetic oligonucleotide
aaaggggaggggaggaaggt

SEQ ID NO: 12666 - DNA, 20 bp, Artificial Sequence
  Description of Artificial Sequence: Synthetic oligonucleotide
gaaaggggaggggaggaagg

SEQ ID NO: 12667 - DNA, 20 bp, Artificial Sequence
  Description of Artificial Sequence: Synthetic oligonucleotide
tgaaaggggaggggaggaag

SEQ ID NO: 12668 - DNA, 20 bp, Artificial Sequence
  Description of Artificial Sequence: Synthetic oligonucleotide
gtgaaaggggaggggaggaa

SEQ ID NO: 12669 - DNA, 20 bp, Artificial Sequence
  Description of Artificial Sequence: Synthetic oligonucleotide
agtgaaaggggaggggagga

SEQ ID NO: 12670 - DNA, 20 bp, Artificial Sequence
  Description of Artificial Sequence: Synthetic oligonucleotide
gagtgaaaggggaggggagg

SEQ ID NO: 12671 - DNA, 20 bp, Artificial Sequence
  Description of Artificial Sequence: Synthetic oligonucleotide
tgagtgaaaggggaggggag

SEQ ID NO: 12672 - DNA, 20 bp, Artificial Sequence
  Description of Artificial Sequence: Synthetic oligonucleotide
ttgagtgaaaggggagggga

SEQ ID NO: 12673 - DNA, 20 bp, Artificial Sequence
  Description of Artificial Sequence: Synthetic oligonucleotide
attgagtgaaaggggagggg

SEQ ID NO: 12674 - DNA, 20 bp, Artificial Sequence
  Description of Artificial Sequence: Synthetic oligonucleotide
aattgagtgaaaggggaggg

SEQ ID NO: 12675 - DNA, 20 bp, Artificial Sequence
  Description of Artificial Sequence: Synthetic oligonucleotide
gaattgagtgaaaggggagg

SEQ ID NO: 12676 - DNA, 20 bp, Artificial Sequence
  Description of Artificial Sequence: Synthetic oligonucleotide
agaattgagtgaaaggggag

SEQ ID NO: 12677 - DNA, 20 bp, Artificial Sequence
  Description of Artificial Sequence: Synthetic oligonucleotide
gagaattgagtgaaagggga

SEQ ID NO: 12678 - DNA, 20 bp, Artificial Sequence
  Description of Artificial Sequence: Synthetic oligonucleotide
tgagaattgagtgaaagggg

SEQ ID NO: 12679 - DNA, 20 bp, Artificial Sequence
  Description of Artificial Sequence: Synthetic oligonucleotide
gtgagaattgagtgaaaggg

SEQ ID NO: 12680 - DNA, 20 bp, Artificial Sequence
  Description of Artificial Sequence: Synthetic oligonucleotide
ggtgagaattgagtgaaagg

SEQ ID NO: 12681 - DNA, 20 bp, Artificial Sequence
  Description of Artificial Sequence: Synthetic oligonucleotide
tggtgagaattgagtgaaag

SEQ ID NO: 12682 - DNA, 20 bp, Artificial Sequence
  Description of Artificial Sequence: Synthetic oligonucleotide
ttggtgagaattgagtgaaa

SEQ ID NO: 12683 - DNA, 20 bp, Artificial Sequence
  Description of Artificial Sequence: Synthetic oligonucleotide
gttggtgagaattgagtgaa

SEQ ID NO: 12684 - DNA, 20 bp, Artificial Sequence
  Description of Artificial Sequence: Synthetic oligonucleotide
agttggtgagaattgagtga

SEQ ID NO: 12685 - DNA, 20 bp, Artificial Sequence
  Description of Artificial Sequence: Synthetic oligonucleotide
gagttggtgagaattgagtg

SEQ ID NO: 12686 - DNA, 20 bp, Artificial Sequence
  Description of Artificial Sequence: Synthetic oligonucleotide
agagttggtgagaattgagt

SEQ ID NO: 12687 - DNA, 20 bp, Artificial Sequence
  Description of Artificial Sequence: Synthetic oligonucleotide
aagagttggtgagaattgag

SEQ ID NO: 12688 - DNA, 20 bp, Artificial Sequence
  Description of Artificial Sequence: Synthetic oligonucleotide
aaagagttggtgagaattga

SEQ ID NO: 12689 - DNA, 20 bp, Artificial Sequence
  Description of Artificial Sequence: Synthetic oligonucleotide
gaaagagttggtgagaattg

SEQ ID NO: 12690 - DNA, 20 bp, Artificial Sequence
  Description of Artificial Sequence: Synthetic oligonucleotide
agaaagagttggtgagaatt

SEQ ID NO: 12691 - DNA, 20 bp, Artificial Sequence
  Description of Artificial Sequence: Synthetic oligonucleotide
gagaaagagttggtgagaat

SEQ ID NO: 12692 - DNA, 20 bp, Artificial Sequence
  Description of Artificial Sequence: Synthetic oligonucleotide
agagaaagagttggtgagaa

SEQ ID NO: 12693 - DNA, 20 bp, Artificial Sequence
  Description of Artificial Sequence: Synthetic oligonucleotide
gagagaaagagttggtgaga

SEQ ID NO: 12694 - DNA, 20 bp, Artificial Sequence
  Description of Artificial Sequence: Synthetic oligonucleotide
agagagaaagagttggtgag

SEQ ID NO: 12695 - DNA, 20 bp, Artificial Sequence
  Description of Artificial Sequence: Synthetic oligonucleotide
gagagagaaagagttggtga

SEQ ID NO: 12696 - DNA, 20 bp, Artificial Sequence
  Description of Artificial Sequence: Synthetic oligonucleotide
agagagagaaagagttggtg

SEQ ID NO: 12697 - DNA, 20 bp, Artificial Sequence
  Description of Artificial Sequence: Synthetic oligonucleotide
cagagagagaaagagttggt

SEQ ID NO: 12698 - DNA, 20 bp, Artificial Sequence
  Description of Artificial Sequence: Synthetic oligonucleotide
ccagagagagaaagagttgg

SEQ ID NO: 12699 - DNA, 20 bp, Artificial Sequence
  Description of Artificial Sequence: Synthetic oligonucleotide
accagagagagaaagagttg

SEQ ID NO: 12700 - DNA, 20 bp, Artificial Sequence
  Description of Artificial Sequence: Synthetic oligonucleotide
caccagagagagaaagagtt

SEQ ID NO: 12701 - DNA, 20 bp, Artificial Sequence
  Description of Artificial Sequence: Synthetic oligonucleotide
acaccagagagagaaagagt

SEQ ID NO: 12702 - DNA, 20 bp, Artificial Sequence
  Description of Artificial Sequence: Synthetic oligonucleotide
aacaccagagagagaaagag

SEQ ID NO: 12703 - DNA, 20 bp, Artificial Sequence
  Description of Artificial Sequence: Synthetic oligonucleotide
aaacaccagagagagaaaga

SEQ ID NO: 12704 - DNA, 20 bp, Artificial Sequence
  Description of Artificial Sequence: Synthetic oligonucleotide
aaaacaccagagagagaaag

SEQ ID NO: 12705 - DNA, 20 bp, Artificial Sequence
  Description of Artificial Sequence: Synthetic oligonucleotide
gaaaacaccagagagagaaa

SEQ ID NO: 12706 - DNA, 20 bp, Artificial Sequence
  Description of Artificial Sequence: Synthetic oligonucleotide
agaaaacaccagagagagaa

SEQ ID NO: 12707 - DNA, 20 bp, Artificial Sequence
  Description of Artificial Sequence: Synthetic oligonucleotide
gagaaaacaccagagagaga

SEQ ID NO: 12708 - DNA, 20 bp, Artificial Sequence
  Description of Artificial Sequence: Synthetic oligonucleotide
ggagaaaacaccagagagag

SEQ ID NO: 12709 - DNA, 20 bp, Artificial Sequence
  Description of Artificial Sequence: Synthetic oligonucleotide
aggagaaaacaccagagaga

SEQ ID NO: 12710 - DNA, 20 bp, Artificial Sequence
  Description of Artificial Sequence: Synthetic oligonucleotide
aaggagaaaacaccagagag

SEQ ID NO: 12711 - DNA, 20 bp, Artificial Sequence
  Description of Artificial Sequence: Synthetic oligonucleotide
aaaggagaaaacaccagaga

SEQ ID NO: 12712 - DNA, 20 bp, Artificial Sequence
  Description of Artificial Sequence: Synthetic oligonucleotide
aaaaggagaaaacaccagag

SEQ ID NO: 12713 - DNA, 20 bp, Artificial Sequence
  Description of Artificial Sequence: Synthetic oligonucleotide
gaaaaggagaaaacaccaga

SEQ ID NO: 12714 - DNA, 20 bp, Artificial Sequence
  Description of Artificial Sequence: Synthetic oligonucleotide
agaaaaggagaaaacaccag

SEQ ID NO: 12715 - DNA, 20 bp, Artificial Sequence
  Description of Artificial Sequence: Synthetic oligonucleotide
gagaaaaggagaaaacacca

SEQ ID NO: 12716 - DNA, 20 bp, Artificial Sequence
  Description of Artificial Sequence: Synthetic oligonucleotide
cgagaaaaggagaaaacacc

SEQ ID NO: 12717 - DNA, 20 bp, Artificial Sequence
  Description of Artificial Sequence: Synthetic oligonucleotide
acgagaaaaggagaaaacac

SEQ ID NO: 12718 - DNA, 20 bp, Artificial Sequence
  Description of Artificial Sequence: Synthetic oligonucleotide
tacgagaaaaggagaaaaca

SEQ ID NO: 12719 - DNA, 20 bp, Artificial Sequence
  Description of Artificial Sequence: Synthetic oligonucleotide
ttacgagaaaaggagaaaac

SEQ ID NO: 12720 - DNA, 20 bp, Artificial Sequence
  Description of Artificial Sequence: Synthetic oligonucleotide
tttacgagaaaaggagaaaa

SEQ ID NO: 12721 - DNA, 20 bp, Artificial Sequence
  Description of Artificial Sequence: Synthetic oligonucleotide
gtttacgagaaaaggagaaa

SEQ ID NO: 12722 - DNA, 20 bp, Artificial Sequence
  Description of Artificial Sequence: Synthetic oligonucleotide
agtttacgagaaaaggagaa

SEQ ID NO: 12723 - DNA, 20 bp, Artificial Sequence
  Description of Artificial Sequence: Synthetic oligonucleotide
aagtttacgagaaaaggaga

SEQ ID NO: 12724 - DNA, 20 bp, Artificial Sequence
  Description of Artificial Sequence: Synthetic oligonucleotide
aaagtttacgagaaaaggag

SEQ ID NO: 12725 - DNA, 20 bp, Artificial Sequence
  Description of Artificial Sequence: Synthetic oligonucleotide
caaagtttacgagaaaagga

SEQ ID NO: 12726 - DNA, 20 bp, Artificial Sequence
  Description of Artificial Sequence: Synthetic oligonucleotide
gcaaagtttacgagaaaagg

SEQ ID NO: 12727 - DNA, 20 bp, Artificial Sequence
  Description of Artificial Sequence: Synthetic oligonucleotide
ggcaaagtttacgagaaaag

SEQ ID NO: 12728 - DNA, 20 bp, Artificial Sequence
  Description of Artificial Sequence: Synthetic oligonucleotide
cggcaaagtttacgagaaaa

SEQ ID NO: 12729 - DNA, 20 bp, Artificial Sequence
  Description of Artificial Sequence: Synthetic oligonucleotide
gcggcaaagtttacgagaaa

SEQ ID NO: 12730 - DNA, 20 bp, Artificial Sequence
  Description of Artificial Sequence: Synthetic oligonucleotide
ggcggcaaagtttacgagaa

SEQ ID NO: 12731 - DNA, 20 bp, Artificial Sequence
  Description of Artificial Sequence: Synthetic oligonucleotide
aggcggcaaagtttacgaga

SEQ ID NO: 12732 - DNA, 20 bp, Artificial Sequence
  Description of Artificial Sequence: Synthetic oligonucleotide
taggcggcaaagtttacgag

SEQ ID NO: 12733 - DNA, 20 bp, Artificial Sequence
  Description of Artificial Sequence: Synthetic oligonucleotide
ataggcggcaaagtttacga

SEQ ID NO: 12734 - DNA, 20 bp, Artificial Sequence
  Description of Artificial Sequence: Synthetic oligonucleotide
cataggcggcaaagtttacg

SEQ ID NO: 12735 - DNA, 20 bp, Artificial Sequence
  Description of Artificial Sequence: Synthetic oligonucleotide
tcataggcggcaaagtttac

SEQ ID NO: 12736 - DNA, 20 bp, Artificial Sequence
  Description of Artificial Sequence: Synthetic oligonucleotide
ctcataggcggcaaagttta

SEQ ID NO: 12737 - DNA, 20 bp, Artificial Sequence
  Description of Artificial Sequence: Synthetic oligonucleotide
gctcataggcggcaaagttt

SEQ ID NO: 12738 - DNA, 20 bp, Artificial Sequence
  Description of Artificial Sequence: Synthetic oligonucleotide
tgctcataggcggcaaagtt

SEQ ID NO: 12739 - DNA, 20 bp, Artificial Sequence
  Description of Artificial Sequence: Synthetic oligonucleotide
ctgctcataggcggcaaagt

SEQ ID NO: 12740 - DNA, 20 bp, Artificial Sequence
  Description of Artificial Sequence: Synthetic oligonucleotide
gctgctcataggcggcaaag

SEQ ID NO: 12741 - DNA, 20 bp, Artificial Sequence
  Description of Artificial Sequence: Synthetic oligonucleotide
ggctgctcataggcggcaaa

SEQ ID NO: 12742 - DNA, 20 bp, Artificial Sequence
  Description of Artificial Sequence: Synthetic oligonucleotide
tggctgctcataggcggcaa

SEQ ID NO: 12743 - DNA, 20 bp, Artificial Sequence
  Description of Artificial Sequence: Synthetic oligonucleotide
gtggctgctcataggcggca

SEQ ID NO: 12744 - DNA, 20 bp, Artificial Sequence
  Description of Artificial Sequence: Synthetic oligonucleotide
tgtggctgctcataggcggc

SEQ ID NO: 12745 - DNA, 20 bp, Artificial Sequence
  Description of Artificial Sequence: Synthetic oligonucleotide
atgtggctgctcataggcgg

SEQ ID NO: 12746 - DNA, 20 bp, Artificial Sequence
  Description of Artificial Sequence: Synthetic oligonucleotide
aatgtggctgctcataggcg

SEQ ID NO: 12747 - DNA, 20 bp, Artificial Sequence
  Description of Artificial Sequence: Synthetic oligonucleotide
caatgtggctgctcataggc

SEQ ID NO: 12748 - DNA, 20 bp, Artificial Sequence
  Description of Artificial Sequence: Synthetic oligonucleotide
gcaatgtggctgctcatagg

SEQ ID NO: 12749 - DNA, 20 bp, Artificial Sequence
  Description of Artificial Sequence: Synthetic oligonucleotide
ggcaatgtggctgctcatag

SEQ ID NO: 12750 - DNA, 20 bp, Artificial Sequence
  Description of Artificial Sequence: Synthetic oligonucleotide
aggcaatgtggctgctcata

SEQ ID NO: 12751 - DNA, 20 bp, Artificial Sequence
  Description of Artificial Sequence: Synthetic oligonucleotide
aaggcaatgtggctgctcat

SEQ ID NO: 12752 - DNA, 20 bp, Artificial Sequence
  Description of Artificial Sequence: Synthetic oligonucleotide
taaggcaatgtggctgctca

SEQ ID NO: 12753 - DNA, 20 bp, Artificial Sequence
  Description of Artificial Sequence: Synthetic oligonucleotide
gtaaggcaatgtggctgctc

SEQ ID NO: 12754 - DNA, 20 bp, Artificial Sequence
  Description of Artificial Sequence: Synthetic oligonucleotide
agtaaggcaatgtggctgct

SEQ ID NO: 12755 - DNA, 20 bp, Artificial Sequence
  Description of Artificial Sequence: Synthetic oligonucleotide
cagtaaggcaatgtggctgc

SEQ ID NO: 12756 - DNA, 20 bp, Artificial Sequence
  Description of Artificial Sequence: Synthetic oligonucleotide
tcagtaaggcaatgtggctg

SEQ ID NO: 12757 - DNA, 20 bp, Artificial Sequence
  Description of Artificial Sequence: Synthetic oligonucleotide
ttcagtaaggcaatgtggct

SEQ ID NO: 12758 - DNA, 20 bp, Artificial Sequence
  Description of Artificial Sequence: Synthetic oligonucleotide
tttcagtaaggcaatgtggc

SEQ ID NO: 12759 - DNA, 20 bp, Artificial Sequence
  Description of Artificial Sequence: Synthetic oligonucleotide
atttcagtaaggcaatgtgg

SEQ ID NO: 12760 - DNA, 20 bp, Artificial Sequence
  Description of Artificial Sequence: Synthetic oligonucleotide
gatttcagtaaggcaatgtg

SEQ ID NO: 12761 - DNA, 20 bp, Artificial Sequence
  Description of Artificial Sequence: Synthetic oligonucleotide
ggatttcagtaaggcaatgt

SEQ ID NO: 12762 - DNA, 20 bp, Artificial Sequence
  Description of Artificial Sequence: Synthetic oligonucleotide
tggatttcagtaaggcaatg

SEQ ID NO: 12763 - DNA, 20 bp, Artificial Sequence
  Description of Artificial Sequence: Synthetic oligonucleotide
ctggatttcagtaaggcaat

SEQ ID NO: 12764 - DNA, 20 bp, Artificial Sequence
  Description of Artificial Sequence: Synthetic oligonucleotide
tctggatttcagtaaggcaa

SEQ ID NO: 12765 - DNA, 20 bp, Artificial Sequence
  Description of Artificial Sequence: Synthetic oligonucleotide
ctctggatttcagtaaggca

SEQ ID NO: 12766 - DNA, 20 bp, Artificial Sequence
  Description of Artificial Sequence: Synthetic oligonucleotide
gctctggatttcagtaaggc

SEQ ID NO: 12767 - DNA, 20 bp, Artificial Sequence
  Description of Artificial Sequence: Synthetic oligonucleotide
ggctctggatttcagtaagg

SEQ ID NO: 12768 - DNA, 20 bp, Artificial Sequence
  Description of Artificial Sequence: Synthetic oligonucleotide
aggctctggatttcagtaag

SEQ ID NO: 12769 - DNA, 20 bp, Artificial Sequence
  Description of Artificial Sequence: Synthetic oligonucleotide
taggctctggatttcagtaa

SEQ ID NO: 12770 - DNA, 20 bp, Artificial Sequence
  Description of Artificial Sequence: Synthetic oligonucleotide
ttaggctctggatttcagta

SEQ ID NO: 12771 - DNA, 20 bp, Artificial Sequence
  Description of Artificial Sequence: Synthetic oligonucleotide
gttaggctctggatttcagt

SEQ ID NO: 12772 - DNA, 20 bp, Artificial Sequence
  Description of Artificial Sequence: Synthetic oligonucleotide
ggttaggctctggatttcag

SEQ ID NO: 12773 - DNA, 20 bp, Artificial Sequence
  Description of Artificial Sequence: Synthetic oligonucleotide
aggttaggctctggatttca

SEQ ID NO: 12774 - DNA, 20 bp, Artificial Sequence
  Description of Artificial Sequence: Synthetic oligonucleotide
aaggttaggctctggatttc

SEQ ID NO: 12775 - DNA, 20 bp, Artificial Sequence
  Description of Artificial Sequence: Synthetic oligonucleotide
gaaggttaggctctggattt

SEQ ID NO: 12776 - DNA, 20 bp, Artificial Sequence
  Description of Artificial Sequence: Synthetic oligonucleotide
tgaaggttaggctctggatt

SEQ ID NO: 12777 - DNA, 20 bp, Artificial Sequence
  Description of Artificial Sequence: Synthetic oligonucleotide
ttgaaggttaggctctggat

SEQ ID NO: 12778 - DNA, 20 bp, Artificial Sequence
  Description of Artificial Sequence: Synthetic oligonucleotide
attgaaggttaggctctgga

SEQ ID NO: 12779 - DNA, 20 bp, Artificial Sequence
  Description of Artificial Sequence: Synthetic oligonucleotide
gattgaaggttaggctctgg

SEQ ID NO: 12780 - DNA, 20 bp, Artificial Sequence
  Description of Artificial Sequence: Synthetic oligonucleotide
ggattgaaggttaggctctg

SEQ ID NO: 12781 - DNA, 20 bp, Artificial Sequence
  Description of Artificial Sequence: Synthetic oligonucleotide
gggattgaaggttaggctct

SEQ ID NO: 12782 - DNA, 20 bp, Artificial Sequence
  Description of Artificial Sequence: Synthetic oligonucleotide
tgggattgaaggttaggctc

SEQ ID NO: 12783 - DNA, 20 bp, Artificial Sequence
  Description of Artificial Sequence: Synthetic oligonucleotide
gtgggattgaaggttaggct

SEQ ID NO: 12784 - DNA, 20 bp, Artificial Sequence
  Description of Artificial Sequence: Synthetic oligonucleotide
ggtgggattgaaggttaggc

SEQ ID NO: 12785 - DNA, 20 bp, Artificial Sequence
  Description of Artificial Sequence: Synthetic oligonucleotide
cggtgggattgaaggttagg

SEQ ID NO: 12786 - DNA, 20 bp, Artificial Sequence
  Description of Artificial Sequence: Synthetic oligonucleotide
gcggtgggattgaaggttag

SEQ ID NO: 12787 - DNA, 20 bp, Artificial Sequence
  Description of Artificial Sequence: Synthetic oligonucleotide
ggcggtgggattgaaggtta

SEQ ID NO: 12788 - DNA, 20 bp, Artificial Sequence
  Description of Artificial Sequence: Synthetic oligonucleotide
cggcggtgggattgaaggtt

SEQ ID NO: 12789 - DNA, 20 bp, Artificial Sequence
  Description of Artificial Sequence: Synthetic oligonucleotide
ccggcggtgggattgaaggt

SEQ ID NO: 12790 - DNA, 20 bp, Artificial Sequence
  Description of Artificial Sequence: Synthetic oligonucleotide
gccggcggtgggattgaagg

SEQ ID NO: 12791 - DNA, 20 bp, Artificial Sequence
  Description of Artificial Sequence: Synthetic oligonucleotide
agccggcggtgggattgaag

SEQ ID NO: 12792 - DNA, 20 bp, Artificial Sequence
  Description of Artificial Sequence: Synthetic oligonucleotide
cagccggcggtgggattgaa

SEQ ID NO: 12793 - DNA, 20 bp, Artificial Sequence
  Description of Artificial Sequence: Synthetic oligonucleotide
gcagccggcggtgggattga

SEQ ID NO: 12794 - DNA, 20 bp, Artificial Sequence
  Description of Artificial Sequence: Synthetic oligonucleotide
cgcagccggcggtgggattg

SEQ ID NO: 12795 - DNA, 20 bp, Artificial Sequence
  Description of Artificial Sequence: Synthetic oligonucleotide
gcgcagccggcggtgggatt

SEQ ID NO: 12796 - DNA, 20 bp, Artificial Sequence
  Description of Artificial Sequence: Synthetic oligonucleotide
cgcgcagccggcggtgggat

SEQ ID NO: 12797 - DNA, 20 bp, Artificial Sequence
  Description of Artificial Sequence: Synthetic oligonucleotide
acgcgcagccggcggtggga

SEQ ID NO: 12798 - DNA, 20 bp, Artificial Sequence
  Description of Artificial Sequence: Synthetic oligonucleotide
gacgcgcagccggcggtggg

SEQ ID NO: 12799 - DNA, 20 bp, Artificial Sequence
  Description of Artificial Sequence: Synthetic oligonucleotide
cgacgcgcagccggcggtgg

SEQ ID NO: 12800 - DNA, 20 bp, Artificial Sequence
  Description of Artificial Sequence: Synthetic oligonucleotide
gcgacgcgcagccggcggtg

SEQ ID NO: 12801 - DNA, 20 bp, Artificial Sequence
  Description of Artificial Sequence: Synthetic oligonucleotide
agcgacgcgcagccggcggt

SEQ ID NO: 12802 - DNA, 20 bp, Artificial Sequence
  Description of Artificial Sequence: Synthetic oligonucleotide
gagcgacgcgcagccggcgg

SEQ ID NO: 12803 - DNA, 20 bp, Artificial Sequence
  Description of Artificial Sequence: Synthetic oligonucleotide
cgagcgacgcgcagccggcg

SEQ ID NO: 12804 - DNA, 20 bp, Artificial Sequence
  Description of Artificial Sequence: Synthetic oligonucleotide
gcgagcgacgcgcagccggc

SEQ ID NO: 12805 - DNA, 20 bp, Artificial Sequence
  Description of Artificial Sequence: Synthetic oligonucleotide
ggcgagcgacgcgcagccgg

SEQ ID NO: 12806 - DNA, 20 bp, Artificial Sequence
  Description of Artificial Sequence: Synthetic oligonucleotide
tggcgagcgacgcgcagccg

SEQ ID NO: 12807 - DNA, 20 bp, Artificial Sequence
  Description of Artificial Sequence: Synthetic oligonucleotide
ttggcgagcgacgcgcagcc

SEQ ID NO: 12808 - DNA, 20 bp, Artificial Sequence
  Description of Artificial Sequence: Synthetic oligonucleotide
tttggcgagcgacgcgcagc

SEQ ID NO: 12809 - DNA, 20 bp, Artificial Sequence
  Description of Artificial Sequence: Synthetic oligonucleotide
ctttggcgagcgacgcgcag

SEQ ID NO: 12810 - DNA, 20 bp, Artificial Sequence
  Description of Artificial Sequence: Synthetic oligonucleotide
tctttggcgagcgacgcgca

SEQ ID NO: 12811 - DNA, 20 bp, Artificial Sequence
  Description of Artificial Sequence: Synthetic oligonucleotide
ttctttggcgagcgacgcgc

SEQ ID NO: 12812 - DNA, 20 bp, Artificial Sequence
  Description of Artificial Sequence: Synthetic oligonucleotide
tttctttggcgagcgacgcg

SEQ ID NO: 12813 - DNA, 20 bp, Artificial Sequence
  Description of Artificial Sequence: Synthetic oligonucleotide
atttctttggcgagcgacgc

SEQ ID NO: 12814 - DNA, 20 bp, Artificial Sequence
  Description of Artificial Sequence: Synthetic oligonucleotide
catttctttggcgagcgacg

SEQ ID NO: 12815 - DNA, 20 bp, Artificial Sequence
  Description of Artificial Sequence: Synthetic oligonucleotide
acatttctttggcgagcgac

SEQ ID NO: 12816 - DNA, 20 bp, Artificial Sequence
  Description of Artificial Sequence: Synthetic oligonucleotide
aacatttctttggcgagcga

SEQ ID NO: 12817 - DNA, 20 bp, Artificial Sequence
  Description of Artificial Sequence: Synthetic oligonucleotide
gaacatttctttggcgagcg

SEQ ID NO: 12818 - DNA, 20 bp, Artificial Sequence
  Description of Artificial Sequence: Synthetic oligonucleotide
cgaacatttctttggcgagc

SEQ ID NO: 12819 - DNA, 20 bp, Artificial Sequence
  Description of Artificial Sequence: Synthetic oligonucleotide
gcgaacatttctttggcgag

SEQ ID NO: 12820 - DNA, 20 bp, Artificial Sequence
  Description of Artificial Sequence: Synthetic oligonucleotide
ggcgaacatttctttggcga

SEQ ID NO: 12821 - DNA, 20 bp, Artificial Sequence
  Description of Artificial Sequence: Synthetic oligonucleotide
tggcgaacatttctttggcg

SEQ ID NO: 12822 - DNA, 20 bp, Artificial Sequence
  Description of Artificial Sequence: Synthetic oligonucleotide
atggcgaacatttctttggc

SEQ ID NO: 12823 - DNA, 20 bp, Artificial Sequence
  Description of Artificial Sequence: Synthetic oligonucleotide
catggcgaacatttctttgg

SEQ ID NO: 12824 - DNA, 20 bp, Artificial Sequence
  Description of Artificial Sequence: Synthetic oligonucleotide
tcatggcgaacatttctttg

SEQ ID NO: 12825 - DNA, 20 bp, Artificial Sequence
  Description of Artificial Sequence: Synthetic oligonucleotide
ttcatggcgaacatttcttt

SEQ ID NO: 12826 - DNA, 20 bp, Artificial Sequence
  Description of Artificial Sequence: Synthetic oligonucleotide
tttcatggcgaacatttctt

SEQ ID NO: 12827 - DNA, 20 bp, Artificial Sequence
  Description of Artificial Sequence: Synthetic oligonucleotide
ttttcatggcgaacatttct

SEQ ID NO: 12828 - DNA, 20 bp, Artificial Sequence
  Description of Artificial Sequence: Synthetic oligonucleotide
gttttcatggcgaacatttc

SEQ ID NO: 12829 - DNA, 20 bp, Artificial Sequence
  Description of Artificial Sequence: Synthetic oligonucleotide
agttttcatggcgaacattt

SEQ ID NO: 12830 - DNA, 20 bp, Artificial Sequence
  Description of Artificial Sequence: Synthetic oligonucleotide
tagttttcatggcgaacatt

SEQ ID NO: 12831 - DNA, 20 bp, Artificial Sequence
  Description of Artificial Sequence: Synthetic oligonucleotide
ttagttttcatggcgaacat

SEQ ID NO: 12832 - DNA, 20 bp, Artificial Sequence
  Description of Artificial Sequence: Synthetic oligonucleotide
cttagttttcatggcgaaca

SEQ ID NO: 12833 - DNA, 20 bp, Artificial Sequence
  Description of Artificial Sequence: Synthetic oligonucleotide
ccttagttttcatggcgaac

SEQ ID NO: 12834 - DNA, 20 bp, Artificial Sequence
  Description of Artificial Sequence: Synthetic oligonucleotide
gccttagttttcatggcgaa

SEQ ID NO: 12835 - DNA, 20 bp, Artificial Sequence
  Description of Artificial Sequence: Synthetic oligonucleotide
agccttagttttcatggcga

SEQ ID NO: 12836 - DNA, 20 bp, Artificial Sequence
  Description of Artificial Sequence: Synthetic oligonucleotide
cagccttagttttcatggcg

SEQ ID NO: 12837 - DNA, 20 bp, Artificial Sequence
  Description of Artificial Sequence: Synthetic oligonucleotide
gcagccttagttttcatggc

SEQ ID NO: 12838 - DNA, 20 bp, Artificial Sequence
  Description of Artificial Sequence: Synthetic oligonucleotide
ggcagccttagttttcatgg

SEQ ID NO: 12839 - DNA, 20 bp, Artificial Sequence
  Description of Artificial Sequence: Synthetic oligonucleotide
aggcagccttagttttcatg

SEQ ID NO: 12840 - DNA, 20 bp, Artificial Sequence
  Description of Artificial Sequence: Synthetic oligonucleotide
aaggcagccttagttttcat

SEQ ID NO: 12841 - DNA, 20 bp, Artificial Sequence
  Description of Artificial Sequence: Synthetic oligonucleotide
taaggcagccttagttttca

SEQ ID NO: 12842 - DNA, 20 bp, Artificial Sequence
  Description of Artificial Sequence: Synthetic oligonucleotide
ctaaggcagccttagttttc

SEQ ID NO: 12843 - DNA, 20 bp, Artificial Sequence
  Description of Artificial Sequence: Synthetic oligonucleotide
gctaaggcagccttagtttt

SEQ ID NO: 12844 - DNA, 20 bp, Artificial Sequence
  Description of Artificial Sequence: Synthetic oligonucleotide
agctaaggcagccttagttt

SEQ ID NO: 12845 - DNA, 20 bp, Artificial Sequence
  Description of Artificial Sequence: Synthetic oligonucleotide
tagctaaggcagccttagtt

SEQ ID NO: 12846 - DNA, 20 bp, Artificial Sequence
  Description of Artificial Sequence: Synthetic oligonucleotide
atagctaaggcagccttagt

SEQ ID NO: 12847 - DNA, 20 bp, Artificial Sequence
  Description of Artificial Sequence: Synthetic oligonucleotide
gatagctaaggcagccttag

SEQ ID NO: 12848 - DNA, 20 bp, Artificial Sequence
  Description of Artificial Sequence: Synthetic oligonucleotide
agatagctaaggcagcctta

SEQ ID NO: 12849 - DNA, 20 bp, Artificial Sequence
  Description of Artificial Sequence: Synthetic oligonucleotide
cagatagctaaggcagcctt

SEQ ID NO: 12850 - DNA, 20 bp, Artificial Sequence
  Description of Artificial Sequence: Synthetic oligonucleotide
ccagatagctaaggcagcct

SEQ ID NO: 12851 - DNA, 20 bp, Artificial Sequence
  Description of Artificial Sequence: Synthetic oligonucleotide
accagatagctaaggcagcc

SEQ ID NO: 12852 - DNA, 20 bp, Artificial Sequence
  Description of Artificial Sequence: Synthetic oligonucleotide
caccagatagctaaggcagc

SEQ ID NO: 12853 - DNA, 20 bp, Artificial Sequence
  Description of Artificial Sequence: Synthetic oligonucleotide
gcaccagatagctaaggcag

SEQ ID NO: 12854 - DNA, 20 bp, Artificial Sequence
  Description of Artificial Sequence: Synthetic oligonucleotide
ggcaccagatagctaaggca

SEQ ID NO: 12855 - DNA, 20 bp, Artificial Sequence
  Description of Artificial Sequence: Synthetic oligonucleotide
gggcaccagatagctaaggc

SEQ ID NO: 12856 - DNA, 20 bp, Artificial Sequence
  Description of Artificial Sequence: Synthetic oligonucleotide
tgggcaccagatagctaagg

SEQ ID NO: 12857 - DNA, 20 bp, Artificial Sequence
  Description of Artificial Sequence: Synthetic oligonucleotide
ctgggcaccagatagctaag

SEQ ID NO: 12858 - DNA, 20 bp, Artificial Sequence
  Description of Artificial Sequence: Synthetic oligonucleotide
cctgggcaccagatagctaa

SEQ ID NO: 12859 - DNA, 20 bp, Artificial Sequence
  Description of Artificial Sequence: Synthetic oligonucleotide
gcctgggcaccagatagcta

SEQ ID NO: 12860 - DNA, 20 bp, Artificial Sequence
  Description of Artificial Sequence: Synthetic oligonucleotide
agcctgggcaccagatagct

SEQ ID NO: 12861 - DNA, 20 bp, Artificial Sequence
  Description of Artificial Sequence: Synthetic oligonucleotide
tagcctgggcaccagatagc

SEQ ID NO: 12862 - DNA, 20 bp, Artificial Sequence
  Description of Artificial Sequence: Synthetic oligonucleotide
atagcctgggcaccagatag

SEQ ID NO: 12863 - DNA, 20 bp, Artificial Sequence
  Description of Artificial Sequence: Synthetic oligonucleotide
aatagcctgggcaccagata

SEQ ID NO: 12864 - DNA, 20 bp, Artificial Sequence
  Description of Artificial Sequence: Synthetic oligonucleotide
gaatagcctgggcaccagat

SEQ ID NO: 12865 - DNA, 20 bp, Artificial Sequence
  Description of Artificial Sequence: Synthetic oligonucleotide
cgaatagcctgggcaccaga

SEQ ID NO: 12866 - DNA, 20 bp, Artificial Sequence
  Description of Artificial Sequence: Synthetic oligonucleotide
ccgaatagcctgggcaccag

SEQ ID NO: 12867 - DNA, 20 bp, Artificial Sequence
  Description of Artificial Sequence: Synthetic oligonucleotide
tccgaatagcctgggcacca

SEQ ID NO: 12868 - DNA, 20 bp, Artificial Sequence
  Description of Artificial Sequence: Synthetic oligonucleotide
ttccgaatagcctgggcacc

SEQ ID NO: 12869 - DNA, 20 bp, Artificial Sequence
  Description of Artificial Sequence: Synthetic oligonucleotide
tttccgaatagcctgggcac

SEQ ID NO: 12870 - DNA, 20 bp, Artificial Sequence
  Description of Artificial Sequence: Synthetic oligonucleotide
gtttccgaatagcctgggca

SEQ ID NO: 12871 - DNA, 20 bp, Artificial Sequence
  Description of Artificial Sequence: Synthetic oligonucleotide
agtttccgaatagcctgggc

SEQ ID NO: 12872 - DNA, 20 bp, Artificial Sequence
  Description of Artificial Sequence: Synthetic oligonucleotide
gagtttccgaatagcctggg

SEQ ID NO: 12873 - DNA, 20 bp, Artificial Sequence
  Description of Artificial Sequence: Synthetic oligonucleotide
tgagtttccgaatagcctgg

SEQ ID NO: 12874 - DNA, 20 bp, Artificial Sequence
  Description of Artificial Sequence: Synthetic oligonucleotide
ctgagtttccgaatagcctg

SEQ ID NO: 12875 - DNA, 20 bp, Artificial Sequence
  Description of Artificial Sequence: Synthetic oligonucleotide
tctgagtttccgaatagcct

SEQ ID NO: 12876 - DNA, 20 bp, Artificial Sequence
  Description of Artificial Sequence: Synthetic oligonucleotide
atctgagtttccgaatagcc

SEQ ID NO: 12877 - DNA, 20 bp, Artificial Sequence
  Description of Artificial Sequence: Synthetic oligonucleotide
tatctgagtttccgaatagc

SEQ ID NO: 12878 - DNA, 20 bp, Artificial Sequence
  Description of Artificial Sequence: Synthetic oligonucleotide
ttatctgagtttccgaatag

SEQ ID NO: 12879 - DNA, 20 bp, Artificial Sequence
  Description of Artificial Sequence: Synthetic oligonucleotide
tttatctgagtttccgaata

SEQ ID NO: 12880 - DNA, 20 bp, Artificial Sequence
  Description of Artificial Sequence: Synthetic oligonucleotide
atttatctgagtttccgaat

SEQ ID NO: 12881 - DNA, 20 bp, Artificial Sequence
  Description of Artificial Sequence: Synthetic oligonucleotide
catttatctgagtttccgaa

SEQ ID NO: 12882 - DNA, 20 bp, Artificial Sequence
  Description of Artificial Sequence: Synthetic oligonucleotide
gcatttatctgagtttccga

SEQ ID NO: 12883 - DNA, 20 bp, Artificial Sequence
  Description of Artificial Sequence: Synthetic oligonucleotide
agcatttatctgagtttccg

SEQ ID NO: 12884 - DNA, 20 bp, Artificial Sequence
  Description of Artificial Sequence: Synthetic oligonucleotide
tagcatttatctgagtttcc

SEQ ID NO: 12885 - DNA, 20 bp, Artificial Sequence
  Description of Artificial Sequence: Synthetic oligonucleotide
gtagcatttatctgagtttc

SEQ ID NO: 12886 - DNA, 20 bp, Artificial Sequence
  Description of Artificial Sequence: Synthetic oligonucleotide
agtagcatttatctgagttt

SEQ ID NO: 12887 - DNA, 20 bp, Artificial Sequence
  Description of Artificial Sequence: Synthetic oligonucleotide
gagtagcatttatctgagtt

SEQ ID NO: 12888 - DNA, 20 bp, Artificial Sequence
  Description of Artificial Sequence: Synthetic oligonucleotide
tgagtagcatttatctgagt

SEQ ID NO: 12889 - DNA, 20 bp, Artificial Sequence
  Description of Artificial Sequence: Synthetic oligonucleotide
ctgagtagcatttatctgag

SEQ ID NO: 12890 - DNA, 20 bp, Artificial Sequence
  Description of Artificial Sequence: Synthetic oligonucleotide
cctgagtagcatttatctga

SEQ ID NO: 12891 - DNA, 20 bp, Artificial Sequence
  Description of Artificial Sequence: Synthetic oligonucleotide
gcctgagtagcatttatctg

SEQ ID NO: 12892 - DNA, 20 bp, Artificial Sequence
  Description of Artificial Sequence: Synthetic oligonucleotide
tgcctgagtagcatttatct

SEQ ID NO: 12893 - DNA, 20 bp, Artificial Sequence
  Description of Artificial Sequence: Synthetic oligonucleotide
ttgcctgagtagcatttatc

SEQ ID NO: 12894 - DNA, 20 bp, Artificial Sequence
  Description of Artificial Sequence: Synthetic oligonucleotide
attgcctgagtagcatttat

SEQ ID NO: 12895 - DNA, 20 bp, Artificial Sequence
  Description of Artificial Sequence: Synthetic oligonucleotide
cattgcctgagtagcattta

SEQ ID NO: 12896 - DNA, 20 bp, Artificial Sequence
  Description of Artificial Sequence: Synthetic oligonucleotide
tcattgcctgagtagcattt

SEQ ID NO: 12897 - DNA, 20 bp, Artificial Sequence
  Description of Artificial Sequence: Synthetic oligonucleotide
ttcattgcctgagtagcatt

SEQ ID NO: 12898 - DNA, 20 bp, Artificial Sequence
  Description of Artificial Sequence: Synthetic oligonucleotide
cttcattgcctgagtagcat

SEQ ID NO: 12899 - DNA, 20 bp, Artificial Sequence
  Description of Artificial Sequence: Synthetic oligonucleotide
tcttcattgcctgagtagca

SEQ ID NO: 12900 - DNA, 20 bp, Artificial Sequence
  Description of Artificial Sequence: Synthetic oligonucleotide
ttcttcattgcctgagtagc

SEQ ID NO: 12901 - DNA, 20 bp, Artificial Sequence
  Description of Artificial Sequence: Synthetic oligonucleotide
cttcttcattgcctgagtag

SEQ ID NO: 12902 - DNA, 20 bp, Artificial Sequence
  Description of Artificial Sequence: Synthetic oligonucleotide
tcttcttcattgcctgagta

SEQ ID NO: 12903 - DNA, 20 bp, Artificial Sequence
  Description of Artificial Sequence: Synthetic oligonucleotide
ctcttcttcattgcctgagt

SEQ ID NO: 12904 - DNA, 20 bp, Artificial Sequence
  Description of Artificial Sequence: Synthetic oligonucleotide
cctcttcttcattgcctgag

SEQ ID NO: 12905 - DNA, 20 bp, Artificial Sequence
  Description of Artificial Sequence: Synthetic oligonucleotide
tcctcttcttcattgcctga

SEQ ID NO: 12906 - DNA, 20 bp, Artificial Sequence
  Description of Artificial Sequence: Synthetic oligonucleotide
ctcctcttcttcattgcctg

SEQ ID NO: 12907 - DNA, 20 bp, Artificial Sequence
  Description of Artificial Sequence: Synthetic oligonucleotide
tctcctcttcttcattgcct

SEQ ID NO: 12908 - DNA, 20 bp, Artificial Sequence
  Description of Artificial Sequence: Synthetic oligonucleotide
ttctcctcttcttcattgcc

SEQ ID NO: 12909 - DNA, 20 bp, Artificial Sequence
  Description of Artificial Sequence: Synthetic oligonucleotide
tttctcctcttcttcattgc

SEQ ID NO: 12910 - DNA, 20 bp, Artificial Sequence
  Description of Artificial Sequence: Synthetic oligonucleotide
ttttctcctcttcttcattg

SEQ ID NO: 12911 - DNA, 20 bp, Artificial Sequence
  Description of Artificial Sequence: Synthetic oligonucleotide
tttttctcctcttcttcatt

SEQ ID NO: 12912 - DNA, 20 bp, Artificial Sequence
  Description of Artificial Sequence: Synthetic oligonucleotide
ctttttctcctcttcttcat

SEQ ID NO: 12913 - DNA, 20 bp, Artificial Sequence
  Description of Artificial Sequence: Synthetic oligonucleotide
cctttttctcctcttcttca

SEQ ID NO: 12914 - DNA, 20 bp, Artificial Sequence
  Description of Artificial Sequence: Synthetic oligonucleotide
tcctttttctcctcttcttc

SEQ ID NO: 12915 - DNA, 20 bp, Artificial Sequence
  Description of Artificial Sequence: Synthetic oligonucleotide
ttcctttttctcctcttctt

SEQ ID NO: 12916 - DNA, 20 bp, Artificial Sequence
  Description of Artificial Sequence: Synthetic oligonucleotide
tttcctttttctcctcttct

SEQ ID NO: 12917 - DNA, 20 bp, Artificial Sequence
  Description of Artificial Sequence: Synthetic oligonucleotide
ctttcctttttctcctcttc

SEQ ID NO: 12918 - DNA, 20 bp, Artificial Sequence
  Description of Artificial Sequence: Synthetic oligonucleotide
actttcctttttctcctctt

SEQ ID NO: 12919 - DNA, 20 bp, Artificial Sequence
  Description of Artificial Sequence: Synthetic oligonucleotide
gactttcctttttctcctct

SEQ ID NO: 12920 - DNA, 20 bp, Artificial Sequence
  Description of Artificial Sequence: Synthetic oligonucleotide
tgactttcctttttctcctc

SEQ ID NO: 12921 - DNA, 20 bp, Artificial Sequence
  Description of Artificial Sequence: Synthetic oligonucleotide
gtgactttcctttttctcct

SEQ ID NO: 12922 - DNA, 20 bp, Artificial Sequence
  Description of Artificial Sequence: Synthetic oligonucleotide
tgtgactttcctttttctcc

SEQ ID NO: 12923 - DNA, 20 bp, Artificial Sequence
  Description of Artificial Sequence: Synthetic oligonucleotide
ttgtgactttcctttttctc

SEQ ID NO: 12924 - DNA, 20 bp, Artificial Sequence
  Description of Artificial Sequence: Synthetic oligonucleotide
gttgtgactttcctttttct

SEQ ID NO: 12925 - DNA, 20 bp, Artificial Sequence
  Description of Artificial Sequence: Synthetic oligonucleotide
ggttgtgactttcctttttc

SEQ ID NO: 12926 - DNA, 20 bp, Artificial Sequence
  Description of Artificial Sequence: Synthetic oligonucleotide
tggttgtgactttccttttt

SEQ ID NO: 12927 - DNA, 20 bp, Artificial Sequence
  Description of Artificial Sequence: Synthetic oligonucleotide
ttggttgtgactttcctttt

SEQ ID NO: 12928 - DNA, 20 bp, Artificial Sequence
  Description of Artificial Sequence: Synthetic oligonucleotide
attggttgtgactttccttt

SEQ ID NO: 12929 - DNA, 20 bp, Artificial Sequence
  Description of Artificial Sequence: Synthetic oligonucleotide
tattggttgtgactttcctt

SEQ ID NO: 12930 - DNA, 20 bp, Artificial Sequence
  Description of Artificial Sequence: Synthetic oligonucleotide
ttattggttgtgactttcct

SEQ ID NO: 12931 - DNA, 20 bp, Artificial Sequence
  Description of Artificial Sequence: Synthetic oligonucleotide
tttattggttgtgactttcc

SEQ ID NO: 12932 - DNA, 20 bp, Artificial Sequence
  Description of Artificial Sequence: Synthetic oligonucleotide
atttattggttgtgactttc

SEQ ID NO: 12933 - DNA, 20 bp, Artificial Sequence
  Description of Artificial Sequence: Synthetic oligonucleotide
catttattggttgtgacttt

SEQ ID NO: 12934 - DNA, 20 bp, Artificial Sequence
  Description of Artificial Sequence: Synthetic oligonucleotide
acatttattggttgtgactt

SEQ ID NO: 12935 - DNA, 20 bp, Artificial Sequence
  Description of Artificial Sequence: Synthetic oligonucleotide
gacatttattggttgtgact

SEQ ID NO: 12936 - DNA, 20 bp, Artificial Sequence
  Description of Artificial Sequence: Synthetic oligonucleotide
agacatttattggttgtgac

SEQ ID NO: 12937 - DNA, 20 bp, Artificial Sequence
  Description of Artificial Sequence: Synthetic oligonucleotide
cagacatttattggttgtga

SEQ ID NO: 12938 - DNA, 20 bp, Artificial Sequence
  Description of Artificial Sequence: Synthetic oligonucleotide
ccagacatttattggttgtg

SEQ ID NO: 12939 - DNA, 20 bp, Artificial Sequence
  Description of Artificial Sequence: Synthetic oligonucleotide
tccagacatttattggttgt

SEQ ID NO: 12940 - DNA, 20 bp, Artificial Sequence
  Description of Artificial Sequence: Synthetic oligonucleotide
ttccagacatttattggttg

SEQ ID NO: 12941 - DNA, 20 bp, Artificial Sequence
  Description of Artificial Sequence: Synthetic oligonucleotide
gttccagacatttattggtt

SEQ ID NO: 12942 - DNA, 20 bp, Artificial Sequence
  Description of Artificial Sequence: Synthetic oligonucleotide
tgttccagacatttattggt

SEQ ID NO: 12943 - DNA, 20 bp, Artificial Sequence
  Description of Artificial Sequence: Synthetic oligonucleotide
ttgttccagacatttattgg

SEQ ID NO: 12944 - DNA, 20 bp, Artificial Sequence
  Description of Artificial Sequence: Synthetic oligonucleotide
cttgttccagacatttattg

SEQ ID NO: 12945 - DNA, 20 bp, Artificial Sequence
  Description of Artificial Sequence: Synthetic oligonucleotide
acttgttccagacatttatt

SEQ ID NO: 12946 - DNA, 20 bp, Artificial Sequence
  Description of Artificial Sequence: Synthetic oligonucleotide
cacttgttccagacatttat

SEQ ID NO: 12947 - DNA, 20 bp, Artificial Sequence
  Description of Artificial Sequence: Synthetic oligonucleotide
acacttgttccagacattta

SEQ ID NO: 12948 - DNA, 20 bp, Artificial Sequence
  Description of Artificial Sequence: Synthetic oligonucleotide
gacacttgttccagacattt

SEQ ID NO: 12949 - DNA, 20 bp, Artificial Sequence
  Description of Artificial Sequence: Synthetic oligonucleotide
tgacacttgttccagacatt

SEQ ID NO: 12950 - DNA, 20 bp, Artificial Sequence
  Description of Artificial Sequence: Synthetic oligonucleotide
gtgacacttgttccagacat

SEQ ID NO: 12951 - DNA, 20 bp, Artificial Sequence
  Description of Artificial Sequence: Synthetic oligonucleotide
tgtgacacttgttccagaca

SEQ ID NO: 12952 - DNA, 20 bp, Artificial Sequence
  Description of Artificial Sequence: Synthetic oligonucleotide
ttgtgacacttgttccagac

SEQ ID NO: 12953 - DNA, 20 bp, Artificial Sequence
  Description of Artificial Sequence: Synthetic oligonucleotide
attgtgacacttgttccaga

SEQ ID NO: 12954 - DNA, 20 bp, Artificial Sequence
  Description of Artificial Sequence: Synthetic oligonucleotide
aattgtgacacttgttccag

SEQ ID NO: 12955 - DNA, 20 bp, Artificial Sequence
  Description of Artificial Sequence: Synthetic oligonucleotide
taattgtgacacttgttcca

SEQ ID NO: 12956 - DNA, 20 bp, Artificial Sequence
  Description of Artificial Sequence: Synthetic oligonucleotide
gtaattgtgacacttgttcc

SEQ ID NO: 12957 - DNA, 20 bp, Artificial Sequence
  Description of Artificial Sequence: Synthetic oligonucleotide
tgtaattgtgacacttgttc

SEQ ID NO: 12958 - DNA, 20 bp, Artificial Sequence
  Description of Artificial Sequence: Synthetic oligonucleotide
ttgtaattgtgacacttgtt

SEQ ID NO: 12959 - DNA, 20 bp, Artificial Sequence
  Description of Artificial Sequence: Synthetic oligonucleotide
cttgtaattgtgacacttgt

SEQ ID NO: 12960 - DNA, 20 bp, Artificial Sequence
  Description of Artificial Sequence: Synthetic oligonucleotide
ccttgtaattgtgacacttg

SEQ ID NO: 12961 - DNA, 20 bp, Artificial Sequence
  Description of Artificial Sequence: Synthetic oligonucleotide
tccttgtaattgtgacactt

SEQ ID NO: 12962 - DNA, 20 bp, Artificial Sequence
  Description of Artificial Sequence: Synthetic oligonucleotide
atccttgtaattgtgacact

SEQ ID NO: 12963 - DNA, 20 bp, Artificial Sequence
  Description of Artificial Sequence: Synthetic oligonucleotide
aatccttgtaattgtgacac

SEQ ID NO: 12964 - DNA, 20 bp, Artificial Sequence
  Description of Artificial Sequence: Synthetic oligonucleotide
caatccttgtaattgtgaca

SEQ ID NO: 12965 - DNA, 20 bp, Artificial Sequence
  Description of Artificial Sequence: Synthetic oligonucleotide
acaatccttgtaattgtgac

SEQ ID NO: 12966 - DNA, 20 bp, Artificial Sequence
  Description of Artificial Sequence: Synthetic oligonucleotide
cacaatccttgtaattgtga

SEQ ID NO: 12967 - DNA, 20 bp, Artificial Sequence
  Description of Artificial Sequence: Synthetic oligonucleotide
ccacaatccttgtaattgtg

SEQ ID NO: 12968 - DNA, 20 bp, Artificial Sequence
  Description of Artificial Sequence: Synthetic oligonucleotide
gccacaatccttgtaattgt

SEQ ID NO: 12969 - DNA, 20 bp, Artificial Sequence
  Description of Artificial Sequence: Synthetic oligonucleotide
cgccacaatccttgtaattg

SEQ ID NO: 12970 - DNA, 20 bp, Artificial Sequence
  Description of Artificial Sequence: Synthetic oligonucleotide
acgccacaatccttgtaatt

SEQ ID NO: 12971 - DNA, 20 bp, Artificial Sequence
  Description of Artificial Sequence: Synthetic oligonucleotide
gacgccacaatccttgtaat

SEQ ID NO: 12972 - DNA, 20 bp, Artificial Sequence
  Description of Artificial Sequence: Synthetic oligonucleotide
cgacgccacaatccttgtaa

SEQ ID NO: 12973 - DNA, 20 bp, Artificial Sequence
  Description of Artificial Sequence: Synthetic oligonucleotide
gcgacgccacaatccttgta

SEQ ID NO: 12974 - DNA, 20 bp, Artificial Sequence
  Description of Artificial Sequence: Synthetic oligonucleotide
agcgacgccacaatccttgt

SEQ ID NO: 12975 - DNA, 20 bp, Artificial Sequence
  Description of Artificial Sequence: Synthetic oligonucleotide
aagcgacgccacaatccttg

SEQ ID NO: 12976 - DNA, 20 bp, Artificial Sequence
  Description of Artificial Sequence: Synthetic oligonucleotide
gaagcgacgccacaatcctt

SEQ ID NO: 12977 - DNA, 20 bp, Artificial Sequence
  Description of Artificial Sequence: Synthetic oligonucleotide
tgaagcgacgccacaatcct

SEQ ID NO: 12978 - DNA, 20 bp, Artificial Sequence
  Description of Artificial Sequence: Synthetic oligonucleotide
ttgaagcgacgccacaatcc

SEQ ID NO: 12979 - DNA, 20 bp, Artificial Sequence
  Description of Artificial Sequence: Synthetic oligonucleotide
attgaagcgacgccacaatc

SEQ ID NO: 12980 - DNA, 20 bp, Artificial Sequence
  Description of Artificial Sequence: Synthetic oligonucleotide
gattgaagcgacgccacaat

SEQ ID NO: 12981 - DNA, 20 bp, Artificial Sequence
  Description of Artificial Sequence: Synthetic oligonucleotide
cgattgaagcgacgccacaa

SEQ ID NO: 12982 - DNA, 20 bp, Artificial Sequence
  Description of Artificial Sequence: Synthetic oligonucleotide
tcgattgaagcgacgccaca

SEQ ID NO: 12983 - DNA, 20 bp, Artificial Sequence
  Description of Artificial Sequence: Synthetic oligonucleotide
gtcgattgaagcgacgccac

SEQ ID NO: 12984 - DNA, 20 bp, Artificial Sequence
  Description of Artificial Sequence: Synthetic oligonucleotide
ggtcgattgaagcgacgcca

SEQ ID NO: 12985 - DNA, 20 bp, Artificial Sequence
  Description of Artificial Sequence: Synthetic oligonucleotide
aggtcgattgaagcgacgcc

SEQ ID NO: 12986 - DNA, 20 bp, Artificial Sequence
  Description of Artificial Sequence: Synthetic oligonucleotide
aaggtcgattgaagcgacgc

SEQ ID NO: 12987 - DNA, 20 bp, Artificial Sequence
  Description of Artificial Sequence: Synthetic oligonucleotide
aaaggtcgattgaagcgacg

SEQ ID NO: 12988 - DNA, 20 bp, Artificial Sequence
  Description of Artificial Sequence: Synthetic oligonucleotide
taaaggtcgattgaagcgac

SEQ ID NO: 12989 - DNA, 20 bp, Artificial Sequence
  Description of Artificial Sequence: Synthetic oligonucleotide
gtaaaggtcgattgaagcga

SEQ ID NO: 12990 - DNA, 20 bp, Artificial Sequence
  Description of Artificial Sequence: Synthetic oligonucleotide
agtaaaggtcgattgaagcg

SEQ ID NO: 12991 - DNA, 20 bp, Artificial Sequence
  Description of Artificial Sequence: Synthetic oligonucleotide
cagtaaaggtcgattgaagc

SEQ ID NO: 12992 - DNA, 20 bp, Artificial Sequence
  Description of Artificial Sequence: Synthetic oligonucleotide
tcagtaaaggtcgattgaag

SEQ ID NO: 12993 - DNA, 20 bp, Artificial Sequence
  Description of Artificial Sequence: Synthetic oligonucleotide
ttcagtaaaggtcgattgaa

SEQ ID NO: 12994 - DNA, 20 bp, Artificial Sequence
  Description of Artificial Sequence: Synthetic oligonucleotide
tttcagtaaaggtcgattga

SEQ ID NO: 12995 - DNA, 20 bp, Artificial Sequence
  Description of Artificial Sequence: Synthetic oligonucleotide
gtttcagtaaaggtcgattg

SEQ ID NO: 12996 - DNA, 20 bp, Artificial Sequence
  Description of Artificial Sequence: Synthetic oligonucleotide
tgtttcagtaaaggtcgatt

SEQ ID NO: 12997 - DNA, 20 bp, Artificial Sequence
  Description of Artificial Sequence: Synthetic oligonucleotide
ttgtttcagtaaaggtcgat

SEQ ID NO: 12998 - DNA, 20 bp, Artificial Sequence
  Description of Artificial Sequence: Synthetic oligonucleotide
gttgtttcagtaaaggtcga

SEQ ID NO: 12999 - DNA, 20 bp, Artificial Sequence
  Description of Artificial Sequence: Synthetic oligonucleotide
tgttgtttcagtaaaggtcg

SEQ ID NO: 13000 - DNA, 20 bp, Artificial Sequence
  Description of Artificial Sequence: Synthetic oligonucleotide
ctgttgtttcagtaaaggtc

SEQ ID NO: 13001 - DNA, 20 bp, Artificial Sequence
  Description of Artificial Sequence: Synthetic oligonucleotide
actgttgtttcagtaaaggt

SEQ ID NO: 13002 - DNA, 20 bp, Artificial Sequence
  Description of Artificial Sequence: Synthetic oligonucleotide
tactgttgtttcagtaaagg

SEQ ID NO: 13003 - DNA, 20 bp, Artificial Sequence
  Description of Artificial Sequence: Synthetic oligonucleotide
ttactgttgtttcagtaaag

SEQ ID NO: 13004 - DNA, 20 bp, Artificial Sequence
  Description of Artificial Sequence: Synthetic oligonucleotide
tttactgttgtttcagtaaa

SEQ ID NO: 13005 - DNA, 20 bp, Artificial Sequence
  Description of Artificial Sequence: Synthetic oligonucleotide
gtttactgttgtttcagtaa

SEQ ID NO: 13006 - DNA, 20 bp, Artificial Sequence
  Description of Artificial Sequence: Synthetic oligonucleotide
ggtttactgttgtttcagta

SEQ ID NO: 13007 - DNA, 20 bp, Artificial Sequence
  Description of Artificial Sequence: Synthetic oligonucleotide
tggtttactgttgtttcagt

SEQ ID NO: 13008 - DNA, 20 bp, Artificial Sequence
  Description of Artificial Sequence: Synthetic oligonucleotide
atggtttactgttgtttcag

SEQ ID NO: 13009 - DNA, 20 bp, Artificial Sequence
  Description of Artificial Sequence: Synthetic oligonucleotide
gatggtttactgttgtttca

SEQ ID NO: 13010 - DNA, 20 bp, Artificial Sequence
  Description of Artificial Sequence: Synthetic oligonucleotide
agatggtttactgttgtttc

SEQ ID NO: 13011 - DNA, 20 bp, Artificial Sequence
  Description of Artificial Sequence: Synthetic oligonucleotide
aagatggtttactgttgttt

SEQ ID NO: 13012 - DNA, 20 bp, Artificial Sequence
  Description of Artificial Sequence: Synthetic oligonucleotide
aaagatggtttactgttgtt

SEQ ID NO: 13013 - DNA, 20 bp, Artificial Sequence
  Description of Artificial Sequence: Synthetic oligonucleotide
taaagatggtttactgttgt

SEQ ID NO: 13014 - DNA, 20 bp, Artificial Sequence
  Description of Artificial Sequence: Synthetic oligonucleotide
ataaagatggtttactgttg

SEQ ID NO: 13015 - DNA, 20 bp, Artificial Sequence
  Description of Artificial Sequence: Synthetic oligonucleotide
aataaagatggtttactgtt

SEQ ID NO: 13016 - DNA, 20 bp, Artificial Sequence
  Description of Artificial Sequence: Synthetic oligonucleotide
taataaagatggtttactgt

SEQ ID NO: 13017 - DNA, 20 bp, Artificial Sequence
  Description of Artificial Sequence: Synthetic oligonucleotide
ataataaagatggtttactg

SEQ ID NO: 13018 - DNA, 20 bp, Artificial Sequence
  Description of Artificial Sequence: Synthetic oligonucleotide
cataataaagatggtttact

SEQ ID NO: 13019 - DNA, 20 bp, Artificial Sequence
  Description of Artificial Sequence: Synthetic oligonucleotide
ccataataaagatggtttac

SEQ ID NO: 13020 - DNA, 20 bp, Artificial Sequence
  Description of Artificial Sequence: Synthetic oligonucleotide
accataataaagatggttta

SEQ ID NO: 13021 - DNA, 20 bp, Artificial Sequence
  Description of Artificial Sequence: Synthetic oligonucleotide
gaccataataaagatggttt

SEQ ID NO: 13022 - DNA, 20 bp, Artificial Sequence
  Description of Artificial Sequence: Synthetic oligonucleotide
tgaccataataaagatggtt

SEQ ID NO: 13023 - DNA, 20 bp, Artificial Sequence
  Description of Artificial Sequence: Synthetic oligonucleotide
atgaccataataaagatggt

SEQ ID NO: 13024 - DNA, 20 bp, Artificial Sequence
  Description of Artificial Sequence: Synthetic oligonucleotide
tatgaccataataaagatgg

SEQ ID NO: 13025 - DNA, 20 bp, Artificial Sequence
  Description of Artificial Sequence: Synthetic oligonucleotide
atatgaccataataaagatg

SEQ ID NO: 13026 - DNA, 20 bp, Artificial Sequence
  Description of Artificial Sequence: Synthetic oligonucleotide
aatatgaccataataaagat

SEQ ID NO: 13027 - DNA, 20 bp, Artificial Sequence
  Description of Artificial Sequence: Synthetic oligonucleotide
aaatatgaccataataaaga

SEQ ID NO: 13028 - DNA, 20 bp, Artificial Sequence
  Description of Artificial Sequence: Synthetic oligonucleotide
gaaatatgaccataataaag

SEQ ID NO: 13029 - DNA, 20 bp, Artificial Sequence
  Description of Artificial Sequence: Synthetic oligonucleotide
tgaaatatgaccataataaa

SEQ ID NO: 13030 - DNA, 20 bp, Artificial Sequence
  Description of Artificial Sequence: Synthetic oligonucleotide
gtgaaatatgaccataataa

SEQ ID NO: 13031 - DNA, 20 bp, Artificial Sequence
  Description of Artificial Sequence: Synthetic oligonucleotide
tgtgaaatatgaccataata

SEQ ID NO: 13032 - DNA, 20 bp, Artificial Sequence
  Description of Artificial Sequence: Synthetic oligonucleotide
ctgtgaaatatgaccataat

SEQ ID NO: 13033 - DNA, 20 bp, Artificial Sequence
  Description of Artificial Sequence: Synthetic oligonucleotide
gctgtgaaatatgaccataa

SEQ ID NO: 13034 - DNA, 20 bp, Artificial Sequence
  Description of Artificial Sequence: Synthetic oligonucleotide
tgctgtgaaatatgaccata

SEQ ID NO: 13035 - DNA, 20 bp, Artificial Sequence
  Description of Artificial Sequence: Synthetic oligonucleotide
gtgctgtgaaatatgaccat

SEQ ID NO: 13036 - DNA, 20 bp, Artificial Sequence
  Description of Artificial Sequence: Synthetic oligonucleotide
ggtgctgtgaaatatgacca

SEQ ID NO: 13037 - DNA, 20 bp, Artificial Sequence
  Description of Artificial Sequence: Synthetic oligonucleotide
tggtgctgtgaaatatgacc

SEQ ID NO: 13038 - DNA, 20 bp, Artificial Sequence
  Description of Artificial Sequence: Synthetic oligonucleotide
ttggtgctgtgaaatatgac

SEQ ID NO: 13039 - DNA, 20 bp, Artificial Sequence
  Description of Artificial Sequence: Synthetic oligonucleotide
tttggtgctgtgaaatatga

SEQ ID NO: 13040 - DNA, 20 bp, Artificial Sequence
  Description of Artificial Sequence: Synthetic oligonucleotide
ttttggtgctgtgaaatatg

SEQ ID NO: 13041 - DNA, 20 bp, Artificial Sequence
  Description of Artificial Sequence: Synthetic oligonucleotide
attttggtgctgtgaaatat

SEQ ID NO: 13042 - DNA, 20 bp, Artificial Sequence
  Description of Artificial Sequence: Synthetic oligonucleotide
tattttggtgctgtgaaata

SEQ ID NO: 13043 - DNA, 20 bp, Artificial Sequence
  Description of Artificial Sequence: Synthetic oligonucleotide
ttattttggtgctgtgaaat

SEQ ID NO: 13044 - DNA, 20 bp, Artificial Sequence
  Description of Artificial Sequence: Synthetic oligonucleotide
tttattttggtgctgtgaaa

SEQ ID NO: 13045 - DNA, 20 bp, Artificial Sequence
  Description of Artificial Sequence: Synthetic oligonucleotide
atttattttggtgctgtgaa

SEQ ID NO: 13046 - DNA, 20 bp, Artificial Sequence
  Description of Artificial Sequence: Synthetic oligonucleotide
gatttattttggtgctgtga

SEQ ID NO: 13047 - DNA, 20 bp, Artificial Sequence
  Description of Artificial Sequence: Synthetic oligonucleotide
tgatttattttggtgctgtg

SEQ ID NO: 13048 - DNA, 20 bp, Artificial Sequence
  Description of Artificial Sequence: Synthetic oligonucleotide
atgatttattttggtgctgt

SEQ ID NO: 13049 - DNA, 20 bp, Artificial Sequence
  Description of Artificial Sequence: Synthetic oligonucleotide
gatgatttattttggtgctg

SEQ ID NO: 13050 - DNA, 20 bp, Artificial Sequence
  Description of Artificial Sequence: Synthetic oligonucleotide
agatgatttattttggtgct

SEQ ID NO: 13051 - DNA, 20 bp, Artificial Sequence
  Description of Artificial Sequence: Synthetic oligonucleotide
aagatgatttattttggtgc

SEQ ID NO: 13052 - DNA, 20 bp, Artificial Sequence
  Description of Artificial Sequence: Synthetic oligonucleotide
aaagatgatttattttggtg

SEQ ID NO: 13053 - DNA, 20 bp, Artificial Sequence
  Description of Artificial Sequence: Synthetic oligonucleotide
taaagatgatttattttggt

SEQ ID NO: 13054 - DNA, 20 bp, Artificial Sequence
  Description of Artificial Sequence: Synthetic oligonucleotide
ataaagatgatttattttgg

SEQ ID NO: 13055 - DNA, 20 bp, Artificial Sequence
  Description of Artificial Sequence: Synthetic oligonucleotide
aataaagatgatttattttg

SEQ ID NO: 13056 - DNA, 20 bp, Artificial Sequence
  Description of Artificial Sequence: Synthetic oligonucleotide
taataaagatgatttatttt

SEQ ID NO: 13057 - DNA, 20 bp, Artificial Sequence
  Description of Artificial Sequence: Synthetic oligonucleotide
ttaataaagatgatttattt

SEQ ID NO: 13058 - DNA, 20 bp, Artificial Sequence
  Description of Artificial Sequence: Synthetic oligonucleotide
cttaataaagatgatttatt

SEQ ID NO: 13059 - DNA, 20 bp, Artificial Sequence
  Description of Artificial Sequence: Synthetic oligonucleotide
acttaataaagatgatttat

SEQ ID NO: 13060 - DNA, 20 bp, Artificial Sequence
  Description of Artificial Sequence: Synthetic oligonucleotide
tacttaataaagatgattta

SEQ ID NO: 13061 - DNA, 20 bp, Artificial Sequence
  Description of Artificial Sequence: Synthetic oligonucleotide
ctacttaataaagatgattt

SEQ ID NO: 13062 - DNA, 20 bp, Artificial Sequence
  Description of Artificial Sequence: Synthetic oligonucleotide
tctacttaataaagatgatt

SEQ ID NO: 13063 - DNA, 20 bp, Artificial Sequence
  Description of Artificial Sequence: Synthetic oligonucleotide
atctacttaataaagatgat

SEQ ID NO: 13064 - DNA, 20 bp, Artificial Sequence
  Description of Artificial Sequence: Synthetic oligonucleotide
catctacttaataaagatga

SEQ ID NO: 13065 - DNA, 20 bp, Artificial Sequence
  Description of Artificial Sequence: Synthetic oligonucleotide
tcatctacttaataaagatg

SEQ ID NO: 13066 - DNA, 20 bp, Artificial Sequence
  Description of Artificial Sequence: Synthetic oligonucleotide
ttcatctacttaataaagat

SEQ ID NO: 13067 - DNA, 20 bp, Artificial Sequence
  Description of Artificial Sequence: Synthetic oligonucleotide
tttcatctacttaataaaga

SEQ ID NO: 13068 - DNA, 20 bp, Artificial Sequence
  Description of Artificial Sequence: Synthetic oligonucleotide
gtttcatctacttaataaag

SEQ ID NO: 13069 - DNA, 20 bp, Artificial Sequence
  Description of Artificial Sequence: Synthetic oligonucleotide
tgtttcatctacttaataaa

SEQ ID NO: 13070 - DNA, 20 bp, Artificial Sequence
  Description of Artificial Sequence: Synthetic oligonucleotide
atgtttcatctacttaataa

SEQ ID NO: 13071 - DNA, 20 bp, Artificial Sequence
  Description of Artificial Sequence: Synthetic oligonucleotide
aatgtttcatctacttaata

SEQ ID NO: 13072 - DNA, 20 bp, Artificial Sequence
  Description of Artificial Sequence: Synthetic oligonucleotide
taatgtttcatctacttaat

SEQ ID NO: 13073 - DNA, 20 bp, Artificial Sequence
  Description of Artificial Sequence: Synthetic oligonucleotide
ttaatgtttcatctacttaa

SEQ ID NO: 13074 - DNA, 20 bp, Artificial Sequence
  Description of Artificial Sequence: Synthetic oligonucleotide
gttaatgtttcatctactta

SEQ ID NO: 13075 - DNA, 20 bp, Artificial Sequence
  Description of Artificial Sequence: Synthetic oligonucleotide
agttaatgtttcatctactt

SEQ ID NO: 13076 - DNA, 20 bp, Artificial Sequence
  Description of Artificial Sequence: Synthetic oligonucleotide
gagttaatgtttcatctact

SEQ ID NO: 13077 - DNA, 20 bp, Artificial Sequence
  Description of Artificial Sequence: Synthetic oligonucleotide
agagttaatgtttcatctac

SEQ ID NO: 13078 - DNA, 20 bp, Artificial Sequence
  Description of Artificial Sequence: Synthetic oligonucleotide
tagagttaatgtttcatcta

SEQ ID NO: 13079 - DNA, 20 bp, Artificial Sequence
  Description of Artificial Sequence: Synthetic oligonucleotide
ttagagttaatgtttcatct

SEQ ID NO: 13080 - DNA, 20 bp, Artificial Sequence
  Description of Artificial Sequence: Synthetic oligonucleotide
gttagagttaatgtttcatc

SEQ ID NO: 13081 - DNA, 20 bp, Artificial Sequence
  Description of Artificial Sequence: Synthetic oligonucleotide
agttagagttaatgtttcat

SEQ ID NO: 13082 - DNA, 20 bp, Artificial Sequence
  Description of Artificial Sequence: Synthetic oligonucleotide
cagttagagttaatgtttca

SEQ ID NO: 13083 - DNA, 20 bp, Artificial Sequence
  Description of Artificial Sequence: Synthetic oligonucleotide
acagttagagttaatgtttc

SEQ ID NO: 13084 - DNA, 20 bp, Artificial Sequence
  Description of Artificial Sequence: Synthetic oligonucleotide
cacagttagagttaatgttt

SEQ ID NO: 13085 - DNA, 20 bp, Artificial Sequence
  Description of Artificial Sequence: Synthetic oligonucleotide
tcacagttagagttaatgtt

SEQ ID NO: 13086 - DNA, 20 bp, Artificial Sequence
  Description of Artificial Sequence: Synthetic oligonucleotide
gtcacagttagagttaatgt

SEQ ID NO: 13087 - DNA, 20 bp, Artificial Sequence
  Description of Artificial Sequence: Synthetic oligonucleotide
tgtcacagttagagttaatg

SEQ ID NO: 13088 - DNA, 20 bp, Artificial Sequence
  Description of Artificial Sequence: Synthetic oligonucleotide
ttgtcacagttagagttaat

SEQ ID NO: 13089 - DNA, 20 bp, Artificial Sequence
  Description of Artificial Sequence: Synthetic oligonucleotide
tttgtcacagttagagttaa

SEQ ID NO: 13090 - DNA, 20 bp, Artificial Sequence
  Description of Artificial Sequence: Synthetic oligonucleotide
ctttgtcacagttagagtta

SEQ ID NO: 13091 - DNA, 20 bp, Artificial Sequence
  Description of Artificial Sequence: Synthetic oligonucleotide
tctttgtcacagttagagtt

SEQ ID NO: 13092 - DNA, 20 bp, Artificial Sequence
  Description of Artificial Sequence: Synthetic oligonucleotide
ttctttgtcacagttagagt

SEQ ID NO: 13093 - DNA, 20 bp, Artificial Sequence
  Description of Artificial Sequence: Synthetic oligonucleotide
cttctttgtcacagttagag

SEQ ID NO: 13094 - DNA, 20 bp, Artificial Sequence
  Description of Artificial Sequence: Synthetic oligonucleotide
tcttctttgtcacagttaga

SEQ ID NO: 13095 - DNA, 20 bp, Artificial Sequence
  Description of Artificial Sequence: Synthetic oligonucleotide
gtcttctttgtcacagttag

SEQ ID NO: 13096 - DNA, 20 bp, Artificial Sequence
  Description of Artificial Sequence: Synthetic oligonucleotide
ggtcttctttgtcacagtta

SEQ ID NO: 13097 - DNA, 20 bp, Artificial Sequence
  Description of Artificial Sequence: Synthetic oligonucleotide
tggtcttctttgtcacagtt

SEQ ID NO: 13098 - DNA, 20 bp, Artificial Sequence
  Description of Artificial Sequence: Synthetic oligonucleotide
gtggtcttctttgtcacagt

SEQ ID NO: 13099 - DNA, 20 bp, Artificial Sequence
  Description of Artificial Sequence: Synthetic oligonucleotide
tgtggtcttctttgtcacag

SEQ ID NO: 13100 - DNA, 20 bp, Artificial Sequence
  Description of Artificial Sequence: Synthetic oligonucleotide
ttgtggtcttctttgtcaca

SEQ ID NO: 13101 - DNA, 20 bp, Artificial Sequence
  Description of Artificial Sequence: Synthetic oligonucleotide
tttgtggtcttctttgtcac

SEQ ID NO: 13102 - DNA, 20 bp, Artificial Sequence
  Description of Artificial Sequence: Synthetic oligonucleotide
atttgtggtcttctttgtca

SEQ ID NO: 13103 - DNA, 20 bp, Artificial Sequence
  Description of Artificial Sequence: Synthetic oligonucleotide
tatttgtggtcttctttgtc

SEQ ID NO: 13104 - DNA, 20 bp, Artificial Sequence
  Description of Artificial Sequence: Synthetic oligonucleotide
ctatttgtggtcttctttgt

SEQ ID NO: 13105 - DNA, 20 bp, Artificial Sequence
  Description of Artificial Sequence: Synthetic oligonucleotide
actatttgtggtcttctttg

SEQ ID NO: 13106 - DNA, 20 bp, Artificial Sequence
  Description of Artificial Sequence: Synthetic oligonucleotide
aactatttgtggtcttcttt

SEQ ID NO: 13107 - DNA, 20 bp, Artificial Sequence
  Description of Artificial Sequence: Synthetic oligonucleotide
taactatttgtggtcttctt

SEQ ID NO: 13108 - DNA, 20 bp, Artificial Sequence
  Description of Artificial Sequence: Synthetic oligonucleotide
ataactatttgtggtcttct

SEQ ID NO: 13109 - DNA, 20 bp, Artificial Sequence
  Description of Artificial Sequence: Synthetic oligonucleotide
gataactatttgtggtcttc

SEQ ID NO: 13110 - DNA, 20 bp, Artificial Sequence
  Description of Artificial Sequence: Synthetic oligonucleotide
agataactatttgtggtctt

SEQ ID NO: 13111 - DNA, 20 bp, Artificial Sequence
  Description of Artificial Sequence: Synthetic oligonucleotide
aagataactatttgtggtct

SEQ ID NO: 13112 - DNA, 20 bp, Artificial Sequence
  Description of Artificial Sequence: Synthetic oligonucleotide
aaagataactatttgtggtc

SEQ ID NO: 13113 - DNA, 20 bp, Artificial Sequence
  Description of Artificial Sequence: Synthetic oligonucleotide
aaaagataactatttgtggt

SEQ ID NO: 13114 - DNA, 20 bp, Artificial Sequence
  Description of Artificial Sequence: Synthetic oligonucleotide
taaaagataactatttgtgg

SEQ ID NO: 13115 - DNA, 20 bp, Artificial Sequence
  Description of Artificial Sequence: Synthetic oligonucleotide
ttaaaagataactatttgtg

SEQ ID NO: 13116 - DNA, 20 bp, Artificial Sequence
  Description of Artificial Sequence: Synthetic oligonucleotide
attaaaagataactatttgt

SEQ ID NO: 13117 - DNA, 20 bp, Artificial Sequence
  Description of Artificial Sequence: Synthetic oligonucleotide
aattaaaagataactatttg

SEQ ID NO: 13118 - DNA, 20 bp, Artificial Sequence
  Description of Artificial Sequence: Synthetic oligonucleotide
taattaaaagataactattt

SEQ ID NO: 13119 - DNA, 20 bp, Artificial Sequence
  Description of Artificial Sequence: Synthetic oligonucleotide
gtaattaaaagataactatt

SEQ ID NO: 13120 - DNA, 20 bp, Artificial Sequence
  Description of Artificial Sequence: Synthetic oligonucleotide
tgtaattaaaagataactat

SEQ ID NO: 13121 - DNA, 20 bp, Artificial Sequence
  Description of Artificial Sequence: Synthetic oligonucleotide
ctgtaattaaaagataacta

SEQ ID NO: 13122 - DNA, 20 bp, Artificial Sequence
  Description of Artificial Sequence: Synthetic oligonucleotide
tctgtaattaaaagataact

SEQ ID NO: 13123 - DNA, 20 bp, Artificial Sequence
  Description of Artificial Sequence: Synthetic oligonucleotide
ttctgtaattaaaagataac

SEQ ID NO: 13124 - DNA, 20 bp, Artificial Sequence
  Description of Artificial Sequence: Synthetic oligonucleotide
cttctgtaattaaaagataa

SEQ ID NO: 13125 - DNA, 20 bp, Artificial Sequence
  Description of Artificial Sequence: Synthetic oligonucleotide
tcttctgtaattaaaagata

SEQ ID NO: 13126 - DNA, 20 bp, Artificial Sequence
  Description of Artificial Sequence: Synthetic oligonucleotide
ctcttctgtaattaaaagat

SEQ ID NO: 13127 - DNA, 20 bp, Artificial Sequence
  Description of Artificial Sequence: Synthetic oligonucleotide
actcttctgtaattaaaaga

SEQ ID NO: 13128 - DNA, 20 bp, Artificial Sequence
  Description of Artificial Sequence: Synthetic oligonucleotide
aactcttctgtaattaaaag

SEQ ID NO: 13129 - DNA, 20 bp, Artificial Sequence
  Description of Artificial Sequence: Synthetic oligonucleotide
aaactcttctgtaattaaaa

SEQ ID NO: 13130 - DNA, 20 bp, Artificial Sequence
  Description of Artificial Sequence: Synthetic oligonucleotide
gaaactcttctgtaattaaa

SEQ ID NO: 13131 - DNA, 20 bp, Artificial Sequence
  Description of Artificial Sequence: Synthetic oligonucleotide
agaaactcttctgtaattaa

SEQ ID NO: 13132 - DNA, 20 bp, Artificial Sequence
  Description of Artificial Sequence: Synthetic oligonucleotide
aagaaactcttctgtaatta

SEQ ID NO: 13133 - DNA, 20 bp, Artificial Sequence
  Description of Artificial Sequence: Synthetic oligonucleotide
taagaaactcttctgtaatt

SEQ ID NO: 13134 - DNA, 20 bp, Artificial Sequence
  Description of Artificial Sequence: Synthetic oligonucleotide
ttaagaaactcttctgtaat

SEQ ID NO: 13135 - DNA, 20 bp, Artificial Sequence
  Description of Artificial Sequence: Synthetic oligonucleotide
gttaagaaactcttctgtaa

SEQ ID NO: 13136 - DNA, 20 bp, Artificial Sequence
  Description of Artificial Sequence: Synthetic oligonucleotide
agttaagaaactcttctgta

SEQ ID NO: 13137 - DNA, 20 bp, Artificial Sequence
  Description of Artificial Sequence: Synthetic oligonucleotide
aagttaagaaactcttctgt

SEQ ID NO: 13138 - DNA, 20 bp, Artificial Sequence
  Description of Artificial Sequence: Synthetic oligonucleotide
taagttaagaaactcttctg

SEQ ID NO: 13139 - DNA, 20 bp, Artificial Sequence
  Description of Artificial Sequence: Synthetic oligonucleotide
gtaagttaagaaactcttct

SEQ ID NO: 13140 - DNA, 20 bp, Artificial Sequence
  Description of Artificial Sequence: Synthetic oligonucleotide
agtaagttaagaaactcttc

SEQ ID NO: 13141 - DNA, 20 bp, Artificial Sequence
  Description of Artificial Sequence: Synthetic oligonucleotide
aagtaagttaagaaactctt

SEQ ID NO: 13142 - DNA, 20 bp, Artificial Sequence
  Description of Artificial Sequence: Synthetic oligonucleotide
aaagtaagttaagaaactct

SEQ ID NO: 13143 - DNA, 20 bp, Artificial Sequence
  Description of Artificial Sequence: Synthetic oligonucleotide
aaaagtaagttaagaaactc

SEQ ID NO: 13144 - DNA, 20 bp, Artificial Sequence
  Description of Artificial Sequence: Synthetic oligonucleotide
caaaagtaagttaagaaact

SEQ ID NO: 13145 - DNA, 20 bp, Artificial Sequence
  Description of Artificial Sequence: Synthetic oligonucleotide
acaaaagtaagttaagaaac

SEQ ID NO: 13146 - DNA, 20 bp, Artificial Sequence
  Description of Artificial Sequence: Synthetic oligonucleotide
tacaaaagtaagttaagaaa

SEQ ID NO: 13147 - DNA, 20 bp, Artificial Sequence
  Description of Artificial Sequence: Synthetic oligonucleotide
ttacaaaagtaagttaagaa

SEQ ID NO: 13148 - DNA, 20 bp, Artificial Sequence
  Description of Artificial Sequence: Synthetic oligonucleotide
cttacaaaagtaagttaaga

SEQ ID NO: 13149 - DNA, 20 bp, Artificial Sequence
  Description of Artificial Sequence: Synthetic oligonucleotide
acttacaaaagtaagttaag

SEQ ID NO: 13150 - DNA, 20 bp, Artificial Sequence
  Description of Artificial Sequence: Synthetic oligonucleotide
aacttacaaaagtaagttaa

SEQ ID NO: 13151 - DNA, 20 bp, Artificial Sequence
  Description of Artificial Sequence: Synthetic oligonucleotide
aaacttacaaaagtaagtta

SEQ ID NO: 13152 - DNA, 20 bp, Artificial Sequence
  Description of Artificial Sequence: Synthetic oligonucleotide
aaaacttacaaaagtaagtt

SEQ ID NO: 13153 - DNA, 20 bp, Artificial Sequence
  Description of Artificial Sequence: Synthetic oligonucleotide
aaaaacttacaaaagtaagt

SEQ ID NO: 13154 - DNA, 20 bp, Artificial Sequence
  Description of Artificial Sequence: Synthetic oligonucleotide
taaaaacttacaaaagtaag

SEQ ID NO: 13155 - DNA, 20 bp, Artificial Sequence
  Description of Artificial Sequence: Synthetic oligonucleotide
ataaaaacttacaaaagtaa

SEQ ID NO: 13156 - DNA, 20 bp, Artificial Sequence
  Description of Artificial Sequence: Synthetic oligonucleotide
aataaaaacttacaaaagta

SEQ ID NO: 13157 - DNA, 20 bp, Artificial Sequence
  Description of Artificial Sequence: Synthetic oligonucleotide
caataaaaacttacaaaagt

SEQ ID NO: 13158 - DNA, 20 bp, Artificial Sequence
  Description of Artificial Sequence: Synthetic oligonucleotide
acaataaaaacttacaaaag

SEQ ID NO: 13159 - DNA, 20 bp, Artificial Sequence
  Description of Artificial Sequence: Synthetic oligonucleotide
cacaataaaaacttacaaaa

SEQ ID NO: 13160 - DNA, 20 bp, Artificial Sequence
  Description of Artificial Sequence: Synthetic oligonucleotide
acacaataaaaacttacaaa

SEQ ID NO: 13161 - DNA, 20 bp, Artificial Sequence
  Description of Artificial Sequence: Synthetic oligonucleotide
tacacaataaaaacttacaa

SEQ ID NO: 13162 - DNA, 20 bp, Artificial Sequence
  Description of Artificial Sequence: Synthetic oligonucleotide
ttacacaataaaaacttaca

SEQ ID NO: 13163 - DNA, 20 bp, Artificial Sequence
  Description of Artificial Sequence: Synthetic oligonucleotide
cttacacaataaaaacttac

SEQ ID NO: 13164 - DNA, 20 bp, Artificial Sequence
  Description of Artificial Sequence: Synthetic oligonucleotide
acttacacaataaaaactta

SEQ ID NO: 13165 - DNA, 20 bp, Artificial Sequence
  Description of Artificial Sequence: Synthetic oligonucleotide
aacttacacaataaaaactt

SEQ ID NO: 13166 - DNA, 20 bp, Artificial Sequence
  Description of Artificial Sequence: Synthetic oligonucleotide
aaacttacacaataaaaact

SEQ ID NO: 13167 - DNA, 20 bp, Artificial Sequence
  Description of Artificial Sequence: Synthetic oligonucleotide
taaacttacacaataaaaac

SEQ ID NO: 13168 - DNA, 20 bp, Artificial Sequence
  Description of Artificial Sequence: Synthetic oligonucleotide
ataaacttacacaataaaaa

SEQ ID NO: 13169 - DNA, 20 bp, Artificial Sequence
  Description of Artificial Sequence: Synthetic oligonucleotide
tataaacttacacaataaaa

SEQ ID NO: 13170 - DNA, 20 bp, Artificial Sequence
  Description of Artificial Sequence: Synthetic oligonucleotide
ttataaacttacacaataaa

SEQ ID NO: 13171 - DNA, 20 bp, Artificial Sequence
  Description of Artificial Sequence: Synthetic oligonucleotide
attataaacttacacaataa

SEQ ID NO: 13172 - DNA, 20 bp, Artificial Sequence
  Description of Artificial Sequence: Synthetic oligonucleotide
cattataaacttacacaata

SEQ ID NO: 13173 - DNA, 20 bp, Artificial Sequence
  Description of Artificial Sequence: Synthetic oligonucleotide
gcattataaacttacacaat

SEQ ID NO: 13174 - DNA, 20 bp, Artificial Sequence
  Description of Artificial Sequence: Synthetic oligonucleotide
tgcattataaacttacacaa

SEQ ID NO: 13175 - DNA, 20 bp, Artificial Sequence
  Description of Artificial Sequence: Synthetic oligonucleotide
ctgcattataaacttacaca

SEQ ID NO: 13176 - DNA, 20 bp, Artificial Sequence
  Description of Artificial Sequence: Synthetic oligonucleotide
cctgcattataaacttacac

SEQ ID NO: 13177 - DNA, 20 bp, Artificial Sequence
  Description of Artificial Sequence: Synthetic oligonucleotide
ccctgcattataaacttaca

SEQ ID NO: 13178 - DNA, 20 bp, Artificial Sequence
  Description of Artificial Sequence: Synthetic oligonucleotide
cccctgcattataaacttac

SEQ ID NO: 13179 - DNA, 20 bp, Artificial Sequence
  Description of Artificial Sequence: Synthetic oligonucleotide
tcccctgcattataaactta

SEQ ID NO: 13180 - DNA, 20 bp, Artificial Sequence
  Description of Artificial Sequence: Synthetic oligonucleotide
ttcccctgcattataaactt

SEQ ID NO: 13181 - DNA, 20 bp, Artificial Sequence
  Description of Artificial Sequence: Synthetic oligonucleotide
cttcccctgcattataaact

SEQ ID NO: 13182 - DNA, 20 bp, Artificial Sequence
  Description of Artificial Sequence: Synthetic oligonucleotide
acttcccctgcattataaac

SEQ ID NO: 13183 - DNA, 20 bp, Artificial Sequence
  Description of Artificial Sequence: Synthetic oligonucleotide
tacttcccctgcattataaa

SEQ ID NO: 13184 - DNA, 20 bp, Artificial Sequence
  Description of Artificial Sequence: Synthetic oligonucleotide
gtacttcccctgcattataa

SEQ ID NO: 13185 - DNA, 20 bp, Artificial Sequence
  Description of Artificial Sequence: Synthetic oligonucleotide
agtacttcccctgcattata

SEQ ID NO: 13186 - DNA, 20 bp, Artificial Sequence
  Description of Artificial Sequence: Synthetic oligonucleotide
tagtacttcccctgcattat

SEQ ID NO: 13187 - DNA, 20 bp, Artificial Sequence
  Description of Artificial Sequence: Synthetic oligonucleotide
gtagtacttcccctgcatta

SEQ ID NO: 13188 - DNA, 20 bp, Artificial Sequence
  Description of Artificial Sequence: Synthetic oligonucleotide
agtagtacttcccctgcatt

SEQ ID NO: 13189 - DNA, 20 bp, Artificial Sequence
  Description of Artificial Sequence: Synthetic oligonucleotide
gagtagtacttcccctgcat

SEQ ID NO: 13190 - DNA, 20 bp, Artificial Sequence
  Description of Artificial Sequence: Synthetic oligonucleotide
ggagtagtacttcccctgca

SEQ ID NO: 13191 - DNA, 20 bp, Artificial Sequence
  Description of Artificial Sequence: Synthetic oligonucleotide
aggagtagtacttcccctgc

SEQ ID NO: 13192 - DNA, 20 bp, Artificial Sequence
  Description of Artificial Sequence: Synthetic oligonucleotide
gaggagtagtacttcccctg

SEQ ID NO: 13193 - DNA, 20 bp, Artificial Sequence
  Description of Artificial Sequence: Synthetic oligonucleotide
tgaggagtagtacttcccct

SEQ ID NO: 13194 - DNA, 20 bp, Artificial Sequence
  Description of Artificial Sequence: Synthetic oligonucleotide
ttgaggagtagtacttcccc

SEQ ID NO: 13195 - DNA, 20 bp, Artificial Sequence
  Description of Artificial Sequence: Synthetic oligonucleotide
tttgaggagtagtacttccc

SEQ ID NO: 13196 - DNA, 20 bp, Artificial Sequence
  Description of Artificial Sequence: Synthetic oligonucleotide
atttgaggagtagtacttcc

SEQ ID NO: 13197 - DNA, 20 bp, Artificial Sequence
  Description of Artificial Sequence: Synthetic oligonucleotide
catttgaggagtagtacttc

SEQ ID NO: 13198 - DNA, 20 bp, Artificial Sequence
  Description of Artificial Sequence: Synthetic oligonucleotide
acatttgaggagtagtactt

SEQ ID NO: 13199 - DNA, 20 bp, Artificial Sequence
  Description of Artificial Sequence: Synthetic oligonucleotide
aacatttgaggagtagtact

SEQ ID NO: 13200 - DNA, 20 bp, Artificial Sequence
  Description of Artificial Sequence: Synthetic oligonucleotide
caacatttgaggagtagtac

SEQ ID NO: 13201 - DNA, 20 bp, Artificial Sequence
  Description of Artificial Sequence: Synthetic oligonucleotide
tcaacatttgaggagtagta

SEQ ID NO: 13202 - DNA, 20 bp, Artificial Sequence
  Description of Artificial Sequence: Synthetic oligonucleotide
ctcaacatttgaggagtagt

SEQ ID NO: 13203 - DNA, 20 bp, Artificial Sequence
  Description of Artificial Sequence: Synthetic oligonucleotide
cctcaacatttgaggagtag

SEQ ID NO: 13204 - DNA, 20 bp, Artificial Sequence
  Description of Artificial Sequence: Synthetic oligonucleotide
ccctcaacatttgaggagta

SEQ ID NO: 13205 - DNA, 20 bp, Artificial Sequence
  Description of Artificial Sequence: Synthetic oligonucleotide
tccctcaacatttgaggagt

SEQ ID NO: 13206 - DNA, 20 bp, Artificial Sequence
  Description of Artificial Sequence: Synthetic oligonucleotide
ttccctcaacatttgaggag

SEQ ID NO: 13207 - DNA, 20 bp, Artificial Sequence
  Description of Artificial Sequence: Synthetic oligonucleotide
cttccctcaacatttgagga

SEQ ID NO: 13208 - DNA, 20 bp, Artificial Sequence
  Description of Artificial Sequence: Synthetic oligonucleotide
gcttccctcaacatttgagg

SEQ ID NO: 13209 - DNA, 20 bp, Artificial Sequence
  Description of Artificial Sequence: Synthetic oligonucleotide
agcttccctcaacatttgag

SEQ ID NO: 13210 - DNA, 20 bp, Artificial Sequence
  Description of Artificial Sequence: Synthetic oligonucleotide
aagcttccctcaacatttga

SEQ ID NO: 13211 - DNA, 20 bp, Artificial Sequence
  Description of Artificial Sequence: Synthetic oligonucleotide
gaagcttccctcaacatttg

SEQ ID NO: 13212 - DNA, 20 bp, Artificial Sequence
  Description of Artificial Sequence: Synthetic oligonucleotide
ggaagcttccctcaacattt

SEQ ID NO: 13213 - DNA, 20 bp, Artificial Sequence
  Description of Artificial Sequence: Synthetic oligonucleotide
tggaagcttccctcaacatt

SEQ ID NO: 13214 - DNA, 20 bp, Artificial Sequence
  Description of Artificial Sequence: Synthetic oligonucleotide
atggaagcttccctcaacat

SEQ ID NO: 13215 - DNA, 20 bp, Artificial Sequence
  Description of Artificial Sequence: Synthetic oligonucleotide
tatggaagcttccctcaaca

SEQ ID NO: 13216 - DNA, 20 bp, Artificial Sequence
  Description of Artificial Sequence: Synthetic oligonucleotide
ttatggaagcttccctcaac

SEQ ID NO: 13217 - DNA, 20 bp, Artificial Sequence
  Description of Artificial Sequence: Synthetic oligonucleotide
gttatggaagcttccctcaa

SEQ ID NO: 13218 - DNA, 20 bp, Artificial Sequence
  Description of Artificial Sequence: Synthetic oligonucleotide
tgttatggaagcttccctca

SEQ ID NO: 13219 - DNA, 20 bp, Artificial Sequence
  Description of Artificial Sequence: Synthetic oligonucleotide
atgttatggaagcttccctc

SEQ ID NO: 13220 - DNA, 20 bp, Artificial Sequence
  Description of Artificial Sequence: Synthetic oligonucleotide
aatgttatggaagcttccct

SEQ ID NO: 13221 - DNA, 20 bp, Artificial Sequence
  Description of Artificial Sequence: Synthetic oligonucleotide
caatgttatggaagcttccc

SEQ ID NO: 13222 - DNA, 20 bp, Artificial Sequence
  Description of Artificial Sequence: Synthetic oligonucleotide
tcaatgttatggaagcttcc

SEQ ID NO: 13223 - DNA, 20 bp, Artificial Sequence
  Description of Artificial Sequence: Synthetic oligonucleotide
atcaatgttatggaagcttc

SEQ ID NO: 13224 - DNA, 20 bp, Artificial Sequence
  Description of Artificial Sequence: Synthetic oligonucleotide
catcaatgttatggaagctt

SEQ ID NO: 13225 - DNA, 20 bp, Artificial Sequence
  Description of Artificial Sequence: Synthetic oligonucleotide
tcatcaatgttatggaagct

SEQ ID NO: 13226 - DNA, 20 bp, Artificial Sequence
  Description of Artificial Sequence: Synthetic oligonucleotide
gtcatcaatgttatggaagc

SEQ ID NO: 13227 - DNA, 20 bp, Artificial Sequence
  Description of Artificial Sequence: Synthetic oligonucleotide
agtcatcaatgttatggaag

SEQ ID NO: 13228 - DNA, 20 bp, Artificial Sequence
  Description of Artificial Sequence: Synthetic oligonucleotide
cagtcatcaatgttatggaa

SEQ ID NO: 13229 - DNA, 20 bp, Artificial Sequence
  Description of Artificial Sequence: Synthetic oligonucleotide
ccagtcatcaatgttatgga

SEQ ID NO: 13230 - DNA, 20 bp, Artificial Sequence
  Description of Artificial Sequence: Synthetic oligonucleotide
gccagtcatcaatgttatgg

SEQ ID NO: 13231 - DNA, 20 bp, Artificial Sequence
  Description of Artificial Sequence: Synthetic oligonucleotide
agccagtcatcaatgttatg

SEQ ID NO: 13232 - DNA, 20 bp, Artificial Sequence
  Description of Artificial Sequence: Synthetic oligonucleotide
aagccagtcatcaatgttat

SEQ ID NO: 13233 - DNA, 20 bp, Artificial Sequence
  Description of Artificial Sequence: Synthetic oligonucleotide
gaagccagtcatcaatgtta

SEQ ID NO: 13234 - DNA, 20 bp, Artificial Sequence
  Description of Artificial Sequence: Synthetic oligonucleotide
tgaagccagtcatcaatgtt

SEQ ID NO: 13235 - DNA, 20 bp, Artificial Sequence
  Description of Artificial Sequence: Synthetic oligonucleotide
atgaagccagtcatcaatgt

SEQ ID NO: 13236 - DNA, 20 bp, Artificial Sequence
  Description of Artificial Sequence: Synthetic oligonucleotide
catgaagccagtcatcaatg

SEQ ID NO: 13237 - DNA, 20 bp, Artificial Sequence
  Description of Artificial Sequence: Synthetic oligonucleotide
ccatgaagccagtcatcaat

SEQ ID NO: 13238 - DNA, 20 bp, Artificial Sequence
  Description of Artificial Sequence: Synthetic oligonucleotide
gccatgaagccagtcatcaa

SEQ ID NO: 13239 - DNA, 20 bp, Artificial Sequence
  Description of Artificial Sequence: Synthetic oligonucleotide
tgccatgaagccagtcatca

SEQ ID NO: 13240 - DNA, 20 bp, Artificial Sequence
  Description of Artificial Sequence: Synthetic oligonucleotide
ctgccatgaagccagtcatc

SEQ ID NO: 13241 - DNA, 20 bp, Artificial Sequence
  Description of Artificial Sequence: Synthetic oligonucleotide
actgccatgaagccagtcat

SEQ ID NO: 13242 - DNA, 20 bp, Artificial Sequence
  Description of Artificial Sequence: Synthetic oligonucleotide
tactgccatgaagccagtca

SEQ ID NO: 13243 - DNA, 20 bp, Artificial Sequence
  Description of Artificial Sequence: Synthetic oligonucleotide
ttactgccatgaagccagtc

SEQ ID NO: 13244 - DNA, 20 bp, Artificial Sequence
  Description of Artificial Sequence: Synthetic oligonucleotide
attactgccatgaagccagt

SEQ ID NO: 13245 - DNA, 20 bp, Artificial Sequence
  Description of Artificial Sequence: Synthetic oligonucleotide
aattactgccatgaagccag

SEQ ID NO: 13246 - DNA, 20 bp, Artificial Sequence
  Description of Artificial Sequence: Synthetic oligonucleotide
gaattactgccatgaagcca

SEQ ID NO: 13247 - DNA, 20 bp, Artificial Sequence
  Description of Artificial Sequence: Synthetic oligonucleotide
agaattactgccatgaagcc

SEQ ID NO: 13248 - DNA, 20 bp, Artificial Sequence
  Description of Artificial Sequence: Synthetic oligonucleotide
gagaattactgccatgaagc

SEQ ID NO: 13249 - DNA, 20 bp, Artificial Sequence
  Description of Artificial Sequence: Synthetic oligonucleotide
cgagaattactgccatgaag

SEQ ID NO: 13250 - DNA, 20 bp, Artificial Sequence
  Description of Artificial Sequence: Synthetic oligonucleotide
ccgagaattactgccatgaa

SEQ ID NO: 13251 - DNA, 20 bp, Artificial Sequence
  Description of Artificial Sequence: Synthetic oligonucleotide
gccgagaattactgccatga

SEQ ID NO: 13252 - DNA, 20 bp, Artificial Sequence
  Description of Artificial Sequence: Synthetic oligonucleotide
agccgagaattactgccatg

SEQ ID NO: 13253 - DNA, 20 bp, Artificial Sequence
  Description of Artificial Sequence: Synthetic oligonucleotide
cagccgagaattactgccat

SEQ ID NO: 13254 - DNA, 20 bp, Artificial Sequence
  Description of Artificial Sequence: Synthetic oligonucleotide
acagccgagaattactgcca

SEQ ID NO: 13255 - DNA, 20 bp, Artificial Sequence
  Description of Artificial Sequence: Synthetic oligonucleotide
tacagccgagaattactgcc

SEQ ID NO: 13256 - DNA, 20 bp, Artificial Sequence
  Description of Artificial Sequence: Synthetic oligonucleotide
ctacagccgagaattactgc

SEQ ID NO: 13257 - DNA, 20 bp, Artificial Sequence
  Description of Artificial Sequence: Synthetic oligonucleotide
actacagccgagaattactg

SEQ ID NO: 13258 - DNA, 20 bp, Artificial Sequence
  Description of Artificial Sequence: Synthetic oligonucleotide
aactacagccgagaattact

SEQ ID NO: 13259 - DNA, 20 bp, Artificial Sequence
  Description of Artificial Sequence: Synthetic oligonucleotide
caactacagccgagaattac

SEQ ID NO: 13260 - DNA, 20 bp, Artificial Sequence
  Description of Artificial Sequence: Synthetic oligonucleotide
gcaactacagccgagaatta

SEQ ID NO: 13261 - DNA, 20 bp, Artificial Sequence
  Description of Artificial Sequence: Synthetic oligonucleotide
tgcaactacagccgagaatt

SEQ ID NO: 13262 - DNA, 20 bp, Artificial Sequence
  Description of Artificial Sequence: Synthetic oligonucleotide
atgcaactacagccgagaat

SEQ ID NO: 13263 - DNA, 20 bp, Artificial Sequence
  Description of Artificial Sequence: Synthetic oligonucleotide
tatgcaactacagccgagaa

SEQ ID NO: 13264 - DNA, 20 bp, Artificial Sequence
  Description of Artificial Sequence: Synthetic oligonucleotide
ttatgcaactacagccgaga

SEQ ID NO: 13265 - DNA, 20 bp, Artificial Sequence
  Description of Artificial Sequence: Synthetic oligonucleotide
cttatgcaactacagccgag

SEQ ID NO: 13266 - DNA, 20 bp, Artificial Sequence
  Description of Artificial Sequence: Synthetic oligonucleotide
gcttatgcaactacagccga

SEQ ID NO: 13267 - DNA, 20 bp, Artificial Sequence
  Description of Artificial Sequence: Synthetic oligonucleotide
tgcttatgcaactacagccg

SEQ ID NO: 13268 - DNA, 20 bp, Artificial Sequence
  Description of Artificial Sequence: Synthetic oligonucleotide
atgcttatgcaactacagcc

SEQ ID NO: 13269 - DNA, 20 bp, Artificial Sequence
  Description of Artificial Sequence: Synthetic oligonucleotide
aatgcttatgcaactacagc

SEQ ID NO: 13270 - DNA, 20 bp, Artificial Sequence
  Description of Artificial Sequence: Synthetic oligonucleotide
caatgcttatgcaactacag

SEQ ID NO: 13271 - DNA, 20 bp, Artificial Sequence
  Description of Artificial Sequence: Synthetic oligonucleotide
gcaatgcttatgcaactaca

SEQ ID NO: 13272 - DNA, 20 bp, Artificial Sequence
  Description of Artificial Sequence: Synthetic oligonucleotide
agcaatgcttatgcaactac

SEQ ID NO: 13273 - DNA, 20 bp, Artificial Sequence
  Description of Artificial Sequence: Synthetic oligonucleotide
gagcaatgcttatgcaacta

SEQ ID NO: 13274 - DNA, 20 bp, Artificial Sequence
  Description of Artificial Sequence: Synthetic oligonucleotide
tgagcaatgcttatgcaact

SEQ ID NO: 13275 - DNA, 20 bp, Artificial Sequence
  Description of Artificial Sequence: Synthetic oligonucleotide
ttgagcaatgcttatgcaac

SEQ ID NO: 13276 - DNA, 20 bp, Artificial Sequence
  Description of Artificial Sequence: Synthetic oligonucleotide
cttgagcaatgcttatgcaa

SEQ ID NO: 13277 - DNA, 20 bp, Artificial Sequence
  Description of Artificial Sequence: Synthetic oligonucleotide
tcttgagcaatgcttatgca

SEQ ID NO: 13278 - DNA, 20 bp, Artificial Sequence
  Description of Artificial Sequence: Synthetic oligonucleotide
ctcttgagcaatgcttatgc

SEQ ID NO: 13279 - DNA, 20 bp, Artificial Sequence
  Description of Artificial Sequence: Synthetic oligonucleotide
cctcttgagcaatgcttatg

SEQ ID NO: 13280 - DNA, 20 bp, Artificial Sequence
  Description of Artificial Sequence: Synthetic oligonucleotide
tcctcttgagcaatgcttat

SEQ ID NO: 13281 - DNA, 20 bp, Artificial Sequence
  Description of Artificial Sequence: Synthetic oligonucleotide
ttcctcttgagcaatgctta

SEQ ID NO: 13282 - DNA, 20 bp, Artificial Sequence
  Description of Artificial Sequence: Synthetic oligonucleotide
tttcctcttgagcaatgctt

SEQ ID NO: 13283 - DNA, 20 bp, Artificial Sequence
  Description of Artificial Sequence: Synthetic oligonucleotide
ttttcctcttgagcaatgct

SEQ ID NO: 13284 - DNA, 20 bp, Artificial Sequence
  Description of Artificial Sequence: Synthetic oligonucleotide
attttcctcttgagcaatgc

SEQ ID NO: 13285 - DNA, 20 bp, Artificial Sequence
  Description of Artificial Sequence: Synthetic oligonucleotide
gattttcctcttgagcaatg

SEQ ID NO: 13286 - DNA, 20 bp, Artificial Sequence
  Description of Artificial Sequence: Synthetic oligonucleotide
ggattttcctcttgagcaat

SEQ ID NO: 13287 - DNA, 20 bp, Artificial Sequence
  Description of Artificial Sequence: Synthetic oligonucleotide
tggattttcctcttgagcaa

SEQ ID NO: 13288 - DNA, 20 bp, Artificial Sequence
  Description of Artificial Sequence: Synthetic oligonucleotide
ttggattttcctcttgagca

SEQ ID NO: 13289 - DNA, 20 bp, Artificial Sequence
  Description of Artificial Sequence: Synthetic oligonucleotide
tttggattttcctcttgagc

SEQ ID NO: 13290 - DNA, 20 bp, Artificial Sequence
  Description of Artificial Sequence: Synthetic oligonucleotide
ttttggattttcctcttgag

SEQ ID NO: 13291 - DNA, 20 bp, Artificial Sequence
  Description of Artificial Sequence: Synthetic oligonucleotide
cttttggattttcctcttga

SEQ ID NO: 13292 - DNA, 20 bp, Artificial Sequence
  Description of Artificial Sequence: Synthetic oligonucleotide
acttttggattttcctcttg

SEQ ID NO: 13293 - DNA, 20 bp, Artificial Sequence
  Description of Artificial Sequence: Synthetic oligonucleotide
cacttttggattttcctctt

SEQ ID NO: 13294 - DNA, 20 bp, Artificial Sequence
  Description of Artificial Sequence: Synthetic oligonucleotide
gcacttttggattttcctct

SEQ ID NO: 13295 - DNA, 20 bp, Artificial Sequence
  Description of Artificial Sequence: Synthetic oligonucleotide
tgcacttttggattttcctc

SEQ ID NO: 13296 - DNA, 20 bp, Artificial Sequence
  Description of Artificial Sequence: Synthetic oligonucleotide
ctgcacttttggattttcct

SEQ ID NO: 13297 - DNA, 20 bp, Artificial Sequence
  Description of Artificial Sequence: Synthetic oligonucleotide
gctgcacttttggattttcc

SEQ ID NO: 13298 - DNA, 20 bp, Artificial Sequence
  Description of Artificial Sequence: Synthetic oligonucleotide
tgctgcacttttggattttc

SEQ ID NO: 13299 - DNA, 20 bp, Artificial Sequence
  Description of Artificial Sequence: Synthetic oligonucleotide
ctgctgcacttttggatttt

SEQ ID NO: 13300 - DNA, 20 bp, Artificial Sequence
  Description of Artificial Sequence: Synthetic oligonucleotide
cctgctgcacttttggattt

SEQ ID NO: 13301 - DNA, 20 bp, Artificial Sequence
  Description of Artificial Sequence: Synthetic oligonucleotide
tcctgctgcacttttggatt

SEQ ID NO: 13302 - DNA, 20 bp, Artificial Sequence
  Description of Artificial Sequence: Synthetic oligonucleotide
ctcctgctgcacttttggat

SEQ ID NO: 13303 - DNA, 20 bp, Artificial Sequence
  Description of Artificial Sequence: Synthetic oligonucleotide
tctcctgctgcacttttgga

SEQ ID NO: 13304 - DNA, 20 bp, Artificial Sequence
  Description of Artificial Sequence: Synthetic oligonucleotide
ttctcctgctgcacttttgg

SEQ ID NO: 13305 - DNA, 20 bp, Artificial Sequence
  Description of Artificial Sequence: Synthetic oligonucleotide
gttctcctgctgcacttttg

SEQ ID NO: 13306 - DNA, 20 bp, Artificial Sequence
  Description of Artificial Sequence: Synthetic oligonucleotide
agttctcctgctgcactttt

SEQ ID NO: 13307 - DNA, 20 bp, Artificial Sequence
  Description of Artificial Sequence: Synthetic oligonucleotide
gagttctcctgctgcacttt

SEQ ID NO: 13308 - DNA, 20 bp, Artificial Sequence
  Description of Artificial Sequence: Synthetic oligonucleotide
agagttctcctgctgcactt

SEQ ID NO: 13309 - DNA, 20 bp, Artificial Sequence
  Description of Artificial Sequence: Synthetic oligonucleotide
aagagttctcctgctgcact

SEQ ID NO: 13310 - DNA, 20 bp, Artificial Sequence
  Description of Artificial Sequence: Synthetic oligonucleotide
aaagagttctcctgctgcac

SEQ ID NO: 13311 - DNA, 20 bp, Artificial Sequence
  Description of Artificial Sequence: Synthetic oligonucleotide
aaaagagttctcctgctgca

SEQ ID NO: 13312 - DNA, 20 bp, Artificial Sequence
  Description of Artificial Sequence: Synthetic oligonucleotide
gaaaagagttctcctgctgc

SEQ ID NO: 13313 - DNA, 20 bp, Artificial Sequence
  Description of Artificial Sequence: Synthetic oligonucleotide
ggaaaagagttctcctgctg

SEQ ID NO: 13314 - DNA, 20 bp, Artificial Sequence
  Description of Artificial Sequence: Synthetic oligonucleotide
gggaaaagagttctcctgct

SEQ ID NO: 13315 - DNA, 20 bp, Artificial Sequence
  Description of Artificial Sequence: Synthetic oligonucleotide
agggaaaagagttctcctgc

SEQ ID NO: 13316 - DNA, 20 bp, Artificial Sequence
  Description of Artificial Sequence: Synthetic oligonucleotide
cagggaaaagagttctcctg

SEQ ID NO: 13317 - DNA, 20 bp, Artificial Sequence
  Description of Artificial Sequence: Synthetic oligonucleotide
tcagggaaaagagttctcct

SEQ ID NO: 13318 - DNA, 20 bp, Artificial Sequence
  Description of Artificial Sequence: Synthetic oligonucleotide
ttcagggaaaagagttctcc

SEQ ID NO: 13319 - DNA, 20 bp, Artificial Sequence
  Description of Artificial Sequence: Synthetic oligonucleotide
tttcagggaaaagagttctc

SEQ ID NO: 13320 - DNA, 20 bp, Artificial Sequence
  Description of Artificial Sequence: Synthetic oligonucleotide
ttttcagggaaaagagttct

SEQ ID NO: 13321 - DNA, 20 bp, Artificial Sequence
  Description of Artificial Sequence: Synthetic oligonucleotide
tttttcagggaaaagagttc

SEQ ID NO: 13322 - DNA, 20 bp, Artificial Sequence
  Description of Artificial Sequence: Synthetic oligonucleotide
ctttttcagggaaaagagtt

SEQ ID NO: 13323 - DNA, 20 bp, Artificial Sequence
  Description of Artificial Sequence: Synthetic oligonucleotide
cctttttcagggaaaagagt

SEQ ID NO: 13324 - DNA, 20 bp, Artificial Sequence
  Description of Artificial Sequence: Synthetic oligonucleotide
tcctttttcagggaaaagag

SEQ ID NO: 13325 - DNA, 20 bp, Artificial Sequence
  Description of Artificial Sequence: Synthetic oligonucleotide
ttcctttttcagggaaaaga

SEQ ID NO: 13326 - DNA, 20 bp, Artificial Sequence
  Description of Artificial Sequence: Synthetic oligonucleotide
tttcctttttcagggaaaag

SEQ ID NO: 13327 - DNA, 20 bp, Artificial Sequence
  Description of Artificial Sequence: Synthetic oligonucleotide
ttttcctttttcagggaaaa

SEQ ID NO: 13328 - DNA, 20 bp, Artificial Sequence
  Description of Artificial Sequence: Synthetic oligonucleotide
tttttcctttttcagggaaa

SEQ ID NO: 13329 - DNA, 20 bp, Artificial Sequence
  Description of Artificial Sequence: Synthetic oligonucleotide
atttttcctttttcagggaa

SEQ ID NO: 13330 - DNA, 20 bp, Artificial Sequence
  Description of Artificial Sequence: Synthetic oligonucleotide
tatttttcctttttcaggga

SEQ ID NO: 13331 - DNA, 20 bp, Artificial Sequence
  Description of Artificial Sequence: Synthetic oligonucleotide
atatttttcctttttcaggg

SEQ ID NO: 13332 - DNA, 20 bp, Artificial Sequence
  Description of Artificial Sequence: Synthetic oligonucleotide
aatatttttcctttttcagg

SEQ ID NO: 13333 - DNA, 20 bp, Artificial Sequence
  Description of Artificial Sequence: Synthetic oligonucleotide
caatatttttcctttttcag

SEQ ID NO: 13334 - DNA, 20 bp, Artificial Sequence
  Description of Artificial Sequence: Synthetic oligonucleotide
tcaatatttttcctttttca

SEQ ID NO: 13335 - DNA, 20 bp, Artificial Sequence
  Description of Artificial Sequence: Synthetic oligonucleotide
ttcaatatttttcctttttc

SEQ ID NO: 13336 - DNA, 20 bp, Artificial Sequence
  Description of Artificial Sequence: Synthetic oligonucleotide
gttcaatatttttccttttt

SEQ ID NO: 13337 - DNA, 20 bp, Artificial Sequence
  Description of Artificial Sequence: Synthetic oligonucleotide
agttcaatatttttcctttt

SEQ ID NO: 13338 - DNA, 20 bp, Artificial Sequence
  Description of Artificial Sequence: Synthetic oligonucleotide
gagttcaatatttttccttt

SEQ ID NO: 13339 - DNA, 20 bp, Artificial Sequence
  Description of Artificial Sequence: Synthetic oligonucleotide
tgagttcaatatttttcctt

SEQ ID NO: 13340 - DNA, 20 bp, Artificial Sequence
  Description of Artificial Sequence: Synthetic oligonucleotide
ttgagttcaatatttttcct

SEQ ID NO: 13341 - DNA, 20 bp, Artificial Sequence
  Description of Artificial Sequence: Synthetic oligonucleotide
attgagttcaatatttttcc

SEQ ID NO: 13342 - DNA, 20 bp, Artificial Sequence
  Description of Artificial Sequence: Synthetic oligonucleotide
cattgagttcaatatttttc

SEQ ID NO: 13343 - DNA, 20 bp, Artificial Sequence
  Description of Artificial Sequence: Synthetic oligonucleotide
tcattgagttcaatattttt

SEQ ID NO: 13344 - DNA, 20 bp, Artificial Sequence
  Description of Artificial Sequence: Synthetic oligonucleotide
atcattgagttcaatatttt

SEQ ID NO: 13345 - DNA, 20 bp, Artificial Sequence
  Description of Artificial Sequence: Synthetic oligonucleotide
tatcattgagttcaatattt

SEQ ID NO: 13346 - DNA, 20 bp, Artificial Sequence
  Description of Artificial Sequence: Synthetic oligonucleotide
ctatcattgagttcaatatt

SEQ ID NO: 13347 - DNA, 20 bp, Artificial Sequence
  Description of Artificial Sequence: Synthetic oligonucleotide
gctatcattgagttcaatat

SEQ ID NO: 13348 - DNA, 20 bp, Artificial Sequence
  Description of Artificial Sequence: Synthetic oligonucleotide
tgctatcattgagttcaata

SEQ ID NO: 13349 - DNA, 20 bp, Artificial Sequence
  Description of Artificial Sequence: Synthetic oligonucleotide
gtgctatcattgagttcaat

SEQ ID NO: 13350 - DNA, 20 bp, Artificial Sequence
  Description of Artificial Sequence: Synthetic oligonucleotide
ggtgctatcattgagttcaa

SEQ ID NO: 13351 - DNA, 20 bp, Artificial Sequence
  Description of Artificial Sequence: Synthetic oligonucleotide
aggtgctatcattgagttca

SEQ ID NO: 13352 - DNA, 20 bp, Artificial Sequence
  Description of Artificial Sequence: Synthetic oligonucleotide
taggtgctatcattgagttc

SEQ ID NO: 13353 - DNA, 20 bp, Artificial Sequence
  Description of Artificial Sequence: Synthetic oligonucleotide
ttaggtgctatcattgagtt

SEQ ID NO: 13354 - DNA, 20 bp, Artificial Sequence
  Description of Artificial Sequence: Synthetic oligonucleotide
tttaggtgctatcattgagt

SEQ ID NO: 13355 - DNA, 20 bp, Artificial Sequence
  Description of Artificial Sequence: Synthetic oligonucleotide
gtttaggtgctatcattgag

SEQ ID NO: 13356 - DNA, 20 bp, Artificial Sequence
  Description of Artificial Sequence: Synthetic oligonucleotide
agtttaggtgctatcattga

SEQ ID NO: 13357 - DNA, 20 bp, Artificial Sequence
  Description of Artificial Sequence: Synthetic oligonucleotide
aagtttaggtgctatcattg

SEQ ID NO: 13358 - DNA, 20 bp, Artificial Sequence
  Description of Artificial Sequence: Synthetic oligonucleotide
taagtttaggtgctatcatt

SEQ ID NO: 13359 - DNA, 20 bp, Artificial Sequence
  Description of Artificial Sequence: Synthetic oligonucleotide
gtaagtttaggtgctatcat

SEQ ID NO: 13360 - DNA, 20 bp, Artificial Sequence
  Description of Artificial Sequence: Synthetic oligonucleotide
tgtaagtttaggtgctatca

SEQ ID NO: 13361 - DNA, 20 bp, Artificial Sequence
  Description of Artificial Sequence: Synthetic oligonucleotide
atgtaagtttaggtgctatc

SEQ ID NO: 13362 - DNA, 20 bp, Artificial Sequence
  Description of Artificial Sequence: Synthetic oligonucleotide
aatgtaagtttaggtgctat

SEQ ID NO: 13363 - DNA, 20 bp, Artificial Sequence
  Description of Artificial Sequence: Synthetic oligonucleotide
aaatgtaagtttaggtgcta

SEQ ID NO: 13364 - DNA, 20 bp, Artificial Sequence
  Description of Artificial Sequence: Synthetic oligonucleotide
taaatgtaagtttaggtgct

SEQ ID NO: 13365 - DNA, 20 bp, Artificial Sequence
  Description of Artificial Sequence: Synthetic oligonucleotide
ttaaatgtaagtttaggtgc

SEQ ID NO: 13366 - DNA, 20 bp, Artificial Sequence
  Description of Artificial Sequence: Synthetic oligonucleotide
tttaaatgtaagtttaggtg

SEQ ID NO: 13367 - DNA, 20 bp, Artificial Sequence
  Description of Artificial Sequence: Synthetic oligonucleotide
ttttaaatgtaagtttaggt

SEQ ID NO: 13368 - DNA, 20 bp, Artificial Sequence
  Description of Artificial Sequence: Synthetic oligonucleotide
cttttaaatgtaagtttagg

SEQ ID NO: 13369 - DNA, 20 bp, Artificial Sequence
  Description of Artificial Sequence: Synthetic oligonucleotide
tcttttaaatgtaagtttag

SEQ ID NO: 13370 - DNA, 20 bp, Artificial Sequence
  Description of Artificial Sequence: Synthetic oligonucleotide
gtcttttaaatgtaagttta

SEQ ID NO: 13371 - DNA, 20 bp, Artificial Sequence
  Description of Artificial Sequence: Synthetic oligonucleotide
tgtcttttaaatgtaagttt

SEQ ID NO: 13372 - DNA, 20 bp, Artificial Sequence
  Description of Artificial Sequence: Synthetic oligonucleotide
ctgtcttttaaatgtaagtt

SEQ ID NO: 13373 - DNA, 20 bp, Artificial Sequence
  Description of Artificial Sequence: Synthetic oligonucleotide
tctgtcttttaaatgtaagt

SEQ ID NO: 13374 - DNA, 20 bp, Artificial Sequence
  Description of Artificial Sequence: Synthetic oligonucleotide
gtctgtcttttaaatgtaag

SEQ ID NO: 13375 - DNA, 20 bp, Artificial Sequence
  Description of Artificial Sequence: Synthetic oligonucleotide
tgtctgtcttttaaatgtaa

SEQ ID NO: 13376 - DNA, 20 bp, Artificial Sequence
  Description of Artificial Sequence: Synthetic oligonucleotide
atgtctgtcttttaaatgta

SEQ ID NO: 13377 - DNA, 20 bp, Artificial Sequence
  Description of Artificial Sequence: Synthetic oligonucleotide
aatgtctgtcttttaaatgt

SEQ ID NO: 13378 - DNA, 20 bp, Artificial Sequence
  Description of Artificial Sequence: Synthetic oligonucleotide
gaatgtctgtcttttaaatg

SEQ ID NO: 13379 - DNA, 20 bp, Artificial Sequence
  Description of Artificial Sequence: Synthetic oligonucleotide
ggaatgtctgtcttttaaat

SEQ ID NO: 13380 - DNA, 20 bp, Artificial Sequence
  Description of Artificial Sequence: Synthetic oligonucleotide
aggaatgtctgtcttttaaa

SEQ ID NO: 13381 - DNA, 20 bp, Artificial Sequence
  Description of Artificial Sequence: Synthetic oligonucleotide
aaggaatgtctgtcttttaa

SEQ ID NO: 13382 - DNA, 20 bp, Artificial Sequence
  Description of Artificial Sequence: Synthetic oligonucleotide
gaaggaatgtctgtctttta

SEQ ID NO: 13383 - DNA, 20 bp, Artificial Sequence
  Description of Artificial Sequence: Synthetic oligonucleotide
agaaggaatgtctgtctttt

SEQ ID NO: 13384 - DNA, 20 bp, Artificial Sequence
  Description of Artificial Sequence: Synthetic oligonucleotide
tagaaggaatgtctgtcttt

SEQ ID NO: 13385 - DNA, 20 bp, Artificial Sequence
  Description of Artificial Sequence: Synthetic oligonucleotide
gtagaaggaatgtctgtctt

SEQ ID NO: 13386 - DNA, 20 bp, Artificial Sequence
  Description of Artificial Sequence: Synthetic oligonucleotide
tgtagaaggaatgtctgtct

SEQ ID NO: 13387 - DNA, 20 bp, Artificial Sequence
  Description of Artificial Sequence: Synthetic oligonucleotide
atgtagaaggaatgtctgtc

SEQ ID NO: 13388 - DNA, 20 bp, Artificial Sequence
  Description of Artificial Sequence: Synthetic oligonucleotide
catgtagaaggaatgtctgt

SEQ ID NO: 13389 - DNA, 20 bp, Artificial Sequence
  Description of Artificial Sequence: Synthetic oligonucleotide
acatgtagaaggaatgtctg

SEQ ID NO: 13390 - DNA, 20 bp, Artificial Sequence
  Description of Artificial Sequence: Synthetic oligonucleotide
tacatgtagaaggaatgtct

SEQ ID NO: 13391 - DNA, 20 bp, Artificial Sequence
  Description of Artificial Sequence: Synthetic oligonucleotide
ttacatgtagaaggaatgtc

SEQ ID NO: 13392 - DNA, 20 bp, Artificial Sequence
  Description of Artificial Sequence: Synthetic oligonucleotide
attacatgtagaaggaatgt

SEQ ID NO: 13393 - DNA, 20 bp, Artificial Sequence
  Description of Artificial Sequence: Synthetic oligonucleotide
cattacatgtagaaggaatg

SEQ ID NO: 13394 - DNA, 20 bp, Artificial Sequence
  Description of Artificial Sequence: Synthetic oligonucleotide
tcattacatgtagaaggaat

SEQ ID NO: 13395 - DNA, 20 bp, Artificial Sequence
  Description of Artificial Sequence: Synthetic oligonucleotide
gtcattacatgtagaaggaa

SEQ ID NO: 13396 - DNA, 20 bp, Artificial Sequence
  Description of Artificial Sequence: Synthetic oligonucleotide
tgtcattacatgtagaagga

SEQ ID NO: 13397 - DNA, 20 bp, Artificial Sequence
  Description of Artificial Sequence: Synthetic oligonucleotide
gtgtcattacatgtagaagg

SEQ ID NO: 13398 - DNA, 20 bp, Artificial Sequence
  Description of Artificial Sequence: Synthetic oligonucleotide
agtgtcattacatgtagaag

SEQ ID NO: 13399 - DNA, 20 bp, Artificial Sequence
  Description of Artificial Sequence: Synthetic oligonucleotide
aagtgtcattacatgtagaa

SEQ ID NO: 13400 - DNA, 20 bp, Artificial Sequence
  Description of Artificial Sequence: Synthetic oligonucleotide
gaagtgtcattacatgtaga

SEQ ID NO: 13401 - DNA, 20 bp, Artificial Sequence
  Description of Artificial Sequence: Synthetic oligonucleotide
agaagtgtcattacatgtag

SEQ ID NO: 13402 - DNA, 20 bp, Artificial Sequence
  Description of Artificial Sequence: Synthetic oligonucleotide
aagaagtgtcattacatgta

SEQ ID NO: 13403 - DNA, 20 bp, Artificial Sequence
  Description of Artificial Sequence: Synthetic oligonucleotide
caagaagtgtcattacatgt

SEQ ID NO: 13404 - DNA, 20 bp, Artificial Sequence
  Description of Artificial Sequence: Synthetic oligonucleotide
acaagaagtgtcattacatg

SEQ ID NO: 13405 - DNA, 20 bp, Artificial Sequence
  Description of Artificial Sequence: Synthetic oligonucleotide
cacaagaagtgtcattacat

SEQ ID NO: 13406 - DNA, 20 bp, Artificial Sequence
  Description of Artificial Sequence: Synthetic oligonucleotide
acacaagaagtgtcattaca

SEQ ID NO: 13407 - DNA, 20 bp, Artificial Sequence
  Description of Artificial Sequence: Synthetic oligonucleotide
aacacaagaagtgtcattac

SEQ ID NO: 13408 - DNA, 20 bp, Artificial Sequence
  Description of Artificial Sequence: Synthetic oligonucleotide
taacacaagaagtgtcatta

SEQ ID NO: 13409 - DNA, 20 bp, Artificial Sequence
  Description of Artificial Sequence: Synthetic oligonucleotide
ttaacacaagaagtgtcatt

SEQ ID NO: 13410 - DNA, 20 bp, Artificial Sequence
  Description of Artificial Sequence: Synthetic oligonucleotide
tttaacacaagaagtgtcat

SEQ ID NO: 13411 - DNA, 20 bp, Artificial Sequence
  Description of Artificial Sequence: Synthetic oligonucleotide
gtttaacacaagaagtgtca

SEQ ID NO: 13412 - DNA, 20 bp, Artificial Sequence
  Description of Artificial Sequence: Synthetic oligonucleotide
agtttaacacaagaagtgtc

SEQ ID NO: 13413 - DNA, 20 bp, Artificial Sequence
  Description of Artificial Sequence: Synthetic oligonucleotide
tagtttaacacaagaagtgt

SEQ ID NO: 13414 - DNA, 20 bp, Artificial Sequence
  Description of Artificial Sequence: Synthetic oligonucleotide
ttagtttaacacaagaagtg

SEQ ID NO: 13415 - DNA, 20 bp, Artificial Sequence
  Description of Artificial Sequence: Synthetic oligonucleotide
tttagtttaacacaagaagt

SEQ ID NO: 13416 - DNA, 20 bp, Artificial Sequence
  Description of Artificial Sequence: Synthetic oligonucleotide
ttttagtttaacacaagaag

SEQ ID NO: 13417 - DNA, 20 bp, Artificial Sequence
  Description of Artificial Sequence: Synthetic oligonucleotide
tttttagtttaacacaagaa

SEQ ID NO: 13418 - DNA, 20 bp, Artificial Sequence
  Description of Artificial Sequence: Synthetic oligonucleotide
atttttagtttaacacaaga

SEQ ID NO: 13419 - DNA, 20 bp, Artificial Sequence
  Description of Artificial Sequence: Synthetic oligonucleotide
aatttttagtttaacacaag

SEQ ID NO: 13420 - DNA, 20 bp, Artificial Sequence
  Description of Artificial Sequence: Synthetic oligonucleotide
aaatttttagtttaacacaa

SEQ ID NO: 13421 - DNA, 20 bp, Artificial Sequence
  Description of Artificial Sequence: Synthetic oligonucleotide
taaatttttagtttaacaca

SEQ ID NO: 13422 - DNA, 20 bp, Artificial Sequence
  Description of Artificial Sequence: Synthetic oligonucleotide
gtaaatttttagtttaacac

SEQ ID NO: 13423 - DNA, 20 bp, Artificial Sequence
  Description of Artificial Sequence: Synthetic oligonucleotide
tgtaaatttttagtttaaca

SEQ ID NO: 13424 - DNA, 20 bp, Artificial Sequence
  Description of Artificial Sequence: Synthetic oligonucleotide
ttgtaaatttttagtttaac

SEQ ID NO: 13425 - DNA, 20 bp, Artificial Sequence
  Description of Artificial Sequence: Synthetic oligonucleotide
cttgtaaatttttagtttaa

SEQ ID NO: 13426 - DNA, 20 bp, Artificial Sequence
  Description of Artificial Sequence: Synthetic oligonucleotide
tcttgtaaatttttagttta

SEQ ID NO: 13427 - DNA, 20 bp, Artificial Sequence
  Description of Artificial Sequence: Synthetic oligonucleotide
ctcttgtaaatttttagttt

SEQ ID NO: 13428 - DNA, 20 bp, Artificial Sequence
  Description of Artificial Sequence: Synthetic oligonucleotide
tctcttgtaaatttttagtt

SEQ ID NO: 13429 - DNA, 20 bp, Artificial Sequence
  Description of Artificial Sequence: Synthetic oligonucleotide
ttctcttgtaaatttttagt

SEQ ID NO: 13430 - DNA, 20 bp, Artificial Sequence
  Description of Artificial Sequence: Synthetic oligonucleotide
cttctcttgtaaatttttag

SEQ ID NO: 13431 - DNA, 20 bp, Artificial Sequence
  Description of Artificial Sequence: Synthetic oligonucleotide
tcttctcttgtaaattttta

SEQ ID NO: 13432 - DNA, 20 bp, Artificial Sequence
  Description of Artificial Sequence: Synthetic oligonucleotide
ttcttctcttgtaaattttt

SEQ ID NO: 13433 - DNA, 20 bp, Artificial Sequence
  Description of Artificial Sequence: Synthetic oligonucleotide
tttcttctcttgtaaatttt

SEQ ID NO: 13434 - DNA, 20 bp, Artificial Sequence
  Description of Artificial Sequence: Synthetic oligonucleotide
ctttcttctcttgtaaattt

SEQ ID NO: 13435 - DNA, 20 bp, Artificial Sequence
  Description of Artificial Sequence: Synthetic oligonucleotide
actttcttctcttgtaaatt

SEQ ID NO: 13436 - DNA, 20 bp, Artificial Sequence
  Description of Artificial Sequence: Synthetic oligonucleotide
cactttcttctcttgtaaat

SEQ ID NO: 13437 - DNA, 20 bp, Artificial Sequence
  Description of Artificial Sequence: Synthetic oligonucleotide
tcactttcttctcttgtaaa

SEQ ID NO: 13438 - DNA, 20 bp, Artificial Sequence
  Description of Artificial Sequence: Synthetic oligonucleotide
ttcactttcttctcttgtaa

SEQ ID NO: 13439 - DNA, 20 bp, Artificial Sequence
  Description of Artificial Sequence: Synthetic oligonucleotide
tttcactttcttctcttgta

SEQ ID NO: 13440 - DNA, 20 bp, Artificial Sequence
  Description of Artificial Sequence: Synthetic oligonucleotide
ctttcactttcttctcttgt

SEQ ID NO: 13441 - DNA, 20 bp, Artificial Sequence
  Description of Artificial Sequence: Synthetic oligonucleotide
gctttcactttcttctcttg

SEQ ID NO: 13442 - DNA, 20 bp, Artificial Sequence
  Description of Artificial Sequence: Synthetic oligonucleotide
tgctttcactttcttctctt

SEQ ID NO: 13443 - DNA, 20 bp, Artificial Sequence
  Description of Artificial Sequence: Synthetic oligonucleotide
ttgctttcactttcttctct

SEQ ID NO: 13444 - DNA, 20 bp, Artificial Sequence
  Description of Artificial Sequence: Synthetic oligonucleotide
tttgctttcactttcttctc

SEQ ID NO: 13445 - DNA, 20 bp, Artificial Sequence
  Description of Artificial Sequence: Synthetic oligonucleotide
atttgctttcactttcttct

SEQ ID NO: 13446 - DNA, 20 bp, Artificial Sequence
  Description of Artificial Sequence: Synthetic oligonucleotide
catttgctttcactttcttc

SEQ ID NO: 13447 - DNA, 20 bp, Artificial Sequence
  Description of Artificial Sequence: Synthetic oligonucleotide
ccatttgctttcactttctt

SEQ ID NO: 13448 - DNA, 20 bp, Artificial Sequence
  Description of Artificial Sequence: Synthetic oligonucleotide
cccatttgctttcactttct

SEQ ID NO: 13449 - DNA, 20 bp, Artificial Sequence
  Description of Artificial Sequence: Synthetic oligonucleotide
ccccatttgctttcactttc

SEQ ID NO: 13450 - DNA, 20 bp, Artificial Sequence
  Description of Artificial Sequence: Synthetic oligonucleotide
accccatttgctttcacttt

SEQ ID NO: 13451 - DNA, 20 bp, Artificial Sequence
  Description of Artificial Sequence: Synthetic oligonucleotide
aaccccatttgctttcactt

SEQ ID NO: 13452 - DNA, 20 bp, Artificial Sequence
  Description of Artificial Sequence: Synthetic oligonucleotide
aaaccccatttgctttcact

SEQ ID NO: 13453 - DNA, 20 bp, Artificial Sequence
  Description of Artificial Sequence: Synthetic oligonucleotide
gaaaccccatttgctttcac

SEQ ID NO: 13454 - DNA, 20 bp, Artificial Sequence
  Description of Artificial Sequence: Synthetic oligonucleotide
tgaaaccccatttgctttca

SEQ ID NO: 13455 - DNA, 20 bp, Artificial Sequence
  Description of Artificial Sequence: Synthetic oligonucleotide
gtgaaaccccatttgctttc

SEQ ID NO: 13456 - DNA, 20 bp, Artificial Sequence
  Description of Artificial Sequence: Synthetic oligonucleotide
tgtgaaaccccatttgcttt

SEQ ID NO: 13457 - DNA, 20 bp, Artificial Sequence
  Description of Artificial Sequence: Synthetic oligonucleotide
ttgtgaaaccccatttgctt

SEQ ID NO: 13458 - DNA, 20 bp, Artificial Sequence
  Description of Artificial Sequence: Synthetic oligonucleotide
tttgtgaaaccccatttgct

SEQ ID NO: 13459 - DNA, 20 bp, Artificial Sequence
  Description of Artificial Sequence: Synthetic oligonucleotide
atttgtgaaaccccatttgc

SEQ ID NO: 13460 - DNA, 20 bp, Artificial Sequence
  Description of Artificial Sequence: Synthetic oligonucleotide
tatttgtgaaaccccatttg

SEQ ID NO: 13461 - DNA, 20 bp, Artificial Sequence
  Description of Artificial Sequence: Synthetic oligonucleotide
ctatttgtgaaaccccattt

SEQ ID NO: 13462 - DNA, 20 bp, Artificial Sequence
  Description of Artificial Sequence: Synthetic oligonucleotide
actatttgtgaaaccccatt

SEQ ID NO: 13463 - DNA, 20 bp, Artificial Sequence
  Description of Artificial Sequence: Synthetic oligonucleotide
aactatttgtgaaaccccat

SEQ ID NO: 13464 - DNA, 20 bp, Artificial Sequence
  Description of Artificial Sequence: Synthetic oligonucleotide
caactatttgtgaaacccca

SEQ ID NO: 13465 - DNA, 20 bp, Artificial Sequence
  Description of Artificial Sequence: Synthetic oligonucleotide
acaactatttgtgaaacccc

SEQ ID NO: 13466 - DNA, 20 bp, Artificial Sequence
  Description of Artificial Sequence: Synthetic oligonucleotide
tacaactatttgtgaaaccc

SEQ ID NO: 13467 - DNA, 20 bp, Artificial Sequence
  Description of Artificial Sequence: Synthetic oligonucleotide
ttacaactatttgtgaaacc

SEQ ID NO: 13468 - DNA, 20 bp, Artificial Sequence
  Description of Artificial Sequence: Synthetic oligonucleotide
tttacaactatttgtgaaac

SEQ ID NO: 13469 - DNA, 20 bp, Artificial Sequence
  Description of Artificial Sequence: Synthetic oligonucleotide
atttacaactatttgtgaaa

SEQ ID NO: 13470 - DNA, 20 bp, Artificial Sequence
  Description of Artificial Sequence: Synthetic oligonucleotide
tatttacaactatttgtgaa

SEQ ID NO: 13471 - DNA, 20 bp, Artificial Sequence
  Description of Artificial Sequence: Synthetic oligonucleotide
atatttacaactatttgtga

SEQ ID NO: 13472 - DNA, 20 bp, Artificial Sequence
  Description of Artificial Sequence: Synthetic oligonucleotide
tatatttacaactatttgtg

SEQ ID NO: 13473 - DNA, 20 bp, Artificial Sequence
  Description of Artificial Sequence: Synthetic oligonucleotide
ctatatttacaactatttgt

SEQ ID NO: 13474 - DNA, 20 bp, Artificial Sequence
  Description of Artificial Sequence: Synthetic oligonucleotide
actatatttacaactatttg

SEQ ID NO: 13475 - DNA, 20 bp, Artificial Sequence
  Description of Artificial Sequence: Synthetic oligonucleotide
cactatatttacaactattt

SEQ ID NO: 13476 - DNA, 20 bp, Artificial Sequence
  Description of Artificial Sequence: Synthetic oligonucleotide
tcactatatttacaactatt

SEQ ID NO: 13477 - DNA, 20 bp, Artificial Sequence
  Description of Artificial Sequence: Synthetic oligonucleotide
ttcactatatttacaactat

SEQ ID NO: 13478 - DNA, 20 bp, Artificial Sequence
  Description of Artificial Sequence: Synthetic oligonucleotide
cttcactatatttacaacta

SEQ ID NO: 13479 - DNA, 20 bp, Artificial Sequence
  Description of Artificial Sequence: Synthetic oligonucleotide
gcttcactatatttacaact

SEQ ID NO: 13480 - DNA, 20 bp, Artificial Sequence
  Description of Artificial Sequence: Synthetic oligonucleotide
tgcttcactatatttacaac

SEQ ID NO: 13481 - DNA, 20 bp, Artificial Sequence
  Description of Artificial Sequence: Synthetic oligonucleotide
ttgcttcactatatttacaa

SEQ ID NO: 13482 - DNA, 20 bp, Artificial Sequence
  Description of Artificial Sequence: Synthetic oligonucleotide
attgcttcactatatttaca

SEQ ID NO: 13483 - DNA, 20 bp, Artificial Sequence
  Description of Artificial Sequence: Synthetic oligonucleotide
aattgcttcactatatttac

SEQ ID NO: 13484 - DNA, 20 bp, Artificial Sequence
  Description of Artificial Sequence: Synthetic oligonucleotide
aaattgcttcactatattta

SEQ ID NO: 13485 - DNA, 20 bp, Artificial Sequence
  Description of Artificial Sequence: Synthetic oligonucleotide
caaattgcttcactatattt

SEQ ID NO: 13486 - DNA, 20 bp, Artificial Sequence
  Description of Artificial Sequence: Synthetic oligonucleotide
tcaaattgcttcactatatt

SEQ ID NO: 13487 - DNA, 20 bp, Artificial Sequence
  Description of Artificial Sequence: Synthetic oligonucleotide
ttcaaattgcttcactatat

SEQ ID NO: 13488 - DNA, 20 bp, Artificial Sequence
  Description of Artificial Sequence: Synthetic oligonucleotide
tttcaaattgcttcactata

SEQ ID NO: 13489 - DNA, 20 bp, Artificial Sequence
  Description of Artificial Sequence: Synthetic oligonucleotide
atttcaaattgcttcactat

SEQ ID NO: 13490 - DNA, 20 bp, Artificial Sequence
  Description of Artificial Sequence: Synthetic oligonucleotide
tatttcaaattgcttcacta

SEQ ID NO: 13491 - DNA, 20 bp, Artificial Sequence
  Description of Artificial Sequence: Synthetic oligonucleotide
ttatttcaaattgcttcact

SEQ ID NO: 13492 - DNA, 20 bp, Artificial Sequence
  Description of Artificial Sequence: Synthetic oligonucleotide
attatttcaaattgcttcac

SEQ ID NO: 13493 - DNA, 20 bp, Artificial Sequence
  Description of Artificial Sequence: Synthetic oligonucleotide
aattatttcaaattgcttca

SEQ ID NO: 13494 - DNA, 20 bp, Artificial Sequence
  Description of Artificial Sequence: Synthetic oligonucleotide
aaattatttcaaattgcttc

SEQ ID NO: 13495 - DNA, 20 bp, Artificial Sequence
  Description of Artificial Sequence: Synthetic oligonucleotide
aaaattatttcaaattgctt

SEQ ID NO: 13496 - DNA, 20 bp, Artificial Sequence
  Description of Artificial Sequence: Synthetic oligonucleotide
gaaaattatttcaaattgct

SEQ ID NO: 13497 - DNA, 20 bp, Artificial Sequence
  Description of Artificial Sequence: Synthetic oligonucleotide
tgaaaattatttcaaattgc

SEQ ID NO: 13498 - DNA, 20 bp, Artificial Sequence
  Description of Artificial Sequence: Synthetic oligonucleotide
ttgaaaattatttcaaattg

SEQ ID NO: 13499 - DNA, 20 bp, Artificial Sequence
  Description of Artificial Sequence: Synthetic oligonucleotide
cttgaaaattatttcaaatt

SEQ ID NO: 13500 - DNA, 20 bp, Artificial Sequence
  Description of Artificial Sequence: Synthetic oligonucleotide
gcttgaaaattatttcaaat

SEQ ID NO: 13501 - DNA, 20 bp, Artificial Sequence
  Description of Artificial Sequence: Synthetic oligonucleotide
tgcttgaaaattatttcaaa

SEQ ID NO: 13502 - DNA, 20 bp, Artificial Sequence
  Description of Artificial Sequence: Synthetic oligonucleotide
ttgcttgaaaattatttcaa

SEQ ID NO: 13503 - DNA, 20 bp, Artificial Sequence
  Description of Artificial Sequence: Synthetic oligonucleotide
tttgcttgaaaattatttca

SEQ ID NO: 13504 - DNA, 20 bp, Artificial Sequence
  Description of Artificial Sequence: Synthetic oligonucleotide
ctttgcttgaaaattatttc

SEQ ID NO: 13505 - DNA, 20 bp, Artificial Sequence
  Description of Artificial Sequence: Synthetic oligonucleotide
actttgcttgaaaattattt

SEQ ID NO: 13506 - DNA, 20 bp, Artificial Sequence
  Description of Artificial Sequence: Synthetic oligonucleotide
tactttgcttgaaaattatt

SEQ ID NO: 13507 - DNA, 20 bp, Artificial Sequence
  Description of Artificial Sequence: Synthetic oligonucleotide
atactttgcttgaaaattat

SEQ ID NO: 13508 - DNA, 20 bp, Artificial Sequence
  Description of Artificial Sequence: Synthetic oligonucleotide
aatactttgcttgaaaatta

SEQ ID NO: 13509 - DNA, 20 bp, Artificial Sequence
  Description of Artificial Sequence: Synthetic oligonucleotide
caatactttgcttgaaaatt

SEQ ID NO: 13510 - DNA, 20 bp, Artificial Sequence
  Description of Artificial Sequence: Synthetic oligonucleotide
acaatactttgcttgaaaat

SEQ ID NO: 13511 - DNA, 20 bp, Artificial Sequence
  Description of Artificial Sequence: Synthetic oligonucleotide
cacaatactttgcttgaaaa

SEQ ID NO: 13512 - DNA, 20 bp, Artificial Sequence
  Description of Artificial Sequence: Synthetic oligonucleotide
tcacaatactttgcttgaaa

SEQ ID NO: 13513 - DNA, 20 bp, Artificial Sequence
  Description of Artificial Sequence: Synthetic oligonucleotide
ttcacaatactttgcttgaa

SEQ ID NO: 13514 - DNA, 20 bp, Artificial Sequence
  Description of Artificial Sequence: Synthetic oligonucleotide
tttcacaatactttgcttga

SEQ ID NO: 13515 - DNA, 20 bp, Artificial Sequence
  Description of Artificial Sequence: Synthetic oligonucleotide
ctttcacaatactttgcttg

SEQ ID NO: 13516 - DNA, 20 bp, Artificial Sequence
  Description of Artificial Sequence: Synthetic oligonucleotide
actttcacaatactttgctt

SEQ ID NO: 13517 - DNA, 20 bp, Artificial Sequence
  Description of Artificial Sequence: Synthetic oligonucleotide
tactttcacaatactttgct

SEQ ID NO: 13518 - DNA, 20 bp, Artificial Sequence
  Description of Artificial Sequence: Synthetic oligonucleotide
atactttcacaatactttgc

SEQ ID NO: 13519 - DNA, 20 bp, Artificial Sequence
  Description of Artificial Sequence: Synthetic oligonucleotide
aatactttcacaatactttg

SEQ ID NO: 13520 - DNA, 20 bp, Artificial Sequence
  Description of Artificial Sequence: Synthetic oligonucleotide
gaatactttcacaatacttt

SEQ ID NO: 13521 - DNA, 20 bp, Artificial Sequence
  Description of Artificial Sequence: Synthetic oligonucleotide
agaatactttcacaatactt

SEQ ID NO: 13522 - DNA, 20 bp, Artificial Sequence
  Description of Artificial Sequence: Synthetic oligonucleotide
tagaatactttcacaatact

SEQ ID NO: 13523 - DNA, 20 bp, Artificial Sequence
  Description of Artificial Sequence: Synthetic oligonucleotide
ttagaatactttcacaatac

SEQ ID NO: 13524 - DNA, 20 bp, Artificial Sequence
  Description of Artificial Sequence: Synthetic oligonucleotide
cttagaatactttcacaata

SEQ ID NO: 13525 - DNA, 20 bp, Artificial Sequence
  Description of Artificial Sequence: Synthetic oligonucleotide
gcttagaatactttcacaat

SEQ ID NO: 13526 - DNA, 20 bp, Artificial Sequence
  Description of Artificial Sequence: Synthetic oligonucleotide
ggcttagaatactttcacaa

SEQ ID NO: 13527 - DNA, 20 bp, Artificial Sequence
  Description of Artificial Sequence: Synthetic oligonucleotide
tggcttagaatactttcaca

SEQ ID NO: 13528 - DNA, 20 bp, Artificial Sequence
  Description of Artificial Sequence: Synthetic oligonucleotide
ttggcttagaatactttcac

SEQ ID NO: 13529 - DNA, 20 bp, Artificial Sequence
  Description of Artificial Sequence: Synthetic oligonucleotide
cttggcttagaatactttca

SEQ ID NO: 13530 - DNA, 20 bp, Artificial Sequence
  Description of Artificial Sequence: Synthetic oligonucleotide
acttggcttagaatactttc

SEQ ID NO: 13531 - DNA, 20 bp, Artificial Sequence
  Description of Artificial Sequence: Synthetic oligonucleotide
aacttggcttagaatacttt

SEQ ID NO: 13532 - DNA, 20 bp, Artificial Sequence
  Description of Artificial Sequence: Synthetic oligonucleotide
aaacttggcttagaatactt

SEQ ID NO: 13533 - DNA, 20 bp, Artificial Sequence
  Description of Artificial Sequence: Synthetic oligonucleotide
aaaacttggcttagaatact

SEQ ID NO: 13534 - DNA, 20 bp, Artificial Sequence
  Description of Artificial Sequence: Synthetic oligonucleotide
taaaacttggcttagaatac

SEQ ID NO: 13535 - DNA, 20 bp, Artificial Sequence
  Description of Artificial Sequence: Synthetic oligonucleotide
ttaaaacttggcttagaata

SEQ ID NO: 13536 - DNA, 20 bp, Artificial Sequence
  Description of Artificial Sequence: Synthetic oligonucleotide
tttaaaacttggcttagaat

SEQ ID NO: 13537 - DNA, 20 bp, Artificial Sequence
  Description of Artificial Sequence: Synthetic oligonucleotide
atttaaaacttggcttagaa

SEQ ID NO: 13538 - DNA, 20 bp, Artificial Sequence
  Description of Artificial Sequence: Synthetic oligonucleotide
tatttaaaacttggcttaga

SEQ ID NO: 13539 - DNA, 20 bp, Artificial Sequence
  Description of Artificial Sequence: Synthetic oligonucleotide
atatttaaaacttggcttag

SEQ ID NO: 13540 - DNA, 20 bp, Artificial Sequence
  Description of Artificial Sequence: Synthetic oligonucleotide
aatatttaaaacttggctta

SEQ ID NO: 13541 - DNA, 20 bp, Artificial Sequence
  Description of Artificial Sequence: Synthetic oligonucleotide
taatatttaaaacttggctt

SEQ ID NO: 13542 - DNA, 20 bp, Artificial Sequence
  Description of Artificial Sequence: Synthetic oligonucleotide
ataatatttaaaacttggct

SEQ ID NO: 13543 - DNA, 20 bp, Artificial Sequence
  Description of Artificial Sequence: Synthetic oligonucleotide
gataatatttaaaacttggc

SEQ ID NO: 13544 - DNA, 20 bp, Artificial Sequence
  Description of Artificial Sequence: Synthetic oligonucleotide
agataatatttaaaacttgg

SEQ ID NO: 13545 - DNA, 20 bp, Artificial Sequence
  Description of Artificial Sequence: Synthetic oligonucleotide
tagataatatttaaaacttg

SEQ ID NO: 13546 - DNA, 20 bp, Artificial Sequence
  Description of Artificial Sequence: Synthetic oligonucleotide
ttagataatatttaaaactt

SEQ ID NO: 13547 - DNA, 20 bp, Artificial Sequence
  Description of Artificial Sequence: Synthetic oligonucleotide
gttagataatatttaaaact

SEQ ID NO: 13548 - DNA, 20 bp, Artificial Sequence
  Description of Artificial Sequence: Synthetic oligonucleotide
tgttagataatatttaaaac

SEQ ID NO: 13549 - DNA, 20 bp, Artificial Sequence
  Description of Artificial Sequence: Synthetic oligonucleotide
ctgttagataatatttaaaa

SEQ ID NO: 13550 - DNA, 20 bp, Artificial Sequence
  Description of Artificial Sequence: Synthetic oligonucleotide
tctgttagataatatttaaa

SEQ ID NO: 13551 - DNA, 20 bp, Artificial Sequence
  Description of Artificial Sequence: Synthetic oligonucleotide
gtctgttagataatatttaa

SEQ ID NO: 13552 - DNA, 20 bp, Artificial Sequence
  Description of Artificial Sequence: Synthetic oligonucleotide
tgtctgttagataatattta

SEQ ID NO: 13553 - DNA, 20 bp, Artificial Sequence
  Description of Artificial Sequence: Synthetic oligonucleotide
ttgtctgttagataatattt

SEQ ID NO: 13554 - DNA, 20 bp, Artificial Sequence
  Description of Artificial Sequence: Synthetic oligonucleotide
cttgtctgttagataatatt

SEQ ID NO: 13555 - DNA, 20 bp, Artificial Sequence
  Description of Artificial Sequence: Synthetic oligonucleotide
tcttgtctgttagataatat

SEQ ID NO: 13556 - DNA, 20 bp, Artificial Sequence
  Description of Artificial Sequence: Synthetic oligonucleotide
ctcttgtctgttagataata

SEQ ID NO: 13557 - DNA, 20 bp, Artificial Sequence
  Description of Artificial Sequence: Synthetic oligonucleotide
actcttgtctgttagataat

SEQ ID NO: 13558 - DNA, 20 bp, Artificial Sequence
  Description of Artificial Sequence: Synthetic oligonucleotide
cactcttgtctgttagataa

SEQ ID NO: 13559 - DNA, 20 bp, Artificial Sequence
  Description of Artificial Sequence: Synthetic oligonucleotide
ccactcttgtctgttagata

SEQ ID NO: 13560 - DNA, 20 bp, Artificial Sequence
  Description of Artificial Sequence: Synthetic oligonucleotide
accactcttgtctgttagat

SEQ ID NO: 13561 - DNA, 20 bp, Artificial Sequence
  Description of Artificial Sequence: Synthetic oligonucleotide
taccactcttgtctgttaga

SEQ ID NO: 13562 - DNA, 20 bp, Artificial Sequence
  Description of Artificial Sequence: Synthetic oligonucleotide
ataccactcttgtctgttag

SEQ ID NO: 13563 - DNA, 20 bp, Artificial Sequence
  Description of Artificial Sequence: Synthetic oligonucleotide
tataccactcttgtctgtta

SEQ ID NO: 13564 - DNA, 20 bp, Artificial Sequence
  Description of Artificial Sequence: Synthetic oligonucleotide
atataccactcttgtctgtt

SEQ ID NO: 13565 - DNA, 20 bp, Artificial Sequence
  Description of Artificial Sequence: Synthetic oligonucleotide
tatataccactcttgtctgt

SEQ ID NO: 13566 - DNA, 20 bp, Artificial Sequence
  Description of Artificial Sequence: Synthetic oligonucleotide
gtatataccactcttgtctg

SEQ ID NO: 13567 - DNA, 20 bp, Artificial Sequence
  Description of Artificial Sequence: Synthetic oligonucleotide
tgtatataccactcttgtct

SEQ ID NO: 13568 - DNA, 20 bp, Artificial Sequence
  Description of Artificial Sequence: Synthetic oligonucleotide
ttgtatataccactcttgtc

SEQ ID NO: 13569 - DNA, 20 bp, Artificial Sequence
  Description of Artificial Sequence: Synthetic oligonucleotide
cttgtatataccactcttgt

SEQ ID NO: 13570 - DNA, 20 bp, Artificial Sequence
  Description of Artificial Sequence: Synthetic oligonucleotide
acttgtatataccactcttg

SEQ ID NO: 13571 - DNA, 20 bp, Artificial Sequence
  Description of Artificial Sequence: Synthetic oligonucleotide
tacttgtatataccactctt

SEQ ID NO: 13572 - DNA, 20 bp, Artificial Sequence
  Description of Artificial Sequence: Synthetic oligonucleotide
ctacttgtatataccactct

SEQ ID NO: 13573 - DNA, 20 bp, Artificial Sequence
  Description of Artificial Sequence: Synthetic oligonucleotide
tctacttgtatataccactc

SEQ ID NO: 13574 - DNA, 20 bp, Artificial Sequence
  Description of Artificial Sequence: Synthetic oligonucleotide
atctacttgtatataccact

SEQ ID NO: 13575 - DNA, 20 bp, Artificial Sequence
  Description of Artificial Sequence: Synthetic oligonucleotide
gatctacttgtatataccac

SEQ ID NO: 13576 - DNA, 20 bp, Artificial Sequence
  Description of Artificial Sequence: Synthetic oligonucleotide
ggatctacttgtatatacca

SEQ ID NO: 13577 - DNA, 20 bp, Artificial Sequence
  Description of Artificial Sequence: Synthetic oligonucleotide
aggatctacttgtatatacc

SEQ ID NO: 13578 - DNA, 20 bp, Artificial Sequence
  Description of Artificial Sequence: Synthetic oligonucleotide
caggatctacttgtatatac

SEQ ID NO: 13579 - DNA, 20 bp, Artificial Sequence
  Description of Artificial Sequence: Synthetic oligonucleotide
tcaggatctacttgtatata

SEQ ID NO: 13580 - DNA, 20 bp, Artificial Sequence
  Description of Artificial Sequence: Synthetic oligonucleotide
ctcaggatctacttgtatat

SEQ ID NO: 13581 - DNA, 20 bp, Artificial Sequence
  Description of Artificial Sequence: Synthetic oligonucleotide
tctcaggatctacttgtata

SEQ ID NO: 13582 - DNA, 20 bp, Artificial Sequence
  Description of Artificial Sequence: Synthetic oligonucleotide
ttctcaggatctacttgtat

SEQ ID NO: 13583 - DNA, 20 bp, Artificial Sequence
  Description of Artificial Sequence: Synthetic oligonucleotide
cttctcaggatctacttgta

SEQ ID NO: 13584 - DNA, 20 bp, Artificial Sequence
  Description of Artificial Sequence: Synthetic oligonucleotide
acttctcaggatctacttgt

SEQ ID NO: 13585 - DNA, 20 bp, Artificial Sequence
  Description of Artificial Sequence: Synthetic oligonucleotide
tacttctcaggatctacttg

SEQ ID NO: 13586 - DNA, 20 bp, Artificial Sequence
  Description of Artificial Sequence: Synthetic oligonucleotide
gtacttctcaggatctactt

SEQ ID NO: 13587 - DNA, 20 bp, Artificial Sequence
  Description of Artificial Sequence: Synthetic oligonucleotide
ggtacttctcaggatctact

SEQ ID NO: 13588 - DNA, 20 bp, Artificial Sequence
  Description of Artificial Sequence: Synthetic oligonucleotide
aggtacttctcaggatctac

SEQ ID NO: 13589 - DNA, 20 bp, Artificial Sequence
  Description of Artificial Sequence: Synthetic oligonucleotide
aaggtacttctcaggatcta

SEQ ID NO: 13590 - DNA, 20 bp, Artificial Sequence
  Description of Artificial Sequence: Synthetic oligonucleotide
aaaggtacttctcaggatct

SEQ ID NO: 13591 - DNA, 20 bp, Artificial Sequence
  Description of Artificial Sequence: Synthetic oligonucleotide
caaaggtacttctcaggatc

SEQ ID NO: 13592 - DNA, 20 bp, Artificial Sequence
  Description of Artificial Sequence: Synthetic oligonucleotide
acaaaggtacttctcaggat

SEQ ID NO: 13593 - DNA, 20 bp, Artificial Sequence
  Description of Artificial Sequence: Synthetic oligonucleotide
aacaaaggtacttctcagga

SEQ ID NO: 13594 - DNA, 20 bp, Artificial Sequence
  Description of Artificial Sequence: Synthetic oligonucleotide
taacaaaggtacttctcagg

SEQ ID NO: 13595 - DNA, 20 bp, Artificial Sequence
  Description of Artificial Sequence: Synthetic oligonucleotide
gtaacaaaggtacttctcag

SEQ ID NO: 13596 - DNA, 20 bp, Artificial Sequence
  Description of Artificial Sequence: Synthetic oligonucleotide
tgtaacaaaggtacttctca

SEQ ID NO: 13597 - DNA, 20 bp, Artificial Sequence
  Description of Artificial Sequence: Synthetic oligonucleotide
ctgtaacaaaggtacttctc

SEQ ID NO: 13598 - DNA, 20 bp, Artificial Sequence
  Description of Artificial Sequence: Synthetic oligonucleotide
gctgtaacaaaggtacttct

SEQ ID NO: 13599 - DNA, 20 bp, Artificial Sequence
  Description of Artificial Sequence: Synthetic oligonucleotide
agctgtaacaaaggtacttc

SEQ ID NO: 13600 - DNA, 20 bp, Artificial Sequence
  Description of Artificial Sequence: Synthetic oligonucleotide
tagctgtaacaaaggtactt

SEQ ID NO: 13601 - DNA, 20 bp, Artificial Sequence
  Description of Artificial Sequence: Synthetic oligonucleotide
gtagctgtaacaaaggtact

SEQ ID NO: 13602 - DNA, 20 bp, Artificial Sequence
  Description of Artificial Sequence: Synthetic oligonucleotide
agtagctgtaacaaaggtac

SEQ ID NO: 13603 - DNA, 20 bp, Artificial Sequence
  Description of Artificial Sequence: Synthetic oligonucleotide
tagtagctgtaacaaaggta

SEQ ID NO: 13604 - DNA, 20 bp, Artificial Sequence
  Description of Artificial Sequence: Synthetic oligonucleotide
atagtagctgtaacaaaggt

SEQ ID NO: 13605 - DNA, 20 bp, Artificial Sequence
  Description of Artificial Sequence: Synthetic oligonucleotide
tatagtagctgtaacaaagg

SEQ ID NO: 13606 - DNA, 20 bp, Artificial Sequence
  Description of Artificial Sequence: Synthetic oligonucleotide
ttatagtagctgtaacaaag

SEQ ID NO: 13607 - DNA, 20 bp, Artificial Sequence
  Description of Artificial Sequence: Synthetic oligonucleotide
tttatagtagctgtaacaaa

SEQ ID NO: 13608 - DNA, 20 bp, Artificial Sequence
  Description of Artificial Sequence: Synthetic oligonucleotide
atttatagtagctgtaacaa

SEQ ID NO: 13609 - DNA, 20 bp, Artificial Sequence
  Description of Artificial Sequence: Synthetic oligonucleotide
tatttatagtagctgtaaca

SEQ ID NO: 13610 - DNA, 20 bp, Artificial Sequence
  Description of Artificial Sequence: Synthetic oligonucleotide
atatttatagtagctgtaac

SEQ ID NO: 13611 - DNA, 20 bp, Artificial Sequence
  Description of Artificial Sequence: Synthetic oligonucleotide
tatatttatagtagctgtaa

SEQ ID NO: 13612 - DNA, 20 bp, Artificial Sequence
  Description of Artificial Sequence: Synthetic oligonucleotide
gtatatttatagtagctgta

SEQ ID NO: 13613 - DNA, 20 bp, Artificial Sequence
  Description of Artificial Sequence: Synthetic oligonucleotide
tgtatatttatagtagctgt

SEQ ID NO: 13614 - DNA, 20 bp, Artificial Sequence
  Description of Artificial Sequence: Synthetic oligonucleotide
atgtatatttatagtagctg

SEQ ID NO: 13615 - DNA, 20 bp, Artificial Sequence
  Description of Artificial Sequence: Synthetic oligonucleotide
tatgtatatttatagtagct

SEQ ID NO: 13616 - DNA, 20 bp, Artificial Sequence
  Description of Artificial Sequence: Synthetic oligonucleotide
atatgtatatttatagtagc

SEQ ID NO: 13617 - DNA, 20 bp, Artificial Sequence
  Description of Artificial Sequence: Synthetic oligonucleotide
tatatgtatatttatagtag

SEQ ID NO: 13618 - DNA, 20 bp, Artificial Sequence
  Description of Artificial Sequence: Synthetic oligonucleotide
ttatatgtatatttatagta

SEQ ID NO: 13619 - DNA, 20 bp, Artificial Sequence
  Description of Artificial Sequence: Synthetic oligonucleotide
tttatatgtatatttatagt

SEQ ID NO: 13620 - DNA, 20 bp, Artificial Sequence
  Description of Artificial Sequence: Synthetic oligonucleotide
atttatatgtatatttatag

SEQ ID NO: 13621 - DNA, 20 bp, Artificial Sequence
  Description of Artificial Sequence: Synthetic oligonucleotide
aatttatatgtatatttata

SEQ ID NO: 13622 - DNA, 20 bp, Artificial Sequence
  Description of Artificial Sequence: Synthetic oligonucleotide
taatttatatgtatatttat

SEQ ID NO: 13623 - DNA, 20 bp, Artificial Sequence
  Description of Artificial Sequence: Synthetic oligonucleotide
ataatttatatgtatattta

SEQ ID NO: 13624 - DNA, 20 bp, Artificial Sequence
  Description of Artificial Sequence: Synthetic oligonucleotide
tataatttatatgtatattt

SEQ ID NO: 13625 - DNA, 20 bp, Artificial Sequence
  Description of Artificial Sequence: Synthetic oligonucleotide
ctataatttatatgtatatt

SEQ ID NO: 13626 - DNA, 20 bp, Artificial Sequence
  Description of Artificial Sequence: Synthetic oligonucleotide
tctataatttatatgtatat

SEQ ID NO: 13627 - DNA, 20 bp, Artificial Sequence
  Description of Artificial Sequence: Synthetic oligonucleotide
ttctataatttatatgtata

SEQ ID NO: 13628 - DNA, 20 bp, Artificial Sequence
  Description of Artificial Sequence: Synthetic oligonucleotide
attctataatttatatgtat

SEQ ID NO: 13629 - DNA, 20 bp, Artificial Sequence
  Description of Artificial Sequence: Synthetic oligonucleotide
gattctataatttatatgta

SEQ ID NO: 13630 - DNA, 20 bp, Artificial Sequence
  Description of Artificial Sequence: Synthetic oligonucleotide
agattctataatttatatgt

SEQ ID NO: 13631 - DNA, 20 bp, Artificial Sequence
  Description of Artificial Sequence: Synthetic oligonucleotide
tagattctataatttatatg

SEQ ID NO: 13632 - DNA, 20 bp, Artificial Sequence
  Description of Artificial Sequence: Synthetic oligonucleotide
gtagattctataatttatat

SEQ ID NO: 13633 - DNA, 20 bp, Artificial Sequence
  Description of Artificial Sequence: Synthetic oligonucleotide
agtagattctataatttata

SEQ ID NO: 13634 - DNA, 20 bp, Artificial Sequence
  Description of Artificial Sequence: Synthetic oligonucleotide
aagtagattctataatttat

SEQ ID NO: 13635 - DNA, 20 bp, Artificial Sequence
  Description of Artificial Sequence: Synthetic oligonucleotide
aaagtagattctataattta

SEQ ID NO: 13636 - DNA, 20 bp, Artificial Sequence
  Description of Artificial Sequence: Synthetic oligonucleotide
taaagtagattctataattt

SEQ ID NO: 13637 - DNA, 20 bp, Artificial Sequence
  Description of Artificial Sequence: Synthetic oligonucleotide
ttaaagtagattctataatt

SEQ ID NO: 13638 - DNA, 20 bp, Artificial Sequence
  Description of Artificial Sequence: Synthetic oligonucleotide
attaaagtagattctataat

SEQ ID NO: 13639 - DNA, 20 bp, Artificial Sequence
  Description of Artificial Sequence: Synthetic oligonucleotide
aattaaagtagattctataa

SEQ ID NO: 13640 - DNA, 20 bp, Artificial Sequence
  Description of Artificial Sequence: Synthetic oligonucleotide
aaattaaagtagattctata

SEQ ID NO: 13641 - DNA, 20 bp, Artificial Sequence
  Description of Artificial Sequence: Synthetic oligonucleotide
taaattaaagtagattctat

SEQ ID NO: 13642 - DNA, 20 bp, Artificial Sequence
  Description of Artificial Sequence: Synthetic oligonucleotide
ataaattaaagtagattcta

SEQ ID NO: 13643 - DNA, 20 bp, Artificial Sequence
  Description of Artificial Sequence: Synthetic oligonucleotide
aataaattaaagtagattct

SEQ ID NO: 13644 - DNA, 20 bp, Artificial Sequence
  Description of Artificial Sequence: Synthetic oligonucleotide
aaataaattaaagtagattc

SEQ ID NO: 13645 - DNA, 20 bp, Artificial Sequence
  Description of Artificial Sequence: Synthetic oligonucleotide
aaaataaattaaagtagatt

SEQ ID NO: 13646 - DNA, 20 bp, Artificial Sequence
  Description of Artificial Sequence: Synthetic oligonucleotide
caaaataaattaaagtagat

SEQ ID NO: 13647 - DNA, 20 bp, Artificial Sequence
  Description of Artificial Sequence: Synthetic oligonucleotide
acaaaataaattaaagtaga

SEQ ID NO: 13648 - DNA, 20 bp, Artificial Sequence
  Description of Artificial Sequence: Synthetic oligonucleotide
cacaaaataaattaaagtag

SEQ ID NO: 13649 - DNA, 20 bp, Artificial Sequence
  Description of Artificial Sequence: Synthetic oligonucleotide
tcacaaaataaattaaagta

SEQ ID NO: 13650 - DNA, 20 bp, Artificial Sequence
  Description of Artificial Sequence: Synthetic oligonucleotide
ttcacaaaataaattaaagt

SEQ ID NO: 13651 - DNA, 20 bp, Artificial Sequence
  Description of Artificial Sequence: Synthetic oligonucleotide
gttcacaaaataaattaaag

SEQ ID NO: 13652 - DNA, 20 bp, Artificial Sequence
  Description of Artificial Sequence: Synthetic oligonucleotide
tgttcacaaaataaattaaa

SEQ ID NO: 13653 - DNA, 20 bp, Artificial Sequence
  Description of Artificial Sequence: Synthetic oligonucleotide
gtgttcacaaaataaattaa

SEQ ID NO: 13654 - DNA, 20 bp, Artificial Sequence
  Description of Artificial Sequence: Synthetic oligonucleotide
agtgttcacaaaataaatta

SEQ ID NO: 13655 - DNA, 20 bp, Artificial Sequence
  Description of Artificial Sequence: Synthetic oligonucleotide
aagtgttcacaaaataaatt

SEQ ID NO: 13656 - DNA, 20 bp, Artificial Sequence
  Description of Artificial Sequence: Synthetic oligonucleotide
aaagtgttcacaaaataaat

SEQ ID NO: 13657 - DNA, 20 bp, Artificial Sequence
  Description of Artificial Sequence: Synthetic oligonucleotide
aaaagtgttcacaaaataaa

SEQ ID NO: 13658 - DNA, 20 bp, Artificial Sequence
  Description of Artificial Sequence: Synthetic oligonucleotide
caaaagtgttcacaaaataa

SEQ ID NO: 13659 - DNA, 20 bp, Artificial Sequence
  Description of Artificial Sequence: Synthetic oligonucleotide
tcaaaagtgttcacaaaata

SEQ ID NO: 13660 - DNA, 20 bp, Artificial Sequence
  Description of Artificial Sequence: Synthetic oligonucleotide
ttcaaaagtgttcacaaaat

SEQ ID NO: 13661 - DNA, 20 bp, Artificial Sequence
  Description of Artificial Sequence: Synthetic oligonucleotide
tttcaaaagtgttcacaaaa

SEQ ID NO: 13662 - DNA, 20 bp, Artificial Sequence
  Description of Artificial Sequence: Synthetic oligonucleotide
ttttcaaaagtgttcacaaa

SEQ ID NO: 13663 - DNA, 20 bp, Artificial Sequence
  Description of Artificial Sequence: Synthetic oligonucleotide
attttcaaaagtgttcacaa

SEQ ID NO: 13664 - DNA, 20 bp, Artificial Sequence
  Description of Artificial Sequence: Synthetic oligonucleotide
cattttcaaaagtgttcaca

SEQ ID NO: 13665 - DNA, 20 bp, Artificial Sequence
  Description of Artificial Sequence: Synthetic oligonucleotide
acattttcaaaagtgttcac

SEQ ID NO: 13666 - DNA, 20 bp, Artificial Sequence
  Description of Artificial Sequence: Synthetic oligonucleotide
tacattttcaaaagtgttca

SEQ ID NO: 13667 - DNA, 20 bp, Artificial Sequence
  Description of Artificial Sequence: Synthetic oligonucleotide
gtacattttcaaaagtgttc

SEQ ID NO: 13668 - DNA, 20 bp, Artificial Sequence
  Description of Artificial Sequence: Synthetic oligonucleotide
tgtacattttcaaaagtgtt

SEQ ID NO: 13669 - DNA, 20 bp, Artificial Sequence
  Description of Artificial Sequence: Synthetic oligonucleotide
atgtacattttcaaaagtgt

SEQ ID NO: 13670 - DNA, 20 bp, Artificial Sequence
  Description of Artificial Sequence: Synthetic oligonucleotide
catgtacattttcaaaagtg

SEQ ID NO: 13671 - DNA, 20 bp, Artificial Sequence
  Description of Artificial Sequence: Synthetic oligonucleotide
acatgtacattttcaaaagt

SEQ ID NO: 13672 - DNA, 20 bp, Artificial Sequence
  Description of Artificial Sequence: Synthetic oligonucleotide
aacatgtacattttcaaaag

SEQ ID NO: 13673 - DNA, 20 bp, Artificial Sequence
  Description of Artificial Sequence: Synthetic oligonucleotide
gaacatgtacattttcaaaa

SEQ ID NO: 13674 - DNA, 20 bp, Artificial Sequence
  Description of Artificial Sequence: Synthetic oligonucleotide
ggaacatgtacattttcaaa

SEQ ID NO: 13675 - DNA, 20 bp, Artificial Sequence
  Description of Artificial Sequence: Synthetic oligonucleotide
aggaacatgtacattttcaa

SEQ ID NO: 13676 - DNA, 20 bp, Artificial Sequence
  Description of Artificial Sequence: Synthetic oligonucleotide
aaggaacatgtacattttca

SEQ ID NO: 13677 - DNA, 20 bp, Artificial Sequence
  Description of Artificial Sequence: Synthetic oligonucleotide
aaaggaacatgtacattttc

SEQ ID NO: 13678 - DNA, 20 bp, Artificial Sequence
  Description of Artificial Sequence: Synthetic oligonucleotide
caaaggaacatgtacatttt

SEQ ID NO: 13679 - DNA, 20 bp, Artificial Sequence
  Description of Artificial Sequence: Synthetic oligonucleotide
acaaaggaacatgtacattt

SEQ ID NO: 13680 - DNA, 20 bp, Artificial Sequence
  Description of Artificial Sequence: Synthetic oligonucleotide
tacaaaggaacatgtacatt

SEQ ID NO: 13681 - DNA, 20 bp, Artificial Sequence
  Description of Artificial Sequence: Synthetic oligonucleotide
ttacaaaggaacatgtacat

SEQ ID NO: 13682 - DNA, 20 bp, Artificial Sequence
  Description of Artificial Sequence: Synthetic oligonucleotide
attacaaaggaacatgtaca

SEQ ID NO: 13683 - DNA, 20 bp, Artificial Sequence
  Description of Artificial Sequence: Synthetic oligonucleotide
aattacaaaggaacatgtac

SEQ ID NO: 13684 - DNA, 20 bp, Artificial Sequence
  Description of Artificial Sequence: Synthetic oligonucleotide
caattacaaaggaacatgta

SEQ ID NO: 13685 - DNA, 20 bp, Artificial Sequence
  Description of Artificial Sequence: Synthetic oligonucleotide
tcaattacaaaggaacatgt

SEQ ID NO: 13686 - DNA, 20 bp, Artificial Sequence
  Description of Artificial Sequence: Synthetic oligonucleotide
gtcaattacaaaggaacatg

SEQ ID NO: 13687 - DNA, 20 bp, Artificial Sequence
  Description of Artificial Sequence: Synthetic oligonucleotide
tgtcaattacaaaggaacat

SEQ ID NO: 13688 - DNA, 20 bp, Artificial Sequence
  Description of Artificial Sequence: Synthetic oligonucleotide
gtgtcaattacaaaggaaca

SEQ ID NO: 13689 - DNA, 20 bp, Artificial Sequence
  Description of Artificial Sequence: Synthetic oligonucleotide
agtgtcaattacaaaggaac

SEQ ID NO: 13690 - DNA, 20 bp, Artificial Sequence
  Description of Artificial Sequence: Synthetic oligonucleotide
tagtgtcaattacaaaggaa

SEQ ID NO: 13691 - DNA, 20 bp, Artificial Sequence
  Description of Artificial Sequence: Synthetic oligonucleotide
atagtgtcaattacaaagga

SEQ ID NO: 13692 - DNA, 20 bp, Artificial Sequence
  Description of Artificial Sequence: Synthetic oligonucleotide
tatagtgtcaattacaaagg

SEQ ID NO: 13693 - DNA, 20 bp, Artificial Sequence
  Description of Artificial Sequence: Synthetic oligonucleotide
atatagtgtcaattacaaag

SEQ ID NO: 13694 - DNA, 20 bp, Artificial Sequence
  Description of Artificial Sequence: Synthetic oligonucleotide
tatatagtgtcaattacaaa

SEQ ID NO: 13695 - DNA, 20 bp, Artificial Sequence
  Description of Artificial Sequence: Synthetic oligonucleotide
atatatagtgtcaattacaa

SEQ ID NO: 13696 - DNA, 20 bp, Artificial Sequence
  Description of Artificial Sequence: Synthetic oligonucleotide
aatatatagtgtcaattaca

SEQ ID NO: 13697 - DNA, 20 bp, Artificial Sequence
  Description of Artificial Sequence: Synthetic oligonucleotide
aaatatatagtgtcaattac

SEQ ID NO: 13698 - DNA, 20 bp, Artificial Sequence
  Description of Artificial Sequence: Synthetic oligonucleotide
gaaatatatagtgtcaatta

SEQ ID NO: 13699 - DNA, 20 bp, Artificial Sequence
  Description of Artificial Sequence: Synthetic oligonucleotide
agaaatatatagtgtcaatt

SEQ ID NO: 13700 - DNA, 20 bp, Artificial Sequence
  Description of Artificial Sequence: Synthetic oligonucleotide
aagaaatatatagtgtcaat

SEQ ID NO: 13701 - DNA, 20 bp, Artificial Sequence
  Description of Artificial Sequence: Synthetic oligonucleotide
taagaaatatatagtgtcaa

SEQ ID NO: 13702 - DNA, 20 bp, Artificial Sequence
  Description of Artificial Sequence: Synthetic oligonucleotide
ttaagaaatatatagtgtca

SEQ ID NO: 13703 - DNA, 20 bp, Artificial Sequence
  Description of Artificial Sequence: Synthetic oligonucleotide
attaagaaatatatagtgtc

SEQ ID NO: 13704 - DNA, 20 bp, Artificial Sequence
  Description of Artificial Sequence: Synthetic oligonucleotide
tattaagaaatatatagtgt

SEQ ID NO: 13705 - DNA, 20 bp, Artificial Sequence
  Description of Artificial Sequence: Synthetic oligonucleotide
ttattaagaaatatatagtg

SEQ ID NO: 13706 - DNA, 20 bp, Artificial Sequence
  Description of Artificial Sequence: Synthetic oligonucleotide
tttattaagaaatatatagt

SEQ ID NO: 13707 - DNA, 20 bp, Artificial Sequence
  Description of Artificial Sequence: Synthetic oligonucleotide
ttttattaagaaatatatag

SEQ ID NO: 13708 - DNA, 20 bp, Artificial Sequence
  Description of Artificial Sequence: Synthetic oligonucleotide
attttattaagaaatatata

SEQ ID NO: 13709 - DNA, 20 bp, Artificial Sequence
  Description of Artificial Sequence: Synthetic oligonucleotide
tattttattaagaaatatat

SEQ ID NO: 13710 - DNA, 20 bp, Artificial Sequence
  Description of Artificial Sequence: Synthetic oligonucleotide
ttattttattaagaaatata

SEQ ID NO: 13711 - DNA, 20 bp, Artificial Sequence
  Description of Artificial Sequence: Synthetic oligonucleotide
attattttattaagaaatat

SEQ ID NO: 13712 - DNA, 20 bp, Artificial Sequence
  Description of Artificial Sequence: Synthetic oligonucleotide
aattattttattaagaaata

SEQ ID NO: 13713 - DNA, 20 bp, Artificial Sequence
  Description of Artificial Sequence: Synthetic oligonucleotide
gaattattttattaagaaat

SEQ ID NO: 13714 - DNA, 20 bp, Artificial Sequence
  Description of Artificial Sequence: Synthetic oligonucleotide
agaattattttattaagaaa

SEQ ID NO: 13715 - DNA, 20 bp, Artificial Sequence
  Description of Artificial Sequence: Synthetic oligonucleotide
gagaattattttattaagaa

SEQ ID NO: 13716 - DNA, 20 bp, Artificial Sequence
  Description of Artificial Sequence: Synthetic oligonucleotide
tgagaattattttattaaga

SEQ ID NO: 13717 - DNA, 20 bp, Artificial Sequence
  Description of Artificial Sequence: Synthetic oligonucleotide
ttgagaattattttattaag

SEQ ID NO: 13718 - DNA, 20 bp, Artificial Sequence
  Description of Artificial Sequence: Synthetic oligonucleotide
tttgagaattattttattaa

SEQ ID NO: 13719 - DNA, 20 bp, Artificial Sequence
  Description of Artificial Sequence: Synthetic oligonucleotide
atttgagaattattttatta

SEQ ID NO: 13720 - DNA, 20 bp, Artificial Sequence
  Description of Artificial Sequence: Synthetic oligonucleotide
aatttgagaattattttatt

SEQ ID NO: 13721 - DNA, 20 bp, Artificial Sequence
  Description of Artificial Sequence: Synthetic oligonucleotide
aaatttgagaattattttat

SEQ ID NO: 13722 - DNA, 20 bp, Artificial Sequence
  Description of Artificial Sequence: Synthetic oligonucleotide
caaatttgagaattatttta

SEQ ID NO: 13723 - DNA, 20 bp, Artificial Sequence
  Description of Artificial Sequence: Synthetic oligonucleotide
acaaatttgagaattatttt

SEQ ID NO: 13724 - DNA, 20 bp, Artificial Sequence
  Description of Artificial Sequence: Synthetic oligonucleotide
aacaaatttgagaattattt

SEQ ID NO: 13725 - DNA, 20 bp, Artificial Sequence
  Description of Artificial Sequence: Synthetic oligonucleotide
aaacaaatttgagaattatt

SEQ ID NO: 13726 - DNA, 20 bp, Artificial Sequence
  Description of Artificial Sequence: Synthetic oligonucleotide
gaaacaaatttgagaattat

SEQ ID NO: 13727 - DNA, 20 bp, Artificial Sequence
  Description of Artificial Sequence: Synthetic oligonucleotide
agaaacaaatttgagaatta

SEQ ID NO: 13728 - DNA, 20 bp, Artificial Sequence
  Description of Artificial Sequence: Synthetic oligonucleotide
aagaaacaaatttgagaatt

SEQ ID NO: 13729 - DNA, 20 bp, Artificial Sequence
  Description of Artificial Sequence: Synthetic oligonucleotide
taagaaacaaatttgagaat

SEQ ID NO: 13730 - DNA, 20 bp, Artificial Sequence
  Description of Artificial Sequence: Synthetic oligonucleotide
ataagaaacaaatttgagaa

SEQ ID NO: 13731 - DNA, 20 bp, Artificial Sequence
  Description of Artificial Sequence: Synthetic oligonucleotide
cataagaaacaaatttgaga

SEQ ID NO: 13732 - DNA, 20 bp, Artificial Sequence
  Description of Artificial Sequence: Synthetic oligonucleotide
tcataagaaacaaatttgag

SEQ ID NO: 13733 - DNA, 20 bp, Artificial Sequence
  Description of Artificial Sequence: Synthetic oligonucleotide
ttcataagaaacaaatttga

SEQ ID NO: 13734 - DNA, 20 bp, Artificial Sequence
  Description of Artificial Sequence: Synthetic oligonucleotide
attcataagaaacaaatttg

SEQ ID NO: 13735 - DNA, 20 bp, Artificial Sequence
  Description of Artificial Sequence: Synthetic oligonucleotide
gattcataagaaacaaattt

SEQ ID NO: 13736 - DNA, 20 bp, Artificial Sequence
  Description of Artificial Sequence: Synthetic oligonucleotide
tgattcataagaaacaaatt

SEQ ID NO: 13737 - DNA, 20 bp, Artificial Sequence
  Description of Artificial Sequence: Synthetic oligonucleotide
atgattcataagaaacaaat

SEQ ID NO: 13738 - DNA, 20 bp, Artificial Sequence
  Description of Artificial Sequence: Synthetic oligonucleotide
gatgattcataagaaacaaa

SEQ ID NO: 13739 - DNA, 20 bp, Artificial Sequence
  Description of Artificial Sequence: Synthetic oligonucleotide
agatgattcataagaaacaa

SEQ ID NO: 13740 - DNA, 20 bp, Artificial Sequence
  Description of Artificial Sequence: Synthetic oligonucleotide
gagatgattcataagaaaca

SEQ ID NO: 13741 - DNA, 20 bp, Artificial Sequence
  Description of Artificial Sequence: Synthetic oligonucleotide
agagatgattcataagaaac

SEQ ID NO: 13742 - DNA, 20 bp, Artificial Sequence
  Description of Artificial Sequence: Synthetic oligonucleotide
gagagatgattcataagaaa

SEQ ID NO: 13743 - DNA, 20 bp, Artificial Sequence
  Description of Artificial Sequence: Synthetic oligonucleotide
tgagagatgattcataagaa

SEQ ID NO: 13744 - DNA, 20 bp, Artificial Sequence
  Description of Artificial Sequence: Synthetic oligonucleotide
ttgagagatgattcataaga

SEQ ID NO: 13745 - DNA, 20 bp, Artificial Sequence
  Description of Artificial Sequence: Synthetic oligonucleotide
tttgagagatgattcataag

SEQ ID NO: 13746 - DNA, 20 bp, Artificial Sequence
  Description of Artificial Sequence: Synthetic oligonucleotide
atttgagagatgattcataa

SEQ ID NO: 13747 - DNA, 20 bp, Artificial Sequence
  Description of Artificial Sequence: Synthetic oligonucleotide
gatttgagagatgattcata

SEQ ID NO: 13748 - DNA, 20 bp, Artificial Sequence
  Description of Artificial Sequence: Synthetic oligonucleotide
agatttgagagatgattcat

SEQ ID NO: 13749 - DNA, 20 bp, Artificial Sequence
  Description of Artificial Sequence: Synthetic oligonucleotide
tagatttgagagatgattca

SEQ ID NO: 13750 - DNA, 20 bp, Artificial Sequence
  Description of Artificial Sequence: Synthetic oligonucleotide
ctagatttgagagatgattc

SEQ ID NO: 13751 - DNA, 20 bp, Artificial Sequence
  Description of Artificial Sequence: Synthetic oligonucleotide
actagatttgagagatgatt

SEQ ID NO: 13752 - DNA, 20 bp, Artificial Sequence
  Description of Artificial Sequence: Synthetic oligonucleotide
aactagatttgagagatgat

SEQ ID NO: 13753 - DNA, 20 bp, Artificial Sequence
  Description of Artificial Sequence: Synthetic oligonucleotide
taactagatttgagagatga

SEQ ID NO: 13754 - DNA, 20 bp, Artificial Sequence
  Description of Artificial Sequence: Synthetic oligonucleotide
ctaactagatttgagagatg

SEQ ID NO: 13755 - DNA, 20 bp, Artificial Sequence
  Description of Artificial Sequence: Synthetic oligonucleotide
tctaactagatttgagagat

SEQ ID NO: 13756 - DNA, 20 bp, Artificial Sequence
  Description of Artificial Sequence: Synthetic oligonucleotide
gtctaactagatttgagaga

SEQ ID NO: 13757 - DNA, 20 bp, Artificial Sequence
  Description of Artificial Sequence: Synthetic oligonucleotide
tgtctaactagatttgagag

SEQ ID NO: 13758 - DNA, 20 bp, Artificial Sequence
  Description of Artificial Sequence: Synthetic oligonucleotide
ttgtctaactagatttgaga

SEQ ID NO: 13759 - DNA, 20 bp, Artificial Sequence
  Description of Artificial Sequence: Synthetic oligonucleotide
attgtctaactagatttgag

SEQ ID NO: 13760 - DNA, 20 bp, Artificial Sequence
  Description of Artificial Sequence: Synthetic oligonucleotide
aattgtctaactagatttga

SEQ ID NO: 13761 - DNA, 20 bp, Artificial Sequence
  Description of Artificial Sequence: Synthetic oligonucleotide
aaattgtctaactagatttg

SEQ ID NO: 13762 - DNA, 20 bp, Artificial Sequence
  Description of Artificial Sequence: Synthetic oligonucleotide
caaattgtctaactagattt

SEQ ID NO: 13763 - DNA, 20 bp, Artificial Sequence
  Description of Artificial Sequence: Synthetic oligonucleotide
gcaaattgtctaactagatt

SEQ ID NO: 13764 - DNA, 20 bp, Artificial Sequence
  Description of Artificial Sequence: Synthetic oligonucleotide
tgcaaattgtctaactagat

SEQ ID NO: 13765 - DNA, 20 bp, Artificial Sequence
  Description of Artificial Sequence: Synthetic oligonucleotide
gtgcaaattgtctaactaga

SEQ ID NO: 13766 - DNA, 20 bp, Artificial Sequence
  Description of Artificial Sequence: Synthetic oligonucleotide
tgtgcaaattgtctaactag

SEQ ID NO: 13767 - DNA, 20 bp, Artificial Sequence
  Description of Artificial Sequence: Synthetic oligonucleotide
gtgtgcaaattgtctaacta

SEQ ID NO: 13768 - DNA, 20 bp, Artificial Sequence
  Description of Artificial Sequence: Synthetic oligonucleotide
tgtgtgcaaattgtctaact

SEQ ID NO: 13769 - DNA, 20 bp, Artificial Sequence
  Description of Artificial Sequence: Synthetic oligonucleotide
atgtgtgcaaattgtctaac

SEQ ID NO: 13770 - DNA, 20 bp, Artificial Sequence
  Description of Artificial Sequence: Synthetic oligonucleotide
tatgtgtgcaaattgtctaa

SEQ ID NO: 13771 - DNA, 20 bp, Artificial Sequence
  Description of Artificial Sequence: Synthetic oligonucleotide
gtatgtgtgcaaattgtcta

SEQ ID NO: 13772 - DNA, 20 bp, Artificial Sequence
  Description of Artificial Sequence: Synthetic oligonucleotide
agtatgtgtgcaaattgtct

SEQ ID NO: 13773 - DNA, 20 bp, Artificial Sequence
  Description of Artificial Sequence: Synthetic oligonucleotide
aagtatgtgtgcaaattgtc

SEQ ID NO: 13774 - DNA, 20 bp, Artificial Sequence
  Description of Artificial Sequence: Synthetic oligonucleotide
aaagtatgtgtgcaaattgt

SEQ ID NO: 13775 - DNA, 20 bp, Artificial Sequence
  Description of Artificial Sequence: Synthetic oligonucleotide
aaaagtatgtgtgcaaattg

SEQ ID NO: 13776 - DNA, 20 bp, Artificial Sequence
  Description of Artificial Sequence: Synthetic oligonucleotide
gaaaagtatgtgtgcaaatt

SEQ ID NO: 13777 - DNA, 20 bp, Artificial Sequence
  Description of Artificial Sequence: Synthetic oligonucleotide
agaaaagtatgtgtgcaaat

SEQ ID NO: 13778 - DNA, 20 bp, Artificial Sequence
  Description of Artificial Sequence: Synthetic oligonucleotide
tagaaaagtatgtgtgcaaa

SEQ ID NO: 13779 - DNA, 20 bp, Artificial Sequence
  Description of Artificial Sequence: Synthetic oligonucleotide
ttagaaaagtatgtgtgcaa

SEQ ID NO: 13780 - DNA, 20 bp, Artificial Sequence
  Description of Artificial Sequence: Synthetic oligonucleotide
cttagaaaagtatgtgtgca

SEQ ID NO: 13781 - DNA, 20 bp, Artificial Sequence
  Description of Artificial Sequence: Synthetic oligonucleotide
ccttagaaaagtatgtgtgc

SEQ ID NO: 13782 - DNA, 20 bp, Artificial Sequence
  Description of Artificial Sequence: Synthetic oligonucleotide
cccttagaaaagtatgtgtg

SEQ ID NO: 13783 - DNA, 20 bp, Artificial Sequence
  Description of Artificial Sequence: Synthetic oligonucleotide
tcccttagaaaagtatgtgt

SEQ ID NO: 13784 - DNA, 20 bp, Artificial Sequence
  Description of Artificial Sequence: Synthetic oligonucleotide
gtcccttagaaaagtatgtg

SEQ ID NO: 13785 - DNA, 20 bp, Artificial Sequence
  Description of Artificial Sequence: Synthetic oligonucleotide
tgtcccttagaaaagtatgt

SEQ ID NO: 13786 - DNA, 20 bp, Artificial Sequence
  Description of Artificial Sequence: Synthetic oligonucleotide
atgtcccttagaaaagtatg

SEQ ID NO: 13787 - DNA, 20 bp, Artificial Sequence
  Description of Artificial Sequence: Synthetic oligonucleotide
aatgtcccttagaaaagtat

SEQ ID NO: 13788 - DNA, 20 bp, Artificial Sequence
  Description of Artificial Sequence: Synthetic oligonucleotide
taatgtcccttagaaaagta

SEQ ID NO: 13789 - DNA, 20 bp, Artificial Sequence
  Description of Artificial Sequence: Synthetic oligonucleotide
ataatgtcccttagaaaagt

SEQ ID NO: 13790 - DNA, 20 bp, Artificial Sequence
  Description of Artificial Sequence: Synthetic oligonucleotide
gataatgtcccttagaaaag

SEQ ID NO: 13791 - DNA, 20 bp, Artificial Sequence
  Description of Artificial Sequence: Synthetic oligonucleotide
agataatgtcccttagaaaa

SEQ ID NO: 13792 - DNA, 20 bp, Artificial Sequence
  Description of Artificial Sequence: Synthetic oligonucleotide
aagataatgtcccttagaaa

SEQ ID NO: 13793 - DNA, 20 bp, Artificial Sequence
  Description of Artificial Sequence: Synthetic oligonucleotide
gaagataatgtcccttagaa

SEQ ID NO: 13794 - DNA, 20 bp, Artificial Sequence
  Description of Artificial Sequence: Synthetic oligonucleotide
ggaagataatgtcccttaga

SEQ ID NO: 13795 - DNA, 20 bp, Artificial Sequence
  Description of Artificial Sequence: Synthetic oligonucleotide
aggaagataatgtcccttag

SEQ ID NO: 13796 - DNA, 20 bp, Artificial Sequence
  Description of Artificial Sequence: Synthetic oligonucleotide
aaggaagataatgtccctta

SEQ ID NO: 13797 - DNA, 20 bp, Artificial Sequence
  Description of Artificial Sequence: Synthetic oligonucleotide
gaaggaagataatgtccctt

SEQ ID NO: 13798 - DNA, 20 bp, Artificial Sequence
  Description of Artificial Sequence: Synthetic oligonucleotide
tgaaggaagataatgtccct

SEQ ID NO: 13799 - DNA, 20 bp, Artificial Sequence
  Description of Artificial Sequence: Synthetic oligonucleotide
ctgaaggaagataatgtccc

SEQ ID NO: 13800 - DNA, 20 bp, Artificial Sequence
  Description of Artificial Sequence: Synthetic oligonucleotide
cctgaaggaagataatgtcc

SEQ ID NO: 13801 - DNA, 20 bp, Artificial Sequence
  Description of Artificial Sequence: Synthetic oligonucleotide
acctgaaggaagataatgtc

SEQ ID NO: 13802 - DNA, 20 bp, Artificial Sequence
  Description of Artificial Sequence: Synthetic oligonucleotide
aacctgaaggaagataatgt

SEQ ID NO: 13803 - DNA, 20 bp, Artificial Sequence
  Description of Artificial Sequence: Synthetic oligonucleotide
aaacctgaaggaagataatg

SEQ ID NO: 13804 - DNA, 20 bp, Artificial Sequence
  Description of Artificial Sequence: Synthetic oligonucleotide
aaaacctgaaggaagataat

SEQ ID NO: 13805 - DNA, 20 bp, Artificial Sequence
  Description of Artificial Sequence: Synthetic oligonucleotide
aaaaacctgaaggaagataa

SEQ ID NO: 13806 - DNA, 20 bp, Artificial Sequence
  Description of Artificial Sequence: Synthetic oligonucleotide
taaaaacctgaaggaagata

SEQ ID NO: 13807 - DNA, 20 bp, Artificial Sequence
  Description of Artificial Sequence: Synthetic oligonucleotide
gtaaaaacctgaaggaagat

SEQ ID NO: 13808 - DNA, 20 bp, Artificial Sequence
  Description of Artificial Sequence: Synthetic oligonucleotide
ggtaaaaacctgaaggaaga

SEQ ID NO: 13809 - DNA, 20 bp, Artificial Sequence
  Description of Artificial Sequence: Synthetic oligonucleotide
aggtaaaaacctgaaggaag

SEQ ID NO: 13810 - DNA, 20 bp, Artificial Sequence
  Description of Artificial Sequence: Synthetic oligonucleotide
gaggtaaaaacctgaaggaa

SEQ ID NO: 13811 - DNA, 20 bp, Artificial Sequence
  Description of Artificial Sequence: Synthetic oligonucleotide
ggaggtaaaaacctgaagga

SEQ ID NO: 13812 - DNA, 20 bp, Artificial Sequence
  Description of Artificial Sequence: Synthetic oligonucleotide
tggaggtaaaaacctgaagg

SEQ ID NO: 13813 - DNA, 20 bp, Artificial Sequence
  Description of Artificial Sequence: Synthetic oligonucleotide
gtggaggtaaaaacctgaag

SEQ ID NO: 13814 - DNA, 20 bp, Artificial Sequence
  Description of Artificial Sequence: Synthetic oligonucleotide
agtggaggtaaaaacctgaa

SEQ ID NO: 13815 - DNA, 20 bp, Artificial Sequence
  Description of Artificial Sequence: Synthetic oligonucleotide
gagtggaggtaaaaacctga

SEQ ID NO: 13816 - DNA, 20 bp, Artificial Sequence
  Description of Artificial Sequence: Synthetic oligonucleotide
tgagtggaggtaaaaacctg

SEQ ID NO: 13817 - DNA, 20 bp, Artificial Sequence
  Description of Artificial Sequence: Synthetic oligonucleotide
atgagtggaggtaaaaacct

SEQ ID NO: 13818 - DNA, 20 bp, Artificial Sequence
  Description of Artificial Sequence: Synthetic oligonucleotide
gatgagtggaggtaaaaacc

SEQ ID NO: 13819 - DNA, 20 bp, Artificial Sequence
  Description of Artificial Sequence: Synthetic oligonucleotide
ggatgagtggaggtaaaaac

SEQ ID NO: 13820 - DNA, 20 bp, Artificial Sequence
  Description of Artificial Sequence: Synthetic oligonucleotide
aggatgagtggaggtaaaaa

SEQ ID NO: 13821 - DNA, 20 bp, Artificial Sequence
  Description of Artificial Sequence: Synthetic oligonucleotide
aaggatgagtggaggtaaaa

SEQ ID NO: 13822 - DNA, 20 bp, Artificial Sequence
  Description of Artificial Sequence: Synthetic oligonucleotide
taaggatgagtggaggtaaa

SEQ ID NO: 13823 - DNA, 20 bp, Artificial Sequence
  Description of Artificial Sequence: Synthetic oligonucleotide
ctaaggatgagtggaggtaa

SEQ ID NO: 13824 - DNA, 20 bp, Artificial Sequence
  Description of Artificial Sequence: Synthetic oligonucleotide
tctaaggatgagtggaggta

SEQ ID NO: 13825 - DNA, 20 bp, Artificial Sequence
  Description of Artificial Sequence: Synthetic oligonucleotide
ctctaaggatgagtggaggt

SEQ ID NO: 13826 - DNA, 20 bp, Artificial Sequence
  Description of Artificial Sequence: Synthetic oligonucleotide
gctctaaggatgagtggagg

SEQ ID NO: 13827 - DNA, 20 bp, Artificial Sequence
  Description of Artificial Sequence: Synthetic oligonucleotide
ggctctaaggatgagtggag

SEQ ID NO: 13828 - DNA, 20 bp, Artificial Sequence
  Description of Artificial Sequence: Synthetic oligonucleotide
gggctctaaggatgagtgga

SEQ ID NO: 13829 - DNA, 20 bp, Artificial Sequence
  Description of Artificial Sequence: Synthetic oligonucleotide
tgggctctaaggatgagtgg

SEQ ID NO: 13830 - DNA, 20 bp, Artificial Sequence
  Description of Artificial Sequence: Synthetic oligonucleotide
gtgggctctaaggatgagtg

SEQ ID NO: 13831 - DNA, 20 bp, Artificial Sequence
  Description of Artificial Sequence: Synthetic oligonucleotide
agtgggctctaaggatgagt

SEQ ID NO: 13832 - DNA, 20 bp, Artificial Sequence
  Description of Artificial Sequence: Synthetic oligonucleotide
cagtgggctctaaggatgag

SEQ ID NO: 13833 - DNA, 20 bp, Artificial Sequence
  Description of Artificial Sequence: Synthetic oligonucleotide
tcagtgggctctaaggatga

SEQ ID NO: 13834 - DNA, 20 bp, Artificial Sequence
  Description of Artificial Sequence: Synthetic oligonucleotide
gtcagtgggctctaaggatg

SEQ ID NO: 13835 - DNA, 20 bp, Artificial Sequence
  Description of Artificial Sequence: Synthetic oligonucleotide
agtcagtgggctctaaggat

SEQ ID NO: 13836 - DNA, 20 bp, Artificial Sequence
  Description of Artificial Sequence: Synthetic oligonucleotide
cagtcagtgggctctaagga

SEQ ID NO: 13837 - DNA, 20 bp, Artificial Sequence
  Description of Artificial Sequence: Synthetic oligonucleotide
gcagtcagtgggctctaagg

SEQ ID NO: 13838 - DNA, 20 bp, Artificial Sequence
  Description of Artificial Sequence: Synthetic oligonucleotide
agcagtcagtgggctctaag

SEQ ID NO: 13839 - DNA, 20 bp, Artificial Sequence
  Description of Artificial Sequence: Synthetic oligonucleotide
gagcagtcagtgggctctaa

SEQ ID NO: 13840 - DNA, 20 bp, Artificial Sequence
  Description of Artificial Sequence: Synthetic oligonucleotide
ggagcagtcagtgggctcta

SEQ ID NO: 13841 - DNA, 20 bp, Artificial Sequence
  Description of Artificial Sequence: Synthetic oligonucleotide
gggagcagtcagtgggctct

SEQ ID NO: 13842 - DNA, 20 bp, Artificial Sequence
  Description of Artificial Sequence: Synthetic oligonucleotide
ggggagcagtcagtgggctc

SEQ ID NO: 13843 - DNA, 20 bp, Artificial Sequence
  Description of Artificial Sequence: Synthetic oligonucleotide
aggggagcagtcagtgggct

SEQ ID NO: 13844 - DNA, 20 bp, Artificial Sequence
  Description of Artificial Sequence: Synthetic oligonucleotide
aaggggagcagtcagtgggc

SEQ ID NO: 13845 - DNA, 20 bp, Artificial Sequence
  Description of Artificial Sequence: Synthetic oligonucleotide
aaaggggagcagtcagtggg

SEQ ID NO: 13846 - DNA, 20 bp, Artificial Sequence
  Description of Artificial Sequence: Synthetic oligonucleotide
taaaggggagcagtcagtgg

SEQ ID NO: 13847 - DNA, 20 bp, Artificial Sequence
  Description of Artificial Sequence: Synthetic oligonucleotide
ataaaggggagcagtcagtg

SEQ ID NO: 13848 - DNA, 20 bp, Artificial Sequence
  Description of Artificial Sequence: Synthetic oligonucleotide
tataaaggggagcagtcagt

SEQ ID NO: 13849 - DNA, 20 bp, Artificial Sequence
  Description of Artificial Sequence: Synthetic oligonucleotide
gtataaaggggagcagtcag

SEQ ID NO: 13850 - DNA, 20 bp, Artificial Sequence
  Description of Artificial Sequence: Synthetic oligonucleotide
ggtataaaggggagcagtca

SEQ ID NO: 13851 - DNA, 20 bp, Artificial Sequence
  Description of Artificial Sequence: Synthetic oligonucleotide
aggtataaaggggagcagtc

SEQ ID NO: 13852 - DNA, 20 bp, Artificial Sequence
  Description of Artificial Sequence: Synthetic oligonucleotide
caggtataaaggggagcagt

SEQ ID NO: 13853 - DNA, 20 bp, Artificial Sequence
  Description of Artificial Sequence: Synthetic oligonucleotide
acaggtataaaggggagcag

SEQ ID NO: 13854 - DNA, 20 bp, Artificial Sequence
  Description of Artificial Sequence: Synthetic oligonucleotide
aacaggtataaaggggagca

SEQ ID NO: 13855 - DNA, 20 bp, Artificial Sequence
  Description of Artificial Sequence: Synthetic oligonucleotide
caacaggtataaaggggagc

SEQ ID NO: 13856 - DNA, 20 bp, Artificial Sequence
  Description of Artificial Sequence: Synthetic oligonucleotide
ccaacaggtataaaggggag

SEQ ID NO: 13857 - DNA, 20 bp, Artificial Sequence
  Description of Artificial Sequence: Synthetic oligonucleotide
gccaacaggtataaagggga

SEQ ID NO: 13858 - DNA, 20 bp, Artificial Sequence
  Description of Artificial Sequence: Synthetic oligonucleotide
ggccaacaggtataaagggg

SEQ ID NO: 13859 - DNA, 20 bp, Artificial Sequence
  Description of Artificial Sequence: Synthetic oligonucleotide
gggccaacaggtataaaggg

SEQ ID NO: 13860 - DNA, 20 bp, Artificial Sequence
  Description of Artificial Sequence: Synthetic oligonucleotide
agggccaacaggtataaagg

SEQ ID NO: 13861 - DNA, 20 bp, Artificial Sequence
  Description of Artificial Sequence: Synthetic oligonucleotide
cagggccaacaggtataaag

SEQ ID NO: 13862 - DNA, 20 bp, Artificial Sequence
  Description of Artificial Sequence: Synthetic oligonucleotide
gcagggccaacaggtataaa

SEQ ID NO: 13863 - DNA, 20 bp, Artificial Sequence
  Description of Artificial Sequence: Synthetic oligonucleotide
ggcagggccaacaggtataa

SEQ ID NO: 13864 - DNA, 20 bp, Artificial Sequence
  Description of Artificial Sequence: Synthetic oligonucleotide
aggcagggccaacaggtata

SEQ ID NO: 13865 - DNA, 20 bp, Artificial Sequence
  Description of Artificial Sequence: Synthetic oligonucleotide
taggcagggccaacaggtat

SEQ ID NO: 13866 - DNA, 20 bp, Artificial Sequence
  Description of Artificial Sequence: Synthetic oligonucleotide
ataggcagggccaacaggta

SEQ ID NO: 13867 - DNA, 20 bp, Artificial Sequence
  Description of Artificial Sequence: Synthetic oligonucleotide
tataggcagggccaacaggt

SEQ ID NO: 13868 - DNA, 20 bp, Artificial Sequence
  Description of Artificial Sequence: Synthetic oligonucleotide
ctataggcagggccaacagg

SEQ ID NO: 13869 - DNA, 20 bp, Artificial Sequence
  Description of Artificial Sequence: Synthetic oligonucleotide
cctataggcagggccaacag

SEQ ID NO: 13870 - DNA, 20 bp, Artificial Sequence
  Description of Artificial Sequence: Synthetic oligonucleotide
tcctataggcagggccaaca

SEQ ID NO: 13871 - DNA, 20 bp, Artificial Sequence
  Description of Artificial Sequence: Synthetic oligonucleotide
ctcctataggcagggccaac

SEQ ID NO: 13872 - DNA, 20 bp, Artificial Sequence
  Description of Artificial Sequence: Synthetic oligonucleotide
tctcctataggcagggccaa

SEQ ID NO: 13873 - DNA, 20 bp, Artificial Sequence
  Description of Artificial Sequence: Synthetic oligonucleotide
ctctcctataggcagggcca

SEQ ID NO: 13874 - DNA, 20 bp, Artificial Sequence
  Description of Artificial Sequence: Synthetic oligonucleotide
tctctcctataggcagggcc

SEQ ID NO: 13875 - DNA, 20 bp, Artificial Sequence
  Description of Artificial Sequence: Synthetic oligonucleotide
ttctctcctataggcagggc

SEQ ID NO: 13876 - DNA, 20 bp, Artificial Sequence
  Description of Artificial Sequence: Synthetic oligonucleotide
attctctcctataggcaggg

SEQ ID NO: 13877 - DNA, 20 bp, Artificial Sequence
  Description of Artificial Sequence: Synthetic oligonucleotide
tattctctcctataggcagg

SEQ ID NO: 13878 - DNA, 20 bp, Artificial Sequence
  Description of Artificial Sequence: Synthetic oligonucleotide
atattctctcctataggcag

SEQ ID NO: 13879 - DNA, 20 bp, Artificial Sequence
  Description of Artificial Sequence: Synthetic oligonucleotide
aatattctctcctataggca

SEQ ID NO: 13880 - DNA, 20 bp, Artificial Sequence
  Description of Artificial Sequence: Synthetic oligonucleotide
aaatattctctcctataggc

SEQ ID NO: 13881 - DNA, 20 bp, Artificial Sequence
  Description of Artificial Sequence: Synthetic oligonucleotide
caaatattctctcctatagg

SEQ ID NO: 13882 - DNA, 20 bp, Artificial Sequence
  Description of Artificial Sequence: Synthetic oligonucleotide
ccaaatattctctcctatag

SEQ ID NO: 13883 - DNA, 20 bp, Artificial Sequence
  Description of Artificial Sequence: Synthetic oligonucleotide
tccaaatattctctcctata

SEQ ID NO: 13884 - DNA, 20 bp, Artificial Sequence
  Description of Artificial Sequence: Synthetic oligonucleotide
ctccaaatattctctcctat

SEQ ID NO: 13885 - DNA, 20 bp, Artificial Sequence
  Description of Artificial Sequence: Synthetic oligonucleotide
tctccaaatattctctccta

SEQ ID NO: 13886 - DNA, 20 bp, Artificial Sequence
  Description of Artificial Sequence: Synthetic oligonucleotide
atctccaaatattctctcct

SEQ ID NO: 13887 - DNA, 20 bp, Artificial Sequence
  Description of Artificial Sequence: Synthetic oligonucleotide
tatctccaaatattctctcc

SEQ ID NO: 13888 - DNA, 20 bp, Artificial Sequence
  Description of Artificial Sequence: Synthetic oligonucleotide
ctatctccaaatattctctc

SEQ ID NO: 13889 - DNA, 20 bp, Artificial Sequence
  Description of Artificial Sequence: Synthetic oligonucleotide
cctatctccaaatattctct

SEQ ID NO: 13890 - DNA, 20 bp, Artificial Sequence
  Description of Artificial Sequence: Synthetic oligonucleotide
gcctatctccaaatattctc

SEQ ID NO: 13891 - DNA, 20 bp, Artificial Sequence
  Description of Artificial Sequence: Synthetic oligonucleotide
tgcctatctccaaatattct

SEQ ID NO: 13892 - DNA, 20 bp, Artificial Sequence
  Description of Artificial Sequence: Synthetic oligonucleotide
ctgcctatctccaaatattc

SEQ ID NO: 13893 - DNA, 20 bp, Artificial Sequence
  Description of Artificial Sequence: Synthetic oligonucleotide
gctgcctatctccaaatatt

SEQ ID NO: 13894 - DNA, 20 bp, Artificial Sequence
  Description of Artificial Sequence: Synthetic oligonucleotide
agctgcctatctccaaatat

SEQ ID NO: 13895 - DNA, 20 bp, Artificial Sequence
  Description of Artificial Sequence: Synthetic oligonucleotide
aagctgcctatctccaaata

SEQ ID NO: 13896 - DNA, 20 bp, Artificial Sequence
  Description of Artificial Sequence: Synthetic oligonucleotide
gaagctgcctatctccaaat

SEQ ID NO: 13897 - DNA, 20 bp, Artificial Sequence
  Description of Artificial Sequence: Synthetic oligonucleotide
tgaagctgcctatctccaaa

SEQ ID NO: 13898 - DNA, 20 bp, Artificial Sequence
  Description of Artificial Sequence: Synthetic oligonucleotide
ctgaagctgcctatctccaa

SEQ ID NO: 13899 - DNA, 20 bp, Artificial Sequence
  Description of Artificial Sequence: Synthetic oligonucleotide
cctgaagctgcctatctcca

SEQ ID NO: 13900 - DNA, 20 bp, Artificial Sequence
  Description of Artificial Sequence: Synthetic oligonucleotide
tcctgaagctgcctatctcc

SEQ ID NO: 13901 - DNA, 20 bp, Artificial Sequence
  Description of Artificial Sequence: Synthetic oligonucleotide
atcctgaagctgcctatctc

SEQ ID NO: 13902 - DNA, 20 bp, Artificial Sequence
  Description of Artificial Sequence: Synthetic oligonucleotide
catcctgaagctgcctatct

SEQ ID NO: 13903 - DNA, 20 bp, Artificial Sequence
  Description of Artificial Sequence: Synthetic oligonucleotide
gcatcctgaagctgcctatc

SEQ ID NO: 13904 - DNA, 20 bp, Artificial Sequence
  Description of Artificial Sequence: Synthetic oligonucleotide
tgcatcctgaagctgcctat

SEQ ID NO: 13905 - DNA, 20 bp, Artificial Sequence
  Description of Artificial Sequence: Synthetic oligonucleotide
atgcatcctgaagctgccta

SEQ ID NO: 13906 - DNA, 20 bp, Artificial Sequence
  Description of Artificial Sequence: Synthetic oligonucleotide
aatgcatcctgaagctgcct

SEQ ID NO: 13907 - DNA, 20 bp, Artificial Sequence
  Description of Artificial Sequence: Synthetic oligonucleotide
caatgcatcctgaagctgcc

SEQ ID NO: 13908 - DNA, 20 bp, Artificial Sequence
  Description of Artificial Sequence: Synthetic oligonucleotide
gcaatgcatcctgaagctgc

SEQ ID NO: 13909 - DNA, 20 bp, Artificial Sequence
  Description of Artificial Sequence: Synthetic oligonucleotide
tgcaatgcatcctgaagctg

SEQ ID NO: 13910 - DNA, 20 bp, Artificial Sequence
  Description of Artificial Sequence: Synthetic oligonucleotide
ttgcaatgcatcctgaagct

SEQ ID NO: 13911 - DNA, 20 bp, Artificial Sequence
  Description of Artificial Sequence: Synthetic oligonucleotide
attgcaatgcatcctgaagc

SEQ ID NO: 13912 - DNA, 20 bp, Artificial Sequence
  Description of Artificial Sequence: Synthetic oligonucleotide
gattgcaatgcatcctgaag

SEQ ID NO: 13913 - DNA, 20 bp, Artificial Sequence
  Description of Artificial Sequence: Synthetic oligonucleotide
tgattgcaatgcatcctgaa

SEQ ID NO: 13914 - DNA, 20 bp, Artificial Sequence
  Description of Artificial Sequence: Synthetic oligonucleotide
atgattgcaatgcatcctga

SEQ ID NO: 13915 - DNA, 20 bp, Artificial Sequence
  Description of Artificial Sequence: Synthetic oligonucleotide
gatgattgcaatgcatcctg

SEQ ID NO: 13916 - DNA, 20 bp, Artificial Sequence
  Description of Artificial Sequence: Synthetic oligonucleotide
ggatgattgcaatgcatcct

SEQ ID NO: 13917 - DNA, 20 bp, Artificial Sequence
  Description of Artificial Sequence: Synthetic oligonucleotide
aggatgattgcaatgcatcc

SEQ ID NO: 13918 - DNA, 20 bp, Artificial Sequence
  Description of Artificial Sequence: Synthetic oligonucleotide
aaggatgattgcaatgcatc

SEQ ID NO: 13919 - DNA, 20 bp, Artificial Sequence
  Description of Artificial Sequence: Synthetic oligonucleotide
aaaggatgattgcaatgcat

SEQ ID NO: 13920 - DNA, 20 bp, Artificial Sequence
  Description of Artificial Sequence: Synthetic oligonucleotide
aaaaggatgattgcaatgca

SEQ ID NO: 13921 - DNA, 20 bp, Artificial Sequence
  Description of Artificial Sequence: Synthetic oligonucleotide
gaaaaggatgattgcaatgc

SEQ ID NO: 13922 - DNA, 20 bp, Artificial Sequence
  Description of Artificial Sequence: Synthetic oligonucleotide
agaaaaggatgattgcaatg

SEQ ID NO: 13923 - DNA, 20 bp, Artificial Sequence
  Description of Artificial Sequence: Synthetic oligonucleotide
aagaaaaggatgattgcaat

SEQ ID NO: 13924 - DNA, 20 bp, Artificial Sequence
  Description of Artificial Sequence: Synthetic oligonucleotide
taagaaaaggatgattgcaa

SEQ ID NO: 13925 - DNA, 20 bp, Artificial Sequence
  Description of Artificial Sequence: Synthetic oligonucleotide
ttaagaaaaggatgattgca

SEQ ID NO: 13926 - DNA, 20 bp, Artificial Sequence
  Description of Artificial Sequence: Synthetic oligonucleotide
tttaagaaaaggatgattgc

SEQ ID NO: 13927 - DNA, 20 bp, Artificial Sequence
  Description of Artificial Sequence: Synthetic oligonucleotide
atttaagaaaaggatgattg

SEQ ID NO: 13928 - DNA, 20 bp, Artificial Sequence
  Description of Artificial Sequence: Synthetic oligonucleotide
aatttaagaaaaggatgatt

SEQ ID NO: 13929 - DNA, 20 bp, Artificial Sequence
  Description of Artificial Sequence: Synthetic oligonucleotide
taatttaagaaaaggatgat

SEQ ID NO: 13930 - DNA, 20 bp, Artificial Sequence
  Description of Artificial Sequence: Synthetic oligonucleotide
ataatttaagaaaaggatga

SEQ ID NO: 13931 - DNA, 20 bp, Artificial Sequence
  Description of Artificial Sequence: Synthetic oligonucleotide
cataatttaagaaaaggatg

SEQ ID NO: 13932 - DNA, 20 bp, Artificial Sequence
  Description of Artificial Sequence: Synthetic oligonucleotide
acataatttaagaaaaggat

SEQ ID NO: 13933 - DNA, 20 bp, Artificial Sequence
  Description of Artificial Sequence: Synthetic oligonucleotide
gacataatttaagaaaagga

SEQ ID NO: 13934 - DNA, 20 bp, Artificial Sequence
  Description of Artificial Sequence: Synthetic oligonucleotide
tgacataatttaagaaaagg

SEQ ID NO: 13935 - DNA, 20 bp, Artificial Sequence
  Description of Artificial Sequence: Synthetic oligonucleotide
gtgacataatttaagaaaag

SEQ ID NO: 13936 - DNA, 20 bp, Artificial Sequence
  Description of Artificial Sequence: Synthetic oligonucleotide
agtgacataatttaagaaaa

SEQ ID NO: 13937 - DNA, 20 bp, Artificial Sequence
  Description of Artificial Sequence: Synthetic oligonucleotide
tagtgacataatttaagaaa

SEQ ID NO: 13938 - DNA, 20 bp, Artificial Sequence
  Description of Artificial Sequence: Synthetic oligonucleotide
ctagtgacataatttaagaa

SEQ ID NO: 13939 - DNA, 20 bp, Artificial Sequence
  Description of Artificial Sequence: Synthetic oligonucleotide
actagtgacataatttaaga

SEQ ID NO: 13940 - DNA, 20 bp, Artificial Sequence
  Description of Artificial Sequence: Synthetic oligonucleotide
gactagtgacataatttaag

SEQ ID NO: 13941 - DNA, 20 bp, Artificial Sequence
  Description of Artificial Sequence: Synthetic oligonucleotide
agactagtgacataatttaa

SEQ ID NO: 13942 - DNA, 20 bp, Artificial Sequence
  Description of Artificial Sequence: Synthetic oligonucleotide
aagactagtgacataattta

SEQ ID NO: 13943 - DNA, 20 bp, Artificial Sequence
  Description of Artificial Sequence: Synthetic oligonucleotide
aaagactagtgacataattt

SEQ ID NO: 13944 - DNA, 20 bp, Artificial Sequence
  Description of Artificial Sequence: Synthetic oligonucleotide
aaaagactagtgacataatt

SEQ ID NO: 13945 - DNA, 20 bp, Artificial Sequence
  Description of Artificial Sequence: Synthetic oligonucleotide
taaaagactagtgacataat

SEQ ID NO: 13946 - DNA, 20 bp, Artificial Sequence
  Description of Artificial Sequence: Synthetic oligonucleotide
ataaaagactagtgacataa

SEQ ID NO: 13947 - DNA, 20 bp, Artificial Sequence
  Description of Artificial Sequence: Synthetic oligonucleotide
aataaaagactagtgacata

SEQ ID NO: 13948 - DNA, 20 bp, Artificial Sequence
  Description of Artificial Sequence: Synthetic oligonucleotide
aaataaaagactagtgacat

SEQ ID NO: 13949 - DNA, 20 bp, Artificial Sequence
  Description of Artificial Sequence: Synthetic oligonucleotide
aaaataaaagactagtgaca

SEQ ID NO: 13950 - DNA, 20 bp, Artificial Sequence
  Description of Artificial Sequence: Synthetic oligonucleotide
aaaaataaaagactagtgac

SEQ ID NO: 13951 - DNA, 20 bp, Artificial Sequence
  Description of Artificial Sequence: Synthetic oligonucleotide
aaaaaataaaagactagtga

SEQ ID NO: 13952 - DNA, 20 bp, Artificial Sequence
  Description of Artificial Sequence: Synthetic oligonucleotide
gaaaaaataaaagactagtg

SEQ ID NO: 13953 - DNA, 20 bp, Artificial Sequence
  Description of Artificial Sequence: Synthetic oligonucleotide
ggaaaaaataaaagactagt

SEQ ID NO: 13954 - DNA, 20 bp, Artificial Sequence
  Description of Artificial Sequence: Synthetic oligonucleotide
gggaaaaaataaaagactag

SEQ ID NO: 13955 - DNA, 20 bp, Artificial Sequence
  Description of Artificial Sequence: Synthetic oligonucleotide
ggggaaaaaataaaagacta

SEQ ID NO: 13956 - DNA, 20 bp, Artificial Sequence
  Description of Artificial Sequence: Synthetic oligonucleotide
aggggaaaaaataaaagact

SEQ ID NO: 13957 - DNA, 20 bp, Artificial Sequence
  Description of Artificial Sequence: Synthetic oligonucleotide
gaggggaaaaaataaaagac

SEQ ID NO: 13958 - DNA, 20 bp, Artificial Sequence
  Description of Artificial Sequence: Synthetic oligonucleotide
agaggggaaaaaataaaaga

SEQ ID NO: 13959 - DNA, 20 bp, Artificial Sequence
  Description of Artificial Sequence: Synthetic oligonucleotide
aagaggggaaaaaataaaag

SEQ ID NO: 13960 - DNA, 20 bp, Artificial Sequence
  Description of Artificial Sequence: Synthetic oligonucleotide
caagaggggaaaaaataaaa

SEQ ID NO: 13961 - DNA, 20 bp, Artificial Sequence
  Description of Artificial Sequence: Synthetic oligonucleotide
tcaagaggggaaaaaataaa

SEQ ID NO: 13962 - DNA, 20 bp, Artificial Sequence
  Description of Artificial Sequence: Synthetic oligonucleotide
ttcaagaggggaaaaaataa

SEQ ID NO: 13963 - DNA, 20 bp, Artificial Sequence
  Description of Artificial Sequence: Synthetic oligonucleotide
gttcaagaggggaaaaaata

SEQ ID NO: 13964 - DNA, 20 bp, Artificial Sequence
  Description of Artificial Sequence: Synthetic oligonucleotide
agttcaagaggggaaaaaat

SEQ ID NO: 13965 - DNA, 20 bp, Artificial Sequence
  Description of Artificial Sequence: Synthetic oligonucleotide
aagttcaagaggggaaaaaa

SEQ ID NO: 13966 - DNA, 20 bp, Artificial Sequence
  Description of Artificial Sequence: Synthetic oligonucleotide
aaagttcaagaggggaaaaa

SEQ ID NO: 13967 - DNA, 20 bp, Artificial Sequence
  Description of Artificial Sequence: Synthetic oligonucleotide
gaaagttcaagaggggaaaa

SEQ ID NO: 13968 - DNA, 20 bp, Artificial Sequence
  Description of Artificial Sequence: Synthetic oligonucleotide
ggaaagttcaagaggggaaa

SEQ ID NO: 13969 - DNA, 20 bp, Artificial Sequence
  Description of Artificial Sequence: Synthetic oligonucleotide
aggaaagttcaagaggggaa

SEQ ID NO: 13970 - DNA, 20 bp, Artificial Sequence
  Description of Artificial Sequence: Synthetic oligonucleotide
gaggaaagttcaagagggga

SEQ ID NO: 13971 - DNA, 20 bp, Artificial Sequence
  Description of Artificial Sequence: Synthetic oligonucleotide
tgaggaaagttcaagagggg

SEQ ID NO: 13972 - DNA, 20 bp, Artificial Sequence
  Description of Artificial Sequence: Synthetic oligonucleotide
gtgaggaaagttcaagaggg

SEQ ID NO: 13973 - DNA, 20 bp, Artificial Sequence
  Description of Artificial Sequence: Synthetic oligonucleotide
tgtgaggaaagttcaagagg

SEQ ID NO: 13974 - DNA, 20 bp, Artificial Sequence
  Description of Artificial Sequence: Synthetic oligonucleotide
gtgtgaggaaagttcaagag

SEQ ID NO: 13975 - DNA, 20 bp, Artificial Sequence
  Description of Artificial Sequence: Synthetic oligonucleotide
ggtgtgaggaaagttcaaga

SEQ ID NO: 13976 - DNA, 20 bp, Artificial Sequence
  Description of Artificial Sequence: Synthetic oligonucleotide
aggtgtgaggaaagttcaag

SEQ ID NO: 13977 - DNA, 20 bp, Artificial Sequence
  Description of Artificial Sequence: Synthetic oligonucleotide
caggtgtgaggaaagttcaa

SEQ ID NO: 13978 - DNA, 20 bp, Artificial Sequence
  Description of Artificial Sequence: Synthetic oligonucleotide
ccaggtgtgaggaaagttca

SEQ ID NO: 13979 - DNA, 20 bp, Artificial Sequence
  Description of Artificial Sequence: Synthetic oligonucleotide
tccaggtgtgaggaaagttc

SEQ ID NO: 13980 - DNA, 20 bp, Artificial Sequence
  Description of Artificial Sequence: Synthetic oligonucleotide
ttccaggtgtgaggaaagtt

SEQ ID NO: 13981 - DNA, 20 bp, Artificial Sequence
  Description of Artificial Sequence: Synthetic oligonucleotide
cttccaggtgtgaggaaagt

SEQ ID NO: 13982 - DNA, 20 bp, Artificial Sequence
  Description of Artificial Sequence: Synthetic oligonucleotide
tcttccaggtgtgaggaaag

SEQ ID NO: 13983 - DNA, 20 bp, Artificial Sequence
  Description of Artificial Sequence: Synthetic oligonucleotide
ttcttccaggtgtgaggaaa

SEQ ID NO: 13984 - DNA, 20 bp, Artificial Sequence
  Description of Artificial Sequence: Synthetic oligonucleotide
tttcttccaggtgtgaggaa

SEQ ID NO: 13985 - DNA, 20 bp, Artificial Sequence
  Description of Artificial Sequence: Synthetic oligonucleotide
gtttcttccaggtgtgagga

SEQ ID NO: 13986 - DNA, 20 bp, Artificial Sequence
  Description of Artificial Sequence: Synthetic oligonucleotide
tgtttcttccaggtgtgagg

SEQ ID NO: 13987 - DNA, 20 bp, Artificial Sequence
  Description of Artificial Sequence: Synthetic oligonucleotide
ttgtttcttccaggtgtgag

SEQ ID NO: 13988 - DNA, 20 bp, Artificial Sequence
  Description of Artificial Sequence: Synthetic oligonucleotide
tttgtttcttccaggtgtga

SEQ ID NO: 13989 - DNA, 20 bp, Artificial Sequence
  Description of Artificial Sequence: Synthetic oligonucleotide
ctttgtttcttccaggtgtg

SEQ ID NO: 13990 - DNA, 20 bp, Artificial Sequence
  Description of Artificial Sequence: Synthetic oligonucleotide
actttgtttcttccaggtgt

SEQ ID NO: 13991 - DNA, 20 bp, Artificial Sequence
  Description of Artificial Sequence: Synthetic oligonucleotide
tactttgtttcttccaggtg

SEQ ID NO: 13992 - DNA, 20 bp, Artificial Sequence
  Description of Artificial Sequence: Synthetic oligonucleotide
ctactttgtttcttccaggt

SEQ ID NO: 13993 - DNA, 20 bp, Artificial Sequence
  Description of Artificial Sequence: Synthetic oligonucleotide
cctactttgtttcttccagg

SEQ ID NO: 13994 - DNA, 20 bp, Artificial Sequence
  Description of Artificial Sequence: Synthetic oligonucleotide
tcctactttgtttcttccag

SEQ ID NO: 13995 - DNA, 20 bp, Artificial Sequence
  Description of Artificial Sequence: Synthetic oligonucleotide
ttcctactttgtttcttcca

SEQ ID NO: 13996 - DNA, 20 bp, Artificial Sequence
  Description of Artificial Sequence: Synthetic oligonucleotide
tttcctactttgtttcttcc

SEQ ID NO: 13997 - DNA, 20 bp, Artificial Sequence
  Description of Artificial Sequence: Synthetic oligonucleotide
ttttcctactttgtttcttc

SEQ ID NO: 13998 - DNA, 20 bp, Artificial Sequence
  Description of Artificial Sequence: Synthetic oligonucleotide
tttttcctactttgtttctt

SEQ ID NO: 13999 - DNA, 20 bp, Artificial Sequence
  Description of Artificial Sequence: Synthetic oligonucleotide
ctttttcctactttgtttct

SEQ ID NO: 14000 - DNA, 20 bp, Artificial Sequence
  Description of Artificial Sequence: Synthetic oligonucleotide
actttttcctactttgtttc

SEQ ID NO: 14001 - DNA, 20 bp, Artificial Sequence
  Description of Artificial Sequence: Synthetic oligonucleotide
cactttttcctactttgttt

SEQ ID NO: 14002 - DNA, 20 bp, Artificial Sequence
  Description of Artificial Sequence: Synthetic oligonucleotide
tcactttttcctactttgtt

SEQ ID NO: 14003 - DNA, 20 bp, Artificial Sequence
  Description of Artificial Sequence: Synthetic oligonucleotide
ttcactttttcctactttgt

SEQ ID NO: 14004 - DNA, 20 bp, Artificial Sequence
  Description of Artificial Sequence: Synthetic oligonucleotide
gttcactttttcctactttg

SEQ ID NO: 14005 - DNA, 20 bp, Artificial Sequence
  Description of Artificial Sequence: Synthetic oligonucleotide
tgttcactttttcctacttt

SEQ ID NO: 14006 - DNA, 20 bp, Artificial Sequence
  Description of Artificial Sequence: Synthetic oligonucleotide
ctgttcactttttcctactt

SEQ ID NO: 14007 - DNA, 20 bp, Artificial Sequence
  Description of Artificial Sequence: Synthetic oligonucleotide
cctgttcactttttcctact

SEQ ID NO: 14008 - DNA, 20 bp, Artificial Sequence
  Description of Artificial Sequence: Synthetic oligonucleotide
ccctgttcactttttcctac

SEQ ID NO: 14009 - DNA, 20 bp, Artificial Sequence
  Description of Artificial Sequence: Synthetic oligonucleotide
cccctgttcactttttccta

SEQ ID NO: 14010 - DNA, 20 bp, Artificial Sequence
  Description of Artificial Sequence: Synthetic oligonucleotide
tcccctgttcactttttcct

SEQ ID NO: 14011 - DNA, 20 bp, Artificial Sequence
  Description of Artificial Sequence: Synthetic oligonucleotide
atcccctgttcactttttcc

SEQ ID NO: 14012 - DNA, 20 bp, Artificial Sequence
  Description of Artificial Sequence: Synthetic oligonucleotide
catcccctgttcactttttc

SEQ ID NO: 14013 - DNA, 20 bp, Artificial Sequence
  Description of Artificial Sequence: Synthetic oligonucleotide
acatcccctgttcacttttt

SEQ ID NO: 14014 - DNA, 20 bp, Artificial Sequence
  Description of Artificial Sequence: Synthetic oligonucleotide
gacatcccctgttcactttt

SEQ ID NO: 14015 - DNA, 20 bp, Artificial Sequence
  Description of Artificial Sequence: Synthetic oligonucleotide
tgacatcccctgttcacttt

SEQ ID NO: 14016 - DNA, 20 bp, Artificial Sequence
  Description of Artificial Sequence: Synthetic oligonucleotide
ttgacatcccctgttcactt

SEQ ID NO: 14017 - DNA, 20 bp, Artificial Sequence
  Description of Artificial Sequence: Synthetic oligonucleotide
tttgacatcccctgttcact

SEQ ID NO: 14018 - DNA, 20 bp, Artificial Sequence
  Description of Artificial Sequence: Synthetic oligonucleotide
atttgacatcccctgttcac

SEQ ID NO: 14019 - DNA, 20 bp, Artificial Sequence
  Description of Artificial Sequence: Synthetic oligonucleotide
gatttgacatcccctgttca

SEQ ID NO: 14020 - DNA, 20 bp, Artificial Sequence
  Description of Artificial Sequence: Synthetic oligonucleotide
cgatttgacatcccctgttc

SEQ ID NO: 14021 - DNA, 20 bp, Artificial Sequence
  Description of Artificial Sequence: Synthetic oligonucleotide
tcgatttgacatcccctgtt

SEQ ID NO: 14022 - DNA, 20 bp, Artificial Sequence
  Description of Artificial Sequence: Synthetic oligonucleotide
atcgatttgacatcccctgt

SEQ ID NO: 14023 - DNA, 20 bp, Artificial Sequence
  Description of Artificial Sequence: Synthetic oligonucleotide
aatcgatttgacatcccctg

SEQ ID NO: 14024 - DNA, 20 bp, Artificial Sequence
  Description of Artificial Sequence: Synthetic oligonucleotide
gaatcgatttgacatcccct

SEQ ID NO: 14025 - DNA, 20 bp, Artificial Sequence
  Description of Artificial Sequence: Synthetic oligonucleotide
agaatcgatttgacatcccc

SEQ ID NO: 14026 - DNA, 20 bp, Artificial Sequence
  Description of Artificial Sequence: Synthetic oligonucleotide
aagaatcgatttgacatccc

SEQ ID NO: 14027 - DNA, 20 bp, Artificial Sequence
  Description of Artificial Sequence: Synthetic oligonucleotide
caagaatcgatttgacatcc

SEQ ID NO: 14028 - DNA, 20 bp, Artificial Sequence
  Description of Artificial Sequence: Synthetic oligonucleotide
tcaagaatcgatttgacatc

SEQ ID NO: 14029 - DNA, 20 bp, Artificial Sequence
  Description of Artificial Sequence: Synthetic oligonucleotide
ttcaagaatcgatttgacat

SEQ ID NO: 14030 - DNA, 20 bp, Artificial Sequence
  Description of Artificial Sequence: Synthetic oligonucleotide
attcaagaatcgatttgaca

SEQ ID NO: 14031 - DNA, 20 bp, Artificial Sequence
  Description of Artificial Sequence: Synthetic oligonucleotide
aattcaagaatcgatttgac

SEQ ID NO: 14032 - DNA, 20 bp, Artificial Sequence
  Description of Artificial Sequence: Synthetic oligonucleotide
gaattcaagaatcgatttga

SEQ ID NO: 14033 - DNA, 20 bp, Artificial Sequence
  Description of Artificial Sequence: Synthetic oligonucleotide
ggaattcaagaatcgatttg

SEQ ID NO: 14034 - DNA, 20 bp, Artificial Sequence
  Description of Artificial Sequence: Synthetic oligonucleotide
gggaattcaagaatcgattt

SEQ ID NO: 14035 - DNA, 20 bp, Artificial Sequence
  Description of Artificial Sequence: Synthetic oligonucleotide
cgggaattcaagaatcgatt

SEQ ID NO: 14036 - DNA, 20 bp, Artificial Sequence
  Description of Artificial Sequence: Synthetic oligonucleotide
gcgggaattcaagaatcgat

SEQ ID NO: 14037 - DNA, 20 bp, Artificial Sequence
  Description of Artificial Sequence: Synthetic oligonucleotide
agcgggaattcaagaatcga

SEQ ID NO: 14038 - DNA, 20 bp, Artificial Sequence
  Description of Artificial Sequence: Synthetic oligonucleotide
cagcgggaattcaagaatcg

SEQ ID NO: 14039 - DNA, 20 bp, Artificial Sequence
  Description of Artificial Sequence: Synthetic oligonucleotide
gcagcgggaattcaagaatc

SEQ ID NO: 14040 - DNA, 20 bp, Artificial Sequence
  Description of Artificial Sequence: Synthetic oligonucleotide
tgcagcgggaattcaagaat

SEQ ID NO: 14041 - DNA, 20 bp, Artificial Sequence
  Description of Artificial Sequence: Synthetic oligonucleotide
ttgcagcgggaattcaagaa

SEQ ID NO: 14042 - DNA, 20 bp, Artificial Sequence
  Description of Artificial Sequence: Synthetic oligonucleotide
cttgcagcgggaattcaaga

SEQ ID NO: 14043 - DNA, 20 bp, Artificial Sequence
  Description of Artificial Sequence: Synthetic oligonucleotide
gcttgcagcgggaattcaag

SEQ ID NO: 14044 - DNA, 20 bp, Artificial Sequence
  Description of Artificial Sequence: Synthetic oligonucleotide
agcttgcagcgggaattcaa

SEQ ID NO: 14045 - DNA, 20 bp, Artificial Sequence
  Description of Artificial Sequence: Synthetic oligonucleotide
tagcttgcagcgggaattca

SEQ ID NO: 14046 - DNA, 20 bp, Artificial Sequence
  Description of Artificial Sequence: Synthetic oligonucleotide
ctagcttgcagcgggaattc

SEQ ID NO: 14047 - DNA, 20 bp, Artificial Sequence
  Description of Artificial Sequence: Synthetic oligonucleotide
tctagcttgcagcgggaatt

SEQ ID NO: 14048 - DNA, 20 bp, Artificial Sequence
  Description of Artificial Sequence: Synthetic oligonucleotide
ctctagcttgcagcgggaat

SEQ ID NO: 14049 - DNA, 20 bp, Artificial Sequence
  Description of Artificial Sequence: Synthetic oligonucleotide
gctctagcttgcagcgggaa

SEQ ID NO: 14050 - DNA, 20 bp, Artificial Sequence
  Description of Artificial Sequence: Synthetic oligonucleotide
ggctctagcttgcagcggga

SEQ ID NO: 14051 - DNA, 20 bp, Artificial Sequence
  Description of Artificial Sequence: Synthetic oligonucleotide
cggctctagcttgcagcggg

SEQ ID NO: 14052 - DNA, 20 bp, Artificial Sequence
  Description of Artificial Sequence: Synthetic oligonucleotide
gcggctctagcttgcagcgg

SEQ ID NO: 14053 - DNA, 20 bp, Artificial Sequence
  Description of Artificial Sequence: Synthetic oligonucleotide
tgcggctctagcttgcagcg

SEQ ID NO: 14054 - DNA, 20 bp, Artificial Sequence
  Description of Artificial Sequence: Synthetic oligonucleotide
ctgcggctctagcttgcagc

SEQ ID NO: 14055 - DNA, 20 bp, Artificial Sequence
  Description of Artificial Sequence: Synthetic oligonucleotide
cctgcggctctagcttgcag

SEQ ID NO: 14056 - DNA, 20 bp, Artificial Sequence
  Description of Artificial Sequence: Synthetic oligonucleotide
gcctgcggctctagcttgca

SEQ ID NO: 14057 - DNA, 20 bp, Artificial Sequence
  Description of Artificial Sequence: Synthetic oligonucleotide
tgcctgcggctctagcttgc

SEQ ID NO: 14058 - DNA, 20 bp, Artificial Sequence
  Description of Artificial Sequence: Synthetic oligonucleotide
gtgcctgcggctctagcttg

SEQ ID NO: 14059 - DNA, 20 bp, Artificial Sequence
  Description of Artificial Sequence: Synthetic oligonucleotide
ggtgcctgcggctctagctt

SEQ ID NO: 14060 - DNA, 20 bp, Artificial Sequence
  Description of Artificial Sequence: Synthetic oligonucleotide
gggtgcctgcggctctagct

SEQ ID NO: 14061 - DNA, 20 bp, Artificial Sequence
  Description of Artificial Sequence: Synthetic oligonucleotide
agggtgcctgcggctctagc

SEQ ID NO: 14062 - DNA, 20 bp, Artificial Sequence
  Description of Artificial Sequence: Synthetic oligonucleotide
gagggtgcctgcggctctag

SEQ ID NO: 14063 - DNA, 20 bp, Artificial Sequence
  Description of Artificial Sequence: Synthetic oligonucleotide
agagggtgcctgcggctcta

SEQ ID NO: 14064 - DNA, 20 bp, Artificial Sequence
  Description of Artificial Sequence: Synthetic oligonucleotide
gagagggtgcctgcggctct

SEQ ID NO: 14065 - DNA, 20 bp, Artificial Sequence
  Description of Artificial Sequence: Synthetic oligonucleotide
tgagagggtgcctgcggctc

SEQ ID NO: 14066 - DNA, 20 bp, Artificial Sequence
  Description of Artificial Sequence: Synthetic oligonucleotide
gtgagagggtgcctgcggct

SEQ ID NO: 14067 - DNA, 20 bp, Artificial Sequence
  Description of Artificial Sequence: Synthetic oligonucleotide
agtgagagggtgcctgcggc

SEQ ID NO: 14068 - DNA, 20 bp, Artificial Sequence
  Description of Artificial Sequence: Synthetic oligonucleotide
gagtgagagggtgcctgcgg

SEQ ID NO: 14069 - DNA, 20 bp, Artificial Sequence
  Description of Artificial Sequence: Synthetic oligonucleotide
tgagtgagagggtgcctgcg

SEQ ID NO: 14070 - DNA, 20 bp, Artificial Sequence
  Description of Artificial Sequence: Synthetic oligonucleotide
ttgagtgagagggtgcctgc

SEQ ID NO: 14071 - DNA, 20 bp, Artificial Sequence
  Description of Artificial Sequence: Synthetic oligonucleotide
attgagtgagagggtgcctg

SEQ ID NO: 14072 - DNA, 20 bp, Artificial Sequence
  Description of Artificial Sequence: Synthetic oligonucleotide
aattgagtgagagggtgcct

SEQ ID NO: 14073 - DNA, 20 bp, Artificial Sequence
  Description of Artificial Sequence: Synthetic oligonucleotide
aaattgagtgagagggtgcc

SEQ ID NO: 14074 - DNA, 20 bp, Artificial Sequence
  Description of Artificial Sequence: Synthetic oligonucleotide
gaaattgagtgagagggtgc

SEQ ID NO: 14075 - DNA, 20 bp, Artificial Sequence
  Description of Artificial Sequence: Synthetic oligonucleotide
ggaaattgagtgagagggtg

SEQ ID NO: 14076 - DNA, 20 bp, Artificial Sequence
  Description of Artificial Sequence: Synthetic oligonucleotide
tggaaattgagtgagagggt

SEQ ID NO: 14077 - DNA, 20 bp, Artificial Sequence
  Description of Artificial Sequence: Synthetic oligonucleotide
gtggaaattgagtgagaggg

SEQ ID NO: 14078 - DNA, 20 bp, Artificial Sequence
  Description of Artificial Sequence: Synthetic oligonucleotide
agtggaaattgagtgagagg

SEQ ID NO: 14079 - DNA, 20 bp, Artificial Sequence
  Description of Artificial Sequence: Synthetic oligonucleotide
gagtggaaattgagtgagag

SEQ ID NO: 14080 - DNA, 20 bp, Artificial Sequence
  Description of Artificial Sequence: Synthetic oligonucleotide
tgagtggaaattgagtgaga

SEQ ID NO: 14081 - DNA, 20 bp, Artificial Sequence
  Description of Artificial Sequence: Synthetic oligonucleotide
ctgagtggaaattgagtgag

SEQ ID NO: 14082 - DNA, 20 bp, Artificial Sequence
  Description of Artificial Sequence: Synthetic oligonucleotide
tctgagtggaaattgagtga

SEQ ID NO: 14083 - DNA, 20 bp, Artificial Sequence
  Description of Artificial Sequence: Synthetic oligonucleotide
ttctgagtggaaattgagtg

SEQ ID NO: 14084 - DNA, 20 bp, Artificial Sequence
  Description of Artificial Sequence: Synthetic oligonucleotide
gttctgagtggaaattgagt

SEQ ID NO: 14085 - DNA, 20 bp, Artificial Sequence
  Description of Artificial Sequence: Synthetic oligonucleotide
ggttctgagtggaaattgag

SEQ ID NO: 14086 - DNA, 20 bp, Artificial Sequence
  Description of Artificial Sequence: Synthetic oligonucleotide
gggttctgagtggaaattga

SEQ ID NO: 14087 - DNA, 20 bp, Artificial Sequence
  Description of Artificial Sequence: Synthetic oligonucleotide
agggttctgagtggaaattg

SEQ ID NO: 14088 - DNA, 20 bp, Artificial Sequence
  Description of Artificial Sequence: Synthetic oligonucleotide
tagggttctgagtggaaatt

SEQ ID NO: 14089 - DNA, 20 bp, Artificial Sequence
  Description of Artificial Sequence: Synthetic oligonucleotide
atagggttctgagtggaaat

SEQ ID NO: 14090 - DNA, 20 bp, Artificial Sequence
  Description of Artificial Sequence: Synthetic oligonucleotide
tatagggttctgagtggaaa

SEQ ID NO: 14091 - DNA, 20 bp, Artificial Sequence
  Description of Artificial Sequence: Synthetic oligonucleotide
ttatagggttctgagtggaa

SEQ ID NO: 14092 - DNA, 20 bp, Artificial Sequence
  Description of Artificial Sequence: Synthetic oligonucleotide
tttatagggttctgagtgga

SEQ ID NO: 14093 - DNA, 20 bp, Artificial Sequence
  Description of Artificial Sequence: Synthetic oligonucleotide
gtttatagggttctgagtgg

SEQ ID NO: 14094 - DNA, 20 bp, Artificial Sequence
  Description of Artificial Sequence: Synthetic oligonucleotide
tgtttatagggttctgagtg

SEQ ID NO: 14095 - DNA, 20 bp, Artificial Sequence
  Description of Artificial Sequence: Synthetic oligonucleotide
gtgtttatagggttctgagt

SEQ ID NO: 14096 - DNA, 20 bp, Artificial Sequence
  Description of Artificial Sequence: Synthetic oligonucleotide
ggtgtttatagggttctgag

SEQ ID NO: 14097 - DNA, 20 bp, Artificial Sequence
  Description of Artificial Sequence: Synthetic oligonucleotide
tggtgtttatagggttctga

SEQ ID NO: 14098 - DNA, 20 bp, Artificial Sequence
  Description of Artificial Sequence: Synthetic oligonucleotide
ctggtgtttatagggttctg

SEQ ID NO: 14099 - DNA, 20 bp, Artificial Sequence
  Description of Artificial Sequence: Synthetic oligonucleotide
actggtgtttatagggttct

SEQ ID NO: 14100 - DNA, 20 bp, Artificial Sequence
  Description of Artificial Sequence: Synthetic oligonucleotide
cactggtgtttatagggttc

SEQ ID NO: 14101 - DNA, 20 bp, Artificial Sequence
  Description of Artificial Sequence: Synthetic oligonucleotide
ccactggtgtttatagggtt

SEQ ID NO: 14102 - DNA, 20 bp, Artificial Sequence
  Description of Artificial Sequence: Synthetic oligonucleotide
cccactggtgtttatagggt

SEQ ID NO: 14103 - DNA, 20 bp, Artificial Sequence
  Description of Artificial Sequence: Synthetic oligonucleotide
tcccactggtgtttataggg

SEQ ID NO: 14104 - DNA, 20 bp, Artificial Sequence
  Description of Artificial Sequence: Synthetic oligonucleotide
ttcccactggtgtttatagg

SEQ ID NO: 14105 - DNA, 20 bp, Artificial Sequence
  Description of Artificial Sequence: Synthetic oligonucleotide
cttcccactggtgtttatag

SEQ ID NO: 14106 - DNA, 20 bp, Artificial Sequence
  Description of Artificial Sequence: Synthetic oligonucleotide
ccttcccactggtgtttata

SEQ ID NO: 14107 - DNA, 20 bp, Artificial Sequence
  Description of Artificial Sequence: Synthetic oligonucleotide
cccttcccactggtgtttat

SEQ ID NO: 14108 - DNA, 20 bp, Artificial Sequence
  Description of Artificial Sequence: Synthetic oligonucleotide
gcccttcccactggtgttta

SEQ ID NO: 14109 - DNA, 20 bp, Artificial Sequence
  Description of Artificial Sequence: Synthetic oligonucleotide
tgcccttcccactggtgttt

SEQ ID NO: 14110 - DNA, 20 bp, Artificial Sequence
  Description of Artificial Sequence: Synthetic oligonucleotide
ttgcccttcccactggtgtt

SEQ ID NO: 14111 - DNA, 20 bp, Artificial Sequence
  Description of Artificial Sequence: Synthetic oligonucleotide
gttgcccttcccactggtgt

SEQ ID NO: 14112 - DNA, 20 bp, Artificial Sequence
  Description of Artificial Sequence: Synthetic oligonucleotide
ggttgcccttcccactggtg

SEQ ID NO: 14113 - DNA, 20 bp, Artificial Sequence
  Description of Artificial Sequence: Synthetic oligonucleotide
gggttgcccttcccactggt

SEQ ID NO: 14114 - DNA, 20 bp, Artificial Sequence
  Description of Artificial Sequence: Synthetic oligonucleotide
tgggttgcccttcccactgg

SEQ ID NO: 14115 - DNA, 20 bp, Artificial Sequence
  Description of Artificial Sequence: Synthetic oligonucleotide
gtgggttgcccttcccactg

SEQ ID NO: 14116 - DNA, 20 bp, Artificial Sequence
  Description of Artificial Sequence: Synthetic oligonucleotide
agtgggttgcccttcccact

SEQ ID NO: 14117 - DNA, 20 bp, Artificial Sequence
  Description of Artificial Sequence: Synthetic oligonucleotide
cagtgggttgcccttcccac

SEQ ID NO: 14118 - DNA, 20 bp, Artificial Sequence
  Description of Artificial Sequence: Synthetic oligonucleotide
gcagtgggttgcccttccca

SEQ ID NO: 14119 - DNA, 20 bp, Artificial Sequence
  Description of Artificial Sequence: Synthetic oligonucleotide
tgcagtgggttgcccttccc

SEQ ID NO: 14120 - DNA, 20 bp, Artificial Sequence
  Description of Artificial Sequence: Synthetic oligonucleotide
gtgcagtgggttgcccttcc

SEQ ID NO: 14121 - DNA, 20 bp, Artificial Sequence
  Description of Artificial Sequence: Synthetic oligonucleotide
cgtgcagtgggttgcccttc

SEQ ID NO: 14122 - DNA, 20 bp, Artificial Sequence
  Description of Artificial Sequence: Synthetic oligonucleotide
acgtgcagtgggttgccctt

SEQ ID NO: 14123 - DNA, 20 bp, Artificial Sequence
  Description of Artificial Sequence: Synthetic oligonucleotide
cacgtgcagtgggttgccct

SEQ ID NO: 14124 - DNA, 20 bp, Artificial Sequence
  Description of Artificial Sequence: Synthetic oligonucleotide
ccacgtgcagtgggttgccc

SEQ ID NO: 14125 - DNA, 20 bp, Artificial Sequence
  Description of Artificial Sequence: Synthetic oligonucleotide
cccacgtgcagtgggttgcc

SEQ ID NO: 14126 - DNA, 20 bp, Artificial Sequence
  Description of Artificial Sequence: Synthetic oligonucleotide
tcccacgtgcagtgggttgc

SEQ ID NO: 14127 - DNA, 20 bp, Artificial Sequence
  Description of Artificial Sequence: Synthetic oligonucleotide
ttcccacgtgcagtgggttg

SEQ ID NO: 14128 - DNA, 20 bp, Artificial Sequence
  Description of Artificial Sequence: Synthetic oligonucleotide
attcccacgtgcagtgggtt

SEQ ID NO: 14129 - DNA, 20 bp, Artificial Sequence
  Description of Artificial Sequence: Synthetic oligonucleotide
cattcccacgtgcagtgggt

SEQ ID NO: 14130 - DNA, 20 bp, Artificial Sequence
  Description of Artificial Sequence: Synthetic oligonucleotide
gcattcccacgtgcagtggg

SEQ ID NO: 14131 - DNA, 20 bp, Artificial Sequence
  Description of Artificial Sequence: Synthetic oligonucleotide
tgcattcccacgtgcagtgg

SEQ ID NO: 14132 - DNA, 20 bp, Artificial Sequence
  Description of Artificial Sequence: Synthetic oligonucleotide
gtgcattcccacgtgcagtg

SEQ ID NO: 14133 - DNA, 20 bp, Artificial Sequence
  Description of Artificial Sequence: Synthetic oligonucleotide
agtgcattcccacgtgcagt

SEQ ID NO: 14134 - DNA, 20 bp, Artificial Sequence
  Description of Artificial Sequence: Synthetic oligonucleotide
cagtgcattcccacgtgcag

SEQ ID NO: 14135 - DNA, 20 bp, Artificial Sequence
  Description of Artificial Sequence: Synthetic oligonucleotide
tcagtgcattcccacgtgca

SEQ ID NO: 14136 - DNA, 20 bp, Artificial Sequence
  Description of Artificial Sequence: Synthetic oligonucleotide
atcagtgcattcccacgtgc

SEQ ID NO: 14137 - DNA, 20 bp, Artificial Sequence
  Description of Artificial Sequence: Synthetic oligonucleotide
aatcagtgcattcccacgtg

SEQ ID NO: 14138 - DNA, 20 bp, Artificial Sequence
  Description of Artificial Sequence: Synthetic oligonucleotide
aaatcagtgcattcccacgt

SEQ ID NO: 14139 - DNA, 20 bp, Artificial Sequence
  Description of Artificial Sequence: Synthetic oligonucleotide
aaaatcagtgcattcccacg

SEQ ID NO: 14140 - DNA, 20 bp, Artificial Sequence
  Description of Artificial Sequence: Synthetic oligonucleotide
aaaaatcagtgcattcccac

SEQ ID NO: 14141 - DNA, 20 bp, Artificial Sequence
  Description of Artificial Sequence: Synthetic oligonucleotide
gaaaaatcagtgcattccca

SEQ ID NO: 14142 - DNA, 20 bp, Artificial Sequence
  Description of Artificial Sequence: Synthetic oligonucleotide
ggaaaaatcagtgcattccc

SEQ ID NO: 14143 - DNA, 20 bp, Artificial Sequence
  Description of Artificial Sequence: Synthetic oligonucleotide
aggaaaaatcagtgcattcc

SEQ ID NO: 14144 - DNA, 20 bp, Artificial Sequence
  Description of Artificial Sequence: Synthetic oligonucleotide
taggaaaaatcagtgcattc

SEQ ID NO: 14145 - DNA, 20 bp, Artificial Sequence
  Description of Artificial Sequence: Synthetic oligonucleotide
ctaggaaaaatcagtgcatt

SEQ ID NO: 14146 - DNA, 20 bp, Artificial Sequence
  Description of Artificial Sequence: Synthetic oligonucleotide
cctaggaaaaatcagtgcat

SEQ ID NO: 14147 - DNA, 20 bp, Artificial Sequence
  Description of Artificial Sequence: Synthetic oligonucleotide
tcctaggaaaaatcagtgca

SEQ ID NO: 14148 - DNA, 20 bp, Artificial Sequence
  Description of Artificial Sequence: Synthetic oligonucleotide
ctcctaggaaaaatcagtgc

SEQ ID NO: 14149 - DNA, 20 bp, Artificial Sequence
  Description of Artificial Sequence: Synthetic oligonucleotide
actcctaggaaaaatcagtg

SEQ ID NO: 14150 - DNA, 20 bp, Artificial Sequence
  Description of Artificial Sequence: Synthetic oligonucleotide
tactcctaggaaaaatcagt

SEQ ID NO: 14151 - DNA, 20 bp, Artificial Sequence
  Description of Artificial Sequence: Synthetic oligonucleotide
ctactcctaggaaaaatcag

SEQ ID NO: 14152 - DNA, 20 bp, Artificial Sequence
  Description of Artificial Sequence: Synthetic oligonucleotide
tctactcctaggaaaaatca

SEQ ID NO: 14153 - DNA, 20 bp, Artificial Sequence
  Description of Artificial Sequence: Synthetic oligonucleotide
gtctactcctaggaaaaatc

SEQ ID NO: 14154 - DNA, 20 bp, Artificial Sequence
  Description of Artificial Sequence: Synthetic oligonucleotide
tgtctactcctaggaaaaat

SEQ ID NO: 14155 - DNA, 20 bp, Artificial Sequence
  Description of Artificial Sequence: Synthetic oligonucleotide
atgtctactcctaggaaaaa

SEQ ID NO: 14156 - DNA, 20 bp, Artificial Sequence
  Description of Artificial Sequence: Synthetic oligonucleotide
catgtctactcctaggaaaa

SEQ ID NO: 14157 - DNA, 20 bp, Artificial Sequence
  Description of Artificial Sequence: Synthetic oligonucleotide
acatgtctactcctaggaaa

SEQ ID NO: 14158 - DNA, 20 bp, Artificial Sequence
  Description of Artificial Sequence: Synthetic oligonucleotide
aacatgtctactcctaggaa

SEQ ID NO: 14159 - DNA, 20 bp, Artificial Sequence
  Description of Artificial Sequence: Synthetic oligonucleotide
gaacatgtctactcctagga

SEQ ID NO: 14160 - DNA, 20 bp, Artificial Sequence
  Description of Artificial Sequence: Synthetic oligonucleotide
ggaacatgtctactcctagg

SEQ ID NO: 14161 - DNA, 20 bp, Artificial Sequence
  Description of Artificial Sequence: Synthetic oligonucleotide
aggaacatgtctactcctag

SEQ ID NO: 14162 - DNA, 20 bp, Artificial Sequence
  Description of Artificial Sequence: Synthetic oligonucleotide
gaggaacatgtctactccta

SEQ ID NO: 14163 - DNA, 20 bp, Artificial Sequence
  Description of Artificial Sequence: Synthetic oligonucleotide
agaggaacatgtctactcct

SEQ ID NO: 14164 - DNA, 20 bp, Artificial Sequence
  Description of Artificial Sequence: Synthetic oligonucleotide
tagaggaacatgtctactcc

SEQ ID NO: 14165 - DNA, 20 bp, Artificial Sequence
  Description of Artificial Sequence: Synthetic oligonucleotide
ttagaggaacatgtctactc

SEQ ID NO: 14166 - DNA, 20 bp, Artificial Sequence
  Description of Artificial Sequence: Synthetic oligonucleotide
attagaggaacatgtctact

SEQ ID NO: 14167 - DNA, 20 bp, Artificial Sequence
  Description of Artificial Sequence: Synthetic oligonucleotide
aattagaggaacatgtctac

SEQ ID NO: 14168 - DNA, 20 bp, Artificial Sequence
  Description of Artificial Sequence: Synthetic oligonucleotide
taattagaggaacatgtcta

SEQ ID NO: 14169 - DNA, 20 bp, Artificial Sequence
  Description of Artificial Sequence: Synthetic oligonucleotide
gtaattagaggaacatgtct

SEQ ID NO: 14170 - DNA, 20 bp, Artificial Sequence
  Description of Artificial Sequence: Synthetic oligonucleotide
agtaattagaggaacatgtc

SEQ ID NO: 14171 - DNA, 20 bp, Artificial Sequence
  Description of Artificial Sequence: Synthetic oligonucleotide
gagtaattagaggaacatgt

SEQ ID NO: 14172 - DNA, 20 bp, Artificial Sequence
  Description of Artificial Sequence: Synthetic oligonucleotide
ggagtaattagaggaacatg

SEQ ID NO: 14173 - DNA, 20 bp, Artificial Sequence
  Description of Artificial Sequence: Synthetic oligonucleotide
gggagtaattagaggaacat

SEQ ID NO: 14174 - DNA, 20 bp, Artificial Sequence
  Description of Artificial Sequence: Synthetic oligonucleotide
agggagtaattagaggaaca

SEQ ID NO: 14175 - DNA, 20 bp, Artificial Sequence
  Description of Artificial Sequence: Synthetic oligonucleotide
cagggagtaattagaggaac

SEQ ID NO: 14176 - DNA, 20 bp, Artificial Sequence
  Description of Artificial Sequence: Synthetic oligonucleotide
tcagggagtaattagaggaa

SEQ ID NO: 14177 - DNA, 20 bp, Artificial Sequence
  Description of Artificial Sequence: Synthetic oligonucleotide
ctcagggagtaattagagga

SEQ ID NO: 14178 - DNA, 20 bp, Artificial Sequence
  Description of Artificial Sequence: Synthetic oligonucleotide
cctcagggagtaattagagg

SEQ ID NO: 14179 - DNA, 20 bp, Artificial Sequence
  Description of Artificial Sequence: Synthetic oligonucleotide
ccctcagggagtaattagag

SEQ ID NO: 14180 - DNA, 20 bp, Artificial Sequence
  Description of Artificial Sequence: Synthetic oligonucleotide
accctcagggagtaattaga

SEQ ID NO: 14181 - DNA, 20 bp, Artificial Sequence
  Description of Artificial Sequence: Synthetic oligonucleotide
aaccctcagggagtaattag

SEQ ID NO: 14182 - DNA, 20 bp, Artificial Sequence
  Description of Artificial Sequence: Synthetic oligonucleotide
taaccctcagggagtaatta

SEQ ID NO: 14183 - DNA, 20 bp, Artificial Sequence
  Description of Artificial Sequence: Synthetic oligonucleotide
ctaaccctcagggagtaatt

SEQ ID NO: 14184 - DNA, 20 bp, Artificial Sequence
  Description of Artificial Sequence: Synthetic oligonucleotide
actaaccctcagggagtaat

SEQ ID NO: 14185 - DNA, 20 bp, Artificial Sequence
  Description of Artificial Sequence: Synthetic oligonucleotide
aactaaccctcagggagtaa

SEQ ID NO: 14186 - DNA, 20 bp, Artificial Sequence
  Description of Artificial Sequence: Synthetic oligonucleotide
caactaaccctcagggagta

SEQ ID NO: 14187 - DNA, 20 bp, Artificial Sequence
  Description of Artificial Sequence: Synthetic oligonucleotide
ccaactaaccctcagggagt

SEQ ID NO: 14188 - DNA, 20 bp, Artificial Sequence
  Description of Artificial Sequence: Synthetic oligonucleotide
cccaactaaccctcagggag

SEQ ID NO: 14189 - DNA, 20 bp, Artificial Sequence
  Description of Artificial Sequence: Synthetic oligonucleotide
ccccaactaaccctcaggga

SEQ ID NO: 14190 - DNA, 20 bp, Artificial Sequence
  Description of Artificial Sequence: Synthetic oligonucleotide
gccccaactaaccctcaggg

SEQ ID NO: 14191 - DNA, 20 bp, Artificial Sequence
  Description of Artificial Sequence: Synthetic oligonucleotide
agccccaactaaccctcagg

SEQ ID NO: 14192 - DNA, 20 bp, Artificial Sequence
  Description of Artificial Sequence: Synthetic oligonucleotide
tagccccaactaaccctcag

SEQ ID NO: 14193 - DNA, 20 bp, Artificial Sequence
  Description of Artificial Sequence: Synthetic oligonucleotide
ttagccccaactaaccctca

SEQ ID NO: 14194 - DNA, 20 bp, Artificial Sequence
  Description of Artificial Sequence: Synthetic oligonucleotide
tttagccccaactaaccctc

SEQ ID NO: 14195 - DNA, 20 bp, Artificial Sequence
  Description of Artificial Sequence: Synthetic oligonucleotide
gtttagccccaactaaccct

SEQ ID NO: 14196 - DNA, 20 bp, Artificial Sequence
  Description of Artificial Sequence: Synthetic oligonucleotide
ggtttagccccaactaaccc

SEQ ID NO: 14197 - DNA, 20 bp, Artificial Sequence
  Description of Artificial Sequence: Synthetic oligonucleotide
tggtttagccccaactaacc

SEQ ID NO: 14198 - DNA, 20 bp, Artificial Sequence
  Description of Artificial Sequence: Synthetic oligonucleotide
atggtttagccccaactaac

SEQ ID NO: 14199 - DNA, 20 bp, Artificial Sequence
  Description of Artificial Sequence: Synthetic oligonucleotide
catggtttagccccaactaa

SEQ ID NO: 14200 - DNA, 20 bp, Artificial Sequence
  Description of Artificial Sequence: Synthetic oligonucleotide
tcatggtttagccccaacta

SEQ ID NO: 14201 - DNA, 20 bp, Artificial Sequence
  Description of Artificial Sequence: Synthetic oligonucleotide
gtcatggtttagccccaact

SEQ ID NO: 14202 - DNA, 20 bp, Artificial Sequence
  Description of Artificial Sequence: Synthetic oligonucleotide
tgtcatggtttagccccaac

SEQ ID NO: 14203 - DNA, 20 bp, Artificial Sequence
  Description of Artificial Sequence: Synthetic oligonucleotide
ctgtcatggtttagccccaa

SEQ ID NO: 14204 - DNA, 20 bp, Artificial Sequence
  Description of Artificial Sequence: Synthetic oligonucleotide
tctgtcatggtttagcccca

SEQ ID NO: 14205 - DNA, 20 bp, Artificial Sequence
  Description of Artificial Sequence: Synthetic oligonucleotide
ttctgtcatggtttagcccc

SEQ ID NO: 14206 - DNA, 20 bp, Artificial Sequence
  Description of Artificial Sequence: Synthetic oligonucleotide
cttctgtcatggtttagccc

SEQ ID NO: 14207 - DNA, 20 bp, Artificial Sequence
  Description of Artificial Sequence: Synthetic oligonucleotide
acttctgtcatggtttagcc

SEQ ID NO: 14208 - DNA, 20 bp, Artificial Sequence
  Description of Artificial Sequence: Synthetic oligonucleotide
cacttctgtcatggtttagc

SEQ ID NO: 14209 - DNA, 20 bp, Artificial Sequence
  Description of Artificial Sequence: Synthetic oligonucleotide
ccacttctgtcatggtttag

SEQ ID NO: 14210 - DNA, 20 bp, Artificial Sequence
  Description of Artificial Sequence: Synthetic oligonucleotide
cccacttctgtcatggttta

SEQ ID NO: 14211 - DNA, 20 bp, Artificial Sequence
  Description of Artificial Sequence: Synthetic oligonucleotide
ccccacttctgtcatggttt

SEQ ID NO: 14212 - DNA, 20 bp, Artificial Sequence
  Description of Artificial Sequence: Synthetic oligonucleotide
tccccacttctgtcatggtt

SEQ ID NO: 14213 - DNA, 20 bp, Artificial Sequence
  Description of Artificial Sequence: Synthetic oligonucleotide
ttccccacttctgtcatggt

SEQ ID NO: 14214 - DNA, 20 bp, Artificial Sequence
  Description of Artificial Sequence: Synthetic oligonucleotide
cttccccacttctgtcatgg

SEQ ID NO: 14215 - DNA, 20 bp, Artificial Sequence
  Description of Artificial Sequence: Synthetic oligonucleotide
acttccccacttctgtcatg

SEQ ID NO: 14216 - DNA, 20 bp, Artificial Sequence
  Description of Artificial Sequence: Synthetic oligonucleotide
aacttccccacttctgtcat

SEQ ID NO: 14217 - DNA, 20 bp, Artificial Sequence
  Description of Artificial Sequence: Synthetic oligonucleotide
gaacttccccacttctgtca

SEQ ID NO: 14218 - DNA, 20 bp, Artificial Sequence
  Description of Artificial Sequence: Synthetic oligonucleotide
tgaacttccccacttctgtc

SEQ ID NO: 14219 - DNA, 20 bp, Artificial Sequence
  Description of Artificial Sequence: Synthetic oligonucleotide
ttgaacttccccacttctgt

SEQ ID NO: 14220 - DNA, 20 bp, Artificial Sequence
  Description of Artificial Sequence: Synthetic oligonucleotide
attgaacttccccacttctg

SEQ ID NO: 14221 - DNA, 20 bp, Artificial Sequence
  Description of Artificial Sequence: Synthetic oligonucleotide
cattgaacttccccacttct

SEQ ID NO: 14222 - DNA, 20 bp, Artificial Sequence
  Description of Artificial Sequence: Synthetic oligonucleotide
acattgaacttccccacttc

SEQ ID NO: 14223 - DNA, 20 bp, Artificial Sequence
  Description of Artificial Sequence: Synthetic oligonucleotide
gacattgaacttccccactt

SEQ ID NO: 14224 - DNA, 20 bp, Artificial Sequence
  Description of Artificial Sequence: Synthetic oligonucleotide
ggacattgaacttccccact

SEQ ID NO: 14225 - DNA, 20 bp, Artificial Sequence
  Description of Artificial Sequence: Synthetic oligonucleotide
aggacattgaacttccccac

SEQ ID NO: 14226 - DNA, 20 bp, Artificial Sequence
  Description of Artificial Sequence: Synthetic oligonucleotide
aaggacattgaacttcccca

SEQ ID NO: 14227 - DNA, 20 bp, Artificial Sequence
  Description of Artificial Sequence: Synthetic oligonucleotide
taaggacattgaacttcccc

SEQ ID NO: 14228 - DNA, 20 bp, Artificial Sequence
  Description of Artificial Sequence: Synthetic oligonucleotide
ttaaggacattgaacttccc

SEQ ID NO: 14229 - DNA, 20 bp, Artificial Sequence
  Description of Artificial Sequence: Synthetic oligonucleotide
tttaaggacattgaacttcc

SEQ ID NO: 14230 - DNA, 20 bp, Artificial Sequence
  Description of Artificial Sequence: Synthetic oligonucleotide
atttaaggacattgaacttc

SEQ ID NO: 14231 - DNA, 20 bp, Artificial Sequence
  Description of Artificial Sequence: Synthetic oligonucleotide
gatttaaggacattgaactt

SEQ ID NO: 14232 - DNA, 20 bp, Artificial Sequence
  Description of Artificial Sequence: Synthetic oligonucleotide
ggatttaaggacattgaact

SEQ ID NO: 14233 - DNA, 20 bp, Artificial Sequence
  Description of Artificial Sequence: Synthetic oligonucleotide
tggatttaaggacattgaac

SEQ ID NO: 14234 - DNA, 20 bp, Artificial Sequence
  Description of Artificial Sequence: Synthetic oligonucleotide
atggatttaaggacattgaa

SEQ ID NO: 14235 - DNA, 20 bp, Artificial Sequence
  Description of Artificial Sequence: Synthetic oligonucleotide
gatggatttaaggacattga

SEQ ID NO: 14236 - DNA, 20 bp, Artificial Sequence
  Description of Artificial Sequence: Synthetic oligonucleotide
agatggatttaaggacattg

SEQ ID NO: 14237 - DNA, 20 bp, Artificial Sequence
  Description of Artificial Sequence: Synthetic oligonucleotide
aagatggatttaaggacatt

SEQ ID NO: 14238 - DNA, 20 bp, Artificial Sequence
  Description of Artificial Sequence: Synthetic oligonucleotide
taagatggatttaaggacat

SEQ ID NO: 14239 - DNA, 20 bp, Artificial Sequence
  Description of Artificial Sequence: Synthetic oligonucleotide
gtaagatggatttaaggaca

SEQ ID NO: 14240 - DNA, 20 bp, Artificial Sequence
  Description of Artificial Sequence: Synthetic oligonucleotide
agtaagatggatttaaggac

SEQ ID NO: 14241 - DNA, 20 bp, Artificial Sequence
  Description of Artificial Sequence: Synthetic oligonucleotide
aagtaagatggatttaagga

SEQ ID NO: 14242 - DNA, 20 bp, Artificial Sequence
  Description of Artificial Sequence: Synthetic oligonucleotide
caagtaagatggatttaagg

SEQ ID NO: 14243 - DNA, 20 bp, Artificial Sequence
  Description of Artificial Sequence: Synthetic oligonucleotide
gcaagtaagatggatttaag

SEQ ID NO: 14244 - DNA, 20 bp, Artificial Sequence
  Description of Artificial Sequence: Synthetic oligonucleotide
ggcaagtaagatggatttaa

SEQ ID NO: 14245 - DNA, 20 bp, Artificial Sequence
  Description of Artificial Sequence: Synthetic oligonucleotide
tggcaagtaagatggattta

SEQ ID NO: 14246 - DNA, 20 bp, Artificial Sequence
  Description of Artificial Sequence: Synthetic oligonucleotide
ttggcaagtaagatggattt

SEQ ID NO: 14247 - DNA, 20 bp, Artificial Sequence
  Description of Artificial Sequence: Synthetic oligonucleotide
gttggcaagtaagatggatt

SEQ ID NO: 14248 - DNA, 20 bp, Artificial Sequence
  Description of Artificial Sequence: Synthetic oligonucleotide
tgttggcaagtaagatggat

SEQ ID NO: 14249 - DNA, 20 bp, Artificial Sequence
  Description of Artificial Sequence: Synthetic oligonucleotide
ctgttggcaagtaagatgga

SEQ ID NO: 14250 - DNA, 20 bp, Artificial Sequence
  Description of Artificial Sequence: Synthetic oligonucleotide
cctgttggcaagtaagatgg

SEQ ID NO: 14251 - DNA, 20 bp, Artificial Sequence
  Description of Artificial Sequence: Synthetic oligonucleotide
acctgttggcaagtaagatg

SEQ ID NO: 14252 - DNA, 20 bp, Artificial Sequence
  Description of Artificial Sequence: Synthetic oligonucleotide
tacctgttggcaagtaagat

SEQ ID NO: 14253 - DNA, 20 bp, Artificial Sequence
  Description of Artificial Sequence: Synthetic oligonucleotide
ttacctgttggcaagtaaga

SEQ ID NO: 14254 - DNA, 20 bp, Artificial Sequence
  Description of Artificial Sequence: Synthetic oligonucleotide
cttacctgttggcaagtaag

SEQ ID NO: 14255 - DNA, 20 bp, Artificial Sequence
  Description of Artificial Sequence: Synthetic oligonucleotide
tcttacctgttggcaagtaa

SEQ ID NO: 14256 - DNA, 20 bp, Artificial Sequence
  Description of Artificial Sequence: Synthetic oligonucleotide
ctcttacctgttggcaagta

SEQ ID NO: 14257 - DNA, 20 bp, Artificial Sequence
  Description of Artificial Sequence: Synthetic oligonucleotide
cctcttacctgttggcaagt

SEQ ID NO: 14258 - DNA, 20 bp, Artificial Sequence
  Description of Artificial Sequence: Synthetic oligonucleotide
tcctcttacctgttggcaag

SEQ ID NO: 14259 - DNA, 20 bp, Artificial Sequence
  Description of Artificial Sequence: Synthetic oligonucleotide
ttcctcttacctgttggcaa

SEQ ID NO: 14260 - DNA, 20 bp, Artificial Sequence
  Description of Artificial Sequence: Synthetic oligonucleotide
cttcctcttacctgttggca

SEQ ID NO: 14261 - DNA, 20 bp, Artificial Sequence
  Description of Artificial Sequence: Synthetic oligonucleotide
gcttcctcttacctgttggc

SEQ ID NO: 14262 - DNA, 20 bp, Artificial Sequence
  Description of Artificial Sequence: Synthetic oligonucleotide
agcttcctcttacctgttgg

SEQ ID NO: 14263 - DNA, 20 bp, Artificial Sequence
  Description of Artificial Sequence: Synthetic oligonucleotide
aagcttcctcttacctgttg

SEQ ID NO: 14264 - DNA, 20 bp, Artificial Sequence
  Description of Artificial Sequence: Synthetic oligonucleotide
taagcttcctcttacctgtt

SEQ ID NO: 14265 - DNA, 20 bp, Artificial Sequence
  Description of Artificial Sequence: Synthetic oligonucleotide
gtaagcttcctcttacctgt

SEQ ID NO: 14266 - DNA, 20 bp, Artificial Sequence
  Description of Artificial Sequence: Synthetic oligonucleotide
tgtaagcttcctcttacctg

SEQ ID NO: 14267 - DNA, 20 bp, Artificial Sequence
  Description of Artificial Sequence: Synthetic oligonucleotide
atgtaagcttcctcttacct

SEQ ID NO: 14268 - DNA, 20 bp, Artificial Sequence
  Description of Artificial Sequence: Synthetic oligonucleotide
aatgtaagcttcctcttacc

SEQ ID NO: 14269 - DNA, 20 bp, Artificial Sequence
  Description of Artificial Sequence: Synthetic oligonucleotide
taatgtaagcttcctcttac

SEQ ID NO: 14270 - DNA, 20 bp, Artificial Sequence
  Description of Artificial Sequence: Synthetic oligonucleotide
gtaatgtaagcttcctctta

SEQ ID NO: 14271 - DNA, 20 bp, Artificial Sequence
  Description of Artificial Sequence: Synthetic oligonucleotide
tgtaatgtaagcttcctctt

SEQ ID NO: 14272 - DNA, 20 bp, Artificial Sequence
  Description of Artificial Sequence: Synthetic oligonucleotide
atgtaatgtaagcttcctct

SEQ ID NO: 14273 - DNA, 20 bp, Artificial Sequence
  Description of Artificial Sequence: Synthetic oligonucleotide
catgtaatgtaagcttcctc

SEQ ID NO: 14274 - DNA, 20 bp, Artificial Sequence
  Description of Artificial Sequence: Synthetic oligonucleotide
acatgtaatgtaagcttcct

SEQ ID NO: 14275 - DNA, 20 bp, Artificial Sequence
  Description of Artificial Sequence: Synthetic oligonucleotide
gacatgtaatgtaagcttcc

SEQ ID NO: 14276 - DNA, 20 bp, Artificial Sequence
  Description of Artificial Sequence: Synthetic oligonucleotide
ggacatgtaatgtaagcttc

SEQ ID NO: 14277 - DNA, 20 bp, Artificial Sequence
  Description of Artificial Sequence: Synthetic oligonucleotide
tggacatgtaatgtaagctt

SEQ ID NO: 14278 - DNA, 20 bp, Artificial Sequence
  Description of Artificial Sequence: Synthetic oligonucleotide
ctggacatgtaatgtaagct

SEQ ID NO: 14279 - DNA, 20 bp, Artificial Sequence
  Description of Artificial Sequence: Synthetic oligonucleotide
actggacatgtaatgtaagc

SEQ ID NO: 14280 - DNA, 20 bp, Artificial Sequence
  Description of Artificial Sequence: Synthetic oligonucleotide
gactggacatgtaatgtaag

SEQ ID NO: 14281 - DNA, 20 bp, Artificial Sequence
  Description of Artificial Sequence: Synthetic oligonucleotide
ggactggacatgtaatgtaa

SEQ ID NO: 14282 - DNA, 20 bp, Artificial Sequence
  Description of Artificial Sequence: Synthetic oligonucleotide
tggactggacatgtaatgta

SEQ ID NO: 14283 - DNA, 20 bp, Artificial Sequence
  Description of Artificial Sequence: Synthetic oligonucleotide
gtggactggacatgtaatgt

SEQ ID NO: 14284 - DNA, 20 bp, Artificial Sequence
  Description of Artificial Sequence: Synthetic oligonucleotide
tgtggactggacatgtaatg

SEQ ID NO: 14285 - DNA, 20 bp, Artificial Sequence
  Description of Artificial Sequence: Synthetic oligonucleotide
atgtggactggacatgtaat

SEQ ID NO: 14286 - DNA, 20 bp, Artificial Sequence
  Description of Artificial Sequence: Synthetic oligonucleotide
aatgtggactggacatgtaa

SEQ ID NO: 14287 - DNA, 20 bp, Artificial Sequence
  Description of Artificial Sequence: Synthetic oligonucleotide
aaatgtggactggacatgta

SEQ ID NO: 14288 - DNA, 20 bp, Artificial Sequence
  Description of Artificial Sequence: Synthetic oligonucleotide
taaatgtggactggacatgt

SEQ ID NO: 14289 - DNA, 20 bp, Artificial Sequence
  Description of Artificial Sequence: Synthetic oligonucleotide
ttaaatgtggactggacatg

SEQ ID NO: 14290 - DNA, 20 bp, Artificial Sequence
  Description of Artificial Sequence: Synthetic oligonucleotide
tttaaatgtggactggacat

SEQ ID NO: 14291 - DNA, 20 bp, Artificial Sequence
  Description of Artificial Sequence: Synthetic oligonucleotide
ctttaaatgtggactggaca

SEQ ID NO: 14292 - DNA, 20 bp, Artificial Sequence
  Description of Artificial Sequence: Synthetic oligonucleotide
tctttaaatgtggactggac

SEQ ID NO: 14293 - DNA, 20 bp, Artificial Sequence
  Description of Artificial Sequence: Synthetic oligonucleotide
ctctttaaatgtggactgga

SEQ ID NO: 14294 - DNA, 20 bp, Artificial Sequence
  Description of Artificial Sequence: Synthetic oligonucleotide
gctctttaaatgtggactgg

SEQ ID NO: 14295 - DNA, 20 bp, Artificial Sequence
  Description of Artificial Sequence: Synthetic oligonucleotide
tgctctttaaatgtggactg

SEQ ID NO: 14296 - DNA, 20 bp, Artificial Sequence
  Description of Artificial Sequence: Synthetic oligonucleotide
gtgctctttaaatgtggact

SEQ ID NO: 14297 - DNA, 20 bp, Artificial Sequence
  Description of Artificial Sequence: Synthetic oligonucleotide
agtgctctttaaatgtggac

SEQ ID NO: 14298 - DNA, 20 bp, Artificial Sequence
  Description of Artificial Sequence: Synthetic oligonucleotide
aagtgctctttaaatgtgga

SEQ ID NO: 14299 - DNA, 20 bp, Artificial Sequence
  Description of Artificial Sequence: Synthetic oligonucleotide
taagtgctctttaaatgtgg

SEQ ID NO: 14300 - DNA, 20 bp, Artificial Sequence
  Description of Artificial Sequence: Synthetic oligonucleotide
gtaagtgctctttaaatgtg

SEQ ID NO: 14301 - DNA, 20 bp, Artificial Sequence
  Description of Artificial Sequence: Synthetic oligonucleotide
agtaagtgctctttaaatgt

SEQ ID NO: 14302 - DNA, 20 bp, Artificial Sequence
  Description of Artificial Sequence: Synthetic oligonucleotide
cagtaagtgctctttaaatg

SEQ ID NO: 14303 - DNA, 20 bp, Artificial Sequence
  Description of Artificial Sequence: Synthetic oligonucleotide
acagtaagtgctctttaaat

SEQ ID NO: 14304 - DNA, 20 bp, Artificial Sequence
  Description of Artificial Sequence: Synthetic oligonucleotide
cacagtaagtgctctttaaa

SEQ ID NO: 14305 - DNA, 20 bp, Artificial Sequence
  Description of Artificial Sequence: Synthetic oligonucleotide
ccacagtaagtgctctttaa

SEQ ID NO: 14306 - DNA, 20 bp, Artificial Sequence
  Description of Artificial Sequence: Synthetic oligonucleotide
tccacagtaagtgctcttta

SEQ ID NO: 14307 - DNA, 20 bp, Artificial Sequence
  Description of Artificial Sequence: Synthetic oligonucleotide
ttccacagtaagtgctcttt

SEQ ID NO: 14308 - DNA, 20 bp, Artificial Sequence
  Description of Artificial Sequence: Synthetic oligonucleotide
gttccacagtaagtgctctt

SEQ ID NO: 14309 - DNA, 20 bp, Artificial Sequence
  Description of Artificial Sequence: Synthetic oligonucleotide
tgttccacagtaagtgctct

SEQ ID NO: 14310 - DNA, 20 bp, Artificial Sequence
  Description of Artificial Sequence: Synthetic oligonucleotide
ttgttccacagtaagtgctc

SEQ ID NO: 14311 - DNA, 20 bp, Artificial Sequence
  Description of Artificial Sequence: Synthetic oligonucleotide
cttgttccacagtaagtgct

SEQ ID NO: 14312 - DNA, 20 bp, Artificial Sequence
  Description of Artificial Sequence: Synthetic oligonucleotide
gcttgttccacagtaagtgc

SEQ ID NO: 14313 - DNA, 20 bp, Artificial Sequence
  Description of Artificial Sequence: Synthetic oligonucleotide
ggcttgttccacagtaagtg

SEQ ID NO: 14314 - DNA, 20 bp, Artificial Sequence
  Description of Artificial Sequence: Synthetic oligonucleotide
aggcttgttccacagtaagt

SEQ ID NO: 14315 - DNA, 20 bp, Artificial Sequence
  Description of Artificial Sequence: Synthetic oligonucleotide
aaggcttgttccacagtaag

SEQ ID NO: 14316 - DNA, 20 bp, Artificial Sequence
  Description of Artificial Sequence: Synthetic oligonucleotide
gaaggcttgttccacagtaa

SEQ ID NO: 14317 - DNA, 20 bp, Artificial Sequence
  Description of Artificial Sequence: Synthetic oligonucleotide
tgaaggcttgttccacagta

SEQ ID NO: 14318 - DNA, 20 bp, Artificial Sequence
  Description of Artificial Sequence: Synthetic oligonucleotide
ctgaaggcttgttccacagt

SEQ ID NO: 14319 - DNA, 20 bp, Artificial Sequence
  Description of Artificial Sequence: Synthetic oligonucleotide
gctgaaggcttgttccacag

SEQ ID NO: 14320 - DNA, 20 bp, Artificial Sequence
  Description of Artificial Sequence: Synthetic oligonucleotide
ggctgaaggcttgttccaca

SEQ ID NO: 14321 - DNA, 20 bp, Artificial Sequence
  Description of Artificial Sequence: Synthetic oligonucleotide
tggctgaaggcttgttccac

SEQ ID NO: 14322 - DNA, 20 bp, Artificial Sequence
  Description of Artificial Sequence: Synthetic oligonucleotide
ttggctgaaggcttgttcca

SEQ ID NO: 14323 - DNA, 20 bp, Artificial Sequence
  Description of Artificial Sequence: Synthetic oligonucleotide
tttggctgaaggcttgttcc

SEQ ID NO: 14324 - DNA, 20 bp, Artificial Sequence
  Description of Artificial Sequence: Synthetic oligonucleotide
gtttggctgaaggcttgttc

SEQ ID NO: 14325 - DNA, 20 bp, Artificial Sequence
  Description of Artificial Sequence: Synthetic oligonucleotide
tgtttggctgaaggcttgtt

SEQ ID NO: 14326 - DNA, 20 bp, Artificial Sequence
  Description of Artificial Sequence: Synthetic oligonucleotide
ttgtttggctgaaggcttgt

SEQ ID NO: 14327 - DNA, 20 bp, Artificial Sequence
  Description of Artificial Sequence: Synthetic oligonucleotide
attgtttggctgaaggcttg

SEQ ID NO: 14328 - DNA, 20 bp, Artificial Sequence
  Description of Artificial Sequence: Synthetic oligonucleotide
cattgtttggctgaaggctt

SEQ ID NO: 14329 - DNA, 20 bp, Artificial Sequence
  Description of Artificial Sequence: Synthetic oligonucleotide
ccattgtttggctgaaggct

SEQ ID NO: 14330 - DNA, 20 bp, Artificial Sequence
  Description of Artificial Sequence: Synthetic oligonucleotide
cccattgtttggctgaaggc

SEQ ID NO: 14331 - DNA, 20 bp, Artificial Sequence
  Description of Artificial Sequence: Synthetic oligonucleotide
ccccattgtttggctgaagg

SEQ ID NO: 14332 - DNA, 20 bp, Artificial Sequence
  Description of Artificial Sequence: Synthetic oligonucleotide
tccccattgtttggctgaag

SEQ ID NO: 14333 - DNA, 20 bp, Artificial Sequence
  Description of Artificial Sequence: Synthetic oligonucleotide
atccccattgtttggctgaa

SEQ ID NO: 14334 - DNA, 20 bp, Artificial Sequence
  Description of Artificial Sequence: Synthetic oligonucleotide
tatccccattgtttggctga

SEQ ID NO: 14335 - DNA, 20 bp, Artificial Sequence
  Description of Artificial Sequence: Synthetic oligonucleotide
ctatccccattgtttggctg

SEQ ID NO: 14336 - DNA, 20 bp, Artificial Sequence
  Description of Artificial Sequence: Synthetic oligonucleotide
tctatccccattgtttggct

SEQ ID NO: 14337 - DNA, 20 bp, Artificial Sequence
  Description of Artificial Sequence: Synthetic oligonucleotide
ttctatccccattgtttggc

SEQ ID NO: 14338 - DNA, 20 bp, Artificial Sequence
  Description of Artificial Sequence: Synthetic oligonucleotide
tttctatccccattgtttgg

SEQ ID NO: 14339 - DNA, 20 bp, Artificial Sequence
  Description of Artificial Sequence: Synthetic oligonucleotide
ttttctatccccattgtttg

SEQ ID NO: 14340 - DNA, 20 bp, Artificial Sequence
  Description of Artificial Sequence: Synthetic oligonucleotide
cttttctatccccattgttt

SEQ ID NO: 14341 - DNA, 20 bp, Artificial Sequence
  Description of Artificial Sequence: Synthetic oligonucleotide
acttttctatccccattgtt

SEQ ID NO: 14342 - DNA, 20 bp, Artificial Sequence
  Description of Artificial Sequence: Synthetic oligonucleotide
tacttttctatccccattgt

SEQ ID NO: 14343 - DNA, 20 bp, Artificial Sequence
  Description of Artificial Sequence: Synthetic oligonucleotide
ctacttttctatccccattg

SEQ ID NO: 14344 - DNA, 20 bp, Artificial Sequence
  Description of Artificial Sequence: Synthetic oligonucleotide
cctacttttctatccccatt

SEQ ID NO: 14345 - DNA, 20 bp, Artificial Sequence
  Description of Artificial Sequence: Synthetic oligonucleotide
acctacttttctatccccat

SEQ ID NO: 14346 - DNA, 20 bp, Artificial Sequence
  Description of Artificial Sequence: Synthetic oligonucleotide
tacctacttttctatcccca

SEQ ID NO: 14347 - DNA, 20 bp, Artificial Sequence
  Description of Artificial Sequence: Synthetic oligonucleotide
ttacctacttttctatcccc

SEQ ID NO: 14348 - DNA, 20 bp, Artificial Sequence
  Description of Artificial Sequence: Synthetic oligonucleotide
cttacctacttttctatccc

SEQ ID NO: 14349 - DNA, 20 bp, Artificial Sequence
  Description of Artificial Sequence: Synthetic oligonucleotide
tcttacctacttttctatcc

SEQ ID NO: 14350 - DNA, 20 bp, Artificial Sequence
  Description of Artificial Sequence: Synthetic oligonucleotide
gtcttacctacttttctatc

SEQ ID NO: 14351 - DNA, 20 bp, Artificial Sequence
  Description of Artificial Sequence: Synthetic oligonucleotide
agtcttacctacttttctat

SEQ ID NO: 14352 - DNA, 20 bp, Artificial Sequence
  Description of Artificial Sequence: Synthetic oligonucleotide
gagtcttacctacttttcta

SEQ ID NO: 14353 - DNA, 20 bp, Artificial Sequence
  Description of Artificial Sequence: Synthetic oligonucleotide
tgagtcttacctacttttct

SEQ ID NO: 14354 - DNA, 20 bp, Artificial Sequence
  Description of Artificial Sequence: Synthetic oligonucleotide
ctgagtcttacctacttttc

SEQ ID NO: 14355 - DNA, 20 bp, Artificial Sequence
  Description of Artificial Sequence: Synthetic oligonucleotide
gctgagtcttacctactttt

SEQ ID NO: 14356 - DNA, 20 bp, Artificial Sequence
  Description of Artificial Sequence: Synthetic oligonucleotide
ggctgagtcttacctacttt

SEQ ID NO: 14357 - DNA, 20 bp, Artificial Sequence
  Description of Artificial Sequence: Synthetic oligonucleotide
aggctgagtcttacctactt

SEQ ID NO: 14358 - DNA, 20 bp, Artificial Sequence
  Description of Artificial Sequence: Synthetic oligonucleotide
aaggctgagtcttacctact

SEQ ID NO: 14359 - DNA, 20 bp, Artificial Sequence
  Description of Artificial Sequence: Synthetic oligonucleotide
aaaggctgagtcttacctac

SEQ ID NO: 14360 - DNA, 20 bp, Artificial Sequence
  Description of Artificial Sequence: Synthetic oligonucleotide
caaaggctgagtcttaccta

SEQ ID NO: 14361 - DNA, 20 bp, Artificial Sequence
  Description of Artificial Sequence: Synthetic oligonucleotide
acaaaggctgagtcttacct

SEQ ID NO: 14362 - DNA, 20 bp, Artificial Sequence
  Description of Artificial Sequence: Synthetic oligonucleotide
gacaaaggctgagtcttacc

SEQ ID NO: 14363 - DNA, 20 bp, Artificial Sequence
  Description of Artificial Sequence: Synthetic oligonucleotide
ggacaaaggctgagtcttac

SEQ ID NO: 14364 - DNA, 20 bp, Artificial Sequence
  Description of Artificial Sequence: Synthetic oligonucleotide
tggacaaaggctgagtctta

SEQ ID NO: 14365 - DNA, 20 bp, Artificial Sequence
  Description of Artificial Sequence: Synthetic oligonucleotide
ctggacaaaggctgagtctt

SEQ ID NO: 14366 - DNA, 20 bp, Artificial Sequence
  Description of Artificial Sequence: Synthetic oligonucleotide
tctggacaaaggctgagtct

SEQ ID NO: 14367 - DNA, 20 bp, Artificial Sequence
  Description of Artificial Sequence: Synthetic oligonucleotide
ctctggacaaaggctgagtc

SEQ ID NO: 14368 - DNA, 20 bp, Artificial Sequence
  Description of Artificial Sequence: Synthetic oligonucleotide
tctctggacaaaggctgagt

SEQ ID NO: 14369 - DNA, 20 bp, Artificial Sequence
  Description of Artificial Sequence: Synthetic oligonucleotide
ttctctggacaaaggctgag

SEQ ID NO: 14370 - DNA, 20 bp, Artificial Sequence
  Description of Artificial Sequence: Synthetic oligonucleotide
cttctctggacaaaggctga

SEQ ID NO: 14371 - DNA, 20 bp, Artificial Sequence
  Description of Artificial Sequence: Synthetic oligonucleotide
gcttctctggacaaaggctg

SEQ ID NO: 14372 - DNA, 20 bp, Artificial Sequence
  Description of Artificial Sequence: Synthetic oligonucleotide
agcttctctggacaaaggct

SEQ ID NO: 14373 - DNA, 20 bp, Artificial Sequence
  Description of Artificial Sequence: Synthetic oligonucleotide
gagcttctctggacaaaggc

SEQ ID NO: 14374 - DNA, 20 bp, Artificial Sequence
  Description of Artificial Sequence: Synthetic oligonucleotide
tgagcttctctggacaaagg

SEQ ID NO: 14375 - DNA, 20 bp, Artificial Sequence
  Description of Artificial Sequence: Synthetic oligonucleotide
ctgagcttctctggacaaag

SEQ ID NO: 14376 - DNA, 20 bp, Artificial Sequence
  Description of Artificial Sequence: Synthetic oligonucleotide
cctgagcttctctggacaaa

SEQ ID NO: 14377 - DNA, 20 bp, Artificial Sequence
  Description of Artificial Sequence: Synthetic oligonucleotide
ccctgagcttctctggacaa

SEQ ID NO: 14378 - DNA, 20 bp, Artificial Sequence
  Description of Artificial Sequence: Synthetic oligonucleotide
accctgagcttctctggaca

SEQ ID NO: 14379 - DNA, 20 bp, Artificial Sequence
  Description of Artificial Sequence: Synthetic oligonucleotide
taccctgagcttctctggac

SEQ ID NO: 14380 - DNA, 20 bp, Artificial Sequence
  Description of Artificial Sequence: Synthetic oligonucleotide
ataccctgagcttctctgga

SEQ ID NO: 14381 - DNA, 20 bp, Artificial Sequence
  Description of Artificial Sequence: Synthetic oligonucleotide
tataccctgagcttctctgg

SEQ ID NO: 14382 - DNA, 20 bp, Artificial Sequence
  Description of Artificial Sequence: Synthetic oligonucleotide
ctataccctgagcttctctg

SEQ ID NO: 14383 - DNA, 20 bp, Artificial Sequence
  Description of Artificial Sequence: Synthetic oligonucleotide
gctataccctgagcttctct

SEQ ID NO: 14384 - DNA, 20 bp, Artificial Sequence
  Description of Artificial Sequence: Synthetic oligonucleotide
agctataccctgagcttctc

SEQ ID NO: 14385 - DNA, 20 bp, Artificial Sequence
  Description of Artificial Sequence: Synthetic oligonucleotide
cagctataccctgagcttct

SEQ ID NO: 14386 - DNA, 20 bp, Artificial Sequence
  Description of Artificial Sequence: Synthetic oligonucleotide
tcagctataccctgagcttc

SEQ ID NO: 14387 - DNA, 20 bp, Artificial Sequence
  Description of Artificial Sequence: Synthetic oligonucleotide
ttcagctataccctgagctt

SEQ ID NO: 14388 - DNA, 20 bp, Artificial Sequence
  Description of Artificial Sequence: Synthetic oligonucleotide
attcagctataccctgagct

SEQ ID NO: 14389 - DNA, 20 bp, Artificial Sequence
  Description of Artificial Sequence: Synthetic oligonucleotide
tattcagctataccctgagc

SEQ ID NO: 14390 - DNA, 20 bp, Artificial Sequence
  Description of Artificial Sequence: Synthetic oligonucleotide
ctattcagctataccctgag

SEQ ID NO: 14391 - DNA, 20 bp, Artificial Sequence
  Description of Artificial Sequence: Synthetic oligonucleotide
cctattcagctataccctga

SEQ ID NO: 14392 - DNA, 20 bp, Artificial Sequence
  Description of Artificial Sequence: Synthetic oligonucleotide
gcctattcagctataccctg

SEQ ID NO: 14393 - DNA, 20 bp, Artificial Sequence
  Description of Artificial Sequence: Synthetic oligonucleotide
tgcctattcagctataccct

SEQ ID NO: 14394 - DNA, 20 bp, Artificial Sequence
  Description of Artificial Sequence: Synthetic oligonucleotide
ctgcctattcagctataccc

SEQ ID NO: 14395 - DNA, 20 bp, Artificial Sequence
  Description of Artificial Sequence: Synthetic oligonucleotide
actgcctattcagctatacc

SEQ ID NO: 14396 - DNA, 20 bp, Artificial Sequence
  Description of Artificial Sequence: Synthetic oligonucleotide
aactgcctattcagctatac

SEQ ID NO: 14397 - DNA, 20 bp, Artificial Sequence
  Description of Artificial Sequence: Synthetic oligonucleotide
aaactgcctattcagctata

SEQ ID NO: 14398 - DNA, 20 bp, Artificial Sequence
  Description of Artificial Sequence: Synthetic oligonucleotide
gaaactgcctattcagctat

SEQ ID NO: 14399 - DNA, 20 bp, Artificial Sequence
  Description of Artificial Sequence: Synthetic oligonucleotide
agaaactgcctattcagcta

SEQ ID NO: 14400 - DNA, 20 bp, Artificial Sequence
  Description of Artificial Sequence: Synthetic oligonucleotide
aagaaactgcctattcagct

SEQ ID NO: 14401 - DNA, 20 bp, Artificial Sequence
  Description of Artificial Sequence: Synthetic oligonucleotide
aaagaaactgcctattcagc

SEQ ID NO: 14402 - DNA, 20 bp, Artificial Sequence
  Description of Artificial Sequence: Synthetic oligonucleotide
aaaagaaactgcctattcag

SEQ ID NO: 14403 - DNA, 20 bp, Artificial Sequence
  Description of Artificial Sequence: Synthetic oligonucleotide
caaaagaaactgcctattca

SEQ ID NO: 14404 - DNA, 20 bp, Artificial Sequence
  Description of Artificial Sequence: Synthetic oligonucleotide
acaaaagaaactgcctattc

SEQ ID NO: 14405 - DNA, 20 bp, Artificial Sequence
  Description of Artificial Sequence: Synthetic oligonucleotide
gacaaaagaaactgcctatt

SEQ ID NO: 14406 - DNA, 20 bp, Artificial Sequence
  Description of Artificial Sequence: Synthetic oligonucleotide
ggacaaaagaaactgcctat

SEQ ID NO: 14407 - DNA, 20 bp, Artificial Sequence
  Description of Artificial Sequence: Synthetic oligonucleotide
aggacaaaagaaactgccta

SEQ ID NO: 14408 - DNA, 20 bp, Artificial Sequence
  Description of Artificial Sequence: Synthetic oligonucleotide
caggacaaaagaaactgcct

SEQ ID NO: 14409 - DNA, 20 bp, Artificial Sequence
  Description of Artificial Sequence: Synthetic oligonucleotide
tcaggacaaaagaaactgcc

SEQ ID NO: 14410 - DNA, 20 bp, Artificial Sequence
  Description of Artificial Sequence: Synthetic oligonucleotide
ctcaggacaaaagaaactgc

SEQ ID NO: 14411 - DNA, 20 bp, Artificial Sequence
  Description of Artificial Sequence: Synthetic oligonucleotide
cctcaggacaaaagaaactg

SEQ ID NO: 14412 - DNA, 20 bp, Artificial Sequence
  Description of Artificial Sequence: Synthetic oligonucleotide
tcctcaggacaaaagaaact

SEQ ID NO: 14413 - DNA, 20 bp, Artificial Sequence
  Description of Artificial Sequence: Synthetic oligonucleotide
ttcctcaggacaaaagaaac

SEQ ID NO: 14414 - DNA, 20 bp, Artificial Sequence
  Description of Artificial Sequence: Synthetic oligonucleotide
tttcctcaggacaaaagaaa

SEQ ID NO: 14415 - DNA, 20 bp, Artificial Sequence
  Description of Artificial Sequence: Synthetic oligonucleotide
ttttcctcaggacaaaagaa

SEQ ID NO: 14416 - DNA, 20 bp, Artificial Sequence
  Description of Artificial Sequence: Synthetic oligonucleotide
attttcctcaggacaaaaga

SEQ ID NO: 14417 - DNA, 20 bp, Artificial Sequence
  Description of Artificial Sequence: Synthetic oligonucleotide
gattttcctcaggacaaaag

SEQ ID NO: 14418 - DNA, 20 bp, Artificial Sequence
  Description of Artificial Sequence: Synthetic oligonucleotide
tgattttcctcaggacaaaa

SEQ ID NO: 14419 - DNA, 20 bp, Artificial Sequence
  Description of Artificial Sequence: Synthetic oligonucleotide
ctgattttcctcaggacaaa

SEQ ID NO: 14420 - DNA, 20 bp, Artificial Sequence
  Description of Artificial Sequence: Synthetic oligonucleotide
cctgattttcctcaggacaa

SEQ ID NO: 14421 - DNA, 20 bp, Artificial Sequence
  Description of Artificial Sequence: Synthetic oligonucleotide
tcctgattttcctcaggaca

SEQ ID NO: 14422 - DNA, 20 bp, Artificial Sequence
  Description of Artificial Sequence: Synthetic oligonucleotide
gtcctgattttcctcaggac

SEQ ID NO: 14423 - DNA, 20 bp, Artificial Sequence
  Description of Artificial Sequence: Synthetic oligonucleotide
tgtcctgattttcctcagga

SEQ ID NO: 14424 - DNA, 20 bp, Artificial Sequence
  Description of Artificial Sequence: Synthetic oligonucleotide
atgtcctgattttcctcagg

SEQ ID NO: 14425 - DNA, 20 bp, Artificial Sequence
  Description of Artificial Sequence: Synthetic oligonucleotide
catgtcctgattttcctcag

SEQ ID NO: 14426 - DNA, 20 bp, Artificial Sequence
  Description of Artificial Sequence: Synthetic oligonucleotide
gcatgtcctgattttcctca

SEQ ID NO: 14427 - DNA, 20 bp, Artificial Sequence
  Description of Artificial Sequence: Synthetic oligonucleotide
ggcatgtcctgattttcctc

SEQ ID NO: 14428 - DNA, 20 bp, Artificial Sequence
  Description of Artificial Sequence: Synthetic oligonucleotide
aggcatgtcctgattttcct

SEQ ID NO: 14429 - DNA, 20 bp, Artificial Sequence
  Description of Artificial Sequence: Synthetic oligonucleotide
caggcatgtcctgattttcc

SEQ ID NO: 14430 - DNA, 20 bp, Artificial Sequence
  Description of Artificial Sequence: Synthetic oligonucleotide
gcaggcatgtcctgattttc

SEQ ID NO: 14431 - DNA, 20 bp, Artificial Sequence
  Description of Artificial Sequence: Synthetic oligonucleotide
agcaggcatgtcctgatttt

SEQ ID NO: 14432 - DNA, 20 bp, Artificial Sequence
  Description of Artificial Sequence: Synthetic oligonucleotide
aagcaggcatgtcctgattt

SEQ ID NO: 14433 - DNA, 20 bp, Artificial Sequence
  Description of Artificial Sequence: Synthetic oligonucleotide
aaagcaggcatgtcctgatt

SEQ ID NO: 14434 - DNA, 20 bp, Artificial Sequence
  Description of Artificial Sequence: Synthetic oligonucleotide
gaaagcaggcatgtcctgat

SEQ ID NO: 14435 - DNA, 20 bp, Artificial Sequence
  Description of Artificial Sequence: Synthetic oligonucleotide
agaaagcaggcatgtcctga

SEQ ID NO: 14436 - DNA, 20 bp, Artificial Sequence
  Description of Artificial Sequence: Synthetic oligonucleotide
tagaaagcaggcatgtcctg

SEQ ID NO: 14437 - DNA, 20 bp, Artificial Sequence
  Description of Artificial Sequence: Synthetic oligonucleotide
ttagaaagcaggcatgtcct

SEQ ID NO: 14438 - DNA, 20 bp, Artificial Sequence
  Description of Artificial Sequence: Synthetic oligonucleotide
tttagaaagcaggcatgtcc

SEQ ID NO: 14439 - DNA, 20 bp, Artificial Sequence
  Description of Artificial Sequence: Synthetic oligonucleotide
ttttagaaagcaggcatgtc

SEQ ID NO: 14440 - DNA, 20 bp, Artificial Sequence
  Description of Artificial Sequence: Synthetic oligonucleotide
tttttagaaagcaggcatgt

SEQ ID NO: 14441 - DNA, 20 bp, Artificial Sequence
  Description of Artificial Sequence: Synthetic oligonucleotide
atttttagaaagcaggcatg

SEQ ID NO: 14442 - DNA, 20 bp, Artificial Sequence
  Description of Artificial Sequence: Synthetic oligonucleotide
gatttttagaaagcaggcat

SEQ ID NO: 14443 - DNA, 20 bp, Artificial Sequence
  Description of Artificial Sequence: Synthetic oligonucleotide
agatttttagaaagcaggca

SEQ ID NO: 14444 - DNA, 20 bp, Artificial Sequence
  Description of Artificial Sequence: Synthetic oligonucleotide
aagatttttagaaagcaggc

SEQ ID NO: 14445 - DNA, 20 bp, Artificial Sequence
  Description of Artificial Sequence: Synthetic oligonucleotide
gaagatttttagaaagcagg

SEQ ID NO: 14446 - DNA, 20 bp, Artificial Sequence
  Description of Artificial Sequence: Synthetic oligonucleotide
ggaagatttttagaaagcag

SEQ ID NO: 14447 - DNA, 20 bp, Artificial Sequence
  Description of Artificial Sequence: Synthetic oligonucleotide
aggaagatttttagaaagca

SEQ ID NO: 14448 - DNA, 20 bp, Artificial Sequence
  Description of Artificial Sequence: Synthetic oligonucleotide
gaggaagatttttagaaagc

SEQ ID NO: 14449 - DNA, 20 bp, Artificial Sequence
  Description of Artificial Sequence: Synthetic oligonucleotide
agaggaagatttttagaaag

SEQ ID NO: 14450 - DNA, 20 bp, Artificial Sequence
  Description of Artificial Sequence: Synthetic oligonucleotide
cagaggaagatttttagaaa

SEQ ID NO: 14451 - DNA, 20 bp, Artificial Sequence
  Description of Artificial Sequence: Synthetic oligonucleotide
tcagaggaagatttttagaa

SEQ ID NO: 14452 - DNA, 20 bp, Artificial Sequence
  Description of Artificial Sequence: Synthetic oligonucleotide
ttcagaggaagatttttaga

SEQ ID NO: 14453 - DNA, 20 bp, Artificial Sequence
  Description of Artificial Sequence: Synthetic oligonucleotide
cttcagaggaagatttttag

SEQ ID NO: 14454 - DNA, 20 bp, Artificial Sequence
  Description of Artificial Sequence: Synthetic oligonucleotide
tcttcagaggaagattttta

SEQ ID NO: 14455 - DNA, 20 bp, Artificial Sequence
  Description of Artificial Sequence: Synthetic oligonucleotide
gtcttcagaggaagattttt

SEQ ID NO: 14456 - DNA, 20 bp, Artificial Sequence
  Description of Artificial Sequence: Synthetic oligonucleotide
ggtcttcagaggaagatttt

SEQ ID NO: 14457 - DNA, 20 bp, Artificial Sequence
  Description of Artificial Sequence: Synthetic oligonucleotide
aggtcttcagaggaagattt

SEQ ID NO: 14458 - DNA, 20 bp, Artificial Sequence
  Description of Artificial Sequence: Synthetic oligonucleotide
caggtcttcagaggaagatt

SEQ ID NO: 14459 - DNA, 20 bp, Artificial Sequence
  Description of Artificial Sequence: Synthetic oligonucleotide
tcaggtcttcagaggaagat

SEQ ID NO: 14460 - DNA, 20 bp, Artificial Sequence
  Description of Artificial Sequence: Synthetic oligonucleotide
gtcaggtcttcagaggaaga

SEQ ID NO: 14461 - DNA, 20 bp, Artificial Sequence
  Description of Artificial Sequence: Synthetic oligonucleotide
ggtcaggtcttcagaggaag

SEQ ID NO: 14462 - DNA, 20 bp, Artificial Sequence
  Description of Artificial Sequence: Synthetic oligonucleotide
gggtcaggtcttcagaggaa

SEQ ID NO: 14463 - DNA, 20 bp, Artificial Sequence
  Description of Artificial Sequence: Synthetic oligonucleotide
tgggtcaggtcttcagagga

SEQ ID NO: 14464 - DNA, 20 bp, Artificial Sequence
  Description of Artificial Sequence: Synthetic oligonucleotide
ttgggtcaggtcttcagagg

SEQ ID NO: 14465 - DNA, 20 bp, Artificial Sequence
  Description of Artificial Sequence: Synthetic oligonucleotide
cttgggtcaggtcttcagag

SEQ ID NO: 14466 - DNA, 20 bp, Artificial Sequence
  Description of Artificial Sequence: Synthetic oligonucleotide
gcttgggtcaggtcttcaga

SEQ ID NO: 14467 - DNA, 20 bp, Artificial Sequence
  Description of Artificial Sequence: Synthetic oligonucleotide
agcttgggtcaggtcttcag

SEQ ID NO: 14468 - DNA, 20 bp, Artificial Sequence
  Description of Artificial Sequence: Synthetic oligonucleotide
gagcttgggtcaggtcttca

SEQ ID NO: 14469 - DNA, 20 bp, Artificial Sequence
  Description of Artificial Sequence: Synthetic oligonucleotide
agagcttgggtcaggtcttc

SEQ ID NO: 14470 - DNA, 20 bp, Artificial Sequence
  Description of Artificial Sequence: Synthetic oligonucleotide
aagagcttgggtcaggtctt

SEQ ID NO: 14471 - DNA, 20 bp, Artificial Sequence
  Description of Artificial Sequence: Synthetic oligonucleotide
taagagcttgggtcaggtct

SEQ ID NO: 14472 - DNA, 20 bp, Artificial Sequence
  Description of Artificial Sequence: Synthetic oligonucleotide
ttaagagcttgggtcaggtc

SEQ ID NO: 14473 - DNA, 20 bp, Artificial Sequence
  Description of Artificial Sequence: Synthetic oligonucleotide
tttaagagcttgggtcaggt

SEQ ID NO: 14474 - DNA, 20 bp, Artificial Sequence
  Description of Artificial Sequence: Synthetic oligonucleotide
atttaagagcttgggtcagg

SEQ ID NO: 14475 - DNA, 20 bp, Artificial Sequence
  Description of Artificial Sequence: Synthetic oligonucleotide
catttaagagcttgggtcag

SEQ ID NO: 14476 - DNA, 20 bp, Artificial Sequence
  Description of Artificial Sequence: Synthetic oligonucleotide
gcatttaagagcttgggtca

SEQ ID NO: 14477 - DNA, 20 bp, Artificial Sequence
  Description of Artificial Sequence: Synthetic oligonucleotide
agcatttaagagcttgggtc

SEQ ID NO: 14478 - DNA, 20 bp, Artificial Sequence
  Description of Artificial Sequence: Synthetic oligonucleotide
tagcatttaagagcttgggt

SEQ ID NO: 14479 - DNA, 20 bp, Artificial Sequence
  Description of Artificial Sequence: Synthetic oligonucleotide
atagcatttaagagcttggg

SEQ ID NO: 14480 - DNA, 20 bp, Artificial Sequence
  Description of Artificial Sequence: Synthetic oligonucleotide
aatagcatttaagagcttgg

SEQ ID NO: 14481 - DNA, 20 bp, Artificial Sequence
  Description of Artificial Sequence: Synthetic oligonucleotide
caatagcatttaagagcttg

SEQ ID NO: 14482 - DNA, 20 bp, Artificial Sequence
  Description of Artificial Sequence: Synthetic oligonucleotide
acaatagcatttaagagctt

SEQ ID NO: 14483 - DNA, 20 bp, Artificial Sequence
  Description of Artificial Sequence: Synthetic oligonucleotide
tacaatagcatttaagagct

SEQ ID NO: 14484 - DNA, 20 bp, Artificial Sequence
  Description of Artificial Sequence: Synthetic oligonucleotide
ttacaatagcatttaagagc

SEQ ID NO: 14485 - DNA, 20 bp, Artificial Sequence
  Description of Artificial Sequence: Synthetic oligonucleotide
cttacaatagcatttaagag

SEQ ID NO: 14486 - DNA, 20 bp, Artificial Sequence
  Description of Artificial Sequence: Synthetic oligonucleotide
tcttacaatagcatttaaga

SEQ ID NO: 14487 - DNA, 20 bp, Artificial Sequence
  Description of Artificial Sequence: Synthetic oligonucleotide
ctcttacaatagcatttaag

SEQ ID NO: 14488 - DNA, 20 bp, Artificial Sequence
  Description of Artificial Sequence: Synthetic oligonucleotide
tctcttacaatagcatttaa

SEQ ID NO: 14489 - DNA, 20 bp, Artificial Sequence
  Description of Artificial Sequence: Synthetic oligonucleotide
ttctcttacaatagcattta

SEQ ID NO: 14490 - DNA, 20 bp, Artificial Sequence
  Description of Artificial Sequence: Synthetic oligonucleotide
tttctcttacaatagcattt

SEQ ID NO: 14491 - DNA, 20 bp, Artificial Sequence
  Description of Artificial Sequence: Synthetic oligonucleotide
atttctcttacaatagcatt

SEQ ID NO: 14492 - DNA, 20 bp, Artificial Sequence
  Description of Artificial Sequence: Synthetic oligonucleotide
aatttctcttacaatagcat

SEQ ID NO: 14493 - DNA, 20 bp, Artificial Sequence
  Description of Artificial Sequence: Synthetic oligonucleotide
aaatttctcttacaatagca

SEQ ID NO: 14494 - DNA, 20 bp, Artificial Sequence
  Description of Artificial Sequence: Synthetic oligonucleotide
gaaatttctcttacaatagc

SEQ ID NO: 14495 - DNA, 20 bp, Artificial Sequence
  Description of Artificial Sequence: Synthetic oligonucleotide
agaaatttctcttacaatag

SEQ ID NO: 14496 - DNA, 20 bp, Artificial Sequence
  Description of Artificial Sequence: Synthetic oligonucleotide
aagaaatttctcttacaata

SEQ ID NO: 14497 - DNA, 20 bp, Artificial Sequence
  Description of Artificial Sequence: Synthetic oligonucleotide
aaagaaatttctcttacaat

SEQ ID NO: 14498 - DNA, 20 bp, Artificial Sequence
  Description of Artificial Sequence: Synthetic oligonucleotide
caaagaaatttctcttacaa

SEQ ID NO: 14499 - DNA, 20 bp, Artificial Sequence
  Description of Artificial Sequence: Synthetic oligonucleotide
acaaagaaatttctcttaca

SEQ ID NO: 14500 - DNA, 20 bp, Artificial Sequence
  Description of Artificial Sequence: Synthetic oligonucleotide
gacaaagaaatttctcttac

SEQ ID NO: 14501 - DNA, 20 bp, Artificial Sequence
  Description of Artificial Sequence: Synthetic oligonucleotide
agacaaagaaatttctctta

SEQ ID NO: 14502 - DNA, 20 bp, Artificial Sequence
  Description of Artificial Sequence: Synthetic oligonucleotide
tagacaaagaaatttctctt

SEQ ID NO: 14503 - DNA, 20 bp, Artificial Sequence
  Description of Artificial Sequence: Synthetic oligonucleotide
atagacaaagaaatttctct

SEQ ID NO: 14504 - DNA, 20 bp, Artificial Sequence
  Description of Artificial Sequence: Synthetic oligonucleotide
aatagacaaagaaatttctc

SEQ ID NO: 14505 - DNA, 20 bp, Artificial Sequence
  Description of Artificial Sequence: Synthetic oligonucleotide
taatagacaaagaaatttct

SEQ ID NO: 14506 - DNA, 20 bp, Artificial Sequence
  Description of Artificial Sequence: Synthetic oligonucleotide
ttaatagacaaagaaatttc

SEQ ID NO: 14507 - DNA, 20 bp, Artificial Sequence
  Description of Artificial Sequence: Synthetic oligonucleotide
gttaatagacaaagaaattt

SEQ ID NO: 14508 - DNA, 20 bp, Artificial Sequence
  Description of Artificial Sequence: Synthetic oligonucleotide
agttaatagacaaagaaatt

SEQ ID NO: 14509 - DNA, 20 bp, Artificial Sequence
  Description of Artificial Sequence: Synthetic oligonucleotide
gagttaatagacaaagaaat

SEQ ID NO: 14510 - DNA, 20 bp, Artificial Sequence
  Description of Artificial Sequence: Synthetic oligonucleotide
ggagttaatagacaaagaaa

SEQ ID NO: 14511 - DNA, 20 bp, Artificial Sequence
  Description of Artificial Sequence: Synthetic oligonucleotide
tggagttaatagacaaagaa

SEQ ID NO: 14512 - DNA, 20 bp, Artificial Sequence
  Description of Artificial Sequence: Synthetic oligonucleotide
atggagttaatagacaaaga

SEQ ID NO: 14513 - DNA, 20 bp, Artificial Sequence
  Description of Artificial Sequence: Synthetic oligonucleotide
aatggagttaatagacaaag

SEQ ID NO: 14514 - DNA, 20 bp, Artificial Sequence
  Description of Artificial Sequence: Synthetic oligonucleotide
aaatggagttaatagacaaa

SEQ ID NO: 14515 - DNA, 20 bp, Artificial Sequence
  Description of Artificial Sequence: Synthetic oligonucleotide
aaaatggagttaatagacaa

SEQ ID NO: 14516 - DNA, 20 bp, Artificial Sequence
  Description of Artificial Sequence: Synthetic oligonucleotide
taaaatggagttaatagaca

SEQ ID NO: 14517 - DNA, 20 bp, Artificial Sequence
  Description of Artificial Sequence: Synthetic oligonucleotide
ctaaaatggagttaatagac

SEQ ID NO: 14518 - DNA, 20 bp, Artificial Sequence
  Description of Artificial Sequence: Synthetic oligonucleotide
actaaaatggagttaataga

SEQ ID NO: 14519 - DNA, 20 bp, Artificial Sequence
  Description of Artificial Sequence: Synthetic oligonucleotide
tactaaaatggagttaatag

SEQ ID NO: 14520 - DNA, 20 bp, Artificial Sequence
  Description of Artificial Sequence: Synthetic oligonucleotide
ctactaaaatggagttaata

SEQ ID NO: 14521 - DNA, 20 bp, Artificial Sequence
  Description of Artificial Sequence: Synthetic oligonucleotide
cctactaaaatggagttaat

SEQ ID NO: 14522 - DNA, 20 bp, Artificial Sequence
  Description of Artificial Sequence: Synthetic oligonucleotide
ccctactaaaatggagttaa

SEQ ID NO: 14523 - DNA, 20 bp, Artificial Sequence
  Description of Artificial Sequence: Synthetic oligonucleotide
tccctactaaaatggagtta

SEQ ID NO: 14524 - DNA, 20 bp, Artificial Sequence
  Description of Artificial Sequence: Synthetic oligonucleotide
atccctactaaaatggagtt

SEQ ID NO: 14525 - DNA, 20 bp, Artificial Sequence
  Description of Artificial Sequence: Synthetic oligonucleotide
aatccctactaaaatggagt

SEQ ID NO: 14526 - DNA, 20 bp, Artificial Sequence
  Description of Artificial Sequence: Synthetic oligonucleotide
gaatccctactaaaatggag

SEQ ID NO: 14527 - DNA, 20 bp, Artificial Sequence
  Description of Artificial Sequence: Synthetic oligonucleotide
tgaatccctactaaaatgga

SEQ ID NO: 14528 - DNA, 20 bp, Artificial Sequence
  Description of Artificial Sequence: Synthetic oligonucleotide
gtgaatccctactaaaatgg

SEQ ID NO: 14529 - DNA, 20 bp, Artificial Sequence
  Description of Artificial Sequence: Synthetic oligonucleotide
agtgaatccctactaaaatg

SEQ ID NO: 14530 - DNA, 20 bp, Artificial Sequence
  Description of Artificial Sequence: Synthetic oligonucleotide
cagtgaatccctactaaaat

SEQ ID NO: 14531 - DNA, 20 bp, Artificial Sequence
  Description of Artificial Sequence: Synthetic oligonucleotide
tcagtgaatccctactaaaa

SEQ ID NO: 14532 - DNA, 20 bp, Artificial Sequence
  Description of Artificial Sequence: Synthetic oligonucleotide
gtcagtgaatccctactaaa

SEQ ID NO: 14533 - DNA, 20 bp, Artificial Sequence
  Description of Artificial Sequence: Synthetic oligonucleotide
agtcagtgaatccctactaa

SEQ ID NO: 14534 - DNA, 20 bp, Artificial Sequence
  Description of Artificial Sequence: Synthetic oligonucleotide
tagtcagtgaatccctacta

SEQ ID NO: 14535 - DNA, 20 bp, Artificial Sequence
  Description of Artificial Sequence: Synthetic oligonucleotide
ctagtcagtgaatccctact

SEQ ID NO: 14536 - DNA, 20 bp, Artificial Sequence
  Description of Artificial Sequence: Synthetic oligonucleotide
tctagtcagtgaatccctac

SEQ ID NO: 14537 - DNA, 20 bp, Artificial Sequence
  Description of Artificial Sequence: Synthetic oligonucleotide
atctagtcagtgaatcccta

SEQ ID NO: 14538 - DNA, 20 bp, Artificial Sequence
  Description of Artificial Sequence: Synthetic oligonucleotide
aatctagtcagtgaatccct

SEQ ID NO: 14539 - DNA, 20 bp, Artificial Sequence
  Description of Artificial Sequence: Synthetic oligonucleotide
aaatctagtcagtgaatccc

SEQ ID NO: 14540 - DNA, 20 bp, Artificial Sequence
  Description of Artificial Sequence: Synthetic oligonucleotide
aaaatctagtcagtgaatcc

SEQ ID NO: 14541 - DNA, 20 bp, Artificial Sequence
  Description of Artificial Sequence: Synthetic oligonucleotide
taaaatctagtcagtgaatc

SEQ ID NO: 14542 - DNA, 20 bp, Artificial Sequence
  Description of Artificial Sequence: Synthetic oligonucleotide
gtaaaatctagtcagtgaat

SEQ ID NO: 14543 - DNA, 20 bp, Artificial Sequence
  Description of Artificial Sequence: Synthetic oligonucleotide
agtaaaatctagtcagtgaa

SEQ ID NO: 14544 - DNA, 20 bp, Artificial Sequence
  Description of Artificial Sequence: Synthetic oligonucleotide
cagtaaaatctagtcagtga

SEQ ID NO: 14545 - DNA, 20 bp, Artificial Sequence
  Description of Artificial Sequence: Synthetic oligonucleotide
tcagtaaaatctagtcagtg

SEQ ID NO: 14546 - DNA, 20 bp, Artificial Sequence
  Description of Artificial Sequence: Synthetic oligonucleotide
ttcagtaaaatctagtcagt

SEQ ID NO: 14547 - DNA, 20 bp, Artificial Sequence
  Description of Artificial Sequence: Synthetic oligonucleotide
gttcagtaaaatctagtcag

SEQ ID NO: 14548 - DNA, 20 bp, Artificial Sequence
  Description of Artificial Sequence: Synthetic oligonucleotide
agttcagtaaaatctagtca

SEQ ID NO: 14549 - DNA, 20 bp, Artificial Sequence
  Description of Artificial Sequence: Synthetic oligonucleotide
tagttcagtaaaatctagtc

SEQ ID NO: 14550 - DNA, 20 bp, Artificial Sequence
  Description of Artificial Sequence: Synthetic oligonucleotide
atagttcagtaaaatctagt

SEQ ID NO: 14551 - DNA, 20 bp, Artificial Sequence
  Description of Artificial Sequence: Synthetic oligonucleotide
catagttcagtaaaatctag

SEQ ID NO: 14552 - DNA, 20 bp, Artificial Sequence
  Description of Artificial Sequence: Synthetic oligonucleotide
tcatagttcagtaaaatcta

SEQ ID NO: 14553 - DNA, 20 bp, Artificial Sequence
  Description of Artificial Sequence: Synthetic oligonucleotide
ttcatagttcagtaaaatct

SEQ ID NO: 14554 - DNA, 20 bp, Artificial Sequence
  Description of Artificial Sequence: Synthetic oligonucleotide
tttcatagttcagtaaaatc

SEQ ID NO: 14555 - DNA, 20 bp, Artificial Sequence
  Description of Artificial Sequence: Synthetic oligonucleotide
ttttcatagttcagtaaaat

SEQ ID NO: 14556 - DNA, 20 bp, Artificial Sequence
  Description of Artificial Sequence: Synthetic oligonucleotide
attttcatagttcagtaaaa

SEQ ID NO: 14557 - DNA, 20 bp, Artificial Sequence
  Description of Artificial Sequence: Synthetic oligonucleotide
tattttcatagttcagtaaa

SEQ ID NO: 14558 - DNA, 20 bp, Artificial Sequence
  Description of Artificial Sequence: Synthetic oligonucleotide
ttattttcatagttcagtaa

SEQ ID NO: 14559 - DNA, 20 bp, Artificial Sequence
  Description of Artificial Sequence: Synthetic oligonucleotide
tttattttcatagttcagta

SEQ ID NO: 14560 - DNA, 20 bp, Artificial Sequence
  Description of Artificial Sequence: Synthetic oligonucleotide
atttattttcatagttcagt

SEQ ID NO: 14561 - DNA, 20 bp, Artificial Sequence
  Description of Artificial Sequence: Synthetic oligonucleotide
tatttattttcatagttcag

SEQ ID NO: 14562 - DNA, 20 bp, Artificial Sequence
  Description of Artificial Sequence: Synthetic oligonucleotide
gtatttattttcatagttca

SEQ ID NO: 14563 - DNA, 20 bp, Artificial Sequence
  Description of Artificial Sequence: Synthetic oligonucleotide
tgtatttattttcatagttc

SEQ ID NO: 14564 - DNA, 20 bp, Artificial Sequence
  Description of Artificial Sequence: Synthetic oligonucleotide
gtgtatttattttcatagtt

SEQ ID NO: 14565 - DNA, 20 bp, Artificial Sequence
  Description of Artificial Sequence: Synthetic oligonucleotide
tgtgtatttattttcatagt

SEQ ID NO: 14566 - DNA, 20 bp, Artificial Sequence
  Description of Artificial Sequence: Synthetic oligonucleotide
atgtgtatttattttcatag

SEQ ID NO: 14567 - DNA, 20 bp, Artificial Sequence
  Description of Artificial Sequence: Synthetic oligonucleotide
tatgtgtatttattttcata

SEQ ID NO: 14568 - DNA, 20 bp, Artificial Sequence
  Description of Artificial Sequence: Synthetic oligonucleotide
ttatgtgtatttattttcat

SEQ ID NO: 14569 - DNA, 20 bp, Artificial Sequence
  Description of Artificial Sequence: Synthetic oligonucleotide
attatgtgtatttattttca

SEQ ID NO: 14570 - DNA, 20 bp, Artificial Sequence
  Description of Artificial Sequence: Synthetic oligonucleotide
aattatgtgtatttattttc

SEQ ID NO: 14571 - DNA, 20 bp, Artificial Sequence
  Description of Artificial Sequence: Synthetic oligonucleotide
aaattatgtgtatttatttt

SEQ ID NO: 14572 - DNA, 20 bp, Artificial Sequence
  Description of Artificial Sequence: Synthetic oligonucleotide
aaaattatgtgtatttattt

SEQ ID NO: 14573 - DNA, 20 bp, Artificial Sequence
  Description of Artificial Sequence: Synthetic oligonucleotide
aaaaattatgtgtatttatt

SEQ ID NO: 14574 - DNA, 20 bp, Artificial Sequence
  Description of Artificial Sequence: Synthetic oligonucleotide
gaaaaattatgtgtatttat

SEQ ID NO: 14575 - DNA, 20 bp, Artificial Sequence
  Description of Artificial Sequence: Synthetic oligonucleotide
tgaaaaattatgtgtattta

SEQ ID NO: 14576 - DNA, 20 bp, Artificial Sequence
  Description of Artificial Sequence: Synthetic oligonucleotide
gtgaaaaattatgtgtattt

SEQ ID NO: 14577 - DNA, 20 bp, Artificial Sequence
  Description of Artificial Sequence: Synthetic oligonucleotide
tgtgaaaaattatgtgtatt

SEQ ID NO: 14578 - DNA, 20 bp, Artificial Sequence
  Description of Artificial Sequence: Synthetic oligonucleotide
ttgtgaaaaattatgtgtat

SEQ ID NO: 14579 - DNA, 20 bp, Artificial Sequence
  Description of Artificial Sequence: Synthetic oligonucleotide
tttgtgaaaaattatgtgta

SEQ ID NO: 14580 - DNA, 20 bp, Artificial Sequence
  Description of Artificial Sequence: Synthetic oligonucleotide
ttttgtgaaaaattatgtgt

SEQ ID NO: 14581 - DNA, 20 bp, Artificial Sequence
  Description of Artificial Sequence: Synthetic oligonucleotide
attttgtgaaaaattatgtg

SEQ ID NO: 14582 - DNA, 20 bp, Artificial Sequence
  Description of Artificial Sequence: Synthetic oligonucleotide
aattttgtgaaaaattatgt

SEQ ID NO: 14583 - DNA, 20 bp, Artificial Sequence
  Description of Artificial Sequence: Synthetic oligonucleotide
aaattttgtgaaaaattatg

SEQ ID NO: 14584 - DNA, 20 bp, Artificial Sequence
  Description of Artificial Sequence: Synthetic oligonucleotide
aaaattttgtgaaaaattat

SEQ ID NO: 14585 - DNA, 20 bp, Artificial Sequence
  Description of Artificial Sequence: Synthetic oligonucleotide
caaaattttgtgaaaaatta

SEQ ID NO: 14586 - DNA, 20 bp, Artificial Sequence
  Description of Artificial Sequence: Synthetic oligonucleotide
ccaaaattttgtgaaaaatt

SEQ ID NO: 14587 - DNA, 20 bp, Artificial Sequence
  Description of Artificial Sequence: Synthetic oligonucleotide
cccaaaattttgtgaaaaat

SEQ ID NO: 14588 - DNA, 20 bp, Artificial Sequence
  Description of Artificial Sequence: Synthetic oligonucleotide
gcccaaaattttgtgaaaaa

SEQ ID NO: 14589 - DNA, 20 bp, Artificial Sequence
  Description of Artificial Sequence: Synthetic oligonucleotide
ggcccaaaattttgtgaaaa

SEQ ID NO: 14590 - DNA, 20 bp, Artificial Sequence
  Description of Artificial Sequence: Synthetic oligonucleotide
gggcccaaaattttgtgaaa

SEQ ID NO: 14591 - DNA, 20 bp, Artificial Sequence
  Description of Artificial Sequence: Synthetic oligonucleotide
tgggcccaaaattttgtgaa

SEQ ID NO: 14592 - DNA, 20 bp, Artificial Sequence
  Description of Artificial Sequence: Synthetic oligonucleotide
ttgggcccaaaattttgtga

SEQ ID NO: 14593 - DNA, 20 bp, Artificial Sequence
  Description of Artificial Sequence: Synthetic oligonucleotide
attgggcccaaaattttgtg

SEQ ID NO: 14594 - DNA, 20 bp, Artificial Sequence
  Description of Artificial Sequence: Synthetic oligonucleotide
aattgggcccaaaattttgt

SEQ ID NO: 14595 - DNA, 20 bp, Artificial Sequence
  Description of Artificial Sequence: Synthetic oligonucleotide
gaattgggcccaaaattttg

SEQ ID NO: 14596 - DNA, 20 bp, Artificial Sequence
  Description of Artificial Sequence: Synthetic oligonucleotide
ggaattgggcccaaaatttt

SEQ ID NO: 14597 - DNA, 20 bp, Artificial Sequence
  Description of Artificial Sequence: Synthetic oligonucleotide
gggaattgggcccaaaattt

SEQ ID NO: 14598 - DNA, 20 bp, Artificial Sequence
  Description of Artificial Sequence: Synthetic oligonucleotide
ggggaattgggcccaaaatt

SEQ ID NO: 14599 - DNA, 20 bp, Artificial Sequence
  Description of Artificial Sequence: Synthetic oligonucleotide
aggggaattgggcccaaaat

SEQ ID NO: 14600 - DNA, 20 bp, Artificial Sequence
  Description of Artificial Sequence: Synthetic oligonucleotide
taggggaattgggcccaaaa

SEQ ID NO: 14601 - DNA, 20 bp, Artificial Sequence
  Description of Artificial Sequence: Synthetic oligonucleotide
ttaggggaattgggcccaaa

SEQ ID NO: 14602 - DNA, 20 bp, Artificial Sequence
  Description of Artificial Sequence: Synthetic oligonucleotide
tttaggggaattgggcccaa

SEQ ID NO: 14603 - DNA, 20 bp, Artificial Sequence
  Description of Artificial Sequence: Synthetic oligonucleotide
ttttaggggaattgggccca

SEQ ID NO: 14604 - DNA, 20 bp, Artificial Sequence
  Description of Artificial Sequence: Synthetic oligonucleotide
cttttaggggaattgggccc

SEQ ID NO: 14605 - DNA, 20 bp, Artificial Sequence
  Description of Artificial Sequence: Synthetic oligonucleotide
tcttttaggggaattgggcc

SEQ ID NO: 14606 - DNA, 20 bp, Artificial Sequence
  Description of Artificial Sequence: Synthetic oligonucleotide
ttcttttaggggaattgggc

SEQ ID NO: 14607 - DNA, 20 bp, Artificial Sequence
  Description of Artificial Sequence: Synthetic oligonucleotide
attcttttaggggaattggg

SEQ ID NO: 14608 - DNA, 20 bp, Artificial Sequence
  Description of Artificial Sequence: Synthetic oligonucleotide
aattcttttaggggaattgg

SEQ ID NO: 14609 - DNA, 20 bp, Artificial Sequence
  Description of Artificial Sequence: Synthetic oligonucleotide
caattcttttaggggaattg

SEQ ID NO: 14610 - DNA, 20 bp, Artificial Sequence
  Description of Artificial Sequence: Synthetic oligonucleotide
tcaattcttttaggggaatt

SEQ ID NO: 14611 - DNA, 20 bp, Artificial Sequence
  Description of Artificial Sequence: Synthetic oligonucleotide
ctcaattcttttaggggaat

SEQ ID NO: 14612 - DNA, 20 bp, Artificial Sequence
  Description of Artificial Sequence: Synthetic oligonucleotide
cctcaattcttttaggggaa

SEQ ID NO: 14613 - DNA, 20 bp, Artificial Sequence
  Description of Artificial Sequence: Synthetic oligonucleotide
tcctcaattcttttagggga

SEQ ID NO: 14614 - DNA, 20 bp, Artificial Sequence
  Description of Artificial Sequence: Synthetic oligonucleotide
atcctcaattcttttagggg

SEQ ID NO: 14615 - DNA, 20 bp, Artificial Sequence
  Description of Artificial Sequence: Synthetic oligonucleotide
aatcctcaattcttttaggg

SEQ ID NO: 14616 - DNA, 20 bp, Artificial Sequence
  Description of Artificial Sequence: Synthetic oligonucleotide
taatcctcaattcttttagg

SEQ ID NO: 14617 - DNA, 20 bp, Artificial Sequence
  Description of Artificial Sequence: Synthetic oligonucleotide
ctaatcctcaattcttttag

SEQ ID NO: 14618 - DNA, 20 bp, Artificial Sequence
  Description of Artificial Sequence: Synthetic oligonucleotide
cctaatcctcaattctttta

SEQ ID NO: 14619 - DNA, 20 bp, Artificial Sequence
  Description of Artificial Sequence: Synthetic oligonucleotide
ccctaatcctcaattctttt

SEQ ID NO: 14620 - DNA, 20 bp, Artificial Sequence
  Description of Artificial Sequence: Synthetic oligonucleotide
tccctaatcctcaattcttt

SEQ ID NO: 14621 - DNA, 20 bp, Artificial Sequence
  Description of Artificial Sequence: Synthetic oligonucleotide
ctccctaatcctcaattctt

SEQ ID NO: 14622 - DNA, 20 bp, Artificial Sequence
  Description of Artificial Sequence: Synthetic oligonucleotide
tctccctaatcctcaattct

SEQ ID NO: 14623 - DNA, 20 bp, Artificial Sequence
  Description of Artificial Sequence: Synthetic oligonucleotide
ttctccctaatcctcaattc

SEQ ID NO: 14624 - DNA, 20 bp, Artificial Sequence
  Description of Artificial Sequence: Synthetic oligonucleotide
tttctccctaatcctcaatt

SEQ ID NO: 14625 - DNA, 20 bp, Artificial Sequence
  Description of Artificial Sequence: Synthetic oligonucleotide
ctttctccctaatcctcaat

SEQ ID NO: 14626 - DNA, 20 bp, Artificial Sequence
  Description of Artificial Sequence: Synthetic oligonucleotide
cctttctccctaatcctcaa

SEQ ID NO: 14627 - DNA, 20 bp, Artificial Sequence
  Description of Artificial Sequence: Synthetic oligonucleotide
tcctttctccctaatcctca

SEQ ID NO: 14628 - DNA, 20 bp, Artificial Sequence
  Description of Artificial Sequence: Synthetic oligonucleotide
ctcctttctccctaatcctc

SEQ ID NO: 14629 - DNA, 20 bp, Artificial Sequence
  Description of Artificial Sequence: Synthetic oligonucleotide
tctcctttctccctaatcct

SEQ ID NO: 14630 - DNA, 20 bp, Artificial Sequence
  Description of Artificial Sequence: Synthetic oligonucleotide
gtctcctttctccctaatcc

SEQ ID NO: 14631 - DNA, 20 bp, Artificial Sequence
  Description of Artificial Sequence: Synthetic oligonucleotide
tgtctcctttctccctaatc

SEQ ID NO: 14632 - DNA, 20 bp, Artificial Sequence
  Description of Artificial Sequence: Synthetic oligonucleotide
ttgtctcctttctccctaat

SEQ ID NO: 14633 - DNA, 20 bp, Artificial Sequence
  Description of Artificial Sequence: Synthetic oligonucleotide
gttgtctcctttctccctaa

SEQ ID NO: 14634 - DNA, 20 bp, Artificial Sequence
  Description of Artificial Sequence: Synthetic oligonucleotide
agttgtctcctttctcccta

SEQ ID NO: 14635 - DNA, 20 bp, Artificial Sequence
  Description of Artificial Sequence: Synthetic oligonucleotide
gagttgtctcctttctccct

SEQ ID NO: 14636 - DNA, 20 bp, Artificial Sequence
  Description of Artificial Sequence: Synthetic oligonucleotide
tgagttgtctcctttctccc

SEQ ID NO: 14637 - DNA, 20 bp, Artificial Sequence
  Description of Artificial Sequence: Synthetic oligonucleotide
ttgagttgtctcctttctcc

SEQ ID NO: 14638 - DNA, 20 bp, Artificial Sequence
  Description of Artificial Sequence: Synthetic oligonucleotide
tttgagttgtctcctttctc

SEQ ID NO: 14639 - DNA, 20 bp, Artificial Sequence
  Description of Artificial Sequence: Synthetic oligonucleotide
ctttgagttgtctcctttct

SEQ ID NO: 14640 - DNA, 20 bp, Artificial Sequence
  Description of Artificial Sequence: Synthetic oligonucleotide
actttgagttgtctcctttc

SEQ ID NO: 14641 - DNA, 20 bp, Artificial Sequence
  Description of Artificial Sequence: Synthetic oligonucleotide
gactttgagttgtctccttt

SEQ ID NO: 14642 - DNA, 20 bp, Artificial Sequence
  Description of Artificial Sequence: Synthetic oligonucleotide
tgactttgagttgtctcctt

SEQ ID NO: 14643 - DNA, 20 bp, Artificial Sequence
  Description of Artificial Sequence: Synthetic oligonucleotide
atgactttgagttgtctcct

SEQ ID NO: 14644 - DNA, 20 bp, Artificial Sequence
  Description of Artificial Sequence: Synthetic oligonucleotide
gatgactttgagttgtctcc

SEQ ID NO: 14645 - DNA, 20 bp, Artificial Sequence
  Description of Artificial Sequence: Synthetic oligonucleotide
ggatgactttgagttgtctc

SEQ ID NO: 14646 - DNA, 20 bp, Artificial Sequence
  Description of Artificial Sequence: Synthetic oligonucleotide
gggatgactttgagttgtct

SEQ ID NO: 14647 - DNA, 20 bp, Artificial Sequence
  Description of Artificial Sequence: Synthetic oligonucleotide
tgggatgactttgagttgtc

SEQ ID NO: 14648 - DNA, 20 bp, Artificial Sequence
  Description of Artificial Sequence: Synthetic oligonucleotide
atgggatgactttgagttgt

SEQ ID NO: 14649 - DNA, 20 bp, Artificial Sequence
  Description of Artificial Sequence: Synthetic oligonucleotide
aatgggatgactttgagttg

SEQ ID NO: 14650 - DNA, 20 bp, Artificial Sequence
  Description of Artificial Sequence: Synthetic oligonucleotide
taatgggatgactttgagtt

SEQ ID NO: 14651 - DNA, 20 bp, Artificial Sequence
  Description of Artificial Sequence: Synthetic oligonucleotide
ttaatgggatgactttgagt

SEQ ID NO: 14652 - DNA, 20 bp, Artificial Sequence
  Description of Artificial Sequence: Synthetic oligonucleotide
cttaatgggatgactttgag

SEQ ID NO: 14653 - DNA, 20 bp, Artificial Sequence
  Description of Artificial Sequence: Synthetic oligonucleotide
acttaatgggatgactttga

SEQ ID NO: 14654 - DNA, 20 bp, Artificial Sequence
  Description of Artificial Sequence: Synthetic oligonucleotide
cacttaatgggatgactttg

SEQ ID NO: 14655 - DNA, 20 bp, Artificial Sequence
  Description of Artificial Sequence: Synthetic oligonucleotide
gcacttaatgggatgacttt

SEQ ID NO: 14656 - DNA, 20 bp, Artificial Sequence
  Description of Artificial Sequence: Synthetic oligonucleotide
tgcacttaatgggatgactt

SEQ ID NO: 14657 - DNA, 20 bp, Artificial Sequence
  Description of Artificial Sequence: Synthetic oligonucleotide
ctgcacttaatgggatgact

SEQ ID NO: 14658 - DNA, 20 bp, Artificial Sequence
  Description of Artificial Sequence: Synthetic oligonucleotide
actgcacttaatgggatgac

SEQ ID NO: 14659 - DNA, 20 bp, Artificial Sequence
  Description of Artificial Sequence: Synthetic oligonucleotide
aactgcacttaatgggatga

SEQ ID NO: 14660 - DNA, 20 bp, Artificial Sequence
  Description of Artificial Sequence: Synthetic oligonucleotide
aaactgcacttaatgggatg

SEQ ID NO: 14661 - DNA, 20 bp, Artificial Sequence
  Description of Artificial Sequence: Synthetic oligonucleotide
gaaactgcacttaatgggat

SEQ ID NO: 14662 - DNA, 20 bp, Artificial Sequence
  Description of Artificial Sequence: Synthetic oligonucleotide
agaaactgcacttaatggga

SEQ ID NO: 14663 - DNA, 20 bp, Artificial Sequence
  Description of Artificial Sequence: Synthetic oligonucleotide
aagaaactgcacttaatggg

SEQ ID NO: 14664 - DNA, 20 bp, Artificial Sequence
  Description of Artificial Sequence: Synthetic oligonucleotide
aaagaaactgcacttaatgg

SEQ ID NO: 14665 - DNA, 20 bp, Artificial Sequence
  Description of Artificial Sequence: Synthetic oligonucleotide
caaagaaactgcacttaatg

SEQ ID NO: 14666 - DNA, 20 bp, Artificial Sequence
  Description of Artificial Sequence: Synthetic oligonucleotide
tcaaagaaactgcacttaat

SEQ ID NO: 14667 - DNA, 20 bp, Artificial Sequence
  Description of Artificial Sequence: Synthetic oligonucleotide
ttcaaagaaactgcacttaa

SEQ ID NO: 14668 - DNA, 20 bp, Artificial Sequence
  Description of Artificial Sequence: Synthetic oligonucleotide
attcaaagaaactgcactta

SEQ ID NO: 14669 - DNA, 20 bp, Artificial Sequence
  Description of Artificial Sequence: Synthetic oligonucleotide
gattcaaagaaactgcactt

SEQ ID NO: 14670 - DNA, 20 bp, Artificial Sequence
  Description of Artificial Sequence: Synthetic oligonucleotide
agattcaaagaaactgcact

SEQ ID NO: 14671 - DNA, 20 bp, Artificial Sequence
  Description of Artificial Sequence: Synthetic oligonucleotide
aagattcaaagaaactgcac

SEQ ID NO: 14672 - DNA, 20 bp, Artificial Sequence
  Description of Artificial Sequence: Synthetic oligonucleotide
gaagattcaaagaaactgca

SEQ ID NO: 14673 - DNA, 20 bp, Artificial Sequence
  Description of Artificial Sequence: Synthetic oligonucleotide
agaagattcaaagaaactgc

SEQ ID NO: 14674 - DNA, 20 bp, Artificial Sequence
  Description of Artificial Sequence: Synthetic oligonucleotide
cagaagattcaaagaaactg

SEQ ID NO: 14675 - DNA, 20 bp, Artificial Sequence
  Description of Artificial Sequence: Synthetic oligonucleotide
gcagaagattcaaagaaact

SEQ ID NO: 14676 - DNA, 20 bp, Artificial Sequence
  Description of Artificial Sequence: Synthetic oligonucleotide
agcagaagattcaaagaaac

SEQ ID NO: 14677 - DNA, 20 bp, Artificial Sequence
  Description of Artificial Sequence: Synthetic oligonucleotide
aagcagaagattcaaagaaa

SEQ ID NO: 14678 - DNA, 20 bp, Artificial Sequence
  Description of Artificial Sequence: Synthetic oligonucleotide
aaagcagaagattcaaagaa

SEQ ID NO: 14679 - DNA, 20 bp, Artificial Sequence
  Description of Artificial Sequence: Synthetic oligonucleotide
taaagcagaagattcaaaga

SEQ ID NO: 14680 - DNA, 20 bp, Artificial Sequence
  Description of Artificial Sequence: Synthetic oligonucleotide
ataaagcagaagattcaaag

SEQ ID NO: 14681 - DNA, 20 bp, Artificial Sequence
  Description of Artificial Sequence: Synthetic oligonucleotide
gataaagcagaagattcaaa

SEQ ID NO: 14682 - DNA, 20 bp, Artificial Sequence
  Description of Artificial Sequence: Synthetic oligonucleotide
agataaagcagaagattcaa

SEQ ID NO: 14683 - DNA, 20 bp, Artificial Sequence
  Description of Artificial Sequence: Synthetic oligonucleotide
aagataaagcagaagattca

SEQ ID NO: 14684 - DNA, 20 bp, Artificial Sequence
  Description of Artificial Sequence: Synthetic oligonucleotide
aaagataaagcagaagattc

SEQ ID NO: 14685 - DNA, 20 bp, Artificial Sequence
  Description of Artificial Sequence: Synthetic oligonucleotide
taaagataaagcagaagatt

SEQ ID NO: 14686 - DNA, 20 bp, Artificial Sequence
  Description of Artificial Sequence: Synthetic oligonucleotide
ttaaagataaagcagaagat

SEQ ID NO: 14687 - DNA, 20 bp, Artificial Sequence
  Description of Artificial Sequence: Synthetic oligonucleotide
tttaaagataaagcagaaga

SEQ ID NO: 14688 - DNA, 20 bp, Artificial Sequence
  Description of Artificial Sequence: Synthetic oligonucleotide
ttttaaagataaagcagaag

SEQ ID NO: 14689 - DNA, 20 bp, Artificial Sequence
  Description of Artificial Sequence: Synthetic oligonucleotide
tttttaaagataaagcagaa

SEQ ID NO: 14690 - DNA, 20 bp, Artificial Sequence
  Description of Artificial Sequence: Synthetic oligonucleotide
atttttaaagataaagcaga

SEQ ID NO: 14691 - DNA, 20 bp, Artificial Sequence
  Description of Artificial Sequence: Synthetic oligonucleotide
aatttttaaagataaagcag

SEQ ID NO: 14692 - DNA, 20 bp, Artificial Sequence
  Description of Artificial Sequence: Synthetic oligonucleotide
aaatttttaaagataaagca

SEQ ID NO: 14693 - DNA, 20 bp, Artificial Sequence
  Description of Artificial Sequence: Synthetic oligonucleotide
caaatttttaaagataaagc

SEQ ID NO: 14694 - DNA, 20 bp, Artificial Sequence
  Description of Artificial Sequence: Synthetic oligonucleotide
acaaatttttaaagataaag

SEQ ID NO: 14695 - DNA, 20 bp, Artificial Sequence
  Description of Artificial Sequence: Synthetic oligonucleotide
tacaaatttttaaagataaa

SEQ ID NO: 14696 - DNA, 20 bp, Artificial Sequence
  Description of Artificial Sequence: Synthetic oligonucleotide
atacaaatttttaaagataa

SEQ ID NO: 14697 - DNA, 20 bp, Artificial Sequence
  Description of Artificial Sequence: Synthetic oligonucleotide
tatacaaatttttaaagata

SEQ ID NO: 14698 - DNA, 20 bp, Artificial Sequence
  Description of Artificial Sequence: Synthetic oligonucleotide
ttatacaaatttttaaagat

SEQ ID NO: 14699 - DNA, 20 bp, Artificial Sequence
  Description of Artificial Sequence: Synthetic oligonucleotide
attatacaaatttttaaaga

SEQ ID NO: 14700 - DNA, 20 bp, Artificial Sequence
  Description of Artificial Sequence: Synthetic oligonucleotide
aattatacaaatttttaaag

SEQ ID NO: 14701 - DNA, 20 bp, Artificial Sequence
  Description of Artificial Sequence: Synthetic oligonucleotide
aaattatacaaatttttaaa

SEQ ID NO: 14702 - DNA, 20 bp, Artificial Sequence
  Description of Artificial Sequence: Synthetic oligonucleotide
taaattatacaaatttttaa

SEQ ID NO: 14703 - DNA, 20 bp, Artificial Sequence
  Description of Artificial Sequence: Synthetic oligonucleotide
ataaattatacaaattttta

SEQ ID NO: 14704 - DNA, 20 bp, Artificial Sequence
  Description of Artificial Sequence: Synthetic oligonucleotide
tataaattatacaaattttt

SEQ ID NO: 14705 - DNA, 20 bp, Artificial Sequence
  Description of Artificial Sequence: Synthetic oligonucleotide
atataaattatacaaatttt

SEQ ID NO: 14706 - DNA, 20 bp, Artificial Sequence
  Description of Artificial Sequence: Synthetic oligonucleotide
tatataaattatacaaattt

SEQ ID NO: 14707 - DNA, 20 bp, Artificial Sequence
  Description of Artificial Sequence: Synthetic oligonucleotide
atatataaattatacaaatt

SEQ ID NO: 14708 - DNA, 20 bp, Artificial Sequence
  Description of Artificial Sequence: Synthetic oligonucleotide
aatatataaattatacaaat

SEQ ID NO: 14709 - DNA, 20 bp, Artificial Sequence
  Description of Artificial Sequence: Synthetic oligonucleotide
aaatatataaattatacaaa

SEQ ID NO: 14710 - DNA, 20 bp, Artificial Sequence
  Description of Artificial Sequence: Synthetic oligonucleotide
aaaatatataaattatacaa

SEQ ID NO: 14711 - DNA, 20 bp, Artificial Sequence
  Description of Artificial Sequence: Synthetic oligonucleotide
taaaatatataaattataca

SEQ ID NO: 14712 - DNA, 20 bp, Artificial Sequence
  Description of Artificial Sequence: Synthetic oligonucleotide
ataaaatatataaattatac

SEQ ID NO: 14713 - DNA, 20 bp, Artificial Sequence
  Description of Artificial Sequence: Synthetic oligonucleotide
aataaaatatataaattata

SEQ ID NO: 14714 - DNA, 20 bp, Artificial Sequence
  Description of Artificial Sequence: Synthetic oligonucleotide
gaataaaatatataaattat

SEQ ID NO: 14715 - DNA, 20 bp, Artificial Sequence
  Description of Artificial Sequence: Synthetic oligonucleotide
agaataaaatatataaatta

SEQ ID NO: 14716 - DNA, 20 bp, Artificial Sequence
  Description of Artificial Sequence: Synthetic oligonucleotide
tagaataaaatatataaatt

SEQ ID NO: 14717 - DNA, 20 bp, Artificial Sequence
  Description of Artificial Sequence: Synthetic oligonucleotide
atagaataaaatatataaat

SEQ ID NO: 14718 - DNA, 20 bp, Artificial Sequence
  Description of Artificial Sequence: Synthetic oligonucleotide
catagaataaaatatataaa

SEQ ID NO: 14719 - DNA, 20 bp, Artificial Sequence
  Description of Artificial Sequence: Synthetic oligonucleotide
acatagaataaaatatataa

SEQ ID NO: 14720 - DNA, 20 bp, Artificial Sequence
  Description of Artificial Sequence: Synthetic oligonucleotide
cacatagaataaaatatata

SEQ ID NO: 14721 - DNA, 20 bp, Artificial Sequence
  Description of Artificial Sequence: Synthetic oligonucleotide
acacatagaataaaatatat

SEQ ID NO: 14722 - DNA, 20 bp, Artificial Sequence
  Description of Artificial Sequence: Synthetic oligonucleotide
aacacatagaataaaatata

SEQ ID NO: 14723 - DNA, 20 bp, Artificial Sequence
  Description of Artificial Sequence: Synthetic oligonucleotide
gaacacatagaataaaatat

SEQ ID NO: 14724 - DNA, 20 bp, Artificial Sequence
  Description of Artificial Sequence: Synthetic oligonucleotide
ggaacacatagaataaaata

SEQ ID NO: 14725 - DNA, 20 bp, Artificial Sequence
  Description of Artificial Sequence: Synthetic oligonucleotide
tggaacacatagaataaaat

SEQ ID NO: 14726 - DNA, 20 bp, Artificial Sequence
  Description of Artificial Sequence: Synthetic oligonucleotide
atggaacacatagaataaaa

SEQ ID NO: 14727 - DNA, 20 bp, Artificial Sequence
  Description of Artificial Sequence: Synthetic oligonucleotide
tatggaacacatagaataaa

SEQ ID NO: 14728 - DNA, 20 bp, Artificial Sequence
  Description of Artificial Sequence: Synthetic oligonucleotide
ctatggaacacatagaataa

SEQ ID NO: 14729 - DNA, 20 bp, Artificial Sequence
  Description of Artificial Sequence: Synthetic oligonucleotide
tctatggaacacatagaata

SEQ ID NO: 14730 - DNA, 20 bp, Artificial Sequence
  Description of Artificial Sequence: Synthetic oligonucleotide
atctatggaacacatagaat

SEQ ID NO: 14731 - DNA, 20 bp, Artificial Sequence
  Description of Artificial Sequence: Synthetic oligonucleotide
tatctatggaacacatagaa

SEQ ID NO: 14732 - DNA, 20 bp, Artificial Sequence
  Description of Artificial Sequence: Synthetic oligonucleotide
atatctatggaacacataga

SEQ ID NO: 14733 - DNA, 20 bp, Artificial Sequence
  Description of Artificial Sequence: Synthetic oligonucleotide
gatatctatggaacacatag

SEQ ID NO: 14734 - DNA, 20 bp, Artificial Sequence
  Description of Artificial Sequence: Synthetic oligonucleotide
agatatctatggaacacata

SEQ ID NO: 14735 - DNA, 20 bp, Artificial Sequence
  Description of Artificial Sequence: Synthetic oligonucleotide
aagatatctatggaacacat

SEQ ID NO: 14736 - DNA, 20 bp, Artificial Sequence
  Description of Artificial Sequence: Synthetic oligonucleotide
taagatatctatggaacaca

SEQ ID NO: 14737 - DNA, 20 bp, Artificial Sequence
  Description of Artificial Sequence: Synthetic oligonucleotide
ttaagatatctatggaacac

SEQ ID NO: 14738 - DNA, 20 bp, Artificial Sequence
  Description of Artificial Sequence: Synthetic oligonucleotide
attaagatatctatggaaca

SEQ ID NO: 14739 - DNA, 20 bp, Artificial Sequence
  Description of Artificial Sequence: Synthetic oligonucleotide
cattaagatatctatggaac

SEQ ID NO: 14740 - DNA, 20 bp, Artificial Sequence
  Description of Artificial Sequence: Synthetic oligonucleotide
acattaagatatctatggaa

SEQ ID NO: 14741 - DNA, 20 bp, Artificial Sequence
  Description of Artificial Sequence: Synthetic oligonucleotide
tacattaagatatctatgga

SEQ ID NO: 14742 - DNA, 20 bp, Artificial Sequence
  Description of Artificial Sequence: Synthetic oligonucleotide
ttacattaagatatctatgg

SEQ ID NO: 14743 - DNA, 20 bp, Artificial Sequence
  Description of Artificial Sequence: Synthetic oligonucleotide
tttacattaagatatctatg

SEQ ID NO: 14744 - DNA, 20 bp, Artificial Sequence
  Description of Artificial Sequence: Synthetic oligonucleotide
ttttacattaagatatctat

SEQ ID NO: 14745 - DNA, 20 bp, Artificial Sequence
  Description of Artificial Sequence: Synthetic oligonucleotide
attttacattaagatatcta

SEQ ID NO: 14746 - DNA, 20 bp, Artificial Sequence
  Description of Artificial Sequence: Synthetic oligonucleotide
aattttacattaagatatct

SEQ ID NO: 14747 - DNA, 20 bp, Artificial Sequence
  Description of Artificial Sequence: Synthetic oligonucleotide
taattttacattaagatatc

SEQ ID NO: 14748 - DNA, 20 bp, Artificial Sequence
  Description of Artificial Sequence: Synthetic oligonucleotide
ctaattttacattaagatat

SEQ ID NO: 14749 - DNA, 20 bp, Artificial Sequence
  Description of Artificial Sequence: Synthetic oligonucleotide
actaattttacattaagata

SEQ ID NO: 14750 - DNA, 20 bp, Artificial Sequence
  Description of Artificial Sequence: Synthetic oligonucleotide
gactaattttacattaagat

SEQ ID NO: 14751 - DNA, 20 bp, Artificial Sequence
  Description of Artificial Sequence: Synthetic oligonucleotide
tgactaattttacattaaga

SEQ ID NO: 14752 - DNA, 20 bp, Artificial Sequence
  Description of Artificial Sequence: Synthetic oligonucleotide
atgactaattttacattaag

SEQ ID NO: 14753 - DNA, 20 bp, Artificial Sequence
  Description of Artificial Sequence: Synthetic oligonucleotide
aatgactaattttacattaa

SEQ ID NO: 14754 - DNA, 20 bp, Artificial Sequence
  Description of Artificial Sequence: Synthetic oligonucleotide
aaatgactaattttacatta

SEQ ID NO: 14755 - DNA, 20 bp, Artificial Sequence
  Description of Artificial Sequence: Synthetic oligonucleotide
taaatgactaattttacatt

SEQ ID NO: 14756 - DNA, 20 bp, Artificial Sequence
  Description of Artificial Sequence: Synthetic oligonucleotide
ttaaatgactaattttacat

SEQ ID NO: 14757 - DNA, 20 bp, Artificial Sequence
  Description of Artificial Sequence: Synthetic oligonucleotide
tttaaatgactaattttaca

SEQ ID NO: 14758 - DNA, 20 bp, Artificial Sequence
  Description of Artificial Sequence: Synthetic oligonucleotide
atttaaatgactaattttac

SEQ ID NO: 14759 - DNA, 20 bp, Artificial Sequence
  Description of Artificial Sequence: Synthetic oligonucleotide
aatttaaatgactaatttta

SEQ ID NO: 14760 - DNA, 20 bp, Artificial Sequence
  Description of Artificial Sequence: Synthetic oligonucleotide
taatttaaatgactaatttt

SEQ ID NO: 14761 - DNA, 20 bp, Artificial Sequence
  Description of Artificial Sequence: Synthetic oligonucleotide
gtaatttaaatgactaattt

SEQ ID NO: 14762 - DNA, 20 bp, Artificial Sequence
  Description of Artificial Sequence: Synthetic oligonucleotide
tgtaatttaaatgactaatt

SEQ ID NO: 14763 - DNA, 20 bp, Artificial Sequence
  Description of Artificial Sequence: Synthetic oligonucleotide
gtgtaatttaaatgactaat

SEQ ID NO: 14764 - DNA, 20 bp, Artificial Sequence
  Description of Artificial Sequence: Synthetic oligonucleotide
agtgtaatttaaatgactaa

SEQ ID NO: 14765 - DNA, 20 bp, Artificial Sequence
  Description of Artificial Sequence: Synthetic oligonucleotide
cagtgtaatttaaatgacta

SEQ ID NO: 14766 - DNA, 20 bp, Artificial Sequence
  Description of Artificial Sequence: Synthetic oligonucleotide
acagtgtaatttaaatgact

SEQ ID NO: 14767 - DNA, 20 bp, Artificial Sequence
  Description of Artificial Sequence: Synthetic oligonucleotide
gacagtgtaatttaaatgac

SEQ ID NO: 14768 - DNA, 20 bp, Artificial Sequence
  Description of Artificial Sequence: Synthetic oligonucleotide
tgacagtgtaatttaaatga

SEQ ID NO: 14769 - DNA, 20 bp, Artificial Sequence
  Description of Artificial Sequence: Synthetic oligonucleotide
ttgacagtgtaatttaaatg

SEQ ID NO: 14770 - DNA, 20 bp, Artificial Sequence
  Description of Artificial Sequence: Synthetic oligonucleotide
attgacagtgtaatttaaat

SEQ ID NO: 14771 - DNA, 20 bp, Artificial Sequence
  Description of Artificial Sequence: Synthetic oligonucleotide
aattgacagtgtaatttaaa

SEQ ID NO: 14772 - DNA, 20 bp, Artificial Sequence
  Description of Artificial Sequence: Synthetic oligonucleotide
taattgacagtgtaatttaa

SEQ ID NO: 14773 - DNA, 20 bp, Artificial Sequence
  Description of Artificial Sequence: Synthetic oligonucleotide
ttaattgacagtgtaattta

SEQ ID NO: 14774 - DNA, 20 bp, Artificial Sequence
  Description of Artificial Sequence: Synthetic oligonucleotide
tttaattgacagtgtaattt

SEQ ID NO: 14775 - DNA, 20 bp, Artificial Sequence
  Description of Artificial Sequence: Synthetic oligonucleotide
ttttaattgacagtgtaatt

SEQ ID NO: 14776 - DNA, 20 bp, Artificial Sequence
  Description of Artificial Sequence: Synthetic oligonucleotide
cttttaattgacagtgtaat

SEQ ID NO: 14777 - DNA, 20 bp, Artificial Sequence
  Description of Artificial Sequence: Synthetic oligonucleotide
acttttaattgacagtgtaa

SEQ ID NO: 14778 - DNA, 20 bp, Artificial Sequence
  Description of Artificial Sequence: Synthetic oligonucleotide
tacttttaattgacagtgta

SEQ ID NO: 14779 - DNA, 20 bp, Artificial Sequence
  Description of Artificial Sequence: Synthetic oligonucleotide
ttacttttaattgacagtgt

SEQ ID NO: 14780 - DNA, 20 bp, Artificial Sequence
  Description of Artificial Sequence: Synthetic oligonucleotide
attacttttaattgacagtg

SEQ ID NO: 14781 - DNA, 20 bp, Artificial Sequence
  Description of Artificial Sequence: Synthetic oligonucleotide
cattacttttaattgacagt

SEQ ID NO: 14782 - DNA, 20 bp, Artificial Sequence
  Description of Artificial Sequence: Synthetic oligonucleotide
ccattacttttaattgacag

SEQ ID NO: 14783 - DNA, 20 bp, Artificial Sequence
  Description of Artificial Sequence: Synthetic oligonucleotide
cccattacttttaattgaca

SEQ ID NO: 14784 - DNA, 20 bp, Artificial Sequence
  Description of Artificial Sequence: Synthetic oligonucleotide
gcccattacttttaattgac

SEQ ID NO: 14785 - DNA, 20 bp, Artificial Sequence
  Description of Artificial Sequence: Synthetic oligonucleotide
tgcccattacttttaattga

SEQ ID NO: 14786 - DNA, 20 bp, Artificial Sequence
  Description of Artificial Sequence: Synthetic oligonucleotide
ttgcccattacttttaattg

SEQ ID NO: 14787 - DNA, 20 bp, Artificial Sequence
  Description of Artificial Sequence: Synthetic oligonucleotide
cttgcccattacttttaatt

SEQ ID NO: 14788 - DNA, 20 bp, Artificial Sequence
  Description of Artificial Sequence: Synthetic oligonucleotide
tcttgcccattacttttaat

SEQ ID NO: 14789 - DNA, 20 bp, Artificial Sequence
  Description of Artificial Sequence: Synthetic oligonucleotide
ctcttgcccattacttttaa

SEQ ID NO: 14790 - DNA, 20 bp, Artificial Sequence
  Description of Artificial Sequence: Synthetic oligonucleotide
tctcttgcccattactttta

SEQ ID NO: 14791 - DNA, 20 bp, Artificial Sequence
  Description of Artificial Sequence: Synthetic oligonucleotide
atctcttgcccattactttt

SEQ ID NO: 14792 - DNA, 20 bp, Artificial Sequence
  Description of Artificial Sequence: Synthetic oligonucleotide
aatctcttgcccattacttt

SEQ ID NO: 14793 - DNA, 20 bp, Artificial Sequence
  Description of Artificial Sequence: Synthetic oligonucleotide
caatctcttgcccattactt

SEQ ID NO: 14794 - DNA, 20 bp, Artificial Sequence
  Description of Artificial Sequence: Synthetic oligonucleotide
gcaatctcttgcccattact

SEQ ID NO: 14795 - DNA, 20 bp, Artificial Sequence
  Description of Artificial Sequence: Synthetic oligonucleotide
tgcaatctcttgcccattac

SEQ ID NO: 14796 - DNA, 20 bp, Artificial Sequence
  Description of Artificial Sequence: Synthetic oligonucleotide
atgcaatctcttgcccatta

SEQ ID NO: 14797 - DNA, 20 bp, Artificial Sequence
  Description of Artificial Sequence: Synthetic oligonucleotide
gatgcaatctcttgcccatt

SEQ ID NO: 14798 - DNA, 20 bp, Artificial Sequence
  Description of Artificial Sequence: Synthetic oligonucleotide
tgatgcaatctcttgcccat

SEQ ID NO: 14799 - DNA, 20 bp, Artificial Sequence
  Description of Artificial Sequence: Synthetic oligonucleotide
atgatgcaatctcttgccca

SEQ ID NO: 14800 - DNA, 20 bp, Artificial Sequence
  Description of Artificial Sequence: Synthetic oligonucleotide
tatgatgcaatctcttgccc

SEQ ID NO: 14801 - DNA, 20 bp, Artificial Sequence
  Description of Artificial Sequence: Synthetic oligonucleotide
gtatgatgcaatctcttgcc

SEQ ID NO: 14802 - DNA, 20 bp, Artificial Sequence
  Description of Artificial Sequence: Synthetic oligonucleotide
agtatgatgcaatctcttgc

SEQ ID NO: 14803 - DNA, 20 bp, Artificial Sequence
  Description of Artificial Sequence: Synthetic oligonucleotide
tagtatgatgcaatctcttg

SEQ ID NO: 14804 - DNA, 20 bp, Artificial Sequence
  Description of Artificial Sequence: Synthetic oligonucleotide
ttagtatgatgcaatctctt

SEQ ID NO: 14805 - DNA, 20 bp, Artificial Sequence
  Description of Artificial Sequence: Synthetic oligonucleotide
attagtatgatgcaatctct

SEQ ID NO: 14806 - DNA, 20 bp, Artificial Sequence
  Description of Artificial Sequence: Synthetic oligonucleotide
aattagtatgatgcaatctc

SEQ ID NO: 14807 - DNA, 20 bp, Artificial Sequence
  Description of Artificial Sequence: Synthetic oligonucleotide
aaattagtatgatgcaatct

SEQ ID NO: 14808 - DNA, 20 bp, Artificial Sequence
  Description of Artificial Sequence: Synthetic oligonucleotide
taaattagtatgatgcaatc

SEQ ID NO: 14809 - DNA, 20 bp, Artificial Sequence
  Description of Artificial Sequence: Synthetic oligonucleotide
ctaaattagtatgatgcaat

SEQ ID NO: 14810 - DNA, 20 bp, Artificial Sequence
  Description of Artificial Sequence: Synthetic oligonucleotide
actaaattagtatgatgcaa

SEQ ID NO: 14811 - DNA, 20 bp, Artificial Sequence
  Description of Artificial Sequence: Synthetic oligonucleotide
tactaaattagtatgatgca

SEQ ID NO: 14812 - DNA, 20 bp, Artificial Sequence
  Description of Artificial Sequence: Synthetic oligonucleotide
ttactaaattagtatgatgc

SEQ ID NO: 14813 - DNA, 20 bp, Artificial Sequence
  Description of Artificial Sequence: Synthetic oligonucleotide
cttactaaattagtatgatg

SEQ ID NO: 14814 - DNA, 20 bp, Artificial Sequence
  Description of Artificial Sequence: Synthetic oligonucleotide
tcttactaaattagtatgat

SEQ ID NO: 14815 - DNA, 20 bp, Artificial Sequence
  Description of Artificial Sequence: Synthetic oligonucleotide
ttcttactaaattagtatga

SEQ ID NO: 14816 - DNA, 20 bp, Artificial Sequence
  Description of Artificial Sequence: Synthetic oligonucleotide
gttcttactaaattagtatg

SEQ ID NO: 14817 - DNA, 20 bp, Artificial Sequence
  Description of Artificial Sequence: Synthetic oligonucleotide
cgttcttactaaattagtat

SEQ ID NO: 14818 - DNA, 20 bp, Artificial Sequence
  Description of Artificial Sequence: Synthetic oligonucleotide
acgttcttactaaattagta

SEQ ID NO: 14819 - DNA, 20 bp, Artificial Sequence
  Description of Artificial Sequence: Synthetic oligonucleotide
aacgttcttactaaattagt

SEQ ID NO: 14820 - DNA, 20 bp, Artificial Sequence
  Description of Artificial Sequence: Synthetic oligonucleotide
gaacgttcttactaaattag

SEQ ID NO: 14821 - DNA, 20 bp, Artificial Sequence
  Description of Artificial Sequence: Synthetic oligonucleotide
ggaacgttcttactaaatta

SEQ ID NO: 14822 - DNA, 20 bp, Artificial Sequence
  Description of Artificial Sequence: Synthetic oligonucleotide
gggaacgttcttactaaatt

SEQ ID NO: 14823 - DNA, 20 bp, Artificial Sequence
  Description of Artificial Sequence: Synthetic oligonucleotide
tgggaacgttcttactaaat

SEQ ID NO: 14824 - DNA, 20 bp, Artificial Sequence
  Description of Artificial Sequence: Synthetic oligonucleotide
ttgggaacgttcttactaaa

SEQ ID NO: 14825 - DNA, 20 bp, Artificial Sequence
  Description of Artificial Sequence: Synthetic oligonucleotide
tttgggaacgttcttactaa

SEQ ID NO: 14826 - DNA, 20 bp, Artificial Sequence
  Description of Artificial Sequence: Synthetic oligonucleotide
atttgggaacgttcttacta

SEQ ID NO: 14827 - DNA, 20 bp, Artificial Sequence
  Description of Artificial Sequence: Synthetic oligonucleotide
catttgggaacgttcttact

SEQ ID NO: 14828 - DNA, 20 bp, Artificial Sequence
  Description of Artificial Sequence: Synthetic oligonucleotide
acatttgggaacgttcttac

SEQ ID NO: 14829 - DNA, 20 bp, Artificial Sequence
  Description of Artificial Sequence: Synthetic oligonucleotide
aacatttgggaacgttctta

SEQ ID NO: 14830 - DNA, 20 bp, Artificial Sequence
  Description of Artificial Sequence: Synthetic oligonucleotide
caacatttgggaacgttctt

SEQ ID NO: 14831 - DNA, 20 bp, Artificial Sequence
  Description of Artificial Sequence: Synthetic oligonucleotide
acaacatttgggaacgttct

SEQ ID NO: 14832 - DNA, 20 bp, Artificial Sequence
  Description of Artificial Sequence: Synthetic oligonucleotide
tacaacatttgggaacgttc

SEQ ID NO: 14833 - DNA, 20 bp, Artificial Sequence
  Description of Artificial Sequence: Synthetic oligonucleotide
ttacaacatttgggaacgtt

SEQ ID NO: 14834 - DNA, 20 bp, Artificial Sequence
  Description of Artificial Sequence: Synthetic oligonucleotide
gttacaacatttgggaacgt

SEQ ID NO: 14835 - DNA, 20 bp, Artificial Sequence
  Description of Artificial Sequence: Synthetic oligonucleotide
tgttacaacatttgggaacg

SEQ ID NO: 14836 - DNA, 20 bp, Artificial Sequence
  Description of Artificial Sequence: Synthetic oligonucleotide
ttgttacaacatttgggaac

SEQ ID NO: 14837 - DNA, 20 bp, Artificial Sequence
  Description of Artificial Sequence: Synthetic oligonucleotide
attgttacaacatttgggaa

SEQ ID NO: 14838 - DNA, 20 bp, Artificial Sequence
  Description of Artificial Sequence: Synthetic oligonucleotide
cattgttacaacatttggga

SEQ ID NO: 14839 - DNA, 20 bp, Artificial Sequence
  Description of Artificial Sequence: Synthetic oligonucleotide
acattgttacaacatttggg

SEQ ID NO: 14840 - DNA, 20 bp, Artificial Sequence
  Description of Artificial Sequence: Synthetic oligonucleotide
cacattgttacaacatttgg

SEQ ID NO: 14841 - DNA, 20 bp, Artificial Sequence
  Description of Artificial Sequence: Synthetic oligonucleotide
ccacattgttacaacatttg

SEQ ID NO: 14842 - DNA, 20 bp, Artificial Sequence
  Description of Artificial Sequence: Synthetic oligonucleotide
tccacattgttacaacattt

SEQ ID NO: 14843 - DNA, 20 bp, Artificial Sequence
  Description of Artificial Sequence: Synthetic oligonucleotide
atccacattgttacaacatt

SEQ ID NO: 14844 - DNA, 20 bp, Artificial Sequence
  Description of Artificial Sequence: Synthetic oligonucleotide
gatccacattgttacaacat

SEQ ID NO: 14845 - DNA, 20 bp, Artificial Sequence
  Description of Artificial Sequence: Synthetic oligonucleotide
tgatccacattgttacaaca

SEQ ID NO: 14846 - DNA, 20 bp, Artificial Sequence
  Description of Artificial Sequence: Synthetic oligonucleotide
atgatccacattgttacaac

SEQ ID NO: 14847 - DNA, 20 bp, Artificial Sequence
  Description of Artificial Sequence: Synthetic oligonucleotide
tatgatccacattgttacaa

SEQ ID NO: 14848 - DNA, 20 bp, Artificial Sequence
  Description of Artificial Sequence: Synthetic oligonucleotide
gtatgatccacattgttaca

SEQ ID NO: 14849 - DNA, 20 bp, Artificial Sequence
  Description of Artificial Sequence: Synthetic oligonucleotide
tgtatgatccacattgttac

SEQ ID NO: 14850 - DNA, 20 bp, Artificial Sequence
  Description of Artificial Sequence: Synthetic oligonucleotide
atgtatgatccacattgtta

SEQ ID NO: 14851 - DNA, 20 bp, Artificial Sequence
  Description of Artificial Sequence: Synthetic oligonucleotide
gatgtatgatccacattgtt

SEQ ID NO: 14852 - DNA, 20 bp, Artificial Sequence
  Description of Artificial Sequence: Synthetic oligonucleotide
agatgtatgatccacattgt

SEQ ID NO: 14853 - DNA, 20 bp, Artificial Sequence
  Description of Artificial Sequence: Synthetic oligonucleotide
gagatgtatgatccacattg

SEQ ID NO: 14854 - DNA, 20 bp, Artificial Sequence
  Description of Artificial Sequence: Synthetic oligonucleotide
agagatgtatgatccacatt

SEQ ID NO: 14855 - DNA, 20 bp, Artificial Sequence
  Description of Artificial Sequence: Synthetic oligonucleotide
cagagatgtatgatccacat

SEQ ID NO: 14856 - DNA, 20 bp, Artificial Sequence
  Description of Artificial Sequence: Synthetic oligonucleotide
ccagagatgtatgatccaca

SEQ ID NO: 14857 - DNA, 20 bp, Artificial Sequence
  Description of Artificial Sequence: Synthetic oligonucleotide
accagagatgtatgatccac

SEQ ID NO: 14858 - DNA, 20 bp, Artificial Sequence
  Description of Artificial Sequence: Synthetic oligonucleotide
aaccagagatgtatgatcca

SEQ ID NO: 14859 - DNA, 20 bp, Artificial Sequence
  Description of Artificial Sequence: Synthetic oligonucleotide
aaaccagagatgtatgatcc

SEQ ID NO: 14860 - DNA, 20 bp, Artificial Sequence
  Description of Artificial Sequence: Synthetic oligonucleotide
aaaaccagagatgtatgatc

SEQ ID NO: 14861 - DNA, 20 bp, Artificial Sequence
  Description of Artificial Sequence: Synthetic oligonucleotide
aaaaaccagagatgtatgat

SEQ ID NO: 14862 - DNA, 20 bp, Artificial Sequence
  Description of Artificial Sequence: Synthetic oligonucleotide
aaaaaaccagagatgtatga

SEQ ID NO: 14863 - DNA, 20 bp, Artificial Sequence
  Description of Artificial Sequence: Synthetic oligonucleotide
taaaaaaccagagatgtatg

SEQ ID NO: 14864 - DNA, 20 bp, Artificial Sequence
  Description of Artificial Sequence: Synthetic oligonucleotide
ttaaaaaaccagagatgtat

SEQ ID NO: 14865 - DNA, 20 bp, Artificial Sequence
  Description of Artificial Sequence: Synthetic oligonucleotide
tttaaaaaaccagagatgta

SEQ ID NO: 14866 - DNA, 20 bp, Artificial Sequence
  Description of Artificial Sequence: Synthetic oligonucleotide
atttaaaaaaccagagatgt

SEQ ID NO: 14867 - DNA, 20 bp, Artificial Sequence
  Description of Artificial Sequence: Synthetic oligonucleotide
catttaaaaaaccagagatg

SEQ ID NO: 14868 - DNA, 20 bp, Artificial Sequence
  Description of Artificial Sequence: Synthetic oligonucleotide
acatttaaaaaaccagagat

SEQ ID NO: 14869 - DNA, 20 bp, Artificial Sequence
  Description of Artificial Sequence: Synthetic oligonucleotide
tacatttaaaaaaccagaga

SEQ ID NO: 14870 - DNA, 20 bp, Artificial Sequence
  Description of Artificial Sequence: Synthetic oligonucleotide
atacatttaaaaaaccagag

SEQ ID NO: 14871 - DNA, 20 bp, Artificial Sequence
  Description of Artificial Sequence: Synthetic oligonucleotide
aatacatttaaaaaaccaga

SEQ ID NO: 14872 - DNA, 20 bp, Artificial Sequence
  Description of Artificial Sequence: Synthetic oligonucleotide
caatacatttaaaaaaccag

SEQ ID NO: 14873 - DNA, 20 bp, Artificial Sequence
  Description of Artificial Sequence: Synthetic oligonucleotide
tcaatacatttaaaaaacca

SEQ ID NO: 14874 - DNA, 20 bp, Artificial Sequence
  Description of Artificial Sequence: Synthetic oligonucleotide
ctcaatacatttaaaaaacc

SEQ ID NO: 14875 - DNA, 20 bp, Artificial Sequence
  Description of Artificial Sequence: Synthetic oligonucleotide
cctcaatacatttaaaaaac

SEQ ID NO: 14876 - DNA, 20 bp, Artificial Sequence
  Description of Artificial Sequence: Synthetic oligonucleotide
gcctcaatacatttaaaaaa

SEQ ID NO: 14877 - DNA, 20 bp, Artificial Sequence
  Description of Artificial Sequence: Synthetic oligonucleotide
agcctcaatacatttaaaaa

SEQ ID NO: 14878 - DNA, 20 bp, Artificial Sequence
  Description of Artificial Sequence: Synthetic oligonucleotide
aagcctcaatacatttaaaa

SEQ ID NO: 14879 - DNA, 20 bp, Artificial Sequence
  Description of Artificial Sequence: Synthetic oligonucleotide
aaagcctcaatacatttaaa

SEQ ID NO: 14880 - DNA, 20 bp, Artificial Sequence
  Description of Artificial Sequence: Synthetic oligonucleotide
gaaagcctcaatacatttaa

SEQ ID NO: 14881 - DNA, 20 bp, Artificial Sequence
  Description of Artificial Sequence: Synthetic oligonucleotide
agaaagcctcaatacattta

SEQ ID NO: 14882 - DNA, 20 bp, Artificial Sequence
  Description of Artificial Sequence: Synthetic oligonucleotide
aagaaagcctcaatacattt

SEQ ID NO: 14883 - DNA, 20 bp, Artificial Sequence
  Description of Artificial Sequence: Synthetic oligonucleotide
caagaaagcctcaatacatt

SEQ ID NO: 14884 - DNA, 20 bp, Artificial Sequence
  Description of Artificial Sequence: Synthetic oligonucleotide
ccaagaaagcctcaatacat

SEQ ID NO: 14885 - DNA, 20 bp, Artificial Sequence
  Description of Artificial Sequence: Synthetic oligonucleotide
accaagaaagcctcaataca

SEQ ID NO: 14886 - DNA, 20 bp, Artificial Sequence
  Description of Artificial Sequence: Synthetic oligonucleotide
caccaagaaagcctcaatac

SEQ ID NO: 14887 - DNA, 20 bp, Artificial Sequence
  Description of Artificial Sequence: Synthetic oligonucleotide
ccaccaagaaagcctcaata

SEQ ID NO: 14888 - DNA, 20 bp, Artificial Sequence
  Description of Artificial Sequence: Synthetic oligonucleotide
tccaccaagaaagcctcaat

SEQ ID NO: 14889 - DNA, 20 bp, Artificial Sequence
  Description of Artificial Sequence: Synthetic oligonucleotide
gtccaccaagaaagcctcaa

SEQ ID NO: 14890 - DNA, 20 bp, Artificial Sequence
  Description of Artificial Sequence: Synthetic oligonucleotide
agtccaccaagaaagcctca

SEQ ID NO: 14891 - DNA, 20 bp, Artificial Sequence
  Description of Artificial Sequence: Synthetic oligonucleotide
tagtccaccaagaaagcctc

SEQ ID NO: 14892 - DNA, 20 bp, Artificial Sequence
  Description of Artificial Sequence: Synthetic oligonucleotide
ctagtccaccaagaaagcct

SEQ ID NO: 14893 - DNA, 20 bp, Artificial Sequence
  Description of Artificial Sequence: Synthetic oligonucleotide
actagtccaccaagaaagcc

SEQ ID NO: 14894 - DNA, 20 bp, Artificial Sequence
  Description of Artificial Sequence: Synthetic oligonucleotide
tactagtccaccaagaaagc

SEQ ID NO: 14895 - DNA, 20 bp, Artificial Sequence
  Description of Artificial Sequence: Synthetic oligonucleotide
atactagtccaccaagaaag

SEQ ID NO: 14896 - DNA, 20 bp, Artificial Sequence
  Description of Artificial Sequence: Synthetic oligonucleotide
tatactagtccaccaagaaa

SEQ ID NO: 14897 - DNA, 20 bp, Artificial Sequence
  Description of Artificial Sequence: Synthetic oligonucleotide
ctatactagtccaccaagaa

SEQ ID NO: 14898 - DNA, 20 bp, Artificial Sequence
  Description of Artificial Sequence: Synthetic oligonucleotide
actatactagtccaccaaga

SEQ ID NO: 14899 - DNA, 20 bp, Artificial Sequence
  Description of Artificial Sequence: Synthetic oligonucleotide
tactatactagtccaccaag

SEQ ID NO: 14900 - DNA, 20 bp, Artificial Sequence
  Description of Artificial Sequence: Synthetic oligonucleotide
atactatactagtccaccaa

SEQ ID NO: 14901 - DNA, 20 bp, Artificial Sequence
  Description of Artificial Sequence: Synthetic oligonucleotide
tatactatactagtccacca

SEQ ID NO: 14902 - DNA, 20 bp, Artificial Sequence
  Description of Artificial Sequence: Synthetic oligonucleotide
gtatactatactagtccacc

SEQ ID NO: 14903 - DNA, 20 bp, Artificial Sequence
  Description of Artificial Sequence: Synthetic oligonucleotide
cgtatactatactagtccac

SEQ ID NO: 14904 - DNA, 20 bp, Artificial Sequence
  Description of Artificial Sequence: Synthetic oligonucleotide
ccgtatactatactagtcca

SEQ ID NO: 14905 - DNA, 20 bp, Artificial Sequence
  Description of Artificial Sequence: Synthetic oligonucleotide
accgtatactatactagtcc

SEQ ID NO: 14906 - DNA, 20 bp, Artificial Sequence
  Description of Artificial Sequence: Synthetic oligonucleotide
gaccgtatactatactagtc

SEQ ID NO: 14907 - DNA, 20 bp, Artificial Sequence
  Description of Artificial Sequence: Synthetic oligonucleotide
tgaccgtatactatactagt

SEQ ID NO: 14908 - DNA, 20 bp, Artificial Sequence
  Description of Artificial Sequence: Synthetic oligonucleotide
ctgaccgtatactatactag

SEQ ID NO: 14909 - DNA, 20 bp, Artificial Sequence
  Description of Artificial Sequence: Synthetic oligonucleotide
actgaccgtatactatacta

SEQ ID NO: 14910 - DNA, 20 bp, Artificial Sequence
  Description of Artificial Sequence: Synthetic oligonucleotide
aactgaccgtatactatact

SEQ ID NO: 14911 - DNA, 20 bp, Artificial Sequence
  Description of Artificial Sequence: Synthetic oligonucleotide
taactgaccgtatactatac

SEQ ID NO: 14912 - DNA, 20 bp, Artificial Sequence
  Description of Artificial Sequence: Synthetic oligonucleotide
ataactgaccgtatactata

SEQ ID NO: 14913 - DNA, 20 bp, Artificial Sequence
  Description of Artificial Sequence: Synthetic oligonucleotide
cataactgaccgtatactat

SEQ ID NO: 14914 - DNA, 20 bp, Artificial Sequence
  Description of Artificial Sequence: Synthetic oligonucleotide
acataactgaccgtatacta

SEQ ID NO: 14915 - DNA, 20 bp, Artificial Sequence
  Description of Artificial Sequence: Synthetic oligonucleotide
gacataactgaccgtatact

SEQ ID NO: 14916 - DNA, 20 bp, Artificial Sequence
  Description of Artificial Sequence: Synthetic oligonucleotide
tgacataactgaccgtatac

SEQ ID NO: 14917 - DNA, 20 bp, Artificial Sequence
  Description of Artificial Sequence: Synthetic oligonucleotide
ttgacataactgaccgtata

SEQ ID NO: 14918 - DNA, 20 bp, Artificial Sequence
  Description of Artificial Sequence: Synthetic oligonucleotide
attgacataactgaccgtat

SEQ ID NO: 14919 - DNA, 20 bp, Artificial Sequence
  Description of Artificial Sequence: Synthetic oligonucleotide
cattgacataactgaccgta

SEQ ID NO: 14920 - DNA, 20 bp, Artificial Sequence
  Description of Artificial Sequence: Synthetic oligonucleotide
acattgacataactgaccgt

SEQ ID NO: 14921 - DNA, 20 bp, Artificial Sequence
  Description of Artificial Sequence: Synthetic oligonucleotide
aacattgacataactgaccg

SEQ ID NO: 14922 - DNA, 20 bp, Artificial Sequence
  Description of Artificial Sequence: Synthetic oligonucleotide
aaacattgacataactgacc

SEQ ID NO: 14923 - DNA, 2610 bp, Homo sapiens
atcagggagactccaacttaaggcaacagcatgggtgaataagggcttcctgtggactggcaatgagaggcaaaacctggtgcttgagcactggcccctaaggcaggccttacagatctcttacactcgtggtgggaagagtttagtgtgaaactggggtggaattgggtgtccacgtatgttcccttttgccttactatatgttctgtcagtttctttcaggaaaatcttcatcttacaacttgtagggctggtgttaacttacgacttcactaactgtgactttgagaagattaaagcagcctatctcagtactatttctaaagacctgattacatatatgagtgggaccaaaagtaccgagttcaacaacaccgtctcttgtagcaatcggccacattgccttactgaaatccagagcctaaccttcaatcccaccgccggctgcgcgtcgctcgccaaagaaatgttcgccatgaaaactaaggctgccttagctatctggtgcccaggctattcggaaactcagataaatgctactcaggcaatgaagaagaggagaaaaaggaaagtcacaaccaataaatgtctggaacaagtgtcacaattacaaggattgtggcgtcgcttcaatcgacctttactgaaacaacagtaaaccatctttattatggtcatatttcacagcaccaaaataaatcatctttattaagtagatgaaacattaactctaactgtgacaaagaagaccacaaatagttatcttttaattacagaagagtttcttaacttacttttgtaagtttttattgtgtaagtttataatgcaggggaagtactactcctcaaatgttgagggaagcttccataacattgatgactggcttcatggcagtaattctcggctgtagttgcataagcattgctcaagaggaaaatccaaaagtgcagcaggagaactcttttccctgaaaaaggaaaaatattgaactcaatgatagcacctaaacttacatttaaaagacagacattccttctacatgtaatgacacttcttgtgttaaactaaaaatttacaagagaagaaagtgaaagcaaatggggtttcacaaatagttgtaaatatagtgaagcaatttgaaataattttcaagcaaagtattgtgaaagtattctaagccaagttttaaatattatctaacagacaagagtggtatatacaagtagatcctgagaagtacctttgttacagctactataaatatacatataaattatagaatctactttaatttattttgtgaacacttttgaaaatgtacatgttcctttgtaattgacactatatatttcttaataaaataattctcaaatttgtttcttatgaatcatctctcaaatctagttagacaatttgcacacatacttttctaagggacattatcttccttcaggtttttacctccactcatccttagagcccactgactgctcccctttatacctgttggccctgcctataggagagaatatttggagataggcagcttcaggatgcattgcaatcatccttttcttaaattatgtcactagtcttttattttttcccctcttgaactttcctcacacctggaagaaacaaagtaggaaaaagtgaacaggggatgtcaaatcgattcttgaattcccgctgcaagctagagccgcaggcaccctctcactcaatttccactcagaaccctataaacaccagtgggaagggcaacccactgcacgtgggaatgcactgatttttcctaggagtagacatgttcctctaattactccctgagggttagttggggctaaaccatgacagaagtggggaagttcaatgtccttaaatccatcttacttgccaacaggtaagaggaagcttacattacatgtccagtccacatttaaagagcacttactgtggaacaagccttcagccaaacaatggggatagaaaagtaggtaagactcagcctttgtccagagaagctcagggtatagctgaataggcagtttcttttgtcctgaggaaaatcaggacatgcctgctttctaaaaatcttcctctgaagacctgacccaagctcttaaatgctattgtaagagaaatttctttgtctattaactccattttagtagggattcactgactagattttactgaactatgaaaataaatacacataatttttcacaaaattttgggcccaattcccctaaaagaattgaggattagggagaaaggagacaactcaaagtcatcccattaagtgcagtttctttgaatcttctgctttatctttaaaaatttgtataatttatatattttattctatgtgttccatagatatcttaatgtaaaattagtcatttaaattacactgtcaattaaaagtaatgggcaagagattgcatcatactaatttagtaagaacgttcccaaatgttgtaacaatgtggatcatacatctctggttttttaaatgtattgaggctttcttggtggactagtatagtatacggtcagttatgtcaatgtttcatggtcaataaaaaggaagttgcaaattgtga

SEQ ID NO: 14924 - DNA, 2380 bp, Homo sapiens
accctcgccacgcccctgctcccccgcggttggttcttccttgctctactcaaccctgacctcttctctctgactctcgacttgtgttccccgctcctccctgaccttcctcccctcccctttcactcaattctcaccaactctttctctctctggtgttttctccttttctcgtaaactttgccgcctatgagcagccacattgccttactgaaatccagagcctaaccttcaatcccaccgccggctgcgcgtcgctcgccaaagaaatgttcgccatgaaaactaaggctgccttagctatctggtgcccaggctattcggaaactcagataaatgctactcaggcaatgaagaagaggagaaaaaggaaagtcacaaccaataaatgtctggaacaagtgtcacaattacaaggattgtggcgtcgcttcaatcgacctttactgaaacaacagtaaaccatctttattatggtcatatttcacagcaccaaaataaatcatctttattaagtagatgaaacattaactctaactgtgacaaagaagaccacaaatagttatcttttaattacagaagagtttcttaacttacttttgtaagtttttattgtgtaagtttataatgcaggggaagtactactcctcaaatgttgagggaagcttccataacattgatgactggcttcatggcagtaattctcggctgtagttgcataagcattgctcaagaggaaaatccaaaagtgcagcaggagaactcttttccctgaaaaaggaaaaatattgaactcaatgatagcacctaaacttacatttaaaagacagacattccttctacatgtaatgacacttcttgtgttaaactaaaaatttacaagagaagaaagtgaaagcaaatggggtttcacaaatagttgtaaatatagtgaagcaatttgaaataattttcaagcaaagtattgtgaaagtattctaagccaagttttaaatattatctaacagacaagagtggtatatacaagtagatcctgagaagtacctttgttacagctactataaatatacatataaattatagaatctactttaatttattttgtgaacacttttgaaaatgtacatgttcctttgtaattgacactatatatttcttaataaaataattctcaaatttgtttcttatgaatcatctctcaaatctagttagacaatttgcacacatacttttctaagggacattatcttccttcaggtttttacctccactcatccttagagcccactgactgctcccctttatacctgttggccctgcctataggagagaatatttggagataggcagcttcaggatgcattgcaatcatccttttcttaaattatgtcactagtcttttattttttcccctcttgaactttcctcacacctggaagaaacaaagtaggaaaaagtgaacaggggatgtcaaatcgattcttgaattcccgctgcaagctagagccgcaggcaccctctcactcaatttccactcagaaccctataaacaccagtgggaagggcaacccactgcacgtgggaatgcactgatttttcctaggagtagacatgttcctctaattactccctgagggttagttggggctaaaccatgacagaagtggggaagttcaatgtccttaaatccatcttacttgccaacaggtaagaggaagcttacattacatgtccagtccacatttaaagagcacttactgtggaacaagccttcagccaaacaatggggatagaaaagtaggtaagactcagcctttgtccagagaagctcagggtatagctgaataggcagtttcttttgtcctgaggaaaatcaggacatgcctgctttctaaaaatcttcctctgaagacctgacccaagctcttaaatgctattgtaagagaaatttctttgtctattaactccattttagtagggattcactgactagattttactgaactatgaaaataaatacacataatttttcacaaaattttgggcccaattcccctaaaagaattgaggattagggagaaaggagacaactcaaagtcatcccattaagtgcagtttctttgaatcttctgctttatctttaaaaatttgtataatttatatattttattctatgtgttccatagatatcttaatgtaaaattagtcatttaaattacactgtcaattaaaagtaatgggcaagagattgcatcatactaatttagtaagaacgttcccaaatgttgtaacaatgtggatcatacatctctggttttttaaatgtattgaggctttcttggtggactagtatagtatacggtcagttatgtcaatgttt

SEQ ID NO: 14925 - DNA, 6333 bp, Homo sapiens
gcagccagaaagctctggagcatcagggagactccaacttaaggcaacagcatgggtgaataagggcttcctgtggactggcaatgagaggcaaaacctggtgcttgagcactggcccctaaggcaggccttacagatctcttacactcgtggtgggaagagtttagtgtgaaactggggtggaattgggtgtccacgtatgttcccttttgccttactatatgttctgtcagtttctttcaggaaaatcttcatcttacaacttgtagggctggtgttaacttacgacttcactaactgtgactttgagaagattaaagcagcctatctcagtactatttctaaagacctgattacatatatgagtggggtaagtgaagaagcttttttaaaacaaatgtattttcatcagaggagtcggcatacacacactctacaatttaactttgtaggaaagaaaaataatttagaaaaaatcatggccccacattttgtcaaggattcttacaagtgatattcaaatatctaatctaaaatgattatctagaaattggcacattctaagtgtgcagatgctgatgaggagcaggtattgatagacagcgcgttatgcgtcaaaggatgtctatcctttgctaaagtgttactctgactatgctgtaaaaagcaggaggtaagagcttaagaaagaggagtaaaagagataattctcatgagataaactctaaggattgatgctgtgctccaggtctctccagtgttttagatgtttcaggatgctatttattacagaatatggtgtacttggaattttttttaacatacagtagtaatcattttcctgattaacctaatttctagacagagtttgcattcatgaatggccacagtacagatgcggacatccaaaggatggcattattactcacaagcatagtgctatgtgcagttatggcttgagggaagggaggggggaggtcgccctctgagacctgaaccttttggtgtggtttcaagcactaaccagcactatctaatggctatttcactgccttgtcaatgacataggaaaaaggtacctgagtggaaactgttttcagggcacctttaaagcctgggagcaaagggtggagggatgattttccttgtggacttaaaagtctttaccctctttgtcctatttttctttcttccagaccaaaagtaccgagttcaacaacaccgtctcttgtagcaatcgggtgagtagagagttcagtgctgctggctttctccagggagacgccaggcattttggagagggagtatcctgctacgtgcagaactccgagaggtgcctgggctccgggacgccgccgccgggggaaaggggacatctgggctgtcagagcggggctgcgcctagcttgggacaacacttctgttccaatttagggagaggaagtctctatccggaggaaaggcaaattgggaactgggacgagggaacgttgttaggggcaccacctgctggggtccggcgcctccgcgctcgggctcggaattttggcagcctccgccccctggagacttgggaggagcgagcgtgggtgacagtcttttcgcgacgagtgccctccgccaccctcgccacgcccctgctcccccgcggttggttcttccttgctctactcaaccctgacctcttctctctgactctcgacttgtgttccccgctcctccctgaccttcctcccctcccctttcactcaattctcaccaactctttctctctctggtgttttctccttttctcgtaaactttgccgcctatgagcagccacattgccttactgaaatccagagcctaaccttcaatcccaccgccggctgcgcgtcgctcgccaaagaaatgttcgccatgaaaactaaggctgccttagctatctggtgcccaggctattcggaaactcaggtaagcccgaagcctcagacgtttgctgtaccttggggctaacctcaaattaaactggggctttggtgcagaagtcgttctcttatttttatttaggttttatctttcgaagagcaaacgagccgggtaaaagtggtaggatgtcagttagacccacgttgatacccggaatcaaactcacctatttctacggttctgatactgttttggctgaattatggttctaaaccttagggcaatgtttcaagctatgatgagtgagacttctatatcagaatgttttgattgctggagcataagagtatggctgctaaaaatgccaattcccaggtactcaacccagaccttcaacattaaaatctcagattatggggctccttaagagattcttgtccagtccaaagtttgagcaacacctcttgttcttatcacttaattattgtgtgcttatttgctaaatgtataattacattatacataaaatctctatcctatgtttgcttaattgcttgtgtgggcgctattgctgtctctttacacatttttgcacatgtagttatctgcatttgaatgctcgtgtagcattaaatatggagatagtgtagtggaaagttaggcacaggaactctggagacaacctgcctgactttgaatcctggccctataacttctgtgaagacttagttaaattacttagcctccgtgtactgtagcttcatgggtaaagtaagtatcatatcagttagtcttatacaggttgtttctgaggattaaattagtcaacacatgtaaatgcagttggaacagtgcctggtacacaacaggcactcaatatttatttcagtcagcaagtagaggatttatcttcatggtgacaagtttaaggaacagagagagacaagtgcagatatgtttgattgctccttattagcctagtggactttatatgtctacagtctaggtagatggacacgactgtcactttttttttttttttttttttgagacagaatctcgctctgttacccaggctggaatgcagtggcacgatctcagctcactgcaacctccatctcctgggttcaagcctcagcctcccgagtagctggaactacaggtgcccgccaccacgcctggctaacttttgtatttttagtagagacggggtttcaccatattggccaggctggtctcgaattcctgaccttgtgatctgcctgcctcggcctcccaaagtgctggaattacaagcatgagccaccatgcccagccaaaactgtcactttctagaggttgaggattgaagccatagcgctgatctgggttgagcttgaattagaaactcaataccagacagccatatgggaaacctatttggcttcatgccttcttatgaaggagaccctggcaaatctgcagatggctacaataaaattcatttaaataagagcacaaacaaaaagctagatcaagttcttggacagcatgtgagaaagggagagtttggagaaatttatttcagtccctcccaagcccaaatggagagtctaagactaataataatgattttgcaggtttttttaagatttgtgcttaataaccctgtgactttattaatttgcataccatgtgtctaggaggcccagtgtactactcaaaggtaattcagataaaggtatatactgcaatcctctttaaaataagccctcagatgtctgtgacacatctagacaatggggcaggggagggggaaggatggggagcaggagcatgcattttgggtccaaaaaatagactaggtttattgaatgatgtctataaacaggtataagatagctcttgcccatgaggaacttgtgatcttgtcagggaggtcttgaaatcagcaatttattcatttacttaatcactcaacaaatattcagtgtttcctatgattaagacactgtattcagtgctatggggaatacctatgatgcaatataaagaaaagcatgttaagtgagagccaagttaaatgacacacactcttaagtactggaagagtttccaaaagcaaggtctgagcaattagtggaggctttttgaaggaggtggtgcttggccttgaagcaaaagtaggtgggtacagaaacaggaaggcattcccctggaaaaggcacatgctagcacatagtaagcaggtgctttggagacacactgaaagatggatttgcatagagaaggcaattaaacctgctctcaacagttactaaagatagtgaaaagtaattttgactattgattcttatattctgcagataaatgctactcaggcaatgaagaagaggagaaaaaggaaagtcacaaccaataaatgtctggaacaagtgtcacaattacaaggattgtggcgtcgcttcaatcgacctttactgaaacaacagtaaaccatctttattatggtcatatttcacagcaccaaaataaatcatctttattaagtagatgaaacattaactctaactgtgacaaagaagaccacaaatagttatcttttaattacagaagagtttcttaacttacttttgtaagtttttattgtgtaagtttataatgcaggggaagtactactcctcaaatgttgagggaagcttccataacattgatgactggcttcatggcagtaattctcggctgtagttgcataagcattgctcaagaggaaaatccaaaagtgcagcaggagaactcttttccctgaaaaaggaaaaatattgaactcaatgatagcacctaaacttacatttaaaagacagacattccttctacatgtaatgacacttcttgtgttaaactaaaaatttacaagagaagaaagtgaaagcaaatggggtttcacaaatagttgtaaatatagtgaagcaatttgaaataattttcaagcaaagtattgtgaaagtattctaagccaagttttaaatattatctaacagacaagagtggtatatacaagtagatcctgagaagtacctttgttacagctactataaatatacatataaattatagaatctactttaatttattttgtgaacacttttgaaaatgtacatgttcctttgtaattgacactatatatttcttaataaaataattctcaaatttgtttcttatgaatcatctctcaaatctagttagacaatttgcacacatacttttctaagggacattatcttccttcaggtttttacctccactcatccttagagcccactgactgctcccctttatacctgttggccctgcctataggagagaatatttggagataggcagcttcaggatgcattgcaatcatccttttcttaaattatgtcactagtcttttattttttcccctcttgaactttcctcacacctggaagaaacaaagtaggaaaaagtgaacaggggatgtcaaatcgattcttgaattcccgctgcaagctagagccgcaggcaccctctcactcaatttccactcagaaccctataaacaccagtgggaagggcaacccactgcacgtgggaatgcactgatttttcctaggagtagacatgttcctctaattactccctgagggttagttggggctaaaccatgacagaagtggggaagttcaatgtccttaaatccatcttacttgccaacaggtaagaggaagcttacattacatgtccagtccacatttaaagagcacttactgtggaacaagccttcagccaaacaatggggatagaaaagtaggtaagactcagcctttgtccagagaagctcagggtatagctgaataggcagtttcttttgtcctgaggaaaatcaggacatgcctgctttctaaaaatcttcctctgaagacctgacccaagctcttaaatgctattgtaagagaaatttctttgtctattaactccattttagtagggattcactgactagattttactgaactatgaaaataaatacacataatttttcacaaaattttgggcccaattcccctaaaagaattgaggattagggagaaaggagacaactcaaagtcatcccattaagtgcagtttctttgaatcttctgctttatctttaaaaatttgtataatttatatattttattctatgtgttccatagatatcttaatgtaaaattagtcatttaaattacactgtcaattaaaagtaatgggcaagagattgcatcatactaatttagtaagaacgttcccaaatgttgtaacaatgtggatcatacatctctggttttttaaatgtattgaggctttcttggtggactagtatagtatacggtcagttatgtcaatgtttcatggtcaataaaaaggaagttgcaaattgt

SEQ ID NO: 14926 - DNA, 20 bp, Artificial Sequence
  Description of Artificial Sequence: Synthetic oligonucleotide
  modified_base (1)..(5): 2'O-methoxyethyl modified
  misc_feature (1)..(20): Phosphorothioate linkage
  modified_base (6)..(15): Deoxyribonucleotide
  modified_base (16)..(20): 2'O-methoxyethyl modified
ctctcattgccagtccacag

SEQ ID NO: 14927 - DNA, 20 bp, Artificial Sequence
  Description of Artificial Sequence: Synthetic oligonucleotide
  modified_base (1)..(5): 2'O-methoxyethyl modified
  misc_feature (1)..(20): Phosphorothioate linkage
  modified_base (6)..(15): Deoxyribonucleotide
  modified_base (16)..(20): 2'O-methoxyethyl modified
aggtcagggttgagtagagc

SEQ ID NO: 14928 - DNA, 20 bp, Artificial Sequence
  Description of Artificial Sequence: Synthetic oligonucleotide
  modified_base (1)..(5): 2'O-methoxyethyl modified
  misc_feature (1)..(20): Phosphorothioate linkage
  modified_base (6)..(15): Deoxyribonucleotide
  modified_base (16)..(20): 2'O-methoxyethyl modified
tctaaccgagctgatggact

SEQ ID NO: 14929 - DNA, 21 bp, Artificial Sequence
  Description of Artificial Sequence: Synthetic oligonucleotide
  Description of Combined DNA/RNA Molecule: Synthetic oligonucleotide
cugguguuaacuuacgacutt

SEQ ID NO: 14930 - DNA, 21 bp, Artificial Sequence
  Description of Artificial Sequence: Synthetic oligonucleotide
  Description of Combined DNA/RNA Molecule: Synthetic oligonucleotide
agucguaaguuaacaccagtt

SEQ ID NO: 14931 - DNA, 21 bp, Artificial Sequence
  Description of Artificial Sequence: Synthetic oligonucleotide
  Description of Combined DNA/RNA Molecule: Synthetic oligonucleotide
cguaaacuuugccgccuautt

SEQ ID NO: 14932 - DNA, 21 bp, Artificial Sequence
  Description of Artificial Sequence: Synthetic oligonucleotide
  Description of Combined DNA/RNA Molecule: Synthetic oligonucleotide
auaggcggcaaaguuuacgtt

SEQ ID NO: 14933 - DNA, 23 bp, Artificial Sequence
  Description of Artificial Sequence: Synthetic oligonucleotide
  Description of Combined DNA/RNA Molecule: Synthetic oligonucleotide
guuguacagcaugcggagagutt

SEQ ID NO: 14934 - DNA, 23 bp, Artificial Sequence
  Description of Artificial Sequence: Synthetic oligonucleotide
  Description of Combined DNA/RNA Molecule: Synthetic oligonucleotide
acucuccgcaugcuguacaactt

SEQ ID NO: 14935 - RNA, 21 nt, Artificial Sequence
  Description of Artificial Sequence: Synthetic oligonucleotide
aucagggagacuccaacuuaa

SEQ ID NO: 14936 - RNA, 21 nt, Artificial Sequence
  Description of Artificial Sequence: Synthetic oligonucleotide
ucagggagacuccaacuuaag

SEQ ID NO: 14937 - RNA, 21 nt, Artificial Sequence
  Description of Artificial Sequence: Synthetic oligonucleotide
cagggagacuccaacuuaagg

SEQ ID NO: 14938 - RNA, 21 nt, Artificial Sequence
  Description of Artificial Sequence: Synthetic oligonucleotide
agggagacuccaacuuaaggc

SEQ ID NO: 14939 - RNA, 21 nt, Artificial Sequence
  Description of Artificial Sequence: Synthetic oligonucleotide
gggagacuccaacuuaaggca

SEQ ID NO: 14940 - RNA, 21 nt, Artificial Sequence
  Description of Artificial Sequence: Synthetic oligonucleotide
ggagacuccaacuuaaggcaa

SEQ ID NO: 14941 - RNA, 21 nt, Artificial Sequence
  Description of Artificial Sequence: Synthetic oligonucleotide
gagacuccaacuuaaggcaac

SEQ ID NO: 14942 - RNA, 21 nt, Artificial Sequence
  Description of Artificial Sequence: Synthetic oligonucleotide
agacuccaacuuaaggcaaca

SEQ ID NO: 14943 - RNA, 21 nt, Artificial Sequence
  Description of Artificial Sequence: Synthetic oligonucleotide
gacuccaacuuaaggcaacag

SEQ ID NO: 14944 - RNA, 21 nt, Artificial Sequence
  Description of Artificial Sequence: Synthetic oligonucleotide
acuccaacuuaaggcaacagc

SEQ ID NO: 14945 - RNA, 21 nt, Artificial Sequence
  Description of Artificial Sequence: Synthetic oligonucleotide
cuccaacuuaaggcaacagca

SEQ ID NO: 14946 - RNA, 21 nt, Artificial Sequence
  Description of Artificial Sequence: Synthetic oligonucleotide
uccaacuuaaggcaacagcau

SEQ ID NO: 14947 - RNA, 21 nt, Artificial Sequence
  Description of Artificial Sequence: Synthetic oligonucleotide
ccaacuuaaggcaacagcaug

SEQ ID NO: 14948 - RNA, 21 nt, Artificial Sequence
  Description of Artificial Sequence: Synthetic oligonucleotide
caacuuaaggcaacagcaugg

SEQ ID NO: 14949 - RNA, 21 nt, Artificial Sequence
  Description of Artificial Sequence: Synthetic oligonucleotide
aacuuaaggcaacagcauggg

SEQ ID NO: 14950 - RNA, 21 nt, Artificial Sequence
  Description of Artificial Sequence: Synthetic oligonucleotide
acuuaaggcaacagcaugggu

SEQ ID NO: 14951 - RNA, 21 nt, Artificial Sequence
  Description of Artificial Sequence: Synthetic oligonucleotide
cuuaaggcaacagcaugggug

SEQ ID NO: 14952 - RNA, 21 nt, Artificial Sequence
  Description of Artificial Sequence: Synthetic oligonucleotide
uuaaggcaacagcauggguga

SEQ ID NO: 14953 - RNA, 21 nt, Artificial Sequence
  Description of Artificial Sequence: Synthetic oligonucleotide
uaaggcaacagcaugggugaa

SEQ ID NO: 14954 - RNA, 21 nt, Artificial Sequence
  Description of Artificial Sequence: Synthetic oligonucleotide
aaggcaacagcaugggugaau

SEQ ID NO: 14955 - RNA, 21 nt, Artificial Sequence
  Description of Artificial Sequence: Synthetic oligonucleotide
aggcaacagcaugggugaaua

SEQ ID NO: 14956 - RNA, 21 nt, Artificial Sequence
  Description of Artificial Sequence: Synthetic oligonucleotide
ggcaacagcaugggugaauaa

SEQ ID NO: 14957 - RNA, 21 nt, Artificial Sequence
  Description of Artificial Sequence: Synthetic oligonucleotide
gcaacagcaugggugaauaag

SEQ ID NO: 14958 - RNA, 21 nt, Artificial Sequence
  Description of Artificial Sequence: Synthetic oligonucleotide
caacagcaugggugaauaagg

SEQ ID NO: 14959 - RNA, 21 nt, Artificial Sequence
  Description of Artificial Sequence: Synthetic oligonucleotide
aacagcaugggugaauaaggg

SEQ ID NO: 14960 - RNA, 21 nt, Artificial Sequence
  Description of Artificial Sequence: Synthetic oligonucleotide
acagcaugggugaauaagggc

SEQ ID NO: 14961 - RNA, 21 nt, Artificial Sequence
  Description of Artificial Sequence: Synthetic oligonucleotide
cagcaugggugaauaagggcu

SEQ ID NO: 14962 - RNA, 21 nt, Artificial Sequence
  Description of Artificial Sequence: Synthetic oligonucleotide
agcaugggugaauaagggcuu

SEQ ID NO: 14963 - RNA, 21 nt, Artificial Sequence
  Description of Artificial Sequence: Synthetic oligonucleotide
gcaugggugaauaagggcuuc

SEQ ID NO: 14964 - RNA, 21 nt, Artificial Sequence
  Description of Artificial Sequence: Synthetic oligonucleotide
caugggugaauaagggcuucc

SEQ ID NO: 14965 - RNA, 21 nt, Artificial Sequence
  Description of Artificial Sequence: Synthetic oligonucleotide
augggugaauaagggcuuccu

SEQ ID NO: 14966 - RNA, 21 nt, Artificial Sequence
  Description of Artificial Sequence: Synthetic oligonucleotide
ugggugaauaagggcuuccug

SEQ ID NO: 14967 - RNA, 21 nt, Artificial Sequence
  Description of Artificial Sequence: Synthetic oligonucleotide
gggugaauaagggcuuccugu

SEQ ID NO: 14968 - RNA, 21 nt, Artificial Sequence
  Description of Artificial Sequence: Synthetic oligonucleotide
ggugaauaagggcuuccugug

SEQ ID NO: 14969 - RNA, 21 nt, Artificial Sequence
  Description of Artificial Sequence: Synthetic oligonucleotide
gugaauaagggcuuccugugg

SEQ ID NO: 14970 - RNA, 21 nt, Artificial Sequence
  Description of Artificial Sequence: Synthetic oligonucleotide
ugaauaagggcuuccugugga

SEQ ID NO: 14971 - RNA, 21 nt, Artificial Sequence
  Description of Artificial Sequence: Synthetic oligonucleotide
gaauaagggcuuccuguggac

SEQ ID NO: 14972 - RNA, 21 nt, Artificial Sequence
  Description of Artificial Sequence: Synthetic oligonucleotide
aauaagggcuuccuguggacu

SEQ ID NO: 14973 - RNA, 21 nt, Artificial Sequence
  Description of Artificial Sequence: Synthetic oligonucleotide
auaagggcuuccuguggacug

SEQ ID NO: 14974 - RNA, 21 nt, Artificial Sequence
  Description of Artificial Sequence: Synthetic oligonucleotide
uaagggcuuccuguggacugg

SEQ ID NO: 14975 - RNA, 21 nt, Artificial Sequence
  Description of Artificial Sequence: Synthetic oligonucleotide
aagggcuuccuguggacuggc

SEQ ID NO: 14976 - RNA, 21 nt, Artificial Sequence
  Description of Artificial Sequence: Synthetic oligonucleotide
agggcuuccuguggacuggca

SEQ ID NO: 14977 - RNA, 21 nt, Artificial Sequence
  Description of Artificial Sequence: Synthetic oligonucleotide
gggcuuccuguggacuggcaa

SEQ ID NO: 14978 - RNA, 21 nt, Artificial Sequence
  Description of Artificial Sequence: Synthetic oligonucleotide
ggcuuccuguggacuggcaau

SEQ ID NO: 14979 - RNA, 21 nt, Artificial Sequence
  Description of Artificial Sequence: Synthetic oligonucleotide
gcuuccuguggacuggcaaug

SEQ ID NO: 14980 - RNA, 21 nt, Artificial Sequence
  Description of Artificial Sequence: Synthetic oligonucleotide
cuuccuguggacuggcaauga

SEQ ID NO: 14981 - RNA, 21 nt, Artificial Sequence
  Description of Artificial Sequence: Synthetic oligonucleotide
uuccuguggacuggcaaugag

SEQ ID NO: 14982 - RNA, 21 nt, Artificial Sequence
  Description of Artificial Sequence: Synthetic oligonucleotide
uccuguggacuggcaaugaga

SEQ ID NO: 14983 - RNA, 21 nt, Artificial Sequence
  Description of Artificial Sequence: Synthetic oligonucleotide
ccuguggacuggcaaugagag

SEQ ID NO: 14984 - RNA, 21 nt, Artificial Sequence
  Description of Artificial Sequence: Synthetic oligonucleotide
cuguggacuggcaaugagagg

SEQ ID NO: 14985 - RNA, 21 nt, Artificial Sequence
  Description of Artificial Sequence: Synthetic oligonucleotide
uguggacuggcaaugagaggc

SEQ ID NO: 14986 - RNA, 21 nt, Artificial Sequence
  Description of Artificial Sequence: Synthetic oligonucleotide
guggacuggcaaugagaggca

SEQ ID NO: 14987 - RNA, 21 nt, Artificial Sequence
  Description of Artificial Sequence: Synthetic oligonucleotide
uggacuggcaaugagaggcaa

SEQ ID NO: 14988 - RNA, 21 nt, Artificial Sequence
  Description of Artificial Sequence: Synthetic oligonucleotide
ggacuggcaaugagaggcaaa

SEQ ID NO: 14989 - RNA, 21 nt, Artificial Sequence
  Description of Artificial Sequence: Synthetic oligonucleotide
gacuggcaaugagaggcaaaa

SEQ ID NO: 14990 - RNA, 21 nt, Artificial Sequence
  Description of Artificial Sequence: Synthetic oligonucleotide
acuggcaaugagaggcaaaac

SEQ ID NO: 14991 - RNA, 21 nt, Artificial Sequence
  Description of Artificial Sequence: Synthetic oligonucleotide
cuggcaaugagaggcaaaacc

SEQ ID NO: 14992 - RNA, 21 nt, Artificial Sequence
  Description of Artificial Sequence: Synthetic oligonucleotide
uggcaaugagaggcaaaaccu

SEQ ID NO: 14993 - RNA, 21 nt, Artificial Sequence
  Description of Artificial Sequence: Synthetic oligonucleotide
ggcaaugagaggcaaaaccug

SEQ ID NO: 14994 - RNA, 21 nt, Artificial Sequence
  Description of Artificial Sequence: Synthetic oligonucleotide
gcaaugagaggcaaaaccugg

SEQ ID NO: 14995 - RNA, 21 nt, Artificial Sequence
  Description of Artificial Sequence: Synthetic oligonucleotide
caaugagaggcaaaaccuggu

SEQ ID NO: 14996 - RNA, 21 nt, Artificial Sequence
  Description of Artificial Sequence: Synthetic oligonucleotide
aaugagaggcaaaaccuggug

SEQ ID NO: 14997 - RNA, 21 nt, Artificial Sequence
  Description of Artificial Sequence: Synthetic oligonucleotide
augagaggcaaaaccuggugc

SEQ ID NO: 14998 - RNA, 21 nt, Artificial Sequence
  Description of Artificial Sequence: Synthetic oligonucleotide
ugagaggcaaaaccuggugcu

SEQ ID NO: 14999 - RNA, 21 nt, Artificial Sequence
  Description of Artificial Sequence: Synthetic oligonucleotide
gagaggcaaaaccuggugcuu

SEQ ID NO: 15000 - RNA, 21 nt, Artificial Sequence
  Description of Artificial Sequence: Synthetic oligonucleotide
agaggcaaaaccuggugcuug

SEQ ID NO: 15001 - RNA, 21 nt, Artificial Sequence
  Description of Artificial Sequence: Synthetic oligonucleotide
gaggcaaaaccuggugcuuga

SEQ ID NO: 15002 - RNA, 21 nt, Artificial Sequence
  Description of Artificial Sequence: Synthetic oligonucleotide
aggcaaaaccuggugcuugag

SEQ ID NO: 15003 - RNA, 21 nt, Artificial Sequence
  Description of Artificial Sequence: Synthetic oligonucleotide
ggcaaaaccuggugcuugagc

SEQ ID NO: 15004 - RNA, 21 nt, Artificial Sequence
  Description of Artificial Sequence: Synthetic oligonucleotide
gcaaaaccuggugcuugagca

SEQ ID NO: 15005 - RNA, 21 nt, Artificial Sequence
  Description of Artificial Sequence: Synthetic oligonucleotide
caaaaccuggugcuugagcac

SEQ ID NO: 15006 - RNA, 21 nt, Artificial Sequence
  Description of Artificial Sequence: Synthetic oligonucleotide
aaaaccuggugcuugagcacu

SEQ ID NO: 15007 - RNA, 21 nt, Artificial Sequence
  Description of Artificial Sequence: Synthetic oligonucleotide
aaaccuggugcuugagcacug

SEQ ID NO: 15008 - RNA, 21 nt, Artificial Sequence
  Description of Artificial Sequence: Synthetic oligonucleotide
aaccuggugcuugagcacugg

SEQ ID NO: 15009 - RNA, 21 nt, Artificial Sequence
  Description of Artificial Sequence: Synthetic oligonucleotide
accuggugcuugagcacuggc

SEQ ID NO: 15010 - RNA, 21 nt, Artificial Sequence
  Description of Artificial Sequence: Synthetic oligonucleotide
ccuggugcuugagcacuggcc

SEQ ID NO: 15011 - RNA, 21 nt, Artificial Sequence
  Description of Artificial Sequence: Synthetic oligonucleotide
cuggugcuugagcacuggccc

SEQ ID NO: 15012 - RNA, 21 nt, Artificial Sequence
  Description of Artificial Sequence: Synthetic oligonucleotide
uggugcuugagcacuggcccc

SEQ ID NO: 15013 - RNA, 21 nt, Artificial Sequence
  Description of Artificial Sequence: Synthetic oligonucleotide
ggugcuugagcacuggccccu

SEQ ID NO: 15014 - RNA, 21 nt, Artificial Sequence
  Description of Artificial Sequence: Synthetic oligonucleotide
gugcuugagcacuggccccua

SEQ ID NO: 15015 - RNA, 21 nt, Artificial Sequence
  Description of Artificial Sequence: Synthetic oligonucleotide
ugcuugagcacuggccccuaa

SEQ ID NO: 15016 - RNA, 21 nt, Artificial Sequence
  Description of Artificial Sequence: Synthetic oligonucleotide
gcuugagcacuggccccuaag

SEQ ID NO: 15017 - RNA, 21 nt, Artificial Sequence
  Description of Artificial Sequence: Synthetic oligonucleotide
cuugagcacuggccccuaagg

SEQ ID NO: 15018 - RNA, 21 nt, Artificial Sequence
  Description of Artificial Sequence: Synthetic oligonucleotide
uugagcacuggccccuaaggc

SEQ ID NO: 15019 - RNA, 21 nt, Artificial Sequence
  Description of Artificial Sequence: Synthetic oligonucleotide
ugagcacuggccccuaaggca

SEQ ID NO: 15020 - RNA, 21 nt, Artificial Sequence
  Description of Artificial Sequence: Synthetic oligonucleotide
gagcacuggccccuaaggcag

SEQ ID NO: 15021 - RNA, 21 nt, Artificial Sequence
  Description of Artificial Sequence: Synthetic oligonucleotide
agcacuggccccuaaggcagg

SEQ ID NO: 15022 - RNA, 21 nt, Artificial Sequence
  Description of Artificial Sequence: Synthetic oligonucleotide
gcacuggccccuaaggcaggc

SEQ ID NO: 15023 - RNA, 21 nt, Artificial Sequence
  Description of Artificial Sequence: Synthetic oligonucleotide
cacuggccccuaaggcaggcc

SEQ ID NO: 15024 - RNA, 21 nt, Artificial Sequence
  Description of Artificial Sequence: Synthetic oligonucleotide
acuggccccuaaggcaggccu

SEQ ID NO: 15025 - RNA, 21 nt, Artificial Sequence
  Description of Artificial Sequence: Synthetic oligonucleotide
cuggccccuaaggcaggccuu

SEQ ID NO: 15026 - RNA, 21 nt, Artificial Sequence
  Description of Artificial Sequence: Synthetic oligonucleotide
uggccccuaaggcaggccuua

SEQ ID NO: 15027 - RNA, 21 nt, Artificial Sequence
  Description of Artificial Sequence: Synthetic oligonucleotide
ggccccuaaggcaggccuuac

SEQ ID NO: 15028 - RNA, 21 nt, Artificial Sequence
  Description of Artificial Sequence: Synthetic oligonucleotide
gccccuaaggcaggccuuaca

SEQ ID NO: 15029 - RNA, 21 nt, Artificial Sequence
  Description of Artificial Sequence: Synthetic oligonucleotide
ccccuaaggcaggccuuacag

SEQ ID NO: 15030 - RNA, 21 nt, Artificial Sequence
  Description of Artificial Sequence: Synthetic oligonucleotide
cccuaaggcaggccuuacaga

SEQ ID NO: 15031 - RNA, 21 nt, Artificial Sequence
  Description of Artificial Sequence: Synthetic oligonucleotide
ccuaaggcaggccuuacagau

SEQ ID NO: 15032 - RNA, 21 nt, Artificial Sequence
  Description of Artificial Sequence: Synthetic oligonucleotide
cuaaggcaggccuuacagauc

SEQ ID NO: 15033 - RNA, 21 nt, Artificial Sequence
  Description of Artificial Sequence: Synthetic oligonucleotide
uaaggcaggccuuacagaucu

SEQ ID NO: 15034 - RNA, 21 nt, Artificial Sequence
  Description of Artificial Sequence: Synthetic oligonucleotide
aaggcaggccuuacagaucuc

SEQ ID NO: 15035 - RNA, 21 nt, Artificial Sequence
  Description of Artificial Sequence: Synthetic oligonucleotide
aggcaggccuuacagaucucu

SEQ ID NO: 15036 - RNA, 21 nt, Artificial Sequence
  Description of Artificial Sequence: Synthetic oligonucleotide
ggcaggccuuacagaucucuu

SEQ ID NO: 15037 - RNA, 21 nt, Artificial Sequence
  Description of Artificial Sequence: Synthetic oligonucleotide
gcaggccuuacagaucucuua

SEQ ID NO: 15038 - RNA, 21 nt, Artificial Sequence
  Description of Artificial Sequence: Synthetic oligonucleotide
caggccuuacagaucucuuac

SEQ ID NO: 15039 - RNA, 21 nt, Artificial Sequence
  Description of Artificial Sequence: Synthetic oligonucleotide
aggccuuacagaucucuuaca

SEQ ID NO: 15040 - RNA, 21 nt, Artificial Sequence
  Description of Artificial Sequence: Synthetic oligonucleotide
ggccuuacagaucucuuacac

SEQ ID NO: 15041 - RNA, 21 nt, Artificial Sequence
  Description of Artificial Sequence: Synthetic oligonucleotide
gccuuacagaucucuuacacu

SEQ ID NO: 15042 - RNA, 21 nt, Artificial Sequence
  Description of Artificial Sequence: Synthetic oligonucleotide
ccuuacagaucucuuacacuc

SEQ ID NO: 15043 - RNA, 21 nt, Artificial Sequence
  Description of Artificial Sequence: Synthetic oligonucleotide
cuuacagaucucuuacacucg

SEQ ID NO: 15044 - RNA, 21 nt, Artificial Sequence
  Description of Artificial Sequence: Synthetic oligonucleotide
uuacagaucucuuacacucgu

SEQ ID NO: 15045 - RNA, 21 nt, Artificial Sequence
  Description of Artificial Sequence: Synthetic oligonucleotide
uacagaucucuuacacucgug

SEQ ID NO: 15046 - RNA, 21 nt, Artificial Sequence
  Description of Artificial Sequence: Synthetic oligonucleotide
acagaucucuuacacucgugg

SEQ ID NO: 15047 - RNA, 21 nt, Artificial Sequence
  Description of Artificial Sequence: Synthetic oligonucleotide
cagaucucuuacacucguggu

SEQ ID NO: 15048 - RNA, 21 nt, Artificial Sequence
  Description of Artificial Sequence: Synthetic oligonucleotide
agaucucuuacacucguggug

SEQ ID NO: 15049 - RNA, 21 nt, Artificial Sequence
  Description of Artificial Sequence: Synthetic oligonucleotide
gaucucuuacacucguggugg

SEQ ID NO: 15050 - RNA, 21 nt, Artificial Sequence
  Description of Artificial Sequence: Synthetic oligonucleotide
aucucuuacacucgugguggg

SEQ ID NO: 15051 - RNA, 21 nt, Artificial Sequence
  Description of Artificial Sequence: Synthetic oligonucleotide
ucucuuacacucgugguggga

SEQ ID NO: 15052 - RNA, 21 nt, Artificial Sequence
  Description of Artificial Sequence: Synthetic oligonucleotide
cucuuacacucguggugggaa

SEQ ID NO: 15053 - RNA, 21 nt, Artificial Sequence
  Description of Artificial Sequence: Synthetic oligonucleotide
ucuuacacucguggugggaag

SEQ ID NO: 15054 - RNA, 21 nt, Artificial Sequence
  Description of Artificial Sequence: Synthetic oligonucleotide
cuuacacucguggugggaaga

SEQ ID NO: 15055 - RNA, 21 nt, Artificial Sequence
  Description of Artificial Sequence: Synthetic oligonucleotide
uuacacucguggugggaagag

SEQ ID NO: 15056 - RNA, 21 nt, Artificial Sequence
  Description of Artificial Sequence: Synthetic oligonucleotide
uacacucguggugggaagagu

SEQ ID NO: 15057 - RNA, 21 nt, Artificial Sequence
  Description of Artificial Sequence: Synthetic oligonucleotide
acacucguggugggaagaguu

SEQ ID NO: 15058 - RNA, 21 nt, Artificial Sequence
  Description of Artificial Sequence: Synthetic oligonucleotide
cacucguggugggaagaguuu

SEQ ID NO: 15059 - RNA, 21 nt, Artificial Sequence
  Description of Artificial Sequence: Synthetic oligonucleotide
acucguggugggaagaguuua

SEQ ID NO: 15060 - RNA, 21 nt, Artificial Sequence
  Description of Artificial Sequence: Synthetic oligonucleotide
cucguggugggaagaguuuag

SEQ ID NO: 15061 - RNA, 21 nt, Artificial Sequence
  Description of Artificial Sequence: Synthetic oligonucleotide
ucguggugggaagaguuuagu

SEQ ID NO: 15062 - RNA, 21 nt, Artificial Sequence
  Description of Artificial Sequence: Synthetic oligonucleotide
cguggugggaagaguuuagug

SEQ ID NO: 15063 - RNA, 21 nt, Artificial Sequence
  Description of Artificial Sequence: Synthetic oligonucleotide
guggugggaagaguuuagugu

SEQ ID NO: 15064 - RNA, 21 nt, Artificial Sequence
  Description of Artificial Sequence: Synthetic oligonucleotide
uggugggaagaguuuagugug

SEQ ID NO: 15065 - RNA, 21 nt, Artificial Sequence
  Description of Artificial Sequence: Synthetic oligonucleotide
ggugggaagaguuuaguguga

SEQ ID NO: 15066 - RNA, 21 nt, Artificial Sequence
  Description of Artificial Sequence: Synthetic oligonucleotide
gugggaagaguuuagugugaa

SEQ ID NO: 15067 - RNA, 21 nt, Artificial Sequence
  Description of Artificial Sequence: Synthetic oligonucleotide
ugggaagaguuuagugugaaa

SEQ ID NO: 15068 - RNA, 21 nt, Artificial Sequence
  Description of Artificial Sequence: Synthetic oligonucleotide
gggaagaguuuagugugaaac

SEQ ID NO: 15069 - RNA, 21 nt, Artificial Sequence
  Description of Artificial Sequence: Synthetic oligonucleotide
ggaagaguuuagugugaaacu

SEQ ID NO: 15070 - RNA, 21 nt, Artificial Sequence
  Description of Artificial Sequence: Synthetic oligonucleotide
gaagaguuuagugugaaacug

SEQ ID NO: 15071 - RNA, 21 nt, Artificial Sequence
  Description of Artificial Sequence: Synthetic oligonucleotide
aagaguuuagugugaaacugg

SEQ ID NO: 15072 - RNA, 21 nt, Artificial Sequence
  Description of Artificial Sequence: Synthetic oligonucleotide
agaguuuagugugaaacuggg

SEQ ID NO: 15073 - RNA, 21 nt, Artificial Sequence
  Description of Artificial Sequence: Synthetic oligonucleotide
gaguuuagugugaaacugggg

SEQ ID NO: 15074 - RNA, 21 nt, Artificial Sequence
  Description of Artificial Sequence: Synthetic oligonucleotide
aguuuagugugaaacuggggu

SEQ ID NO: 15075 - RNA, 21 nt, Artificial Sequence
  Description of Artificial Sequence: Synthetic oligonucleotide
guuuagugugaaacuggggug

SEQ ID NO: 15076 - RNA, 21 nt, Artificial Sequence
  Description of Artificial Sequence: Synthetic oligonucleotide
uuuagugugaaacuggggugg

SEQ ID NO: 15077 - RNA, 21 nt, Artificial Sequence
  Description of Artificial Sequence: Synthetic oligonucleotide
uuagugugaaacuggggugga

SEQ ID NO: 15078 - RNA, 21 nt, Artificial Sequence
  Description of Artificial Sequence: Synthetic oligonucleotide
uagugugaaacugggguggaa

SEQ ID NO: 15079 - RNA, 21 nt, Artificial Sequence
  Description of Artificial Sequence: Synthetic oligonucleotide
agugugaaacugggguggaau

SEQ ID NO: 15080 - RNA, 21 nt, Artificial Sequence
  Description of Artificial Sequence: Synthetic oligonucleotide
gugugaaacugggguggaauu

SEQ ID NO: 15081 - RNA, 21 nt, Artificial Sequence
  Description of Artificial Sequence: Synthetic oligonucleotide
ugugaaacugggguggaauug

SEQ ID NO: 15082 - RNA, 21 nt, Artificial Sequence
  Description of Artificial Sequence: Synthetic oligonucleotide
gugaaacugggguggaauugg

SEQ ID NO: 15083 - RNA, 21 nt, Artificial Sequence
  Description of Artificial Sequence: Synthetic oligonucleotide
ugaaacugggguggaauuggg

SEQ ID NO: 15084 - RNA, 21 nt, Artificial Sequence
  Description of Artificial Sequence: Synthetic oligonucleotide
gaaacugggguggaauugggu

SEQ ID NO: 15085 - RNA, 21 nt, Artificial Sequence
  Description of Artificial Sequence: Synthetic oligonucleotide
aaacugggguggaauugggug

SEQ ID NO: 15086 - RNA, 21 nt, Artificial Sequence
  Description of Artificial Sequence: Synthetic oligonucleotide
aacugggguggaauugggugu

SEQ ID NO: 15087 - RNA, 21 nt, Artificial Sequence
  Description of Artificial Sequence: Synthetic oligonucleotide
acugggguggaauuggguguc

SEQ ID NO: 15088 - RNA, 21 nt, Artificial Sequence
  Description of Artificial Sequence: Synthetic oligonucleotide
cugggguggaauugggugucc

SEQ ID NO: 15089 - RNA, 21 nt, Artificial Sequence
  Description of Artificial Sequence: Synthetic oligonucleotide
ugggguggaauugggugucca

SEQ ID NO: 15090 - RNA, 21 nt, Artificial Sequence
  Description of Artificial Sequence: Synthetic oligonucleotide
gggguggaauuggguguccac

SEQ ID NO: 15091 - RNA, 21 nt, Artificial Sequence
  Description of Artificial Sequence: Synthetic oligonucleotide
ggguggaauuggguguccacg

SEQ ID NO: 15092 - RNA, 21 nt, Artificial Sequence
  Description of Artificial Sequence: Synthetic oligonucleotide
gguggaauuggguguccacgu

SEQ ID NO: 15093 - RNA, 21 nt, Artificial Sequence
  Description of Artificial Sequence: Synthetic oligonucleotide
guggaauuggguguccacgua

SEQ ID NO: 15094 - RNA, 21 nt, Artificial Sequence
  Description of Artificial Sequence: Synthetic oligonucleotide
uggaauuggguguccacguau

SEQ ID NO: 15095 - RNA, 21 nt, Artificial Sequence
  Description of Artificial Sequence: Synthetic oligonucleotide
ggaauuggguguccacguaug

SEQ ID NO: 15096 - RNA, 21 nt, Artificial Sequence
  Description of Artificial Sequence: Synthetic oligonucleotide
gaauuggguguccacguaugu

SEQ ID NO: 15097 - RNA, 21 nt, Artificial Sequence
  Description of Artificial Sequence: Synthetic oligonucleotide
aauuggguguccacguauguu

SEQ ID NO: 15098 - RNA, 21 nt, Artificial Sequence
  Description of Artificial Sequence: Synthetic oligonucleotide
auuggguguccacguauguuc

SEQ ID NO: 15099 - RNA, 21 nt, Artificial Sequence
  Description of Artificial Sequence: Synthetic oligonucleotide
uuggguguccacguauguucc

SEQ ID NO: 15100 - RNA, 21 nt, Artificial Sequence
  Description of Artificial Sequence: Synthetic oligonucleotide
uggguguccacguauguuccc

SEQ ID NO: 15101 - RNA, 21 nt, Artificial Sequence
  Description of Artificial Sequence: Synthetic oligonucleotide
ggguguccacguauguucccu

SEQ ID NO: 15102 - RNA, 21 nt, Artificial Sequence
  Description of Artificial Sequence: Synthetic oligonucleotide
gguguccacguauguucccuu

SEQ ID NO: 15103 - RNA, 21 nt, Artificial Sequence
  Description of Artificial Sequence: Synthetic oligonucleotide
guguccacguauguucccuuu

SEQ ID NO: 15104 - RNA, 21 nt, Artificial Sequence
  Description of Artificial Sequence: Synthetic oligonucleotide
uguccacguauguucccuuuu

SEQ ID NO: 15105 - RNA, 21 nt, Artificial Sequence
  Description of Artificial Sequence: Synthetic oligonucleotide
guccacguauguucccuuuug

SEQ ID NO: 15106 - RNA, 21 nt, Artificial Sequence
  Description of Artificial Sequence: Synthetic oligonucleotide
uccacguauguucccuuuugc

SEQ ID NO: 15107 - RNA, 21 nt, Artificial Sequence
  Description of Artificial Sequence: Synthetic oligonucleotide
ccacguauguucccuuuugcc

SEQ ID NO: 15108 - RNA, 21 nt, Artificial Sequence
  Description of Artificial Sequence: Synthetic oligonucleotide
cacguauguucccuuuugccu

SEQ ID NO: 15109 - RNA, 21 nt, Artificial Sequence
  Description of Artificial Sequence: Synthetic oligonucleotide
acguauguucccuuuugccuu

SEQ ID NO: 15110 - RNA, 21 nt, Artificial Sequence
  Description of Artificial Sequence: Synthetic oligonucleotide
cguauguucccuuuugccuua

SEQ ID NO: 15111 - RNA, 21 nt, Artificial Sequence
  Description of Artificial Sequence: Synthetic oligonucleotide
guauguucccuuuugccuuac

SEQ ID NO: 15112 - RNA, 21 nt, Artificial Sequence
  Description of Artificial Sequence: Synthetic oligonucleotide
uauguucccuuuugccuuacu

SEQ ID NO: 15113 - RNA, 21 nt, Artificial Sequence
  Description of Artificial Sequence: Synthetic oligonucleotide
auguucccuuuugccuuacua

SEQ ID NO: 15114 - RNA, 21 nt, Artificial Sequence
  Description of Artificial Sequence: Synthetic oligonucleotide
uguucccuuuugccuuacuau

SEQ ID NO: 15115 - RNA, 21 nt, Artificial Sequence
  Description of Artificial Sequence: Synthetic oligonucleotide
guucccuuuugccuuacuaua

SEQ ID NO: 15116 - RNA, 21 nt, Artificial Sequence
  Description of Artificial Sequence: Synthetic oligonucleotide
uucccuuuugccuuacuauau

SEQ ID NO: 15117 - RNA, 21 nt, Artificial Sequence
  Description of Artificial Sequence: Synthetic oligonucleotide
ucccuuuugccuuacuauaug

SEQ ID NO: 15118 - RNA, 21 nt, Artificial Sequence
  Description of Artificial Sequence: Synthetic oligonucleotide
cccuuuugccuuacuauaugu

SEQ ID NO: 15119 - RNA, 21 nt, Artificial Sequence
  Description of Artificial Sequence: Synthetic oligonucleotide
ccuuuugccuuacuauauguu

SEQ ID NO: 15120 - RNA, 21 nt, Artificial Sequence
  Description of Artificial Sequence: Synthetic oligonucleotide
cuuuugccuuacuauauguuc

SEQ ID NO: 15121 - RNA, 21 nt, Artificial Sequence
  Description of Artificial Sequence: Synthetic oligonucleotide
uuuugccuuacuauauguucu

SEQ ID NO: 15122 - RNA, 21 nt, Artificial Sequence
  Description of Artificial Sequence: Synthetic oligonucleotide
uuugccuuacuauauguucug

SEQ ID NO: 15123 - RNA, 21 nt, Artificial Sequence
  Description of Artificial Sequence: Synthetic oligonucleotide
uugccuuacuauauguucugu

SEQ ID NO: 15124 - RNA, 21 nt, Artificial Sequence
  Description of Artificial Sequence: Synthetic oligonucleotide
ugccuuacuauauguucuguc

SEQ ID NO: 15125 - RNA, 21 nt, Artificial Sequence
  Description of Artificial Sequence: Synthetic oligonucleotide
gccuuacuauauguucuguca

SEQ ID NO: 15126 - RNA, 21 nt, Artificial Sequence
  Description of Artificial Sequence: Synthetic oligonucleotide
ccuuacuauauguucugucag

SEQ ID NO: 15127 - RNA, 21 nt, Artificial Sequence
  Description of Artificial Sequence: Synthetic oligonucleotide
cuuacuauauguucugucagu

SEQ ID NO: 15128 - RNA, 21 nt, Artificial Sequence
  Description of Artificial Sequence: Synthetic oligonucleotide
uuacuauauguucugucaguu

SEQ ID NO: 15129 - RNA, 21 nt, Artificial Sequence
  Description of Artificial Sequence: Synthetic oligonucleotide
uacuauauguucugucaguuu

SEQ ID NO: 15130 - RNA, 21 nt, Artificial Sequence
  Description of Artificial Sequence: Synthetic oligonucleotide
acuauauguucugucaguuuc

SEQ ID NO: 15131 - RNA, 21 nt, Artificial Sequence
  Description of Artificial Sequence: Synthetic oligonucleotide
cuauauguucugucaguuucu

SEQ ID NO: 15132 - RNA, 21 nt, Artificial Sequence
  Description of Artificial Sequence: Synthetic oligonucleotide
uauauguucugucaguuucuu

SEQ ID NO: 15133 - RNA, 21 nt, Artificial Sequence
  Description of Artificial Sequence: Synthetic oligonucleotide
auauguucugucaguuucuuu

SEQ ID NO: 15134 - RNA, 21 nt, Artificial Sequence
  Description of Artificial Sequence: Synthetic oligonucleotide
uauguucugucaguuucuuuc

SEQ ID NO: 15135 - RNA, 21 nt, Artificial Sequence
  Description of Artificial Sequence: Synthetic oligonucleotide
auguucugucaguuucuuuca

SEQ ID NO: 15136 - RNA, 21 nt, Artificial Sequence
  Description of Artificial Sequence: Synthetic oligonucleotide
uguucugucaguuucuuucag

SEQ ID NO: 15137 - RNA, 21 nt, Artificial Sequence
  Description of Artificial Sequence: Synthetic oligonucleotide
guucugucaguuucuuucagg

SEQ ID NO: 15138 - RNA, 21 nt, Artificial Sequence
  Description of Artificial Sequence: Synthetic oligonucleotide
uucugucaguuucuuucagga

SEQ ID NO: 15139 - RNA, 21 nt, Artificial Sequence
  Description of Artificial Sequence: Synthetic oligonucleotide
ucugucaguuucuuucaggaa

SEQ ID NO: 15140 - RNA, 21 nt, Artificial Sequence
  Description of Artificial Sequence: Synthetic oligonucleotide
cugucaguuucuuucaggaaa

SEQ ID NO: 15141 - RNA, 21 nt, Artificial Sequence
  Description of Artificial Sequence: Synthetic oligonucleotide
ugucaguuucuuucaggaaaa

SEQ ID NO: 15142 - RNA, 21 nt, Artificial Sequence
  Description of Artificial Sequence: Synthetic oligonucleotide
gucaguuucuuucaggaaaau

SEQ ID NO: 15143 - RNA, 21 nt, Artificial Sequence
  Description of Artificial Sequence: Synthetic oligonucleotide
ucaguuucuuucaggaaaauc

SEQ ID NO: 15144 - RNA, 21 nt, Artificial Sequence
  Description of Artificial Sequence: Synthetic oligonucleotide
caguuucuuucaggaaaaucu

SEQ ID NO: 15145 - RNA, 21 nt, Artificial Sequence
  Description of Artificial Sequence: Synthetic oligonucleotide
aguuucuuucaggaaaaucuu

SEQ ID NO: 15146 - RNA, 21 nt, Artificial Sequence
  Description of Artificial Sequence: Synthetic oligonucleotide
guuucuuucaggaaaaucuuc

SEQ ID NO: 15147 - RNA, 21 nt, Artificial Sequence
  Description of Artificial Sequence: Synthetic oligonucleotide
uuucuuucaggaaaaucuuca

SEQ ID NO: 15148 - RNA, 21 nt, Artificial Sequence
  Description of Artificial Sequence: Synthetic oligonucleotide
uucuuucaggaaaaucuucau

SEQ ID NO: 15149 - RNA, 21 nt, Artificial Sequence
  Description of Artificial Sequence: Synthetic oligonucleotide
ucuuucaggaaaaucuucauc

SEQ ID NO: 15150 - RNA, 21 nt, Artificial Sequence
  Description of Artificial Sequence: Synthetic oligonucleotide
cuuucaggaaaaucuucaucu

SEQ ID NO: 15151 - RNA, 21 nt, Artificial Sequence
  Description of Artificial Sequence: Synthetic oligonucleotide
uuucaggaaaaucuucaucuu

SEQ ID NO: 15152 - RNA, 21 nt, Artificial Sequence
  Description of Artificial Sequence: Synthetic oligonucleotide
uucaggaaaaucuucaucuua

SEQ ID NO: 15153 - RNA, 21 nt, Artificial Sequence
  Description of Artificial Sequence: Synthetic oligonucleotide
ucaggaaaaucuucaucuuac

SEQ ID NO: 15154 - RNA, 21 nt, Artificial Sequence
  Description of Artificial Sequence: Synthetic oligonucleotide
caggaaaaucuucaucuuaca

SEQ ID NO: 15155 - RNA, 21 nt, Artificial Sequence
  Description of Artificial Sequence: Synthetic oligonucleotide
aggaaaaucuucaucuuacaa

SEQ ID NO: 15156 - RNA, 21 nt, Artificial Sequence
  Description of Artificial Sequence: Synthetic oligonucleotide
ggaaaaucuucaucuuacaac

SEQ ID NO: 15157 - RNA, 21 nt, Artificial Sequence
  Description of Artificial Sequence: Synthetic oligonucleotide
gaaaaucuucaucuuacaacu

SEQ ID NO: 15158 - RNA, 21 nt, Artificial Sequence
  Description of Artificial Sequence: Synthetic oligonucleotide
aaaaucuucaucuuacaacuu

SEQ ID NO: 15159 - RNA, 21 nt, Artificial Sequence
  Description of Artificial Sequence: Synthetic oligonucleotide
aaaucuucaucuuacaacuug

SEQ ID NO: 15160 - RNA, 21 nt, Artificial Sequence
  Description of Artificial Sequence: Synthetic oligonucleotide
aaucuucaucuuacaacuugu

SEQ ID NO: 15161 - RNA, 21 nt, Artificial Sequence
  Description of Artificial Sequence: Synthetic oligonucleotide
aucuucaucuuacaacuugua

SEQ ID NO: 15162 - RNA, 21 nt, Artificial Sequence
  Description of Artificial Sequence: Synthetic oligonucleotide
ucuucaucuuacaacuuguag

SEQ ID NO: 15163 - RNA, 21 nt, Artificial Sequence
  Description of Artificial Sequence: Synthetic oligonucleotide
cuucaucuuacaacuuguagg

SEQ ID NO: 15164 - RNA, 21 nt, Artificial Sequence
  Description of Artificial Sequence: Synthetic oligonucleotide
uucaucuuacaacuuguaggg

SEQ ID NO: 15165 - RNA, 21 nt, Artificial Sequence
  Description of Artificial Sequence: Synthetic oligonucleotide
ucaucuuacaacuuguagggc

SEQ ID NO: 15166 - RNA, 21 nt, Artificial Sequence
  Description of Artificial Sequence: Synthetic oligonucleotide
caucuuacaacuuguagggcu

SEQ ID NO: 15167 - RNA, 21 nt, Artificial Sequence
  Description of Artificial Sequence: Synthetic oligonucleotide
aucuuacaacuuguagggcug

SEQ ID NO: 15168 - RNA, 21 nt, Artificial Sequence
  Description of Artificial Sequence: Synthetic oligonucleotide
ucuuacaacuuguagggcugg

SEQ ID NO: 15169 - RNA, 21 nt, Artificial Sequence
  Description of Artificial Sequence: Synthetic oligonucleotide
cuuacaacuuguagggcuggu

SEQ ID NO: 15170 - RNA, 21 nt, Artificial Sequence
  Description of Artificial Sequence: Synthetic oligonucleotide
uuacaacuuguagggcuggug

SEQ ID NO: 15171 - RNA, 21 nt, Artificial Sequence
  Description of Artificial Sequence: Synthetic oligonucleotide
uacaacuuguagggcuggugu

SEQ ID NO: 15172 - RNA, 21 nt, Artificial Sequence
  Description of Artificial Sequence: Synthetic oligonucleotide
acaacuuguagggcugguguu

SEQ ID NO: 15173 - RNA, 21 nt, Artificial Sequence
  Description of Artificial Sequence: Synthetic oligonucleotide
caacuuguagggcugguguua

SEQ ID NO: 15174 - RNA, 21 nt, Artificial Sequence
  Description of Artificial Sequence: Synthetic oligonucleotide
aacuuguagggcugguguuaa

SEQ ID NO: 15175 - RNA, 21 nt, Artificial Sequence
  Description of Artificial Sequence: Synthetic oligonucleotide
acuuguagggcugguguuaac

SEQ ID NO: 15176 - RNA, 21 nt, Artificial Sequence
  Description of Artificial Sequence: Synthetic oligonucleotide
cuuguagggcugguguuaacu

SEQ ID NO: 15177 - RNA, 21 nt, Artificial Sequence
  Description of Artificial Sequence: Synthetic oligonucleotide
uuguagggcugguguuaacuu

SEQ ID NO: 15178 - RNA, 21 nt, Artificial Sequence
  Description of Artificial Sequence: Synthetic oligonucleotide
uguagggcugguguuaacuua

SEQ ID NO: 15179 - RNA, 21 nt, Artificial Sequence
  Description of Artificial Sequence: Synthetic oligonucleotide
guagggcugguguuaacuuac

SEQ ID NO: 15180 - RNA, 21 nt, Artificial Sequence
  Description of Artificial Sequence: Synthetic oligonucleotide
uagggcugguguuaacuuacg

SEQ ID NO: 15181 - RNA, 21 nt, Artificial Sequence
  Description of Artificial Sequence: Synthetic oligonucleotide
agggcugguguuaacuuacga

SEQ ID NO: 15182 - RNA, 21 nt, Artificial Sequence
  Description of Artificial Sequence: Synthetic oligonucleotide
gggcugguguuaacuuacgac

SEQ ID NO: 15183 - RNA, 21 nt, Artificial Sequence
  Description of Artificial Sequence: Synthetic oligonucleotide
ggcugguguuaacuuacgacu

SEQ ID NO: 15184 - RNA, 21 nt, Artificial Sequence
  Description of Artificial Sequence: Synthetic oligonucleotide
gcugguguuaacuuacgacuu

SEQ ID NO: 15185 - RNA, 21 nt, Artificial Sequence
  Description of Artificial Sequence: Synthetic oligonucleotide
cugguguuaacuuacgacuuc

SEQ ID NO: 15186 - RNA, 21 nt, Artificial Sequence
  Description of Artificial Sequence: Synthetic oligonucleotide
ugguguuaacuuacgacuuca

SEQ ID NO: 15187 - RNA, 21 nt, Artificial Sequence
  Description of Artificial Sequence: Synthetic oligonucleotide
gguguuaacuuacgacuucac

SEQ ID NO: 15188 - RNA, 21 nt, Artificial Sequence
  Description of Artificial Sequence: Synthetic oligonucleotide
guguuaacuuacgacuucacu

SEQ ID NO: 15189 - RNA, 21 nt, Artificial Sequence
  Description of Artificial Sequence: Synthetic oligonucleotide
uguuaacuuacgacuucacua

SEQ ID NO: 15190 - RNA, 21 nt, Artificial Sequence
  Description of Artificial Sequence: Synthetic oligonucleotide
guuaacuuacgacuucacuaa

SEQ ID NO: 15191 - RNA, 21 nt, Artificial Sequence
  Description of Artificial Sequence: Synthetic oligonucleotide
uuaacuuacgacuucacuaac

SEQ ID NO: 15192 - RNA, 21 nt, Artificial Sequence
  Description of Artificial Sequence: Synthetic oligonucleotide
uaacuuacgacuucacuaacu

SEQ ID NO: 15193 - RNA, 21 nt, Artificial Sequence
  Description of Artificial Sequence: Synthetic oligonucleotide
aacuuacgacuucacuaacug

SEQ ID NO: 15194 - RNA, 21 nt, Artificial Sequence
  Description of Artificial Sequence: Synthetic oligonucleotide
acuuacgacuucacuaacugu

SEQ ID NO: 15195 - RNA, 21 nt, Artificial Sequence
  Description of Artificial Sequence: Synthetic oligonucleotide
cuuacgacuucacuaacugug

SEQ ID NO: 15196 - RNA, 21 nt, Artificial Sequence
  Description of Artificial Sequence: Synthetic oligonucleotide
uuacgacuucacuaacuguga

SEQ ID NO: 15197 - RNA, 21 nt, Artificial Sequence
  Description of Artificial Sequence: Synthetic oligonucleotide
uacgacuucacuaacugugac

SEQ ID NO: 15198 - RNA, 21 nt, Artificial Sequence
  Description of Artificial Sequence: Synthetic oligonucleotide
acgacuucacuaacugugacu

SEQ ID NO: 15199 - RNA, 21 nt, Artificial Sequence
  Description of Artificial Sequence: Synthetic oligonucleotide
cgacuucacuaacugugacuu

SEQ ID NO: 15200 - RNA, 21 nt, Artificial Sequence
  Description of Artificial Sequence: Synthetic oligonucleotide
gacuucacuaacugugacuuu

SEQ ID NO: 15201 - RNA, 21 nt, Artificial Sequence
  Description of Artificial Sequence: Synthetic oligonucleotide
acuucacuaacugugacuuug

SEQ ID NO: 15202 - RNA, 21 nt, Artificial Sequence
  Description of Artificial Sequence: Synthetic oligonucleotide
cuucacuaacugugacuuuga

SEQ ID NO: 15203 - RNA, 21 nt, Artificial Sequence
  Description of Artificial Sequence: Synthetic oligonucleotide
uucacuaacugugacuuugag

SEQ ID NO: 15204 - RNA, 21 nt, Artificial Sequence
  Description of Artificial Sequence: Synthetic oligonucleotide
ucacuaacugugacuuugaga

SEQ ID NO: 15205 - RNA, 21 nt, Artificial Sequence
  Description of Artificial Sequence: Synthetic oligonucleotide
cacuaacugugacuuugagaa

SEQ ID NO: 15206 - RNA, 21 nt, Artificial Sequence
  Description of Artificial Sequence: Synthetic oligonucleotide
acuaacugugacuuugagaag

SEQ ID NO: 15207 - RNA, 21 nt, Artificial Sequence
  Description of Artificial Sequence: Synthetic oligonucleotide
cuaacugugacuuugagaaga

SEQ ID NO: 15208 - RNA, 21 nt, Artificial Sequence
  Description of Artificial Sequence: Synthetic oligonucleotide
uaacugugacuuugagaagau

SEQ ID NO: 15209 - RNA, 21 nt, Artificial Sequence
  Description of Artificial Sequence: Synthetic oligonucleotide
aacugugacuuugagaagauu

SEQ ID NO: 15210 - RNA, 21 nt, Artificial Sequence
  Description of Artificial Sequence: Synthetic oligonucleotide
acugugacuuugagaagauua

SEQ ID NO: 15211 - RNA, 21 nt, Artificial Sequence
  Description of Artificial Sequence: Synthetic oligonucleotide
cugugacuuugagaagauuaa

SEQ ID NO: 15212 - RNA, 21 nt, Artificial Sequence
  Description of Artificial Sequence: Synthetic oligonucleotide
ugugacuuugagaagauuaaa

SEQ ID NO: 15213 - RNA, 21 nt, Artificial Sequence
  Description of Artificial Sequence: Synthetic oligonucleotide
gugacuuugagaagauuaaag

SEQ ID NO: 15214 - RNA, 21 nt, Artificial Sequence
  Description of Artificial Sequence: Synthetic oligonucleotide
ugacuuugagaagauuaaagc

SEQ ID NO: 15215 - RNA, 21 nt, Artificial Sequence
  Description of Artificial Sequence: Synthetic oligonucleotide
gacuuugagaagauuaaagca

SEQ ID NO: 15216 - RNA, 21 nt, Artificial Sequence
  Description of Artificial Sequence: Synthetic oligonucleotide
acuuugagaagauuaaagcag

SEQ ID NO: 15217 - RNA, 21 nt, Artificial Sequence
  Description of Artificial Sequence: Synthetic oligonucleotide
cuuugagaagauuaaagcagc

SEQ ID NO: 15218 - RNA, 21 nt, Artificial Sequence
  Description of Artificial Sequence: Synthetic oligonucleotide
uuugagaagauuaaagcagcc

SEQ ID NO: 15219 - RNA, 21 nt, Artificial Sequence
  Description of Artificial Sequence: Synthetic oligonucleotide
uugagaagauuaaagcagccu

SEQ ID NO: 15220 - RNA, 21 nt, Artificial Sequence
  Description of Artificial Sequence: Synthetic oligonucleotide
ugagaagauuaaagcagccua

SEQ ID NO: 15221 - RNA, 21 nt, Artificial Sequence
  Description of Artificial Sequence: Synthetic oligonucleotide
gagaagauuaaagcagccuau

SEQ ID NO: 15222 - RNA, 21 nt, Artificial Sequence
  Description of Artificial Sequence: Synthetic oligonucleotide
agaagauuaaagcagccuauc

SEQ ID NO: 15223 - RNA, 21 nt, Artificial Sequence
  Description of Artificial Sequence: Synthetic oligonucleotide
gaagauuaaagcagccuaucu

SEQ ID NO: 15224 - RNA, 21 nt, Artificial Sequence
  Description of Artificial Sequence: Synthetic oligonucleotide
aagauuaaagcagccuaucuc

SEQ ID NO: 15225 - RNA, 21 nt, Artificial Sequence
  Description of Artificial Sequence: Synthetic oligonucleotide
agauuaaagcagccuaucuca

SEQ ID NO: 15226 - RNA, 21 nt, Artificial Sequence
  Description of Artificial Sequence: Synthetic oligonucleotide
gauuaaagcagccuaucucag

SEQ ID NO: 15227 - RNA, 21 nt, Artificial Sequence
  Description of Artificial Sequence: Synthetic oligonucleotide
auuaaagcagccuaucucagu

SEQ ID NO: 15228 - RNA, 21 nt, Artificial Sequence
  Description of Artificial Sequence: Synthetic oligonucleotide
uuaaagcagccuaucucagua

SEQ ID NO: 15229 - RNA, 21 nt, Artificial Sequence
  Description of Artificial Sequence: Synthetic oligonucleotide
uaaagcagccuaucucaguac

SEQ ID NO: 15230 - RNA, 21 nt, Artificial Sequence
  Description of Artificial Sequence: Synthetic oligonucleotide
aaagcagccuaucucaguacu

SEQ ID NO: 15231 - RNA, 21 nt, Artificial Sequence
  Description of Artificial Sequence: Synthetic oligonucleotide
aagcagccuaucucaguacua

SEQ ID NO: 15232 - RNA, 21 nt, Artificial Sequence
  Description of Artificial Sequence: Synthetic oligonucleotide
agcagccuaucucaguacuau

SEQ ID NO: 15233 - RNA, 21 nt, Artificial Sequence
  Description of Artificial Sequence: Synthetic oligonucleotide
gcagccuaucucaguacuauu

SEQ ID NO: 15234 - RNA, 21 nt, Artificial Sequence
  Description of Artificial Sequence: Synthetic oligonucleotide
cagccuaucucaguacuauuu

SEQ ID NO: 15235 - RNA, 21 nt, Artificial Sequence
  Description of Artificial Sequence: Synthetic oligonucleotide
agccuaucucaguacuauuuc

SEQ ID NO: 15236 - RNA, 21 nt, Artificial Sequence
  Description of Artificial Sequence: Synthetic oligonucleotide
gccuaucucaguacuauuucu

SEQ ID NO: 15237 - RNA, 21 nt, Artificial Sequence
  Description of Artificial Sequence: Synthetic oligonucleotide
ccuaucucaguacuauuucua

SEQ ID NO: 15238 - RNA, 21 nt, Artificial Sequence
  Description of Artificial Sequence: Synthetic oligonucleotide
cuaucucaguacuauuucuaa

SEQ ID NO: 15239 - RNA, 21 nt, Artificial Sequence
  Description of Artificial Sequence: Synthetic oligonucleotide
uaucucaguacuauuucuaaa

SEQ ID NO: 15240 - RNA, 21 nt, Artificial Sequence
  Description of Artificial Sequence: Synthetic oligonucleotide
aucucaguacuauuucuaaag

SEQ ID NO: 15241 - RNA, 21 nt, Artificial Sequence
  Description of Artificial Sequence: Synthetic oligonucleotide
ucucaguacuauuucuaaaga

SEQ ID NO: 15242 - RNA, 21 nt, Artificial Sequence
  Description of Artificial Sequence: Synthetic oligonucleotide
cucaguacuauuucuaaagac

SEQ ID NO: 15243 - RNA, 21 nt, Artificial Sequence
  Description of Artificial Sequence: Synthetic oligonucleotide
ucaguacuauuucuaaagacc

SEQ ID NO: 15244 - RNA, 21 nt, Artificial Sequence
  Description of Artificial Sequence: Synthetic oligonucleotide
caguacuauuucuaaagaccu

SEQ ID NO: 15245 - RNA, 21 nt, Artificial Sequence
  Description of Artificial Sequence: Synthetic oligonucleotide
aguacuauuucuaaagaccug

SEQ ID NO: 15246 - RNA, 21 nt, Artificial Sequence
  Description of Artificial Sequence: Synthetic oligonucleotide
guacuauuucuaaagaccuga

SEQ ID NO: 15247 - RNA, 21 nt, Artificial Sequence
  Description of Artificial Sequence: Synthetic oligonucleotide
uacuauuucuaaagaccugau

SEQ ID NO: 15248 - RNA, 21 nt, Artificial Sequence
  Description of Artificial Sequence: Synthetic oligonucleotide
acuauuucuaaagaccugauu

SEQ ID NO: 15249 - RNA, 21 nt, Artificial Sequence
  Description of Artificial Sequence: Synthetic oligonucleotide
cuauuucuaaagaccugauua

SEQ ID NO: 15250 - RNA, 21 nt, Artificial Sequence
  Description of Artificial Sequence: Synthetic oligonucleotide
uauuucuaaagaccugauuac

SEQ ID NO: 15251 - RNA, 21 nt, Artificial Sequence
  Description of Artificial Sequence: Synthetic oligonucleotide
auuucuaaagaccugauuaca

SEQ ID NO: 15252 - RNA, 21 nt, Artificial Sequence
  Description of Artificial Sequence: Synthetic oligonucleotide
uuucuaaagaccugauuacau

SEQ ID NO: 15253 - RNA, 21 nt, Artificial Sequence
  Description of Artificial Sequence: Synthetic oligonucleotide
uucuaaagaccugauuacaua

SEQ ID NO: 15254 - RNA, 21 nt, Artificial Sequence
  Description of Artificial Sequence: Synthetic oligonucleotide
ucuaaagaccugauuacauau

SEQ ID NO: 15255 - RNA, 21 nt, Artificial Sequence
  Description of Artificial Sequence: Synthetic oligonucleotide
cuaaagaccugauuacauaua

SEQ ID NO: 15256 - RNA, 21 nt, Artificial Sequence
  Description of Artificial Sequence: Synthetic oligonucleotide
uaaagaccugauuacauauau

SEQ ID NO: 15257 - RNA, 21 nt, Artificial Sequence
  Description of Artificial Sequence: Synthetic oligonucleotide
aaagaccugauuacauauaug

SEQ ID NO: 15258 - RNA, 21 nt, Artificial Sequence
  Description of Artificial Sequence: Synthetic oligonucleotide
aagaccugauuacauauauga

SEQ ID NO: 15259 - RNA, 21 nt, Artificial Sequence
  Description of Artificial Sequence: Synthetic oligonucleotide
agaccugauuacauauaugag

SEQ ID NO: 15260 - RNA, 21 nt, Artificial Sequence
  Description of Artificial Sequence: Synthetic oligonucleotide
gaccugauuacauauaugagu

SEQ ID NO: 15261 - RNA, 21 nt, Artificial Sequence
  Description of Artificial Sequence: Synthetic oligonucleotide
accugauuacauauaugagug

SEQ ID NO: 15262 - RNA, 21 nt, Artificial Sequence
  Description of Artificial Sequence: Synthetic oligonucleotide
ccugauuacauauaugagugg

SEQ ID NO: 15263 - RNA, 21 nt, Artificial Sequence
  Description of Artificial Sequence: Synthetic oligonucleotide
cugauuacauauaugaguggg

SEQ ID NO: 15264 - RNA, 21 nt, Artificial Sequence
  Description of Artificial Sequence: Synthetic oligonucleotide
ugauuacauauaugaguggga

SEQ ID NO: 15265 - RNA, 21 nt, Artificial Sequence
  Description of Artificial Sequence: Synthetic oligonucleotide
gauuacauauaugagugggac

SEQ ID NO: 15266 - RNA, 21 nt, Artificial Sequence
  Description of Artificial Sequence: Synthetic oligonucleotide
auuacauauaugagugggacc

SEQ ID NO: 15267 - RNA, 21 nt, Artificial Sequence
  Description of Artificial Sequence: Synthetic oligonucleotide
uuacauauaugagugggacca

SEQ ID NO: 15268 - RNA, 21 nt, Artificial Sequence
  Description of Artificial Sequence: Synthetic oligonucleotide
uacauauaugagugggaccaa

SEQ ID NO: 15269 - RNA, 21 nt, Artificial Sequence
  Description of Artificial Sequence: Synthetic oligonucleotide
acauauaugagugggaccaaa

SEQ ID NO: 15270 - RNA, 21 nt, Artificial Sequence
  Description of Artificial Sequence: Synthetic oligonucleotide
cauauaugagugggaccaaaa

SEQ ID NO: 15271 - RNA, 21 nt, Artificial Sequence
  Description of Artificial Sequence: Synthetic oligonucleotide
auauaugagugggaccaaaag

SEQ ID NO: 15272 - RNA, 21 nt, Artificial Sequence
  Description of Artificial Sequence: Synthetic oligonucleotide
uauaugagugggaccaaaagu

SEQ ID NO: 15273 - RNA, 21 nt, Artificial Sequence
  Description of Artificial Sequence: Synthetic oligonucleotide
auaugagugggaccaaaagua

SEQ ID NO: 15274 - RNA, 21 nt, Artificial Sequence
  Description of Artificial Sequence: Synthetic oligonucleotide
uaugagugggaccaaaaguac

SEQ ID NO: 15275 - RNA, 21 nt, Artificial Sequence
  Description of Artificial Sequence: Synthetic oligonucleotide
augagugggaccaaaaguacc

SEQ ID NO: 15276 - RNA, 21 nt, Artificial Sequence
  Description of Artificial Sequence: Synthetic oligonucleotide
ugagugggaccaaaaguaccg

SEQ ID NO: 15277 - RNA, 21 nt, Artificial Sequence
  Description of Artificial Sequence: Synthetic oligonucleotide
gagugggaccaaaaguaccga

SEQ ID NO: 15278 - RNA, 21 nt, Artificial Sequence
  Description of Artificial Sequence: Synthetic oligonucleotide
agugggaccaaaaguaccgag

SEQ ID NO: 15279 - RNA, 21 nt, Artificial Sequence
  Description of Artificial Sequence: Synthetic oligonucleotide
gugggaccaaaaguaccgagu

SEQ ID NO: 15280 - RNA, 21 nt, Artificial Sequence
  Description of Artificial Sequence: Synthetic oligonucleotide
ugggaccaaaaguaccgaguu

SEQ ID NO: 15281 - RNA, 21 nt, Artificial Sequence
  Description of Artificial Sequence: Synthetic oligonucleotide
gggaccaaaaguaccgaguuc

SEQ ID NO: 15282 - RNA, 21 nt, Artificial Sequence
  Description of Artificial Sequence: Synthetic oligonucleotide
ggaccaaaaguaccgaguuca

SEQ ID NO: 15283 - RNA, 21 nt, Artificial Sequence
  Description of Artificial Sequence: Synthetic oligonucleotide
gaccaaaaguaccgaguucaa

SEQ ID NO: 15284 - RNA, 21 nt, Artificial Sequence
  Description of Artificial Sequence: Synthetic oligonucleotide
accaaaaguaccgaguucaac

SEQ ID NO: 15285 - RNA, 21 nt, Artificial Sequence
  Description of Artificial Sequence: Synthetic oligonucleotide
ccaaaaguaccgaguucaaca

SEQ ID NO: 15286 - RNA, 21 nt, Artificial Sequence
  Description of Artificial Sequence: Synthetic oligonucleotide
caaaaguaccgaguucaacaa

SEQ ID NO: 15287 - RNA, 21 nt, Artificial Sequence
  Description of Artificial Sequence: Synthetic oligonucleotide
aaaaguaccgaguucaacaac

SEQ ID NO: 15288 - RNA, 21 nt, Artificial Sequence
  Description of Artificial Sequence: Synthetic oligonucleotide
aaaguaccgaguucaacaaca

SEQ ID NO: 15289 - RNA, 21 nt, Artificial Sequence
  Description of Artificial Sequence: Synthetic oligonucleotide
aaguaccgaguucaacaacac

SEQ ID NO: 15290 - RNA, 21 nt, Artificial Sequence
  Description of Artificial Sequence: Synthetic oligonucleotide
aguaccgaguucaacaacacc

SEQ ID NO: 15291 - RNA, 21 nt, Artificial Sequence
  Description of Artificial Sequence: Synthetic oligonucleotide
guaccgaguucaacaacaccg

SEQ ID NO: 15292 - RNA, 21 nt, Artificial Sequence
  Description of Artificial Sequence: Synthetic oligonucleotide
uaccgaguucaacaacaccgu

SEQ ID NO: 15293 - RNA, 21 nt, Artificial Sequence
  Description of Artificial Sequence: Synthetic oligonucleotide
accgaguucaacaacaccguc

SEQ ID NO: 15294 - RNA, 21 nt, Artificial Sequence
  Description of Artificial Sequence: Synthetic oligonucleotide
ccgaguucaacaacaccgucu

SEQ ID NO: 15295 - RNA, 21 nt, Artificial Sequence
  Description of Artificial Sequence: Synthetic oligonucleotide
cgaguucaacaacaccgucuc

SEQ ID NO: 15296 - RNA, 21 nt, Artificial Sequence
  Description of Artificial Sequence: Synthetic oligonucleotide
gaguucaacaacaccgucucu

SEQ ID NO: 15297 - RNA, 21 nt, Artificial Sequence
  Description of Artificial Sequence: Synthetic oligonucleotide
aguucaacaacaccgucucuu

SEQ ID NO: 15298 - RNA, 21 nt, Artificial Sequence
  Description of Artificial Sequence: Synthetic oligonucleotide
guucaacaacaccgucucuug

SEQ ID NO: 15299 - RNA, 21 nt, Artificial Sequence
  Description of Artificial Sequence: Synthetic oligonucleotide
uucaacaacaccgucucuugu

SEQ ID NO: 15300 - RNA, 21 nt, Artificial Sequence
  Description of Artificial Sequence: Synthetic oligonucleotide
ucaacaacaccgucucuugua

SEQ ID NO: 15301 - RNA, 21 nt, Artificial Sequence
  Description of Artificial Sequence: Synthetic oligonucleotide
caacaacaccgucucuuguag

SEQ ID NO: 15302 - RNA, 21 nt, Artificial Sequence
  Description of Artificial Sequence: Synthetic oligonucleotide
aacaacaccgucucuuguagc

SEQ ID NO: 15303 - RNA, 21 nt, Artificial Sequence
  Description of Artificial Sequence: Synthetic oligonucleotide
acaacaccgucucuuguagca

SEQ ID NO: 15304 - RNA, 21 nt, Artificial Sequence
  Description of Artificial Sequence: Synthetic oligonucleotide
caacaccgucucuuguagcaa

SEQ ID NO: 15305 - RNA, 21 nt, Artificial Sequence
  Description of Artificial Sequence: Synthetic oligonucleotide
aacaccgucucuuguagcaau

SEQ ID NO: 15306 - RNA, 21 nt, Artificial Sequence
  Description of Artificial Sequence: Synthetic oligonucleotide
acaccgucucuuguagcaauc

SEQ ID NO: 15307 - RNA, 21 nt, Artificial Sequence
  Description of Artificial Sequence: Synthetic oligonucleotide
caccgucucuuguagcaaucg

SEQ ID NO: 15308 - RNA, 21 nt, Artificial Sequence
  Description of Artificial Sequence: Synthetic oligonucleotide
accgucucuuguagcaaucgg

SEQ ID NO: 15309 - RNA, 21 nt, Artificial Sequence
  Description of Artificial Sequence: Synthetic oligonucleotide
ccgucucuuguagcaaucggc

SEQ ID NO: 15310 - RNA, 21 nt, Artificial Sequence
  Description of Artificial Sequence: Synthetic oligonucleotide
cgucucuuguagcaaucggcc

SEQ ID NO: 15311 - RNA, 21 nt, Artificial Sequence
  Description of Artificial Sequence: Synthetic oligonucleotide
gucucuuguagcaaucggcca

SEQ ID NO: 15312 - RNA, 21 nt, Artificial Sequence
  Description of Artificial Sequence: Synthetic oligonucleotide
ucucuuguagcaaucggccac

SEQ ID NO: 15313 - RNA, 21 nt, Artificial Sequence
  Description of Artificial Sequence: Synthetic oligonucleotide
cucuuguagcaaucggccaca

SEQ ID NO: 15314 - RNA, 21 nt, Artificial Sequence
  Description of Artificial Sequence: Synthetic oligonucleotide
ucuuguagcaaucggccacau

SEQ ID NO: 15315 - RNA, 21 nt, Artificial Sequence
  Description of Artificial Sequence: Synthetic oligonucleotide
cuuguagcaaucggccacauu

SEQ ID NO: 15316 - RNA, 21 nt, Artificial Sequence
  Description of Artificial Sequence: Synthetic oligonucleotide
uuguagcaaucggccacauug

SEQ ID NO: 15317 - RNA, 21 nt, Artificial Sequence
  Description of Artificial Sequence: Synthetic oligonucleotide
uguagcaaucggccacauugc

SEQ ID NO: 15318 - RNA, 21 nt, Artificial Sequence
  Description of Artificial Sequence: Synthetic oligonucleotide
guagcaaucggccacauugcc

SEQ ID NO: 15319 - RNA, 21 nt, Artificial Sequence
  Description of Artificial Sequence: Synthetic oligonucleotide
uagcaaucggccacauugccu

SEQ ID NO: 15320 - RNA, 21 nt, Artificial Sequence
  Description of Artificial Sequence: Synthetic oligonucleotide
agcaaucggccacauugccuu

SEQ ID NO: 15321 - RNA, 21 nt, Artificial Sequence
  Description of Artificial Sequence: Synthetic oligonucleotide
gcaaucggccacauugccuua

SEQ ID NO: 15322 - RNA, 21 nt, Artificial Sequence
  Description of Artificial Sequence: Synthetic oligonucleotide
caaucggccacauugccuuac

SEQ ID NO: 15323 - RNA, 21 nt, Artificial Sequence
  Description of Artificial Sequence: Synthetic oligonucleotide
aaucggccacauugccuuacu

SEQ ID NO: 15324 - RNA, 21 nt, Artificial Sequence
  Description of Artificial Sequence: Synthetic oligonucleotide
aucggccacauugccuuacug

SEQ ID NO: 15325 - RNA, 21 nt, Artificial Sequence
  Description of Artificial Sequence: Synthetic oligonucleotide
ucggccacauugccuuacuga

SEQ ID NO: 15326 - RNA, 21 nt, Artificial Sequence
  Description of Artificial Sequence: Synthetic oligonucleotide
cggccacauugccuuacugaa

SEQ ID NO: 15327 - RNA, 21 nt, Artificial Sequence
  Description of Artificial Sequence: Synthetic oligonucleotide
ggccacauugccuuacugaaa

SEQ ID NO: 15328 - RNA, 21 nt, Artificial Sequence
  Description of Artificial Sequence: Synthetic oligonucleotide
gccacauugccuuacugaaau

SEQ ID NO: 15329 - RNA, 21 nt, Artificial Sequence
  Description of Artificial Sequence: Synthetic oligonucleotide
ccacauugccuuacugaaauc

SEQ ID NO: 15330 - RNA, 21 nt, Artificial Sequence
  Description of Artificial Sequence: Synthetic oligonucleotide
cacauugccuuacugaaaucc

SEQ ID NO: 15331 - RNA, 21 nt, Artificial Sequence
  Description of Artificial Sequence: Synthetic oligonucleotide
acauugccuuacugaaaucca

SEQ ID NO: 15332 - RNA, 21 nt, Artificial Sequence
  Description of Artificial Sequence: Synthetic oligonucleotide
cauugccuuacugaaauccag

SEQ ID NO: 15333 - RNA, 21 nt, Artificial Sequence
  Description of Artificial Sequence: Synthetic oligonucleotide
auugccuuacugaaauccaga

SEQ ID NO: 15334 - RNA, 21 nt, Artificial Sequence
  Description of Artificial Sequence: Synthetic oligonucleotide
uugccuuacugaaauccagag

SEQ ID NO: 15335 - RNA, 21 nt, Artificial Sequence
  Description of Artificial Sequence: Synthetic oligonucleotide
ugccuuacugaaauccagagc

SEQ ID NO: 15336 - RNA, 21 nt, Artificial Sequence
  Description of Artificial Sequence: Synthetic oligonucleotide
gccuuacugaaauccagagcc

SEQ ID NO: 15337 - RNA, 21 nt, Artificial Sequence
  Description of Artificial Sequence: Synthetic oligonucleotide
ccuuacugaaauccagagccu

SEQ ID NO: 15338 - RNA, 21 nt, Artificial Sequence
  Description of Artificial Sequence: Synthetic oligonucleotide
cuuacugaaauccagagccua

SEQ ID NO: 15339 - RNA, 21 nt, Artificial Sequence
  Description of Artificial Sequence: Synthetic oligonucleotide
uuacugaaauccagagccuaa

SEQ ID NO: 15340 - RNA, 21 nt, Artificial Sequence
  Description of Artificial Sequence: Synthetic oligonucleotide
uacugaaauccagagccuaac

SEQ ID NO: 15341 - RNA, 21 nt, Artificial Sequence
  Description of Artificial Sequence: Synthetic oligonucleotide
acugaaauccagagccuaacc

SEQ ID NO: 15342 - RNA, 21 nt, Artificial Sequence
  Description of Artificial Sequence: Synthetic oligonucleotide
cugaaauccagagccuaaccu

SEQ ID NO: 15343 - RNA, 21 nt, Artificial Sequence
  Description of Artificial Sequence: Synthetic oligonucleotide
ugaaauccagagccuaaccuu

SEQ ID NO: 15344 - RNA, 21 nt, Artificial Sequence
  Description of Artificial Sequence: Synthetic oligonucleotide
gaaauccagagccuaaccuuc

SEQ ID NO: 15345 - RNA, 21 nt, Artificial Sequence
  Description of Artificial Sequence: Synthetic oligonucleotide
aaauccagagccuaaccuuca

SEQ ID NO: 15346 - RNA, 21 nt, Artificial Sequence
  Description of Artificial Sequence: Synthetic oligonucleotide
aauccagagccuaaccuucaa

SEQ ID NO: 15347 - RNA, 21 nt, Artificial Sequence
  Description of Artificial Sequence: Synthetic oligonucleotide
auccagagccuaaccuucaau

SEQ ID NO: 15348 - RNA, 21 nt, Artificial Sequence
  Description of Artificial Sequence: Synthetic oligonucleotide
uccagagccuaaccuucaauc

SEQ ID NO: 15349 - RNA, 21 nt, Artificial Sequence
  Description of Artificial Sequence: Synthetic oligonucleotide
ccagagccuaaccuucaaucc

SEQ ID NO: 15350 - RNA, 21 nt, Artificial Sequence
  Description of Artificial Sequence: Synthetic oligonucleotide
cagagccuaaccuucaauccc

SEQ ID NO: 15351 - RNA, 21 nt, Artificial Sequence
  Description of Artificial Sequence: Synthetic oligonucleotide
agagccuaaccuucaauccca

SEQ ID NO: 15352 - RNA, 21 nt, Artificial Sequence
  Description of Artificial Sequence: Synthetic oligonucleotide
gagccuaaccuucaaucccac

SEQ ID NO: 15353 - RNA, 21 nt, Artificial Sequence
  Description of Artificial Sequence: Synthetic oligonucleotide
agccuaaccuucaaucccacc

SEQ ID NO: 15354 - RNA, 21 nt, Artificial Sequence
  Description of Artificial Sequence: Synthetic oligonucleotide
gccuaaccuucaaucccaccg

SEQ ID NO: 15355 - RNA, 21 nt, Artificial Sequence
  Description of Artificial Sequence: Synthetic oligonucleotide
ccuaaccuucaaucccaccgc

SEQ ID NO: 15356 - RNA, 21 nt, Artificial Sequence
  Description of Artificial Sequence: Synthetic oligonucleotide
cuaaccuucaaucccaccgcc

SEQ ID NO: 15357 - RNA, 21 nt, Artificial Sequence
  Description of Artificial Sequence: Synthetic oligonucleotide
uaaccuucaaucccaccgccg

SEQ ID NO: 15358 - RNA, 21 nt, Artificial Sequence
  Description of Artificial Sequence: Synthetic oligonucleotide
aaccuucaaucccaccgccgg

SEQ ID NO: 15359 - RNA, 21 nt, Artificial Sequence
  Description of Artificial Sequence: Synthetic oligonucleotide
accuucaaucccaccgccggc

SEQ ID NO: 15360 - RNA, 21 nt, Artificial Sequence
  Description of Artificial Sequence: Synthetic oligonucleotide
ccuucaaucccaccgccggcu

SEQ ID NO: 15361 - RNA, 21 nt, Artificial Sequence
  Description of Artificial Sequence: Synthetic oligonucleotide
cuucaaucccaccgccggcug

SEQ ID NO: 15362 - RNA, 21 nt, Artificial Sequence
  Description of Artificial Sequence: Synthetic oligonucleotide
uucaaucccaccgccggcugc

SEQ ID NO: 15363 - RNA, 21 nt, Artificial Sequence
  Description of Artificial Sequence: Synthetic oligonucleotide
ucaaucccaccgccggcugcg

SEQ ID NO: 15364 - RNA, 21 nt, Artificial Sequence
  Description of Artificial Sequence: Synthetic oligonucleotide
caaucccaccgccggcugcgc

SEQ ID NO: 15365 - RNA, 21 nt, Artificial Sequence
  Description of Artificial Sequence: Synthetic oligonucleotide
aaucccaccgccggcugcgcg

SEQ ID NO: 15366 - RNA, 21 nt, Artificial Sequence
  Description of Artificial Sequence: Synthetic oligonucleotide
aucccaccgccggcugcgcgu

SEQ ID NO: 15367 - RNA, 21 nt, Artificial Sequence
  Description of Artificial Sequence: Synthetic oligonucleotide
ucccaccgccggcugcgcguc

SEQ ID NO: 15368 - RNA, 21 nt, Artificial Sequence
  Description of Artificial Sequence: Synthetic oligonucleotide
cccaccgccggcugcgcgucg

SEQ ID NO: 15369 - RNA, 21 nt, Artificial Sequence
  Description of Artificial Sequence: Synthetic oligonucleotide
ccaccgccggcugcgcgucgc

SEQ ID NO: 15370 - RNA, 21 nt, Artificial Sequence
  Description of Artificial Sequence: Synthetic oligonucleotide
caccgccggcugcgcgucgcu

SEQ ID NO: 15371 - RNA, 21 nt, Artificial Sequence
  Description of Artificial Sequence: Synthetic oligonucleotide
accgccggcugcgcgucgcuc

SEQ ID NO: 15372 - RNA, 21 nt, Artificial Sequence
  Description of Artificial Sequence: Synthetic oligonucleotide
ccgccggcugcgcgucgcucg

SEQ ID NO: 15373 - RNA, 21 nt, Artificial Sequence
  Description of Artificial Sequence: Synthetic oligonucleotide
cgccggcugcgcgucgcucgc

SEQ ID NO: 15374 - RNA, 21 nt, Artificial Sequence
  Description of Artificial Sequence: Synthetic oligonucleotide
gccggcugcgcgucgcucgcc

SEQ ID NO: 15375 - RNA, 21 nt, Artificial Sequence
  Description of Artificial Sequence: Synthetic oligonucleotide
ccggcugcgcgucgcucgcca

SEQ ID NO: 15376 - RNA, 21 nt, Artificial Sequence
  Description of Artificial Sequence: Synthetic oligonucleotide
cggcugcgcgucgcucgccaa

SEQ ID NO: 15377 - RNA, 21 nt, Artificial Sequence
  Description of Artificial Sequence: Synthetic oligonucleotide
ggcugcgcgucgcucgccaaa

SEQ ID NO: 15378 - RNA, 21 nt, Artificial Sequence
  Description of Artificial Sequence: Synthetic oligonucleotide
gcugcgcgucgcucgccaaag

SEQ ID NO: 15379 - RNA, 21 nt, Artificial Sequence
  Description of Artificial Sequence: Synthetic oligonucleotide
cugcgcgucgcucgccaaaga

SEQ ID NO: 15380 - RNA, 21 nt, Artificial Sequence
  Description of Artificial Sequence: Synthetic oligonucleotide
ugcgcgucgcucgccaaagaa

SEQ ID NO: 15381 - RNA, 21 nt, Artificial Sequence
  Description of Artificial Sequence: Synthetic oligonucleotide
gcgcgucgcucgccaaagaaa

SEQ ID NO: 15382 - RNA, 21 nt, Artificial Sequence
  Description of Artificial Sequence: Synthetic oligonucleotide
cgcgucgcucgccaaagaaau

SEQ ID NO: 15383 - RNA, 21 nt, Artificial Sequence
  Description of Artificial Sequence: Synthetic oligonucleotide
gcgucgcucgccaaagaaaug

SEQ ID NO: 15384 - RNA, 21 nt, Artificial Sequence
  Description of Artificial Sequence: Synthetic oligonucleotide
cgucgcucgccaaagaaaugu

SEQ ID NO: 15385 - RNA, 21 nt, Artificial Sequence
  Description of Artificial Sequence: Synthetic oligonucleotide
gucgcucgccaaagaaauguu

SEQ ID NO: 15386 - RNA, 21 nt, Artificial Sequence
  Description of Artificial Sequence: Synthetic oligonucleotide
ucgcucgccaaagaaauguuc

SEQ ID NO: 15387 - RNA, 21 nt, Artificial Sequence
  Description of Artificial Sequence: Synthetic oligonucleotide
cgcucgccaaagaaauguucg

SEQ ID NO: 15388 - RNA, 21 nt, Artificial Sequence
  Description of Artificial Sequence: Synthetic oligonucleotide
gcucgccaaagaaauguucgc

SEQ ID NO: 15389 - RNA, 21 nt, Artificial Sequence
  Description of Artificial Sequence: Synthetic oligonucleotide
cucgccaaagaaauguucgcc

SEQ ID NO: 15390 - RNA, 21 nt, Artificial Sequence
  Description of Artificial Sequence: Synthetic oligonucleotide
ucgccaaagaaauguucgcca

SEQ ID NO: 15391 - RNA, 21 nt, Artificial Sequence
  Description of Artificial Sequence: Synthetic oligonucleotide
cgccaaagaaauguucgccau

SEQ ID NO: 15392 - RNA, 21 nt, Artificial Sequence
  Description of Artificial Sequence: Synthetic oligonucleotide
gccaaagaaauguucgccaug

SEQ ID NO: 15393 - RNA, 21 nt, Artificial Sequence
  Description of Artificial Sequence: Synthetic oligonucleotide
ccaaagaaauguucgccauga

SEQ ID NO: 15394 - RNA, 21 nt, Artificial Sequence
  Description of Artificial Sequence: Synthetic oligonucleotide
caaagaaauguucgccaugaa

SEQ ID NO: 15395 - RNA, 21 nt, Artificial Sequence
  Description of Artificial Sequence: Synthetic oligonucleotide
aaagaaauguucgccaugaaa

SEQ ID NO: 15396 - RNA, 21 nt, Artificial Sequence
  Description of Artificial Sequence: Synthetic oligonucleotide
aagaaauguucgccaugaaaa

SEQ ID NO: 15397 - RNA, 21 nt, Artificial Sequence
  Description of Artificial Sequence: Synthetic oligonucleotide
agaaauguucgccaugaaaac

SEQ ID NO: 15398 - RNA, 21 nt, Artificial Sequence
  Description of Artificial Sequence: Synthetic oligonucleotide
gaaauguucgccaugaaaacu

SEQ ID NO: 15399 - RNA, 21 nt, Artificial Sequence
  Description of Artificial Sequence: Synthetic oligonucleotide
aaauguucgccaugaaaacua

SEQ ID NO: 15400 - RNA, 21 nt, Artificial Sequence
  Description of Artificial Sequence: Synthetic oligonucleotide
aauguucgccaugaaaacuaa

SEQ ID NO: 15401 - RNA, 21 nt, Artificial Sequence
  Description of Artificial Sequence: Synthetic oligonucleotide
auguucgccaugaaaacuaag

SEQ ID NO: 15402 - RNA, 21 nt, Artificial Sequence
  Description of Artificial Sequence: Synthetic oligonucleotide
uguucgccaugaaaacuaagg

SEQ ID NO: 15403 - RNA, 21 nt, Artificial Sequence
  Description of Artificial Sequence: Synthetic oligonucleotide
guucgccaugaaaacuaaggc

SEQ ID NO: 15404 - RNA, 21 nt, Artificial Sequence
  Description of Artificial Sequence: Synthetic oligonucleotide
uucgccaugaaaacuaaggcu

SEQ ID NO: 15405 - RNA, 21 nt, Artificial Sequence
  Description of Artificial Sequence: Synthetic oligonucleotide
ucgccaugaaaacuaaggcug

SEQ ID NO: 15406 - RNA, 21 nt, Artificial Sequence
  Description of Artificial Sequence: Synthetic oligonucleotide
cgccaugaaaacuaaggcugc

SEQ ID NO: 15407 - RNA, 21 nt, Artificial Sequence
  Description of Artificial Sequence: Synthetic oligonucleotide
gccaugaaaacuaaggcugcc

SEQ ID NO: 15408 - RNA, 21 nt, Artificial Sequence
  Description of Artificial Sequence: Synthetic oligonucleotide
ccaugaaaacuaaggcugccu

SEQ ID NO: 15409 - RNA, 21 nt, Artificial Sequence
  Description of Artificial Sequence: Synthetic oligonucleotide
caugaaaacuaaggcugccuu

SEQ ID NO: 15410 - RNA, 21 nt, Artificial Sequence
  Description of Artificial Sequence: Synthetic oligonucleotide
augaaaacuaaggcugccuua

SEQ ID NO: 15411 - RNA, 21 nt, Artificial Sequence
  Description of Artificial Sequence: Synthetic oligonucleotide
ugaaaacuaaggcugccuuag

SEQ ID NO: 15412 - RNA, 21 nt, Artificial Sequence
  Description of Artificial Sequence: Synthetic oligonucleotide
gaaaacuaaggcugccuuagc

SEQ ID NO: 15413 - RNA, 21 nt, Artificial Sequence
  Description of Artificial Sequence: Synthetic oligonucleotide
aaaacuaaggcugccuuagcu

SEQ ID NO: 15414 - RNA, 21 nt, Artificial Sequence
  Description of Artificial Sequence: Synthetic oligonucleotide
aaacuaaggcugccuuagcua

SEQ ID NO: 15415 - RNA, 21 nt, Artificial Sequence
  Description of Artificial Sequence: Synthetic oligonucleotide
aacuaaggcugccuuagcuau

SEQ ID NO: 15416 - RNA, 21 nt, Artificial Sequence
  Description of Artificial Sequence: Synthetic oligonucleotide
acuaaggcugccuuagcuauc

SEQ ID NO: 15417 - RNA, 21 nt, Artificial Sequence
  Description of Artificial Sequence: Synthetic oligonucleotide
cuaaggcugccuuagcuaucu

SEQ ID NO: 15418 - RNA, 21 nt, Artificial Sequence
  Description of Artificial Sequence: Synthetic oligonucleotide
uaaggcugccuuagcuaucug

SEQ ID NO: 15419 - RNA, 21 nt, Artificial Sequence
  Description of Artificial Sequence: Synthetic oligonucleotide
aaggcugccuuagcuaucugg

SEQ ID NO: 15420 - RNA, 21 nt, Artificial Sequence
  Description of Artificial Sequence: Synthetic oligonucleotide
aggcugccuuagcuaucuggu

SEQ ID NO: 15421 - RNA, 21 nt, Artificial Sequence
  Description of Artificial Sequence: Synthetic oligonucleotide
ggcugccuuagcuaucuggug

SEQ ID NO: 15422 - RNA, 21 nt, Artificial Sequence
  Description of Artificial Sequence: Synthetic oligonucleotide
gcugccuuagcuaucuggugc

SEQ ID NO: 15423 - RNA, 21 nt, Artificial Sequence
  Description of Artificial Sequence: Synthetic oligonucleotide
cugccuuagcuaucuggugcc

SEQ ID NO: 15424 - RNA, 21 nt, Artificial Sequence
  Description of Artificial Sequence: Synthetic oligonucleotide
ugccuuagcuaucuggugccc

SEQ ID NO: 15425 - RNA, 21 nt, Artificial Sequence
  Description of Artificial Sequence: Synthetic oligonucleotide
gccuuagcuaucuggugccca

SEQ ID NO: 15426 - RNA, 21 nt, Artificial Sequence
  Description of Artificial Sequence: Synthetic oligonucleotide
ccuuagcuaucuggugcccag

SEQ ID NO: 15427 - RNA, 21 nt, Artificial Sequence
  Description of Artificial Sequence: Synthetic oligonucleotide
cuuagcuaucuggugcccagg

SEQ ID NO: 15428 - RNA, 21 nt, Artificial Sequence
  Description of Artificial Sequence: Synthetic oligonucleotide
uuagcuaucuggugcccaggc

SEQ ID NO: 15429 - RNA, 21 nt, Artificial Sequence
  Description of Artificial Sequence: Synthetic oligonucleotide
uagcuaucuggugcccaggcu

SEQ ID NO: 15430 - RNA, 21 nt, Artificial Sequence
  Description of Artificial Sequence: Synthetic oligonucleotide
agcuaucuggugcccaggcua

SEQ ID NO: 15431 - RNA, 21 nt, Artificial Sequence
  Description of Artificial Sequence: Synthetic oligonucleotide
gcuaucuggugcccaggcuau

SEQ ID NO: 15432 - RNA, 21 nt, Artificial Sequence
  Description of Artificial Sequence: Synthetic oligonucleotide
cuaucuggugcccaggcuauu

SEQ ID NO: 15433 - RNA, 21 nt, Artificial Sequence
  Description of Artificial Sequence: Synthetic oligonucleotide
uaucuggugcccaggcuauuc

SEQ ID NO: 15434 - RNA, 21 nt, Artificial Sequence
  Description of Artificial Sequence: Synthetic oligonucleotide
aucuggugcccaggcuauucg

SEQ ID NO: 15435 - RNA, 21 nt, Artificial Sequence
  Description of Artificial Sequence: Synthetic oligonucleotide
ucuggugcccaggcuauucgg

SEQ ID NO: 15436 - RNA, 21 nt, Artificial Sequence
  Description of Artificial Sequence: Synthetic oligonucleotide
cuggugcccaggcuauucgga

SEQ ID NO: 15437 - RNA, 21 nt, Artificial Sequence
  Description of Artificial Sequence: Synthetic oligonucleotide
uggugcccaggcuauucggaa

SEQ ID NO: 15438 - RNA, 21 nt, Artificial Sequence
  Description of Artificial Sequence: Synthetic oligonucleotide
ggugcccaggcuauucggaaa

SEQ ID NO: 15439 - RNA, 21 nt, Artificial Sequence
  Description of Artificial Sequence: Synthetic oligonucleotide
gugcccaggcuauucggaaac

SEQ ID NO: 15440 - RNA, 21 nt, Artificial Sequence
  Description of Artificial Sequence: Synthetic oligonucleotide
ugcccaggcuauucggaaacu

SEQ ID NO: 15441 - RNA, 21 nt, Artificial Sequence
  Description of Artificial Sequence: Synthetic oligonucleotide
gcccaggcuauucggaaacuc

SEQ ID NO: 15442 - RNA, 21 nt, Artificial Sequence
  Description of Artificial Sequence: Synthetic oligonucleotide
cccaggcuauucggaaacuca

SEQ ID NO: 15443 - RNA, 21 nt, Artificial Sequence
  Description of Artificial Sequence: Synthetic oligonucleotide
ccaggcuauucggaaacucag

SEQ ID NO: 15444 - RNA, 21 nt, Artificial Sequence
  Description of Artificial Sequence: Synthetic oligonucleotide
caggcuauucggaaacucaga

SEQ ID NO: 15445 - RNA, 21 nt, Artificial Sequence
  Description of Artificial Sequence: Synthetic oligonucleotide
aggcuauucggaaacucagau

SEQ ID NO: 15446 - RNA, 21 nt, Artificial Sequence
  Description of Artificial Sequence: Synthetic oligonucleotide
ggcuauucggaaacucagaua

SEQ ID NO: 15447 - RNA, 21 nt, Artificial Sequence
  Description of Artificial Sequence: Synthetic oligonucleotide
gcuauucggaaacucagauaa

SEQ ID NO: 15448 - RNA, 21 nt, Artificial Sequence
  Description of Artificial Sequence: Synthetic oligonucleotide
cuauucggaaacucagauaaa

SEQ ID NO: 15449 - RNA, 21 nt, Artificial Sequence
  Description of Artificial Sequence: Synthetic oligonucleotide
uauucggaaacucagauaaau

SEQ ID NO: 15450 - RNA, 21 nt, Artificial Sequence
  Description of Artificial Sequence: Synthetic oligonucleotide
auucggaaacucagauaaaug

SEQ ID NO: 15451 - RNA, 21 nt, Artificial Sequence
  Description of Artificial Sequence: Synthetic oligonucleotide
uucggaaacucagauaaaugc

SEQ ID NO: 15452 - RNA, 21 nt, Artificial Sequence
  Description of Artificial Sequence: Synthetic oligonucleotide
ucggaaacucagauaaaugcu

SEQ ID NO: 15453 - RNA, 21 nt, Artificial Sequence
  Description of Artificial Sequence: Synthetic oligonucleotide
cggaaacucagauaaaugcua

SEQ ID NO: 15454 - RNA, 21 nt, Artificial Sequence
  Description of Artificial Sequence: Synthetic oligonucleotide
ggaaacucagauaaaugcuac

SEQ ID NO: 15455 - RNA, 21 nt, Artificial Sequence
  Description of Artificial Sequence: Synthetic oligonucleotide
gaaacucagauaaaugcuacu

SEQ ID NO: 15456 - RNA, 21 nt, Artificial Sequence
  Description of Artificial Sequence: Synthetic oligonucleotide
aaacucagauaaaugcuacuc

SEQ ID NO: 15457 - RNA, 21 nt, Artificial Sequence
  Description of Artificial Sequence: Synthetic oligonucleotide
aacucagauaaaugcuacuca

SEQ ID NO: 15458 - RNA, 21 nt, Artificial Sequence
  Description of Artificial Sequence: Synthetic oligonucleotide
acucagauaaaugcuacucag

SEQ ID NO: 15459 - RNA, 21 nt, Artificial Sequence
  Description of Artificial Sequence: Synthetic oligonucleotide
cucagauaaaugcuacucagg

SEQ ID NO: 15460 - RNA, 21 nt, Artificial Sequence
  Description of Artificial Sequence: Synthetic oligonucleotide
ucagauaaaugcuacucaggc

SEQ ID NO: 15461 - RNA, 21 nt, Artificial Sequence
  Description of Artificial Sequence: Synthetic oligonucleotide
cagauaaaugcuacucaggca

SEQ ID NO: 15462 - RNA, 21 nt, Artificial Sequence
  Description of Artificial Sequence: Synthetic oligonucleotide
agauaaaugcuacucaggcaa

SEQ ID NO: 15463 - RNA, 21 nt, Artificial Sequence
  Description of Artificial Sequence: Synthetic oligonucleotide
gauaaaugcuacucaggcaau

SEQ ID NO: 15464 - RNA, 21 nt, Artificial Sequence
  Description of Artificial Sequence: Synthetic oligonucleotide
auaaaugcuacucaggcaaug

SEQ ID NO: 15465 - RNA, 21 nt, Artificial Sequence
  Description of Artificial Sequence: Synthetic oligonucleotide
uaaaugcuacucaggcaauga

SEQ ID NO: 15466 - RNA, 21 nt, Artificial Sequence
  Description of Artificial Sequence: Synthetic oligonucleotide
aaaugcuacucaggcaaugaa

SEQ ID NO: 15467 - RNA, 21 nt, Artificial Sequence
  Description of Artificial Sequence: Synthetic oligonucleotide
aaugcuacucaggcaaugaag

SEQ ID NO: 15468 - RNA, 21 nt, Artificial Sequence
  Description of Artificial Sequence: Synthetic oligonucleotide
augcuacucaggcaaugaaga

SEQ ID NO: 15469 - RNA, 21 nt, Artificial Sequence
  Description of Artificial Sequence: Synthetic oligonucleotide
ugcuacucaggcaaugaagaa

SEQ ID NO: 15470 - RNA, 21 nt, Artificial Sequence
  Description of Artificial Sequence: Synthetic oligonucleotide
gcuacucaggcaaugaagaag

SEQ ID NO: 15471 - RNA, 21 nt, Artificial Sequence
  Description of Artificial Sequence: Synthetic oligonucleotide
cuacucaggcaaugaagaaga

SEQ ID NO: 15472 - RNA, 21 nt, Artificial Sequence
  Description of Artificial Sequence: Synthetic oligonucleotide
uacucaggcaaugaagaagag

SEQ ID NO: 15473 - RNA, 21 nt, Artificial Sequence
  Description of Artificial Sequence: Synthetic oligonucleotide
acucaggcaaugaagaagagg

SEQ ID NO: 15474 - RNA, 21 nt, Artificial Sequence
  Description of Artificial Sequence: Synthetic oligonucleotide
cucaggcaaugaagaagagga

SEQ ID NO: 15475 - RNA, 21 nt, Artificial Sequence
  Description of Artificial Sequence: Synthetic oligonucleotide
ucaggcaaugaagaagaggag

SEQ ID NO: 15476 - RNA, 21 nt, Artificial Sequence
  Description of Artificial Sequence: Synthetic oligonucleotide
caggcaaugaagaagaggaga

SEQ ID NO: 15477 - RNA, 21 nt, Artificial Sequence
  Description of Artificial Sequence: Synthetic oligonucleotide
aggcaaugaagaagaggagaa

SEQ ID NO: 15478 - RNA, 21 nt, Artificial Sequence
  Description of Artificial Sequence: Synthetic oligonucleotide
ggcaaugaagaagaggagaaa

SEQ ID NO: 15479 - RNA, 21 nt, Artificial Sequence
  Description of Artificial Sequence: Synthetic oligonucleotide
gcaaugaagaagaggagaaaa

SEQ ID NO: 15480 - RNA, 21 nt, Artificial Sequence
  Description of Artificial Sequence: Synthetic oligonucleotide
caaugaagaagaggagaaaaa

SEQ ID NO: 15481 - RNA, 21 nt, Artificial Sequence
  Description of Artificial Sequence: Synthetic oligonucleotide
aaugaagaagaggagaaaaag

SEQ ID NO: 15482 - RNA, 21 nt, Artificial Sequence
  Description of Artificial Sequence: Synthetic oligonucleotide
augaagaagaggagaaaaagg

SEQ ID NO: 15483 - RNA, 21 nt, Artificial Sequence
  Description of Artificial Sequence: Synthetic oligonucleotide
ugaagaagaggagaaaaagga

SEQ ID NO: 15484 - RNA, 21 nt, Artificial Sequence
  Description of Artificial Sequence: Synthetic oligonucleotide
gaagaagaggagaaaaaggaa

SEQ ID NO: 15485 - RNA, 21 nt, Artificial Sequence
  Description of Artificial Sequence: Synthetic oligonucleotide
aagaagaggagaaaaaggaaa

SEQ ID NO: 15486 - RNA, 21 nt, Artificial Sequence
  Description of Artificial Sequence: Synthetic oligonucleotide
agaagaggagaaaaaggaaag

SEQ ID NO: 15487 - RNA, 21 nt, Artificial Sequence
  Description of Artificial Sequence: Synthetic oligonucleotide
gaagaggagaaaaaggaaagu

SEQ ID NO: 15488 - RNA, 21 nt, Artificial Sequence
  Description of Artificial Sequence: Synthetic oligonucleotide
aagaggagaaaaaggaaaguc

SEQ ID NO: 15489 - RNA, 21 nt, Artificial Sequence
  Description of Artificial Sequence: Synthetic oligonucleotide
agaggagaaaaaggaaaguca

SEQ ID NO: 15490 - RNA, 21 nt, Artificial Sequence
  Description of Artificial Sequence: Synthetic oligonucleotide
gaggagaaaaaggaaagucac

SEQ ID NO: 15491 - RNA, 21 nt, Artificial Sequence
  Description of Artificial Sequence: Synthetic oligonucleotide
aggagaaaaaggaaagucaca

SEQ ID NO: 15492 - RNA, 21 nt, Artificial Sequence
  Description of Artificial Sequence: Synthetic oligonucleotide
ggagaaaaaggaaagucacaa

SEQ ID NO: 15493 - RNA, 21 nt, Artificial Sequence
  Description of Artificial Sequence: Synthetic oligonucleotide
gagaaaaaggaaagucacaac

SEQ ID NO: 15494 - RNA, 21 nt, Artificial Sequence
  Description of Artificial Sequence: Synthetic oligonucleotide
agaaaaaggaaagucacaacc

SEQ ID NO: 15495 - RNA, 21 nt, Artificial Sequence
  Description of Artificial Sequence: Synthetic oligonucleotide
gaaaaaggaaagucacaacca

SEQ ID NO: 15496 - RNA, 21 nt, Artificial Sequence
  Description of Artificial Sequence: Synthetic oligonucleotide
aaaaaggaaagucacaaccaa

SEQ ID NO: 15497 - RNA, 21 nt, Artificial Sequence
  Description of Artificial Sequence: Synthetic oligonucleotide
aaaaggaaagucacaaccaau

SEQ ID NO: 15498 - RNA, 21 nt, Artificial Sequence
  Description of Artificial Sequence: Synthetic oligonucleotide
aaaggaaagucacaaccaaua

SEQ ID NO: 15499 - RNA, 21 nt, Artificial Sequence
  Description of Artificial Sequence: Synthetic oligonucleotide
aaggaaagucacaaccaauaa

SEQ ID NO: 15500 - RNA, 21 nt, Artificial Sequence
  Description of Artificial Sequence: Synthetic oligonucleotide
aggaaagucacaaccaauaaa

SEQ ID NO: 15501 - RNA, 21 nt, Artificial Sequence
  Description of Artificial Sequence: Synthetic oligonucleotide
ggaaagucacaaccaauaaau

SEQ ID NO: 15502 - RNA, 21 nt, Artificial Sequence
  Description of Artificial Sequence: Synthetic oligonucleotide
gaaagucacaaccaauaaaug

SEQ ID NO: 15503 - RNA, 21 nt, Artificial Sequence
  Description of Artificial Sequence: Synthetic oligonucleotide
aaagucacaaccaauaaaugu

SEQ ID NO: 15504 - RNA, 21 nt, Artificial Sequence
  Description of Artificial Sequence: Synthetic oligonucleotide
aagucacaaccaauaaauguc

SEQ ID NO: 15505 - RNA, 21 nt, Artificial Sequence
  Description of Artificial Sequence: Synthetic oligonucleotide
agucacaaccaauaaaugucu

SEQ ID NO: 15506 - RNA, 21 nt, Artificial Sequence
  Description of Artificial Sequence: Synthetic oligonucleotide
gucacaaccaauaaaugucug

SEQ ID NO: 15507 - RNA, 21 nt, Artificial Sequence
  Description of Artificial Sequence: Synthetic oligonucleotide
ucacaaccaauaaaugucugg

SEQ ID NO: 15508 - RNA, 21 nt, Artificial Sequence
  Description of Artificial Sequence: Synthetic oligonucleotide
cacaaccaauaaaugucugga

SEQ ID NO: 15509 - RNA, 21 nt, Artificial Sequence
  Description of Artificial Sequence: Synthetic oligonucleotide
acaaccaauaaaugucuggaa

SEQ ID NO: 15510 - RNA, 21 nt, Artificial Sequence
  Description of Artificial Sequence: Synthetic oligonucleotide
caaccaauaaaugucuggaac

SEQ ID NO: 15511 - RNA, 21 nt, Artificial Sequence
  Description of Artificial Sequence: Synthetic oligonucleotide
aaccaauaaaugucuggaaca

SEQ ID NO: 15512 - RNA, 21 nt, Artificial Sequence
  Description of Artificial Sequence: Synthetic oligonucleotide
accaauaaaugucuggaacaa

SEQ ID NO: 15513 - RNA, 21 nt, Artificial Sequence
  Description of Artificial Sequence: Synthetic oligonucleotide
ccaauaaaugucuggaacaag

SEQ ID NO: 15514 - RNA, 21 nt, Artificial Sequence
  Description of Artificial Sequence: Synthetic oligonucleotide
caauaaaugucuggaacaagu

SEQ ID NO: 15515 - RNA, 21 nt, Artificial Sequence
  Description of Artificial Sequence: Synthetic oligonucleotide
aauaaaugucuggaacaagug

SEQ ID NO: 15516 - RNA, 21 nt, Artificial Sequence
  Description of Artificial Sequence: Synthetic oligonucleotide
auaaaugucuggaacaagugu

SEQ ID NO: 15517 - RNA, 21 nt, Artificial Sequence
  Description of Artificial Sequence: Synthetic oligonucleotide
uaaaugucuggaacaaguguc

SEQ ID NO: 15518 - RNA, 21 nt, Artificial Sequence
  Description of Artificial Sequence: Synthetic oligonucleotide
aaaugucuggaacaaguguca

SEQ ID NO: 15519 - RNA, 21 nt, Artificial Sequence
  Description of Artificial Sequence: Synthetic oligonucleotide
aaugucuggaacaagugucac

SEQ ID NO: 15520 - RNA, 21 nt, Artificial Sequence
  Description of Artificial Sequence: Synthetic oligonucleotide
augucuggaacaagugucaca

SEQ ID NO: 15521 - RNA, 21 nt, Artificial Sequence
  Description of Artificial Sequence: Synthetic oligonucleotide
ugucuggaacaagugucacaa

SEQ ID NO: 15522 - RNA, 21 nt, Artificial Sequence
  Description of Artificial Sequence: Synthetic oligonucleotide
gucuggaacaagugucacaau

SEQ ID NO: 15523 - RNA, 21 nt, Artificial Sequence
  Description of Artificial Sequence: Synthetic oligonucleotide
ucuggaacaagugucacaauu

SEQ ID NO: 15524 - RNA, 21 nt, Artificial Sequence
  Description of Artificial Sequence: Synthetic oligonucleotide
cuggaacaagugucacaauua

SEQ ID NO: 15525 - RNA, 21 nt, Artificial Sequence
  Description of Artificial Sequence: Synthetic oligonucleotide
uggaacaagugucacaauuac

SEQ ID NO: 15526 - RNA, 21 nt, Artificial Sequence
  Description of Artificial Sequence: Synthetic oligonucleotide
ggaacaagugucacaauuaca

SEQ ID NO: 15527 - RNA, 21 nt, Artificial Sequence
  Description of Artificial Sequence: Synthetic oligonucleotide
gaacaagugucacaauuacaa

SEQ ID NO: 15528 - RNA, 21 nt, Artificial Sequence
  Description of Artificial Sequence: Synthetic oligonucleotide
aacaagugucacaauuacaag

SEQ ID NO: 15529 - RNA, 21 nt, Artificial Sequence
  Description of Artificial Sequence: Synthetic oligonucleotide
acaagugucacaauuacaagg

SEQ ID NO: 15530 - RNA, 21 nt, Artificial Sequence
  Description of Artificial Sequence: Synthetic oligonucleotide
caagugucacaauuacaagga

SEQ ID NO: 15531 - RNA, 21 nt, Artificial Sequence
  Description of Artificial Sequence: Synthetic oligonucleotide
aagugucacaauuacaaggau

SEQ ID NO: 15532 - RNA, 21 nt, Artificial Sequence
  Description of Artificial Sequence: Synthetic oligonucleotide
agugucacaauuacaaggauu

SEQ ID NO: 15533 - RNA, 21 nt, Artificial Sequence
  Description of Artificial Sequence: Synthetic oligonucleotide
gugucacaauuacaaggauug

SEQ ID NO: 15534 - RNA, 21 nt, Artificial Sequence
  Description of Artificial Sequence: Synthetic oligonucleotide
ugucacaauuacaaggauugu

SEQ ID NO: 15535 - RNA, 21 nt, Artificial Sequence
  Description of Artificial Sequence: Synthetic oligonucleotide
gucacaauuacaaggauugug

SEQ ID NO: 15536 - RNA, 21 nt, Artificial Sequence
  Description of Artificial Sequence: Synthetic oligonucleotide
ucacaauuacaaggauugugg

SEQ ID NO: 15537 - RNA, 21 nt, Artificial Sequence
  Description of Artificial Sequence: Synthetic oligonucleotide
cacaauuacaaggauuguggc

SEQ ID NO: 15538 - RNA, 21 nt, Artificial Sequence
  Description of Artificial Sequence: Synthetic oligonucleotide
acaauuacaaggauuguggcg

SEQ ID NO: 15539 - RNA, 21 nt, Artificial Sequence
  Description of Artificial Sequence: Synthetic oligonucleotide
caauuacaaggauuguggcgu

SEQ ID NO: 15540 - RNA, 21 nt, Artificial Sequence
  Description of Artificial Sequence: Synthetic oligonucleotide
aauuacaaggauuguggcguc

SEQ ID NO: 15541 - RNA, 21 nt, Artificial Sequence
  Description of Artificial Sequence: Synthetic oligonucleotide
auuacaaggauuguggcgucg

SEQ ID NO: 15542 - RNA, 21 nt, Artificial Sequence
  Description of Artificial Sequence: Synthetic oligonucleotide
uuacaaggauuguggcgucgc

SEQ ID NO: 15543 - RNA, 21 nt, Artificial Sequence
  Description of Artificial Sequence: Synthetic oligonucleotide
uacaaggauuguggcgucgcu

SEQ ID NO: 15544 - RNA, 21 nt, Artificial Sequence
  Description of Artificial Sequence: Synthetic oligonucleotide
acaaggauuguggcgucgcuu

SEQ ID NO: 15545 - RNA, 21 nt, Artificial Sequence
  Description of Artificial Sequence: Synthetic oligonucleotide
caaggauuguggcgucgcuuc

SEQ ID NO: 15546 - RNA, 21 nt, Artificial Sequence
  Description of Artificial Sequence: Synthetic oligonucleotide
aaggauuguggcgucgcuuca

SEQ ID NO: 15547 - RNA, 21 nt, Artificial Sequence
  Description of Artificial Sequence: Synthetic oligonucleotide
aggauuguggcgucgcuucaa

SEQ ID NO: 15548 - RNA, 21 nt, Artificial Sequence
  Description of Artificial Sequence: Synthetic oligonucleotide
ggauuguggcgucgcuucaau

SEQ ID NO: 15549 - RNA, 21 nt, Artificial Sequence
  Description of Artificial Sequence: Synthetic oligonucleotide
gauuguggcgucgcuucaauc

SEQ ID NO: 15550 - RNA, 21 nt, Artificial Sequence
  Description of Artificial Sequence: Synthetic oligonucleotide
auuguggcgucgcuucaaucg

SEQ ID NO: 15551 - RNA, 21 nt, Artificial Sequence
  Description of Artificial Sequence: Synthetic oligonucleotide
uuguggcgucgcuucaaucga

SEQ ID NO: 15552 - RNA, 21 nt, Artificial Sequence
  Description of Artificial Sequence: Synthetic oligonucleotide
uguggcgucgcuucaaucgac

SEQ ID NO: 15553 - RNA, 21 nt, Artificial Sequence
  Description of Artificial Sequence: Synthetic oligonucleotide
guggcgucgcuucaaucgacc

SEQ ID NO: 15554 - RNA, 21 nt, Artificial Sequence
  Description of Artificial Sequence: Synthetic oligonucleotide
uggcgucgcuucaaucgaccu

SEQ ID NO: 15555 - RNA, 21 nt, Artificial Sequence
  Description of Artificial Sequence: Synthetic oligonucleotide
ggcgucgcuucaaucgaccuu

SEQ ID NO: 15556 - RNA, 21 nt, Artificial Sequence
  Description of Artificial Sequence: Synthetic oligonucleotide
gcgucgcuucaaucgaccuuu

SEQ ID NO: 15557 - RNA, 21 nt, Artificial Sequence
  Description of Artificial Sequence: Synthetic oligonucleotide
cgucgcuucaaucgaccuuua

SEQ ID NO: 15558 - RNA, 21 nt, Artificial Sequence
  Description of Artificial Sequence: Synthetic oligonucleotide
gucgcuucaaucgaccuuuac

SEQ ID NO: 15559 - RNA, 21 nt, Artificial Sequence
  Description of Artificial Sequence: Synthetic oligonucleotide
ucgcuucaaucgaccuuuacu

SEQ ID NO: 15560 - RNA, 21 nt, Artificial Sequence
  Description of Artificial Sequence: Synthetic oligonucleotide
cgcuucaaucgaccuuuacug

SEQ ID NO: 15561 - RNA, 21 nt, Artificial Sequence
  Description of Artificial Sequence: Synthetic oligonucleotide
gcuucaaucgaccuuuacuga

SEQ ID NO: 15562 - RNA, 21 nt, Artificial Sequence
  Description of Artificial Sequence: Synthetic oligonucleotide
cuucaaucgaccuuuacugaa

SEQ ID NO: 15563 - RNA, 21 nt, Artificial Sequence
  Description of Artificial Sequence: Synthetic oligonucleotide
uucaaucgaccuuuacugaaa

SEQ ID NO: 15564 - RNA, 21 nt, Artificial Sequence
  Description of Artificial Sequence: Synthetic oligonucleotide
ucaaucgaccuuuacugaaac

SEQ ID NO: 15565 - RNA, 21 nt, Artificial Sequence
  Description of Artificial Sequence: Synthetic oligonucleotide
caaucgaccuuuacugaaaca

SEQ ID NO: 15566 - RNA, 21 nt, Artificial Sequence
  Description of Artificial Sequence: Synthetic oligonucleotide
aaucgaccuuuacugaaacaa

SEQ ID NO: 15567 - RNA, 21 nt, Artificial Sequence
  Description of Artificial Sequence: Synthetic oligonucleotide
aucgaccuuuacugaaacaac

SEQ ID NO: 15568 - RNA, 21 nt, Artificial Sequence
  Description of Artificial Sequence: Synthetic oligonucleotide
ucgaccuuuacugaaacaaca

SEQ ID NO: 15569 - RNA, 21 nt, Artificial Sequence
  Description of Artificial Sequence: Synthetic oligonucleotide
cgaccuuuacugaaacaacag

SEQ ID NO: 15570 - RNA, 21 nt, Artificial Sequence
  Description of Artificial Sequence: Synthetic oligonucleotide
gaccuuuacugaaacaacagu

SEQ ID NO: 15571 - RNA, 21 nt, Artificial Sequence
  Description of Artificial Sequence: Synthetic oligonucleotide
accuuuacugaaacaacagua

SEQ ID NO: 15572 - RNA, 21 nt, Artificial Sequence
  Description of Artificial Sequence: Synthetic oligonucleotide
ccuuuacugaaacaacaguaa

SEQ ID NO: 15573 - RNA, 21 nt, Artificial Sequence
  Description of Artificial Sequence: Synthetic oligonucleotide
cuuuacugaaacaacaguaaa

SEQ ID NO: 15574 - RNA, 21 nt, Artificial Sequence
  Description of Artificial Sequence: Synthetic oligonucleotide
uuuacugaaacaacaguaaac

SEQ ID NO: 15575 - RNA, 21 nt, Artificial Sequence
  Description of Artificial Sequence: Synthetic oligonucleotide
uuacugaaacaacaguaaacc

SEQ ID NO: 15576 - RNA, 21 nt, Artificial Sequence
  Description of Artificial Sequence: Synthetic oligonucleotide
uacugaaacaacaguaaacca

SEQ ID NO: 15577 - RNA, 21 nt, Artificial Sequence
  Description of Artificial Sequence: Synthetic oligonucleotide
acugaaacaacaguaaaccau

SEQ ID NO: 15578 - RNA, 21 nt, Artificial Sequence
  Description of Artificial Sequence: Synthetic oligonucleotide
cugaaacaacaguaaaccauc

SEQ ID NO: 15579 - RNA, 21 nt, Artificial Sequence
  Description of Artificial Sequence: Synthetic oligonucleotide
ugaaacaacaguaaaccaucu

SEQ ID NO: 15580 - RNA, 21 nt, Artificial Sequence
  Description of Artificial Sequence: Synthetic oligonucleotide
gaaacaacaguaaaccaucuu

SEQ ID NO: 15581 - RNA, 21 nt, Artificial Sequence
  Description of Artificial Sequence: Synthetic oligonucleotide
aaacaacaguaaaccaucuuu

SEQ ID NO: 15582 - RNA, 21 nt, Artificial Sequence
  Description of Artificial Sequence: Synthetic oligonucleotide
aacaacaguaaaccaucuuua

SEQ ID NO: 15583 - RNA, 21 nt, Artificial Sequence
  Description of Artificial Sequence: Synthetic oligonucleotide
acaacaguaaaccaucuuuau

SEQ ID NO: 15584 - RNA, 21 nt, Artificial Sequence
  Description of Artificial Sequence: Synthetic oligonucleotide
caacaguaaaccaucuuuauu

SEQ ID NO: 15585 - RNA, 21 nt, Artificial Sequence
  Description of Artificial Sequence: Synthetic oligonucleotide
aacaguaaaccaucuuuauua

SEQ ID NO: 15586 - RNA, 21 nt, Artificial Sequence
  Description of Artificial Sequence: Synthetic oligonucleotide
acaguaaaccaucuuuauuau

SEQ ID NO: 15587 - RNA, 21 nt, Artificial Sequence
  Description of Artificial Sequence: Synthetic oligonucleotide
caguaaaccaucuuuauuaug

SEQ ID NO: 15588 - RNA, 21 nt, Artificial Sequence
  Description of Artificial Sequence: Synthetic oligonucleotide
aguaaaccaucuuuauuaugg

SEQ ID NO: 15589 - RNA, 21 nt, Artificial Sequence
  Description of Artificial Sequence: Synthetic oligonucleotide
guaaaccaucuuuauuauggu

SEQ ID NO: 15590 - RNA, 21 nt, Artificial Sequence
  Description of Artificial Sequence: Synthetic oligonucleotide
uaaaccaucuuuauuaugguc

SEQ ID NO: 15591 - RNA, 21 nt, Artificial Sequence
  Description of Artificial Sequence: Synthetic oligonucleotide
aaaccaucuuuauuaugguca

SEQ ID NO: 15592 - RNA, 21 nt, Artificial Sequence
  Description of Artificial Sequence: Synthetic oligonucleotide
aaccaucuuuauuauggucau

SEQ ID NO: 15593 - RNA, 21 nt, Artificial Sequence
  Description of Artificial Sequence: Synthetic oligonucleotide
accaucuuuauuauggucaua

SEQ ID NO: 15594 - RNA, 21 nt, Artificial Sequence
  Description of Artificial Sequence: Synthetic oligonucleotide
ccaucuuuauuauggucauau

SEQ ID NO: 15595 - RNA, 21 nt, Artificial Sequence
  Description of Artificial Sequence: Synthetic oligonucleotide
caucuuuauuauggucauauu

SEQ ID NO: 15596 - RNA, 21 nt, Artificial Sequence
  Description of Artificial Sequence: Synthetic oligonucleotide
aucuuuauuauggucauauuu

SEQ ID NO: 15597 - RNA, 21 nt, Artificial Sequence
  Description of Artificial Sequence: Synthetic oligonucleotide
ucuuuauuauggucauauuuc

SEQ ID NO: 15598 - RNA, 21 nt, Artificial Sequence
  Description of Artificial Sequence: Synthetic oligonucleotide
cuuuauuauggucauauuuca

SEQ ID NO: 15599 - RNA, 21 nt, Artificial Sequence
  Description of Artificial Sequence: Synthetic oligonucleotide
uuuauuauggucauauuucac

SEQ ID NO: 15600 - RNA, 21 nt, Artificial Sequence
  Description of Artificial Sequence: Synthetic oligonucleotide
uuauuauggucauauuucaca

SEQ ID NO: 15601 - RNA, 21 nt, Artificial Sequence
  Description of Artificial Sequence: Synthetic oligonucleotide
uauuauggucauauuucacag

SEQ ID NO: 15602 - RNA, 21 nt, Artificial Sequence
  Description of Artificial Sequence: Synthetic oligonucleotide
auuauggucauauuucacagc

SEQ ID NO: 15603 - RNA, 21 nt, Artificial Sequence
  Description of Artificial Sequence: Synthetic oligonucleotide
uuauggucauauuucacagca

SEQ ID NO: 15604 - RNA, 21 nt, Artificial Sequence
  Description of Artificial Sequence: Synthetic oligonucleotide
uauggucauauuucacagcac

SEQ ID NO: 15605 - RNA, 21 nt, Artificial Sequence
  Description of Artificial Sequence: Synthetic oligonucleotide
auggucauauuucacagcacc

SEQ ID NO: 15606 - RNA, 21 nt, Artificial Sequence
  Description of Artificial Sequence: Synthetic oligonucleotide
uggucauauuucacagcacca

SEQ ID NO: 15607 - RNA, 21 nt, Artificial Sequence
  Description of Artificial Sequence: Synthetic oligonucleotide
ggucauauuucacagcaccaa

SEQ ID NO: 15608 - RNA, 21 nt, Artificial Sequence
  Description of Artificial Sequence: Synthetic oligonucleotide
gucauauuucacagcaccaaa

SEQ ID NO: 15609 - RNA, 21 nt, Artificial Sequence
  Description of Artificial Sequence: Synthetic oligonucleotide
ucauauuucacagcaccaaaa

SEQ ID NO: 15610 - RNA, 21 nt, Artificial Sequence
  Description of Artificial Sequence: Synthetic oligonucleotide
cauauuucacagcaccaaaau

SEQ ID NO: 15611 - RNA, 21 nt, Artificial Sequence
  Description of Artificial Sequence: Synthetic oligonucleotide
auauuucacagcaccaaaaua

SEQ ID NO: 15612 - RNA, 21 nt, Artificial Sequence
  Description of Artificial Sequence: Synthetic oligonucleotide
uauuucacagcaccaaaauaa

SEQ ID NO: 15613 - RNA, 21 nt, Artificial Sequence
  Description of Artificial Sequence: Synthetic oligonucleotide
auuucacagcaccaaaauaaa

SEQ ID NO: 15614 - RNA, 21 nt, Artificial Sequence
  Description of Artificial Sequence: Synthetic oligonucleotide
uuucacagcaccaaaauaaau

SEQ ID NO: 15615 - RNA, 21 nt, Artificial Sequence
  Description of Artificial Sequence: Synthetic oligonucleotide
uucacagcaccaaaauaaauc

SEQ ID NO: 15616 - RNA, 21 nt, Artificial Sequence
  Description of Artificial Sequence: Synthetic oligonucleotide
ucacagcaccaaaauaaauca

SEQ ID NO: 15617 - RNA, 21 nt, Artificial Sequence
  Description of Artificial Sequence: Synthetic oligonucleotide
cacagcaccaaaauaaaucau

SEQ ID NO: 15618 - RNA, 21 nt, Artificial Sequence
  Description of Artificial Sequence: Synthetic oligonucleotide
acagcaccaaaauaaaucauc

SEQ ID NO: 15619 - RNA, 21 nt, Artificial Sequence
  Description of Artificial Sequence: Synthetic oligonucleotide
cagcaccaaaauaaaucaucu

SEQ ID NO: 15620 - RNA, 21 nt, Artificial Sequence
  Description of Artificial Sequence: Synthetic oligonucleotide
agcaccaaaauaaaucaucuu

SEQ ID NO: 15621 - RNA, 21 nt, Artificial Sequence
  Description of Artificial Sequence: Synthetic oligonucleotide
gcaccaaaauaaaucaucuuu

SEQ ID NO: 15622 - RNA, 21 nt, Artificial Sequence
  Description of Artificial Sequence: Synthetic oligonucleotide
caccaaaauaaaucaucuuua

SEQ ID NO: 15623 - RNA, 21 nt, Artificial Sequence
  Description of Artificial Sequence: Synthetic oligonucleotide
accaaaauaaaucaucuuuau

SEQ ID NO: 15624 - RNA, 21 nt, Artificial Sequence
  Description of Artificial Sequence: Synthetic oligonucleotide
ccaaaauaaaucaucuuuauu

SEQ ID NO: 15625 - RNA, 21 nt, Artificial Sequence
  Description of Artificial Sequence: Synthetic oligonucleotide
caaaauaaaucaucuuuauua

SEQ ID NO: 15626 - RNA, 21 nt, Artificial Sequence
  Description of Artificial Sequence: Synthetic oligonucleotide
aaaauaaaucaucuuuauuaa

SEQ ID NO: 15627 - RNA, 21 nt, Artificial Sequence
  Description of Artificial Sequence: Synthetic oligonucleotide
aaauaaaucaucuuuauuaag

SEQ ID NO: 15628 - RNA, 21 nt, Artificial Sequence
  Description of Artificial Sequence: Synthetic oligonucleotide
aauaaaucaucuuuauuaagu

SEQ ID NO: 15629 - RNA, 21 nt, Artificial Sequence
  Description of Artificial Sequence: Synthetic oligonucleotide
auaaaucaucuuuauuaagua

SEQ ID NO: 15630 - RNA, 21 nt, Artificial Sequence
  Description of Artificial Sequence: Synthetic oligonucleotide
uaaaucaucuuuauuaaguag

SEQ ID NO: 15631 - RNA, 21 nt, Artificial Sequence
  Description of Artificial Sequence: Synthetic oligonucleotide
aaaucaucuuuauuaaguaga

SEQ ID NO: 15632 - RNA, 21 nt, Artificial Sequence
  Description of Artificial Sequence: Synthetic oligonucleotide
aaucaucuuuauuaaguagau

SEQ ID NO: 15633 - RNA, 21 nt, Artificial Sequence
  Description of Artificial Sequence: Synthetic oligonucleotide
aucaucuuuauuaaguagaug

SEQ ID NO: 15634 - RNA, 21 nt, Artificial Sequence
  Description of Artificial Sequence: Synthetic oligonucleotide
ucaucuuuauuaaguagauga

SEQ ID NO: 15635 - RNA, 21 nt, Artificial Sequence
  Description of Artificial Sequence: Synthetic oligonucleotide
caucuuuauuaaguagaugaa

SEQ ID NO: 15636 - RNA, 21 nt, Artificial Sequence
  Description of Artificial Sequence: Synthetic oligonucleotide
aucuuuauuaaguagaugaaa

SEQ ID NO: 15637 - RNA, 21 nt, Artificial Sequence
  Description of Artificial Sequence: Synthetic oligonucleotide
ucuuuauuaaguagaugaaac

SEQ ID NO: 15638 - RNA, 21 nt, Artificial Sequence
  Description of Artificial Sequence: Synthetic oligonucleotide
cuuuauuaaguagaugaaaca

SEQ ID NO: 15639 - RNA, 21 nt, Artificial Sequence
  Description of Artificial Sequence: Synthetic oligonucleotide
uuuauuaaguagaugaaacau

SEQ ID NO: 15640 - RNA, 21 nt, Artificial Sequence
  Description of Artificial Sequence: Synthetic oligonucleotide
uuauuaaguagaugaaacauu

SEQ ID NO: 15641 - RNA, 21 nt, Artificial Sequence
  Description of Artificial Sequence: Synthetic oligonucleotide
uauuaaguagaugaaacauua

SEQ ID NO: 15642 - RNA, 21 nt, Artificial Sequence
  Description of Artificial Sequence: Synthetic oligonucleotide
auuaaguagaugaaacauuaa

SEQ ID NO: 15643 - RNA, 21 nt, Artificial Sequence
  Description of Artificial Sequence: Synthetic oligonucleotide
uuaaguagaugaaacauuaac

SEQ ID NO: 15644 - RNA, 21 nt, Artificial Sequence
  Description of Artificial Sequence: Synthetic oligonucleotide
uaaguagaugaaacauuaacu

SEQ ID NO: 15645 - RNA, 21 nt, Artificial Sequence
  Description of Artificial Sequence: Synthetic oligonucleotide
aaguagaugaaacauuaacuc

SEQ ID NO: 15646 - RNA, 21 nt, Artificial Sequence
  Description of Artificial Sequence: Synthetic oligonucleotide
aguagaugaaacauuaacucu

SEQ ID NO: 15647 - RNA, 21 nt, Artificial Sequence
  Description of Artificial Sequence: Synthetic oligonucleotide
guagaugaaacauuaacucua

SEQ ID NO: 15648 - RNA, 21 nt, Artificial Sequence
  Description of Artificial Sequence: Synthetic oligonucleotide
uagaugaaacauuaacucuaa

SEQ ID NO: 15649 - RNA, 21 nt, Artificial Sequence
  Description of Artificial Sequence: Synthetic oligonucleotide
agaugaaacauuaacucuaac

SEQ ID NO: 15650 - RNA, 21 nt, Artificial Sequence
  Description of Artificial Sequence: Synthetic oligonucleotide
gaugaaacauuaacucuaacu

SEQ ID NO: 15651 - RNA, 21 nt, Artificial Sequence
  Description of Artificial Sequence: Synthetic oligonucleotide
augaaacauuaacucuaacug

SEQ ID NO: 15652 - RNA, 21 nt, Artificial Sequence
  Description of Artificial Sequence: Synthetic oligonucleotide
ugaaacauuaacucuaacugu

SEQ ID NO: 15653 - RNA, 21 nt, Artificial Sequence
  Description of Artificial Sequence: Synthetic oligonucleotide
gaaacauuaacucuaacugug

SEQ ID NO: 15654 - RNA, 21 nt, Artificial Sequence
  Description of Artificial Sequence: Synthetic oligonucleotide
aaacauuaacucuaacuguga

SEQ ID NO: 15655 - RNA, 21 nt, Artificial Sequence
  Description of Artificial Sequence: Synthetic oligonucleotide
aacauuaacucuaacugugac

SEQ ID NO: 15656 - RNA, 21 nt, Artificial Sequence
  Description of Artificial Sequence: Synthetic oligonucleotide
acauuaacucuaacugugaca

SEQ ID NO: 15657 - RNA, 21 nt, Artificial Sequence
  Description of Artificial Sequence: Synthetic oligonucleotide
cauuaacucuaacugugacaa

SEQ ID NO: 15658 - RNA, 21 nt, Artificial Sequence
  Description of Artificial Sequence: Synthetic oligonucleotide
auuaacucuaacugugacaaa

SEQ ID NO: 15659 - RNA, 21 nt, Artificial Sequence
  Description of Artificial Sequence: Synthetic oligonucleotide
uuaacucuaacugugacaaag

SEQ ID NO: 15660 - RNA, 21 nt, Artificial Sequence
  Description of Artificial Sequence: Synthetic oligonucleotide
uaacucuaacugugacaaaga

SEQ ID NO: 15661 - RNA, 21 nt, Artificial Sequence
  Description of Artificial Sequence: Synthetic oligonucleotide
aacucuaacugugacaaagaa

SEQ ID NO: 15662 - RNA, 21 nt, Artificial Sequence
  Description of Artificial Sequence: Synthetic oligonucleotide
acucuaacugugacaaagaag

SEQ ID NO: 15663 - RNA, 21 nt, Artificial Sequence
  Description of Artificial Sequence: Synthetic oligonucleotide
cucuaacugugacaaagaaga

SEQ ID NO: 15664 - RNA, 21 nt, Artificial Sequence
  Description of Artificial Sequence: Synthetic oligonucleotide
ucuaacugugacaaagaagac

SEQ ID NO: 15665 - RNA, 21 nt, Artificial Sequence
  Description of Artificial Sequence: Synthetic oligonucleotide
cuaacugugacaaagaagacc

SEQ ID NO: 15666 - RNA, 21 nt, Artificial Sequence
  Description of Artificial Sequence: Synthetic oligonucleotide
uaacugugacaaagaagacca

SEQ ID NO: 15667 - RNA, 21 nt, Artificial Sequence
  Description of Artificial Sequence: Synthetic oligonucleotide
aacugugacaaagaagaccac

SEQ ID NO: 15668 - RNA, 21 nt, Artificial Sequence
  Description of Artificial Sequence: Synthetic oligonucleotide
acugugacaaagaagaccaca

SEQ ID NO: 15669 - RNA, 21 nt, Artificial Sequence
  Description of Artificial Sequence: Synthetic oligonucleotide
cugugacaaagaagaccacaa

SEQ ID NO: 15670 - RNA, 21 nt, Artificial Sequence
  Description of Artificial Sequence: Synthetic oligonucleotide
ugugacaaagaagaccacaaa

SEQ ID NO: 15671 - RNA, 21 nt, Artificial Sequence
  Description of Artificial Sequence: Synthetic oligonucleotide
gugacaaagaagaccacaaau

SEQ ID NO: 15672 - RNA, 21 nt, Artificial Sequence
  Description of Artificial Sequence: Synthetic oligonucleotide
ugacaaagaagaccacaaaua

SEQ ID NO: 15673 - RNA, 21 nt, Artificial Sequence
  Description of Artificial Sequence: Synthetic oligonucleotide
gacaaagaagaccacaaauag

SEQ ID NO: 15674 - RNA, 21 nt, Artificial Sequence
  Description of Artificial Sequence: Synthetic oligonucleotide
acaaagaagaccacaaauagu

SEQ ID NO: 15675 - RNA, 21 nt, Artificial Sequence
  Description of Artificial Sequence: Synthetic oligonucleotide
caaagaagaccacaaauaguu

SEQ ID NO: 15676 - RNA, 21 nt, Artificial Sequence
  Description of Artificial Sequence: Synthetic oligonucleotide
aaagaagaccacaaauaguua

SEQ ID NO: 15677 - RNA, 21 nt, Artificial Sequence
  Description of Artificial Sequence: Synthetic oligonucleotide
aagaagaccacaaauaguuau

SEQ ID NO: 15678 - RNA, 21 nt, Artificial Sequence
  Description of Artificial Sequence: Synthetic oligonucleotide
agaagaccacaaauaguuauc

SEQ ID NO: 15679 - RNA, 21 nt, Artificial Sequence
  Description of Artificial Sequence: Synthetic oligonucleotide
gaagaccacaaauaguuaucu

SEQ ID NO: 15680 - RNA, 21 nt, Artificial Sequence
  Description of Artificial Sequence: Synthetic oligonucleotide
aagaccacaaauaguuaucuu

SEQ ID NO: 15681 - RNA, 21 nt, Artificial Sequence
  Description of Artificial Sequence: Synthetic oligonucleotide
agaccacaaauaguuaucuuu

SEQ ID NO: 15682 - RNA, 21 nt, Artificial Sequence
  Description of Artificial Sequence: Synthetic oligonucleotide
gaccacaaauaguuaucuuuu

SEQ ID NO: 15683 - RNA, 21 nt, Artificial Sequence
  Description of Artificial Sequence: Synthetic oligonucleotide
accacaaauaguuaucuuuua

SEQ ID NO: 15684 - RNA, 21 nt, Artificial Sequence
  Description of Artificial Sequence: Synthetic oligonucleotide
ccacaaauaguuaucuuuuaa

SEQ ID NO: 15685 - RNA, 21 nt, Artificial Sequence
  Description of Artificial Sequence: Synthetic oligonucleotide
cacaaauaguuaucuuuuaau

SEQ ID NO: 15686 - RNA, 21 nt, Artificial Sequence
  Description of Artificial Sequence: Synthetic oligonucleotide
acaaauaguuaucuuuuaauu

SEQ ID NO: 15687 - RNA, 21 nt, Artificial Sequence
  Description of Artificial Sequence: Synthetic oligonucleotide
caaauaguuaucuuuuaauua

SEQ ID NO: 15688 - RNA, 21 nt, Artificial Sequence
  Description of Artificial Sequence: Synthetic oligonucleotide
aaauaguuaucuuuuaauuac

SEQ ID NO: 15689 - RNA, 21 nt, Artificial Sequence
  Description of Artificial Sequence: Synthetic oligonucleotide
aauaguuaucuuuuaauuaca

SEQ ID NO: 15690 - RNA, 21 nt, Artificial Sequence
  Description of Artificial Sequence: Synthetic oligonucleotide
auaguuaucuuuuaauuacag

SEQ ID NO: 15691 - RNA, 21 nt, Artificial Sequence
  Description of Artificial Sequence: Synthetic oligonucleotide
uaguuaucuuuuaauuacaga

SEQ ID NO: 15692 - RNA, 21 nt, Artificial Sequence
  Description of Artificial Sequence: Synthetic oligonucleotide
aguuaucuuuuaauuacagaa

SEQ ID NO: 15693 - RNA, 21 nt, Artificial Sequence
  Description of Artificial Sequence: Synthetic oligonucleotide
guuaucuuuuaauuacagaag

SEQ ID NO: 15694 - RNA, 21 nt, Artificial Sequence
  Description of Artificial Sequence: Synthetic oligonucleotide
uuaucuuuuaauuacagaaga

SEQ ID NO: 15695 - RNA, 21 nt, Artificial Sequence
  Description of Artificial Sequence: Synthetic oligonucleotide
uaucuuuuaauuacagaagag

SEQ ID NO: 15696 - RNA, 21 nt, Artificial Sequence
  Description of Artificial Sequence: Synthetic oligonucleotide
aucuuuuaauuacagaagagu

SEQ ID NO: 15697 - RNA, 21 nt, Artificial Sequence
  Description of Artificial Sequence: Synthetic oligonucleotide
ucuuuuaauuacagaagaguu

SEQ ID NO: 15698 - RNA, 21 nt, Artificial Sequence
  Description of Artificial Sequence: Synthetic oligonucleotide
cuuuuaauuacagaagaguuu

SEQ ID NO: 15699 - RNA, 21 nt, Artificial Sequence
  Description of Artificial Sequence: Synthetic oligonucleotide
uuuuaauuacagaagaguuuc

SEQ ID NO: 15700 - RNA, 21 nt, Artificial Sequence
  Description of Artificial Sequence: Synthetic oligonucleotide
uuuaauuacagaagaguuucu

SEQ ID NO: 15701 - RNA, 21 nt, Artificial Sequence
  Description of Artificial Sequence: Synthetic oligonucleotide
uuaauuacagaagaguuucuu

SEQ ID NO: 15702 - RNA, 21 nt, Artificial Sequence
  Description of Artificial Sequence: Synthetic oligonucleotide
uaauuacagaagaguuucuua

SEQ ID NO: 15703 - RNA, 21 nt, Artificial Sequence
  Description of Artificial Sequence: Synthetic oligonucleotide
aauuacagaagaguuucuuaa

SEQ ID NO: 15704 - RNA, 21 nt, Artificial Sequence
  Description of Artificial Sequence: Synthetic oligonucleotide
auuacagaagaguuucuuaac

SEQ ID NO: 15705 - RNA, 21 nt, Artificial Sequence
  Description of Artificial Sequence: Synthetic oligonucleotide
uuacagaagaguuucuuaacu

SEQ ID NO: 15706 - RNA, 21 nt, Artificial Sequence
  Description of Artificial Sequence: Synthetic oligonucleotide
uacagaagaguuucuuaacuu

SEQ ID NO: 15707 - RNA, 21 nt, Artificial Sequence
  Description of Artificial Sequence: Synthetic oligonucleotide
acagaagaguuucuuaacuua

SEQ ID NO: 15708 - RNA, 21 nt, Artificial Sequence
  Description of Artificial Sequence: Synthetic oligonucleotide
cagaagaguuucuuaacuuac

SEQ ID NO: 15709 - RNA, 21 nt, Artificial Sequence
  Description of Artificial Sequence: Synthetic oligonucleotide
agaagaguuucuuaacuuacu

SEQ ID NO: 15710 - RNA, 21 nt, Artificial Sequence
  Description of Artificial Sequence: Synthetic oligonucleotide
gaagaguuucuuaacuuacuu

SEQ ID NO: 15711 - RNA, 21 nt, Artificial Sequence
  Description of Artificial Sequence: Synthetic oligonucleotide
aagaguuucuuaacuuacuuu

SEQ ID NO: 15712 - RNA, 21 nt, Artificial Sequence
  Description of Artificial Sequence: Synthetic oligonucleotide
agaguuucuuaacuuacuuuu

SEQ ID NO: 15713 - RNA, 21 nt, Artificial Sequence
  Description of Artificial Sequence: Synthetic oligonucleotide
gaguuucuuaacuuacuuuug

SEQ ID NO: 15714 - RNA, 21 nt, Artificial Sequence
  Description of Artificial Sequence: Synthetic oligonucleotide
aguuucuuaacuuacuuuugu

SEQ ID NO: 15715 - RNA, 21 nt, Artificial Sequence
  Description of Artificial Sequence: Synthetic oligonucleotide
guuucuuaacuuacuuuugua

SEQ ID NO: 15716 - RNA, 21 nt, Artificial Sequence
  Description of Artificial Sequence: Synthetic oligonucleotide
uuucuuaacuuacuuuuguaa

SEQ ID NO: 15717 - RNA, 21 nt, Artificial Sequence
  Description of Artificial Sequence: Synthetic oligonucleotide
uucuuaacuuacuuuuguaag

SEQ ID NO: 15718 - RNA, 21 nt, Artificial Sequence
  Description of Artificial Sequence: Synthetic oligonucleotide
ucuuaacuuacuuuuguaagu

SEQ ID NO: 15719 - RNA, 21 nt, Artificial Sequence
  Description of Artificial Sequence: Synthetic oligonucleotide
cuuaacuuacuuuuguaaguu

SEQ ID NO: 15720 - RNA, 21 nt, Artificial Sequence
  Description of Artificial Sequence: Synthetic oligonucleotide
uuaacuuacuuuuguaaguuu

SEQ ID NO: 15721 - RNA, 21 nt, Artificial Sequence
  Description of Artificial Sequence: Synthetic oligonucleotide
uaacuuacuuuuguaaguuuu

SEQ ID NO: 15722 - RNA, 21 nt, Artificial Sequence
  Description of Artificial Sequence: Synthetic oligonucleotide
aacuuacuuuuguaaguuuuu

SEQ ID NO: 15723 - RNA, 21 nt, Artificial Sequence
  Description of Artificial Sequence: Synthetic oligonucleotide
acuuacuuuuguaaguuuuua

SEQ ID NO: 15724 - RNA, 21 nt, Artificial Sequence
  Description of Artificial Sequence: Synthetic oligonucleotide
cuuacuuuuguaaguuuuuau

SEQ ID NO: 15725 - RNA, 21 nt, Artificial Sequence
  Description of Artificial Sequence: Synthetic oligonucleotide
uuacuuuuguaaguuuuuauu

SEQ ID NO: 15726 - RNA, 21 nt, Artificial Sequence
  Description of Artificial Sequence: Synthetic oligonucleotide
uacuuuuguaaguuuuuauug

SEQ ID NO: 15727 - RNA, 21 nt, Artificial Sequence
  Description of Artificial Sequence: Synthetic oligonucleotide
acuuuuguaaguuuuuauugu

SEQ ID NO: 15728 - RNA, 21 nt, Artificial Sequence
  Description of Artificial Sequence: Synthetic oligonucleotide
cuuuuguaaguuuuuauugug

SEQ ID NO: 15729 - RNA, 21 nt, Artificial Sequence
  Description of Artificial Sequence: Synthetic oligonucleotide
uuuuguaaguuuuuauugugu

SEQ ID NO: 15730 - RNA, 21 nt, Artificial Sequence
  Description of Artificial Sequence: Synthetic oligonucleotide
uuuguaaguuuuuauugugua

SEQ ID NO: 15731 - RNA, 21 nt, Artificial Sequence
  Description of Artificial Sequence: Synthetic oligonucleotide
uuguaaguuuuuauuguguaa

SEQ ID NO: 15732 - RNA, 21 nt, Artificial Sequence
  Description of Artificial Sequence: Synthetic oligonucleotide
uguaaguuuuuauuguguaag

SEQ ID NO: 15733 - RNA, 21 nt, Artificial Sequence
  Description of Artificial Sequence: Synthetic oligonucleotide
guaaguuuuuauuguguaagu

SEQ ID NO: 15734 - RNA, 21 nt, Artificial Sequence
  Description of Artificial Sequence: Synthetic oligonucleotide
uaaguuuuuauuguguaaguu

SEQ ID NO: 15735 - RNA, 21 nt, Artificial Sequence
  Description of Artificial Sequence: Synthetic oligonucleotide
aaguuuuuauuguguaaguuu

SEQ ID NO: 15736 - RNA, 21 nt, Artificial Sequence
  Description of Artificial Sequence: Synthetic oligonucleotide
aguuuuuauuguguaaguuua

SEQ ID NO: 15737 - RNA, 21 nt, Artificial Sequence
  Description of Artificial Sequence: Synthetic oligonucleotide
guuuuuauuguguaaguuuau

SEQ ID NO: 15738 - RNA, 21 nt, Artificial Sequence
  Description of Artificial Sequence: Synthetic oligonucleotide
uuuuuauuguguaaguuuaua

SEQ ID NO: 15739 - RNA, 21 nt, Artificial Sequence
  Description of Artificial Sequence: Synthetic oligonucleotide
uuuuauuguguaaguuuauaa

SEQ ID NO: 15740 - RNA, 21 nt, Artificial Sequence
  Description of Artificial Sequence: Synthetic oligonucleotide
uuuauuguguaaguuuauaau

SEQ ID NO: 15741 - RNA, 21 nt, Artificial Sequence
  Description of Artificial Sequence: Synthetic oligonucleotide
uuauuguguaaguuuauaaug

SEQ ID NO: 15742 - RNA, 21 nt, Artificial Sequence
  Description of Artificial Sequence: Synthetic oligonucleotide
uauuguguaaguuuauaaugc

SEQ ID NO: 15743 - RNA, 21 nt, Artificial Sequence
  Description of Artificial Sequence: Synthetic oligonucleotide
auuguguaaguuuauaaugca

SEQ ID NO: 15744 - RNA, 21 nt, Artificial Sequence
  Description of Artificial Sequence: Synthetic oligonucleotide
uuguguaaguuuauaaugcag

SEQ ID NO: 15745 - RNA, 21 nt, Artificial Sequence
  Description of Artificial Sequence: Synthetic oligonucleotide
uguguaaguuuauaaugcagg

SEQ ID NO: 15746 - RNA, 21 nt, Artificial Sequence
  Description of Artificial Sequence: Synthetic oligonucleotide
guguaaguuuauaaugcaggg

SEQ ID NO: 15747 - RNA, 21 nt, Artificial Sequence
  Description of Artificial Sequence: Synthetic oligonucleotide
uguaaguuuauaaugcagggg

SEQ ID NO: 15748 - RNA, 21 nt, Artificial Sequence
  Description of Artificial Sequence: Synthetic oligonucleotide
guaaguuuauaaugcagggga

SEQ ID NO: 15749 - RNA, 21 nt, Artificial Sequence
  Description of Artificial Sequence: Synthetic oligonucleotide
uaaguuuauaaugcaggggaa

SEQ ID NO: 15750 - RNA, 21 nt, Artificial Sequence
  Description of Artificial Sequence: Synthetic oligonucleotide
aaguuuauaaugcaggggaag

SEQ ID NO: 15751 - RNA, 21 nt, Artificial Sequence
  Description of Artificial Sequence: Synthetic oligonucleotide
aguuuauaaugcaggggaagu

SEQ ID NO: 15752 - RNA, 21 nt, Artificial Sequence
  Description of Artificial Sequence: Synthetic oligonucleotide
guuuauaaugcaggggaagua

SEQ ID NO: 15753 - RNA, 21 nt, Artificial Sequence
  Description of Artificial Sequence: Synthetic oligonucleotide
uuuauaaugcaggggaaguac

SEQ ID NO: 15754 - RNA, 21 nt, Artificial Sequence
  Description of Artificial Sequence: Synthetic oligonucleotide
uuauaaugcaggggaaguacu

SEQ ID NO: 15755 - RNA, 21 nt, Artificial Sequence
  Description of Artificial Sequence: Synthetic oligonucleotide
uauaaugcaggggaaguacua

SEQ ID NO: 15756 - RNA, 21 nt, Artificial Sequence
  Description of Artificial Sequence: Synthetic oligonucleotide
auaaugcaggggaaguacuac

SEQ ID NO: 15757 - RNA, 21 nt, Artificial Sequence
  Description of Artificial Sequence: Synthetic oligonucleotide
uaaugcaggggaaguacuacu

SEQ ID NO: 15758 - RNA, 21 nt, Artificial Sequence
  Description of Artificial Sequence: Synthetic oligonucleotide
aaugcaggggaaguacuacuc

SEQ ID NO: 15759 - RNA, 21 nt, Artificial Sequence
  Description of Artificial Sequence: Synthetic oligonucleotide
augcaggggaaguacuacucc

SEQ ID NO: 15760 - RNA, 21 nt, Artificial Sequence
  Description of Artificial Sequence: Synthetic oligonucleotide
ugcaggggaaguacuacuccu

SEQ ID NO: 15761 - RNA, 21 nt, Artificial Sequence
  Description of Artificial Sequence: Synthetic oligonucleotide
gcaggggaaguacuacuccuc

SEQ ID NO: 15762 - RNA, 21 nt, Artificial Sequence
  Description of Artificial Sequence: Synthetic oligonucleotide
caggggaaguacuacuccuca

SEQ ID NO: 15763 - RNA, 21 nt, Artificial Sequence
  Description of Artificial Sequence: Synthetic oligonucleotide
aggggaaguacuacuccucaa

SEQ ID NO: 15764 - RNA, 21 nt, Artificial Sequence
  Description of Artificial Sequence: Synthetic oligonucleotide
ggggaaguacuacuccucaaa

SEQ ID NO: 15765 - RNA, 21 nt, Artificial Sequence
  Description of Artificial Sequence: Synthetic oligonucleotide
gggaaguacuacuccucaaau

SEQ ID NO: 15766 - RNA, 21 nt, Artificial Sequence
  Description of Artificial Sequence: Synthetic oligonucleotide
ggaaguacuacuccucaaaug

SEQ ID NO: 15767 - RNA, 21 nt, Artificial Sequence
  Description of Artificial Sequence: Synthetic oligonucleotide
gaaguacuacuccucaaaugu

SEQ ID NO: 15768 - RNA, 21 nt, Artificial Sequence
  Description of Artificial Sequence: Synthetic oligonucleotide
aaguacuacuccucaaauguu

SEQ ID NO: 15769 - RNA, 21 nt, Artificial Sequence
  Description of Artificial Sequence: Synthetic oligonucleotide
aguacuacuccucaaauguug

SEQ ID NO: 15770 - RNA, 21 nt, Artificial Sequence
  Description of Artificial Sequence: Synthetic oligonucleotide
guacuacuccucaaauguuga

SEQ ID NO: 15771 - RNA, 21 nt, Artificial Sequence
  Description of Artificial Sequence: Synthetic oligonucleotide
uacuacuccucaaauguugag

SEQ ID NO: 15772 - RNA, 21 nt, Artificial Sequence
  Description of Artificial Sequence: Synthetic oligonucleotide
acuacuccucaaauguugagg

SEQ ID NO: 15773 - RNA, 21 nt, Artificial Sequence
  Description of Artificial Sequence: Synthetic oligonucleotide
cuacuccucaaauguugaggg

SEQ ID NO: 15774 - RNA, 21 nt, Artificial Sequence
  Description of Artificial Sequence: Synthetic oligonucleotide
uacuccucaaauguugaggga

SEQ ID NO: 15775 - RNA, 21 nt, Artificial Sequence
  Description of Artificial Sequence: Synthetic oligonucleotide
acuccucaaauguugagggaa

SEQ ID NO: 15776 - RNA, 21 nt, Artificial Sequence
  Description of Artificial Sequence: Synthetic oligonucleotide
cuccucaaauguugagggaag

SEQ ID NO: 15777 - RNA, 21 nt, Artificial Sequence
  Description of Artificial Sequence: Synthetic oligonucleotide
uccucaaauguugagggaagc

SEQ ID NO: 15778 - RNA, 21 nt, Artificial Sequence
  Description of Artificial Sequence: Synthetic oligonucleotide
ccucaaauguugagggaagcu

SEQ ID NO: 15779 - RNA, 21 nt, Artificial Sequence
  Description of Artificial Sequence: Synthetic oligonucleotide
cucaaauguugagggaagcuu

SEQ ID NO: 15780 - RNA, 21 nt, Artificial Sequence
  Description of Artificial Sequence: Synthetic oligonucleotide
ucaaauguugagggaagcuuc

SEQ ID NO: 15781 - RNA, 21 nt, Artificial Sequence
  Description of Artificial Sequence: Synthetic oligonucleotide
caaauguugagggaagcuucc

SEQ ID NO: 15782 - RNA, 21 nt, Artificial Sequence
  Description of Artificial Sequence: Synthetic oligonucleotide
aaauguugagggaagcuucca

SEQ ID NO: 15783 - RNA, 21 nt, Artificial Sequence
  Description of Artificial Sequence: Synthetic oligonucleotide
aauguugagggaagcuuccau

SEQ ID NO: 15784 - RNA, 21 nt, Artificial Sequence
  Description of Artificial Sequence: Synthetic oligonucleotide
auguugagggaagcuuccaua

SEQ ID NO: 15785 - RNA, 21 nt, Artificial Sequence
  Description of Artificial Sequence: Synthetic oligonucleotide
uguugagggaagcuuccauaa

SEQ ID NO: 15786 - RNA, 21 nt, Artificial Sequence
  Description of Artificial Sequence: Synthetic oligonucleotide
guugagggaagcuuccauaac

SEQ ID NO: 15787 - RNA, 21 nt, Artificial Sequence
  Description of Artificial Sequence: Synthetic oligonucleotide
uugagggaagcuuccauaaca

SEQ ID NO: 15788 - RNA, 21 nt, Artificial Sequence
  Description of Artificial Sequence: Synthetic oligonucleotide
ugagggaagcuuccauaacau

SEQ ID NO: 15789 - RNA, 21 nt, Artificial Sequence
  Description of Artificial Sequence: Synthetic oligonucleotide
gagggaagcuuccauaacauu

SEQ ID NO: 15790 - RNA, 21 nt, Artificial Sequence
  Description of Artificial Sequence: Synthetic oligonucleotide
agggaagcuuccauaacauug

SEQ ID NO: 15791 - RNA, 21 nt, Artificial Sequence
  Description of Artificial Sequence: Synthetic oligonucleotide
gggaagcuuccauaacauuga

SEQ ID NO: 15792 - RNA, 21 nt, Artificial Sequence
  Description of Artificial Sequence: Synthetic oligonucleotide
ggaagcuuccauaacauugau

SEQ ID NO: 15793 - RNA, 21 nt, Artificial Sequence
  Description of Artificial Sequence: Synthetic oligonucleotide
gaagcuuccauaacauugaug

SEQ ID NO: 15794 - RNA, 21 nt, Artificial Sequence
  Description of Artificial Sequence: Synthetic oligonucleotide
aagcuuccauaacauugauga

SEQ ID NO: 15795 - RNA, 21 nt, Artificial Sequence
  Description of Artificial Sequence: Synthetic oligonucleotide
agcuuccauaacauugaugac

SEQ ID NO: 15796 - RNA, 21 nt, Artificial Sequence
  Description of Artificial Sequence: Synthetic oligonucleotide
gcuuccauaacauugaugacu

SEQ ID NO: 15797 - RNA, 21 nt, Artificial Sequence
  Description of Artificial Sequence: Synthetic oligonucleotide
cuuccauaacauugaugacug

SEQ ID NO: 15798 - RNA, 21 nt, Artificial Sequence
  Description of Artificial Sequence: Synthetic oligonucleotide
uuccauaacauugaugacugg

SEQ ID NO: 15799 - RNA, 21 nt, Artificial Sequence
  Description of Artificial Sequence: Synthetic oligonucleotide
uccauaacauugaugacuggc

SEQ ID NO: 15800 - RNA, 21 nt, Artificial Sequence
  Description of Artificial Sequence: Synthetic oligonucleotide
ccauaacauugaugacuggcu

SEQ ID NO: 15801 - RNA, 21 nt, Artificial Sequence
  Description of Artificial Sequence: Synthetic oligonucleotide
cauaacauugaugacuggcuu

SEQ ID NO: 15802 - RNA, 21 nt, Artificial Sequence
  Description of Artificial Sequence: Synthetic oligonucleotide
auaacauugaugacuggcuuc

SEQ ID NO: 15803 - RNA, 21 nt, Artificial Sequence
  Description of Artificial Sequence: Synthetic oligonucleotide
uaacauugaugacuggcuuca

SEQ ID NO: 15804 - RNA, 21 nt, Artificial Sequence
  Description of Artificial Sequence: Synthetic oligonucleotide
aacauugaugacuggcuucau

SEQ ID NO: 15805 - RNA, 21 nt, Artificial Sequence
  Description of Artificial Sequence: Synthetic oligonucleotide
acauugaugacuggcuucaug

SEQ ID NO: 15806 - RNA, 21 nt, Artificial Sequence
  Description of Artificial Sequence: Synthetic oligonucleotide
cauugaugacuggcuucaugg

SEQ ID NO: 15807 - RNA, 21 nt, Artificial Sequence
  Description of Artificial Sequence: Synthetic oligonucleotide
auugaugacuggcuucauggc

SEQ ID NO: 15808 - RNA, 21 nt, Artificial Sequence
  Description of Artificial Sequence: Synthetic oligonucleotide
uugaugacuggcuucauggca

SEQ ID NO: 15809 - RNA, 21 nt, Artificial Sequence
  Description of Artificial Sequence: Synthetic oligonucleotide
ugaugacuggcuucauggcag

SEQ ID NO: 15810 - RNA, 21 nt, Artificial Sequence
  Description of Artificial Sequence: Synthetic oligonucleotide
gaugacuggcuucauggcagu

SEQ ID NO: 15811 - RNA, 21 nt, Artificial Sequence
  Description of Artificial Sequence: Synthetic oligonucleotide
augacuggcuucauggcagua

SEQ ID NO: 15812 - RNA, 21 nt, Artificial Sequence
  Description of Artificial Sequence: Synthetic oligonucleotide
ugacuggcuucauggcaguaa

SEQ ID NO: 15813 - RNA, 21 nt, Artificial Sequence
  Description of Artificial Sequence: Synthetic oligonucleotide
gacuggcuucauggcaguaau

SEQ ID NO: 15814 - RNA, 21 nt, Artificial Sequence
  Description of Artificial Sequence: Synthetic oligonucleotide
acuggcuucauggcaguaauu

SEQ ID NO: 15815 - RNA, 21 nt, Artificial Sequence
  Description of Artificial Sequence: Synthetic oligonucleotide
cuggcuucauggcaguaauuc

SEQ ID NO: 15816 - RNA, 21 nt, Artificial Sequence
  Description of Artificial Sequence: Synthetic oligonucleotide
uggcuucauggcaguaauucu

SEQ ID NO: 15817 - RNA, 21 nt, Artificial Sequence
  Description of Artificial Sequence: Synthetic oligonucleotide
ggcuucauggcaguaauucuc

SEQ ID NO: 15818 - RNA, 21 nt, Artificial Sequence
  Description of Artificial Sequence: Synthetic oligonucleotide
gcuucauggcaguaauucucg

SEQ ID NO: 15819 - RNA, 21 nt, Artificial Sequence
  Description of Artificial Sequence: Synthetic oligonucleotide
cuucauggcaguaauucucgg

SEQ ID NO: 15820 - RNA, 21 nt, Artificial Sequence
  Description of Artificial Sequence: Synthetic oligonucleotide
uucauggcaguaauucucggc

SEQ ID NO: 15821 - RNA, 21 nt, Artificial Sequence
  Description of Artificial Sequence: Synthetic oligonucleotide
ucauggcaguaauucucggcu

SEQ ID NO: 15822 - RNA, 21 nt, Artificial Sequence
  Description of Artificial Sequence: Synthetic oligonucleotide
cauggcaguaauucucggcug

SEQ ID NO: 15823 - RNA, 21 nt, Artificial Sequence
  Description of Artificial Sequence: Synthetic oligonucleotide
auggcaguaauucucggcugu

SEQ ID NO: 15824 - RNA, 21 nt, Artificial Sequence
  Description of Artificial Sequence: Synthetic oligonucleotide
uggcaguaauucucggcugua

SEQ ID NO: 15825 - RNA, 21 nt, Artificial Sequence
  Description of Artificial Sequence: Synthetic oligonucleotide
ggcaguaauucucggcuguag

SEQ ID NO: 15826 - RNA, 21 nt, Artificial Sequence
  Description of Artificial Sequence: Synthetic oligonucleotide
gcaguaauucucggcuguagu

SEQ ID NO: 15827 - RNA, 21 nt, Artificial Sequence
  Description of Artificial Sequence: Synthetic oligonucleotide
caguaauucucggcuguaguu

SEQ ID NO: 15828 - RNA, 21 nt, Artificial Sequence
  Description of Artificial Sequence: Synthetic oligonucleotide
aguaauucucggcuguaguug

SEQ ID NO: 15829 - RNA, 21 nt, Artificial Sequence
  Description of Artificial Sequence: Synthetic oligonucleotide
guaauucucggcuguaguugc

SEQ ID NO: 15830 - RNA, 21 nt, Artificial Sequence
  Description of Artificial Sequence: Synthetic oligonucleotide
uaauucucggcuguaguugca

SEQ ID NO: 15831 - RNA, 21 nt, Artificial Sequence
  Description of Artificial Sequence: Synthetic oligonucleotide
aauucucggcuguaguugcau

SEQ ID NO: 15832 - RNA, 21 nt, Artificial Sequence
  Description of Artificial Sequence: Synthetic oligonucleotide
auucucggcuguaguugcaua

SEQ ID NO: 15833 - RNA, 21 nt, Artificial Sequence
  Description of Artificial Sequence: Synthetic oligonucleotide
uucucggcuguaguugcauaa

SEQ ID NO: 15834 - RNA, 21 nt, Artificial Sequence
  Description of Artificial Sequence: Synthetic oligonucleotide
ucucggcuguaguugcauaag

SEQ ID NO: 15835 - RNA, 21 nt, Artificial Sequence
  Description of Artificial Sequence: Synthetic oligonucleotide
cucggcuguaguugcauaagc

SEQ ID NO: 15836 - RNA, 21 nt, Artificial Sequence
  Description of Artificial Sequence: Synthetic oligonucleotide
ucggcuguaguugcauaagca

SEQ ID NO: 15837 - RNA, 21 nt, Artificial Sequence
  Description of Artificial Sequence: Synthetic oligonucleotide
cggcuguaguugcauaagcau

SEQ ID NO: 15838 - RNA, 21 nt, Artificial Sequence
  Description of Artificial Sequence: Synthetic oligonucleotide
ggcuguaguugcauaagcauu

SEQ ID NO: 15839 - RNA, 21 nt, Artificial Sequence
  Description of Artificial Sequence: Synthetic oligonucleotide
gcuguaguugcauaagcauug

SEQ ID NO: 15840 - RNA, 21 nt, Artificial Sequence
  Description of Artificial Sequence: Synthetic oligonucleotide
cuguaguugcauaagcauugc

SEQ ID NO: 15841 - RNA, 21 nt, Artificial Sequence
  Description of Artificial Sequence: Synthetic oligonucleotide
uguaguugcauaagcauugcu

SEQ ID NO: 15842 - RNA, 21 nt, Artificial Sequence
  Description of Artificial Sequence: Synthetic oligonucleotide
guaguugcauaagcauugcuc

SEQ ID NO: 15843 - RNA, 21 nt, Artificial Sequence
  Description of Artificial Sequence: Synthetic oligonucleotide
uaguugcauaagcauugcuca

SEQ ID NO: 15844 - RNA, 21 nt, Artificial Sequence
  Description of Artificial Sequence: Synthetic oligonucleotide
aguugcauaagcauugcucaa

SEQ ID NO: 15845 - RNA, 21 nt, Artificial Sequence
  Description of Artificial Sequence: Synthetic oligonucleotide
guugcauaagcauugcucaag

SEQ ID NO: 15846 - RNA, 21 nt, Artificial Sequence
  Description of Artificial Sequence: Synthetic oligonucleotide
uugcauaagcauugcucaaga

SEQ ID NO: 15847 - RNA, 21 nt, Artificial Sequence
  Description of Artificial Sequence: Synthetic oligonucleotide
ugcauaagcauugcucaagag

SEQ ID NO: 15848 - RNA, 21 nt, Artificial Sequence
  Description of Artificial Sequence: Synthetic oligonucleotide
gcauaagcauugcucaagagg

SEQ ID NO: 15849 - RNA, 21 nt, Artificial Sequence
  Description of Artificial Sequence: Synthetic oligonucleotide
cauaagcauugcucaagagga

SEQ ID NO: 15850 - RNA, 21 nt, Artificial Sequence
  Description of Artificial Sequence: Synthetic oligonucleotide
auaagcauugcucaagaggaa

SEQ ID NO: 15851 - RNA, 21 nt, Artificial Sequence
  Description of Artificial Sequence: Synthetic oligonucleotide
uaagcauugcucaagaggaaa

SEQ ID NO: 15852 - RNA, 21 nt, Artificial Sequence
  Description of Artificial Sequence: Synthetic oligonucleotide
aagcauugcucaagaggaaaa

SEQ ID NO: 15853 - RNA, 21 nt, Artificial Sequence
  Description of Artificial Sequence: Synthetic oligonucleotide
agcauugcucaagaggaaaau

SEQ ID NO: 15854 - RNA, 21 nt, Artificial Sequence
  Description of Artificial Sequence: Synthetic oligonucleotide
gcauugcucaagaggaaaauc

SEQ ID NO: 15855 - RNA, 21 nt, Artificial Sequence
  Description of Artificial Sequence: Synthetic oligonucleotide
cauugcucaagaggaaaaucc

SEQ ID NO: 15856 - RNA, 21 nt, Artificial Sequence
  Description of Artificial Sequence: Synthetic oligonucleotide
auugcucaagaggaaaaucca

SEQ ID NO: 15857 - RNA, 21 nt, Artificial Sequence
  Description of Artificial Sequence: Synthetic oligonucleotide
uugcucaagaggaaaauccaa

SEQ ID NO: 15858 - RNA, 21 nt, Artificial Sequence
  Description of Artificial Sequence: Synthetic oligonucleotide
ugcucaagaggaaaauccaaa

SEQ ID NO: 15859 - RNA, 21 nt, Artificial Sequence
  Description of Artificial Sequence: Synthetic oligonucleotide
gcucaagaggaaaauccaaaa

SEQ ID NO: 15860 - RNA, 21 nt, Artificial Sequence
  Description of Artificial Sequence: Synthetic oligonucleotide
cucaagaggaaaauccaaaag

SEQ ID NO: 15861 - RNA, 21 nt, Artificial Sequence
  Description of Artificial Sequence: Synthetic oligonucleotide
ucaagaggaaaauccaaaagu

SEQ ID NO: 15862 - RNA, 21 nt, Artificial Sequence
  Description of Artificial Sequence: Synthetic oligonucleotide
caagaggaaaauccaaaagug

SEQ ID NO: 15863 - RNA, 21 nt, Artificial Sequence
  Description of Artificial Sequence: Synthetic oligonucleotide
aagaggaaaauccaaaagugc

SEQ ID NO: 15864 - RNA, 21 nt, Artificial Sequence
  Description of Artificial Sequence: Synthetic oligonucleotide
agaggaaaauccaaaagugca

SEQ ID NO: 15865 - RNA, 21 nt, Artificial Sequence
  Description of Artificial Sequence: Synthetic oligonucleotide
gaggaaaauccaaaagugcag

SEQ ID NO: 15866 - RNA, 21 nt, Artificial Sequence
  Description of Artificial Sequence: Synthetic oligonucleotide
aggaaaauccaaaagugcagc

SEQ ID NO: 15867 - RNA, 21 nt, Artificial Sequence
  Description of Artificial Sequence: Synthetic oligonucleotide
ggaaaauccaaaagugcagca

SEQ ID NO: 15868 - RNA, 21 nt, Artificial Sequence
  Description of Artificial Sequence: Synthetic oligonucleotide
gaaaauccaaaagugcagcag

SEQ ID NO: 15869 - RNA, 21 nt, Artificial Sequence
  Description of Artificial Sequence: Synthetic oligonucleotide
aaaauccaaaagugcagcagg

SEQ ID NO: 15870 - RNA, 21 nt, Artificial Sequence
  Description of Artificial Sequence: Synthetic oligonucleotide
aaauccaaaagugcagcagga

SEQ ID NO: 15871 - RNA, 21 nt, Artificial Sequence
  Description of Artificial Sequence: Synthetic oligonucleotide
aauccaaaagugcagcaggag

SEQ ID NO: 15872 - RNA, 21 nt, Artificial Sequence
  Description of Artificial Sequence: Synthetic oligonucleotide
auccaaaagugcagcaggaga

SEQ ID NO: 15873 - RNA, 21 nt, Artificial Sequence
  Description of Artificial Sequence: Synthetic oligonucleotide
uccaaaagugcagcaggagaa

SEQ ID NO: 15874 - RNA, 21 nt, Artificial Sequence
  Description of Artificial Sequence: Synthetic oligonucleotide
ccaaaagugcagcaggagaac

SEQ ID NO: 15875 - RNA, 21 nt, Artificial Sequence
  Description of Artificial Sequence: Synthetic oligonucleotide
caaaagugcagcaggagaacu

SEQ ID NO: 15876 - RNA, 21 nt, Artificial Sequence
  Description of Artificial Sequence: Synthetic oligonucleotide
aaaagugcagcaggagaacuc

SEQ ID NO: 15877 - RNA, 21 nt, Artificial Sequence
  Description of Artificial Sequence: Synthetic oligonucleotide
aaagugcagcaggagaacucu

SEQ ID NO: 15878 - RNA, 21 nt, Artificial Sequence
  Description of Artificial Sequence: Synthetic oligonucleotide
aagugcagcaggagaacucuu

SEQ ID NO: 15879 - RNA, 21 nt, Artificial Sequence
  Description of Artificial Sequence: Synthetic oligonucleotide
agugcagcaggagaacucuuu

SEQ ID NO: 15880 - RNA, 21 nt, Artificial Sequence
  Description of Artificial Sequence: Synthetic oligonucleotide
gugcagcaggagaacucuuuu

SEQ ID NO: 15881 - RNA, 21 nt, Artificial Sequence
  Description of Artificial Sequence: Synthetic oligonucleotide
ugcagcaggagaacucuuuuc

SEQ ID NO: 15882 - RNA, 21 nt, Artificial Sequence
  Description of Artificial Sequence: Synthetic oligonucleotide
gcagcaggagaacucuuuucc

SEQ ID NO: 15883 - RNA, 21 nt, Artificial Sequence
  Description of Artificial Sequence: Synthetic oligonucleotide
cagcaggagaacucuuuuccc

SEQ ID NO: 15884 - RNA, 21 nt, Artificial Sequence
  Description of Artificial Sequence: Synthetic oligonucleotide
agcaggagaacucuuuucccu

SEQ ID NO: 15885 - RNA, 21 nt, Artificial Sequence
  Description of Artificial Sequence: Synthetic oligonucleotide
gcaggagaacucuuuucccug

SEQ ID NO: 15886 - RNA, 21 nt, Artificial Sequence
  Description of Artificial Sequence: Synthetic oligonucleotide
caggagaacucuuuucccuga

SEQ ID NO: 15887 - RNA, 21 nt, Artificial Sequence
  Description of Artificial Sequence: Synthetic oligonucleotide
aggagaacucuuuucccugaa

SEQ ID NO: 15888 - RNA, 21 nt, Artificial Sequence
  Description of Artificial Sequence: Synthetic oligonucleotide
ggagaacucuuuucccugaaa

SEQ ID NO: 15889 - RNA, 21 nt, Artificial Sequence
  Description of Artificial Sequence: Synthetic oligonucleotide
gagaacucuuuucccugaaaa

SEQ ID NO: 15890 - RNA, 21 nt, Artificial Sequence
  Description of Artificial Sequence: Synthetic oligonucleotide
agaacucuuuucccugaaaaa

SEQ ID NO: 15891 - RNA, 21 nt, Artificial Sequence
  Description of Artificial Sequence: Synthetic oligonucleotide
gaacucuuuucccugaaaaag

SEQ ID NO: 15892 - RNA, 21 nt, Artificial Sequence
  Description of Artificial Sequence: Synthetic oligonucleotide
aacucuuuucccugaaaaagg

SEQ ID NO: 15893 - RNA, 21 nt, Artificial Sequence
  Description of Artificial Sequence: Synthetic oligonucleotide
acucuuuucccugaaaaagga

SEQ ID NO: 15894 - RNA, 21 nt, Artificial Sequence
  Description of Artificial Sequence: Synthetic oligonucleotide
cucuuuucccugaaaaaggaa

SEQ ID NO: 15895 - RNA, 21 nt, Artificial Sequence
  Description of Artificial Sequence: Synthetic oligonucleotide
ucuuuucccugaaaaaggaaa

SEQ ID NO: 15896 - RNA, 21 nt, Artificial Sequence
  Description of Artificial Sequence: Synthetic oligonucleotide
cuuuucccugaaaaaggaaaa

SEQ ID NO: 15897 - RNA, 21 nt, Artificial Sequence
  Description of Artificial Sequence: Synthetic oligonucleotide
uuuucccugaaaaaggaaaaa

SEQ ID NO: 15898 - RNA, 21 nt, Artificial Sequence
  Description of Artificial Sequence: Synthetic oligonucleotide
uuucccugaaaaaggaaaaau

SEQ ID NO: 15899 - RNA, 21 nt, Artificial Sequence
  Description of Artificial Sequence: Synthetic oligonucleotide
uucccugaaaaaggaaaaaua

SEQ ID NO: 15900 - RNA, 21 nt, Artificial Sequence
  Description of Artificial Sequence: Synthetic oligonucleotide
ucccugaaaaaggaaaaauau

SEQ ID NO: 15901 - RNA, 21 nt, Artificial Sequence
  Description of Artificial Sequence: Synthetic oligonucleotide
cccugaaaaaggaaaaauauu

SEQ ID NO: 15902 - RNA, 21 nt, Artificial Sequence
  Description of Artificial Sequence: Synthetic oligonucleotide
ccugaaaaaggaaaaauauug

SEQ ID NO: 15903 - RNA, 21 nt, Artificial Sequence
  Description of Artificial Sequence: Synthetic oligonucleotide
cugaaaaaggaaaaauauuga

SEQ ID NO: 15904 - RNA, 21 nt, Artificial Sequence
  Description of Artificial Sequence: Synthetic oligonucleotide
ugaaaaaggaaaaauauugaa

SEQ ID NO: 15905 - RNA, 21 nt, Artificial Sequence
  Description of Artificial Sequence: Synthetic oligonucleotide
gaaaaaggaaaaauauugaac

SEQ ID NO: 15906 - RNA, 21 nt, Artificial Sequence
  Description of Artificial Sequence: Synthetic oligonucleotide
aaaaaggaaaaauauugaacu

SEQ ID NO: 15907 - RNA, 21 nt, Artificial Sequence
  Description of Artificial Sequence: Synthetic oligonucleotide
aaaaggaaaaauauugaacuc

SEQ ID NO: 15908 - RNA, 21 nt, Artificial Sequence
  Description of Artificial Sequence: Synthetic oligonucleotide
aaaggaaaaauauugaacuca

SEQ ID NO: 15909 - RNA, 21 nt, Artificial Sequence
  Description of Artificial Sequence: Synthetic oligonucleotide
aaggaaaaauauugaacucaa

SEQ ID NO: 15910 - RNA, 21 nt, Artificial Sequence
  Description of Artificial Sequence: Synthetic oligonucleotide
aggaaaaauauugaacucaau

SEQ ID NO: 15911 - RNA, 21 nt, Artificial Sequence
  Description of Artificial Sequence: Synthetic oligonucleotide
ggaaaaauauugaacucaaug

SEQ ID NO: 15912 - RNA, 21 nt, Artificial Sequence
  Description of Artificial Sequence: Synthetic oligonucleotide
gaaaaauauugaacucaauga

SEQ ID NO: 15913 - RNA, 21 nt, Artificial Sequence
  Description of Artificial Sequence: Synthetic oligonucleotide
aaaaauauugaacucaaugau

SEQ ID NO: 15914 - RNA, 21 nt, Artificial Sequence
  Description of Artificial Sequence: Synthetic oligonucleotide
aaaauauugaacucaaugaua

SEQ ID NO: 15915 - RNA, 21 nt, Artificial Sequence
  Description of Artificial Sequence: Synthetic oligonucleotide
aaauauugaacucaaugauag

SEQ ID NO: 15916 - RNA, 21 nt, Artificial Sequence
  Description of Artificial Sequence: Synthetic oligonucleotide
aauauugaacucaaugauagc

SEQ ID NO: 15917 - RNA, 21 nt, Artificial Sequence
  Description of Artificial Sequence: Synthetic oligonucleotide
auauugaacucaaugauagca

SEQ ID NO: 15918 - RNA, 21 nt, Artificial Sequence
  Description of Artificial Sequence: Synthetic oligonucleotide
uauugaacucaaugauagcac

SEQ ID NO: 15919 - RNA, 21 nt, Artificial Sequence
  Description of Artificial Sequence: Synthetic oligonucleotide
auugaacucaaugauagcacc

SEQ ID NO: 15920 - RNA, 21 nt, Artificial Sequence
  Description of Artificial Sequence: Synthetic oligonucleotide
uugaacucaaugauagcaccu

SEQ ID NO: 15921 - RNA, 21 nt, Artificial Sequence
  Description of Artificial Sequence: Synthetic oligonucleotide
ugaacucaaugauagcaccua

SEQ ID NO: 15922 - RNA, 21 nt, Artificial Sequence
  Description of Artificial Sequence: Synthetic oligonucleotide
gaacucaaugauagcaccuaa

SEQ ID NO: 15923 - RNA, 21 nt, Artificial Sequence
  Description of Artificial Sequence: Synthetic oligonucleotide
aacucaaugauagcaccuaaa

SEQ ID NO: 15924 - RNA, 21 nt, Artificial Sequence
  Description of Artificial Sequence: Synthetic oligonucleotide
acucaaugauagcaccuaaac

SEQ ID NO: 15925 - RNA, 21 nt, Artificial Sequence
  Description of Artificial Sequence: Synthetic oligonucleotide
cucaaugauagcaccuaaacu

SEQ ID NO: 15926 - RNA, 21 nt, Artificial Sequence
  Description of Artificial Sequence: Synthetic oligonucleotide
ucaaugauagcaccuaaacuu

SEQ ID NO: 15927 - RNA, 21 nt, Artificial Sequence
  Description of Artificial Sequence: Synthetic oligonucleotide
caaugauagcaccuaaacuua

SEQ ID NO: 15928 - RNA, 21 nt, Artificial Sequence
  Description of Artificial Sequence: Synthetic oligonucleotide
aaugauagcaccuaaacuuac

SEQ ID NO: 15929 - RNA, 21 nt, Artificial Sequence
  Description of Artificial Sequence: Synthetic oligonucleotide
augauagcaccuaaacuuaca

SEQ ID NO: 15930 - RNA, 21 nt, Artificial Sequence
  Description of Artificial Sequence: Synthetic oligonucleotide
ugauagcaccuaaacuuacau

SEQ ID NO: 15931 - RNA, 21 nt, Artificial Sequence
  Description of Artificial Sequence: Synthetic oligonucleotide
gauagcaccuaaacuuacauu

SEQ ID NO: 15932 - RNA, 21 nt, Artificial Sequence
  Description of Artificial Sequence: Synthetic oligonucleotide
auagcaccuaaacuuacauuu

SEQ ID NO: 15933 - RNA, 21 nt, Artificial Sequence
  Description of Artificial Sequence: Synthetic oligonucleotide
uagcaccuaaacuuacauuua

SEQ ID NO: 15934 - RNA, 21 nt, Artificial Sequence
  Description of Artificial Sequence: Synthetic oligonucleotide
agcaccuaaacuuacauuuaa

SEQ ID NO: 15935 - RNA, 21 nt, Artificial Sequence
  Description of Artificial Sequence: Synthetic oligonucleotide
gcaccuaaacuuacauuuaaa

SEQ ID NO: 15936 - RNA, 21 nt, Artificial Sequence
  Description of Artificial Sequence: Synthetic oligonucleotide
caccuaaacuuacauuuaaaa

SEQ ID NO: 15937 - RNA, 21 nt, Artificial Sequence
  Description of Artificial Sequence: Synthetic oligonucleotide
accuaaacuuacauuuaaaag

SEQ ID NO: 15938 - RNA, 21 nt, Artificial Sequence
  Description of Artificial Sequence: Synthetic oligonucleotide
ccuaaacuuacauuuaaaaga

SEQ ID NO: 15939 - RNA, 21 nt, Artificial Sequence
  Description of Artificial Sequence: Synthetic oligonucleotide
cuaaacuuacauuuaaaagac

SEQ ID NO: 15940 - RNA, 21 nt, Artificial Sequence
  Description of Artificial Sequence: Synthetic oligonucleotide
uaaacuuacauuuaaaagaca

SEQ ID NO: 15941 - RNA, 21 nt, Artificial Sequence
  Description of Artificial Sequence: Synthetic oligonucleotide
aaacuuacauuuaaaagacag

SEQ ID NO: 15942 - RNA, 21 nt, Artificial Sequence
  Description of Artificial Sequence: Synthetic oligonucleotide
aacuuacauuuaaaagacaga

SEQ ID NO: 15943 - RNA, 21 nt, Artificial Sequence
  Description of Artificial Sequence: Synthetic oligonucleotide
acuuacauuuaaaagacagac

SEQ ID NO: 15944 - RNA, 21 nt, Artificial Sequence
  Description of Artificial Sequence: Synthetic oligonucleotide
cuuacauuuaaaagacagaca

SEQ ID NO: 15945 - RNA, 21 nt, Artificial Sequence
  Description of Artificial Sequence: Synthetic oligonucleotide
uuacauuuaaaagacagacau

SEQ ID NO: 15946 - RNA, 21 nt, Artificial Sequence
  Description of Artificial Sequence: Synthetic oligonucleotide
uacauuuaaaagacagacauu

SEQ ID NO: 15947 - RNA, 21 nt, Artificial Sequence
  Description of Artificial Sequence: Synthetic oligonucleotide
acauuuaaaagacagacauuc

SEQ ID NO: 15948 - RNA, 21 nt, Artificial Sequence
  Description of Artificial Sequence: Synthetic oligonucleotide
cauuuaaaagacagacauucc

SEQ ID NO: 15949 - RNA, 21 nt, Artificial Sequence
  Description of Artificial Sequence: Synthetic oligonucleotide
auuuaaaagacagacauuccu

SEQ ID NO: 15950 - RNA, 21 nt, Artificial Sequence
  Description of Artificial Sequence: Synthetic oligonucleotide
uuuaaaagacagacauuccuu

SEQ ID NO: 15951 - RNA, 21 nt, Artificial Sequence
  Description of Artificial Sequence: Synthetic oligonucleotide
uuaaaagacagacauuccuuc

SEQ ID NO: 15952 - RNA, 21 nt, Artificial Sequence
  Description of Artificial Sequence: Synthetic oligonucleotide
uaaaagacagacauuccuucu

SEQ ID NO: 15953 - RNA, 21 nt, Artificial Sequence
  Description of Artificial Sequence: Synthetic oligonucleotide
aaaagacagacauuccuucua

SEQ ID NO: 15954 - RNA, 21 nt, Artificial Sequence
  Description of Artificial Sequence: Synthetic oligonucleotide
aaagacagacauuccuucuac

SEQ ID NO: 15955 - RNA, 21 nt, Artificial Sequence
  Description of Artificial Sequence: Synthetic oligonucleotide
aagacagacauuccuucuaca

SEQ ID NO: 15956 - RNA, 21 nt, Artificial Sequence
  Description of Artificial Sequence: Synthetic oligonucleotide
agacagacauuccuucuacau

SEQ ID NO: 15957 - RNA, 21 nt, Artificial Sequence
  Description of Artificial Sequence: Synthetic oligonucleotide
gacagacauuccuucuacaug

SEQ ID NO: 15958 - RNA, 21 nt, Artificial Sequence
  Description of Artificial Sequence: Synthetic oligonucleotide
acagacauuccuucuacaugu

SEQ ID NO: 15959 - RNA, 21 nt, Artificial Sequence
  Description of Artificial Sequence: Synthetic oligonucleotide
cagacauuccuucuacaugua

SEQ ID NO: 15960 - RNA, 21 nt, Artificial Sequence
  Description of Artificial Sequence: Synthetic oligonucleotide
agacauuccuucuacauguaa

SEQ ID NO: 15961 - RNA, 21 nt, Artificial Sequence
  Description of Artificial Sequence: Synthetic oligonucleotide
gacauuccuucuacauguaau

SEQ ID NO: 15962 - RNA, 21 nt, Artificial Sequence
  Description of Artificial Sequence: Synthetic oligonucleotide
acauuccuucuacauguaaug

SEQ ID NO: 15963 - RNA, 21 nt, Artificial Sequence
  Description of Artificial Sequence: Synthetic oligonucleotide
cauuccuucuacauguaauga

SEQ ID NO: 15964 - RNA, 21 nt, Artificial Sequence
  Description of Artificial Sequence: Synthetic oligonucleotide
auuccuucuacauguaaugac

SEQ ID NO: 15965 - RNA, 21 nt, Artificial Sequence
  Description of Artificial Sequence: Synthetic oligonucleotide
uuccuucuacauguaaugaca

SEQ ID NO: 15966 - RNA, 21 nt, Artificial Sequence
  Description of Artificial Sequence: Synthetic oligonucleotide
uccuucuacauguaaugacac

SEQ ID NO: 15967 - RNA, 21 nt, Artificial Sequence
  Description of Artificial Sequence: Synthetic oligonucleotide
ccuucuacauguaaugacacu

SEQ ID NO: 15968 - RNA, 21 nt, Artificial Sequence
  Description of Artificial Sequence: Synthetic oligonucleotide
cuucuacauguaaugacacuu

SEQ ID NO: 15969 - RNA, 21 nt, Artificial Sequence
  Description of Artificial Sequence: Synthetic oligonucleotide
uucuacauguaaugacacuuc

SEQ ID NO: 15970 - RNA, 21 nt, Artificial Sequence
  Description of Artificial Sequence: Synthetic oligonucleotide
ucuacauguaaugacacuucu

SEQ ID NO: 15971 - RNA, 21 nt, Artificial Sequence
  Description of Artificial Sequence: Synthetic oligonucleotide
cuacauguaaugacacuucuu

SEQ ID NO: 15972 - RNA, 21 nt, Artificial Sequence
  Description of Artificial Sequence: Synthetic oligonucleotide
uacauguaaugacacuucuug

SEQ ID NO: 15973 - RNA, 21 nt, Artificial Sequence
  Description of Artificial Sequence: Synthetic oligonucleotide
acauguaaugacacuucuugu

SEQ ID NO: 15974 - RNA, 21 nt, Artificial Sequence
  Description of Artificial Sequence: Synthetic oligonucleotide
cauguaaugacacuucuugug

SEQ ID NO: 15975 - RNA, 21 nt, Artificial Sequence
  Description of Artificial Sequence: Synthetic oligonucleotide
auguaaugacacuucuugugu

SEQ ID NO: 15976 - RNA, 21 nt, Artificial Sequence
  Description of Artificial Sequence: Synthetic oligonucleotide
uguaaugacacuucuuguguu

SEQ ID NO: 15977 - RNA, 21 nt, Artificial Sequence
  Description of Artificial Sequence: Synthetic oligonucleotide
guaaugacacuucuuguguua

SEQ ID NO: 15978 - RNA, 21 nt, Artificial Sequence
  Description of Artificial Sequence: Synthetic oligonucleotide
uaaugacacuucuuguguuaa

SEQ ID NO: 15979 - RNA, 21 nt, Artificial Sequence
  Description of Artificial Sequence: Synthetic oligonucleotide
aaugacacuucuuguguuaaa

SEQ ID NO: 15980 - RNA, 21 nt, Artificial Sequence
  Description of Artificial Sequence: Synthetic oligonucleotide
augacacuucuuguguuaaac

SEQ ID NO: 15981 - RNA, 21 nt, Artificial Sequence
  Description of Artificial Sequence: Synthetic oligonucleotide
ugacacuucuuguguuaaacu

SEQ ID NO: 15982 - RNA, 21 nt, Artificial Sequence
  Description of Artificial Sequence: Synthetic oligonucleotide
gacacuucuuguguuaaacua

SEQ ID NO: 15983 - RNA, 21 nt, Artificial Sequence
  Description of Artificial Sequence: Synthetic oligonucleotide
acacuucuuguguuaaacuaa

SEQ ID NO: 15984 - RNA, 21 nt, Artificial Sequence
  Description of Artificial Sequence: Synthetic oligonucleotide
cacuucuuguguuaaacuaaa

SEQ ID NO: 15985 - RNA, 21 nt, Artificial Sequence
  Description of Artificial Sequence: Synthetic oligonucleotide
acuucuuguguuaaacuaaaa

SEQ ID NO: 15986 - RNA, 21 nt, Artificial Sequence
  Description of Artificial Sequence: Synthetic oligonucleotide
cuucuuguguuaaacuaaaaa

SEQ ID NO: 15987 - RNA, 21 nt, Artificial Sequence
  Description of Artificial Sequence: Synthetic oligonucleotide
uucuuguguuaaacuaaaaau

SEQ ID NO: 15988 - RNA, 21 nt, Artificial Sequence
  Description of Artificial Sequence: Synthetic oligonucleotide
ucuuguguuaaacuaaaaauu

SEQ ID NO: 15989 - RNA, 21 nt, Artificial Sequence
  Description of Artificial Sequence: Synthetic oligonucleotide
cuuguguuaaacuaaaaauuu

SEQ ID NO: 15990 - RNA, 21 nt, Artificial Sequence
  Description of Artificial Sequence: Synthetic oligonucleotide
uuguguuaaacuaaaaauuua

SEQ ID NO: 15991 - RNA, 21 nt, Artificial Sequence
  Description of Artificial Sequence: Synthetic oligonucleotide
uguguuaaacuaaaaauuuac

SEQ ID NO: 15992 - RNA, 21 nt, Artificial Sequence
  Description of Artificial Sequence: Synthetic oligonucleotide
guguuaaacuaaaaauuuaca

SEQ ID NO: 15993 - RNA, 21 nt, Artificial Sequence
  Description of Artificial Sequence: Synthetic oligonucleotide
uguuaaacuaaaaauuuacaa

SEQ ID NO: 15994 - RNA, 21 nt, Artificial Sequence
  Description of Artificial Sequence: Synthetic oligonucleotide
guuaaacuaaaaauuuacaag

SEQ ID NO: 15995 - RNA, 21 nt, Artificial Sequence
  Description of Artificial Sequence: Synthetic oligonucleotide
uuaaacuaaaaauuuacaaga

SEQ ID NO: 15996 - RNA, 21 nt, Artificial Sequence
  Description of Artificial Sequence: Synthetic oligonucleotide
uaaacuaaaaauuuacaagag

SEQ ID NO: 15997 - RNA, 21 nt, Artificial Sequence
  Description of Artificial Sequence: Synthetic oligonucleotide
aaacuaaaaauuuacaagaga

SEQ ID NO: 15998 - RNA, 21 nt, Artificial Sequence
  Description of Artificial Sequence: Synthetic oligonucleotide
aacuaaaaauuuacaagagaa

SEQ ID NO: 15999 - RNA, 21 nt, Artificial Sequence
  Description of Artificial Sequence: Synthetic oligonucleotide
acuaaaaauuuacaagagaag

SEQ ID NO: 16000 - RNA, 21 nt, Artificial Sequence
  Description of Artificial Sequence: Synthetic oligonucleotide
cuaaaaauuuacaagagaaga

SEQ ID NO: 16001 - RNA, 21 nt, Artificial Sequence
  Description of Artificial Sequence: Synthetic oligonucleotide
uaaaaauuuacaagagaagaa

SEQ ID NO: 16002 - RNA, 21 nt, Artificial Sequence
  Description of Artificial Sequence: Synthetic oligonucleotide
aaaaauuuacaagagaagaaa

SEQ ID NO: 16003 - RNA, 21 nt, Artificial Sequence
  Description of Artificial Sequence: Synthetic oligonucleotide
aaaauuuacaagagaagaaag

SEQ ID NO: 16004 - RNA, 21 nt, Artificial Sequence
  Description of Artificial Sequence: Synthetic oligonucleotide
aaauuuacaagagaagaaagu

SEQ ID NO: 16005 - RNA, 21 nt, Artificial Sequence
  Description of Artificial Sequence: Synthetic oligonucleotide
aauuuacaagagaagaaagug

SEQ ID NO: 16006 - RNA, 21 nt, Artificial Sequence
  Description of Artificial Sequence: Synthetic oligonucleotide
auuuacaagagaagaaaguga

SEQ ID NO: 16007 - RNA, 21 nt, Artificial Sequence
  Description of Artificial Sequence: Synthetic oligonucleotide
uuuacaagagaagaaagugaa

SEQ ID NO: 16008 - RNA, 21 nt, Artificial Sequence
  Description of Artificial Sequence: Synthetic oligonucleotide
uuacaagagaagaaagugaaa

SEQ ID NO: 16009 - RNA, 21 nt, Artificial Sequence
  Description of Artificial Sequence: Synthetic oligonucleotide
uacaagagaagaaagugaaag

SEQ ID NO: 16010 - RNA, 21 nt, Artificial Sequence
  Description of Artificial Sequence: Synthetic oligonucleotide
acaagagaagaaagugaaagc

SEQ ID NO: 16011 - RNA, 21 nt, Artificial Sequence
  Description of Artificial Sequence: Synthetic oligonucleotide
caagagaagaaagugaaagca

SEQ ID NO: 16012 - RNA, 21 nt, Artificial Sequence
  Description of Artificial Sequence: Synthetic oligonucleotide
aagagaagaaagugaaagcaa

SEQ ID NO: 16013 - RNA, 21 nt, Artificial Sequence
  Description of Artificial Sequence: Synthetic oligonucleotide
agagaagaaagugaaagcaaa

SEQ ID NO: 16014 - RNA, 21 nt, Artificial Sequence
  Description of Artificial Sequence: Synthetic oligonucleotide
gagaagaaagugaaagcaaau

SEQ ID NO: 16015 - RNA, 21 nt, Artificial Sequence
  Description of Artificial Sequence: Synthetic oligonucleotide
agaagaaagugaaagcaaaug

SEQ ID NO: 16016 - RNA, 21 nt, Artificial Sequence
  Description of Artificial Sequence: Synthetic oligonucleotide
gaagaaagugaaagcaaaugg

SEQ ID NO: 16017 - RNA, 21 nt, Artificial Sequence
  Description of Artificial Sequence: Synthetic oligonucleotide
aagaaagugaaagcaaauggg

SEQ ID NO: 16018 - RNA, 21 nt, Artificial Sequence
  Description of Artificial Sequence: Synthetic oligonucleotide
agaaagugaaagcaaaugggg

SEQ ID NO: 16019 - RNA, 21 nt, Artificial Sequence
  Description of Artificial Sequence: Synthetic oligonucleotide
gaaagugaaagcaaauggggu

SEQ ID NO: 16020 - RNA, 21 nt, Artificial Sequence
  Description of Artificial Sequence: Synthetic oligonucleotide
aaagugaaagcaaaugggguu

SEQ ID NO: 16021 - RNA, 21 nt, Artificial Sequence
  Description of Artificial Sequence: Synthetic oligonucleotide
aagugaaagcaaaugggguuu

SEQ ID NO: 16022 - RNA, 21 nt, Artificial Sequence
  Description of Artificial Sequence: Synthetic oligonucleotide
agugaaagcaaaugggguuuc

SEQ ID NO: 16023 - RNA, 21 nt, Artificial Sequence
  Description of Artificial Sequence: Synthetic oligonucleotide
gugaaagcaaaugggguuuca

SEQ ID NO: 16024 - RNA, 21 nt, Artificial Sequence
  Description of Artificial Sequence: Synthetic oligonucleotide
ugaaagcaaaugggguuucac

SEQ ID NO: 16025 - RNA, 21 nt, Artificial Sequence
  Description of Artificial Sequence: Synthetic oligonucleotide
gaaagcaaaugggguuucaca

SEQ ID NO: 16026 - RNA, 21 nt, Artificial Sequence
  Description of Artificial Sequence: Synthetic oligonucleotide
aaagcaaaugggguuucacaa

SEQ ID NO: 16027 - RNA, 21 nt, Artificial Sequence
  Description of Artificial Sequence: Synthetic oligonucleotide
aagcaaaugggguuucacaaa

SEQ ID NO: 16028 - RNA, 21 nt, Artificial Sequence
  Description of Artificial Sequence: Synthetic oligonucleotide
agcaaaugggguuucacaaau

SEQ ID NO: 16029 - RNA, 21 nt, Artificial Sequence
  Description of Artificial Sequence: Synthetic oligonucleotide
gcaaaugggguuucacaaaua

SEQ ID NO: 16030 - RNA, 21 nt, Artificial Sequence
  Description of Artificial Sequence: Synthetic oligonucleotide
caaaugggguuucacaaauag

SEQ ID NO: 16031 - RNA, 21 nt, Artificial Sequence
  Description of Artificial Sequence: Synthetic oligonucleotide
aaaugggguuucacaaauagu

SEQ ID NO: 16032 - RNA, 21 nt, Artificial Sequence
  Description of Artificial Sequence: Synthetic oligonucleotide
aaugggguuucacaaauaguu

SEQ ID NO: 16033 - RNA, 21 nt, Artificial Sequence
  Description of Artificial Sequence: Synthetic oligonucleotide
augggguuucacaaauaguug

SEQ ID NO: 16034 - RNA, 21 nt, Artificial Sequence
  Description of Artificial Sequence: Synthetic oligonucleotide
ugggguuucacaaauaguugu

SEQ ID NO: 16035 - RNA, 21 nt, Artificial Sequence
  Description of Artificial Sequence: Synthetic oligonucleotide
gggguuucacaaauaguugua

SEQ ID NO: 16036 - RNA, 21 nt, Artificial Sequence
  Description of Artificial Sequence: Synthetic oligonucleotide
ggguuucacaaauaguuguaa

SEQ ID NO: 16037 - RNA, 21 nt, Artificial Sequence
  Description of Artificial Sequence: Synthetic oligonucleotide
gguuucacaaauaguuguaaa

SEQ ID NO: 16038 - RNA, 21 nt, Artificial Sequence
  Description of Artificial Sequence: Synthetic oligonucleotide
guuucacaaauaguuguaaau

SEQ ID NO: 16039 - RNA, 21 nt, Artificial Sequence
  Description of Artificial Sequence: Synthetic oligonucleotide
uuucacaaauaguuguaaaua

SEQ ID NO: 16040 - RNA, 21 nt, Artificial Sequence
  Description of Artificial Sequence: Synthetic oligonucleotide
uucacaaauaguuguaaauau

SEQ ID NO: 16041 - RNA, 21 nt, Artificial Sequence
  Description of Artificial Sequence: Synthetic oligonucleotide
ucacaaauaguuguaaauaua

SEQ ID NO: 16042 - RNA, 21 nt, Artificial Sequence
  Description of Artificial Sequence: Synthetic oligonucleotide
cacaaauaguuguaaauauag

SEQ ID NO: 16043 - RNA, 21 nt, Artificial Sequence
  Description of Artificial Sequence: Synthetic oligonucleotide
acaaauaguuguaaauauagu

SEQ ID NO: 16044 - RNA, 21 nt, Artificial Sequence
  Description of Artificial Sequence: Synthetic oligonucleotide
caaauaguuguaaauauagug

SEQ ID NO: 16045 - RNA, 21 nt, Artificial Sequence
  Description of Artificial Sequence: Synthetic oligonucleotide
aaauaguuguaaauauaguga

SEQ ID NO: 16046 - RNA, 21 nt, Artificial Sequence
  Description of Artificial Sequence: Synthetic oligonucleotide
aauaguuguaaauauagugaa

SEQ ID NO: 16047 - RNA, 21 nt, Artificial Sequence
  Description of Artificial Sequence: Synthetic oligonucleotide
auaguuguaaauauagugaag

SEQ ID NO: 16048 - RNA, 21 nt, Artificial Sequence
  Description of Artificial Sequence: Synthetic oligonucleotide
uaguuguaaauauagugaagc

SEQ ID NO: 16049 - RNA, 21 nt, Artificial Sequence
  Description of Artificial Sequence: Synthetic oligonucleotide
aguuguaaauauagugaagca

SEQ ID NO: 16050 - RNA, 21 nt, Artificial Sequence
  Description of Artificial Sequence: Synthetic oligonucleotide
guuguaaauauagugaagcaa

SEQ ID NO: 16051 - RNA, 21 nt, Artificial Sequence
  Description of Artificial Sequence: Synthetic oligonucleotide
uuguaaauauagugaagcaau

SEQ ID NO: 16052 - RNA, 21 nt, Artificial Sequence
  Description of Artificial Sequence: Synthetic oligonucleotide
uguaaauauagugaagcaauu

SEQ ID NO: 16053 - RNA, 21 nt, Artificial Sequence
  Description of Artificial Sequence: Synthetic oligonucleotide
guaaauauagugaagcaauuu

SEQ ID NO: 16054 - RNA, 21 nt, Artificial Sequence
  Description of Artificial Sequence: Synthetic oligonucleotide
uaaauauagugaagcaauuug

SEQ ID NO: 16055 - RNA, 21 nt, Artificial Sequence
  Description of Artificial Sequence: Synthetic oligonucleotide
aaauauagugaagcaauuuga

SEQ ID NO: 16056 - RNA, 21 nt, Artificial Sequence
  Description of Artificial Sequence: Synthetic oligonucleotide
aauauagugaagcaauuugaa

SEQ ID NO: 16057 - RNA, 21 nt, Artificial Sequence
  Description of Artificial Sequence: Synthetic oligonucleotide
auauagugaagcaauuugaaa

SEQ ID NO: 16058 - RNA, 21 nt, Artificial Sequence
  Description of Artificial Sequence: Synthetic oligonucleotide
uauagugaagcaauuugaaau

SEQ ID NO: 16059 - RNA, 21 nt, Artificial Sequence
  Description of Artificial Sequence: Synthetic oligonucleotide
auagugaagcaauuugaaaua

SEQ ID NO: 16060 - RNA, 21 nt, Artificial Sequence
  Description of Artificial Sequence: Synthetic oligonucleotide
uagugaagcaauuugaaauaa

SEQ ID NO: 16061 - RNA, 21 nt, Artificial Sequence
  Description of Artificial Sequence: Synthetic oligonucleotide
agugaagcaauuugaaauaau

SEQ ID NO: 16062 - RNA, 21 nt, Artificial Sequence
  Description of Artificial Sequence: Synthetic oligonucleotide
gugaagcaauuugaaauaauu

SEQ ID NO: 16063 - RNA, 21 nt, Artificial Sequence
  Description of Artificial Sequence: Synthetic oligonucleotide
ugaagcaauuugaaauaauuu

SEQ ID NO: 16064 - RNA, 21 nt, Artificial Sequence
  Description of Artificial Sequence: Synthetic oligonucleotide
gaagcaauuugaaauaauuuu

SEQ ID NO: 16065 - RNA, 21 nt, Artificial Sequence
  Description of Artificial Sequence: Synthetic oligonucleotide
aagcaauuugaaauaauuuuc

SEQ ID NO: 16066 - RNA, 21 nt, Artificial Sequence
  Description of Artificial Sequence: Synthetic oligonucleotide
agcaauuugaaauaauuuuca

SEQ ID NO: 16067 - RNA, 21 nt, Artificial Sequence
  Description of Artificial Sequence: Synthetic oligonucleotide
gcaauuugaaauaauuuucaa

SEQ ID NO: 16068 - RNA, 21 nt, Artificial Sequence
  Description of Artificial Sequence: Synthetic oligonucleotide
caauuugaaauaauuuucaag

SEQ ID NO: 16069 - RNA, 21 nt, Artificial Sequence
  Description of Artificial Sequence: Synthetic oligonucleotide
aauuugaaauaauuuucaagc

SEQ ID NO: 16070 - RNA, 21 nt, Artificial Sequence
  Description of Artificial Sequence: Synthetic oligonucleotide
auuugaaauaauuuucaagca

SEQ ID NO: 16071 - RNA, 21 nt, Artificial Sequence
  Description of Artificial Sequence: Synthetic oligonucleotide
uuugaaauaauuuucaagcaa

SEQ ID NO: 16072 - RNA, 21 nt, Artificial Sequence
  Description of Artificial Sequence: Synthetic oligonucleotide
uugaaauaauuuucaagcaaa

SEQ ID NO: 16073 - RNA, 21 nt, Artificial Sequence
  Description of Artificial Sequence: Synthetic oligonucleotide
ugaaauaauuuucaagcaaag

SEQ ID NO: 16074 - RNA, 21 nt, Artificial Sequence
  Description of Artificial Sequence: Synthetic oligonucleotide
gaaauaauuuucaagcaaagu

SEQ ID NO: 16075 - RNA, 21 nt, Artificial Sequence
  Description of Artificial Sequence: Synthetic oligonucleotide
aaauaauuuucaagcaaagua

SEQ ID NO: 16076 - RNA, 21 nt, Artificial Sequence
  Description of Artificial Sequence: Synthetic oligonucleotide
aauaauuuucaagcaaaguau

SEQ ID NO: 16077 - RNA, 21 nt, Artificial Sequence
  Description of Artificial Sequence: Synthetic oligonucleotide
auaauuuucaagcaaaguauu

SEQ ID NO: 16078 - RNA, 21 nt, Artificial Sequence
  Description of Artificial Sequence: Synthetic oligonucleotide
uaauuuucaagcaaaguauug

SEQ ID NO: 16079 - RNA, 21 nt, Artificial Sequence
  Description of Artificial Sequence: Synthetic oligonucleotide
aauuuucaagcaaaguauugu

SEQ ID NO: 16080 - RNA, 21 nt, Artificial Sequence
  Description of Artificial Sequence: Synthetic oligonucleotide
auuuucaagcaaaguauugug

SEQ ID NO: 16081 - RNA, 21 nt, Artificial Sequence
  Description of Artificial Sequence: Synthetic oligonucleotide
uuuucaagcaaaguauuguga

SEQ ID NO: 16082 - RNA, 21 nt, Artificial Sequence
  Description of Artificial Sequence: Synthetic oligonucleotide
uuucaagcaaaguauugugaa

SEQ ID NO: 16083 - RNA, 21 nt, Artificial Sequence
  Description of Artificial Sequence: Synthetic oligonucleotide
uucaagcaaaguauugugaaa

SEQ ID NO: 16084 - RNA, 21 nt, Artificial Sequence
  Description of Artificial Sequence: Synthetic oligonucleotide
ucaagcaaaguauugugaaag

SEQ ID NO: 16085 - RNA, 21 nt, Artificial Sequence
  Description of Artificial Sequence: Synthetic oligonucleotide
caagcaaaguauugugaaagu

SEQ ID NO: 16086 - RNA, 21 nt, Artificial Sequence
  Description of Artificial Sequence: Synthetic oligonucleotide
aagcaaaguauugugaaagua

SEQ ID NO: 16087 - RNA, 21 nt, Artificial Sequence
  Description of Artificial Sequence: Synthetic oligonucleotide
agcaaaguauugugaaaguau

SEQ ID NO: 16088 - RNA, 21 nt, Artificial Sequence
  Description of Artificial Sequence: Synthetic oligonucleotide
gcaaaguauugugaaaguauu

SEQ ID NO: 16089 - RNA, 21 nt, Artificial Sequence
  Description of Artificial Sequence: Synthetic oligonucleotide
caaaguauugugaaaguauuc

SEQ ID NO: 16090 - RNA, 21 nt, Artificial Sequence
  Description of Artificial Sequence: Synthetic oligonucleotide
aaaguauugugaaaguauucu

SEQ ID NO: 16091 - RNA, 21 nt, Artificial Sequence
  Description of Artificial Sequence: Synthetic oligonucleotide
aaguauugugaaaguauucua

SEQ ID NO: 16092 - RNA, 21 nt, Artificial Sequence
  Description of Artificial Sequence: Synthetic oligonucleotide
aguauugugaaaguauucuaa

SEQ ID NO: 16093 - RNA, 21 nt, Artificial Sequence
  Description of Artificial Sequence: Synthetic oligonucleotide
guauugugaaaguauucuaag

SEQ ID NO: 16094 - RNA, 21 nt, Artificial Sequence
  Description of Artificial Sequence: Synthetic oligonucleotide
uauugugaaaguauucuaagc

SEQ ID NO: 16095 - RNA, 21 nt, Artificial Sequence
  Description of Artificial Sequence: Synthetic oligonucleotide
auugugaaaguauucuaagcc

SEQ ID NO: 16096 - RNA, 21 nt, Artificial Sequence
  Description of Artificial Sequence: Synthetic oligonucleotide
uugugaaaguauucuaagcca

SEQ ID NO: 16097 - RNA, 21 nt, Artificial Sequence
  Description of Artificial Sequence: Synthetic oligonucleotide
ugugaaaguauucuaagccaa

SEQ ID NO: 16098 - RNA, 21 nt, Artificial Sequence
  Description of Artificial Sequence: Synthetic oligonucleotide
gugaaaguauucuaagccaag

SEQ ID NO: 16099 - RNA, 21 nt, Artificial Sequence
  Description of Artificial Sequence: Synthetic oligonucleotide
ugaaaguauucuaagccaagu

SEQ ID NO: 16100 - RNA, 21 nt, Artificial Sequence
  Description of Artificial Sequence: Synthetic oligonucleotide
gaaaguauucuaagccaaguu

SEQ ID NO: 16101 - RNA, 21 nt, Artificial Sequence
  Description of Artificial Sequence: Synthetic oligonucleotide
aaaguauucuaagccaaguuu

SEQ ID NO: 16102 - RNA, 21 nt, Artificial Sequence
  Description of Artificial Sequence: Synthetic oligonucleotide
aaguauucuaagccaaguuuu

SEQ ID NO: 16103 - RNA, 21 nt, Artificial Sequence
  Description of Artificial Sequence: Synthetic oligonucleotide
aguauucuaagccaaguuuua

SEQ ID NO: 16104 - RNA, 21 nt, Artificial Sequence
  Description of Artificial Sequence: Synthetic oligonucleotide
guauucuaagccaaguuuuaa

SEQ ID NO: 16105 - RNA, 21 nt, Artificial Sequence
  Description of Artificial Sequence: Synthetic oligonucleotide
uauucuaagccaaguuuuaaa

SEQ ID NO: 16106 - RNA, 21 nt, Artificial Sequence
  Description of Artificial Sequence: Synthetic oligonucleotide
auucuaagccaaguuuuaaau

SEQ ID NO: 16107 - RNA, 21 nt, Artificial Sequence
  Description of Artificial Sequence: Synthetic oligonucleotide
uucuaagccaaguuuuaaaua

SEQ ID NO: 16108 - RNA, 21 nt, Artificial Sequence
  Description of Artificial Sequence: Synthetic oligonucleotide
ucuaagccaaguuuuaaauau

SEQ ID NO: 16109 - RNA, 21 nt, Artificial Sequence
  Description of Artificial Sequence: Synthetic oligonucleotide
cuaagccaaguuuuaaauauu

SEQ ID NO: 16110 - RNA, 21 nt, Artificial Sequence
  Description of Artificial Sequence: Synthetic oligonucleotide
uaagccaaguuuuaaauauua

SEQ ID NO: 16111 - RNA, 21 nt, Artificial Sequence
  Description of Artificial Sequence: Synthetic oligonucleotide
aagccaaguuuuaaauauuau

SEQ ID NO: 16112 - RNA, 21 nt, Artificial Sequence
  Description of Artificial Sequence: Synthetic oligonucleotide
agccaaguuuuaaauauuauc

SEQ ID NO: 16113 - RNA, 21 nt, Artificial Sequence
  Description of Artificial Sequence: Synthetic oligonucleotide
gccaaguuuuaaauauuaucu

SEQ ID NO: 16114 - RNA, 21 nt, Artificial Sequence
  Description of Artificial Sequence: Synthetic oligonucleotide
ccaaguuuuaaauauuaucua

SEQ ID NO: 16115 - RNA, 21 nt, Artificial Sequence
  Description of Artificial Sequence: Synthetic oligonucleotide
caaguuuuaaauauuaucuaa

SEQ ID NO: 16116 - RNA, 21 nt, Artificial Sequence
  Description of Artificial Sequence: Synthetic oligonucleotide
aaguuuuaaauauuaucuaac

SEQ ID NO: 16117 - RNA, 21 nt, Artificial Sequence
  Description of Artificial Sequence: Synthetic oligonucleotide
aguuuuaaauauuaucuaaca

SEQ ID NO: 16118 - RNA, 21 nt, Artificial Sequence
  Description of Artificial Sequence: Synthetic oligonucleotide
guuuuaaauauuaucuaacag

SEQ ID NO: 16119 - RNA, 21 nt, Artificial Sequence
  Description of Artificial Sequence: Synthetic oligonucleotide
uuuuaaauauuaucuaacaga

SEQ ID NO: 16120 - RNA, 21 nt, Artificial Sequence
  Description of Artificial Sequence: Synthetic oligonucleotide
uuuaaauauuaucuaacagac

SEQ ID NO: 16121 - RNA, 21 nt, Artificial Sequence
  Description of Artificial Sequence: Synthetic oligonucleotide
uuaaauauuaucuaacagaca

SEQ ID NO: 16122 - RNA, 21 nt, Artificial Sequence
  Description of Artificial Sequence: Synthetic oligonucleotide
uaaauauuaucuaacagacaa

SEQ ID NO: 16123 - RNA, 21 nt, Artificial Sequence
  Description of Artificial Sequence: Synthetic oligonucleotide
aaauauuaucuaacagacaag

SEQ ID NO: 16124 - RNA, 21 nt, Artificial Sequence
  Description of Artificial Sequence: Synthetic oligonucleotide
aauauuaucuaacagacaaga

SEQ ID NO: 16125 - RNA, 21 nt, Artificial Sequence
  Description of Artificial Sequence: Synthetic oligonucleotide
auauuaucuaacagacaagag

SEQ ID NO: 16126 - RNA, 21 nt, Artificial Sequence
  Description of Artificial Sequence: Synthetic oligonucleotide
uauuaucuaacagacaagagu

SEQ ID NO: 16127 - RNA, 21 nt, Artificial Sequence
  Description of Artificial Sequence: Synthetic oligonucleotide
auuaucuaacagacaagagug

SEQ ID NO: 16128 - RNA, 21 nt, Artificial Sequence
  Description of Artificial Sequence: Synthetic oligonucleotide
uuaucuaacagacaagagugg

SEQ ID NO: 16129 - RNA, 21 nt, Artificial Sequence
  Description of Artificial Sequence: Synthetic oligonucleotide
uaucuaacagacaagaguggu

SEQ ID NO: 16130 - RNA, 21 nt, Artificial Sequence
  Description of Artificial Sequence: Synthetic oligonucleotide
aucuaacagacaagaguggua

SEQ ID NO: 16131 - RNA, 21 nt, Artificial Sequence
  Description of Artificial Sequence: Synthetic oligonucleotide
ucuaacagacaagagugguau

SEQ ID NO: 16132 - RNA, 21 nt, Artificial Sequence
  Description of Artificial Sequence: Synthetic oligonucleotide
cuaacagacaagagugguaua

SEQ ID NO: 16133 - RNA, 21 nt, Artificial Sequence
  Description of Artificial Sequence: Synthetic oligonucleotide
uaacagacaagagugguauau

SEQ ID NO: 16134 - RNA, 21 nt, Artificial Sequence
  Description of Artificial Sequence: Synthetic oligonucleotide
aacagacaagagugguauaua

SEQ ID NO: 16135 - RNA, 21 nt, Artificial Sequence
  Description of Artificial Sequence: Synthetic oligonucleotide
acagacaagagugguauauac

SEQ ID NO: 16136 - RNA, 21 nt, Artificial Sequence
  Description of Artificial Sequence: Synthetic oligonucleotide
cagacaagagugguauauaca

SEQ ID NO: 16137 - RNA, 21 nt, Artificial Sequence
  Description of Artificial Sequence: Synthetic oligonucleotide
agacaagagugguauauacaa

SEQ ID NO: 16138 - RNA, 21 nt, Artificial Sequence
  Description of Artificial Sequence: Synthetic oligonucleotide
gacaagagugguauauacaag

SEQ ID NO: 16139 - RNA, 21 nt, Artificial Sequence
  Description of Artificial Sequence: Synthetic oligonucleotide
acaagagugguauauacaagu

SEQ ID NO: 16140 - RNA, 21 nt, Artificial Sequence
  Description of Artificial Sequence: Synthetic oligonucleotide
caagagugguauauacaagua

SEQ ID NO: 16141 - RNA, 21 nt, Artificial Sequence
  Description of Artificial Sequence: Synthetic oligonucleotide
aagagugguauauacaaguag

SEQ ID NO: 16142 - RNA, 21 nt, Artificial Sequence
  Description of Artificial Sequence: Synthetic oligonucleotide
agagugguauauacaaguaga

SEQ ID NO: 16143 - RNA, 21 nt, Artificial Sequence
  Description of Artificial Sequence: Synthetic oligonucleotide
gagugguauauacaaguagau

SEQ ID NO: 16144 - RNA, 21 nt, Artificial Sequence
  Description of Artificial Sequence: Synthetic oligonucleotide
agugguauauacaaguagauc

SEQ ID NO: 16145 - RNA, 21 nt, Artificial Sequence
  Description of Artificial Sequence: Synthetic oligonucleotide
gugguauauacaaguagaucc

SEQ ID NO: 16146 - RNA, 21 nt, Artificial Sequence
  Description of Artificial Sequence: Synthetic oligonucleotide
ugguauauacaaguagauccu

SEQ ID NO: 16147 - RNA, 21 nt, Artificial Sequence
  Description of Artificial Sequence: Synthetic oligonucleotide
gguauauacaaguagauccug

SEQ ID NO: 16148 - RNA, 21 nt, Artificial Sequence
  Description of Artificial Sequence: Synthetic oligonucleotide
guauauacaaguagauccuga

SEQ ID NO: 16149 - RNA, 21 nt, Artificial Sequence
  Description of Artificial Sequence: Synthetic oligonucleotide
uauauacaaguagauccugag

SEQ ID NO: 16150 - RNA, 21 nt, Artificial Sequence
  Description of Artificial Sequence: Synthetic oligonucleotide
auauacaaguagauccugaga

SEQ ID NO: 16151 - RNA, 21 nt, Artificial Sequence
  Description of Artificial Sequence: Synthetic oligonucleotide
uauacaaguagauccugagaa

SEQ ID NO: 16152 - RNA, 21 nt, Artificial Sequence
  Description of Artificial Sequence: Synthetic oligonucleotide
auacaaguagauccugagaag

SEQ ID NO: 16153 - RNA, 21 nt, Artificial Sequence
  Description of Artificial Sequence: Synthetic oligonucleotide
uacaaguagauccugagaagu

SEQ ID NO: 16154 - RNA, 21 nt, Artificial Sequence
  Description of Artificial Sequence: Synthetic oligonucleotide
acaaguagauccugagaagua

SEQ ID NO: 16155 - RNA, 21 nt, Artificial Sequence
  Description of Artificial Sequence: Synthetic oligonucleotide
caaguagauccugagaaguac

SEQ ID NO: 16156 - RNA, 21 nt, Artificial Sequence
  Description of Artificial Sequence: Synthetic oligonucleotide
aaguagauccugagaaguacc

SEQ ID NO: 16157 - RNA, 21 nt, Artificial Sequence
  Description of Artificial Sequence: Synthetic oligonucleotide
aguagauccugagaaguaccu

SEQ ID NO: 16158 - RNA, 21 nt, Artificial Sequence
  Description of Artificial Sequence: Synthetic oligonucleotide
guagauccugagaaguaccuu

SEQ ID NO: 16159 - RNA, 21 nt, Artificial Sequence
  Description of Artificial Sequence: Synthetic oligonucleotide
uagauccugagaaguaccuuu

SEQ ID NO: 16160 - RNA, 21 nt, Artificial Sequence
  Description of Artificial Sequence: Synthetic oligonucleotide
agauccugagaaguaccuuug

SEQ ID NO: 16161 - RNA, 21 nt, Artificial Sequence
  Description of Artificial Sequence: Synthetic oligonucleotide
gauccugagaaguaccuuugu

SEQ ID NO: 16162 - RNA, 21 nt, Artificial Sequence
  Description of Artificial Sequence: Synthetic oligonucleotide
auccugagaaguaccuuuguu

SEQ ID NO: 16163 - RNA, 21 nt, Artificial Sequence
  Description of Artificial Sequence: Synthetic oligonucleotide
uccugagaaguaccuuuguua

SEQ ID NO: 16164 - RNA, 21 nt, Artificial Sequence
  Description of Artificial Sequence: Synthetic oligonucleotide
ccugagaaguaccuuuguuac

SEQ ID NO: 16165 - RNA, 21 nt, Artificial Sequence
  Description of Artificial Sequence: Synthetic oligonucleotide
cugagaaguaccuuuguuaca

SEQ ID NO: 16166 - RNA, 21 nt, Artificial Sequence
  Description of Artificial Sequence: Synthetic oligonucleotide
ugagaaguaccuuuguuacag

SEQ ID NO: 16167 - RNA, 21 nt, Artificial Sequence
  Description of Artificial Sequence: Synthetic oligonucleotide
gagaaguaccuuuguuacagc

SEQ ID NO: 16168 - RNA, 21 nt, Artificial Sequence
  Description of Artificial Sequence: Synthetic oligonucleotide
agaaguaccuuuguuacagcu

SEQ ID NO: 16169 - RNA, 21 nt, Artificial Sequence
  Description of Artificial Sequence: Synthetic oligonucleotide
gaaguaccuuuguuacagcua

SEQ ID NO: 16170 - RNA, 21 nt, Artificial Sequence
  Description of Artificial Sequence: Synthetic oligonucleotide
aaguaccuuuguuacagcuac

SEQ ID NO: 16171 - RNA, 21 nt, Artificial Sequence
  Description of Artificial Sequence: Synthetic oligonucleotide
aguaccuuuguuacagcuacu

SEQ ID NO: 16172 - RNA, 21 nt, Artificial Sequence
  Description of Artificial Sequence: Synthetic oligonucleotide
guaccuuuguuacagcuacua

SEQ ID NO: 16173 - RNA, 21 nt, Artificial Sequence
  Description of Artificial Sequence: Synthetic oligonucleotide
uaccuuuguuacagcuacuau

SEQ ID NO: 16174 - RNA, 21 nt, Artificial Sequence
  Description of Artificial Sequence: Synthetic oligonucleotide
accuuuguuacagcuacuaua

SEQ ID NO: 16175 - RNA, 21 nt, Artificial Sequence
  Description of Artificial Sequence: Synthetic oligonucleotide
ccuuuguuacagcuacuauaa

SEQ ID NO: 16176 - RNA, 21 nt, Artificial Sequence
  Description of Artificial Sequence: Synthetic oligonucleotide
cuuuguuacagcuacuauaaa

SEQ ID NO: 16177 - RNA, 21 nt, Artificial Sequence
  Description of Artificial Sequence: Synthetic oligonucleotide
uuuguuacagcuacuauaaau

SEQ ID NO: 16178 - RNA, 21 nt, Artificial Sequence
  Description of Artificial Sequence: Synthetic oligonucleotide
uuguuacagcuacuauaaaua

SEQ ID NO: 16179 - RNA, 21 nt, Artificial Sequence
  Description of Artificial Sequence: Synthetic oligonucleotide
uguuacagcuacuauaaauau

SEQ ID NO: 16180 - RNA, 21 nt, Artificial Sequence
  Description of Artificial Sequence: Synthetic oligonucleotide
guuacagcuacuauaaauaua

SEQ ID NO: 16181 - RNA, 21 nt, Artificial Sequence
  Description of Artificial Sequence: Synthetic oligonucleotide
uuacagcuacuauaaauauac

SEQ ID NO: 16182 - RNA, 21 nt, Artificial Sequence
  Description of Artificial Sequence: Synthetic oligonucleotide
uacagcuacuauaaauauaca

SEQ ID NO: 16183 - RNA, 21 nt, Artificial Sequence
  Description of Artificial Sequence: Synthetic oligonucleotide
acagcuacuauaaauauacau

SEQ ID NO: 16184 - RNA, 21 nt, Artificial Sequence
  Description of Artificial Sequence: Synthetic oligonucleotide
cagcuacuauaaauauacaua

SEQ ID NO: 16185 - RNA, 21 nt, Artificial Sequence
  Description of Artificial Sequence: Synthetic oligonucleotide
agcuacuauaaauauacauau

SEQ ID NO: 16186 - RNA, 21 nt, Artificial Sequence
  Description of Artificial Sequence: Synthetic oligonucleotide
gcuacuauaaauauacauaua

SEQ ID NO: 16187 - RNA, 21 nt, Artificial Sequence
  Description of Artificial Sequence: Synthetic oligonucleotide
cuacuauaaauauacauauaa

SEQ ID NO: 16188 - RNA, 21 nt, Artificial Sequence
  Description of Artificial Sequence: Synthetic oligonucleotide
uacuauaaauauacauauaaa

SEQ ID NO: 16189 - RNA, 21 nt, Artificial Sequence
  Description of Artificial Sequence: Synthetic oligonucleotide
acuauaaauauacauauaaau

SEQ ID NO: 16190 - RNA, 21 nt, Artificial Sequence
  Description of Artificial Sequence: Synthetic oligonucleotide
cuauaaauauacauauaaauu

SEQ ID NO: 16191 - RNA, 21 nt, Artificial Sequence
  Description of Artificial Sequence: Synthetic oligonucleotide
uauaaauauacauauaaauua

SEQ ID NO: 16192 - RNA, 21 nt, Artificial Sequence
  Description of Artificial Sequence: Synthetic oligonucleotide
auaaauauacauauaaauuau

SEQ ID NO: 16193 - RNA, 21 nt, Artificial Sequence
  Description of Artificial Sequence: Synthetic oligonucleotide
uaaauauacauauaaauuaua

SEQ ID NO: 16194 - RNA, 21 nt, Artificial Sequence
  Description of Artificial Sequence: Synthetic oligonucleotide
aaauauacauauaaauuauag

SEQ ID NO: 16195 - RNA, 21 nt, Artificial Sequence
  Description of Artificial Sequence: Synthetic oligonucleotide
aauauacauauaaauuauaga

SEQ ID NO: 16196 - RNA, 21 nt, Artificial Sequence
  Description of Artificial Sequence: Synthetic oligonucleotide
auauacauauaaauuauagaa

SEQ ID NO: 16197 - RNA, 21 nt, Artificial Sequence
  Description of Artificial Sequence: Synthetic oligonucleotide
uauacauauaaauuauagaau

SEQ ID NO: 16198 - RNA, 21 nt, Artificial Sequence
  Description of Artificial Sequence: Synthetic oligonucleotide
auacauauaaauuauagaauc

SEQ ID NO: 16199 - RNA, 21 nt, Artificial Sequence
  Description of Artificial Sequence: Synthetic oligonucleotide
uacauauaaauuauagaaucu

SEQ ID NO: 16200 - RNA, 21 nt, Artificial Sequence
  Description of Artificial Sequence: Synthetic oligonucleotide
acauauaaauuauagaaucua

SEQ ID NO: 16201 - RNA, 21 nt, Artificial Sequence
  Description of Artificial Sequence: Synthetic oligonucleotide
cauauaaauuauagaaucuac

SEQ ID NO: 16202 - RNA, 21 nt, Artificial Sequence
  Description of Artificial Sequence: Synthetic oligonucleotide
auauaaauuauagaaucuacu

SEQ ID NO: 16203 - RNA, 21 nt, Artificial Sequence
  Description of Artificial Sequence: Synthetic oligonucleotide
uauaaauuauagaaucuacuu

SEQ ID NO: 16204 - RNA, 21 nt, Artificial Sequence
  Description of Artificial Sequence: Synthetic oligonucleotide
auaaauuauagaaucuacuuu

SEQ ID NO: 16205 - RNA, 21 nt, Artificial Sequence
  Description of Artificial Sequence: Synthetic oligonucleotide
uaaauuauagaaucuacuuua

SEQ ID NO: 16206 - RNA, 21 nt, Artificial Sequence
  Description of Artificial Sequence: Synthetic oligonucleotide
aaauuauagaaucuacuuuaa

SEQ ID NO: 16207 - RNA, 21 nt, Artificial Sequence
  Description of Artificial Sequence: Synthetic oligonucleotide
aauuauagaaucuacuuuaau

SEQ ID NO: 16208 - RNA, 21 nt, Artificial Sequence
  Description of Artificial Sequence: Synthetic oligonucleotide
auuauagaaucuacuuuaauu

SEQ ID NO: 16209 - RNA, 21 nt, Artificial Sequence
  Description of Artificial Sequence: Synthetic oligonucleotide
uuauagaaucuacuuuaauuu

SEQ ID NO: 16210 - RNA, 21 nt, Artificial Sequence
  Description of Artificial Sequence: Synthetic oligonucleotide
uauagaaucuacuuuaauuua

SEQ ID NO: 16211 - RNA, 21 nt, Artificial Sequence
  Description of Artificial Sequence: Synthetic oligonucleotide
auagaaucuacuuuaauuuau

SEQ ID NO: 16212 - RNA, 21 nt, Artificial Sequence
  Description of Artificial Sequence: Synthetic oligonucleotide
uagaaucuacuuuaauuuauu

SEQ ID NO: 16213 - RNA, 21 nt, Artificial Sequence
  Description of Artificial Sequence: Synthetic oligonucleotide
agaaucuacuuuaauuuauuu

SEQ ID NO: 16214 - RNA, 21 nt, Artificial Sequence
  Description of Artificial Sequence: Synthetic oligonucleotide
gaaucuacuuuaauuuauuuu

SEQ ID NO: 16215 - RNA, 21 nt, Artificial Sequence
  Description of Artificial Sequence: Synthetic oligonucleotide
aaucuacuuuaauuuauuuug

SEQ ID NO: 16216 - RNA, 21 nt, Artificial Sequence
  Description of Artificial Sequence: Synthetic oligonucleotide
aucuacuuuaauuuauuuugu

SEQ ID NO: 16217 - RNA, 21 nt, Artificial Sequence
  Description of Artificial Sequence: Synthetic oligonucleotide
ucuacuuuaauuuauuuugug

SEQ ID NO: 16218 - RNA, 21 nt, Artificial Sequence
  Description of Artificial Sequence: Synthetic oligonucleotide
cuacuuuaauuuauuuuguga

SEQ ID NO: 16219 - RNA, 21 nt, Artificial Sequence
  Description of Artificial Sequence: Synthetic oligonucleotide
uacuuuaauuuauuuugugaa

SEQ ID NO: 16220 - RNA, 21 nt, Artificial Sequence
  Description of Artificial Sequence: Synthetic oligonucleotide
acuuuaauuuauuuugugaac

SEQ ID NO: 16221 - RNA, 21 nt, Artificial Sequence
  Description of Artificial Sequence: Synthetic oligonucleotide
cuuuaauuuauuuugugaaca

SEQ ID NO: 16222 - RNA, 21 nt, Artificial Sequence
  Description of Artificial Sequence: Synthetic oligonucleotide
uuuaauuuauuuugugaacac

SEQ ID NO: 16223 - RNA, 21 nt, Artificial Sequence
  Description of Artificial Sequence: Synthetic oligonucleotide
uuaauuuauuuugugaacacu

SEQ ID NO: 16224 - RNA, 21 nt, Artificial Sequence
  Description of Artificial Sequence: Synthetic oligonucleotide
uaauuuauuuugugaacacuu

SEQ ID NO: 16225 - RNA, 21 nt, Artificial Sequence
  Description of Artificial Sequence: Synthetic oligonucleotide
aauuuauuuugugaacacuuu

SEQ ID NO: 16226 - RNA, 21 nt, Artificial Sequence
  Description of Artificial Sequence: Synthetic oligonucleotide
auuuauuuugugaacacuuuu

SEQ ID NO: 16227 - RNA, 21 nt, Artificial Sequence
  Description of Artificial Sequence: Synthetic oligonucleotide
uuuauuuugugaacacuuuug

SEQ ID NO: 16228 - RNA, 21 nt, Artificial Sequence
  Description of Artificial Sequence: Synthetic oligonucleotide
uuauuuugugaacacuuuuga

SEQ ID NO: 16229 - RNA, 21 nt, Artificial Sequence
  Description of Artificial Sequence: Synthetic oligonucleotide
uauuuugugaacacuuuugaa

SEQ ID NO: 16230 - RNA, 21 nt, Artificial Sequence
  Description of Artificial Sequence: Synthetic oligonucleotide
auuuugugaacacuuuugaaa

SEQ ID NO: 16231 - RNA, 21 nt, Artificial Sequence
  Description of Artificial Sequence: Synthetic oligonucleotide
uuuugugaacacuuuugaaaa

SEQ ID NO: 16232 - RNA, 21 nt, Artificial Sequence
  Description of Artificial Sequence: Synthetic oligonucleotide
uuugugaacacuuuugaaaau

SEQ ID NO: 16233 - RNA, 21 nt, Artificial Sequence
  Description of Artificial Sequence: Synthetic oligonucleotide
uugugaacacuuuugaaaaug

SEQ ID NO: 16234 - RNA, 21 nt, Artificial Sequence
  Description of Artificial Sequence: Synthetic oligonucleotide
ugugaacacuuuugaaaaugu

SEQ ID NO: 16235 - RNA, 21 nt, Artificial Sequence
  Description of Artificial Sequence: Synthetic oligonucleotide
gugaacacuuuugaaaaugua

SEQ ID NO: 16236 - RNA, 21 nt, Artificial Sequence
  Description of Artificial Sequence: Synthetic oligonucleotide
ugaacacuuuugaaaauguac

SEQ ID NO: 16237 - RNA, 21 nt, Artificial Sequence
  Description of Artificial Sequence: Synthetic oligonucleotide
gaacacuuuugaaaauguaca

SEQ ID NO: 16238 - RNA, 21 nt, Artificial Sequence
  Description of Artificial Sequence: Synthetic oligonucleotide
aacacuuuugaaaauguacau

SEQ ID NO: 16239 - RNA, 21 nt, Artificial Sequence
  Description of Artificial Sequence: Synthetic oligonucleotide
acacuuuugaaaauguacaug

SEQ ID NO: 16240 - RNA, 21 nt, Artificial Sequence
  Description of Artificial Sequence: Synthetic oligonucleotide
cacuuuugaaaauguacaugu

SEQ ID NO: 16241 - RNA, 21 nt, Artificial Sequence
  Description of Artificial Sequence: Synthetic oligonucleotide
acuuuugaaaauguacauguu

SEQ ID NO: 16242 - RNA, 21 nt, Artificial Sequence
  Description of Artificial Sequence: Synthetic oligonucleotide
cuuuugaaaauguacauguuc

SEQ ID NO: 16243 - RNA, 21 nt, Artificial Sequence
  Description of Artificial Sequence: Synthetic oligonucleotide
uuuugaaaauguacauguucc

SEQ ID NO: 16244 - RNA, 21 nt, Artificial Sequence
  Description of Artificial Sequence: Synthetic oligonucleotide
uuugaaaauguacauguuccu

SEQ ID NO: 16245 - RNA, 21 nt, Artificial Sequence
  Description of Artificial Sequence: Synthetic oligonucleotide
uugaaaauguacauguuccuu

SEQ ID NO: 16246 - RNA, 21 nt, Artificial Sequence
  Description of Artificial Sequence: Synthetic oligonucleotide
ugaaaauguacauguuccuuu

SEQ ID NO: 16247 - RNA, 21 nt, Artificial Sequence
  Description of Artificial Sequence: Synthetic oligonucleotide
gaaaauguacauguuccuuug

SEQ ID NO: 16248 - RNA, 21 nt, Artificial Sequence
  Description of Artificial Sequence: Synthetic oligonucleotide
aaaauguacauguuccuuugu

SEQ ID NO: 16249 - RNA, 21 nt, Artificial Sequence
  Description of Artificial Sequence: Synthetic oligonucleotide
aaauguacauguuccuuugua

SEQ ID NO: 16250 - RNA, 21 nt, Artificial Sequence
  Description of Artificial Sequence: Synthetic oligonucleotide
aauguacauguuccuuuguaa

SEQ ID NO: 16251 - RNA, 21 nt, Artificial Sequence
  Description of Artificial Sequence: Synthetic oligonucleotide
auguacauguuccuuuguaau

SEQ ID NO: 16252 - RNA, 21 nt, Artificial Sequence
  Description of Artificial Sequence: Synthetic oligonucleotide
uguacauguuccuuuguaauu

SEQ ID NO: 16253 - RNA, 21 nt, Artificial Sequence
  Description of Artificial Sequence: Synthetic oligonucleotide
guacauguuccuuuguaauug

SEQ ID NO: 16254 - RNA, 21 nt, Artificial Sequence
  Description of Artificial Sequence: Synthetic oligonucleotide
uacauguuccuuuguaauuga

SEQ ID NO: 16255 - RNA, 21 nt, Artificial Sequence
  Description of Artificial Sequence: Synthetic oligonucleotide
acauguuccuuuguaauugac

SEQ ID NO: 16256 - RNA, 21 nt, Artificial Sequence
  Description of Artificial Sequence: Synthetic oligonucleotide
cauguuccuuuguaauugaca

SEQ ID NO: 16257 - RNA, 21 nt, Artificial Sequence
  Description of Artificial Sequence: Synthetic oligonucleotide
auguuccuuuguaauugacac

SEQ ID NO: 16258 - RNA, 21 nt, Artificial Sequence
  Description of Artificial Sequence: Synthetic oligonucleotide
uguuccuuuguaauugacacu

SEQ ID NO: 16259 - RNA, 21 nt, Artificial Sequence
  Description of Artificial Sequence: Synthetic oligonucleotide
guuccuuuguaauugacacua

SEQ ID NO: 16260 - RNA, 21 nt, Artificial Sequence
  Description of Artificial Sequence: Synthetic oligonucleotide
uuccuuuguaauugacacuau

SEQ ID NO: 16261 - RNA, 21 nt, Artificial Sequence
  Description of Artificial Sequence: Synthetic oligonucleotide
uccuuuguaauugacacuaua

SEQ ID NO: 16262 - RNA, 21 nt, Artificial Sequence
  Description of Artificial Sequence: Synthetic oligonucleotide
ccuuuguaauugacacuauau

SEQ ID NO: 16263 - RNA, 21 nt, Artificial Sequence
  Description of Artificial Sequence: Synthetic oligonucleotide
cuuuguaauugacacuauaua

SEQ ID NO: 16264 - RNA, 21 nt, Artificial Sequence
  Description of Artificial Sequence: Synthetic oligonucleotide
uuuguaauugacacuauauau

SEQ ID NO: 16265 - RNA, 21 nt, Artificial Sequence
  Description of Artificial Sequence: Synthetic oligonucleotide
uuguaauugacacuauauauu

SEQ ID NO: 16266 - RNA, 21 nt, Artificial Sequence
  Description of Artificial Sequence: Synthetic oligonucleotide
uguaauugacacuauauauuu

SEQ ID NO: 16267 - RNA, 21 nt, Artificial Sequence
  Description of Artificial Sequence: Synthetic oligonucleotide
guaauugacacuauauauuuc

SEQ ID NO: 16268 - RNA, 21 nt, Artificial Sequence
  Description of Artificial Sequence: Synthetic oligonucleotide
uaauugacacuauauauuucu

SEQ ID NO: 16269 - RNA, 21 nt, Artificial Sequence
  Description of Artificial Sequence: Synthetic oligonucleotide
aauugacacuauauauuucuu

SEQ ID NO: 16270 - RNA, 21 nt, Artificial Sequence
  Description of Artificial Sequence: Synthetic oligonucleotide
auugacacuauauauuucuua

SEQ ID NO: 16271 - RNA, 21 nt, Artificial Sequence
  Description of Artificial Sequence: Synthetic oligonucleotide
uugacacuauauauuucuuaa

SEQ ID NO: 16272 - RNA, 21 nt, Artificial Sequence
  Description of Artificial Sequence: Synthetic oligonucleotide
ugacacuauauauuucuuaau

SEQ ID NO: 16273 - RNA, 21 nt, Artificial Sequence
  Description of Artificial Sequence: Synthetic oligonucleotide
gacacuauauauuucuuaaua

SEQ ID NO: 16274 - RNA, 21 nt, Artificial Sequence
  Description of Artificial Sequence: Synthetic oligonucleotide
acacuauauauuucuuaauaa

SEQ ID NO: 16275 - RNA, 21 nt, Artificial Sequence
  Description of Artificial Sequence: Synthetic oligonucleotide
cacuauauauuucuuaauaaa

SEQ ID NO: 16276 - RNA, 21 nt, Artificial Sequence
  Description of Artificial Sequence: Synthetic oligonucleotide
acuauauauuucuuaauaaaa

SEQ ID NO: 16277 - RNA, 21 nt, Artificial Sequence
  Description of Artificial Sequence: Synthetic oligonucleotide
cuauauauuucuuaauaaaau

SEQ ID NO: 16278 - RNA, 21 nt, Artificial Sequence
  Description of Artificial Sequence: Synthetic oligonucleotide
uauauauuucuuaauaaaaua

SEQ ID NO: 16279 - RNA, 21 nt, Artificial Sequence
  Description of Artificial Sequence: Synthetic oligonucleotide
auauauuucuuaauaaaauaa

SEQ ID NO: 16280 - RNA, 21 nt, Artificial Sequence
  Description of Artificial Sequence: Synthetic oligonucleotide
uauauuucuuaauaaaauaau

SEQ ID NO: 16281 - RNA, 21 nt, Artificial Sequence
  Description of Artificial Sequence: Synthetic oligonucleotide
auauuucuuaauaaaauaauu

SEQ ID NO: 16282 - RNA, 21 nt, Artificial Sequence
  Description of Artificial Sequence: Synthetic oligonucleotide
uauuucuuaauaaaauaauuc

SEQ ID NO: 16283 - RNA, 21 nt, Artificial Sequence
  Description of Artificial Sequence: Synthetic oligonucleotide
auuucuuaauaaaauaauucu

SEQ ID NO: 16284 - RNA, 21 nt, Artificial Sequence
  Description of Artificial Sequence: Synthetic oligonucleotide
uuucuuaauaaaauaauucuc

SEQ ID NO: 16285 - RNA, 21 nt, Artificial Sequence
  Description of Artificial Sequence: Synthetic oligonucleotide
uucuuaauaaaauaauucuca

SEQ ID NO: 16286 - RNA, 21 nt, Artificial Sequence
  Description of Artificial Sequence: Synthetic oligonucleotide
ucuuaauaaaauaauucucaa

SEQ ID NO: 16287 - RNA, 21 nt, Artificial Sequence
  Description of Artificial Sequence: Synthetic oligonucleotide
cuuaauaaaauaauucucaaa

SEQ ID NO: 16288 - RNA, 21 nt, Artificial Sequence
  Description of Artificial Sequence: Synthetic oligonucleotide
uuaauaaaauaauucucaaau

SEQ ID NO: 16289 - RNA, 21 nt, Artificial Sequence
  Description of Artificial Sequence: Synthetic oligonucleotide
uaauaaaauaauucucaaauu

SEQ ID NO: 16290 - RNA, 21 nt, Artificial Sequence
  Description of Artificial Sequence: Synthetic oligonucleotide
aauaaaauaauucucaaauuu

SEQ ID NO: 16291 - RNA, 21 nt, Artificial Sequence
  Description of Artificial Sequence: Synthetic oligonucleotide
auaaaauaauucucaaauuug

SEQ ID NO: 16292 - RNA, 21 nt, Artificial Sequence
  Description of Artificial Sequence: Synthetic oligonucleotide
uaaaauaauucucaaauuugu

SEQ ID NO: 16293 - RNA, 21 nt, Artificial Sequence
  Description of Artificial Sequence: Synthetic oligonucleotide
aaaauaauucucaaauuuguu

SEQ ID NO: 16294 - RNA, 21 nt, Artificial Sequence
  Description of Artificial Sequence: Synthetic oligonucleotide
aaauaauucucaaauuuguuu

SEQ ID NO: 16295 - RNA, 21 nt, Artificial Sequence
  Description of Artificial Sequence: Synthetic oligonucleotide
aauaauucucaaauuuguuuc

SEQ ID NO: 16296 - RNA, 21 nt, Artificial Sequence
  Description of Artificial Sequence: Synthetic oligonucleotide
auaauucucaaauuuguuucu

SEQ ID NO: 16297 - RNA, 21 nt, Artificial Sequence
  Description of Artificial Sequence: Synthetic oligonucleotide
uaauucucaaauuuguuucuu

SEQ ID NO: 16298 - RNA, 21 nt, Artificial Sequence
  Description of Artificial Sequence: Synthetic oligonucleotide
aauucucaaauuuguuucuua

SEQ ID NO: 16299 - RNA, 21 nt, Artificial Sequence
  Description of Artificial Sequence: Synthetic oligonucleotide
auucucaaauuuguuucuuau

SEQ ID NO: 16300 - RNA, 21 nt, Artificial Sequence
  Description of Artificial Sequence: Synthetic oligonucleotide
uucucaaauuuguuucuuaug

SEQ ID NO: 16301 - RNA, 21 nt, Artificial Sequence
  Description of Artificial Sequence: Synthetic oligonucleotide
ucucaaauuuguuucuuauga

SEQ ID NO: 16302 - RNA, 21 nt, Artificial Sequence
  Description of Artificial Sequence: Synthetic oligonucleotide
cucaaauuuguuucuuaugaa

SEQ ID NO: 16303 - RNA, 21 nt, Artificial Sequence
  Description of Artificial Sequence: Synthetic oligonucleotide
ucaaauuuguuucuuaugaau

SEQ ID NO: 16304 - RNA, 21 nt, Artificial Sequence
  Description of Artificial Sequence: Synthetic oligonucleotide
caaauuuguuucuuaugaauc

SEQ ID NO: 16305 - RNA, 21 nt, Artificial Sequence
  Description of Artificial Sequence: Synthetic oligonucleotide
aaauuuguuucuuaugaauca

SEQ ID NO: 16306 - RNA, 21 nt, Artificial Sequence
  Description of Artificial Sequence: Synthetic oligonucleotide
aauuuguuucuuaugaaucau

SEQ ID NO: 16307 - RNA, 21 nt, Artificial Sequence
  Description of Artificial Sequence: Synthetic oligonucleotide
auuuguuucuuaugaaucauc

SEQ ID NO: 16308 - RNA, 21 nt, Artificial Sequence
  Description of Artificial Sequence: Synthetic oligonucleotide
uuuguuucuuaugaaucaucu

SEQ ID NO: 16309 - RNA, 21 nt, Artificial Sequence
  Description of Artificial Sequence: Synthetic oligonucleotide
uuguuucuuaugaaucaucuc

SEQ ID NO: 16310 - RNA, 21 nt, Artificial Sequence
  Description of Artificial Sequence: Synthetic oligonucleotide
uguuucuuaugaaucaucucu

SEQ ID NO: 16311 - RNA, 21 nt, Artificial Sequence
  Description of Artificial Sequence: Synthetic oligonucleotide
guuucuuaugaaucaucucuc

SEQ ID NO: 16312 - RNA, 21 nt, Artificial Sequence
  Description of Artificial Sequence: Synthetic oligonucleotide
uuucuuaugaaucaucucuca

SEQ ID NO: 16313 - RNA, 21 nt, Artificial Sequence
  Description of Artificial Sequence: Synthetic oligonucleotide
uucuuaugaaucaucucucaa

SEQ ID NO: 16314 - RNA, 21 nt, Artificial Sequence
  Description of Artificial Sequence: Synthetic oligonucleotide
ucuuaugaaucaucucucaaa

SEQ ID NO: 16315 - RNA, 21 nt, Artificial Sequence
  Description of Artificial Sequence: Synthetic oligonucleotide
cuuaugaaucaucucucaaau

SEQ ID NO: 16316 - RNA, 21 nt, Artificial Sequence
  Description of Artificial Sequence: Synthetic oligonucleotide
uuaugaaucaucucucaaauc

SEQ ID NO: 16317 - RNA, 21 nt, Artificial Sequence
  Description of Artificial Sequence: Synthetic oligonucleotide
uaugaaucaucucucaaaucu

SEQ ID NO: 16318 - RNA, 21 nt, Artificial Sequence
  Description of Artificial Sequence: Synthetic oligonucleotide
augaaucaucucucaaaucua

SEQ ID NO: 16319 - RNA, 21 nt, Artificial Sequence
  Description of Artificial Sequence: Synthetic oligonucleotide
ugaaucaucucucaaaucuag

SEQ ID NO: 16320 - RNA, 21 nt, Artificial Sequence
  Description of Artificial Sequence: Synthetic oligonucleotide
gaaucaucucucaaaucuagu

SEQ ID NO: 16321 - RNA, 21 nt, Artificial Sequence
  Description of Artificial Sequence: Synthetic oligonucleotide
aaucaucucucaaaucuaguu

SEQ ID NO: 16322 - RNA, 21 nt, Artificial Sequence
  Description of Artificial Sequence: Synthetic oligonucleotide
aucaucucucaaaucuaguua

SEQ ID NO: 16323 - RNA, 21 nt, Artificial Sequence
  Description of Artificial Sequence: Synthetic oligonucleotide
ucaucucucaaaucuaguuag

SEQ ID NO: 16324 - RNA, 21 nt, Artificial Sequence
  Description of Artificial Sequence: Synthetic oligonucleotide
caucucucaaaucuaguuaga

SEQ ID NO: 16325 - RNA, 21 nt, Artificial Sequence
  Description of Artificial Sequence: Synthetic oligonucleotide
aucucucaaaucuaguuagac

SEQ ID NO: 16326 - RNA, 21 nt, Artificial Sequence
  Description of Artificial Sequence: Synthetic oligonucleotide
ucucucaaaucuaguuagaca

SEQ ID NO: 16327 - RNA, 21 nt, Artificial Sequence
  Description of Artificial Sequence: Synthetic oligonucleotide
cucucaaaucuaguuagacaa

SEQ ID NO: 16328 - RNA, 21 nt, Artificial Sequence
  Description of Artificial Sequence: Synthetic oligonucleotide
ucucaaaucuaguuagacaau

SEQ ID NO: 16329 - RNA, 21 nt, Artificial Sequence
  Description of Artificial Sequence: Synthetic oligonucleotide
cucaaaucuaguuagacaauu

SEQ ID NO: 16330 - RNA, 21 nt, Artificial Sequence
  Description of Artificial Sequence: Synthetic oligonucleotide
ucaaaucuaguuagacaauuu

SEQ ID NO: 16331 - RNA, 21 nt, Artificial Sequence
  Description of Artificial Sequence: Synthetic oligonucleotide
caaaucuaguuagacaauuug

SEQ ID NO: 16332 - RNA, 21 nt, Artificial Sequence
  Description of Artificial Sequence: Synthetic oligonucleotide
aaaucuaguuagacaauuugc

SEQ ID NO: 16333 - RNA, 21 nt, Artificial Sequence
  Description of Artificial Sequence: Synthetic oligonucleotide
aaucuaguuagacaauuugca

SEQ ID NO: 16334 - RNA, 21 nt, Artificial Sequence
  Description of Artificial Sequence: Synthetic oligonucleotide
aucuaguuagacaauuugcac

SEQ ID NO: 16335 - RNA, 21 nt, Artificial Sequence
  Description of Artificial Sequence: Synthetic oligonucleotide
ucuaguuagacaauuugcaca

SEQ ID NO: 16336 - RNA, 21 nt, Artificial Sequence
  Description of Artificial Sequence: Synthetic oligonucleotide
cuaguuagacaauuugcacac

SEQ ID NO: 16337 - RNA, 21 nt, Artificial Sequence
  Description of Artificial Sequence: Synthetic oligonucleotide
uaguuagacaauuugcacaca

SEQ ID NO: 16338 - RNA, 21 nt, Artificial Sequence
  Description of Artificial Sequence: Synthetic oligonucleotide
aguuagacaauuugcacacau

SEQ ID NO: 16339 - RNA, 21 nt, Artificial Sequence
  Description of Artificial Sequence: Synthetic oligonucleotide
guuagacaauuugcacacaua

SEQ ID NO: 16340 - RNA, 21 nt, Artificial Sequence
  Description of Artificial Sequence: Synthetic oligonucleotide
uuagacaauuugcacacauac

SEQ ID NO: 16341 - RNA, 21 nt, Artificial Sequence
  Description of Artificial Sequence: Synthetic oligonucleotide
uagacaauuugcacacauacu

SEQ ID NO: 16342 - RNA, 21 nt, Artificial Sequence
  Description of Artificial Sequence: Synthetic oligonucleotide
agacaauuugcacacauacuu

SEQ ID NO: 16343 - RNA, 21 nt, Artificial Sequence
  Description of Artificial Sequence: Synthetic oligonucleotide
gacaauuugcacacauacuuu

SEQ ID NO: 16344 - RNA, 21 nt, Artificial Sequence
  Description of Artificial Sequence: Synthetic oligonucleotide
acaauuugcacacauacuuuu

SEQ ID NO: 16345 - RNA, 21 nt, Artificial Sequence
  Description of Artificial Sequence: Synthetic oligonucleotide
caauuugcacacauacuuuuc

SEQ ID NO: 16346 - RNA, 21 nt, Artificial Sequence
  Description of Artificial Sequence: Synthetic oligonucleotide
aauuugcacacauacuuuucu

SEQ ID NO: 16347 - RNA, 21 nt, Artificial Sequence
  Description of Artificial Sequence: Synthetic oligonucleotide
auuugcacacauacuuuucua

SEQ ID NO: 16348 - RNA, 21 nt, Artificial Sequence
  Description of Artificial Sequence: Synthetic oligonucleotide
uuugcacacauacuuuucuaa

SEQ ID NO: 16349 - RNA, 21 nt, Artificial Sequence
  Description of Artificial Sequence: Synthetic oligonucleotide
uugcacacauacuuuucuaag

SEQ ID NO: 16350 - RNA, 21 nt, Artificial Sequence
  Description of Artificial Sequence: Synthetic oligonucleotide
ugcacacauacuuuucuaagg

SEQ ID NO: 16351 - RNA, 21 nt, Artificial Sequence
  Description of Artificial Sequence: Synthetic oligonucleotide
gcacacauacuuuucuaaggg

SEQ ID NO: 16352 - RNA, 21 nt, Artificial Sequence
  Description of Artificial Sequence: Synthetic oligonucleotide
cacacauacuuuucuaaggga

SEQ ID NO: 16353 - RNA, 21 nt, Artificial Sequence
  Description of Artificial Sequence: Synthetic oligonucleotide
acacauacuuuucuaagggac

SEQ ID NO: 16354 - RNA, 21 nt, Artificial Sequence
  Description of Artificial Sequence: Synthetic oligonucleotide
cacauacuuuucuaagggaca

SEQ ID NO: 16355 - RNA, 21 nt, Artificial Sequence
  Description of Artificial Sequence: Synthetic oligonucleotide
acauacuuuucuaagggacau

SEQ ID NO: 16356 - RNA, 21 nt, Artificial Sequence
  Description of Artificial Sequence: Synthetic oligonucleotide
cauacuuuucuaagggacauu

SEQ ID NO: 16357 - RNA, 21 nt, Artificial Sequence
  Description of Artificial Sequence: Synthetic oligonucleotide
auacuuuucuaagggacauua

SEQ ID NO: 16358 - RNA, 21 nt, Artificial Sequence
  Description of Artificial Sequence: Synthetic oligonucleotide
uacuuuucuaagggacauuau

SEQ ID NO: 16359 - RNA, 21 nt, Artificial Sequence
  Description of Artificial Sequence: Synthetic oligonucleotide
acuuuucuaagggacauuauc

SEQ ID NO: 16360 - RNA, 21 nt, Artificial Sequence
  Description of Artificial Sequence: Synthetic oligonucleotide
cuuuucuaagggacauuaucu

SEQ ID NO: 16361 - RNA, 21 nt, Artificial Sequence
  Description of Artificial Sequence: Synthetic oligonucleotide
uuuucuaagggacauuaucuu

SEQ ID NO: 16362 - RNA, 21 nt, Artificial Sequence
  Description of Artificial Sequence: Synthetic oligonucleotide
uuucuaagggacauuaucuuc

SEQ ID NO: 16363 - RNA, 21 nt, Artificial Sequence
  Description of Artificial Sequence: Synthetic oligonucleotide
uucuaagggacauuaucuucc

SEQ ID NO: 16364 - RNA, 21 nt, Artificial Sequence
  Description of Artificial Sequence: Synthetic oligonucleotide
ucuaagggacauuaucuuccu

SEQ ID NO: 16365 - RNA, 21 nt, Artificial Sequence
  Description of Artificial Sequence: Synthetic oligonucleotide
cuaagggacauuaucuuccuu

SEQ ID NO: 16366 - RNA, 21 nt, Artificial Sequence
  Description of Artificial Sequence: Synthetic oligonucleotide
uaagggacauuaucuuccuuc

SEQ ID NO: 16367 - RNA, 21 nt, Artificial Sequence
  Description of Artificial Sequence: Synthetic oligonucleotide
aagggacauuaucuuccuuca

SEQ ID NO: 16368 - RNA, 21 nt, Artificial Sequence
  Description of Artificial Sequence: Synthetic oligonucleotide
agggacauuaucuuccuucag

SEQ ID NO: 16369 - RNA, 21 nt, Artificial Sequence
  Description of Artificial Sequence: Synthetic oligonucleotide
gggacauuaucuuccuucagg

SEQ ID NO: 16370 - RNA, 21 nt, Artificial Sequence
  Description of Artificial Sequence: Synthetic oligonucleotide
ggacauuaucuuccuucaggu

SEQ ID NO: 16371 - RNA, 21 nt, Artificial Sequence
  Description of Artificial Sequence: Synthetic oligonucleotide
gacauuaucuuccuucagguu

SEQ ID NO: 16372 - RNA, 21 nt, Artificial Sequence
  Description of Artificial Sequence: Synthetic oligonucleotide
acauuaucuuccuucagguuu

SEQ ID NO: 16373 - RNA, 21 nt, Artificial Sequence
  Description of Artificial Sequence: Synthetic oligonucleotide
cauuaucuuccuucagguuuu

SEQ ID NO: 16374 - RNA, 21 nt, Artificial Sequence
  Description of Artificial Sequence: Synthetic oligonucleotide
auuaucuuccuucagguuuuu

SEQ ID NO: 16375 - RNA, 21 nt, Artificial Sequence
  Description of Artificial Sequence: Synthetic oligonucleotide
uuaucuuccuucagguuuuua

SEQ ID NO: 16376 - RNA, 21 nt, Artificial Sequence
  Description of Artificial Sequence: Synthetic oligonucleotide
uaucuuccuucagguuuuuac

SEQ ID NO: 16377 - RNA, 21 nt, Artificial Sequence
  Description of Artificial Sequence: Synthetic oligonucleotide
aucuuccuucagguuuuuacc

SEQ ID NO: 16378 - RNA, 21 nt, Artificial Sequence
  Description of Artificial Sequence: Synthetic oligonucleotide
ucuuccuucagguuuuuaccu

SEQ ID NO: 16379 - RNA, 21 nt, Artificial Sequence
  Description of Artificial Sequence: Synthetic oligonucleotide
cuuccuucagguuuuuaccuc

SEQ ID NO: 16380 - RNA, 21 nt, Artificial Sequence
  Description of Artificial Sequence: Synthetic oligonucleotide
uuccuucagguuuuuaccucc

SEQ ID NO: 16381 - RNA, 21 nt, Artificial Sequence
  Description of Artificial Sequence: Synthetic oligonucleotide
uccuucagguuuuuaccucca

SEQ ID NO: 16382 - RNA, 21 nt, Artificial Sequence
  Description of Artificial Sequence: Synthetic oligonucleotide
ccuucagguuuuuaccuccac

SEQ ID NO: 16383 - RNA, 21 nt, Artificial Sequence
  Description of Artificial Sequence: Synthetic oligonucleotide
cuucagguuuuuaccuccacu

SEQ ID NO: 16384 - RNA, 21 nt, Artificial Sequence
  Description of Artificial Sequence: Synthetic oligonucleotide
uucagguuuuuaccuccacuc

SEQ ID NO: 16385 - RNA, 21 nt, Artificial Sequence
  Description of Artificial Sequence: Synthetic oligonucleotide
ucagguuuuuaccuccacuca

SEQ ID NO: 16386 - RNA, 21 nt, Artificial Sequence
  Description of Artificial Sequence: Synthetic oligonucleotide
cagguuuuuaccuccacucau

SEQ ID NO: 16387 - RNA, 21 nt, Artificial Sequence
  Description of Artificial Sequence: Synthetic oligonucleotide
agguuuuuaccuccacucauc

SEQ ID NO: 16388 - RNA, 21 nt, Artificial Sequence
  Description of Artificial Sequence: Synthetic oligonucleotide
gguuuuuaccuccacucaucc

SEQ ID NO: 16389 - RNA, 21 nt, Artificial Sequence
  Description of Artificial Sequence: Synthetic oligonucleotide
guuuuuaccuccacucauccu

SEQ ID NO: 16390 - RNA, 21 nt, Artificial Sequence
  Description of Artificial Sequence: Synthetic oligonucleotide
uuuuuaccuccacucauccuu

SEQ ID NO: 16391 - RNA, 21 nt, Artificial Sequence
  Description of Artificial Sequence: Synthetic oligonucleotide
uuuuaccuccacucauccuua

SEQ ID NO: 16392 - RNA, 21 nt, Artificial Sequence
  Description of Artificial Sequence: Synthetic oligonucleotide
uuuaccuccacucauccuuag

SEQ ID NO: 16393 - RNA, 21 nt, Artificial Sequence
  Description of Artificial Sequence: Synthetic oligonucleotide
uuaccuccacucauccuuaga

SEQ ID NO: 16394 - RNA, 21 nt, Artificial Sequence
  Description of Artificial Sequence: Synthetic oligonucleotide
uaccuccacucauccuuagag

SEQ ID NO: 16395 - RNA, 21 nt, Artificial Sequence
  Description of Artificial Sequence: Synthetic oligonucleotide
accuccacucauccuuagagc

SEQ ID NO: 16396 - RNA, 21 nt, Artificial Sequence
  Description of Artificial Sequence: Synthetic oligonucleotide
ccuccacucauccuuagagcc

SEQ ID NO: 16397 - RNA, 21 nt, Artificial Sequence
  Description of Artificial Sequence: Synthetic oligonucleotide
cuccacucauccuuagagccc

SEQ ID NO: 16398 - RNA, 21 nt, Artificial Sequence
  Description of Artificial Sequence: Synthetic oligonucleotide
uccacucauccuuagagccca

SEQ ID NO: 16399 - RNA, 21 nt, Artificial Sequence
  Description of Artificial Sequence: Synthetic oligonucleotide
ccacucauccuuagagcccac

SEQ ID NO: 16400 - RNA, 21 nt, Artificial Sequence
  Description of Artificial Sequence: Synthetic oligonucleotide
cacucauccuuagagcccacu

SEQ ID NO: 16401 - RNA, 21 nt, Artificial Sequence
  Description of Artificial Sequence: Synthetic oligonucleotide
acucauccuuagagcccacug

SEQ ID NO: 16402 - RNA, 21 nt, Artificial Sequence
  Description of Artificial Sequence: Synthetic oligonucleotide
cucauccuuagagcccacuga

SEQ ID NO: 16403 - RNA, 21 nt, Artificial Sequence
  Description of Artificial Sequence: Synthetic oligonucleotide
ucauccuuagagcccacugac

SEQ ID NO: 16404 - RNA, 21 nt, Artificial Sequence
  Description of Artificial Sequence: Synthetic oligonucleotide
cauccuuagagcccacugacu

SEQ ID NO: 16405 - RNA, 21 nt, Artificial Sequence
  Description of Artificial Sequence: Synthetic oligonucleotide
auccuuagagcccacugacug

SEQ ID NO: 16406 - RNA, 21 nt, Artificial Sequence
  Description of Artificial Sequence: Synthetic oligonucleotide
uccuuagagcccacugacugc

SEQ ID NO: 16407 - RNA, 21 nt, Artificial Sequence
  Description of Artificial Sequence: Synthetic oligonucleotide
ccuuagagcccacugacugcu

SEQ ID NO: 16408 - RNA, 21 nt, Artificial Sequence
  Description of Artificial Sequence: Synthetic oligonucleotide
cuuagagcccacugacugcuc

SEQ ID NO: 16409 - RNA, 21 nt, Artificial Sequence
  Description of Artificial Sequence: Synthetic oligonucleotide
uuagagcccacugacugcucc

SEQ ID NO: 16410 - RNA, 21 nt, Artificial Sequence
  Description of Artificial Sequence: Synthetic oligonucleotide
uagagcccacugacugcuccc

SEQ ID NO: 16411 - RNA, 21 nt, Artificial Sequence
  Description of Artificial Sequence: Synthetic oligonucleotide
agagcccacugacugcucccc

SEQ ID NO: 16412 - RNA, 21 nt, Artificial Sequence
  Description of Artificial Sequence: Synthetic oligonucleotide
gagcccacugacugcuccccu

SEQ ID NO: 16413 - RNA, 21 nt, Artificial Sequence
  Description of Artificial Sequence: Synthetic oligonucleotide
agcccacugacugcuccccuu

SEQ ID NO: 16414 - RNA, 21 nt, Artificial Sequence
  Description of Artificial Sequence: Synthetic oligonucleotide
gcccacugacugcuccccuuu

SEQ ID NO: 16415 - RNA, 21 nt, Artificial Sequence
  Description of Artificial Sequence: Synthetic oligonucleotide
cccacugacugcuccccuuua

SEQ ID NO: 16416 - RNA, 21 nt, Artificial Sequence
  Description of Artificial Sequence: Synthetic oligonucleotide
ccacugacugcuccccuuuau

SEQ ID NO: 16417 - RNA, 21 nt, Artificial Sequence
  Description of Artificial Sequence: Synthetic oligonucleotide
cacugacugcuccccuuuaua

SEQ ID NO: 16418 - RNA, 21 nt, Artificial Sequence
  Description of Artificial Sequence: Synthetic oligonucleotide
acugacugcuccccuuuauac

SEQ ID NO: 16419 - RNA, 21 nt, Artificial Sequence
  Description of Artificial Sequence: Synthetic oligonucleotide
cugacugcuccccuuuauacc

SEQ ID NO: 16420 - RNA, 21 nt, Artificial Sequence
  Description of Artificial Sequence: Synthetic oligonucleotide
ugacugcuccccuuuauaccu

SEQ ID NO: 16421 - RNA, 21 nt, Artificial Sequence
  Description of Artificial Sequence: Synthetic oligonucleotide
gacugcuccccuuuauaccug

SEQ ID NO: 16422 - RNA, 21 nt, Artificial Sequence
  Description of Artificial Sequence: Synthetic oligonucleotide
acugcuccccuuuauaccugu

SEQ ID NO: 16423 - RNA, 21 nt, Artificial Sequence
  Description of Artificial Sequence: Synthetic oligonucleotide
cugcuccccuuuauaccuguu

SEQ ID NO: 16424 - RNA, 21 nt, Artificial Sequence
  Description of Artificial Sequence: Synthetic oligonucleotide
ugcuccccuuuauaccuguug

SEQ ID NO: 16425 - RNA, 21 nt, Artificial Sequence
  Description of Artificial Sequence: Synthetic oligonucleotide
gcuccccuuuauaccuguugg

SEQ ID NO: 16426 - RNA, 21 nt, Artificial Sequence
  Description of Artificial Sequence: Synthetic oligonucleotide
cuccccuuuauaccuguuggc

SEQ ID NO: 16427 - RNA, 21 nt, Artificial Sequence
  Description of Artificial Sequence: Synthetic oligonucleotide
uccccuuuauaccuguuggcc

SEQ ID NO: 16428 - RNA, 21 nt, Artificial Sequence
  Description of Artificial Sequence: Synthetic oligonucleotide
ccccuuuauaccuguuggccc

SEQ ID NO: 16429 - RNA, 21 nt, Artificial Sequence
  Description of Artificial Sequence: Synthetic oligonucleotide
cccuuuauaccuguuggcccu

SEQ ID NO: 16430 - RNA, 21 nt, Artificial Sequence
  Description of Artificial Sequence: Synthetic oligonucleotide
ccuuuauaccuguuggcccug

SEQ ID NO: 16431 - RNA, 21 nt, Artificial Sequence
  Description of Artificial Sequence: Synthetic oligonucleotide
cuuuauaccuguuggcccugc

SEQ ID NO: 16432 - RNA, 21 nt, Artificial Sequence
  Description of Artificial Sequence: Synthetic oligonucleotide
uuuauaccuguuggcccugcc

SEQ ID NO: 16433 - RNA, 21 nt, Artificial Sequence
  Description of Artificial Sequence: Synthetic oligonucleotide
uuauaccuguuggcccugccu

SEQ ID NO: 16434 - RNA, 21 nt, Artificial Sequence
  Description of Artificial Sequence: Synthetic oligonucleotide
uauaccuguuggcccugccua

SEQ ID NO: 16435 - RNA, 21 nt, Artificial Sequence
  Description of Artificial Sequence: Synthetic oligonucleotide
auaccuguuggcccugccuau

SEQ ID NO: 16436 - RNA, 21 nt, Artificial Sequence
  Description of Artificial Sequence: Synthetic oligonucleotide
uaccuguuggcccugccuaua

SEQ ID NO: 16437 - RNA, 21 nt, Artificial Sequence
  Description of Artificial Sequence: Synthetic oligonucleotide
accuguuggcccugccuauag

SEQ ID NO: 16438 - RNA, 21 nt, Artificial Sequence
  Description of Artificial Sequence: Synthetic oligonucleotide
ccuguuggcccugccuauagg

SEQ ID NO: 16439 - RNA, 21 nt, Artificial Sequence
  Description of Artificial Sequence: Synthetic oligonucleotide
cuguuggcccugccuauagga

SEQ ID NO: 16440 - RNA, 21 nt, Artificial Sequence
  Description of Artificial Sequence: Synthetic oligonucleotide
uguuggcccugccuauaggag

SEQ ID NO: 16441 - RNA, 21 nt, Artificial Sequence
  Description of Artificial Sequence: Synthetic oligonucleotide
guuggcccugccuauaggaga

SEQ ID NO: 16442 - RNA, 21 nt, Artificial Sequence
  Description of Artificial Sequence: Synthetic oligonucleotide
uuggcccugccuauaggagag

SEQ ID NO: 16443 - RNA, 21 nt, Artificial Sequence
  Description of Artificial Sequence: Synthetic oligonucleotide
uggcccugccuauaggagaga

SEQ ID NO: 16444 - RNA, 21 nt, Artificial Sequence
  Description of Artificial Sequence: Synthetic oligonucleotide
ggcccugccuauaggagagaa

SEQ ID NO: 16445 - RNA, 21 nt, Artificial Sequence
  Description of Artificial Sequence: Synthetic oligonucleotide
gcccugccuauaggagagaau

SEQ ID NO: 16446 - RNA, 21 nt, Artificial Sequence
  Description of Artificial Sequence: Synthetic oligonucleotide
cccugccuauaggagagaaua

SEQ ID NO: 16447 - RNA, 21 nt, Artificial Sequence
  Description of Artificial Sequence: Synthetic oligonucleotide
ccugccuauaggagagaauau

SEQ ID NO: 16448 - RNA, 21 nt, Artificial Sequence
  Description of Artificial Sequence: Synthetic oligonucleotide
cugccuauaggagagaauauu

SEQ ID NO: 16449 - RNA, 21 nt, Artificial Sequence
  Description of Artificial Sequence: Synthetic oligonucleotide
ugccuauaggagagaauauuu

SEQ ID NO: 16450 - RNA, 21 nt, Artificial Sequence
  Description of Artificial Sequence: Synthetic oligonucleotide
gccuauaggagagaauauuug

SEQ ID NO: 16451 - RNA, 21 nt, Artificial Sequence
  Description of Artificial Sequence: Synthetic oligonucleotide
ccuauaggagagaauauuugg

SEQ ID NO: 16452 - RNA, 21 nt, Artificial Sequence
  Description of Artificial Sequence: Synthetic oligonucleotide
cuauaggagagaauauuugga

SEQ ID NO: 16453 - RNA, 21 nt, Artificial Sequence
  Description of Artificial Sequence: Synthetic oligonucleotide
uauaggagagaauauuuggag

SEQ ID NO: 16454 - RNA, 21 nt, Artificial Sequence
  Description of Artificial Sequence: Synthetic oligonucleotide
auaggagagaauauuuggaga

SEQ ID NO: 16455 - RNA, 21 nt, Artificial Sequence
  Description of Artificial Sequence: Synthetic oligonucleotide
uaggagagaauauuuggagau

SEQ ID NO: 16456 - RNA, 21 nt, Artificial Sequence
  Description of Artificial Sequence: Synthetic oligonucleotide
aggagagaauauuuggagaua

SEQ ID NO: 16457 - RNA, 21 nt, Artificial Sequence
  Description of Artificial Sequence: Synthetic oligonucleotide
ggagagaauauuuggagauag

SEQ ID NO: 16458 - RNA, 21 nt, Artificial Sequence
  Description of Artificial Sequence: Synthetic oligonucleotide
gagagaauauuuggagauagg

SEQ ID NO: 16459 - RNA, 21 nt, Artificial Sequence
  Description of Artificial Sequence: Synthetic oligonucleotide
agagaauauuuggagauaggc

SEQ ID NO: 16460 - RNA, 21 nt, Artificial Sequence
  Description of Artificial Sequence: Synthetic oligonucleotide
gagaauauuuggagauaggca

SEQ ID NO: 16461 - RNA, 21 nt, Artificial Sequence
  Description of Artificial Sequence: Synthetic oligonucleotide
agaauauuuggagauaggcag

SEQ ID NO: 16462 - RNA, 21 nt, Artificial Sequence
  Description of Artificial Sequence: Synthetic oligonucleotide
gaauauuuggagauaggcagc

SEQ ID NO: 16463 - RNA, 21 nt, Artificial Sequence
  Description of Artificial Sequence: Synthetic oligonucleotide
aauauuuggagauaggcagcu

SEQ ID NO: 16464 - RNA, 21 nt, Artificial Sequence
  Description of Artificial Sequence: Synthetic oligonucleotide
auauuuggagauaggcagcuu

SEQ ID NO: 16465 - RNA, 21 nt, Artificial Sequence
  Description of Artificial Sequence: Synthetic oligonucleotide
uauuuggagauaggcagcuuc

SEQ ID NO: 16466 - RNA, 21 nt, Artificial Sequence
  Description of Artificial Sequence: Synthetic oligonucleotide
auuuggagauaggcagcuuca

SEQ ID NO: 16467 - RNA, 21 nt, Artificial Sequence
  Description of Artificial Sequence: Synthetic oligonucleotide
uuuggagauaggcagcuucag

SEQ ID NO: 16468 - RNA, 21 nt, Artificial Sequence
  Description of Artificial Sequence: Synthetic oligonucleotide
uuggagauaggcagcuucagg

SEQ ID NO: 16469 - RNA, 21 nt, Artificial Sequence
  Description of Artificial Sequence: Synthetic oligonucleotide
uggagauaggcagcuucagga

SEQ ID NO: 16470 - RNA, 21 nt, Artificial Sequence
  Description of Artificial Sequence: Synthetic oligonucleotide
ggagauaggcagcuucaggau

SEQ ID NO: 16471 - RNA, 21 nt, Artificial Sequence
  Description of Artificial Sequence: Synthetic oligonucleotide
gagauaggcagcuucaggaug

SEQ ID NO: 16472 - RNA, 21 nt, Artificial Sequence
  Description of Artificial Sequence: Synthetic oligonucleotide
agauaggcagcuucaggaugc

SEQ ID NO: 16473 - RNA, 21 nt, Artificial Sequence
  Description of Artificial Sequence: Synthetic oligonucleotide
gauaggcagcuucaggaugca

SEQ ID NO: 16474 - RNA, 21 nt, Artificial Sequence
  Description of Artificial Sequence: Synthetic oligonucleotide
auaggcagcuucaggaugcau

SEQ ID NO: 16475 - RNA, 21 nt, Artificial Sequence
  Description of Artificial Sequence: Synthetic oligonucleotide
uaggcagcuucaggaugcauu

SEQ ID NO: 16476 - RNA, 21 nt, Artificial Sequence
  Description of Artificial Sequence: Synthetic oligonucleotide
aggcagcuucaggaugcauug

SEQ ID NO: 16477 - RNA, 21 nt, Artificial Sequence
  Description of Artificial Sequence: Synthetic oligonucleotide
ggcagcuucaggaugcauugc

SEQ ID NO: 16478 - RNA, 21 nt, Artificial Sequence
  Description of Artificial Sequence: Synthetic oligonucleotide
gcagcuucaggaugcauugca

SEQ ID NO: 16479 - RNA, 21 nt, Artificial Sequence
  Description of Artificial Sequence: Synthetic oligonucleotide
cagcuucaggaugcauugcaa

SEQ ID NO: 16480 - RNA, 21 nt, Artificial Sequence
  Description of Artificial Sequence: Synthetic oligonucleotide
agcuucaggaugcauugcaau

SEQ ID NO: 16481 - RNA, 21 nt, Artificial Sequence
  Description of Artificial Sequence: Synthetic oligonucleotide
gcuucaggaugcauugcaauc

SEQ ID NO: 16482 - RNA, 21 nt, Artificial Sequence
  Description of Artificial Sequence: Synthetic oligonucleotide
cuucaggaugcauugcaauca

SEQ ID NO: 16483 - RNA, 21 nt, Artificial Sequence
  Description of Artificial Sequence: Synthetic oligonucleotide
uucaggaugcauugcaaucau

SEQ ID NO: 16484 - RNA, 21 nt, Artificial Sequence
  Description of Artificial Sequence: Synthetic oligonucleotide
ucaggaugcauugcaaucauc

SEQ ID NO: 16485 - RNA, 21 nt, Artificial Sequence
  Description of Artificial Sequence: Synthetic oligonucleotide
caggaugcauugcaaucaucc

SEQ ID NO: 16486 - RNA, 21 nt, Artificial Sequence
  Description of Artificial Sequence: Synthetic oligonucleotide
aggaugcauugcaaucauccu

SEQ ID NO: 16487 - RNA, 21 nt, Artificial Sequence
  Description of Artificial Sequence: Synthetic oligonucleotide
ggaugcauugcaaucauccuu

SEQ ID NO: 16488 - RNA, 21 nt, Artificial Sequence
  Description of Artificial Sequence: Synthetic oligonucleotide
gaugcauugcaaucauccuuu

SEQ ID NO: 16489 - RNA, 21 nt, Artificial Sequence
  Description of Artificial Sequence: Synthetic oligonucleotide
augcauugcaaucauccuuuu

SEQ ID NO: 16490 - RNA, 21 nt, Artificial Sequence
  Description of Artificial Sequence: Synthetic oligonucleotide
ugcauugcaaucauccuuuuc

SEQ ID NO: 16491 - RNA, 21 nt, Artificial Sequence
  Description of Artificial Sequence: Synthetic oligonucleotide
gcauugcaaucauccuuuucu

SEQ ID NO: 16492 - RNA, 21 nt, Artificial Sequence
  Description of Artificial Sequence: Synthetic oligonucleotide
cauugcaaucauccuuuucuu

SEQ ID NO: 16493 - RNA, 21 nt, Artificial Sequence
  Description of Artificial Sequence: Synthetic oligonucleotide
auugcaaucauccuuuucuua

SEQ ID NO: 16494 - RNA, 21 nt, Artificial Sequence
  Description of Artificial Sequence: Synthetic oligonucleotide
uugcaaucauccuuuucuuaa

SEQ ID NO: 16495 - RNA, 21 nt, Artificial Sequence
  Description of Artificial Sequence: Synthetic oligonucleotide
ugcaaucauccuuuucuuaaa

SEQ ID NO: 16496 - RNA, 21 nt, Artificial Sequence
  Description of Artificial Sequence: Synthetic oligonucleotide
gcaaucauccuuuucuuaaau

SEQ ID NO: 16497 - RNA, 21 nt, Artificial Sequence
  Description of Artificial Sequence: Synthetic oligonucleotide
caaucauccuuuucuuaaauu

SEQ ID NO: 16498 - RNA, 21 nt, Artificial Sequence
  Description of Artificial Sequence: Synthetic oligonucleotide
aaucauccuuuucuuaaauua

SEQ ID NO: 16499 - RNA, 21 nt, Artificial Sequence
  Description of Artificial Sequence: Synthetic oligonucleotide
aucauccuuuucuuaaauuau

SEQ ID NO: 16500 - RNA, 21 nt, Artificial Sequence
  Description of Artificial Sequence: Synthetic oligonucleotide
ucauccuuuucuuaaauuaug

SEQ ID NO: 16501 - RNA, 21 nt, Artificial Sequence
  Description of Artificial Sequence: Synthetic oligonucleotide
cauccuuuucuuaaauuaugu

SEQ ID NO: 16502 - RNA, 21 nt, Artificial Sequence
  Description of Artificial Sequence: Synthetic oligonucleotide
auccuuuucuuaaauuauguc

SEQ ID NO: 16503 - RNA, 21 nt, Artificial Sequence
  Description of Artificial Sequence: Synthetic oligonucleotide
uccuuuucuuaaauuauguca

SEQ ID NO: 16504 - RNA, 21 nt, Artificial Sequence
  Description of Artificial Sequence: Synthetic oligonucleotide
ccuuuucuuaaauuaugucac

SEQ ID NO: 16505 - RNA, 21 nt, Artificial Sequence
  Description of Artificial Sequence: Synthetic oligonucleotide
cuuuucuuaaauuaugucacu

SEQ ID NO: 16506 - RNA, 21 nt, Artificial Sequence
  Description of Artificial Sequence: Synthetic oligonucleotide
uuuucuuaaauuaugucacua

SEQ ID NO: 16507 - RNA, 21 nt, Artificial Sequence
  Description of Artificial Sequence: Synthetic oligonucleotide
uuucuuaaauuaugucacuag

SEQ ID NO: 16508 - RNA, 21 nt, Artificial Sequence
  Description of Artificial Sequence: Synthetic oligonucleotide
uucuuaaauuaugucacuagu

SEQ ID NO: 16509 - RNA, 21 nt, Artificial Sequence
  Description of Artificial Sequence: Synthetic oligonucleotide
ucuuaaauuaugucacuaguc

SEQ ID NO: 16510 - RNA, 21 nt, Artificial Sequence
  Description of Artificial Sequence: Synthetic oligonucleotide
cuuaaauuaugucacuagucu

SEQ ID NO: 16511 - RNA, 21 nt, Artificial Sequence
  Description of Artificial Sequence: Synthetic oligonucleotide
uuaaauuaugucacuagucuu

SEQ ID NO: 16512 - RNA, 21 nt, Artificial Sequence
  Description of Artificial Sequence: Synthetic oligonucleotide
uaaauuaugucacuagucuuu

SEQ ID NO: 16513 - RNA, 21 nt, Artificial Sequence
  Description of Artificial Sequence: Synthetic oligonucleotide
aaauuaugucacuagucuuuu

SEQ ID NO: 16514 - RNA, 21 nt, Artificial Sequence
  Description of Artificial Sequence: Synthetic oligonucleotide
aauuaugucacuagucuuuua

SEQ ID NO: 16515 - RNA, 21 nt, Artificial Sequence
  Description of Artificial Sequence: Synthetic oligonucleotide
auuaugucacuagucuuuuau

SEQ ID NO: 16516 - RNA, 21 nt, Artificial Sequence
  Description of Artificial Sequence: Synthetic oligonucleotide
uuaugucacuagucuuuuauu

SEQ ID NO: 16517 - RNA, 21 nt, Artificial Sequence
  Description of Artificial Sequence: Synthetic oligonucleotide
uaugucacuagucuuuuauuu

SEQ ID NO: 16518 - RNA, 21 nt, Artificial Sequence
  Description of Artificial Sequence: Synthetic oligonucleotide
augucacuagucuuuuauuuu

SEQ ID NO: 16519 - RNA, 21 nt, Artificial Sequence
  Description of Artificial Sequence: Synthetic oligonucleotide
ugucacuagucuuuuauuuuu

SEQ ID NO: 16520 - RNA, 21 nt, Artificial Sequence
  Description of Artificial Sequence: Synthetic oligonucleotide
gucacuagucuuuuauuuuuu

SEQ ID NO: 16521 - RNA, 21 nt, Artificial Sequence
  Description of Artificial Sequence: Synthetic oligonucleotide
ucacuagucuuuuauuuuuuc

SEQ ID NO: 16522 - RNA, 21 nt, Artificial Sequence
  Description of Artificial Sequence: Synthetic oligonucleotide
cacuagucuuuuauuuuuucc

SEQ ID NO: 16523 - RNA, 21 nt, Artificial Sequence
  Description of Artificial Sequence: Synthetic oligonucleotide
acuagucuuuuauuuuuuccc

SEQ ID NO: 16524 - RNA, 21 nt, Artificial Sequence
  Description of Artificial Sequence: Synthetic oligonucleotide
cuagucuuuuauuuuuucccc

SEQ ID NO: 16525 - RNA, 21 nt, Artificial Sequence
  Description of Artificial Sequence: Synthetic oligonucleotide
uagucuuuuauuuuuuccccu

SEQ ID NO: 16526 - RNA, 21 nt, Artificial Sequence
  Description of Artificial Sequence: Synthetic oligonucleotide
agucuuuuauuuuuuccccuc

SEQ ID NO: 16527 - RNA, 21 nt, Artificial Sequence
  Description of Artificial Sequence: Synthetic oligonucleotide
gucuuuuauuuuuuccccucu

SEQ ID NO: 16528 - RNA, 21 nt, Artificial Sequence
  Description of Artificial Sequence: Synthetic oligonucleotide
ucuuuuauuuuuuccccucuu

SEQ ID NO: 16529 - RNA, 21 nt, Artificial Sequence
  Description of Artificial Sequence: Synthetic oligonucleotide
cuuuuauuuuuuccccucuug

SEQ ID NO: 16530 - RNA, 21 nt, Artificial Sequence
  Description of Artificial Sequence: Synthetic oligonucleotide
uuuuauuuuuuccccucuuga

SEQ ID NO: 16531 - RNA, 21 nt, Artificial Sequence
  Description of Artificial Sequence: Synthetic oligonucleotide
uuuauuuuuuccccucuugaa

SEQ ID NO: 16532 - RNA, 21 nt, Artificial Sequence
  Description of Artificial Sequence: Synthetic oligonucleotide
uuauuuuuuccccucuugaac

SEQ ID NO: 16533 - RNA, 21 nt, Artificial Sequence
  Description of Artificial Sequence: Synthetic oligonucleotide
uauuuuuuccccucuugaacu

SEQ ID NO: 16534 - RNA, 21 nt, Artificial Sequence
  Description of Artificial Sequence: Synthetic oligonucleotide
auuuuuuccccucuugaacuu

SEQ ID NO: 16535 - RNA, 21 nt, Artificial Sequence
  Description of Artificial Sequence: Synthetic oligonucleotide
uuuuuuccccucuugaacuuu

SEQ ID NO: 16536 - RNA, 21 nt, Artificial Sequence
  Description of Artificial Sequence: Synthetic oligonucleotide
uuuuuccccucuugaacuuuc

SEQ ID NO: 16537 - RNA, 21 nt, Artificial Sequence
  Description of Artificial Sequence: Synthetic oligonucleotide
uuuuccccucuugaacuuucc

SEQ ID NO: 16538 - RNA, 21 nt, Artificial Sequence
  Description of Artificial Sequence: Synthetic oligonucleotide
uuuccccucuugaacuuuccu

SEQ ID NO: 16539 - RNA, 21 nt, Artificial Sequence
  Description of Artificial Sequence: Synthetic oligonucleotide
uuccccucuugaacuuuccuc

SEQ ID NO: 16540 - RNA, 21 nt, Artificial Sequence
  Description of Artificial Sequence: Synthetic oligonucleotide
uccccucuugaacuuuccuca

SEQ ID NO: 16541 - RNA, 21 nt, Artificial Sequence
  Description of Artificial Sequence: Synthetic oligonucleotide
ccccucuugaacuuuccucac

SEQ ID NO: 16542 - RNA, 21 nt, Artificial Sequence
  Description of Artificial Sequence: Synthetic oligonucleotide
cccucuugaacuuuccucaca

SEQ ID NO: 16543 - RNA, 21 nt, Artificial Sequence
  Description of Artificial Sequence: Synthetic oligonucleotide
ccucuugaacuuuccucacac

SEQ ID NO: 16544 - RNA, 21 nt, Artificial Sequence
  Description of Artificial Sequence: Synthetic oligonucleotide
cucuugaacuuuccucacacc

SEQ ID NO: 16545 - RNA, 21 nt, Artificial Sequence
  Description of Artificial Sequence: Synthetic oligonucleotide
ucuugaacuuuccucacaccu

SEQ ID NO: 16546 - RNA, 21 nt, Artificial Sequence
  Description of Artificial Sequence: Synthetic oligonucleotide
cuugaacuuuccucacaccug

SEQ ID NO: 16547 - RNA, 21 nt, Artificial Sequence
  Description of Artificial Sequence: Synthetic oligonucleotide
uugaacuuuccucacaccugg

SEQ ID NO: 16548 - RNA, 21 nt, Artificial Sequence
  Description of Artificial Sequence: Synthetic oligonucleotide
ugaacuuuccucacaccugga

SEQ ID NO: 16549 - RNA, 21 nt, Artificial Sequence
  Description of Artificial Sequence: Synthetic oligonucleotide
gaacuuuccucacaccuggaa

SEQ ID NO: 16550 - RNA, 21 nt, Artificial Sequence
  Description of Artificial Sequence: Synthetic oligonucleotide
aacuuuccucacaccuggaag

SEQ ID NO: 16551 - RNA, 21 nt, Artificial Sequence
  Description of Artificial Sequence: Synthetic oligonucleotide
acuuuccucacaccuggaaga

SEQ ID NO: 16552 - RNA, 21 nt, Artificial Sequence
  Description of Artificial Sequence: Synthetic oligonucleotide
cuuuccucacaccuggaagaa

SEQ ID NO: 16553 - RNA, 21 nt, Artificial Sequence
  Description of Artificial Sequence: Synthetic oligonucleotide
uuuccucacaccuggaagaaa

SEQ ID NO: 16554 - RNA, 21 nt, Artificial Sequence
  Description of Artificial Sequence: Synthetic oligonucleotide
uuccucacaccuggaagaaac

SEQ ID NO: 16555 - RNA, 21 nt, Artificial Sequence
  Description of Artificial Sequence: Synthetic oligonucleotide
uccucacaccuggaagaaaca

SEQ ID NO: 16556 - RNA, 21 nt, Artificial Sequence
  Description of Artificial Sequence: Synthetic oligonucleotide
ccucacaccuggaagaaacaa

SEQ ID NO: 16557 - RNA, 21 nt, Artificial Sequence
  Description of Artificial Sequence: Synthetic oligonucleotide
cucacaccuggaagaaacaaa

SEQ ID NO: 16558 - RNA, 21 nt, Artificial Sequence
  Description of Artificial Sequence: Synthetic oligonucleotide
ucacaccuggaagaaacaaag

SEQ ID NO: 16559 - RNA, 21 nt, Artificial Sequence
  Description of Artificial Sequence: Synthetic oligonucleotide
cacaccuggaagaaacaaagu

SEQ ID NO: 16560 - RNA, 21 nt, Artificial Sequence
  Description of Artificial Sequence: Synthetic oligonucleotide
acaccuggaagaaacaaagua

SEQ ID NO: 16561 - RNA, 21 nt, Artificial Sequence
  Description of Artificial Sequence: Synthetic oligonucleotide
caccuggaagaaacaaaguag

SEQ ID NO: 16562 - RNA, 21 nt, Artificial Sequence
  Description of Artificial Sequence: Synthetic oligonucleotide
accuggaagaaacaaaguagg

SEQ ID NO: 16563 - RNA, 21 nt, Artificial Sequence
  Description of Artificial Sequence: Synthetic oligonucleotide
ccuggaagaaacaaaguagga

SEQ ID NO: 16564 - RNA, 21 nt, Artificial Sequence
  Description of Artificial Sequence: Synthetic oligonucleotide
cuggaagaaacaaaguaggaa

SEQ ID NO: 16565 - RNA, 21 nt, Artificial Sequence
  Description of Artificial Sequence: Synthetic oligonucleotide
uggaagaaacaaaguaggaaa

SEQ ID NO: 16566 - RNA, 21 nt, Artificial Sequence
  Description of Artificial Sequence: Synthetic oligonucleotide
ggaagaaacaaaguaggaaaa

SEQ ID NO: 16567 - RNA, 21 nt, Artificial Sequence
  Description of Artificial Sequence: Synthetic oligonucleotide
gaagaaacaaaguaggaaaaa

SEQ ID NO: 16568 - RNA, 21 nt, Artificial Sequence
  Description of Artificial Sequence: Synthetic oligonucleotide
aagaaacaaaguaggaaaaag

SEQ ID NO: 16569 - RNA, 21 nt, Artificial Sequence
  Description of Artificial Sequence: Synthetic oligonucleotide
agaaacaaaguaggaaaaagu

SEQ ID NO: 16570 - RNA, 21 nt, Artificial Sequence
  Description of Artificial Sequence: Synthetic oligonucleotide
gaaacaaaguaggaaaaagug

SEQ ID NO: 16571 - RNA, 21 nt, Artificial Sequence
  Description of Artificial Sequence: Synthetic oligonucleotide
aaacaaaguaggaaaaaguga

SEQ ID NO: 16572 - RNA, 21 nt, Artificial Sequence
  Description of Artificial Sequence: Synthetic oligonucleotide
aacaaaguaggaaaaagugaa

SEQ ID NO: 16573 - RNA, 21 nt, Artificial Sequence
  Description of Artificial Sequence: Synthetic oligonucleotide
acaaaguaggaaaaagugaac

SEQ ID NO: 16574 - RNA, 21 nt, Artificial Sequence
  Description of Artificial Sequence: Synthetic oligonucleotide
caaaguaggaaaaagugaaca

SEQ ID NO: 16575 - RNA, 21 nt, Artificial Sequence
  Description of Artificial Sequence: Synthetic oligonucleotide
aaaguaggaaaaagugaacag

SEQ ID NO: 16576 - RNA, 21 nt, Artificial Sequence
  Description of Artificial Sequence: Synthetic oligonucleotide
aaguaggaaaaagugaacagg

SEQ ID NO: 16577 - RNA, 21 nt, Artificial Sequence
  Description of Artificial Sequence: Synthetic oligonucleotide
aguaggaaaaagugaacaggg

SEQ ID NO: 16578 - RNA, 21 nt, Artificial Sequence
  Description of Artificial Sequence: Synthetic oligonucleotide
guaggaaaaagugaacagggg

SEQ ID NO: 16579 - RNA, 21 nt, Artificial Sequence
  Description of Artificial Sequence: Synthetic oligonucleotide
uaggaaaaagugaacagggga

SEQ ID NO: 16580 - RNA, 21 nt, Artificial Sequence
  Description of Artificial Sequence: Synthetic oligonucleotide
aggaaaaagugaacaggggau

SEQ ID NO: 16581 - RNA, 21 nt, Artificial Sequence
  Description of Artificial Sequence: Synthetic oligonucleotide
ggaaaaagugaacaggggaug

SEQ ID NO: 16582 - RNA, 21 nt, Artificial Sequence
  Description of Artificial Sequence: Synthetic oligonucleotide
gaaaaagugaacaggggaugu

SEQ ID NO: 16583 - RNA, 21 nt, Artificial Sequence
  Description of Artificial Sequence: Synthetic oligonucleotide
aaaaagugaacaggggauguc

SEQ ID NO: 16584 - RNA, 21 nt, Artificial Sequence
  Description of Artificial Sequence: Synthetic oligonucleotide
aaaagugaacaggggauguca

SEQ ID NO: 16585 - RNA, 21 nt, Artificial Sequence
  Description of Artificial Sequence: Synthetic oligonucleotide
aaagugaacaggggaugucaa

SEQ ID NO: 16586 - RNA, 21 nt, Artificial Sequence
  Description of Artificial Sequence: Synthetic oligonucleotide
aagugaacaggggaugucaaa

SEQ ID NO: 16587 - RNA, 21 nt, Artificial Sequence
  Description of Artificial Sequence: Synthetic oligonucleotide
agugaacaggggaugucaaau

SEQ ID NO: 16588 - RNA, 21 nt, Artificial Sequence
  Description of Artificial Sequence: Synthetic oligonucleotide
gugaacaggggaugucaaauc

SEQ ID NO: 16589 - RNA, 21 nt, Artificial Sequence
  Description of Artificial Sequence: Synthetic oligonucleotide
ugaacaggggaugucaaaucg

SEQ ID NO: 16590 - RNA, 21 nt, Artificial Sequence
  Description of Artificial Sequence: Synthetic oligonucleotide
gaacaggggaugucaaaucga

SEQ ID NO: 16591 - RNA, 21 nt, Artificial Sequence
  Description of Artificial Sequence: Synthetic oligonucleotide
aacaggggaugucaaaucgau

SEQ ID NO: 16592 - RNA, 21 nt, Artificial Sequence
  Description of Artificial Sequence: Synthetic oligonucleotide
acaggggaugucaaaucgauu

SEQ ID NO: 16593 - RNA, 21 nt, Artificial Sequence
  Description of Artificial Sequence: Synthetic oligonucleotide
caggggaugucaaaucgauuc

SEQ ID NO: 16594 - RNA, 21 nt, Artificial Sequence
  Description of Artificial Sequence: Synthetic oligonucleotide
aggggaugucaaaucgauucu

SEQ ID NO: 16595 - RNA, 21 nt, Artificial Sequence
  Description of Artificial Sequence: Synthetic oligonucleotide
ggggaugucaaaucgauucuu

SEQ ID NO: 16596 - RNA, 21 nt, Artificial Sequence
  Description of Artificial Sequence: Synthetic oligonucleotide
gggaugucaaaucgauucuug

SEQ ID NO: 16597 - RNA, 21 nt, Artificial Sequence
  Description of Artificial Sequence: Synthetic oligonucleotide
ggaugucaaaucgauucuuga

SEQ ID NO: 16598 - RNA, 21 nt, Artificial Sequence
  Description of Artificial Sequence: Synthetic oligonucleotide
gaugucaaaucgauucuugaa

SEQ ID NO: 16599 - RNA, 21 nt, Artificial Sequence
  Description of Artificial Sequence: Synthetic oligonucleotide
augucaaaucgauucuugaau

SEQ ID NO: 16600 - RNA, 21 nt, Artificial Sequence
  Description of Artificial Sequence: Synthetic oligonucleotide
ugucaaaucgauucuugaauu

SEQ ID NO: 16601 - RNA, 21 nt, Artificial Sequence
  Description of Artificial Sequence: Synthetic oligonucleotide
gucaaaucgauucuugaauuc

SEQ ID NO: 16602 - RNA, 21 nt, Artificial Sequence
  Description of Artificial Sequence: Synthetic oligonucleotide
ucaaaucgauucuugaauucc

SEQ ID NO: 16603 - RNA, 21 nt, Artificial Sequence
  Description of Artificial Sequence: Synthetic oligonucleotide
caaaucgauucuugaauuccc

SEQ ID NO: 16604 - RNA, 21 nt, Artificial Sequence
  Description of Artificial Sequence: Synthetic oligonucleotide
aaaucgauucuugaauucccg

SEQ ID NO: 16605 - RNA, 21 nt, Artificial Sequence
  Description of Artificial Sequence: Synthetic oligonucleotide
aaucgauucuugaauucccgc

SEQ ID NO: 16606 - RNA, 21 nt, Artificial Sequence
  Description of Artificial Sequence: Synthetic oligonucleotide
aucgauucuugaauucccgcu

SEQ ID NO: 16607 - RNA, 21 nt, Artificial Sequence
  Description of Artificial Sequence: Synthetic oligonucleotide
ucgauucuugaauucccgcug

SEQ ID NO: 16608 - RNA, 21 nt, Artificial Sequence
  Description of Artificial Sequence: Synthetic oligonucleotide
cgauucuugaauucccgcugc

SEQ ID NO: 16609 - RNA, 21 nt, Artificial Sequence
  Description of Artificial Sequence: Synthetic oligonucleotide
gauucuugaauucccgcugca

SEQ ID NO: 16610 - RNA, 21 nt, Artificial Sequence
  Description of Artificial Sequence: Synthetic oligonucleotide
auucuugaauucccgcugcaa

SEQ ID NO: 16611 - RNA, 21 nt, Artificial Sequence
  Description of Artificial Sequence: Synthetic oligonucleotide
uucuugaauucccgcugcaag

SEQ ID NO: 16612 - RNA, 21 nt, Artificial Sequence
  Description of Artificial Sequence: Synthetic oligonucleotide
ucuugaauucccgcugcaagc

SEQ ID NO: 16613 - RNA, 21 nt, Artificial Sequence
  Description of Artificial Sequence: Synthetic oligonucleotide
cuugaauucccgcugcaagcu

SEQ ID NO: 16614 - RNA, 21 nt, Artificial Sequence
  Description of Artificial Sequence: Synthetic oligonucleotide
uugaauucccgcugcaagcua

SEQ ID NO: 16615 - RNA, 21 nt, Artificial Sequence
  Description of Artificial Sequence: Synthetic oligonucleotide
ugaauucccgcugcaagcuag

SEQ ID NO: 16616 - RNA, 21 nt, Artificial Sequence
  Description of Artificial Sequence: Synthetic oligonucleotide
gaauucccgcugcaagcuaga

SEQ ID NO: 16617 - RNA, 21 nt, Artificial Sequence
  Description of Artificial Sequence: Synthetic oligonucleotide
aauucccgcugcaagcuagag

SEQ ID NO: 16618 - RNA, 21 nt, Artificial Sequence
  Description of Artificial Sequence: Synthetic oligonucleotide
auucccgcugcaagcuagagc

SEQ ID NO: 16619 - RNA, 21 nt, Artificial Sequence
  Description of Artificial Sequence: Synthetic oligonucleotide
uucccgcugcaagcuagagcc

SEQ ID NO: 16620 - RNA, 21 nt, Artificial Sequence
  Description of Artificial Sequence: Synthetic oligonucleotide
ucccgcugcaagcuagagccg

SEQ ID NO: 16621 - RNA, 21 nt, Artificial Sequence
  Description of Artificial Sequence: Synthetic oligonucleotide
cccgcugcaagcuagagccgc

SEQ ID NO: 16622 - RNA, 21 nt, Artificial Sequence
  Description of Artificial Sequence: Synthetic oligonucleotide
ccgcugcaagcuagagccgca

SEQ ID NO: 16623 - RNA, 21 nt, Artificial Sequence
  Description of Artificial Sequence: Synthetic oligonucleotide
cgcugcaagcuagagccgcag

SEQ ID NO: 16624 - RNA, 21 nt, Artificial Sequence
  Description of Artificial Sequence: Synthetic oligonucleotide
gcugcaagcuagagccgcagg

SEQ ID NO: 16625 - RNA, 21 nt, Artificial Sequence
  Description of Artificial Sequence: Synthetic oligonucleotide
cugcaagcuagagccgcaggc

SEQ ID NO: 16626 - RNA, 21 nt, Artificial Sequence
  Description of Artificial Sequence: Synthetic oligonucleotide
ugcaagcuagagccgcaggca

SEQ ID NO: 16627 - RNA, 21 nt, Artificial Sequence
  Description of Artificial Sequence: Synthetic oligonucleotide
gcaagcuagagccgcaggcac

SEQ ID NO: 16628 - RNA, 21 nt, Artificial Sequence
  Description of Artificial Sequence: Synthetic oligonucleotide
caagcuagagccgcaggcacc

SEQ ID NO: 16629 - RNA, 21 nt, Artificial Sequence
  Description of Artificial Sequence: Synthetic oligonucleotide
aagcuagagccgcaggcaccc

SEQ ID NO: 16630 - RNA, 21 nt, Artificial Sequence
  Description of Artificial Sequence: Synthetic oligonucleotide
agcuagagccgcaggcacccu

SEQ ID NO: 16631 - RNA, 21 nt, Artificial Sequence
  Description of Artificial Sequence: Synthetic oligonucleotide
gcuagagccgcaggcacccuc

SEQ ID NO: 16632 - RNA, 21 nt, Artificial Sequence
  Description of Artificial Sequence: Synthetic oligonucleotide
cuagagccgcaggcacccucu

SEQ ID NO: 16633 - RNA, 21 nt, Artificial Sequence
  Description of Artificial Sequence: Synthetic oligonucleotide
uagagccgcaggcacccucuc

SEQ ID NO: 16634 - RNA, 21 nt, Artificial Sequence
  Description of Artificial Sequence: Synthetic oligonucleotide
agagccgcaggcacccucuca

SEQ ID NO: 16635 - RNA, 21 nt, Artificial Sequence
  Description of Artificial Sequence: Synthetic oligonucleotide
gagccgcaggcacccucucac

SEQ ID NO: 16636 - RNA, 21 nt, Artificial Sequence
  Description of Artificial Sequence: Synthetic oligonucleotide
agccgcaggcacccucucacu

SEQ ID NO: 16637 - RNA, 21 nt, Artificial Sequence
  Description of Artificial Sequence: Synthetic oligonucleotide
gccgcaggcacccucucacuc

SEQ ID NO: 16638 - RNA, 21 nt, Artificial Sequence
  Description of Artificial Sequence: Synthetic oligonucleotide
ccgcaggcacccucucacuca

SEQ ID NO: 16639 - RNA, 21 nt, Artificial Sequence
  Description of Artificial Sequence: Synthetic oligonucleotide
cgcaggcacccucucacucaa

SEQ ID NO: 16640 - RNA, 21 nt, Artificial Sequence
  Description of Artificial Sequence: Synthetic oligonucleotide
gcaggcacccucucacucaau

SEQ ID NO: 16641 - RNA, 21 nt, Artificial Sequence
  Description of Artificial Sequence: Synthetic oligonucleotide
caggcacccucucacucaauu

SEQ ID NO: 16642 - RNA, 21 nt, Artificial Sequence
  Description of Artificial Sequence: Synthetic oligonucleotide
aggcacccucucacucaauuu

SEQ ID NO: 16643 - RNA, 21 nt, Artificial Sequence
  Description of Artificial Sequence: Synthetic oligonucleotide
ggcacccucucacucaauuuc

SEQ ID NO: 16644 - RNA, 21 nt, Artificial Sequence
  Description of Artificial Sequence: Synthetic oligonucleotide
gcacccucucacucaauuucc

SEQ ID NO: 16645 - RNA, 21 nt, Artificial Sequence
  Description of Artificial Sequence: Synthetic oligonucleotide
cacccucucacucaauuucca

SEQ ID NO: 16646 - RNA, 21 nt, Artificial Sequence
  Description of Artificial Sequence: Synthetic oligonucleotide
acccucucacucaauuuccac

SEQ ID NO: 16647 - RNA, 21 nt, Artificial Sequence
  Description of Artificial Sequence: Synthetic oligonucleotide
cccucucacucaauuuccacu

SEQ ID NO: 16648 - RNA, 21 nt, Artificial Sequence
  Description of Artificial Sequence: Synthetic oligonucleotide
ccucucacucaauuuccacuc

SEQ ID NO: 16649 - RNA, 21 nt, Artificial Sequence
  Description of Artificial Sequence: Synthetic oligonucleotide
cucucacucaauuuccacuca

SEQ ID NO: 16650 - RNA, 21 nt, Artificial Sequence
  Description of Artificial Sequence: Synthetic oligonucleotide
ucucacucaauuuccacucag

SEQ ID NO: 16651 - RNA, 21 nt, Artificial Sequence
  Description of Artificial Sequence: Synthetic oligonucleotide
cucacucaauuuccacucaga

SEQ ID NO: 16652 - RNA, 21 nt, Artificial Sequence
  Description of Artificial Sequence: Synthetic oligonucleotide
ucacucaauuuccacucagaa

SEQ ID NO: 16653 - RNA, 21 nt, Artificial Sequence
  Description of Artificial Sequence: Synthetic oligonucleotide
cacucaauuuccacucagaac

SEQ ID NO: 16654 - RNA, 21 nt, Artificial Sequence
  Description of Artificial Sequence: Synthetic oligonucleotide
acucaauuuccacucagaacc

SEQ ID NO: 16655 - RNA, 21 nt, Artificial Sequence
  Description of Artificial Sequence: Synthetic oligonucleotide
cucaauuuccacucagaaccc

SEQ ID NO: 16656 - RNA, 21 nt, Artificial Sequence
  Description of Artificial Sequence: Synthetic oligonucleotide
ucaauuuccacucagaacccu

SEQ ID NO: 16657 - RNA, 21 nt, Artificial Sequence
  Description of Artificial Sequence: Synthetic oligonucleotide
caauuuccacucagaacccua

SEQ ID NO: 16658 - RNA, 21 nt, Artificial Sequence
  Description of Artificial Sequence: Synthetic oligonucleotide
aauuuccacucagaacccuau

SEQ ID NO: 16659 - RNA, 21 nt, Artificial Sequence
  Description of Artificial Sequence: Synthetic oligonucleotide
auuuccacucagaacccuaua

SEQ ID NO: 16660 - RNA, 21 nt, Artificial Sequence
  Description of Artificial Sequence: Synthetic oligonucleotide
uuuccacucagaacccuauaa

SEQ ID NO: 16661 - RNA, 21 nt, Artificial Sequence
  Description of Artificial Sequence: Synthetic oligonucleotide
uuccacucagaacccuauaaa

SEQ ID NO: 16662 - RNA, 21 nt, Artificial Sequence
  Description of Artificial Sequence: Synthetic oligonucleotide
uccacucagaacccuauaaac

SEQ ID NO: 16663 - RNA, 21 nt, Artificial Sequence
  Description of Artificial Sequence: Synthetic oligonucleotide
ccacucagaacccuauaaaca

SEQ ID NO: 16664 - RNA, 21 nt, Artificial Sequence
  Description of Artificial Sequence: Synthetic oligonucleotide
cacucagaacccuauaaacac

SEQ ID NO: 16665 - RNA, 21 nt, Artificial Sequence
  Description of Artificial Sequence: Synthetic oligonucleotide
acucagaacccuauaaacacc

SEQ ID NO: 16666 - RNA, 21 nt, Artificial Sequence
  Description of Artificial Sequence: Synthetic oligonucleotide
cucagaacccuauaaacacca

SEQ ID NO: 16667 - RNA, 21 nt, Artificial Sequence
  Description of Artificial Sequence: Synthetic oligonucleotide
ucagaacccuauaaacaccag

SEQ ID NO: 16668 - RNA, 21 nt, Artificial Sequence
  Description of Artificial Sequence: Synthetic oligonucleotide
cagaacccuauaaacaccagu

SEQ ID NO: 16669 - RNA, 21 nt, Artificial Sequence
  Description of Artificial Sequence: Synthetic oligonucleotide
agaacccuauaaacaccagug

SEQ ID NO: 16670 - RNA, 21 nt, Artificial Sequence
  Description of Artificial Sequence: Synthetic oligonucleotide
gaacccuauaaacaccagugg

SEQ ID NO: 16671 - RNA, 21 nt, Artificial Sequence
  Description of Artificial Sequence: Synthetic oligonucleotide
aacccuauaaacaccaguggg

SEQ ID NO: 16672 - RNA, 21 nt, Artificial Sequence
  Description of Artificial Sequence: Synthetic oligonucleotide
acccuauaaacaccaguggga

SEQ ID NO: 16673 - RNA, 21 nt, Artificial Sequence
  Description of Artificial Sequence: Synthetic oligonucleotide
cccuauaaacaccagugggaa

SEQ ID NO: 16674 - RNA, 21 nt, Artificial Sequence
  Description of Artificial Sequence: Synthetic oligonucleotide
ccuauaaacaccagugggaag

SEQ ID NO: 16675 - RNA, 21 nt, Artificial Sequence
  Description of Artificial Sequence: Synthetic oligonucleotide
cuauaaacaccagugggaagg

SEQ ID NO: 16676 - RNA, 21 nt, Artificial Sequence
  Description of Artificial Sequence: Synthetic oligonucleotide
uauaaacaccagugggaaggg

SEQ ID NO: 16677 - RNA, 21 nt, Artificial Sequence
  Description of Artificial Sequence: Synthetic oligonucleotide
auaaacaccagugggaagggc

SEQ ID NO: 16678 - RNA, 21 nt, Artificial Sequence
  Description of Artificial Sequence: Synthetic oligonucleotide
uaaacaccagugggaagggca

SEQ ID NO: 16679 - RNA, 21 nt, Artificial Sequence
  Description of Artificial Sequence: Synthetic oligonucleotide
aaacaccagugggaagggcaa

SEQ ID NO: 16680 - RNA, 21 nt, Artificial Sequence
  Description of Artificial Sequence: Synthetic oligonucleotide
aacaccagugggaagggcaac

SEQ ID NO: 16681 - RNA, 21 nt, Artificial Sequence
  Description of Artificial Sequence: Synthetic oligonucleotide
acaccagugggaagggcaacc

SEQ ID NO: 16682 - RNA, 21 nt, Artificial Sequence
  Description of Artificial Sequence: Synthetic oligonucleotide
caccagugggaagggcaaccc

SEQ ID NO: 16683 - RNA, 21 nt, Artificial Sequence
  Description of Artificial Sequence: Synthetic oligonucleotide
accagugggaagggcaaccca

SEQ ID NO: 16684 - RNA, 21 nt, Artificial Sequence
  Description of Artificial Sequence: Synthetic oligonucleotide
ccagugggaagggcaacccac

SEQ ID NO: 16685 - RNA, 21 nt, Artificial Sequence
  Description of Artificial Sequence: Synthetic oligonucleotide
cagugggaagggcaacccacu

SEQ ID NO: 16686 - RNA, 21 nt, Artificial Sequence
  Description of Artificial Sequence: Synthetic oligonucleotide
agugggaagggcaacccacug

SEQ ID NO: 16687 - RNA, 21 nt, Artificial Sequence
  Description of Artificial Sequence: Synthetic oligonucleotide
gugggaagggcaacccacugc

SEQ ID NO: 16688 - RNA, 21 nt, Artificial Sequence
  Description of Artificial Sequence: Synthetic oligonucleotide
ugggaagggcaacccacugca

SEQ ID NO: 16689 - RNA, 21 nt, Artificial Sequence
  Description of Artificial Sequence: Synthetic oligonucleotide
gggaagggcaacccacugcac

SEQ ID NO: 16690 - RNA, 21 nt, Artificial Sequence
  Description of Artificial Sequence: Synthetic oligonucleotide
ggaagggcaacccacugcacg

SEQ ID NO: 16691 - RNA, 21 nt, Artificial Sequence
  Description of Artificial Sequence: Synthetic oligonucleotide
gaagggcaacccacugcacgu

SEQ ID NO: 16692 - RNA, 21 nt, Artificial Sequence
  Description of Artificial Sequence: Synthetic oligonucleotide
aagggcaacccacugcacgug

SEQ ID NO: 16693 - RNA, 21 nt, Artificial Sequence
  Description of Artificial Sequence: Synthetic oligonucleotide
agggcaacccacugcacgugg

SEQ ID NO: 16694 - RNA, 21 nt, Artificial Sequence
  Description of Artificial Sequence: Synthetic oligonucleotide
gggcaacccacugcacguggg

SEQ ID NO: 16695 - RNA, 21 nt, Artificial Sequence
  Description of Artificial Sequence: Synthetic oligonucleotide
ggcaacccacugcacguggga

SEQ ID NO: 16696 - RNA, 21 nt, Artificial Sequence
  Description of Artificial Sequence: Synthetic oligonucleotide
gcaacccacugcacgugggaa

SEQ ID NO: 16697 - RNA, 21 nt, Artificial Sequence
  Description of Artificial Sequence: Synthetic oligonucleotide
caacccacugcacgugggaau

SEQ ID NO: 16698 - RNA, 21 nt, Artificial Sequence
  Description of Artificial Sequence: Synthetic oligonucleotide
aacccacugcacgugggaaug

SEQ ID NO: 16699 - RNA, 21 nt, Artificial Sequence
  Description of Artificial Sequence: Synthetic oligonucleotide
acccacugcacgugggaaugc

SEQ ID NO: 16700 - RNA, 21 nt, Artificial Sequence
  Description of Artificial Sequence: Synthetic oligonucleotide
cccacugcacgugggaaugca

SEQ ID NO: 16701 - RNA, 21 nt, Artificial Sequence
  Description of Artificial Sequence: Synthetic oligonucleotide
ccacugcacgugggaaugcac

SEQ ID NO: 16702 - RNA, 21 nt, Artificial Sequence
  Description of Artificial Sequence: Synthetic oligonucleotide
cacugcacgugggaaugcacu

SEQ ID NO: 16703 - RNA, 21 nt, Artificial Sequence
  Description of Artificial Sequence: Synthetic oligonucleotide
acugcacgugggaaugcacug

SEQ ID NO: 16704 - RNA, 21 nt, Artificial Sequence
  Description of Artificial Sequence: Synthetic oligonucleotide
cugcacgugggaaugcacuga

SEQ ID NO: 16705 - RNA, 21 nt, Artificial Sequence
  Description of Artificial Sequence: Synthetic oligonucleotide
ugcacgugggaaugcacugau

SEQ ID NO: 16706 - RNA, 21 nt, Artificial Sequence
  Description of Artificial Sequence: Synthetic oligonucleotide
gcacgugggaaugcacugauu

SEQ ID NO: 16707 - RNA, 21 nt, Artificial Sequence
  Description of Artificial Sequence: Synthetic oligonucleotide
cacgugggaaugcacugauuu

SEQ ID NO: 16708 - RNA, 21 nt, Artificial Sequence
  Description of Artificial Sequence: Synthetic oligonucleotide
acgugggaaugcacugauuuu

SEQ ID NO: 16709 - RNA, 21 nt, Artificial Sequence
  Description of Artificial Sequence: Synthetic oligonucleotide
cgugggaaugcacugauuuuu

SEQ ID NO: 16710 - RNA, 21 nt, Artificial Sequence
  Description of Artificial Sequence: Synthetic oligonucleotide
gugggaaugcacugauuuuuc

SEQ ID NO: 16711 - RNA, 21 nt, Artificial Sequence
  Description of Artificial Sequence: Synthetic oligonucleotide
ugggaaugcacugauuuuucc

SEQ ID NO: 16712 - RNA, 21 nt, Artificial Sequence
  Description of Artificial Sequence: Synthetic oligonucleotide
gggaaugcacugauuuuuccu

SEQ ID NO: 16713 - RNA, 21 nt, Artificial Sequence
  Description of Artificial Sequence: Synthetic oligonucleotide
ggaaugcacugauuuuuccua

SEQ ID NO: 16714 - RNA, 21 nt, Artificial Sequence
  Description of Artificial Sequence: Synthetic oligonucleotide
gaaugcacugauuuuuccuag

SEQ ID NO: 16715 - RNA, 21 nt, Artificial Sequence
  Description of Artificial Sequence: Synthetic oligonucleotide
aaugcacugauuuuuccuagg

SEQ ID NO: 16716 - RNA, 21 nt, Artificial Sequence
  Description of Artificial Sequence: Synthetic oligonucleotide
augcacugauuuuuccuagga

SEQ ID NO: 16717 - RNA, 21 nt, Artificial Sequence
  Description of Artificial Sequence: Synthetic oligonucleotide
ugcacugauuuuuccuaggag

SEQ ID NO: 16718 - RNA, 21 nt, Artificial Sequence
  Description of Artificial Sequence: Synthetic oligonucleotide
gcacugauuuuuccuaggagu

SEQ ID NO: 16719 - RNA, 21 nt, Artificial Sequence
  Description of Artificial Sequence: Synthetic oligonucleotide
cacugauuuuuccuaggagua

SEQ ID NO: 16720 - RNA, 21 nt, Artificial Sequence
  Description of Artificial Sequence: Synthetic oligonucleotide
acugauuuuuccuaggaguag

SEQ ID NO: 16721 - RNA, 21 nt, Artificial Sequence
  Description of Artificial Sequence: Synthetic oligonucleotide
cugauuuuuccuaggaguaga

SEQ ID NO: 16722 - RNA, 21 nt, Artificial Sequence
  Description of Artificial Sequence: Synthetic oligonucleotide
ugauuuuuccuaggaguagac

SEQ ID NO: 16723 - RNA, 21 nt, Artificial Sequence
  Description of Artificial Sequence: Synthetic oligonucleotide
gauuuuuccuaggaguagaca

SEQ ID NO: 16724 - RNA, 21 nt, Artificial Sequence
  Description of Artificial Sequence: Synthetic oligonucleotide
auuuuuccuaggaguagacau

SEQ ID NO: 16725 - RNA, 21 nt, Artificial Sequence
  Description of Artificial Sequence: Synthetic oligonucleotide
uuuuuccuaggaguagacaug

SEQ ID NO: 16726 - RNA, 21 nt, Artificial Sequence
  Description of Artificial Sequence: Synthetic oligonucleotide
uuuuccuaggaguagacaugu

SEQ ID NO: 16727 - RNA, 21 nt, Artificial Sequence
  Description of Artificial Sequence: Synthetic oligonucleotide
uuuccuaggaguagacauguu

SEQ ID NO: 16728 - RNA, 21 nt, Artificial Sequence
  Description of Artificial Sequence: Synthetic oligonucleotide
uuccuaggaguagacauguuc

SEQ ID NO: 16729 - RNA, 21 nt, Artificial Sequence
  Description of Artificial Sequence: Synthetic oligonucleotide
uccuaggaguagacauguucc

SEQ ID NO: 16730 - RNA, 21 nt, Artificial Sequence
  Description of Artificial Sequence: Synthetic oligonucleotide
ccuaggaguagacauguuccu

SEQ ID NO: 16731 - RNA, 21 nt, Artificial Sequence
  Description of Artificial Sequence: Synthetic oligonucleotide
cuaggaguagacauguuccuc

SEQ ID NO: 16732 - RNA, 21 nt, Artificial Sequence
  Description of Artificial Sequence: Synthetic oligonucleotide
uaggaguagacauguuccucu

SEQ ID NO: 16733 - RNA, 21 nt, Artificial Sequence
  Description of Artificial Sequence: Synthetic oligonucleotide
aggaguagacauguuccucua

SEQ ID NO: 16734 - RNA, 21 nt, Artificial Sequence
  Description of Artificial Sequence: Synthetic oligonucleotide
ggaguagacauguuccucuaa

SEQ ID NO: 16735 - RNA, 21 nt, Artificial Sequence
  Description of Artificial Sequence: Synthetic oligonucleotide
gaguagacauguuccucuaau

SEQ ID NO: 16736 - RNA, 21 nt, Artificial Sequence
  Description of Artificial Sequence: Synthetic oligonucleotide
aguagacauguuccucuaauu

SEQ ID NO: 16737 - RNA, 21 nt, Artificial Sequence
  Description of Artificial Sequence: Synthetic oligonucleotide
guagacauguuccucuaauua

SEQ ID NO: 16738 - RNA, 21 nt, Artificial Sequence
  Description of Artificial Sequence: Synthetic oligonucleotide
uagacauguuccucuaauuac

SEQ ID NO: 16739 - RNA, 21 nt, Artificial Sequence
  Description of Artificial Sequence: Synthetic oligonucleotide
agacauguuccucuaauuacu

SEQ ID NO: 16740 - RNA, 21 nt, Artificial Sequence
  Description of Artificial Sequence: Synthetic oligonucleotide
gacauguuccucuaauuacuc

SEQ ID NO: 16741 - RNA, 21 nt, Artificial Sequence
  Description of Artificial Sequence: Synthetic oligonucleotide
acauguuccucuaauuacucc

SEQ ID NO: 16742 - RNA, 21 nt, Artificial Sequence
  Description of Artificial Sequence: Synthetic oligonucleotide
cauguuccucuaauuacuccc

SEQ ID NO: 16743 - RNA, 21 nt, Artificial Sequence
  Description of Artificial Sequence: Synthetic oligonucleotide
auguuccucuaauuacucccu

SEQ ID NO: 16744 - RNA, 21 nt, Artificial Sequence
  Description of Artificial Sequence: Synthetic oligonucleotide
uguuccucuaauuacucccug

SEQ ID NO: 16745 - RNA, 21 nt, Artificial Sequence
  Description of Artificial Sequence: Synthetic oligonucleotide
guuccucuaauuacucccuga

SEQ ID NO: 16746 - RNA, 21 nt, Artificial Sequence
  Description of Artificial Sequence: Synthetic oligonucleotide
uuccucuaauuacucccugag

SEQ ID NO: 16747 - RNA, 21 nt, Artificial Sequence
  Description of Artificial Sequence: Synthetic oligonucleotide
uccucuaauuacucccugagg

SEQ ID NO: 16748 - RNA, 21 nt, Artificial Sequence
  Description of Artificial Sequence: Synthetic oligonucleotide
ccucuaauuacucccugaggg

SEQ ID NO: 16749 - RNA, 21 nt, Artificial Sequence
  Description of Artificial Sequence: Synthetic oligonucleotide
cucuaauuacucccugagggu

SEQ ID NO: 16750 - RNA, 21 nt, Artificial Sequence
  Description of Artificial Sequence: Synthetic oligonucleotide
ucuaauuacucccugaggguu

SEQ ID NO: 16751 - RNA, 21 nt, Artificial Sequence
  Description of Artificial Sequence: Synthetic oligonucleotide
cuaauuacucccugaggguua

SEQ ID NO: 16752 - RNA, 21 nt, Artificial Sequence
  Description of Artificial Sequence: Synthetic oligonucleotide
uaauuacucccugaggguuag

SEQ ID NO: 16753 - RNA, 21 nt, Artificial Sequence
  Description of Artificial Sequence: Synthetic oligonucleotide
aauuacucccugaggguuagu

SEQ ID NO: 16754 - RNA, 21 nt, Artificial Sequence
  Description of Artificial Sequence: Synthetic oligonucleotide
auuacucccugaggguuaguu

SEQ ID NO: 16755 - RNA, 21 nt, Artificial Sequence
  Description of Artificial Sequence: Synthetic oligonucleotide
uuacucccugaggguuaguug

SEQ ID NO: 16756 - RNA, 21 nt, Artificial Sequence
  Description of Artificial Sequence: Synthetic oligonucleotide
uacucccugaggguuaguugg

SEQ ID NO: 16757 - RNA, 21 nt, Artificial Sequence
  Description of Artificial Sequence: Synthetic oligonucleotide
acucccugaggguuaguuggg

SEQ ID NO: 16758 - RNA, 21 nt, Artificial Sequence
  Description of Artificial Sequence: Synthetic oligonucleotide
cucccugaggguuaguugggg

SEQ ID NO: 16759 - RNA, 21 nt, Artificial Sequence
  Description of Artificial Sequence: Synthetic oligonucleotide
ucccugaggguuaguuggggc

SEQ ID NO: 16760 - RNA, 21 nt, Artificial Sequence
  Description of Artificial Sequence: Synthetic oligonucleotide
cccugaggguuaguuggggcu

SEQ ID NO: 16761 - RNA, 21 nt, Artificial Sequence
  Description of Artificial Sequence: Synthetic oligonucleotide
ccugaggguuaguuggggcua

SEQ ID NO: 16762 - RNA, 21 nt, Artificial Sequence
  Description of Artificial Sequence: Synthetic oligonucleotide
cugaggguuaguuggggcuaa

SEQ ID NO: 16763 - RNA, 21 nt, Artificial Sequence
  Description of Artificial Sequence: Synthetic oligonucleotide
ugaggguuaguuggggcuaaa

SEQ ID NO: 16764 - RNA, 21 nt, Artificial Sequence
  Description of Artificial Sequence: Synthetic oligonucleotide
gaggguuaguuggggcuaaac

SEQ ID NO: 16765 - RNA, 21 nt, Artificial Sequence
  Description of Artificial Sequence: Synthetic oligonucleotide
aggguuaguuggggcuaaacc

SEQ ID NO: 16766 - RNA, 21 nt, Artificial Sequence
  Description of Artificial Sequence: Synthetic oligonucleotide
ggguuaguuggggcuaaacca

SEQ ID NO: 16767 - RNA, 21 nt, Artificial Sequence
  Description of Artificial Sequence: Synthetic oligonucleotide
gguuaguuggggcuaaaccau

SEQ ID NO: 16768 - RNA, 21 nt, Artificial Sequence
  Description of Artificial Sequence: Synthetic oligonucleotide
guuaguuggggcuaaaccaug

SEQ ID NO: 16769 - RNA, 21 nt, Artificial Sequence
  Description of Artificial Sequence: Synthetic oligonucleotide
uuaguuggggcuaaaccauga

SEQ ID NO: 16770 - RNA, 21 nt, Artificial Sequence
  Description of Artificial Sequence: Synthetic oligonucleotide
uaguuggggcuaaaccaugac

SEQ ID NO: 16771 - RNA, 21 nt, Artificial Sequence
  Description of Artificial Sequence: Synthetic oligonucleotide
aguuggggcuaaaccaugaca

SEQ ID NO: 16772 - RNA, 21 nt, Artificial Sequence
  Description of Artificial Sequence: Synthetic oligonucleotide
guuggggcuaaaccaugacag

SEQ ID NO: 16773 - RNA, 21 nt, Artificial Sequence
  Description of Artificial Sequence: Synthetic oligonucleotide
uuggggcuaaaccaugacaga

SEQ ID NO: 16774 - RNA, 21 nt, Artificial Sequence
  Description of Artificial Sequence: Synthetic oligonucleotide
uggggcuaaaccaugacagaa

SEQ ID NO: 16775 - RNA, 21 nt, Artificial Sequence
  Description of Artificial Sequence: Synthetic oligonucleotide
ggggcuaaaccaugacagaag

SEQ ID NO: 16776 - RNA, 21 nt, Artificial Sequence
  Description of Artificial Sequence: Synthetic oligonucleotide
gggcuaaaccaugacagaagu

SEQ ID NO: 16777 - RNA, 21 nt, Artificial Sequence
  Description of Artificial Sequence: Synthetic oligonucleotide
ggcuaaaccaugacagaagug

SEQ ID NO: 16778 - RNA, 21 nt, Artificial Sequence
  Description of Artificial Sequence: Synthetic oligonucleotide
gcuaaaccaugacagaagugg

SEQ ID NO: 16779 - RNA, 21 nt, Artificial Sequence
  Description of Artificial Sequence: Synthetic oligonucleotide
cuaaaccaugacagaaguggg

SEQ ID NO: 16780 - RNA, 21 nt, Artificial Sequence
  Description of Artificial Sequence: Synthetic oligonucleotide
uaaaccaugacagaagugggg

SEQ ID NO: 16781 - RNA, 21 nt, Artificial Sequence
  Description of Artificial Sequence: Synthetic oligonucleotide
aaaccaugacagaagugggga

SEQ ID NO: 16782 - RNA, 21 nt, Artificial Sequence
  Description of Artificial Sequence: Synthetic oligonucleotide
aaccaugacagaaguggggaa

SEQ ID NO: 16783 - RNA, 21 nt, Artificial Sequence
  Description of Artificial Sequence: Synthetic oligonucleotide
accaugacagaaguggggaag

SEQ ID NO: 16784 - RNA, 21 nt, Artificial Sequence
  Description of Artificial Sequence: Synthetic oligonucleotide
ccaugacagaaguggggaagu

SEQ ID NO: 16785 - RNA, 21 nt, Artificial Sequence
  Description of Artificial Sequence: Synthetic oligonucleotide
caugacagaaguggggaaguu

SEQ ID NO: 16786 - RNA, 21 nt, Artificial Sequence
  Description of Artificial Sequence: Synthetic oligonucleotide
augacagaaguggggaaguuc

SEQ ID NO: 16787 - RNA, 21 nt, Artificial Sequence
  Description of Artificial Sequence: Synthetic oligonucleotide
ugacagaaguggggaaguuca

SEQ ID NO: 16788 - RNA, 21 nt, Artificial Sequence
  Description of Artificial Sequence: Synthetic oligonucleotide
gacagaaguggggaaguucaa

SEQ ID NO: 16789 - RNA, 21 nt, Artificial Sequence
  Description of Artificial Sequence: Synthetic oligonucleotide
acagaaguggggaaguucaau

SEQ ID NO: 16790 - RNA, 21 nt, Artificial Sequence
  Description of Artificial Sequence: Synthetic oligonucleotide
cagaaguggggaaguucaaug

SEQ ID NO: 16791 - RNA, 21 nt, Artificial Sequence
  Description of Artificial Sequence: Synthetic oligonucleotide
agaaguggggaaguucaaugu

SEQ ID NO: 16792 - RNA, 21 nt, Artificial Sequence
  Description of Artificial Sequence: Synthetic oligonucleotide
gaaguggggaaguucaauguc

SEQ ID NO: 16793 - RNA, 21 nt, Artificial Sequence
  Description of Artificial Sequence: Synthetic oligonucleotide
aaguggggaaguucaaugucc

SEQ ID NO: 16794 - RNA, 21 nt, Artificial Sequence
  Description of Artificial Sequence: Synthetic oligonucleotide
aguggggaaguucaauguccu

SEQ ID NO: 16795 - RNA, 21 nt, Artificial Sequence
  Description of Artificial Sequence: Synthetic oligonucleotide
guggggaaguucaauguccuu

SEQ ID NO: 16796 - RNA, 21 nt, Artificial Sequence
  Description of Artificial Sequence: Synthetic oligonucleotide
uggggaaguucaauguccuua

SEQ ID NO: 16797 - RNA, 21 nt, Artificial Sequence
  Description of Artificial Sequence: Synthetic oligonucleotide
ggggaaguucaauguccuuaa

SEQ ID NO: 16798 - RNA, 21 nt, Artificial Sequence
  Description of Artificial Sequence: Synthetic oligonucleotide
gggaaguucaauguccuuaaa

SEQ ID NO: 16799 - RNA, 21 nt, Artificial Sequence
  Description of Artificial Sequence: Synthetic oligonucleotide
ggaaguucaauguccuuaaau

SEQ ID NO: 16800 - RNA, 21 nt, Artificial Sequence
  Description of Artificial Sequence: Synthetic oligonucleotide
gaaguucaauguccuuaaauc

SEQ ID NO: 16801 - RNA, 21 nt, Artificial Sequence
  Description of Artificial Sequence: Synthetic oligonucleotide
aaguucaauguccuuaaaucc

SEQ ID NO: 16802 - RNA, 21 nt, Artificial Sequence
  Description of Artificial Sequence: Synthetic oligonucleotide
aguucaauguccuuaaaucca

SEQ ID NO: 16803 - RNA, 21 nt, Artificial Sequence
  Description of Artificial Sequence: Synthetic oligonucleotide
guucaauguccuuaaauccau

SEQ ID NO: 16804 - RNA, 21 nt, Artificial Sequence
  Description of Artificial Sequence: Synthetic oligonucleotide
uucaauguccuuaaauccauc

SEQ ID NO: 16805 - RNA, 21 nt, Artificial Sequence
  Description of Artificial Sequence: Synthetic oligonucleotide
ucaauguccuuaaauccaucu

SEQ ID NO: 16806 - RNA, 21 nt, Artificial Sequence
  Description of Artificial Sequence: Synthetic oligonucleotide
caauguccuuaaauccaucuu

SEQ ID NO: 16807 - RNA, 21 nt, Artificial Sequence
  Description of Artificial Sequence: Synthetic oligonucleotide
aauguccuuaaauccaucuua

SEQ ID NO: 16808 - RNA, 21 nt, Artificial Sequence
  Description of Artificial Sequence: Synthetic oligonucleotide
auguccuuaaauccaucuuac

SEQ ID NO: 16809 - RNA, 21 nt, Artificial Sequence
  Description of Artificial Sequence: Synthetic oligonucleotide
uguccuuaaauccaucuuacu

SEQ ID NO: 16810 - RNA, 21 nt, Artificial Sequence
  Description of Artificial Sequence: Synthetic oligonucleotide
guccuuaaauccaucuuacuu

SEQ ID NO: 16811 - RNA, 21 nt, Artificial Sequence
  Description of Artificial Sequence: Synthetic oligonucleotide
uccuuaaauccaucuuacuug

SEQ ID NO: 16812 - RNA, 21 nt, Artificial Sequence
  Description of Artificial Sequence: Synthetic oligonucleotide
ccuuaaauccaucuuacuugc

SEQ ID NO: 16813 - RNA, 21 nt, Artificial Sequence
  Description of Artificial Sequence: Synthetic oligonucleotide
cuuaaauccaucuuacuugcc

SEQ ID NO: 16814 - RNA, 21 nt, Artificial Sequence
  Description of Artificial Sequence: Synthetic oligonucleotide
uuaaauccaucuuacuugcca

SEQ ID NO: 16815 - RNA, 21 nt, Artificial Sequence
  Description of Artificial Sequence: Synthetic oligonucleotide
uaaauccaucuuacuugccaa

SEQ ID NO: 16816 - RNA, 21 nt, Artificial Sequence
  Description of Artificial Sequence: Synthetic oligonucleotide
aaauccaucuuacuugccaac

SEQ ID NO: 16817 - RNA, 21 nt, Artificial Sequence
  Description of Artificial Sequence: Synthetic oligonucleotide
aauccaucuuacuugccaaca

SEQ ID NO: 16818 - RNA, 21 nt, Artificial Sequence
  Description of Artificial Sequence: Synthetic oligonucleotide
auccaucuuacuugccaacag

SEQ ID NO: 16819 - RNA, 21 nt, Artificial Sequence
  Description of Artificial Sequence: Synthetic oligonucleotide
uccaucuuacuugccaacagg

SEQ ID NO: 16820 - RNA, 21 nt, Artificial Sequence
  Description of Artificial Sequence: Synthetic oligonucleotide
ccaucuuacuugccaacaggu

SEQ ID NO: 16821 - RNA, 21 nt, Artificial Sequence
  Description of Artificial Sequence: Synthetic oligonucleotide
caucuuacuugccaacaggua

SEQ ID NO: 16822 - RNA, 21 nt, Artificial Sequence
  Description of Artificial Sequence: Synthetic oligonucleotide
aucuuacuugccaacagguaa

SEQ ID NO: 16823 - RNA, 21 nt, Artificial Sequence
  Description of Artificial Sequence: Synthetic oligonucleotide
ucuuacuugccaacagguaag

SEQ ID NO: 16824 - RNA, 21 nt, Artificial Sequence
  Description of Artificial Sequence: Synthetic oligonucleotide
cuuacuugccaacagguaaga

SEQ ID NO: 16825 - RNA, 21 nt, Artificial Sequence
  Description of Artificial Sequence: Synthetic oligonucleotide
uuacuugccaacagguaagag

SEQ ID NO: 16826 - RNA, 21 nt, Artificial Sequence
  Description of Artificial Sequence: Synthetic oligonucleotide
uacuugccaacagguaagagg

SEQ ID NO: 16827 - RNA, 21 nt, Artificial Sequence
  Description of Artificial Sequence: Synthetic oligonucleotide
acuugccaacagguaagagga

SEQ ID NO: 16828 - RNA, 21 nt, Artificial Sequence
  Description of Artificial Sequence: Synthetic oligonucleotide
cuugccaacagguaagaggaa

SEQ ID NO: 16829 - RNA, 21 nt, Artificial Sequence
  Description of Artificial Sequence: Synthetic oligonucleotide
uugccaacagguaagaggaag

SEQ ID NO: 16830 - RNA, 21 nt, Artificial Sequence
  Description of Artificial Sequence: Synthetic oligonucleotide
ugccaacagguaagaggaagc

SEQ ID NO: 16831 - RNA, 21 nt, Artificial Sequence
  Description of Artificial Sequence: Synthetic oligonucleotide
gccaacagguaagaggaagcu

SEQ ID NO: 16832 - RNA, 21 nt, Artificial Sequence
  Description of Artificial Sequence: Synthetic oligonucleotide
ccaacagguaagaggaagcuu

SEQ ID NO: 16833 - RNA, 21 nt, Artificial Sequence
  Description of Artificial Sequence: Synthetic oligonucleotide
caacagguaagaggaagcuua

SEQ ID NO: 16834 - RNA, 21 nt, Artificial Sequence
  Description of Artificial Sequence: Synthetic oligonucleotide
aacagguaagaggaagcuuac

SEQ ID NO: 16835 - RNA, 21 nt, Artificial Sequence
  Description of Artificial Sequence: Synthetic oligonucleotide
acagguaagaggaagcuuaca

SEQ ID NO: 16836 - RNA, 21 nt, Artificial Sequence
  Description of Artificial Sequence: Synthetic oligonucleotide
cagguaagaggaagcuuacau

SEQ ID NO: 16837 - RNA, 21 nt, Artificial Sequence
  Description of Artificial Sequence: Synthetic oligonucleotide
agguaagaggaagcuuacauu

SEQ ID NO: 16838 - RNA, 21 nt, Artificial Sequence
  Description of Artificial Sequence: Synthetic oligonucleotide
gguaagaggaagcuuacauua

SEQ ID NO: 16839 - RNA, 21 nt, Artificial Sequence
  Description of Artificial Sequence: Synthetic oligonucleotide
guaagaggaagcuuacauuac

SEQ ID NO: 16840 - RNA, 21 nt, Artificial Sequence
  Description of Artificial Sequence: Synthetic oligonucleotide
uaagaggaagcuuacauuaca

SEQ ID NO: 16841 - RNA, 21 nt, Artificial Sequence
  Description of Artificial Sequence: Synthetic oligonucleotide
aagaggaagcuuacauuacau

SEQ ID NO: 16842 - RNA, 21 nt, Artificial Sequence
  Description of Artificial Sequence: Synthetic oligonucleotide
agaggaagcuuacauuacaug

SEQ ID NO: 16843 - RNA, 21 nt, Artificial Sequence
  Description of Artificial Sequence: Synthetic oligonucleotide
gaggaagcuuacauuacaugu

SEQ ID NO: 16844 - RNA, 21 nt, Artificial Sequence
  Description of Artificial Sequence: Synthetic oligonucleotide
aggaagcuuacauuacauguc

SEQ ID NO: 16845 - RNA, 21 nt, Artificial Sequence
  Description of Artificial Sequence: Synthetic oligonucleotide
ggaagcuuacauuacaugucc

SEQ ID NO: 16846 - RNA, 21 nt, Artificial Sequence
  Description of Artificial Sequence: Synthetic oligonucleotide
gaagcuuacauuacaugucca

SEQ ID NO: 16847 - RNA, 21 nt, Artificial Sequence
  Description of Artificial Sequence: Synthetic oligonucleotide
aagcuuacauuacauguccag

SEQ ID NO: 16848 - RNA, 21 nt, Artificial Sequence
  Description of Artificial Sequence: Synthetic oligonucleotide
agcuuacauuacauguccagu

SEQ ID NO: 16849 - RNA, 21 nt, Artificial Sequence
  Description of Artificial Sequence: Synthetic oligonucleotide
gcuuacauuacauguccaguc

SEQ ID NO: 16850 - RNA, 21 nt, Artificial Sequence
  Description of Artificial Sequence: Synthetic oligonucleotide
cuuacauuacauguccagucc

SEQ ID NO: 16851 - RNA, 21 nt, Artificial Sequence
  Description of Artificial Sequence: Synthetic oligonucleotide
uuacauuacauguccagucca

SEQ ID NO: 16852 - RNA, 21 nt, Artificial Sequence
  Description of Artificial Sequence: Synthetic oligonucleotide
uacauuacauguccaguccac

SEQ ID NO: 16853 - RNA, 21 nt, Artificial Sequence
  Description of Artificial Sequence: Synthetic oligonucleotide
acauuacauguccaguccaca

SEQ ID NO: 16854 - RNA, 21 nt, Artificial Sequence
  Description of Artificial Sequence: Synthetic oligonucleotide
cauuacauguccaguccacau

SEQ ID NO: 16855 - RNA, 21 nt, Artificial Sequence
  Description of Artificial Sequence: Synthetic oligonucleotide
auuacauguccaguccacauu

SEQ ID NO: 16856 - RNA, 21 nt, Artificial Sequence
  Description of Artificial Sequence: Synthetic oligonucleotide
uuacauguccaguccacauuu

SEQ ID NO: 16857 - RNA, 21 nt, Artificial Sequence
  Description of Artificial Sequence: Synthetic oligonucleotide
uacauguccaguccacauuua

SEQ ID NO: 16858 - RNA, 21 nt, Artificial Sequence
  Description of Artificial Sequence: Synthetic oligonucleotide
acauguccaguccacauuuaa

SEQ ID NO: 16859 - RNA, 21 nt, Artificial Sequence
  Description of Artificial Sequence: Synthetic oligonucleotide
cauguccaguccacauuuaaa

SEQ ID NO: 16860 - RNA, 21 nt, Artificial Sequence
  Description of Artificial Sequence: Synthetic oligonucleotide
auguccaguccacauuuaaag

SEQ ID NO: 16861 - RNA, 21 nt, Artificial Sequence
  Description of Artificial Sequence: Synthetic oligonucleotide
uguccaguccacauuuaaaga

SEQ ID NO: 16862 - RNA, 21 nt, Artificial Sequence
  Description of Artificial Sequence: Synthetic oligonucleotide
guccaguccacauuuaaagag

SEQ ID NO: 16863 - RNA, 21 nt, Artificial Sequence
  Description of Artificial Sequence: Synthetic oligonucleotide
uccaguccacauuuaaagagc

SEQ ID NO: 16864 - RNA, 21 nt, Artificial Sequence
  Description of Artificial Sequence: Synthetic oligonucleotide
ccaguccacauuuaaagagca

SEQ ID NO: 16865 - RNA, 21 nt, Artificial Sequence
  Description of Artificial Sequence: Synthetic oligonucleotide
caguccacauuuaaagagcac

SEQ ID NO: 16866 - RNA, 21 nt, Artificial Sequence
  Description of Artificial Sequence: Synthetic oligonucleotide
aguccacauuuaaagagcacu

SEQ ID NO: 16867 - RNA, 21 nt, Artificial Sequence
  Description of Artificial Sequence: Synthetic oligonucleotide
guccacauuuaaagagcacuu

SEQ ID NO: 16868 - RNA, 21 nt, Artificial Sequence
  Description of Artificial Sequence: Synthetic oligonucleotide
uccacauuuaaagagcacuua

SEQ ID NO: 16869 - RNA, 21 nt, Artificial Sequence
  Description of Artificial Sequence: Synthetic oligonucleotide
ccacauuuaaagagcacuuac

SEQ ID NO: 16870 - RNA, 21 nt, Artificial Sequence
  Description of Artificial Sequence: Synthetic oligonucleotide
cacauuuaaagagcacuuacu

SEQ ID NO: 16871 - RNA, 21 nt, Artificial Sequence
  Description of Artificial Sequence: Synthetic oligonucleotide
acauuuaaagagcacuuacug

SEQ ID NO: 16872 - RNA, 21 nt, Artificial Sequence
  Description of Artificial Sequence: Synthetic oligonucleotide
cauuuaaagagcacuuacugu

SEQ ID NO: 16873 - RNA, 21 nt, Artificial Sequence
  Description of Artificial Sequence: Synthetic oligonucleotide
auuuaaagagcacuuacugug

SEQ ID NO: 16874 - RNA, 21 nt, Artificial Sequence
  Description of Artificial Sequence: Synthetic oligonucleotide
uuuaaagagcacuuacugugg

SEQ ID NO: 16875 - RNA, 21 nt, Artificial Sequence
  Description of Artificial Sequence: Synthetic oligonucleotide
uuaaagagcacuuacugugga

SEQ ID NO: 16876 - RNA, 21 nt, Artificial Sequence
  Description of Artificial Sequence: Synthetic oligonucleotide
uaaagagcacuuacuguggaa

SEQ ID NO: 16877 - RNA, 21 nt, Artificial Sequence
  Description of Artificial Sequence: Synthetic oligonucleotide
aaagagcacuuacuguggaac

SEQ ID NO: 16878 - RNA, 21 nt, Artificial Sequence
  Description of Artificial Sequence: Synthetic oligonucleotide
aagagcacuuacuguggaaca

SEQ ID NO: 16879 - RNA, 21 nt, Artificial Sequence
  Description of Artificial Sequence: Synthetic oligonucleotide
agagcacuuacuguggaacaa

SEQ ID NO: 16880 - RNA, 21 nt, Artificial Sequence
  Description of Artificial Sequence: Synthetic oligonucleotide
gagcacuuacuguggaacaag

SEQ ID NO: 16881 - RNA, 21 nt, Artificial Sequence
  Description of Artificial Sequence: Synthetic oligonucleotide
agcacuuacuguggaacaagc

SEQ ID NO: 16882 - RNA, 21 nt, Artificial Sequence
  Description of Artificial Sequence: Synthetic oligonucleotide
gcacuuacuguggaacaagcc

SEQ ID NO: 16883 - RNA, 21 nt, Artificial Sequence
  Description of Artificial Sequence: Synthetic oligonucleotide
cacuuacuguggaacaagccu

SEQ ID NO: 16884 - RNA, 21 nt, Artificial Sequence
  Description of Artificial Sequence: Synthetic oligonucleotide
acuuacuguggaacaagccuu

SEQ ID NO: 16885 - RNA, 21 nt, Artificial Sequence
  Description of Artificial Sequence: Synthetic oligonucleotide
cuuacuguggaacaagccuuc

SEQ ID NO: 16886 - RNA, 21 nt, Artificial Sequence
  Description of Artificial Sequence: Synthetic oligonucleotide
uuacuguggaacaagccuuca

SEQ ID NO: 16887 - RNA, 21 nt, Artificial Sequence
  Description of Artificial Sequence: Synthetic oligonucleotide
uacuguggaacaagccuucag

SEQ ID NO: 16888 - RNA, 21 nt, Artificial Sequence
  Description of Artificial Sequence: Synthetic oligonucleotide
acuguggaacaagccuucagc

SEQ ID NO: 16889 - RNA, 21 nt, Artificial Sequence
  Description of Artificial Sequence: Synthetic oligonucleotide
cuguggaacaagccuucagcc

SEQ ID NO: 16890 - RNA, 21 nt, Artificial Sequence
  Description of Artificial Sequence: Synthetic oligonucleotide
uguggaacaagccuucagcca

SEQ ID NO: 16891 - RNA, 21 nt, Artificial Sequence
  Description of Artificial Sequence: Synthetic oligonucleotide
guggaacaagccuucagccaa

SEQ ID NO: 16892 - RNA, 21 nt, Artificial Sequence
  Description of Artificial Sequence: Synthetic oligonucleotide
uggaacaagccuucagccaaa

SEQ ID NO: 16893 - RNA, 21 nt, Artificial Sequence
  Description of Artificial Sequence: Synthetic oligonucleotide
ggaacaagccuucagccaaac

SEQ ID NO: 16894 - RNA, 21 nt, Artificial Sequence
  Description of Artificial Sequence: Synthetic oligonucleotide
gaacaagccuucagccaaaca

SEQ ID NO: 16895 - RNA, 21 nt, Artificial Sequence
  Description of Artificial Sequence: Synthetic oligonucleotide
aacaagccuucagccaaacaa

SEQ ID NO: 16896 - RNA, 21 nt, Artificial Sequence
  Description of Artificial Sequence: Synthetic oligonucleotide
acaagccuucagccaaacaau

SEQ ID NO: 16897 - RNA, 21 nt, Artificial Sequence
  Description of Artificial Sequence: Synthetic oligonucleotide
caagccuucagccaaacaaug

SEQ ID NO: 16898 - RNA, 21 nt, Artificial Sequence
  Description of Artificial Sequence: Synthetic oligonucleotide
aagccuucagccaaacaaugg

SEQ ID NO: 16899 - RNA, 21 nt, Artificial Sequence
  Description of Artificial Sequence: Synthetic oligonucleotide
agccuucagccaaacaauggg

SEQ ID NO: 16900 - RNA, 21 nt, Artificial Sequence
  Description of Artificial Sequence: Synthetic oligonucleotide
gccuucagccaaacaaugggg

SEQ ID NO: 16901 - RNA, 21 nt, Artificial Sequence
  Description of Artificial Sequence: Synthetic oligonucleotide
ccuucagccaaacaaugggga

SEQ ID NO: 16902 - RNA, 21 nt, Artificial Sequence
  Description of Artificial Sequence: Synthetic oligonucleotide
cuucagccaaacaauggggau

SEQ ID NO: 16903 - RNA, 21 nt, Artificial Sequence
  Description of Artificial Sequence: Synthetic oligonucleotide
uucagccaaacaauggggaua

SEQ ID NO: 16904 - RNA, 21 nt, Artificial Sequence
  Description of Artificial Sequence: Synthetic oligonucleotide
ucagccaaacaauggggauag

SEQ ID NO: 16905 - RNA, 21 nt, Artificial Sequence
  Description of Artificial Sequence: Synthetic oligonucleotide
cagccaaacaauggggauaga

SEQ ID NO: 16906 - RNA, 21 nt, Artificial Sequence
  Description of Artificial Sequence: Synthetic oligonucleotide
agccaaacaauggggauagaa

SEQ ID NO: 16907 - RNA, 21 nt, Artificial Sequence
  Description of Artificial Sequence: Synthetic oligonucleotide
gccaaacaauggggauagaaa

SEQ ID NO: 16908 - RNA, 21 nt, Artificial Sequence
  Description of Artificial Sequence: Synthetic oligonucleotide
ccaaacaauggggauagaaaa

SEQ ID NO: 16909 - RNA, 21 nt, Artificial Sequence
  Description of Artificial Sequence: Synthetic oligonucleotide
caaacaauggggauagaaaag

SEQ ID NO: 16910 - RNA, 21 nt, Artificial Sequence
  Description of Artificial Sequence: Synthetic oligonucleotide
aaacaauggggauagaaaagu

SEQ ID NO: 16911 - RNA, 21 nt, Artificial Sequence
  Description of Artificial Sequence: Synthetic oligonucleotide
aacaauggggauagaaaagua

SEQ ID NO: 16912 - RNA, 21 nt, Artificial Sequence
  Description of Artificial Sequence: Synthetic oligonucleotide
acaauggggauagaaaaguag

SEQ ID NO: 16913 - RNA, 21 nt, Artificial Sequence
  Description of Artificial Sequence: Synthetic oligonucleotide
caauggggauagaaaaguagg

SEQ ID NO: 16914 - RNA, 21 nt, Artificial Sequence
  Description of Artificial Sequence: Synthetic oligonucleotide
aauggggauagaaaaguaggu

SEQ ID NO: 16915 - RNA, 21 nt, Artificial Sequence
  Description of Artificial Sequence: Synthetic oligonucleotide
auggggauagaaaaguaggua

SEQ ID NO: 16916 - RNA, 21 nt, Artificial Sequence
  Description of Artificial Sequence: Synthetic oligonucleotide
uggggauagaaaaguagguaa

SEQ ID NO: 16917 - RNA, 21 nt, Artificial Sequence
  Description of Artificial Sequence: Synthetic oligonucleotide
ggggauagaaaaguagguaag

SEQ ID NO: 16918 - RNA, 21 nt, Artificial Sequence
  Description of Artificial Sequence: Synthetic oligonucleotide
gggauagaaaaguagguaaga

SEQ ID NO: 16919 - RNA, 21 nt, Artificial Sequence
  Description of Artificial Sequence: Synthetic oligonucleotide
ggauagaaaaguagguaagac

SEQ ID NO: 16920 - RNA, 21 nt, Artificial Sequence
  Description of Artificial Sequence: Synthetic oligonucleotide
gauagaaaaguagguaagacu

SEQ ID NO: 16921 - RNA, 21 nt, Artificial Sequence
  Description of Artificial Sequence: Synthetic oligonucleotide
auagaaaaguagguaagacuc

SEQ ID NO: 16922 - RNA, 21 nt, Artificial Sequence
  Description of Artificial Sequence: Synthetic oligonucleotide
uagaaaaguagguaagacuca

SEQ ID NO: 16923 - RNA, 21 nt, Artificial Sequence
  Description of Artificial Sequence: Synthetic oligonucleotide
agaaaaguagguaagacucag

SEQ ID NO: 16924 - RNA, 21 nt, Artificial Sequence
  Description of Artificial Sequence: Synthetic oligonucleotide
gaaaaguagguaagacucagc

SEQ ID NO: 16925 - RNA, 21 nt, Artificial Sequence
  Description of Artificial Sequence: Synthetic oligonucleotide
aaaaguagguaagacucagcc

SEQ ID NO: 16926 - RNA, 21 nt, Artificial Sequence
  Description of Artificial Sequence: Synthetic oligonucleotide
aaaguagguaagacucagccu

SEQ ID NO: 16927 - RNA, 21 nt, Artificial Sequence
  Description of Artificial Sequence: Synthetic oligonucleotide
aaguagguaagacucagccuu

SEQ ID NO: 16928 - RNA, 21 nt, Artificial Sequence
  Description of Artificial Sequence: Synthetic oligonucleotide
aguagguaagacucagccuuu

SEQ ID NO: 16929 - RNA, 21 nt, Artificial Sequence
  Description of Artificial Sequence: Synthetic oligonucleotide
guagguaagacucagccuuug

SEQ ID NO: 16930 - RNA, 21 nt, Artificial Sequence
  Description of Artificial Sequence: Synthetic oligonucleotide
uagguaagacucagccuuugu

SEQ ID NO: 16931 - RNA, 21 nt, Artificial Sequence
  Description of Artificial Sequence: Synthetic oligonucleotide
agguaagacucagccuuuguc

SEQ ID NO: 16932 - RNA, 21 nt, Artificial Sequence
  Description of Artificial Sequence: Synthetic oligonucleotide
gguaagacucagccuuugucc

SEQ ID NO: 16933 - RNA, 21 nt, Artificial Sequence
  Description of Artificial Sequence: Synthetic oligonucleotide
guaagacucagccuuugucca

SEQ ID NO: 16934 - RNA, 21 nt, Artificial Sequence
  Description of Artificial Sequence: Synthetic oligonucleotide
uaagacucagccuuuguccag

SEQ ID NO: 16935 - RNA, 21 nt, Artificial Sequence
  Description of Artificial Sequence: Synthetic oligonucleotide
aagacucagccuuuguccaga

SEQ ID NO: 16936 - RNA, 21 nt, Artificial Sequence
  Description of Artificial Sequence: Synthetic oligonucleotide
agacucagccuuuguccagag

SEQ ID NO: 16937 - RNA, 21 nt, Artificial Sequence
  Description of Artificial Sequence: Synthetic oligonucleotide
gacucagccuuuguccagaga

SEQ ID NO: 16938 - RNA, 21 nt, Artificial Sequence
  Description of Artificial Sequence: Synthetic oligonucleotide
acucagccuuuguccagagaa

SEQ ID NO: 16939 - RNA, 21 nt, Artificial Sequence
  Description of Artificial Sequence: Synthetic oligonucleotide
cucagccuuuguccagagaag

SEQ ID NO: 16940 - RNA, 21 nt, Artificial Sequence
  Description of Artificial Sequence: Synthetic oligonucleotide
ucagccuuuguccagagaagc

SEQ ID NO: 16941 - RNA, 21 nt, Artificial Sequence
  Description of Artificial Sequence: Synthetic oligonucleotide
cagccuuuguccagagaagcu

SEQ ID NO: 16942 - RNA, 21 nt, Artificial Sequence
  Description of Artificial Sequence: Synthetic oligonucleotide
agccuuuguccagagaagcuc

SEQ ID NO: 16943 - RNA, 21 nt, Artificial Sequence
  Description of Artificial Sequence: Synthetic oligonucleotide
gccuuuguccagagaagcuca

SEQ ID NO: 16944 - RNA, 21 nt, Artificial Sequence
  Description of Artificial Sequence: Synthetic oligonucleotide
ccuuuguccagagaagcucag

SEQ ID NO: 16945 - RNA, 21 nt, Artificial Sequence
  Description of Artificial Sequence: Synthetic oligonucleotide
cuuuguccagagaagcucagg

SEQ ID NO: 16946 - RNA, 21 nt, Artificial Sequence
  Description of Artificial Sequence: Synthetic oligonucleotide
uuuguccagagaagcucaggg

SEQ ID NO: 16947 - RNA, 21 nt, Artificial Sequence
  Description of Artificial Sequence: Synthetic oligonucleotide
uuguccagagaagcucagggu

SEQ ID NO: 16948 - RNA, 21 nt, Artificial Sequence
  Description of Artificial Sequence: Synthetic oligonucleotide
uguccagagaagcucagggua

SEQ ID NO: 16949 - RNA, 21 nt, Artificial Sequence
  Description of Artificial Sequence: Synthetic oligonucleotide
guccagagaagcucaggguau

SEQ ID NO: 16950 - RNA, 21 nt, Artificial Sequence
  Description of Artificial Sequence: Synthetic oligonucleotide
uccagagaagcucaggguaua

SEQ ID NO: 16951 - RNA, 21 nt, Artificial Sequence
  Description of Artificial Sequence: Synthetic oligonucleotide
ccagagaagcucaggguauag

SEQ ID NO: 16952 - RNA, 21 nt, Artificial Sequence
  Description of Artificial Sequence: Synthetic oligonucleotide
cagagaagcucaggguauagc

SEQ ID NO: 16953 - RNA, 21 nt, Artificial Sequence
  Description of Artificial Sequence: Synthetic oligonucleotide
agagaagcucaggguauagcu

SEQ ID NO: 16954 - RNA, 21 nt, Artificial Sequence
  Description of Artificial Sequence: Synthetic oligonucleotide
gagaagcucaggguauagcug

SEQ ID NO: 16955 - RNA, 21 nt, Artificial Sequence
  Description of Artificial Sequence: Synthetic oligonucleotide
agaagcucaggguauagcuga

SEQ ID NO: 16956 - RNA, 21 nt, Artificial Sequence
  Description of Artificial Sequence: Synthetic oligonucleotide
gaagcucaggguauagcugaa

SEQ ID NO: 16957 - RNA, 21 nt, Artificial Sequence
  Description of Artificial Sequence: Synthetic oligonucleotide
aagcucaggguauagcugaau

SEQ ID NO: 16958 - RNA, 21 nt, Artificial Sequence
  Description of Artificial Sequence: Synthetic oligonucleotide
agcucaggguauagcugaaua

SEQ ID NO: 16959 - RNA, 21 nt, Artificial Sequence
  Description of Artificial Sequence: Synthetic oligonucleotide
gcucaggguauagcugaauag

SEQ ID NO: 16960 - RNA, 21 nt, Artificial Sequence
  Description of Artificial Sequence: Synthetic oligonucleotide
cucaggguauagcugaauagg

SEQ ID NO: 16961 - RNA, 21 nt, Artificial Sequence
  Description of Artificial Sequence: Synthetic oligonucleotide
ucaggguauagcugaauaggc

SEQ ID NO: 16962 - RNA, 21 nt, Artificial Sequence
  Description of Artificial Sequence: Synthetic oligonucleotide
caggguauagcugaauaggca

SEQ ID NO: 16963 - RNA, 21 nt, Artificial Sequence
  Description of Artificial Sequence: Synthetic oligonucleotide
aggguauagcugaauaggcag

SEQ ID NO: 16964 - RNA, 21 nt, Artificial Sequence
  Description of Artificial Sequence: Synthetic oligonucleotide
ggguauagcugaauaggcagu

SEQ ID NO: 16965 - RNA, 21 nt, Artificial Sequence
  Description of Artificial Sequence: Synthetic oligonucleotide
gguauagcugaauaggcaguu

SEQ ID NO: 16966 - RNA, 21 nt, Artificial Sequence
  Description of Artificial Sequence: Synthetic oligonucleotide
guauagcugaauaggcaguuu

SEQ ID NO: 16967 - RNA, 21 nt, Artificial Sequence
  Description of Artificial Sequence: Synthetic oligonucleotide
uauagcugaauaggcaguuuc

SEQ ID NO: 16968 - RNA, 21 nt, Artificial Sequence
  Description of Artificial Sequence: Synthetic oligonucleotide
auagcugaauaggcaguuucu

SEQ ID NO: 16969 - RNA, 21 nt, Artificial Sequence
  Description of Artificial Sequence: Synthetic oligonucleotide
uagcugaauaggcaguuucuu

SEQ ID NO: 16970 - RNA, 21 nt, Artificial Sequence
  Description of Artificial Sequence: Synthetic oligonucleotide
agcugaauaggcaguuucuuu

SEQ ID NO: 16971 - RNA, 21 nt, Artificial Sequence
  Description of Artificial Sequence: Synthetic oligonucleotide
gcugaauaggcaguuucuuuu

SEQ ID NO: 16972 - RNA, 21 nt, Artificial Sequence
  Description of Artificial Sequence: Synthetic oligonucleotide
cugaauaggcaguuucuuuug

SEQ ID NO: 16973 - RNA, 21 nt, Artificial Sequence
  Description of Artificial Sequence: Synthetic oligonucleotide
ugaauaggcaguuucuuuugu

SEQ ID NO: 16974 - RNA, 21 nt, Artificial Sequence
  Description of Artificial Sequence: Synthetic oligonucleotide
gaauaggcaguuucuuuuguc

SEQ ID NO: 16975 - RNA, 21 nt, Artificial Sequence
  Description of Artificial Sequence: Synthetic oligonucleotide
aauaggcaguuucuuuugucc

SEQ ID NO: 16976 - RNA, 21 nt, Artificial Sequence
  Description of Artificial Sequence: Synthetic oligonucleotide
auaggcaguuucuuuuguccu

SEQ ID NO: 16977 - RNA, 21 nt, Artificial Sequence
  Description of Artificial Sequence: Synthetic oligonucleotide
uaggcaguuucuuuuguccug

SEQ ID NO: 16978 - RNA, 21 nt, Artificial Sequence
  Description of Artificial Sequence: Synthetic oligonucleotide
aggcaguuucuuuuguccuga

SEQ ID NO: 16979 - RNA, 21 nt, Artificial Sequence
  Description of Artificial Sequence: Synthetic oligonucleotide
ggcaguuucuuuuguccugag

SEQ ID NO: 16980 - RNA, 21 nt, Artificial Sequence
  Description of Artificial Sequence: Synthetic oligonucleotide
gcaguuucuuuuguccugagg

SEQ ID NO: 16981 - RNA, 21 nt, Artificial Sequence
  Description of Artificial Sequence: Synthetic oligonucleotide
caguuucuuuuguccugagga

SEQ ID NO: 16982 - RNA, 21 nt, Artificial Sequence
  Description of Artificial Sequence: Synthetic oligonucleotide
aguuucuuuuguccugaggaa

SEQ ID NO: 16983 - RNA, 21 nt, Artificial Sequence
  Description of Artificial Sequence: Synthetic oligonucleotide
guuucuuuuguccugaggaaa

SEQ ID NO: 16984 - RNA, 21 nt, Artificial Sequence
  Description of Artificial Sequence: Synthetic oligonucleotide
uuucuuuuguccugaggaaaa

SEQ ID NO: 16985 - RNA, 21 nt, Artificial Sequence
  Description of Artificial Sequence: Synthetic oligonucleotide
uucuuuuguccugaggaaaau

SEQ ID NO: 16986 - RNA, 21 nt, Artificial Sequence
  Description of Artificial Sequence: Synthetic oligonucleotide
ucuuuuguccugaggaaaauc

SEQ ID NO: 16987 - RNA, 21 nt, Artificial Sequence
  Description of Artificial Sequence: Synthetic oligonucleotide
cuuuuguccugaggaaaauca

SEQ ID NO: 16988 - RNA, 21 nt, Artificial Sequence
  Description of Artificial Sequence: Synthetic oligonucleotide
uuuuguccugaggaaaaucag

SEQ ID NO: 16989 - RNA, 21 nt, Artificial Sequence
  Description of Artificial Sequence: Synthetic oligonucleotide
uuuguccugaggaaaaucagg

SEQ ID NO: 16990 - RNA, 21 nt, Artificial Sequence
  Description of Artificial Sequence: Synthetic oligonucleotide
uuguccugaggaaaaucagga

SEQ ID NO: 16991 - RNA, 21 nt, Artificial Sequence
  Description of Artificial Sequence: Synthetic oligonucleotide
uguccugaggaaaaucaggac

SEQ ID NO: 16992 - RNA, 21 nt, Artificial Sequence
  Description of Artificial Sequence: Synthetic oligonucleotide
guccugaggaaaaucaggaca

SEQ ID NO: 16993 - RNA, 21 nt, Artificial Sequence
  Description of Artificial Sequence: Synthetic oligonucleotide
uccugaggaaaaucaggacau

SEQ ID NO: 16994 - RNA, 21 nt, Artificial Sequence
  Description of Artificial Sequence: Synthetic oligonucleotide
ccugaggaaaaucaggacaug

SEQ ID NO: 16995 - RNA, 21 nt, Artificial Sequence
  Description of Artificial Sequence: Synthetic oligonucleotide
cugaggaaaaucaggacaugc

SEQ ID NO: 16996 - RNA, 21 nt, Artificial Sequence
  Description of Artificial Sequence: Synthetic oligonucleotide
ugaggaaaaucaggacaugcc

SEQ ID NO: 16997 - RNA, 21 nt, Artificial Sequence
  Description of Artificial Sequence: Synthetic oligonucleotide
gaggaaaaucaggacaugccu

SEQ ID NO: 16998 - RNA, 21 nt, Artificial Sequence
  Description of Artificial Sequence: Synthetic oligonucleotide
aggaaaaucaggacaugccug

SEQ ID NO: 16999 - RNA, 21 nt, Artificial Sequence
  Description of Artificial Sequence: Synthetic oligonucleotide
ggaaaaucaggacaugccugc

SEQ ID NO: 17000 - RNA, 21 nt, Artificial Sequence
  Description of Artificial Sequence: Synthetic oligonucleotide
gaaaaucaggacaugccugcu

SEQ ID NO: 17001 - RNA, 21 nt, Artificial Sequence
  Description of Artificial Sequence: Synthetic oligonucleotide
aaaaucaggacaugccugcuu

SEQ ID NO: 17002 - RNA, 21 nt, Artificial Sequence
  Description of Artificial Sequence: Synthetic oligonucleotide
aaaucaggacaugccugcuuu

SEQ ID NO: 17003 - RNA, 21 nt, Artificial Sequence
  Description of Artificial Sequence: Synthetic oligonucleotide
aaucaggacaugccugcuuuc

SEQ ID NO: 17004 - RNA, 21 nt, Artificial Sequence
  Description of Artificial Sequence: Synthetic oligonucleotide
aucaggacaugccugcuuucu

SEQ ID NO: 17005 - RNA, 21 nt, Artificial Sequence
  Description of Artificial Sequence: Synthetic oligonucleotide
ucaggacaugccugcuuucua

SEQ ID NO: 17006 - RNA, 21 nt, Artificial Sequence
  Description of Artificial Sequence: Synthetic oligonucleotide
caggacaugccugcuuucuaa

SEQ ID NO: 17007 - RNA, 21 nt, Artificial Sequence
  Description of Artificial Sequence: Synthetic oligonucleotide
aggacaugccugcuuucuaaa

SEQ ID NO: 17008 - RNA, 21 nt, Artificial Sequence
  Description of Artificial Sequence: Synthetic oligonucleotide
ggacaugccugcuuucuaaaa

SEQ ID NO: 17009 - RNA, 21 nt, Artificial Sequence
  Description of Artificial Sequence: Synthetic oligonucleotide
gacaugccugcuuucuaaaaa

SEQ ID NO: 17010 - RNA, 21 nt, Artificial Sequence
  Description of Artificial Sequence: Synthetic oligonucleotide
acaugccugcuuucuaaaaau

SEQ ID NO: 17011 - RNA, 21 nt, Artificial Sequence
  Description of Artificial Sequence: Synthetic oligonucleotide
caugccugcuuucuaaaaauc

SEQ ID NO: 17012 - RNA, 21 nt, Artificial Sequence
  Description of Artificial Sequence: Synthetic oligonucleotide
augccugcuuucuaaaaaucu

SEQ ID NO: 17013 - RNA, 21 nt, Artificial Sequence
  Description of Artificial Sequence: Synthetic oligonucleotide
ugccugcuuucuaaaaaucuu

SEQ ID NO: 17014 - RNA, 21 nt, Artificial Sequence
  Description of Artificial Sequence: Synthetic oligonucleotide
gccugcuuucuaaaaaucuuc

SEQ ID NO: 17015 - RNA, 21 nt, Artificial Sequence
  Description of Artificial Sequence: Synthetic oligonucleotide
ccugcuuucuaaaaaucuucc

SEQ ID NO: 17016 - RNA, 21 nt, Artificial Sequence
  Description of Artificial Sequence: Synthetic oligonucleotide
cugcuuucuaaaaaucuuccu

SEQ ID NO: 17017 - RNA, 21 nt, Artificial Sequence
  Description of Artificial Sequence: Synthetic oligonucleotide
ugcuuucuaaaaaucuuccuc

SEQ ID NO: 17018 - RNA, 21 nt, Artificial Sequence
  Description of Artificial Sequence: Synthetic oligonucleotide
gcuuucuaaaaaucuuccucu

SEQ ID NO: 17019 - RNA, 21 nt, Artificial Sequence
  Description of Artificial Sequence: Synthetic oligonucleotide
cuuucuaaaaaucuuccucug

SEQ ID NO: 17020 - RNA, 21 nt, Artificial Sequence
  Description of Artificial Sequence: Synthetic oligonucleotide
uuucuaaaaaucuuccucuga

SEQ ID NO: 17021 - RNA, 21 nt, Artificial Sequence
  Description of Artificial Sequence: Synthetic oligonucleotide
uucuaaaaaucuuccucugaa

SEQ ID NO: 17022 - RNA, 21 nt, Artificial Sequence
  Description of Artificial Sequence: Synthetic oligonucleotide
ucuaaaaaucuuccucugaag

SEQ ID NO: 17023 - RNA, 21 nt, Artificial Sequence
  Description of Artificial Sequence: Synthetic oligonucleotide
cuaaaaaucuuccucugaaga

SEQ ID NO: 17024 - RNA, 21 nt, Artificial Sequence
  Description of Artificial Sequence: Synthetic oligonucleotide
uaaaaaucuuccucugaagac

SEQ ID NO: 17025 - RNA, 21 nt, Artificial Sequence
  Description of Artificial Sequence: Synthetic oligonucleotide
aaaaaucuuccucugaagacc

SEQ ID NO: 17026 - RNA, 21 nt, Artificial Sequence
  Description of Artificial Sequence: Synthetic oligonucleotide
aaaaucuuccucugaagaccu

SEQ ID NO: 17027 - RNA, 21 nt, Artificial Sequence
  Description of Artificial Sequence: Synthetic oligonucleotide
aaaucuuccucugaagaccug

SEQ ID NO: 17028 - RNA, 21 nt, Artificial Sequence
  Description of Artificial Sequence: Synthetic oligonucleotide
aaucuuccucugaagaccuga

SEQ ID NO: 17029 - RNA, 21 nt, Artificial Sequence
  Description of Artificial Sequence: Synthetic oligonucleotide
aucuuccucugaagaccugac

SEQ ID NO: 17030 - RNA, 21 nt, Artificial Sequence
  Description of Artificial Sequence: Synthetic oligonucleotide
ucuuccucugaagaccugacc

SEQ ID NO: 17031 - RNA, 21 nt, Artificial Sequence
  Description of Artificial Sequence: Synthetic oligonucleotide
cuuccucugaagaccugaccc

SEQ ID NO: 17032 - RNA, 21 nt, Artificial Sequence
  Description of Artificial Sequence: Synthetic oligonucleotide
uuccucugaagaccugaccca

SEQ ID NO: 17033 - RNA, 21 nt, Artificial Sequence
  Description of Artificial Sequence: Synthetic oligonucleotide
uccucugaagaccugacccaa

SEQ ID NO: 17034 - RNA, 21 nt, Artificial Sequence
  Description of Artificial Sequence: Synthetic oligonucleotide
ccucugaagaccugacccaag

SEQ ID NO: 17035 - RNA, 21 nt, Artificial Sequence
  Description of Artificial Sequence: Synthetic oligonucleotide
cucugaagaccugacccaagc

SEQ ID NO: 17036 - RNA, 21 nt, Artificial Sequence
  Description of Artificial Sequence: Synthetic oligonucleotide
ucugaagaccugacccaagcu

SEQ ID NO: 17037 - RNA, 21 nt, Artificial Sequence
  Description of Artificial Sequence: Synthetic oligonucleotide
cugaagaccugacccaagcuc

SEQ ID NO: 17038 - RNA, 21 nt, Artificial Sequence
  Description of Artificial Sequence: Synthetic oligonucleotide
ugaagaccugacccaagcucu

SEQ ID NO: 17039 - RNA, 21 nt, Artificial Sequence
  Description of Artificial Sequence: Synthetic oligonucleotide
gaagaccugacccaagcucuu

SEQ ID NO: 17040 - RNA, 21 nt, Artificial Sequence
  Description of Artificial Sequence: Synthetic oligonucleotide
aagaccugacccaagcucuua

SEQ ID NO: 17041 - RNA, 21 nt, Artificial Sequence
  Description of Artificial Sequence: Synthetic oligonucleotide
agaccugacccaagcucuuaa

SEQ ID NO: 17042 - RNA, 21 nt, Artificial Sequence
  Description of Artificial Sequence: Synthetic oligonucleotide
gaccugacccaagcucuuaaa

SEQ ID NO: 17043 - RNA, 21 nt, Artificial Sequence
  Description of Artificial Sequence: Synthetic oligonucleotide
accugacccaagcucuuaaau

SEQ ID NO: 17044 - RNA, 21 nt, Artificial Sequence
  Description of Artificial Sequence: Synthetic oligonucleotide
ccugacccaagcucuuaaaug

SEQ ID NO: 17045 - RNA, 21 nt, Artificial Sequence
  Description of Artificial Sequence: Synthetic oligonucleotide
cugacccaagcucuuaaaugc

SEQ ID NO: 17046 - RNA, 21 nt, Artificial Sequence
  Description of Artificial Sequence: Synthetic oligonucleotide
ugacccaagcucuuaaaugcu

SEQ ID NO: 17047 - RNA, 21 nt, Artificial Sequence
  Description of Artificial Sequence: Synthetic oligonucleotide
gacccaagcucuuaaaugcua

SEQ ID NO: 17048 - RNA, 21 nt, Artificial Sequence
  Description of Artificial Sequence: Synthetic oligonucleotide
acccaagcucuuaaaugcuau

SEQ ID NO: 17049 - RNA, 21 nt, Artificial Sequence
  Description of Artificial Sequence: Synthetic oligonucleotide
cccaagcucuuaaaugcuauu

SEQ ID NO: 17050 - RNA, 21 nt, Artificial Sequence
  Description of Artificial Sequence: Synthetic oligonucleotide
ccaagcucuuaaaugcuauug

SEQ ID NO: 17051 - RNA, 21 nt, Artificial Sequence
  Description of Artificial Sequence: Synthetic oligonucleotide
caagcucuuaaaugcuauugu

SEQ ID NO: 17052 - RNA, 21 nt, Artificial Sequence
  Description of Artificial Sequence: Synthetic oligonucleotide
aagcucuuaaaugcuauugua

SEQ ID NO: 17053 - RNA, 21 nt, Artificial Sequence
  Description of Artificial Sequence: Synthetic oligonucleotide
agcucuuaaaugcuauuguaa

SEQ ID NO: 17054 - RNA, 21 nt, Artificial Sequence
  Description of Artificial Sequence: Synthetic oligonucleotide
gcucuuaaaugcuauuguaag

SEQ ID NO: 17055 - RNA, 21 nt, Artificial Sequence
  Description of Artificial Sequence: Synthetic oligonucleotide
cucuuaaaugcuauuguaaga

SEQ ID NO: 17056 - RNA, 21 nt, Artificial Sequence
  Description of Artificial Sequence: Synthetic oligonucleotide
ucuuaaaugcuauuguaagag

SEQ ID NO: 17057 - RNA, 21 nt, Artificial Sequence
  Description of Artificial Sequence: Synthetic oligonucleotide
cuuaaaugcuauuguaagaga

SEQ ID NO: 17058 - RNA, 21 nt, Artificial Sequence
  Description of Artificial Sequence: Synthetic oligonucleotide
uuaaaugcuauuguaagagaa

SEQ ID NO: 17059 - RNA, 21 nt, Artificial Sequence
  Description of Artificial Sequence: Synthetic oligonucleotide
uaaaugcuauuguaagagaaa

SEQ ID NO: 17060 - RNA, 21 nt, Artificial Sequence
  Description of Artificial Sequence: Synthetic oligonucleotide
aaaugcuauuguaagagaaau

SEQ ID NO: 17061 - RNA, 21 nt, Artificial Sequence
  Description of Artificial Sequence: Synthetic oligonucleotide
aaugcuauuguaagagaaauu

SEQ ID NO: 17062 - RNA, 21 nt, Artificial Sequence
  Description of Artificial Sequence: Synthetic oligonucleotide
augcuauuguaagagaaauuu

SEQ ID NO: 17063 - RNA, 21 nt, Artificial Sequence
  Description of Artificial Sequence: Synthetic oligonucleotide
ugcuauuguaagagaaauuuc

SEQ ID NO: 17064 - RNA, 21 nt, Artificial Sequence
  Description of Artificial Sequence: Synthetic oligonucleotide
gcuauuguaagagaaauuucu

SEQ ID NO: 17065 - RNA, 21 nt, Artificial Sequence
  Description of Artificial Sequence: Synthetic oligonucleotide
cuauuguaagagaaauuucuu

SEQ ID NO: 17066 - RNA, 21 nt, Artificial Sequence
  Description of Artificial Sequence: Synthetic oligonucleotide
uauuguaagagaaauuucuuu

SEQ ID NO: 17067 - RNA, 21 nt, Artificial Sequence
  Description of Artificial Sequence: Synthetic oligonucleotide
auuguaagagaaauuucuuug

SEQ ID NO: 17068 - RNA, 21 nt, Artificial Sequence
  Description of Artificial Sequence: Synthetic oligonucleotide
uuguaagagaaauuucuuugu

SEQ ID NO: 17069 - RNA, 21 nt, Artificial Sequence
  Description of Artificial Sequence: Synthetic oligonucleotide
uguaagagaaauuucuuuguc

SEQ ID NO: 17070 - RNA, 21 nt, Artificial Sequence
  Description of Artificial Sequence: Synthetic oligonucleotide
guaagagaaauuucuuugucu

SEQ ID NO: 17071 - RNA, 21 nt, Artificial Sequence
  Description of Artificial Sequence: Synthetic oligonucleotide
uaagagaaauuucuuugucua

SEQ ID NO: 17072 - RNA, 21 nt, Artificial Sequence
  Description of Artificial Sequence: Synthetic oligonucleotide
aagagaaauuucuuugucuau

SEQ ID NO: 17073 - RNA, 21 nt, Artificial Sequence
  Description of Artificial Sequence: Synthetic oligonucleotide
agagaaauuucuuugucuauu

SEQ ID NO: 17074 - RNA, 21 nt, Artificial Sequence
  Description of Artificial Sequence: Synthetic oligonucleotide
gagaaauuucuuugucuauua

SEQ ID NO: 17075 - RNA, 21 nt, Artificial Sequence
  Description of Artificial Sequence: Synthetic oligonucleotide
agaaauuucuuugucuauuaa

SEQ ID NO: 17076 - RNA, 21 nt, Artificial Sequence
  Description of Artificial Sequence: Synthetic oligonucleotide
gaaauuucuuugucuauuaac

SEQ ID NO: 17077 - RNA, 21 nt, Artificial Sequence
  Description of Artificial Sequence: Synthetic oligonucleotide
aaauuucuuugucuauuaacu

SEQ ID NO: 17078 - RNA, 21 nt, Artificial Sequence
  Description of Artificial Sequence: Synthetic oligonucleotide
aauuucuuugucuauuaacuc

SEQ ID NO: 17079 - RNA, 21 nt, Artificial Sequence
  Description of Artificial Sequence: Synthetic oligonucleotide
auuucuuugucuauuaacucc

SEQ ID NO: 17080 - RNA, 21 nt, Artificial Sequence
  Description of Artificial Sequence: Synthetic oligonucleotide
uuucuuugucuauuaacucca

SEQ ID NO: 17081 - RNA, 21 nt, Artificial Sequence
  Description of Artificial Sequence: Synthetic oligonucleotide
uucuuugucuauuaacuccau

SEQ ID NO: 17082 - RNA, 21 nt, Artificial Sequence
  Description of Artificial Sequence: Synthetic oligonucleotide
ucuuugucuauuaacuccauu

SEQ ID NO: 17083 - RNA, 21 nt, Artificial Sequence
  Description of Artificial Sequence: Synthetic oligonucleotide
cuuugucuauuaacuccauuu

SEQ ID NO: 17084 - RNA, 21 nt, Artificial Sequence
  Description of Artificial Sequence: Synthetic oligonucleotide
uuugucuauuaacuccauuuu

SEQ ID NO: 17085 - RNA, 21 nt, Artificial Sequence
  Description of Artificial Sequence: Synthetic oligonucleotide
uugucuauuaacuccauuuua

SEQ ID NO: 17086 - RNA, 21 nt, Artificial Sequence
  Description of Artificial Sequence: Synthetic oligonucleotide
ugucuauuaacuccauuuuag

SEQ ID NO: 17087 - RNA, 21 nt, Artificial Sequence
  Description of Artificial Sequence: Synthetic oligonucleotide
gucuauuaacuccauuuuagu

SEQ ID NO: 17088 - RNA, 21 nt, Artificial Sequence
  Description of Artificial Sequence: Synthetic oligonucleotide
ucuauuaacuccauuuuagua

SEQ ID NO: 17089 - RNA, 21 nt, Artificial Sequence
  Description of Artificial Sequence: Synthetic oligonucleotide
cuauuaacuccauuuuaguag

SEQ ID NO: 17090 - RNA, 21 nt, Artificial Sequence
  Description of Artificial Sequence: Synthetic oligonucleotide
uauuaacuccauuuuaguagg

SEQ ID NO: 17091 - RNA, 21 nt, Artificial Sequence
  Description of Artificial Sequence: Synthetic oligonucleotide
auuaacuccauuuuaguaggg

SEQ ID NO: 17092 - RNA, 21 nt, Artificial Sequence
  Description of Artificial Sequence: Synthetic oligonucleotide
uuaacuccauuuuaguaggga

SEQ ID NO: 17093 - RNA, 21 nt, Artificial Sequence
  Description of Artificial Sequence: Synthetic oligonucleotide
uaacuccauuuuaguagggau

SEQ ID NO: 17094 - RNA, 21 nt, Artificial Sequence
  Description of Artificial Sequence: Synthetic oligonucleotide
aacuccauuuuaguagggauu

SEQ ID NO: 17095 - RNA, 21 nt, Artificial Sequence
  Description of Artificial Sequence: Synthetic oligonucleotide
acuccauuuuaguagggauuc

SEQ ID NO: 17096 - RNA, 21 nt, Artificial Sequence
  Description of Artificial Sequence: Synthetic oligonucleotide
cuccauuuuaguagggauuca

SEQ ID NO: 17097 - RNA, 21 nt, Artificial Sequence
  Description of Artificial Sequence: Synthetic oligonucleotide
uccauuuuaguagggauucac

SEQ ID NO: 17098 - RNA, 21 nt, Artificial Sequence
  Description of Artificial Sequence: Synthetic oligonucleotide
ccauuuuaguagggauucacu

SEQ ID NO: 17099 - RNA, 21 nt, Artificial Sequence
  Description of Artificial Sequence: Synthetic oligonucleotide
cauuuuaguagggauucacug

SEQ ID NO: 17100 - RNA, 21 nt, Artificial Sequence
  Description of Artificial Sequence: Synthetic oligonucleotide
auuuuaguagggauucacuga

SEQ ID NO: 17101 - RNA, 21 nt, Artificial Sequence
  Description of Artificial Sequence: Synthetic oligonucleotide
uuuuaguagggauucacugac

SEQ ID NO: 17102 - RNA, 21 nt, Artificial Sequence
  Description of Artificial Sequence: Synthetic oligonucleotide
uuuaguagggauucacugacu

SEQ ID NO: 17103 - RNA, 21 nt, Artificial Sequence
  Description of Artificial Sequence: Synthetic oligonucleotide
uuaguagggauucacugacua

SEQ ID NO: 17104 - RNA, 21 nt, Artificial Sequence
  Description of Artificial Sequence: Synthetic oligonucleotide
uaguagggauucacugacuag

SEQ ID NO: 17105 - RNA, 21 nt, Artificial Sequence
  Description of Artificial Sequence: Synthetic oligonucleotide
aguagggauucacugacuaga

SEQ ID NO: 17106 - RNA, 21 nt, Artificial Sequence
  Description of Artificial Sequence: Synthetic oligonucleotide
guagggauucacugacuagau

SEQ ID NO: 17107 - RNA, 21 nt, Artificial Sequence
  Description of Artificial Sequence: Synthetic oligonucleotide
uagggauucacugacuagauu

SEQ ID NO: 17108 - RNA, 21 nt, Artificial Sequence
  Description of Artificial Sequence: Synthetic oligonucleotide
agggauucacugacuagauuu

SEQ ID NO: 17109 - RNA, 21 nt, Artificial Sequence
  Description of Artificial Sequence: Synthetic oligonucleotide
gggauucacugacuagauuuu

SEQ ID NO: 17110 - RNA, 21 nt, Artificial Sequence
  Description of Artificial Sequence: Synthetic oligonucleotide
ggauucacugacuagauuuua

SEQ ID NO: 17111 - RNA, 21 nt, Artificial Sequence
  Description of Artificial Sequence: Synthetic oligonucleotide
gauucacugacuagauuuuac

SEQ ID NO: 17112 - RNA, 21 nt, Artificial Sequence
  Description of Artificial Sequence: Synthetic oligonucleotide
auucacugacuagauuuuacu

SEQ ID NO: 17113 - RNA, 21 nt, Artificial Sequence
  Description of Artificial Sequence: Synthetic oligonucleotide
uucacugacuagauuuuacug

SEQ ID NO: 17114 - RNA, 21 nt, Artificial Sequence
  Description of Artificial Sequence: Synthetic oligonucleotide
ucacugacuagauuuuacuga

SEQ ID NO: 17115 - RNA, 21 nt, Artificial Sequence
  Description of Artificial Sequence: Synthetic oligonucleotide
cacugacuagauuuuacugaa

SEQ ID NO: 17116 - RNA, 21 nt, Artificial Sequence
  Description of Artificial Sequence: Synthetic oligonucleotide
acugacuagauuuuacugaac

SEQ ID NO: 17117 - RNA, 21 nt, Artificial Sequence
  Description of Artificial Sequence: Synthetic oligonucleotide
cugacuagauuuuacugaacu

SEQ ID NO: 17118 - RNA, 21 nt, Artificial Sequence
  Description of Artificial Sequence: Synthetic oligonucleotide
ugacuagauuuuacugaacua

SEQ ID NO: 17119 - RNA, 21 nt, Artificial Sequence
  Description of Artificial Sequence: Synthetic oligonucleotide
gacuagauuuuacugaacuau

SEQ ID NO: 17120 - RNA, 21 nt, Artificial Sequence
  Description of Artificial Sequence: Synthetic oligonucleotide
acuagauuuuacugaacuaug

SEQ ID NO: 17121 - RNA, 21 nt, Artificial Sequence
  Description of Artificial Sequence: Synthetic oligonucleotide
cuagauuuuacugaacuauga

SEQ ID NO: 17122 - RNA, 21 nt, Artificial Sequence
  Description of Artificial Sequence: Synthetic oligonucleotide
uagauuuuacugaacuaugaa

SEQ ID NO: 17123 - RNA, 21 nt, Artificial Sequence
  Description of Artificial Sequence: Synthetic oligonucleotide
agauuuuacugaacuaugaaa

SEQ ID NO: 17124 - RNA, 21 nt, Artificial Sequence
  Description of Artificial Sequence: Synthetic oligonucleotide
gauuuuacugaacuaugaaaa

SEQ ID NO: 17125 - RNA, 21 nt, Artificial Sequence
  Description of Artificial Sequence: Synthetic oligonucleotide
auuuuacugaacuaugaaaau

SEQ ID NO: 17126 - RNA, 21 nt, Artificial Sequence
  Description of Artificial Sequence: Synthetic oligonucleotide
uuuuacugaacuaugaaaaua

SEQ ID NO: 17127 - RNA, 21 nt, Artificial Sequence
  Description of Artificial Sequence: Synthetic oligonucleotide
uuuacugaacuaugaaaauaa

SEQ ID NO: 17128 - RNA, 21 nt, Artificial Sequence
  Description of Artificial Sequence: Synthetic oligonucleotide
uuacugaacuaugaaaauaaa

SEQ ID NO: 17129 - RNA, 21 nt, Artificial Sequence
  Description of Artificial Sequence: Synthetic oligonucleotide
uacugaacuaugaaaauaaau

SEQ ID NO: 17130 - RNA, 21 nt, Artificial Sequence
  Description of Artificial Sequence: Synthetic oligonucleotide
acugaacuaugaaaauaaaua

SEQ ID NO: 17131 - RNA, 21 nt, Artificial Sequence
  Description of Artificial Sequence: Synthetic oligonucleotide
cugaacuaugaaaauaaauac

SEQ ID NO: 17132 - RNA, 21 nt, Artificial Sequence
  Description of Artificial Sequence: Synthetic oligonucleotide
ugaacuaugaaaauaaauaca

SEQ ID NO: 17133 - RNA, 21 nt, Artificial Sequence
  Description of Artificial Sequence: Synthetic oligonucleotide
gaacuaugaaaauaaauacac

SEQ ID NO: 17134 - RNA, 21 nt, Artificial Sequence
  Description of Artificial Sequence: Synthetic oligonucleotide
aacuaugaaaauaaauacaca

SEQ ID NO: 17135 - RNA, 21 nt, Artificial Sequence
  Description of Artificial Sequence: Synthetic oligonucleotide
acuaugaaaauaaauacacau

SEQ ID NO: 17136 - RNA, 21 nt, Artificial Sequence
  Description of Artificial Sequence: Synthetic oligonucleotide
cuaugaaaauaaauacacaua

SEQ ID NO: 17137 - RNA, 21 nt, Artificial Sequence
  Description of Artificial Sequence: Synthetic oligonucleotide
uaugaaaauaaauacacauaa

SEQ ID NO: 17138 - RNA, 21 nt, Artificial Sequence
  Description of Artificial Sequence: Synthetic oligonucleotide
augaaaauaaauacacauaau

SEQ ID NO: 17139 - RNA, 21 nt, Artificial Sequence
  Description of Artificial Sequence: Synthetic oligonucleotide
ugaaaauaaauacacauaauu

SEQ ID NO: 17140 - RNA, 21 nt, Artificial Sequence
  Description of Artificial Sequence: Synthetic oligonucleotide
gaaaauaaauacacauaauuu

SEQ ID NO: 17141 - RNA, 21 nt, Artificial Sequence
  Description of Artificial Sequence: Synthetic oligonucleotide
aaaauaaauacacauaauuuu

SEQ ID NO: 17142 - RNA, 21 nt, Artificial Sequence
  Description of Artificial Sequence: Synthetic oligonucleotide
aaauaaauacacauaauuuuu

SEQ ID NO: 17143 - RNA, 21 nt, Artificial Sequence
  Description of Artificial Sequence: Synthetic oligonucleotide
aauaaauacacauaauuuuuc

SEQ ID NO: 17144 - RNA, 21 nt, Artificial Sequence
  Description of Artificial Sequence: Synthetic oligonucleotide
auaaauacacauaauuuuuca

SEQ ID NO: 17145 - RNA, 21 nt, Artificial Sequence
  Description of Artificial Sequence: Synthetic oligonucleotide
uaaauacacauaauuuuucac

SEQ ID NO: 17146 - RNA, 21 nt, Artificial Sequence
  Description of Artificial Sequence: Synthetic oligonucleotide
aaauacacauaauuuuucaca

SEQ ID NO: 17147 - RNA, 21 nt, Artificial Sequence
  Description of Artificial Sequence: Synthetic oligonucleotide
aauacacauaauuuuucacaa

SEQ ID NO: 17148 - RNA, 21 nt, Artificial Sequence
  Description of Artificial Sequence: Synthetic oligonucleotide
auacacauaauuuuucacaaa

SEQ ID NO: 17149 - RNA, 21 nt, Artificial Sequence
  Description of Artificial Sequence: Synthetic oligonucleotide
uacacauaauuuuucacaaaa

SEQ ID NO: 17150 - RNA, 21 nt, Artificial Sequence
  Description of Artificial Sequence: Synthetic oligonucleotide
acacauaauuuuucacaaaau

SEQ ID NO: 17151 - RNA, 21 nt, Artificial Sequence
  Description of Artificial Sequence: Synthetic oligonucleotide
cacauaauuuuucacaaaauu

SEQ ID NO: 17152 - RNA, 21 nt, Artificial Sequence
  Description of Artificial Sequence: Synthetic oligonucleotide
acauaauuuuucacaaaauuu

SEQ ID NO: 17153 - RNA, 21 nt, Artificial Sequence
  Description of Artificial Sequence: Synthetic oligonucleotide
cauaauuuuucacaaaauuuu

SEQ ID NO: 17154 - RNA, 21 nt, Artificial Sequence
  Description of Artificial Sequence: Synthetic oligonucleotide
auaauuuuucacaaaauuuug

SEQ ID NO: 17155 - RNA, 21 nt, Artificial Sequence
  Description of Artificial Sequence: Synthetic oligonucleotide
uaauuuuucacaaaauuuugg

SEQ ID NO: 17156 - RNA, 21 nt, Artificial Sequence
  Description of Artificial Sequence: Synthetic oligonucleotide
aauuuuucacaaaauuuuggg

SEQ ID NO: 17157 - RNA, 21 nt, Artificial Sequence
  Description of Artificial Sequence: Synthetic oligonucleotide
auuuuucacaaaauuuugggc

SEQ ID NO: 17158 - RNA, 21 nt, Artificial Sequence
  Description of Artificial Sequence: Synthetic oligonucleotide
uuuuucacaaaauuuugggcc

SEQ ID NO: 17159 - RNA, 21 nt, Artificial Sequence
  Description of Artificial Sequence: Synthetic oligonucleotide
uuuucacaaaauuuugggccc

SEQ ID NO: 17160 - RNA, 21 nt, Artificial Sequence
  Description of Artificial Sequence: Synthetic oligonucleotide
uuucacaaaauuuugggccca

SEQ ID NO: 17161 - RNA, 21 nt, Artificial Sequence
  Description of Artificial Sequence: Synthetic oligonucleotide
uucacaaaauuuugggcccaa

SEQ ID NO: 17162 - RNA, 21 nt, Artificial Sequence
  Description of Artificial Sequence: Synthetic oligonucleotide
ucacaaaauuuugggcccaau

SEQ ID NO: 17163 - RNA, 21 nt, Artificial Sequence
  Description of Artificial Sequence: Synthetic oligonucleotide
cacaaaauuuugggcccaauu

SEQ ID NO: 17164 - RNA, 21 nt, Artificial Sequence
  Description of Artificial Sequence: Synthetic oligonucleotide
acaaaauuuugggcccaauuc

SEQ ID NO: 17165 - RNA, 21 nt, Artificial Sequence
  Description of Artificial Sequence: Synthetic oligonucleotide
caaaauuuugggcccaauucc

SEQ ID NO: 17166 - RNA, 21 nt, Artificial Sequence
  Description of Artificial Sequence: Synthetic oligonucleotide
aaaauuuugggcccaauuccc

SEQ ID NO: 17167 - RNA, 21 nt, Artificial Sequence
  Description of Artificial Sequence: Synthetic oligonucleotide
aaauuuugggcccaauucccc

SEQ ID NO: 17168 - RNA, 21 nt, Artificial Sequence
  Description of Artificial Sequence: Synthetic oligonucleotide
aauuuugggcccaauuccccu

SEQ ID NO: 17169 - RNA, 21 nt, Artificial Sequence
  Description of Artificial Sequence: Synthetic oligonucleotide
auuuugggcccaauuccccua

SEQ ID NO: 17170 - RNA, 21 nt, Artificial Sequence
  Description of Artificial Sequence: Synthetic oligonucleotide
uuuugggcccaauuccccuaa

SEQ ID NO: 17171 - RNA, 21 nt, Artificial Sequence
  Description of Artificial Sequence: Synthetic oligonucleotide
uuugggcccaauuccccuaaa

SEQ ID NO: 17172 - RNA, 21 nt, Artificial Sequence
  Description of Artificial Sequence: Synthetic oligonucleotide
uugggcccaauuccccuaaaa

SEQ ID NO: 17173 - RNA, 21 nt, Artificial Sequence
  Description of Artificial Sequence: Synthetic oligonucleotide
ugggcccaauuccccuaaaag

SEQ ID NO: 17174 - RNA, 21 nt, Artificial Sequence
  Description of Artificial Sequence: Synthetic oligonucleotide
gggcccaauuccccuaaaaga

SEQ ID NO: 17175 - RNA, 21 nt, Artificial Sequence
  Description of Artificial Sequence: Synthetic oligonucleotide
ggcccaauuccccuaaaagaa

SEQ ID NO: 17176 - RNA, 21 nt, Artificial Sequence
  Description of Artificial Sequence: Synthetic oligonucleotide
gcccaauuccccuaaaagaau

SEQ ID NO: 17177 - RNA, 21 nt, Artificial Sequence
  Description of Artificial Sequence: Synthetic oligonucleotide
cccaauuccccuaaaagaauu

SEQ ID NO: 17178 - RNA, 21 nt, Artificial Sequence
  Description of Artificial Sequence: Synthetic oligonucleotide
ccaauuccccuaaaagaauug

SEQ ID NO: 17179 - RNA, 21 nt, Artificial Sequence
  Description of Artificial Sequence: Synthetic oligonucleotide
caauuccccuaaaagaauuga

SEQ ID NO: 17180 - RNA, 21 nt, Artificial Sequence
  Description of Artificial Sequence: Synthetic oligonucleotide
aauuccccuaaaagaauugag

SEQ ID NO: 17181 - RNA, 21 nt, Artificial Sequence
  Description of Artificial Sequence: Synthetic oligonucleotide
auuccccuaaaagaauugagg

SEQ ID NO: 17182 - RNA, 21 nt, Artificial Sequence
  Description of Artificial Sequence: Synthetic oligonucleotide
uuccccuaaaagaauugagga

SEQ ID NO: 17183 - RNA, 21 nt, Artificial Sequence
  Description of Artificial Sequence: Synthetic oligonucleotide
uccccuaaaagaauugaggau

SEQ ID NO: 17184 - RNA, 21 nt, Artificial Sequence
  Description of Artificial Sequence: Synthetic oligonucleotide
ccccuaaaagaauugaggauu

SEQ ID NO: 17185 - RNA, 21 nt, Artificial Sequence
  Description of Artificial Sequence: Synthetic oligonucleotide
cccuaaaagaauugaggauua

SEQ ID NO: 17186 - RNA, 21 nt, Artificial Sequence
  Description of Artificial Sequence: Synthetic oligonucleotide
ccuaaaagaauugaggauuag

SEQ ID NO: 17187 - RNA, 21 nt, Artificial Sequence
  Description of Artificial Sequence: Synthetic oligonucleotide
cuaaaagaauugaggauuagg

SEQ ID NO: 17188 - RNA, 21 nt, Artificial Sequence
  Description of Artificial Sequence: Synthetic oligonucleotide
uaaaagaauugaggauuaggg

SEQ ID NO: 17189 - RNA, 21 nt, Artificial Sequence
  Description of Artificial Sequence: Synthetic oligonucleotide
aaaagaauugaggauuaggga

SEQ ID NO: 17190 - RNA, 21 nt, Artificial Sequence
  Description of Artificial Sequence: Synthetic oligonucleotide
aaagaauugaggauuagggag

SEQ ID NO: 17191 - RNA, 21 nt, Artificial Sequence
  Description of Artificial Sequence: Synthetic oligonucleotide
aagaauugaggauuagggaga

SEQ ID NO: 17192 - RNA, 21 nt, Artificial Sequence
  Description of Artificial Sequence: Synthetic oligonucleotide
agaauugaggauuagggagaa

SEQ ID NO: 17193 - RNA, 21 nt, Artificial Sequence
  Description of Artificial Sequence: Synthetic oligonucleotide
gaauugaggauuagggagaaa

SEQ ID NO: 17194 - RNA, 21 nt, Artificial Sequence
  Description of Artificial Sequence: Synthetic oligonucleotide
aauugaggauuagggagaaag

SEQ ID NO: 17195 - RNA, 21 nt, Artificial Sequence
  Description of Artificial Sequence: Synthetic oligonucleotide
auugaggauuagggagaaagg

SEQ ID NO: 17196 - RNA, 21 nt, Artificial Sequence
  Description of Artificial Sequence: Synthetic oligonucleotide
uugaggauuagggagaaagga

SEQ ID NO: 17197 - RNA, 21 nt, Artificial Sequence
  Description of Artificial Sequence: Synthetic oligonucleotide
ugaggauuagggagaaaggag

SEQ ID NO: 17198 - RNA, 21 nt, Artificial Sequence
  Description of Artificial Sequence: Synthetic oligonucleotide
gaggauuagggagaaaggaga

SEQ ID NO: 17199 - RNA, 21 nt, Artificial Sequence
  Description of Artificial Sequence: Synthetic oligonucleotide
aggauuagggagaaaggagac

SEQ ID NO: 17200 - RNA, 21 nt, Artificial Sequence
  Description of Artificial Sequence: Synthetic oligonucleotide
ggauuagggagaaaggagaca

SEQ ID NO: 17201 - RNA, 21 nt, Artificial Sequence
  Description of Artificial Sequence: Synthetic oligonucleotide
gauuagggagaaaggagacaa

SEQ ID NO: 17202 - RNA, 21 nt, Artificial Sequence
  Description of Artificial Sequence: Synthetic oligonucleotide
auuagggagaaaggagacaac

SEQ ID NO: 17203 - RNA, 21 nt, Artificial Sequence
  Description of Artificial Sequence: Synthetic oligonucleotide
uuagggagaaaggagacaacu

SEQ ID NO: 17204 - RNA, 21 nt, Artificial Sequence
  Description of Artificial Sequence: Synthetic oligonucleotide
uagggagaaaggagacaacuc

SEQ ID NO: 17205 - RNA, 21 nt, Artificial Sequence
  Description of Artificial Sequence: Synthetic oligonucleotide
agggagaaaggagacaacuca

SEQ ID NO: 17206 - RNA, 21 nt, Artificial Sequence
  Description of Artificial Sequence: Synthetic oligonucleotide
gggagaaaggagacaacucaa

SEQ ID NO: 17207 - RNA, 21 nt, Artificial Sequence
  Description of Artificial Sequence: Synthetic oligonucleotide
ggagaaaggagacaacucaaa

SEQ ID NO: 17208 - RNA, 21 nt, Artificial Sequence
  Description of Artificial Sequence: Synthetic oligonucleotide
gagaaaggagacaacucaaag

SEQ ID NO: 17209 - RNA, 21 nt, Artificial Sequence
  Description of Artificial Sequence: Synthetic oligonucleotide
agaaaggagacaacucaaagu

SEQ ID NO: 17210 - RNA, 21 nt, Artificial Sequence
  Description of Artificial Sequence: Synthetic oligonucleotide
gaaaggagacaacucaaaguc

SEQ ID NO: 17211 - RNA, 21 nt, Artificial Sequence
  Description of Artificial Sequence: Synthetic oligonucleotide
aaaggagacaacucaaaguca

SEQ ID NO: 17212 - RNA, 21 nt, Artificial Sequence
  Description of Artificial Sequence: Synthetic oligonucleotide
aaggagacaacucaaagucau

SEQ ID NO: 17213 - RNA, 21 nt, Artificial Sequence
  Description of Artificial Sequence: Synthetic oligonucleotide
aggagacaacucaaagucauc

SEQ ID NO: 17214 - RNA, 21 nt, Artificial Sequence
  Description of Artificial Sequence: Synthetic oligonucleotide
ggagacaacucaaagucaucc

SEQ ID NO: 17215 - RNA, 21 nt, Artificial Sequence
  Description of Artificial Sequence: Synthetic oligonucleotide
gagacaacucaaagucauccc

SEQ ID NO: 17216 - RNA, 21 nt, Artificial Sequence
  Description of Artificial Sequence: Synthetic oligonucleotide
agacaacucaaagucauccca

SEQ ID NO: 17217 - RNA, 21 nt, Artificial Sequence
  Description of Artificial Sequence: Synthetic oligonucleotide
gacaacucaaagucaucccau

SEQ ID NO: 17218 - RNA, 21 nt, Artificial Sequence
  Description of Artificial Sequence: Synthetic oligonucleotide
acaacucaaagucaucccauu

SEQ ID NO: 17219 - RNA, 21 nt, Artificial Sequence
  Description of Artificial Sequence: Synthetic oligonucleotide
caacucaaagucaucccauua

SEQ ID NO: 17220 - RNA, 21 nt, Artificial Sequence
  Description of Artificial Sequence: Synthetic oligonucleotide
aacucaaagucaucccauuaa

SEQ ID NO: 17221 - RNA, 21 nt, Artificial Sequence
  Description of Artificial Sequence: Synthetic oligonucleotide
acucaaagucaucccauuaag

SEQ ID NO: 17222 - RNA, 21 nt, Artificial Sequence
  Description of Artificial Sequence: Synthetic oligonucleotide
cucaaagucaucccauuaagu

SEQ ID NO: 17223 - RNA, 21 nt, Artificial Sequence
  Description of Artificial Sequence: Synthetic oligonucleotide
ucaaagucaucccauuaagug

SEQ ID NO: 17224 - RNA, 21 nt, Artificial Sequence
  Description of Artificial Sequence: Synthetic oligonucleotide
caaagucaucccauuaagugc

SEQ ID NO: 17225 - RNA, 21 nt, Artificial Sequence
  Description of Artificial Sequence: Synthetic oligonucleotide
aaagucaucccauuaagugca

SEQ ID NO: 17226 - RNA, 21 nt, Artificial Sequence
  Description of Artificial Sequence: Synthetic oligonucleotide
aagucaucccauuaagugcag

SEQ ID NO: 17227 - RNA, 21 nt, Artificial Sequence
  Description of Artificial Sequence: Synthetic oligonucleotide
agucaucccauuaagugcagu

SEQ ID NO: 17228 - RNA, 21 nt, Artificial Sequence
  Description of Artificial Sequence: Synthetic oligonucleotide
gucaucccauuaagugcaguu

SEQ ID NO: 17229 - RNA, 21 nt, Artificial Sequence
  Description of Artificial Sequence: Synthetic oligonucleotide
ucaucccauuaagugcaguuu

SEQ ID NO: 17230 - RNA, 21 nt, Artificial Sequence
  Description of Artificial Sequence: Synthetic oligonucleotide
caucccauuaagugcaguuuc

SEQ ID NO: 17231 - RNA, 21 nt, Artificial Sequence
  Description of Artificial Sequence: Synthetic oligonucleotide
aucccauuaagugcaguuucu

SEQ ID NO: 17232 - RNA, 21 nt, Artificial Sequence
  Description of Artificial Sequence: Synthetic oligonucleotide
ucccauuaagugcaguuucuu

SEQ ID NO: 17233 - RNA, 21 nt, Artificial Sequence
  Description of Artificial Sequence: Synthetic oligonucleotide
cccauuaagugcaguuucuuu

SEQ ID NO: 17234 - RNA, 21 nt, Artificial Sequence
  Description of Artificial Sequence: Synthetic oligonucleotide
ccauuaagugcaguuucuuug

SEQ ID NO: 17235 - RNA, 21 nt, Artificial Sequence
  Description of Artificial Sequence: Synthetic oligonucleotide
cauuaagugcaguuucuuuga

SEQ ID NO: 17236 - RNA, 21 nt, Artificial Sequence
  Description of Artificial Sequence: Synthetic oligonucleotide
auuaagugcaguuucuuugaa

SEQ ID NO: 17237 - RNA, 21 nt, Artificial Sequence
  Description of Artificial Sequence: Synthetic oligonucleotide
uuaagugcaguuucuuugaau

SEQ ID NO: 17238 - RNA, 21 nt, Artificial Sequence
  Description of Artificial Sequence: Synthetic oligonucleotide
uaagugcaguuucuuugaauc

SEQ ID NO: 17239 - RNA, 21 nt, Artificial Sequence
  Description of Artificial Sequence: Synthetic oligonucleotide
aagugcaguuucuuugaaucu

SEQ ID NO: 17240 - RNA, 21 nt, Artificial Sequence
  Description of Artificial Sequence: Synthetic oligonucleotide
agugcaguuucuuugaaucuu

SEQ ID NO: 17241 - RNA, 21 nt, Artificial Sequence
  Description of Artificial Sequence: Synthetic oligonucleotide
gugcaguuucuuugaaucuuc

SEQ ID NO: 17242 - RNA, 21 nt, Artificial Sequence
  Description of Artificial Sequence: Synthetic oligonucleotide
ugcaguuucuuugaaucuucu

SEQ ID NO: 17243 - RNA, 21 nt, Artificial Sequence
  Description of Artificial Sequence: Synthetic oligonucleotide
gcaguuucuuugaaucuucug

SEQ ID NO: 17244 - RNA, 21 nt, Artificial Sequence
  Description of Artificial Sequence: Synthetic oligonucleotide
caguuucuuugaaucuucugc

SEQ ID NO: 17245 - RNA, 21 nt, Artificial Sequence
  Description of Artificial Sequence: Synthetic oligonucleotide
aguuucuuugaaucuucugcu

SEQ ID NO: 17246 - RNA, 21 nt, Artificial Sequence
  Description of Artificial Sequence: Synthetic oligonucleotide
guuucuuugaaucuucugcuu

SEQ ID NO: 17247 - RNA, 21 nt, Artificial Sequence
  Description of Artificial Sequence: Synthetic oligonucleotide
uuucuuugaaucuucugcuuu

SEQ ID NO: 17248 - RNA, 21 nt, Artificial Sequence
  Description of Artificial Sequence: Synthetic oligonucleotide
uucuuugaaucuucugcuuua

SEQ ID NO: 17249 - RNA, 21 nt, Artificial Sequence
  Description of Artificial Sequence: Synthetic oligonucleotide
ucuuugaaucuucugcuuuau

SEQ ID NO: 17250 - RNA, 21 nt, Artificial Sequence
  Description of Artificial Sequence: Synthetic oligonucleotide
cuuugaaucuucugcuuuauc

SEQ ID NO: 17251 - RNA, 21 nt, Artificial Sequence
  Description of Artificial Sequence: Synthetic oligonucleotide
uuugaaucuucugcuuuaucu

SEQ ID NO: 17252 - RNA, 21 nt, Artificial Sequence
  Description of Artificial Sequence: Synthetic oligonucleotide
uugaaucuucugcuuuaucuu

SEQ ID NO: 17253 - RNA, 21 nt, Artificial Sequence
  Description of Artificial Sequence: Synthetic oligonucleotide
ugaaucuucugcuuuaucuuu

SEQ ID NO: 17254 - RNA, 21 nt, Artificial Sequence
  Description of Artificial Sequence: Synthetic oligonucleotide
gaaucuucugcuuuaucuuua

SEQ ID NO: 17255 - RNA, 21 nt, Artificial Sequence
  Description of Artificial Sequence: Synthetic oligonucleotide
aaucuucugcuuuaucuuuaa

SEQ ID NO: 17256 - RNA, 21 nt, Artificial Sequence
  Description of Artificial Sequence: Synthetic oligonucleotide
aucuucugcuuuaucuuuaaa

SEQ ID NO: 17257 - RNA, 21 nt, Artificial Sequence
  Description of Artificial Sequence: Synthetic oligonucleotide
ucuucugcuuuaucuuuaaaa

SEQ ID NO: 17258 - RNA, 21 nt, Artificial Sequence
  Description of Artificial Sequence: Synthetic oligonucleotide
cuucugcuuuaucuuuaaaaa

SEQ ID NO: 17259 - RNA, 21 nt, Artificial Sequence
  Description of Artificial Sequence: Synthetic oligonucleotide
uucugcuuuaucuuuaaaaau

SEQ ID NO: 17260 - RNA, 21 nt, Artificial Sequence
  Description of Artificial Sequence: Synthetic oligonucleotide
ucugcuuuaucuuuaaaaauu

SEQ ID NO: 17261 - RNA, 21 nt, Artificial Sequence
  Description of Artificial Sequence: Synthetic oligonucleotide
cugcuuuaucuuuaaaaauuu

SEQ ID NO: 17262 - RNA, 21 nt, Artificial Sequence
  Description of Artificial Sequence: Synthetic oligonucleotide
ugcuuuaucuuuaaaaauuug

SEQ ID NO: 17263 - RNA, 21 nt, Artificial Sequence
  Description of Artificial Sequence: Synthetic oligonucleotide
gcuuuaucuuuaaaaauuugu

SEQ ID NO: 17264 - RNA, 21 nt, Artificial Sequence
  Description of Artificial Sequence: Synthetic oligonucleotide
cuuuaucuuuaaaaauuugua

SEQ ID NO: 17265 - RNA, 21 nt, Artificial Sequence
  Description of Artificial Sequence: Synthetic oligonucleotide
uuuaucuuuaaaaauuuguau

SEQ ID NO: 17266 - RNA, 21 nt, Artificial Sequence
  Description of Artificial Sequence: Synthetic oligonucleotide
uuaucuuuaaaaauuuguaua

SEQ ID NO: 17267 - RNA, 21 nt, Artificial Sequence
  Description of Artificial Sequence: Synthetic oligonucleotide
uaucuuuaaaaauuuguauaa

SEQ ID NO: 17268 - RNA, 21 nt, Artificial Sequence
  Description of Artificial Sequence: Synthetic oligonucleotide
aucuuuaaaaauuuguauaau

SEQ ID NO: 17269 - RNA, 21 nt, Artificial Sequence
  Description of Artificial Sequence: Synthetic oligonucleotide
ucuuuaaaaauuuguauaauu

SEQ ID NO: 17270 - RNA, 21 nt, Artificial Sequence
  Description of Artificial Sequence: Synthetic oligonucleotide
cuuuaaaaauuuguauaauuu

SEQ ID NO: 17271 - RNA, 21 nt, Artificial Sequence
  Description of Artificial Sequence: Synthetic oligonucleotide
uuuaaaaauuuguauaauuua

SEQ ID NO: 17272 - RNA, 21 nt, Artificial Sequence
  Description of Artificial Sequence: Synthetic oligonucleotide
uuaaaaauuuguauaauuuau

SEQ ID NO: 17273 - RNA, 21 nt, Artificial Sequence
  Description of Artificial Sequence: Synthetic oligonucleotide
uaaaaauuuguauaauuuaua

SEQ ID NO: 17274 - RNA, 21 nt, Artificial Sequence
  Description of Artificial Sequence: Synthetic oligonucleotide
aaaaauuuguauaauuuauau

SEQ ID NO: 17275 - RNA, 21 nt, Artificial Sequence
  Description of Artificial Sequence: Synthetic oligonucleotide
aaaauuuguauaauuuauaua

SEQ ID NO: 17276 - RNA, 21 nt, Artificial Sequence
  Description of Artificial Sequence: Synthetic oligonucleotide
aaauuuguauaauuuauauau

SEQ ID NO: 17277 - RNA, 21 nt, Artificial Sequence
  Description of Artificial Sequence: Synthetic oligonucleotide
aauuuguauaauuuauauauu

SEQ ID NO: 17278 - RNA, 21 nt, Artificial Sequence
  Description of Artificial Sequence: Synthetic oligonucleotide
auuuguauaauuuauauauuu

SEQ ID NO: 17279 - RNA, 21 nt, Artificial Sequence
  Description of Artificial Sequence: Synthetic oligonucleotide
uuuguauaauuuauauauuuu

SEQ ID NO: 17280 - RNA, 21 nt, Artificial Sequence
  Description of Artificial Sequence: Synthetic oligonucleotide
uuguauaauuuauauauuuua

SEQ ID NO: 17281 - RNA, 21 nt, Artificial Sequence
  Description of Artificial Sequence: Synthetic oligonucleotide
uguauaauuuauauauuuuau

SEQ ID NO: 17282 - RNA, 21 nt, Artificial Sequence
  Description of Artificial Sequence: Synthetic oligonucleotide
guauaauuuauauauuuuauu

SEQ ID NO: 17283 - RNA, 21 nt, Artificial Sequence
  Description of Artificial Sequence: Synthetic oligonucleotide
uauaauuuauauauuuuauuc

SEQ ID NO: 17284 - RNA, 21 nt, Artificial Sequence
  Description of Artificial Sequence: Synthetic oligonucleotide
auaauuuauauauuuuauucu

SEQ ID NO: 17285 - RNA, 21 nt, Artificial Sequence
  Description of Artificial Sequence: Synthetic oligonucleotide
uaauuuauauauuuuauucua

SEQ ID NO: 17286 - RNA, 21 nt, Artificial Sequence
  Description of Artificial Sequence: Synthetic oligonucleotide
aauuuauauauuuuauucuau

SEQ ID NO: 17287 - RNA, 21 nt, Artificial Sequence
  Description of Artificial Sequence: Synthetic oligonucleotide
auuuauauauuuuauucuaug

SEQ ID NO: 17288 - RNA, 21 nt, Artificial Sequence
  Description of Artificial Sequence: Synthetic oligonucleotide
uuuauauauuuuauucuaugu

SEQ ID NO: 17289 - RNA, 21 nt, Artificial Sequence
  Description of Artificial Sequence: Synthetic oligonucleotide
uuauauauuuuauucuaugug

SEQ ID NO: 17290 - RNA, 21 nt, Artificial Sequence
  Description of Artificial Sequence: Synthetic oligonucleotide
uauauauuuuauucuaugugu

SEQ ID NO: 17291 - RNA, 21 nt, Artificial Sequence
  Description of Artificial Sequence: Synthetic oligonucleotide
auauauuuuauucuauguguu

SEQ ID NO: 17292 - RNA, 21 nt, Artificial Sequence
  Description of Artificial Sequence: Synthetic oligonucleotide
uauauuuuauucuauguguuc

SEQ ID NO: 17293 - RNA, 21 nt, Artificial Sequence
  Description of Artificial Sequence: Synthetic oligonucleotide
auauuuuauucuauguguucc

SEQ ID NO: 17294 - RNA, 21 nt, Artificial Sequence
  Description of Artificial Sequence: Synthetic oligonucleotide
uauuuuauucuauguguucca

SEQ ID NO: 17295 - RNA, 21 nt, Artificial Sequence
  Description of Artificial Sequence: Synthetic oligonucleotide
auuuuauucuauguguuccau

SEQ ID NO: 17296 - RNA, 21 nt, Artificial Sequence
  Description of Artificial Sequence: Synthetic oligonucleotide
uuuuauucuauguguuccaua

SEQ ID NO: 17297 - RNA, 21 nt, Artificial Sequence
  Description of Artificial Sequence: Synthetic oligonucleotide
uuuauucuauguguuccauag

SEQ ID NO: 17298 - RNA, 21 nt, Artificial Sequence
  Description of Artificial Sequence: Synthetic oligonucleotide
uuauucuauguguuccauaga

SEQ ID NO: 17299 - RNA, 21 nt, Artificial Sequence
  Description of Artificial Sequence: Synthetic oligonucleotide
uauucuauguguuccauagau

SEQ ID NO: 17300 - RNA, 21 nt, Artificial Sequence
  Description of Artificial Sequence: Synthetic oligonucleotide
auucuauguguuccauagaua

SEQ ID NO: 17301 - RNA, 21 nt, Artificial Sequence
  Description of Artificial Sequence: Synthetic oligonucleotide
uucuauguguuccauagauau

SEQ ID NO: 17302 - RNA, 21 nt, Artificial Sequence
  Description of Artificial Sequence: Synthetic oligonucleotide
ucuauguguuccauagauauc

SEQ ID NO: 17303 - RNA, 21 nt, Artificial Sequence
  Description of Artificial Sequence: Synthetic oligonucleotide
cuauguguuccauagauaucu

SEQ ID NO: 17304 - RNA, 21 nt, Artificial Sequence
  Description of Artificial Sequence: Synthetic oligonucleotide
uauguguuccauagauaucuu

SEQ ID NO: 17305 - RNA, 21 nt, Artificial Sequence
  Description of Artificial Sequence: Synthetic oligonucleotide
auguguuccauagauaucuua

SEQ ID NO: 17306 - RNA, 21 nt, Artificial Sequence
  Description of Artificial Sequence: Synthetic oligonucleotide
uguguuccauagauaucuuaa

SEQ ID NO: 17307 - RNA, 21 nt, Artificial Sequence
  Description of Artificial Sequence: Synthetic oligonucleotide
guguuccauagauaucuuaau

SEQ ID NO: 17308 - RNA, 21 nt, Artificial Sequence
  Description of Artificial Sequence: Synthetic oligonucleotide
uguuccauagauaucuuaaug

SEQ ID NO: 17309 - RNA, 21 nt, Artificial Sequence
  Description of Artificial Sequence: Synthetic oligonucleotide
guuccauagauaucuuaaugu

SEQ ID NO: 17310 - RNA, 21 nt, Artificial Sequence
  Description of Artificial Sequence: Synthetic oligonucleotide
uuccauagauaucuuaaugua

SEQ ID NO: 17311 - RNA, 21 nt, Artificial Sequence
  Description of Artificial Sequence: Synthetic oligonucleotide
uccauagauaucuuaauguaa

SEQ ID NO: 17312 - RNA, 21 nt, Artificial Sequence
  Description of Artificial Sequence: Synthetic oligonucleotide
ccauagauaucuuaauguaaa

SEQ ID NO: 17313 - RNA, 21 nt, Artificial Sequence
  Description of Artificial Sequence: Synthetic oligonucleotide
cauagauaucuuaauguaaaa

SEQ ID NO: 17314 - RNA, 21 nt, Artificial Sequence
  Description of Artificial Sequence: Synthetic oligonucleotide
auagauaucuuaauguaaaau

SEQ ID NO: 17315 - RNA, 21 nt, Artificial Sequence
  Description of Artificial Sequence: Synthetic oligonucleotide
uagauaucuuaauguaaaauu

SEQ ID NO: 17316 - RNA, 21 nt, Artificial Sequence
  Description of Artificial Sequence: Synthetic oligonucleotide
agauaucuuaauguaaaauua

SEQ ID NO: 17317 - RNA, 21 nt, Artificial Sequence
  Description of Artificial Sequence: Synthetic oligonucleotide
gauaucuuaauguaaaauuag

SEQ ID NO: 17318 - RNA, 21 nt, Artificial Sequence
  Description of Artificial Sequence: Synthetic oligonucleotide
auaucuuaauguaaaauuagu

SEQ ID NO: 17319 - RNA, 21 nt, Artificial Sequence
  Description of Artificial Sequence: Synthetic oligonucleotide
uaucuuaauguaaaauuaguc

SEQ ID NO: 17320 - RNA, 21 nt, Artificial Sequence
  Description of Artificial Sequence: Synthetic oligonucleotide
aucuuaauguaaaauuaguca

SEQ ID NO: 17321 - RNA, 21 nt, Artificial Sequence
  Description of Artificial Sequence: Synthetic oligonucleotide
ucuuaauguaaaauuagucau

SEQ ID NO: 17322 - RNA, 21 nt, Artificial Sequence
  Description of Artificial Sequence: Synthetic oligonucleotide
cuuaauguaaaauuagucauu

SEQ ID NO: 17323 - RNA, 21 nt, Artificial Sequence
  Description of Artificial Sequence: Synthetic oligonucleotide
uuaauguaaaauuagucauuu

SEQ ID NO: 17324 - RNA, 21 nt, Artificial Sequence
  Description of Artificial Sequence: Synthetic oligonucleotide
uaauguaaaauuagucauuua

SEQ ID NO: 17325 - RNA, 21 nt, Artificial Sequence
  Description of Artificial Sequence: Synthetic oligonucleotide
aauguaaaauuagucauuuaa

SEQ ID NO: 17326 - RNA, 21 nt, Artificial Sequence
  Description of Artificial Sequence: Synthetic oligonucleotide
auguaaaauuagucauuuaaa

SEQ ID NO: 17327 - RNA, 21 nt, Artificial Sequence
  Description of Artificial Sequence: Synthetic oligonucleotide
uguaaaauuagucauuuaaau

SEQ ID NO: 17328 - RNA, 21 nt, Artificial Sequence
  Description of Artificial Sequence: Synthetic oligonucleotide
guaaaauuagucauuuaaauu

SEQ ID NO: 17329 - RNA, 21 nt, Artificial Sequence
  Description of Artificial Sequence: Synthetic oligonucleotide
uaaaauuagucauuuaaauua

SEQ ID NO: 17330 - RNA, 21 nt, Artificial Sequence
  Description of Artificial Sequence: Synthetic oligonucleotide
aaaauuagucauuuaaauuac

SEQ ID NO: 17331 - RNA, 21 nt, Artificial Sequence
  Description of Artificial Sequence: Synthetic oligonucleotide
aaauuagucauuuaaauuaca

SEQ ID NO: 17332 - RNA, 21 nt, Artificial Sequence
  Description of Artificial Sequence: Synthetic oligonucleotide
aauuagucauuuaaauuacac

SEQ ID NO: 17333 - RNA, 21 nt, Artificial Sequence
  Description of Artificial Sequence: Synthetic oligonucleotide
auuagucauuuaaauuacacu

SEQ ID NO: 17334 - RNA, 21 nt, Artificial Sequence
  Description of Artificial Sequence: Synthetic oligonucleotide
uuagucauuuaaauuacacug

SEQ ID NO: 17335 - RNA, 21 nt, Artificial Sequence
  Description of Artificial Sequence: Synthetic oligonucleotide
uagucauuuaaauuacacugu

SEQ ID NO: 17336 - RNA, 21 nt, Artificial Sequence
  Description of Artificial Sequence: Synthetic oligonucleotide
agucauuuaaauuacacuguc

SEQ ID NO: 17337 - RNA, 21 nt, Artificial Sequence
  Description of Artificial Sequence: Synthetic oligonucleotide
gucauuuaaauuacacuguca

SEQ ID NO: 17338 - RNA, 21 nt, Artificial Sequence
  Description of Artificial Sequence: Synthetic oligonucleotide
ucauuuaaauuacacugucaa

SEQ ID NO: 17339 - RNA, 21 nt, Artificial Sequence
  Description of Artificial Sequence: Synthetic oligonucleotide
cauuuaaauuacacugucaau

SEQ ID NO: 17340 - RNA, 21 nt, Artificial Sequence
  Description of Artificial Sequence: Synthetic oligonucleotide
auuuaaauuacacugucaauu

SEQ ID NO: 17341 - RNA, 21 nt, Artificial Sequence
  Description of Artificial Sequence: Synthetic oligonucleotide
uuuaaauuacacugucaauua

SEQ ID NO: 17342 - RNA, 21 nt, Artificial Sequence
  Description of Artificial Sequence: Synthetic oligonucleotide
uuaaauuacacugucaauuaa

SEQ ID NO: 17343 - RNA, 21 nt, Artificial Sequence
  Description of Artificial Sequence: Synthetic oligonucleotide
uaaauuacacugucaauuaaa

SEQ ID NO: 17344 - RNA, 21 nt, Artificial Sequence
  Description of Artificial Sequence: Synthetic oligonucleotide
aaauuacacugucaauuaaaa

SEQ ID NO: 17345 - RNA, 21 nt, Artificial Sequence
  Description of Artificial Sequence: Synthetic oligonucleotide
aauuacacugucaauuaaaag

SEQ ID NO: 17346 - RNA, 21 nt, Artificial Sequence
  Description of Artificial Sequence: Synthetic oligonucleotide
auuacacugucaauuaaaagu

SEQ ID NO: 17347 - RNA, 21 nt, Artificial Sequence
  Description of Artificial Sequence: Synthetic oligonucleotide
uuacacugucaauuaaaagua

SEQ ID NO: 17348 - RNA, 21 nt, Artificial Sequence
  Description of Artificial Sequence: Synthetic oligonucleotide
uacacugucaauuaaaaguaa

SEQ ID NO: 17349 - RNA, 21 nt, Artificial Sequence
  Description of Artificial Sequence: Synthetic oligonucleotide
acacugucaauuaaaaguaau

SEQ ID NO: 17350 - RNA, 21 nt, Artificial Sequence
  Description of Artificial Sequence: Synthetic oligonucleotide
cacugucaauuaaaaguaaug

SEQ ID NO: 17351 - RNA, 21 nt, Artificial Sequence
  Description of Artificial Sequence: Synthetic oligonucleotide
acugucaauuaaaaguaaugg

SEQ ID NO: 17352 - RNA, 21 nt, Artificial Sequence
  Description of Artificial Sequence: Synthetic oligonucleotide
cugucaauuaaaaguaauggg

SEQ ID NO: 17353 - RNA, 21 nt, Artificial Sequence
  Description of Artificial Sequence: Synthetic oligonucleotide
ugucaauuaaaaguaaugggc

SEQ ID NO: 17354 - RNA, 21 nt, Artificial Sequence
  Description of Artificial Sequence: Synthetic oligonucleotide
gucaauuaaaaguaaugggca

SEQ ID NO: 17355 - RNA, 21 nt, Artificial Sequence
  Description of Artificial Sequence: Synthetic oligonucleotide
ucaauuaaaaguaaugggcaa

SEQ ID NO: 17356 - RNA, 21 nt, Artificial Sequence
  Description of Artificial Sequence: Synthetic oligonucleotide
caauuaaaaguaaugggcaag

SEQ ID NO: 17357 - RNA, 21 nt, Artificial Sequence
  Description of Artificial Sequence: Synthetic oligonucleotide
aauuaaaaguaaugggcaaga

SEQ ID NO: 17358 - RNA, 21 nt, Artificial Sequence
  Description of Artificial Sequence: Synthetic oligonucleotide
auuaaaaguaaugggcaagag

SEQ ID NO: 17359 - RNA, 21 nt, Artificial Sequence
  Description of Artificial Sequence: Synthetic oligonucleotide
uuaaaaguaaugggcaagaga

SEQ ID NO: 17360 - RNA, 21 nt, Artificial Sequence
  Description of Artificial Sequence: Synthetic oligonucleotide
uaaaaguaaugggcaagagau

SEQ ID NO: 17361 - RNA, 21 nt, Artificial Sequence
  Description of Artificial Sequence: Synthetic oligonucleotide
aaaaguaaugggcaagagauu

SEQ ID NO: 17362 - RNA, 21 nt, Artificial Sequence
  Description of Artificial Sequence: Synthetic oligonucleotide
aaaguaaugggcaagagauug

SEQ ID NO: 17363 - RNA, 21 nt, Artificial Sequence
  Description of Artificial Sequence: Synthetic oligonucleotide
aaguaaugggcaagagauugc

SEQ ID NO: 17364 - RNA, 21 nt, Artificial Sequence
  Description of Artificial Sequence: Synthetic oligonucleotide
aguaaugggcaagagauugca

SEQ ID NO: 17365 - RNA, 21 nt, Artificial Sequence
  Description of Artificial Sequence: Synthetic oligonucleotide
guaaugggcaagagauugcau

SEQ ID NO: 17366 - RNA, 21 nt, Artificial Sequence
  Description of Artificial Sequence: Synthetic oligonucleotide
uaaugggcaagagauugcauc

SEQ ID NO: 17367 - RNA, 21 nt, Artificial Sequence
  Description of Artificial Sequence: Synthetic oligonucleotide
aaugggcaagagauugcauca

SEQ ID NO: 17368 - RNA, 21 nt, Artificial Sequence
  Description of Artificial Sequence: Synthetic oligonucleotide
augggcaagagauugcaucau

SEQ ID NO: 17369 - RNA, 21 nt, Artificial Sequence
  Description of Artificial Sequence: Synthetic oligonucleotide
ugggcaagagauugcaucaua

SEQ ID NO: 17370 - RNA, 21 nt, Artificial Sequence
  Description of Artificial Sequence: Synthetic oligonucleotide
gggcaagagauugcaucauac

SEQ ID NO: 17371 - RNA, 21 nt, Artificial Sequence
  Description of Artificial Sequence: Synthetic oligonucleotide
ggcaagagauugcaucauacu

SEQ ID NO: 17372 - RNA, 21 nt, Artificial Sequence
  Description of Artificial Sequence: Synthetic oligonucleotide
gcaagagauugcaucauacua

SEQ ID NO: 17373 - RNA, 21 nt, Artificial Sequence
  Description of Artificial Sequence: Synthetic oligonucleotide
caagagauugcaucauacuaa

SEQ ID NO: 17374 - RNA, 21 nt, Artificial Sequence
  Description of Artificial Sequence: Synthetic oligonucleotide
aagagauugcaucauacuaau

SEQ ID NO: 17375 - RNA, 21 nt, Artificial Sequence
  Description of Artificial Sequence: Synthetic oligonucleotide
agagauugcaucauacuaauu

SEQ ID NO: 17376 - RNA, 21 nt, Artificial Sequence
  Description of Artificial Sequence: Synthetic oligonucleotide
gagauugcaucauacuaauuu

SEQ ID NO: 17377 - RNA, 21 nt, Artificial Sequence
  Description of Artificial Sequence: Synthetic oligonucleotide
agauugcaucauacuaauuua

SEQ ID NO: 17378 - RNA, 21 nt, Artificial Sequence
  Description of Artificial Sequence: Synthetic oligonucleotide
gauugcaucauacuaauuuag

SEQ ID NO: 17379 - RNA, 21 nt, Artificial Sequence
  Description of Artificial Sequence: Synthetic oligonucleotide
auugcaucauacuaauuuagu

SEQ ID NO: 17380 - RNA, 21 nt, Artificial Sequence
  Description of Artificial Sequence: Synthetic oligonucleotide
uugcaucauacuaauuuagua

SEQ ID NO: 17381 - RNA, 21 nt, Artificial Sequence
  Description of Artificial Sequence: Synthetic oligonucleotide
ugcaucauacuaauuuaguaa

SEQ ID NO: 17382 - RNA, 21 nt, Artificial Sequence
  Description of Artificial Sequence: Synthetic oligonucleotide
gcaucauacuaauuuaguaag

SEQ ID NO: 17383 - RNA, 21 nt, Artificial Sequence
  Description of Artificial Sequence: Synthetic oligonucleotide
caucauacuaauuuaguaaga

SEQ ID NO: 17384 - RNA, 21 nt, Artificial Sequence
  Description of Artificial Sequence: Synthetic oligonucleotide
aucauacuaauuuaguaagaa

SEQ ID NO: 17385 - RNA, 21 nt, Artificial Sequence
  Description of Artificial Sequence: Synthetic oligonucleotide
ucauacuaauuuaguaagaac

SEQ ID NO: 17386 - RNA, 21 nt, Artificial Sequence
  Description of Artificial Sequence: Synthetic oligonucleotide
cauacuaauuuaguaagaacg

SEQ ID NO: 17387 - RNA, 21 nt, Artificial Sequence
  Description of Artificial Sequence: Synthetic oligonucleotide
auacuaauuuaguaagaacgu

SEQ ID NO: 17388 - RNA, 21 nt, Artificial Sequence
  Description of Artificial Sequence: Synthetic oligonucleotide
uacuaauuuaguaagaacguu

SEQ ID NO: 17389 - RNA, 21 nt, Artificial Sequence
  Description of Artificial Sequence: Synthetic oligonucleotide
acuaauuuaguaagaacguuc

SEQ ID NO: 17390 - RNA, 21 nt, Artificial Sequence
  Description of Artificial Sequence: Synthetic oligonucleotide
cuaauuuaguaagaacguucc

SEQ ID NO: 17391 - RNA, 21 nt, Artificial Sequence
  Description of Artificial Sequence: Synthetic oligonucleotide
uaauuuaguaagaacguuccc

SEQ ID NO: 17392 - RNA, 21 nt, Artificial Sequence
  Description of Artificial Sequence: Synthetic oligonucleotide
aauuuaguaagaacguuccca

SEQ ID NO: 17393 - RNA, 21 nt, Artificial Sequence
  Description of Artificial Sequence: Synthetic oligonucleotide
auuuaguaagaacguucccaa

SEQ ID NO: 17394 - RNA, 21 nt, Artificial Sequence
  Description of Artificial Sequence: Synthetic oligonucleotide
uuuaguaagaacguucccaaa

SEQ ID NO: 17395 - RNA, 21 nt, Artificial Sequence
  Description of Artificial Sequence: Synthetic oligonucleotide
uuaguaagaacguucccaaau

SEQ ID NO: 17396 - RNA, 21 nt, Artificial Sequence
  Description of Artificial Sequence: Synthetic oligonucleotide
uaguaagaacguucccaaaug

SEQ ID NO: 17397 - RNA, 21 nt, Artificial Sequence
  Description of Artificial Sequence: Synthetic oligonucleotide
aguaagaacguucccaaaugu

SEQ ID NO: 17398 - RNA, 21 nt, Artificial Sequence
  Description of Artificial Sequence: Synthetic oligonucleotide
guaagaacguucccaaauguu

SEQ ID NO: 17399 - RNA, 21 nt, Artificial Sequence
  Description of Artificial Sequence: Synthetic oligonucleotide
uaagaacguucccaaauguug

SEQ ID NO: 17400 - RNA, 21 nt, Artificial Sequence
  Description of Artificial Sequence: Synthetic oligonucleotide
aagaacguucccaaauguugu

SEQ ID NO: 17401 - RNA, 21 nt, Artificial Sequence
  Description of Artificial Sequence: Synthetic oligonucleotide
agaacguucccaaauguugua

SEQ ID NO: 17402 - RNA, 21 nt, Artificial Sequence
  Description of Artificial Sequence: Synthetic oligonucleotide
gaacguucccaaauguuguaa

SEQ ID NO: 17403 - RNA, 21 nt, Artificial Sequence
  Description of Artificial Sequence: Synthetic oligonucleotide
aacguucccaaauguuguaac

SEQ ID NO: 17404 - RNA, 21 nt, Artificial Sequence
  Description of Artificial Sequence: Synthetic oligonucleotide
acguucccaaauguuguaaca

SEQ ID NO: 17405 - RNA, 21 nt, Artificial Sequence
  Description of Artificial Sequence: Synthetic oligonucleotide
cguucccaaauguuguaacaa

SEQ ID NO: 17406 - RNA, 21 nt, Artificial Sequence
  Description of Artificial Sequence: Synthetic oligonucleotide
guucccaaauguuguaacaau

SEQ ID NO: 17407 - RNA, 21 nt, Artificial Sequence
  Description of Artificial Sequence: Synthetic oligonucleotide
uucccaaauguuguaacaaug

SEQ ID NO: 17408 - RNA, 21 nt, Artificial Sequence
  Description of Artificial Sequence: Synthetic oligonucleotide
ucccaaauguuguaacaaugu

SEQ ID NO: 17409 - RNA, 21 nt, Artificial Sequence
  Description of Artificial Sequence: Synthetic oligonucleotide
cccaaauguuguaacaaugug

SEQ ID NO: 17410 - RNA, 21 nt, Artificial Sequence
  Description of Artificial Sequence: Synthetic oligonucleotide
ccaaauguuguaacaaugugg

SEQ ID NO: 17411 - RNA, 21 nt, Artificial Sequence
  Description of Artificial Sequence: Synthetic oligonucleotide
caaauguuguaacaaugugga

SEQ ID NO: 17412 - RNA, 21 nt, Artificial Sequence
  Description of Artificial Sequence: Synthetic oligonucleotide
aaauguuguaacaauguggau

SEQ ID NO: 17413 - RNA, 21 nt, Artificial Sequence
  Description of Artificial Sequence: Synthetic oligonucleotide
aauguuguaacaauguggauc

SEQ ID NO: 17414 - RNA, 21 nt, Artificial Sequence
  Description of Artificial Sequence: Synthetic oligonucleotide
auguuguaacaauguggauca

SEQ ID NO: 17415 - RNA, 21 nt, Artificial Sequence
  Description of Artificial Sequence: Synthetic oligonucleotide
uguuguaacaauguggaucau

SEQ ID NO: 17416 - RNA, 21 nt, Artificial Sequence
  Description of Artificial Sequence: Synthetic oligonucleotide
guuguaacaauguggaucaua

SEQ ID NO: 17417 - RNA, 21 nt, Artificial Sequence
  Description of Artificial Sequence: Synthetic oligonucleotide
uuguaacaauguggaucauac

SEQ ID NO: 17418 - RNA, 21 nt, Artificial Sequence
  Description of Artificial Sequence: Synthetic oligonucleotide
uguaacaauguggaucauaca

SEQ ID NO: 17419 - RNA, 21 nt, Artificial Sequence
  Description of Artificial Sequence: Synthetic oligonucleotide
guaacaauguggaucauacau

SEQ ID NO: 17420 - RNA, 21 nt, Artificial Sequence
  Description of Artificial Sequence: Synthetic oligonucleotide
uaacaauguggaucauacauc

SEQ ID NO: 17421 - RNA, 21 nt, Artificial Sequence
  Description of Artificial Sequence: Synthetic oligonucleotide
aacaauguggaucauacaucu

SEQ ID NO: 17422 - RNA, 21 nt, Artificial Sequence
  Description of Artificial Sequence: Synthetic oligonucleotide
acaauguggaucauacaucuc

SEQ ID NO: 17423 - RNA, 21 nt, Artificial Sequence
  Description of Artificial Sequence: Synthetic oligonucleotide
caauguggaucauacaucucu

SEQ ID NO: 17424 - RNA, 21 nt, Artificial Sequence
  Description of Artificial Sequence: Synthetic oligonucleotide
aauguggaucauacaucucug

SEQ ID NO: 17425 - RNA, 21 nt, Artificial Sequence
  Description of Artificial Sequence: Synthetic oligonucleotide
auguggaucauacaucucugg

SEQ ID NO: 17426 - RNA, 21 nt, Artificial Sequence
  Description of Artificial Sequence: Synthetic oligonucleotide
uguggaucauacaucucuggu

SEQ ID NO: 17427 - RNA, 21 nt, Artificial Sequence
  Description of Artificial Sequence: Synthetic oligonucleotide
guggaucauacaucucugguu

SEQ ID NO: 17428 - RNA, 21 nt, Artificial Sequence
  Description of Artificial Sequence: Synthetic oligonucleotide
uggaucauacaucucugguuu

SEQ ID NO: 17429 - RNA, 21 nt, Artificial Sequence
  Description of Artificial Sequence: Synthetic oligonucleotide
ggaucauacaucucugguuuu

SEQ ID NO: 17430 - RNA, 21 nt, Artificial Sequence
  Description of Artificial Sequence: Synthetic oligonucleotide
gaucauacaucucugguuuuu

SEQ ID NO: 17431 - RNA, 21 nt, Artificial Sequence
  Description of Artificial Sequence: Synthetic oligonucleotide
aucauacaucucugguuuuuu

SEQ ID NO: 17432 - RNA, 21 nt, Artificial Sequence
  Description of Artificial Sequence: Synthetic oligonucleotide
ucauacaucucugguuuuuua

SEQ ID NO: 17433 - RNA, 21 nt, Artificial Sequence
  Description of Artificial Sequence: Synthetic oligonucleotide
cauacaucucugguuuuuuaa

SEQ ID NO: 17434 - RNA, 21 nt, Artificial Sequence
  Description of Artificial Sequence: Synthetic oligonucleotide
auacaucucugguuuuuuaaa

SEQ ID NO: 17435 - RNA, 21 nt, Artificial Sequence
  Description of Artificial Sequence: Synthetic oligonucleotide
uacaucucugguuuuuuaaau

SEQ ID NO: 17436 - RNA, 21 nt, Artificial Sequence
  Description of Artificial Sequence: Synthetic oligonucleotide
acaucucugguuuuuuaaaug

SEQ ID NO: 17437 - RNA, 21 nt, Artificial Sequence
  Description of Artificial Sequence: Synthetic oligonucleotide
caucucugguuuuuuaaaugu

SEQ ID NO: 17438 - RNA, 21 nt, Artificial Sequence
  Description of Artificial Sequence: Synthetic oligonucleotide
aucucugguuuuuuaaaugua

SEQ ID NO: 17439 - RNA, 21 nt, Artificial Sequence
  Description of Artificial Sequence: Synthetic oligonucleotide
ucucugguuuuuuaaauguau

SEQ ID NO: 17440 - RNA, 21 nt, Artificial Sequence
  Description of Artificial Sequence: Synthetic oligonucleotide
cucugguuuuuuaaauguauu

SEQ ID NO: 17441 - RNA, 21 nt, Artificial Sequence
  Description of Artificial Sequence: Synthetic oligonucleotide
ucugguuuuuuaaauguauug

SEQ ID NO: 17442 - RNA, 21 nt, Artificial Sequence
  Description of Artificial Sequence: Synthetic oligonucleotide
cugguuuuuuaaauguauuga

SEQ ID NO: 17443 - RNA, 21 nt, Artificial Sequence
  Description of Artificial Sequence: Synthetic oligonucleotide
ugguuuuuuaaauguauugag

SEQ ID NO: 17444 - RNA, 21 nt, Artificial Sequence
  Description of Artificial Sequence: Synthetic oligonucleotide
gguuuuuuaaauguauugagg

SEQ ID NO: 17445 - RNA, 21 nt, Artificial Sequence
  Description of Artificial Sequence: Synthetic oligonucleotide
guuuuuuaaauguauugaggc

SEQ ID NO: 17446 - RNA, 21 nt, Artificial Sequence
  Description of Artificial Sequence: Synthetic oligonucleotide
uuuuuuaaauguauugaggcu

SEQ ID NO: 17447 - RNA, 21 nt, Artificial Sequence
  Description of Artificial Sequence: Synthetic oligonucleotide
uuuuuaaauguauugaggcuu

SEQ ID NO: 17448 - RNA, 21 nt, Artificial Sequence
  Description of Artificial Sequence: Synthetic oligonucleotide
uuuuaaauguauugaggcuuu

SEQ ID NO: 17449 - RNA, 21 nt, Artificial Sequence
  Description of Artificial Sequence: Synthetic oligonucleotide
uuuaaauguauugaggcuuuc

SEQ ID NO: 17450 - RNA, 21 nt, Artificial Sequence
  Description of Artificial Sequence: Synthetic oligonucleotide
uuaaauguauugaggcuuucu

SEQ ID NO: 17451 - RNA, 21 nt, Artificial Sequence
  Description of Artificial Sequence: Synthetic oligonucleotide
uaaauguauugaggcuuucuu

SEQ ID NO: 17452 - RNA, 21 nt, Artificial Sequence
  Description of Artificial Sequence: Synthetic oligonucleotide
aaauguauugaggcuuucuug

SEQ ID NO: 17453 - RNA, 21 nt, Artificial Sequence
  Description of Artificial Sequence: Synthetic oligonucleotide
aauguauugaggcuuucuugg

SEQ ID NO: 17454 - RNA, 21 nt, Artificial Sequence
  Description of Artificial Sequence: Synthetic oligonucleotide
auguauugaggcuuucuuggu

SEQ ID NO: 17455 - RNA, 21 nt, Artificial Sequence
  Description of Artificial Sequence: Synthetic oligonucleotide
uguauugaggcuuucuuggug

SEQ ID NO: 17456 - RNA, 21 nt, Artificial Sequence
  Description of Artificial Sequence: Synthetic oligonucleotide
guauugaggcuuucuuggugg

SEQ ID NO: 17457 - RNA, 21 nt, Artificial Sequence
  Description of Artificial Sequence: Synthetic oligonucleotide
uauugaggcuuucuuggugga

SEQ ID NO: 17458 - RNA, 21 nt, Artificial Sequence
  Description of Artificial Sequence: Synthetic oligonucleotide
auugaggcuuucuugguggac

SEQ ID NO: 17459 - RNA, 21 nt, Artificial Sequence
  Description of Artificial Sequence: Synthetic oligonucleotide
uugaggcuuucuugguggacu

SEQ ID NO: 17460 - RNA, 21 nt, Artificial Sequence
  Description of Artificial Sequence: Synthetic oligonucleotide
ugaggcuuucuugguggacua

SEQ ID NO: 17461 - RNA, 21 nt, Artificial Sequence
  Description of Artificial Sequence: Synthetic oligonucleotide
gaggcuuucuugguggacuag

SEQ ID NO: 17462 - RNA, 21 nt, Artificial Sequence
  Description of Artificial Sequence: Synthetic oligonucleotide
aggcuuucuugguggacuagu

SEQ ID NO: 17463 - RNA, 21 nt, Artificial Sequence
  Description of Artificial Sequence: Synthetic oligonucleotide
ggcuuucuugguggacuagua

SEQ ID NO: 17464 - RNA, 21 nt, Artificial Sequence
  Description of Artificial Sequence: Synthetic oligonucleotide
gcuuucuugguggacuaguau

SEQ ID NO: 17465 - RNA, 21 nt, Artificial Sequence
  Description of Artificial Sequence: Synthetic oligonucleotide
cuuucuugguggacuaguaua

SEQ ID NO: 17466 - RNA, 21 nt, Artificial Sequence
  Description of Artificial Sequence: Synthetic oligonucleotide
uuucuugguggacuaguauag

SEQ ID NO: 17467 - RNA, 21 nt, Artificial Sequence
  Description of Artificial Sequence: Synthetic oligonucleotide
uucuugguggacuaguauagu

SEQ ID NO: 17468 - RNA, 21 nt, Artificial Sequence
  Description of Artificial Sequence: Synthetic oligonucleotide
ucuugguggacuaguauagua

SEQ ID NO: 17469 - RNA, 21 nt, Artificial Sequence
  Description of Artificial Sequence: Synthetic oligonucleotide
cuugguggacuaguauaguau

SEQ ID NO: 17470 - RNA, 21 nt, Artificial Sequence
  Description of Artificial Sequence: Synthetic oligonucleotide
uugguggacuaguauaguaua

SEQ ID NO: 17471 - RNA, 21 nt, Artificial Sequence
  Description of Artificial Sequence: Synthetic oligonucleotide
ugguggacuaguauaguauac

SEQ ID NO: 17472 - RNA, 21 nt, Artificial Sequence
  Description of Artificial Sequence: Synthetic oligonucleotide
gguggacuaguauaguauacg

SEQ ID NO: 17473 - RNA, 21 nt, Artificial Sequence
  Description of Artificial Sequence: Synthetic oligonucleotide
guggacuaguauaguauacgg

SEQ ID NO: 17474 - RNA, 21 nt, Artificial Sequence
  Description of Artificial Sequence: Synthetic oligonucleotide
uggacuaguauaguauacggu

SEQ ID NO: 17475 - RNA, 21 nt, Artificial Sequence
  Description of Artificial Sequence: Synthetic oligonucleotide
ggacuaguauaguauacgguc

SEQ ID NO: 17476 - RNA, 21 nt, Artificial Sequence
  Description of Artificial Sequence: Synthetic oligonucleotide
gacuaguauaguauacgguca

SEQ ID NO: 17477 - RNA, 21 nt, Artificial Sequence
  Description of Artificial Sequence: Synthetic oligonucleotide
acuaguauaguauacggucag

SEQ ID NO: 17478 - RNA, 21 nt, Artificial Sequence
  Description of Artificial Sequence: Synthetic oligonucleotide
cuaguauaguauacggucagu

SEQ ID NO: 17479 - RNA, 21 nt, Artificial Sequence
  Description of Artificial Sequence: Synthetic oligonucleotide
uaguauaguauacggucaguu

SEQ ID NO: 17480 - RNA, 21 nt, Artificial Sequence
  Description of Artificial Sequence: Synthetic oligonucleotide
aguauaguauacggucaguua

SEQ ID NO: 17481 - RNA, 21 nt, Artificial Sequence
  Description of Artificial Sequence: Synthetic oligonucleotide
guauaguauacggucaguuau

SEQ ID NO: 17482 - RNA, 21 nt, Artificial Sequence
  Description of Artificial Sequence: Synthetic oligonucleotide
uauaguauacggucaguuaug

SEQ ID NO: 17483 - RNA, 21 nt, Artificial Sequence
  Description of Artificial Sequence: Synthetic oligonucleotide
auaguauacggucaguuaugu

SEQ ID NO: 17484 - RNA, 21 nt, Artificial Sequence
  Description of Artificial Sequence: Synthetic oligonucleotide
uaguauacggucaguuauguc

SEQ ID NO: 17485 - RNA, 21 nt, Artificial Sequence
  Description of Artificial Sequence: Synthetic oligonucleotide
aguauacggucaguuauguca

SEQ ID NO: 17486 - RNA, 21 nt, Artificial Sequence
  Description of Artificial Sequence: Synthetic oligonucleotide
guauacggucaguuaugucaa

SEQ ID NO: 17487 - RNA, 21 nt, Artificial Sequence
  Description of Artificial Sequence: Synthetic oligonucleotide
uauacggucaguuaugucaau

SEQ ID NO: 17488 - RNA, 21 nt, Artificial Sequence
  Description of Artificial Sequence: Synthetic oligonucleotide
auacggucaguuaugucaaug

SEQ ID NO: 17489 - RNA, 21 nt, Artificial Sequence
  Description of Artificial Sequence: Synthetic oligonucleotide
uacggucaguuaugucaaugu

SEQ ID NO: 17490 - RNA, 21 nt, Artificial Sequence
  Description of Artificial Sequence: Synthetic oligonucleotide
acggucaguuaugucaauguu

SEQ ID NO: 17491 - RNA, 21 nt, Artificial Sequence
  Description of Artificial Sequence: Synthetic oligonucleotide
cggucaguuaugucaauguuu

SEQ ID NO: 17492 - RNA, 21 nt, Artificial Sequence
  Description of Artificial Sequence: Synthetic oligonucleotide
ggucaguuaugucaauguuuc

SEQ ID NO: 17493 - RNA, 21 nt, Artificial Sequence
  Description of Artificial Sequence: Synthetic oligonucleotide
gucaguuaugucaauguuuca

SEQ ID NO: 17494 - RNA, 21 nt, Artificial Sequence
  Description of Artificial Sequence: Synthetic oligonucleotide
ucaguuaugucaauguuucau

SEQ ID NO: 17495 - RNA, 21 nt, Artificial Sequence
  Description of Artificial Sequence: Synthetic oligonucleotide
caguuaugucaauguuucaug

SEQ ID NO: 17496 - RNA, 21 nt, Artificial Sequence
  Description of Artificial Sequence: Synthetic oligonucleotide
aguuaugucaauguuucaugg

SEQ ID NO: 17497 - RNA, 21 nt, Artificial Sequence
  Description of Artificial Sequence: Synthetic oligonucleotide
guuaugucaauguuucauggu

SEQ ID NO: 17498 - RNA, 21 nt, Artificial Sequence
  Description of Artificial Sequence: Synthetic oligonucleotide
uuaugucaauguuucaugguc

SEQ ID NO: 17499 - RNA, 21 nt, Artificial Sequence
  Description of Artificial Sequence: Synthetic oligonucleotide
uaugucaauguuucaugguca

SEQ ID NO: 17500 - RNA, 21 nt, Artificial Sequence
  Description of Artificial Sequence: Synthetic oligonucleotide
augucaauguuucauggucaa

SEQ ID NO: 17501 - RNA, 21 nt, Artificial Sequence
  Description of Artificial Sequence: Synthetic oligonucleotide
ugucaauguuucauggucaau

SEQ ID NO: 17502 - RNA, 21 nt, Artificial Sequence
  Description of Artificial Sequence: Synthetic oligonucleotide
gucaauguuucauggucaaua

SEQ ID NO: 17503 - RNA, 21 nt, Artificial Sequence
  Description of Artificial Sequence: Synthetic oligonucleotide
ucaauguuucauggucaauaa

SEQ ID NO: 17504 - RNA, 21 nt, Artificial Sequence
  Description of Artificial Sequence: Synthetic oligonucleotide
caauguuucauggucaauaaa

SEQ ID NO: 17505 - RNA, 21 nt, Artificial Sequence
  Description of Artificial Sequence: Synthetic oligonucleotide
aauguuucauggucaauaaaa

SEQ ID NO: 17506 - RNA, 21 nt, Artificial Sequence
  Description of Artificial Sequence: Synthetic oligonucleotide
auguuucauggucaauaaaaa

SEQ ID NO: 17507 - RNA, 21 nt, Artificial Sequence
  Description of Artificial Sequence: Synthetic oligonucleotide
uguuucauggucaauaaaaag

SEQ ID NO: 17508 - RNA, 21 nt, Artificial Sequence
  Description of Artificial Sequence: Synthetic oligonucleotide
guuucauggucaauaaaaagg

SEQ ID NO: 17509 - RNA, 21 nt, Artificial Sequence
  Description of Artificial Sequence: Synthetic oligonucleotide
uuucauggucaauaaaaagga

SEQ ID NO: 17510 - RNA, 21 nt, Artificial Sequence
  Description of Artificial Sequence: Synthetic oligonucleotide
uucauggucaauaaaaaggaa

SEQ ID NO: 17511 - RNA, 21 nt, Artificial Sequence
  Description of Artificial Sequence: Synthetic oligonucleotide
ucauggucaauaaaaaggaag

SEQ ID NO: 17512 - RNA, 21 nt, Artificial Sequence
  Description of Artificial Sequence: Synthetic oligonucleotide
cauggucaauaaaaaggaagu

SEQ ID NO: 17513 - RNA, 21 nt, Artificial Sequence
  Description of Artificial Sequence: Synthetic oligonucleotide
auggucaauaaaaaggaaguu

SEQ ID NO: 17514 - RNA, 21 nt, Artificial Sequence
  Description of Artificial Sequence: Synthetic oligonucleotide
uggucaauaaaaaggaaguug

SEQ ID NO: 17515 - RNA, 21 nt, Artificial Sequence
  Description of Artificial Sequence: Synthetic oligonucleotide
ggucaauaaaaaggaaguugc

SEQ ID NO: 17516 - RNA, 21 nt, Artificial Sequence
  Description of Artificial Sequence: Synthetic oligonucleotide
gucaauaaaaaggaaguugca

SEQ ID NO: 17517 - RNA, 21 nt, Artificial Sequence
  Description of Artificial Sequence: Synthetic oligonucleotide
ucaauaaaaaggaaguugcaa

SEQ ID NO: 17518 - RNA, 21 nt, Artificial Sequence
  Description of Artificial Sequence: Synthetic oligonucleotide
caauaaaaaggaaguugcaaa

SEQ ID NO: 17519 - RNA, 21 nt, Artificial Sequence
  Description of Artificial Sequence: Synthetic oligonucleotide
aauaaaaaggaaguugcaaau

SEQ ID NO: 17520 - RNA, 21 nt, Artificial Sequence
  Description of Artificial Sequence: Synthetic oligonucleotide
auaaaaaggaaguugcaaauu

SEQ ID NO: 17521 - RNA, 21 nt, Artificial Sequence
  Description of Artificial Sequence: Synthetic oligonucleotide
uaaaaaggaaguugcaaauug

SEQ ID NO: 17522 - RNA, 21 nt, Artificial Sequence
  Description of Artificial Sequence: Synthetic oligonucleotide
aaaaaggaaguugcaaauugu

SEQ ID NO: 17523 - RNA, 21 nt, Artificial Sequence
  Description of Artificial Sequence: Synthetic oligonucleotide
aaaaggaaguugcaaauugug

SEQ ID NO: 17524 - RNA, 21 nt, Artificial Sequence
  Description of Artificial Sequence: Synthetic oligonucleotide
aaaggaaguugcaaauuguga

SEQ ID NO: 17525 - RNA, 21 nt, Artificial Sequence
  Description of Artificial Sequence: Synthetic oligonucleotide
aaggaaguugcaaauugugau

SEQ ID NO: 17526 - RNA, 21 nt, Artificial Sequence
  Description of Artificial Sequence: Synthetic oligonucleotide
aggaaguugcaaauugugauu

SEQ ID NO: 17527 - RNA, 21 nt, Artificial Sequence
  Description of Artificial Sequence: Synthetic oligonucleotide
aucagggagacuccaacuauu

SEQ ID NO: 17528 - RNA, 21 nt, Artificial Sequence
  Description of Artificial Sequence: Synthetic oligonucleotide
ucagggagacuccaacuuauu

SEQ ID NO: 17529 - RNA, 21 nt, Artificial Sequence
  Description of Artificial Sequence: Synthetic oligonucleotide
cagggagacuccaacuuaauu

SEQ ID NO: 17530 - RNA, 21 nt, Artificial Sequence
  Description of Artificial Sequence: Synthetic oligonucleotide
agggagacuccaacuuaaauu

SEQ ID NO: 17531 - RNA, 21 nt, Artificial Sequence
  Description of Artificial Sequence: Synthetic oligonucleotide
gggagacuccaacuuaagauu

SEQ ID NO: 17532 - RNA, 21 nt, Artificial Sequence
  Description of Artificial Sequence: Synthetic oligonucleotide
ggagacuccaacuuaaggauu

SEQ ID NO: 17533 - RNA, 21 nt, Artificial Sequence
  Description of Artificial Sequence: Synthetic oligonucleotide
gagacuccaacuuaaggcauu

SEQ ID NO: 17534 - RNA, 21 nt, Artificial Sequence
  Description of Artificial Sequence: Synthetic oligonucleotide
agacuccaacuuaaggcaauu

SEQ ID NO: 17535 - RNA, 21 nt, Artificial Sequence
  Description of Artificial Sequence: Synthetic oligonucleotide
gacuccaacuuaaggcaaauu

SEQ ID NO: 17536 - RNA, 21 nt, Artificial Sequence
  Description of Artificial Sequence: Synthetic oligonucleotide
acuccaacuuaaggcaacauu

SEQ ID NO: 17537 - RNA, 21 nt, Artificial Sequence
  Description of Artificial Sequence: Synthetic oligonucleotide
cuccaacuuaaggcaacaauu

SEQ ID NO: 17538 - RNA, 21 nt, Artificial Sequence
  Description of Artificial Sequence: Synthetic oligonucleotide
uccaacuuaaggcaacagauu

SEQ ID NO: 17539 - RNA, 21 nt, Artificial Sequence
  Description of Artificial Sequence: Synthetic oligonucleotide
ccaacuuaaggcaacagcauu

SEQ ID NO: 17540 - RNA, 21 nt, Artificial Sequence
  Description of Artificial Sequence: Synthetic oligonucleotide
caacuuaaggcaacagcaauu

SEQ ID NO: 17541 - RNA, 21 nt, Artificial Sequence
  Description of Artificial Sequence: Synthetic oligonucleotide
aacuuaaggcaacagcauauu

SEQ ID NO: 17542 - RNA, 21 nt, Artificial Sequence
  Description of Artificial Sequence: Synthetic oligonucleotide
acuuaaggcaacagcaugauu

SEQ ID NO: 17543 - RNA, 21 nt, Artificial Sequence
  Description of Artificial Sequence: Synthetic oligonucleotide
cuuaaggcaacagcauggauu

SEQ ID NO: 17544 - RNA, 21 nt, Artificial Sequence
  Description of Artificial Sequence: Synthetic oligonucleotide
uuaaggcaacagcaugggauu

SEQ ID NO: 17545 - RNA, 21 nt, Artificial Sequence
  Description of Artificial Sequence: Synthetic oligonucleotide
uaaggcaacagcauggguauu

SEQ ID NO: 17546 - RNA, 21 nt, Artificial Sequence
  Description of Artificial Sequence: Synthetic oligonucleotide
aaggcaacagcaugggugauu

SEQ ID NO: 17547 - RNA, 21 nt, Artificial Sequence
  Description of Artificial Sequence: Synthetic oligonucleotide
aggcaacagcaugggugaauu

SEQ ID NO: 17548 - RNA, 21 nt, Artificial Sequence
  Description of Artificial Sequence: Synthetic oligonucleotide
ggcaacagcaugggugaaauu

SEQ ID NO: 17549 - RNA, 21 nt, Artificial Sequence
  Description of Artificial Sequence: Synthetic oligonucleotide
gcaacagcaugggugaauauu

SEQ ID NO: 17550 - RNA, 21 nt, Artificial Sequence
  Description of Artificial Sequence: Synthetic oligonucleotide
caacagcaugggugaauaauu

SEQ ID NO: 17551 - RNA, 21 nt, Artificial Sequence
  Description of Artificial Sequence: Synthetic oligonucleotide
aacagcaugggugaauaaauu

SEQ ID NO: 17552 - RNA, 21 nt, Artificial Sequence
  Description of Artificial Sequence: Synthetic oligonucleotide
acagcaugggugaauaagauu

SEQ ID NO: 17553 - RNA, 21 nt, Artificial Sequence
  Description of Artificial Sequence: Synthetic oligonucleotide
cagcaugggugaauaaggauu

SEQ ID NO: 17554 - RNA, 21 nt, Artificial Sequence
  Description of Artificial Sequence: Synthetic oligonucleotide
agcaugggugaauaagggauu

SEQ ID NO: 17555 - RNA, 21 nt, Artificial Sequence
  Description of Artificial Sequence: Synthetic oligonucleotide
gcaugggugaauaagggcauu

SEQ ID NO: 17556 - RNA, 21 nt, Artificial Sequence
  Description of Artificial Sequence: Synthetic oligonucleotide
caugggugaauaagggcuauu

SEQ ID NO: 17557 - RNA, 21 nt, Artificial Sequence
  Description of Artificial Sequence: Synthetic oligonucleotide
augggugaauaagggcuuauu

SEQ ID NO: 17558 - RNA, 21 nt, Artificial Sequence
  Description of Artificial Sequence: Synthetic oligonucleotide
ugggugaauaagggcuucauu

SEQ ID NO: 17559 - RNA, 21 nt, Artificial Sequence
  Description of Artificial Sequence: Synthetic oligonucleotide
gggugaauaagggcuuccauu

SEQ ID NO: 17560 - RNA, 21 nt, Artificial Sequence
  Description of Artificial Sequence: Synthetic oligonucleotide
ggugaauaagggcuuccuauu

SEQ ID NO: 17561 - RNA, 21 nt, Artificial Sequence
  Description of Artificial Sequence: Synthetic oligonucleotide
gugaauaagggcuuccugauu

SEQ ID NO: 17562 - RNA, 21 nt, Artificial Sequence
  Description of Artificial Sequence: Synthetic oligonucleotide
ugaauaagggcuuccuguauu

SEQ ID NO: 17563 - RNA, 21 nt, Artificial Sequence
  Description of Artificial Sequence: Synthetic oligonucleotide
gaauaagggcuuccugugauu

SEQ ID NO: 17564 - RNA, 21 nt, Artificial Sequence
  Description of Artificial Sequence: Synthetic oligonucleotide
aauaagggcuuccuguggauu

SEQ ID NO: 17565 - RNA, 21 nt, Artificial Sequence
  Description of Artificial Sequence: Synthetic oligonucleotide
auaagggcuuccuguggaauu

SEQ ID NO: 17566 - RNA, 21 nt, Artificial Sequence
  Description of Artificial Sequence: Synthetic oligonucleotide
uaagggcuuccuguggacauu

SEQ ID NO: 17567 - RNA, 21 nt, Artificial Sequence
  Description of Artificial Sequence: Synthetic oligonucleotide
aagggcuuccuguggacuauu

SEQ ID NO: 17568 - RNA, 21 nt, Artificial Sequence
  Description of Artificial Sequence: Synthetic oligonucleotide
agggcuuccuguggacugauu

SEQ ID NO: 17569 - RNA, 21 nt, Artificial Sequence
  Description of Artificial Sequence: Synthetic oligonucleotide
gggcuuccuguggacuggauu

SEQ ID NO: 17570 - RNA, 21 nt, Artificial Sequence
  Description of Artificial Sequence: Synthetic oligonucleotide
ggcuuccuguggacuggcauu

SEQ ID NO: 17571 - RNA, 21 nt, Artificial Sequence
  Description of Artificial Sequence: Synthetic oligonucleotide
gcuuccuguggacuggcaauu

SEQ ID NO: 17572 - RNA, 21 nt, Artificial Sequence
  Description of Artificial Sequence: Synthetic oligonucleotide
cuuccuguggacuggcaaauu

SEQ ID NO: 17573 - RNA, 21 nt, Artificial Sequence
  Description of Artificial Sequence: Synthetic oligonucleotide
uuccuguggacuggcaauauu

SEQ ID NO: 17574 - RNA, 21 nt, Artificial Sequence
  Description of Artificial Sequence: Synthetic oligonucleotide
uccuguggacuggcaaugauu

SEQ ID NO: 17575 - RNA, 21 nt, Artificial Sequence
  Description of Artificial Sequence: Synthetic oligonucleotide
ccuguggacuggcaaugaauu

SEQ ID NO: 17576 - RNA, 21 nt, Artificial Sequence
  Description of Artificial Sequence: Synthetic oligonucleotide
cuguggacuggcaaugagauu

SEQ ID NO: 17577 - RNA, 21 nt, Artificial Sequence
  Description of Artificial Sequence: Synthetic oligonucleotide
uguggacuggcaaugagaauu

SEQ ID NO: 17578 - RNA, 21 nt, Artificial Sequence
  Description of Artificial Sequence: Synthetic oligonucleotide
guggacuggcaaugagagauu

SEQ ID NO: 17579 - RNA, 21 nt, Artificial Sequence
  Description of Artificial Sequence: Synthetic oligonucleotide
uggacuggcaaugagaggauu

SEQ ID NO: 17580 - RNA, 21 nt, Artificial Sequence
  Description of Artificial Sequence: Synthetic oligonucleotide
ggacuggcaaugagaggcauu

SEQ ID NO: 17581 - RNA, 21 nt, Artificial Sequence
  Description of Artificial Sequence: Synthetic oligonucleotide
gacuggcaaugagaggcaauu

SEQ ID NO: 17582 - RNA, 21 nt, Artificial Sequence
  Description of Artificial Sequence: Synthetic oligonucleotide
acuggcaaugagaggcaaauu

SEQ ID NO: 17583 - RNA, 21 nt, Artificial Sequence
  Description of Artificial Sequence: Synthetic oligonucleotide
cuggcaaugagaggcaaaauu

SEQ ID NO: 17584 - RNA, 21 nt, Artificial Sequence
  Description of Artificial Sequence: Synthetic oligonucleotide
uggcaaugagaggcaaaaauu

SEQ ID NO: 17585 - RNA, 21 nt, Artificial Sequence
  Description of Artificial Sequence: Synthetic oligonucleotide
ggcaaugagaggcaaaacauu

SEQ ID NO: 17586 - RNA, 21 nt, Artificial Sequence
  Description of Artificial Sequence: Synthetic oligonucleotide
gcaaugagaggcaaaaccauu

SEQ ID NO: 17587 - RNA, 21 nt, Artificial Sequence
  Description of Artificial Sequence: Synthetic oligonucleotide
caaugagaggcaaaaccuauu

SEQ ID NO: 17588 - RNA, 21 nt, Artificial Sequence
  Description of Artificial Sequence: Synthetic oligonucleotide
aaugagaggcaaaaccugauu

SEQ ID NO: 17589 - RNA, 21 nt, Artificial Sequence
  Description of Artificial Sequence: Synthetic oligonucleotide
augagaggcaaaaccuggauu

SEQ ID NO: 17590 - RNA, 21 nt, Artificial Sequence
  Description of Artificial Sequence: Synthetic oligonucleotide
ugagaggcaaaaccugguauu

SEQ ID NO: 17591 - RNA, 21 nt, Artificial Sequence
  Description of Artificial Sequence: Synthetic oligonucleotide
gagaggcaaaaccuggugauu

SEQ ID NO: 17592 - RNA, 21 nt, Artificial Sequence
  Description of Artificial Sequence: Synthetic oligonucleotide
agaggcaaaaccuggugcauu

SEQ ID NO: 17593 - RNA, 21 nt, Artificial Sequence
  Description of Artificial Sequence: Synthetic oligonucleotide
gaggcaaaaccuggugcuauu

SEQ ID NO: 17594 - RNA, 21 nt, Artificial Sequence
  Description of Artificial Sequence: Synthetic oligonucleotide
aggcaaaaccuggugcuuauu

SEQ ID NO: 17595 - RNA, 21 nt, Artificial Sequence
  Description of Artificial Sequence: Synthetic oligonucleotide
ggcaaaaccuggugcuugauu

SEQ ID NO: 17596 - RNA, 21 nt, Artificial Sequence
  Description of Artificial Sequence: Synthetic oligonucleotide
gcaaaaccuggugcuugaauu

SEQ ID NO: 17597 - RNA, 21 nt, Artificial Sequence
  Description of Artificial Sequence: Synthetic oligonucleotide
caaaaccuggugcuugagauu

SEQ ID NO: 17598 - RNA, 21 nt, Artificial Sequence
  Description of Artificial Sequence: Synthetic oligonucleotide
aaaaccuggugcuugagcauu

SEQ ID NO: 17599 - RNA, 21 nt, Artificial Sequence
  Description of Artificial Sequence: Synthetic oligonucleotide
aaaccuggugcuugagcaauu

SEQ ID NO: 17600 - RNA, 21 nt, Artificial Sequence
  Description of Artificial Sequence: Synthetic oligonucleotide
aaccuggugcuugagcacauu

SEQ ID NO: 17601 - RNA, 21 nt, Artificial Sequence
  Description of Artificial Sequence: Synthetic oligonucleotide
accuggugcuugagcacuauu

SEQ ID NO: 17602 - RNA, 21 nt, Artificial Sequence
  Description of Artificial Sequence: Synthetic oligonucleotide
ccuggugcuugagcacugauu

SEQ ID NO: 17603 - RNA, 21 nt, Artificial Sequence
  Description of Artificial Sequence: Synthetic oligonucleotide
cuggugcuugagcacuggauu

SEQ ID NO: 17604 - RNA, 21 nt, Artificial Sequence
  Description of Artificial Sequence: Synthetic oligonucleotide
uggugcuugagcacuggcauu

SEQ ID NO: 17605 - RNA, 21 nt, Artificial Sequence
  Description of Artificial Sequence: Synthetic oligonucleotide
ggugcuugagcacuggccauu

SEQ ID NO: 17606 - RNA, 21 nt, Artificial Sequence
  Description of Artificial Sequence: Synthetic oligonucleotide
gugcuugagcacuggcccauu

SEQ ID NO: 17607 - RNA, 21 nt, Artificial Sequence
  Description of Artificial Sequence: Synthetic oligonucleotide
ugcuugagcacuggccccauu

SEQ ID NO: 17608 - RNA, 21 nt, Artificial Sequence
  Description of Artificial Sequence: Synthetic oligonucleotide
gcuugagcacuggccccuauu

SEQ ID NO: 17609 - RNA, 21 nt, Artificial Sequence
  Description of Artificial Sequence: Synthetic oligonucleotide
cuugagcacuggccccuaauu

SEQ ID NO: 17610 - RNA, 21 nt, Artificial Sequence
  Description of Artificial Sequence: Synthetic oligonucleotide
uugagcacuggccccuaaauu

SEQ ID NO: 17611 - RNA, 21 nt, Artificial Sequence
  Description of Artificial Sequence: Synthetic oligonucleotide
ugagcacuggccccuaagauu

SEQ ID NO: 17612 - RNA, 21 nt, Artificial Sequence
  Description of Artificial Sequence: Synthetic oligonucleotide
gagcacuggccccuaaggauu

SEQ ID NO: 17613 - RNA, 21 nt, Artificial Sequence
  Description of Artificial Sequence: Synthetic oligonucleotide
agcacuggccccuaaggcauu

SEQ ID NO: 17614 - RNA, 21 nt, Artificial Sequence
  Description of Artificial Sequence: Synthetic oligonucleotide
gcacuggccccuaaggcaauu

SEQ ID NO: 17615 - RNA, 21 nt, Artificial Sequence
  Description of Artificial Sequence: Synthetic oligonucleotide
cacuggccccuaaggcagauu

SEQ ID NO: 17616 - RNA, 21 nt, Artificial Sequence
  Description of Artificial Sequence: Synthetic oligonucleotide
acuggccccuaaggcaggauu

SEQ ID NO: 17617 - RNA, 21 nt, Artificial Sequence
  Description of Artificial Sequence: Synthetic oligonucleotide
cuggccccuaaggcaggcauu

SEQ ID NO: 17618 - RNA, 21 nt, Artificial Sequence
  Description of Artificial Sequence: Synthetic oligonucleotide
uggccccuaaggcaggccauu

SEQ ID NO: 17619 - RNA, 21 nt, Artificial Sequence
  Description of Artificial Sequence: Synthetic oligonucleotide
ggccccuaaggcaggccuauu

SEQ ID NO: 17620 - RNA, 21 nt, Artificial Sequence
  Description of Artificial Sequence: Synthetic oligonucleotide
gccccuaaggcaggccuuauu

SEQ ID NO: 17621 - RNA, 21 nt, Artificial Sequence
  Description of Artificial Sequence: Synthetic oligonucleotide
ccccuaaggcaggccuuaauu

SEQ ID NO: 17622 - RNA, 21 nt, Artificial Sequence
  Description of Artificial Sequence: Synthetic oligonucleotide
cccuaaggcaggccuuacauu

SEQ ID NO: 17623 - RNA, 21 nt, Artificial Sequence
  Description of Artificial Sequence: Synthetic oligonucleotide
ccuaaggcaggccuuacaauu

SEQ ID NO: 17624 - RNA, 21 nt, Artificial Sequence
  Description of Artificial Sequence: Synthetic oligonucleotide
cuaaggcaggccuuacagauu

SEQ ID NO: 17625 - RNA, 21 nt, Artificial Sequence
  Description of Artificial Sequence: Synthetic oligonucleotide
uaaggcaggccuuacagaauu

SEQ ID NO: 17626 - RNA, 21 nt, Artificial Sequence
  Description of Artificial Sequence: Synthetic oligonucleotide
aaggcaggccuuacagauauu

SEQ ID NO: 17627 - RNA, 21 nt, Artificial Sequence
  Description of Artificial Sequence: Synthetic oligonucleotide
aggcaggccuuacagaucauu

SEQ ID NO: 17628 - RNA, 21 nt, Artificial Sequence
  Description of Artificial Sequence: Synthetic oligonucleotide
ggcaggccuuacagaucuauu

SEQ ID NO: 17629 - RNA, 21 nt, Artificial Sequence
  Description of Artificial Sequence: Synthetic oligonucleotide
gcaggccuuacagaucucauu

SEQ ID NO: 17630 - RNA, 21 nt, Artificial Sequence
  Description of Artificial Sequence: Synthetic oligonucleotide
caggccuuacagaucucuauu

SEQ ID NO: 17631 - RNA, 21 nt, Artificial Sequence
  Description of Artificial Sequence: Synthetic oligonucleotide
aggccuuacagaucucuuauu

SEQ ID NO: 17632 - RNA, 21 nt, Artificial Sequence
  Description of Artificial Sequence: Synthetic oligonucleotide
ggccuuacagaucucuuaauu

SEQ ID NO: 17633 - RNA, 21 nt, Artificial Sequence
  Description of Artificial Sequence: Synthetic oligonucleotide
gccuuacagaucucuuacauu

SEQ ID NO: 17634 - RNA, 21 nt, Artificial Sequence
  Description of Artificial Sequence: Synthetic oligonucleotide
ccuuacagaucucuuacaauu

SEQ ID NO: 17635 - RNA, 21 nt, Artificial Sequence
  Description of Artificial Sequence: Synthetic oligonucleotide
cuuacagaucucuuacacauu

SEQ ID NO: 17636 - RNA, 21 nt, Artificial Sequence
  Description of Artificial Sequence: Synthetic oligonucleotide
uuacagaucucuuacacuauu

SEQ ID NO: 17637 - RNA, 21 nt, Artificial Sequence
  Description of Artificial Sequence: Synthetic oligonucleotide
uacagaucucuuacacucauu

SEQ ID NO: 17638 - RNA, 21 nt, Artificial Sequence
  Description of Artificial Sequence: Synthetic oligonucleotide
acagaucucuuacacucgauu

SEQ ID NO: 17639 - RNA, 21 nt, Artificial Sequence
  Description of Artificial Sequence: Synthetic oligonucleotide
cagaucucuuacacucguauu

SEQ ID NO: 17640 - RNA, 21 nt, Artificial Sequence
  Description of Artificial Sequence: Synthetic oligonucleotide
agaucucuuacacucgugauu

SEQ ID NO: 17641 - RNA, 21 nt, Artificial Sequence
  Description of Artificial Sequence: Synthetic oligonucleotide
gaucucuuacacucguggauu

SEQ ID NO: 17642 - RNA, 21 nt, Artificial Sequence
  Description of Artificial Sequence: Synthetic oligonucleotide
aucucuuacacucgugguauu

SEQ ID NO: 17643 - RNA, 21 nt, Artificial Sequence
  Description of Artificial Sequence: Synthetic oligonucleotide
ucucuuacacucguggugauu

SEQ ID NO: 17644 - RNA, 21 nt, Artificial Sequence
  Description of Artificial Sequence: Synthetic oligonucleotide
cucuuacacucgugguggauu

SEQ ID NO: 17645 - RNA, 21 nt, Artificial Sequence
  Description of Artificial Sequence: Synthetic oligonucleotide
ucuuacacucguggugggauu

SEQ ID NO: 17646 - RNA, 21 nt, Artificial Sequence
  Description of Artificial Sequence: Synthetic oligonucleotide
cuuacacucguggugggaauu

SEQ ID NO: 17647 - RNA, 21 nt, Artificial Sequence
  Description of Artificial Sequence: Synthetic oligonucleotide
uuacacucguggugggaaauu

SEQ ID NO: 17648 - RNA, 21 nt, Artificial Sequence
  Description of Artificial Sequence: Synthetic oligonucleotide
uacacucguggugggaagauu

SEQ ID NO: 17649 - RNA, 21 nt, Artificial Sequence
  Description of Artificial Sequence: Synthetic oligonucleotide
acacucguggugggaagaauu

SEQ ID NO: 17650 - RNA, 21 nt, Artificial Sequence
  Description of Artificial Sequence: Synthetic oligonucleotide
cacucguggugggaagagauu

SEQ ID NO: 17651 - RNA, 21 nt, Artificial Sequence
  Description of Artificial Sequence: Synthetic oligonucleotide
acucguggugggaagaguauu

SEQ ID NO: 17652 - RNA, 21 nt, Artificial Sequence
  Description of Artificial Sequence: Synthetic oligonucleotide
cucguggugggaagaguuauu

SEQ ID NO: 17653 - RNA, 21 nt, Artificial Sequence
  Description of Artificial Sequence: Synthetic oligonucleotide
ucguggugggaagaguuuauu

SEQ ID NO: 17654 - RNA, 21 nt, Artificial Sequence
  Description of Artificial Sequence: Synthetic oligonucleotide
cguggugggaagaguuuaauu

SEQ ID NO: 17655 - RNA, 21 nt, Artificial Sequence
  Description of Artificial Sequence: Synthetic oligonucleotide
guggugggaagaguuuagauu

SEQ ID NO: 17656 - RNA, 21 nt, Artificial Sequence
  Description of Artificial Sequence: Synthetic oligonucleotide
uggugggaagaguuuaguauu

SEQ ID NO: 17657 - RNA, 21 nt, Artificial Sequence
  Description of Artificial Sequence: Synthetic oligonucleotide
ggugggaagaguuuagugauu

SEQ ID NO: 17658 - RNA, 21 nt, Artificial Sequence
  Description of Artificial Sequence: Synthetic oligonucleotide
gugggaagaguuuaguguauu

SEQ ID NO: 17659 - RNA, 21 nt, Artificial Sequence
  Description of Artificial Sequence: Synthetic oligonucleotide
ugggaagaguuuagugugauu

SEQ ID NO: 17660 - RNA, 21 nt, Artificial Sequence
  Description of Artificial Sequence: Synthetic oligonucleotide
gggaagaguuuagugugaauu

SEQ ID NO: 17661 - RNA, 21 nt, Artificial Sequence
  Description of Artificial Sequence: Synthetic oligonucleotide
ggaagaguuuagugugaaauu

SEQ ID NO: 17662 - RNA, 21 nt, Artificial Sequence
  Description of Artificial Sequence: Synthetic oligonucleotide
gaagaguuuagugugaaaauu

SEQ ID NO: 17663 - RNA, 21 nt, Artificial Sequence
  Description of Artificial Sequence: Synthetic oligonucleotide
aagaguuuagugugaaacauu

SEQ ID NO: 17664 - RNA, 21 nt, Artificial Sequence
  Description of Artificial Sequence: Synthetic oligonucleotide
agaguuuagugugaaacuauu

SEQ ID NO: 17665 - RNA, 21 nt, Artificial Sequence
  Description of Artificial Sequence: Synthetic oligonucleotide
gaguuuagugugaaacugauu

SEQ ID NO: 17666 - RNA, 21 nt, Artificial Sequence
  Description of Artificial Sequence: Synthetic oligonucleotide
aguuuagugugaaacuggauu

SEQ ID NO: 17667 - RNA, 21 nt, Artificial Sequence
  Description of Artificial Sequence: Synthetic oligonucleotide
guuuagugugaaacugggauu

SEQ ID NO: 17668 - RNA, 21 nt, Artificial Sequence
  Description of Artificial Sequence: Synthetic oligonucleotide
uuuagugugaaacuggggauu

SEQ ID NO: 17669 - RNA, 21 nt, Artificial Sequence
  Description of Artificial Sequence: Synthetic oligonucleotide
uuagugugaaacugggguauu

SEQ ID NO: 17670 - RNA, 21 nt, Artificial Sequence
  Description of Artificial Sequence: Synthetic oligonucleotide
uagugugaaacuggggugauu

SEQ ID NO: 17671 - RNA, 21 nt, Artificial Sequence
  Description of Artificial Sequence: Synthetic oligonucleotide
agugugaaacugggguggauu

SEQ ID NO: 17672 - RNA, 21 nt, Artificial Sequence
  Description of Artificial Sequence: Synthetic oligonucleotide
gugugaaacugggguggaauu

SEQ ID NO: 17673 - RNA, 21 nt, Artificial Sequence
  Description of Artificial Sequence: Synthetic oligonucleotide
ugugaaacugggguggaaauu

SEQ ID NO: 17674 - RNA, 21 nt, Artificial Sequence
  Description of Artificial Sequence: Synthetic oligonucleotide
gugaaacugggguggaauauu

SEQ ID NO: 17675 - RNA, 21 nt, Artificial Sequence
  Description of Artificial Sequence: Synthetic oligonucleotide
ugaaacugggguggaauuauu

SEQ ID NO: 17676 - RNA, 21 nt, Artificial Sequence
  Description of Artificial Sequence: Synthetic oligonucleotide
gaaacugggguggaauugauu

SEQ ID NO: 17677 - RNA, 21 nt, Artificial Sequence
  Description of Artificial Sequence: Synthetic oligonucleotide
aaacugggguggaauuggauu

SEQ ID NO: 17678 - RNA, 21 nt, Artificial Sequence
  Description of Artificial Sequence: Synthetic oligonucleotide
aacugggguggaauugggauu

SEQ ID NO: 17679 - RNA, 21 nt, Artificial Sequence
  Description of Artificial Sequence: Synthetic oligonucleotide
acugggguggaauuggguauu

SEQ ID NO: 17680 - RNA, 21 nt, Artificial Sequence
  Description of Artificial Sequence: Synthetic oligonucleotide
cugggguggaauugggugauu

SEQ ID NO: 17681 - RNA, 21 nt, Artificial Sequence
  Description of Artificial Sequence: Synthetic oligonucleotide
ugggguggaauuggguguauu

SEQ ID NO: 17682 - RNA, 21 nt, Artificial Sequence
  Description of Artificial Sequence: Synthetic oligonucleotide
gggguggaauugggugucauu

SEQ ID NO: 17683 - RNA, 21 nt, Artificial Sequence
  Description of Artificial Sequence: Synthetic oligonucleotide
ggguggaauuggguguccauu

SEQ ID NO: 17684 - RNA, 21 nt, Artificial Sequence
  Description of Artificial Sequence: Synthetic oligonucleotide
gguggaauuggguguccaauu

SEQ ID NO: 17685 - RNA, 21 nt, Artificial Sequence
  Description of Artificial Sequence: Synthetic oligonucleotide
guggaauuggguguccacauu

SEQ ID NO: 17686 - RNA, 21 nt, Artificial Sequence
  Description of Artificial Sequence: Synthetic oligonucleotide
uggaauuggguguccacgauu

SEQ ID NO: 17687 - RNA, 21 nt, Artificial Sequence
  Description of Artificial Sequence: Synthetic oligonucleotide
ggaauuggguguccacguauu

SEQ ID NO: 17688 - RNA, 21 nt, Artificial Sequence
  Description of Artificial Sequence: Synthetic oligonucleotide
gaauuggguguccacguaauu

SEQ ID NO: 17689 - RNA, 21 nt, Artificial Sequence
  Description of Artificial Sequence: Synthetic oligonucleotide
aauuggguguccacguauauu

SEQ ID NO: 17690 - RNA, 21 nt, Artificial Sequence
  Description of Artificial Sequence: Synthetic oligonucleotide
auuggguguccacguaugauu

SEQ ID NO: 17691 - RNA, 21 nt, Artificial Sequence
  Description of Artificial Sequence: Synthetic oligonucleotide
uuggguguccacguauguauu

SEQ ID NO: 17692 - RNA, 21 nt, Artificial Sequence
  Description of Artificial Sequence: Synthetic oligonucleotide
uggguguccacguauguuauu

SEQ ID NO: 17693 - RNA, 21 nt, Artificial Sequence
  Description of Artificial Sequence: Synthetic oligonucleotide
ggguguccacguauguucauu

SEQ ID NO: 17694 - RNA, 21 nt, Artificial Sequence
  Description of Artificial Sequence: Synthetic oligonucleotide
gguguccacguauguuccauu

SEQ ID NO: 17695 - RNA, 21 nt, Artificial Sequence
  Description of Artificial Sequence: Synthetic oligonucleotide
guguccacguauguucccauu

SEQ ID NO: 17696 - RNA, 21 nt, Artificial Sequence
  Description of Artificial Sequence: Synthetic oligonucleotide
uguccacguauguucccuauu

SEQ ID NO: 17697 - RNA, 21 nt, Artificial Sequence
  Description of Artificial Sequence: Synthetic oligonucleotide
guccacguauguucccuuauu

SEQ ID NO: 17698 - RNA, 21 nt, Artificial Sequence
  Description of Artificial Sequence: Synthetic oligonucleotide
uccacguauguucccuuuauu

SEQ ID NO: 17699 - RNA, 21 nt, Artificial Sequence
  Description of Artificial Sequence: Synthetic oligonucleotide
ccacguauguucccuuuuauu

SEQ ID NO: 17700 - RNA, 21 nt, Artificial Sequence
  Description of Artificial Sequence: Synthetic oligonucleotide
cacguauguucccuuuugauu

SEQ ID NO: 17701 - RNA, 21 nt, Artificial Sequence
  Description of Artificial Sequence: Synthetic oligonucleotide
acguauguucccuuuugcauu

SEQ ID NO: 17702 - RNA, 21 nt, Artificial Sequence
  Description of Artificial Sequence: Synthetic oligonucleotide
cguauguucccuuuugccauu

SEQ ID NO: 17703 - RNA, 21 nt, Artificial Sequence
  Description of Artificial Sequence: Synthetic oligonucleotide
guauguucccuuuugccuauu

SEQ ID NO: 17704 - RNA, 21 nt, Artificial Sequence
  Description of Artificial Sequence: Synthetic oligonucleotide
uauguucccuuuugccuuauu

SEQ ID NO: 17705 - RNA, 21 nt, Artificial Sequence
  Description of Artificial Sequence: Synthetic oligonucleotide
auguucccuuuugccuuaauu

SEQ ID NO: 17706 - RNA, 21 nt, Artificial Sequence
  Description of Artificial Sequence: Synthetic oligonucleotide
uguucccuuuugccuuacauu

SEQ ID NO: 17707 - RNA, 21 nt, Artificial Sequence
  Description of Artificial Sequence: Synthetic oligonucleotide
guucccuuuugccuuacuauu

SEQ ID NO: 17708 - RNA, 21 nt, Artificial Sequence
  Description of Artificial Sequence: Synthetic oligonucleotide
uucccuuuugccuuacuaauu

SEQ ID NO: 17709 - RNA, 21 nt, Artificial Sequence
  Description of Artificial Sequence: Synthetic oligonucleotide
ucccuuuugccuuacuauauu

SEQ ID NO: 17710 - RNA, 21 nt, Artificial Sequence
  Description of Artificial Sequence: Synthetic oligonucleotide
cccuuuugccuuacuauaauu

SEQ ID NO: 17711 - RNA, 21 nt, Artificial Sequence
  Description of Artificial Sequence: Synthetic oligonucleotide
ccuuuugccuuacuauauauu

SEQ ID NO: 17712 - RNA, 21 nt, Artificial Sequence
  Description of Artificial Sequence: Synthetic oligonucleotide
cuuuugccuuacuauaugauu

SEQ ID NO: 17713 - RNA, 21 nt, Artificial Sequence
  Description of Artificial Sequence: Synthetic oligonucleotide
uuuugccuuacuauauguauu

SEQ ID NO: 17714 - RNA, 21 nt, Artificial Sequence
  Description of Artificial Sequence: Synthetic oligonucleotide
uuugccuuacuauauguuauu

SEQ ID NO: 17715 - RNA, 21 nt, Artificial Sequence
  Description of Artificial Sequence: Synthetic oligonucleotide
uugccuuacuauauguucauu

SEQ ID NO: 17716 - RNA, 21 nt, Artificial Sequence
  Description of Artificial Sequence: Synthetic oligonucleotide
ugccuuacuauauguucuauu

SEQ ID NO: 17717 - RNA, 21 nt, Artificial Sequence
  Description of Artificial Sequence: Synthetic oligonucleotide
gccuuacuauauguucugauu

SEQ ID NO: 17718 - RNA, 21 nt, Artificial Sequence
  Description of Artificial Sequence: Synthetic oligonucleotide
ccuuacuauauguucuguauu

SEQ ID NO: 17719 - RNA, 21 nt, Artificial Sequence
  Description of Artificial Sequence: Synthetic oligonucleotide
cuuacuauauguucugucauu

SEQ ID NO: 17720 - RNA, 21 nt, Artificial Sequence
  Description of Artificial Sequence: Synthetic oligonucleotide
uuacuauauguucugucaauu

SEQ ID NO: 17721 - RNA, 21 nt, Artificial Sequence
  Description of Artificial Sequence: Synthetic oligonucleotide
uacuauauguucugucagauu

SEQ ID NO: 17722 - RNA, 21 nt, Artificial Sequence
  Description of Artificial Sequence: Synthetic oligonucleotide
acuauauguucugucaguauu

SEQ ID NO: 17723 - RNA, 21 nt, Artificial Sequence
  Description of Artificial Sequence: Synthetic oligonucleotide
cuauauguucugucaguuauu

SEQ ID NO: 17724 - RNA, 21 nt, Artificial Sequence
  Description of Artificial Sequence: Synthetic oligonucleotide
uauauguucugucaguuuauu

SEQ ID NO: 17725 - RNA, 21 nt, Artificial Sequence
  Description of Artificial Sequence: Synthetic oligonucleotide
auauguucugucaguuucauu

SEQ ID NO: 17726 - RNA, 21 nt, Artificial Sequence
  Description of Artificial Sequence: Synthetic oligonucleotide
uauguucugucaguuucuauu

SEQ ID NO: 17727 - RNA, 21 nt, Artificial Sequence
  Description of Artificial Sequence: Synthetic oligonucleotide
auguucugucaguuucuuauu

SEQ ID NO: 17728 - RNA, 21 nt, Artificial Sequence
  Description of Artificial Sequence: Synthetic oligonucleotide
uguucugucaguuucuuuauu

SEQ ID NO: 17729 - RNA, 21 nt, Artificial Sequence
  Description of Artificial Sequence: Synthetic oligonucleotide
guucugucaguuucuuucauu

SEQ ID NO: 17730 - RNA, 21 nt, Artificial Sequence
  Description of Artificial Sequence: Synthetic oligonucleotide
uucugucaguuucuuucaauu

SEQ ID NO: 17731 - RNA, 21 nt, Artificial Sequence
  Description of Artificial Sequence: Synthetic oligonucleotide
ucugucaguuucuuucagauu

SEQ ID NO: 17732 - RNA, 21 nt, Artificial Sequence
  Description of Artificial Sequence: Synthetic oligonucleotide
cugucaguuucuuucaggauu

SEQ ID NO: 17733 - RNA, 21 nt, Artificial Sequence
  Description of Artificial Sequence: Synthetic oligonucleotide
ugucaguuucuuucaggaauu

SEQ ID NO: 17734 - RNA, 21 nt, Artificial Sequence
  Description of Artificial Sequence: Synthetic oligonucleotide
gucaguuucuuucaggaaauu

SEQ ID NO: 17735 - RNA, 21 nt, Artificial Sequence
  Description of Artificial Sequence: Synthetic oligonucleotide
ucaguuucuuucaggaaaauu

SEQ ID NO: 17736 - RNA, 21 nt, Artificial Sequence
  Description of Artificial Sequence: Synthetic oligonucleotide
caguuucuuucaggaaaaauu

SEQ ID NO: 17737 - RNA, 21 nt, Artificial Sequence
  Description of Artificial Sequence: Synthetic oligonucleotide
aguuucuuucaggaaaauauu

SEQ ID NO: 17738 - RNA, 21 nt, Artificial Sequence
  Description of Artificial Sequence: Synthetic oligonucleotide
guuucuuucaggaaaaucauu

SEQ ID NO: 17739 - RNA, 21 nt, Artificial Sequence
  Description of Artificial Sequence: Synthetic oligonucleotide
uuucuuucaggaaaaucuauu

SEQ ID NO: 17740 - RNA, 21 nt, Artificial Sequence
  Description of Artificial Sequence: Synthetic oligonucleotide
uucuuucaggaaaaucuuauu

SEQ ID NO: 17741 - RNA, 21 nt, Artificial Sequence
  Description of Artificial Sequence: Synthetic oligonucleotide
ucuuucaggaaaaucuucauu

SEQ ID NO: 17742 - RNA, 21 nt, Artificial Sequence
  Description of Artificial Sequence: Synthetic oligonucleotide
cuuucaggaaaaucuucaauu

SEQ ID NO: 17743 - RNA, 21 nt, Artificial Sequence
  Description of Artificial Sequence: Synthetic oligonucleotide
uuucaggaaaaucuucauauu

SEQ ID NO: 17744 - RNA, 21 nt, Artificial Sequence
  Description of Artificial Sequence: Synthetic oligonucleotide
uucaggaaaaucuucaucauu

SEQ ID NO: 17745 - RNA, 21 nt, Artificial Sequence
  Description of Artificial Sequence: Synthetic oligonucleotide
ucaggaaaaucuucaucuauu

SEQ ID NO: 17746 - RNA, 21 nt, Artificial Sequence
  Description of Artificial Sequence: Synthetic oligonucleotide
caggaaaaucuucaucuuauu

SEQ ID NO: 17747 - RNA, 21 nt, Artificial Sequence
  Description of Artificial Sequence: Synthetic oligonucleotide
aggaaaaucuucaucuuaauu

SEQ ID NO: 17748 - RNA, 21 nt, Artificial Sequence
  Description of Artificial Sequence: Synthetic oligonucleotide
ggaaaaucuucaucuuacauu

SEQ ID NO: 17749 - RNA, 21 nt, Artificial Sequence
  Description of Artificial Sequence: Synthetic oligonucleotide
gaaaaucuucaucuuacaauu

SEQ ID NO: 17750 - RNA, 21 nt, Artificial Sequence
  Description of Artificial Sequence: Synthetic oligonucleotide
aaaaucuucaucuuacaaauu

SEQ ID NO: 17751 - RNA, 21 nt, Artificial Sequence
  Description of Artificial Sequence: Synthetic oligonucleotide
aaaucuucaucuuacaacauu

SEQ ID NO: 17752 - RNA, 21 nt, Artificial Sequence
  Description of Artificial Sequence: Synthetic oligonucleotide
aaucuucaucuuacaacuauu

SEQ ID NO: 17753 - RNA, 21 nt, Artificial Sequence
  Description of Artificial Sequence: Synthetic oligonucleotide
aucuucaucuuacaacuuauu

SEQ ID NO: 17754 - RNA, 21 nt, Artificial Sequence
  Description of Artificial Sequence: Synthetic oligonucleotide
ucuucaucuuacaacuugauu

SEQ ID NO: 17755 - RNA, 21 nt, Artificial Sequence
  Description of Artificial Sequence: Synthetic oligonucleotide
cuucaucuuacaacuuguauu

SEQ ID NO: 17756 - RNA, 21 nt, Artificial Sequence
  Description of Artificial Sequence: Synthetic oligonucleotide
uucaucuuacaacuuguaauu

SEQ ID NO: 17757 - RNA, 21 nt, Artificial Sequence
  Description of Artificial Sequence: Synthetic oligonucleotide
ucaucuuacaacuuguagauu

SEQ ID NO: 17758 - RNA, 21 nt, Artificial Sequence
  Description of Artificial Sequence: Synthetic oligonucleotide
caucuuacaacuuguaggauu

SEQ ID NO: 17759 - RNA, 21 nt, Artificial Sequence
  Description of Artificial Sequence: Synthetic oligonucleotide
aucuuacaacuuguagggauu

SEQ ID NO: 17760 - RNA, 21 nt, Artificial Sequence
  Description of Artificial Sequence: Synthetic oligonucleotide
ucuuacaacuuguagggcauu

SEQ ID NO: 17761 - RNA, 21 nt, Artificial Sequence
  Description of Artificial Sequence: Synthetic oligonucleotide
cuuacaacuuguagggcuauu

SEQ ID NO: 17762 - RNA, 21 nt, Artificial Sequence
  Description of Artificial Sequence: Synthetic oligonucleotide
uuacaacuuguagggcugauu

SEQ ID NO: 17763 - RNA, 21 nt, Artificial Sequence
  Description of Artificial Sequence: Synthetic oligonucleotide
uacaacuuguagggcuggauu

SEQ ID NO: 17764 - RNA, 21 nt, Artificial Sequence
  Description of Artificial Sequence: Synthetic oligonucleotide
acaacuuguagggcugguauu

SEQ ID NO: 17765 - RNA, 21 nt, Artificial Sequence
  Description of Artificial Sequence: Synthetic oligonucleotide
caacuuguagggcuggugauu

SEQ ID NO: 17766 - RNA, 21 nt, Artificial Sequence
  Description of Artificial Sequence: Synthetic oligonucleotide
aacuuguagggcugguguauu

SEQ ID NO: 17767 - RNA, 21 nt, Artificial Sequence
  Description of Artificial Sequence: Synthetic oligonucleotide
acuuguagggcugguguuauu

SEQ ID NO: 17768 - RNA, 21 nt, Artificial Sequence
  Description of Artificial Sequence: Synthetic oligonucleotide
cuuguagggcugguguuaauu

SEQ ID NO: 17769 - RNA, 21 nt, Artificial Sequence
  Description of Artificial Sequence: Synthetic oligonucleotide
uuguagggcugguguuaaauu

SEQ ID NO: 17770 - RNA, 21 nt, Artificial Sequence
  Description of Artificial Sequence: Synthetic oligonucleotide
uguagggcugguguuaacauu

SEQ ID NO: 17771 - RNA, 21 nt, Artificial Sequence
  Description of Artificial Sequence: Synthetic oligonucleotide
guagggcugguguuaacuauu

SEQ ID NO: 17772 - RNA, 21 nt, Artificial Sequence
  Description of Artificial Sequence: Synthetic oligonucleotide
uagggcugguguuaacuuauu

SEQ ID NO: 17773 - RNA, 21 nt, Artificial Sequence
  Description of Artificial Sequence: Synthetic oligonucleotide
agggcugguguuaacuuaauu

SEQ ID NO: 17774 - RNA, 21 nt, Artificial Sequence
  Description of Artificial Sequence: Synthetic oligonucleotide
gggcugguguuaacuuacauu

SEQ ID NO: 17775 - RNA, 21 nt, Artificial Sequence
  Description of Artificial Sequence: Synthetic oligonucleotide
ggcugguguuaacuuacgauu

SEQ ID NO: 17776 - RNA, 21 nt, Artificial Sequence
  Description of Artificial Sequence: Synthetic oligonucleotide
gcugguguuaacuuacgaauu

SEQ ID NO: 17777 - RNA, 21 nt, Artificial Sequence
  Description of Artificial Sequence: Synthetic oligonucleotide
cugguguuaacuuacgacauu

SEQ ID NO: 17778 - RNA, 21 nt, Artificial Sequence
  Description of Artificial Sequence: Synthetic oligonucleotide
ugguguuaacuuacgacuauu

SEQ ID NO: 17779 - RNA, 21 nt, Artificial Sequence
  Description of Artificial Sequence: Synthetic oligonucleotide
gguguuaacuuacgacuuauu

SEQ ID NO: 17780 - RNA, 21 nt, Artificial Sequence
  Description of Artificial Sequence: Synthetic oligonucleotide
guguuaacuuacgacuucauu

SEQ ID NO: 17781 - RNA, 21 nt, Artificial Sequence
  Description of Artificial Sequence: Synthetic oligonucleotide
uguuaacuuacgacuucaauu

SEQ ID NO: 17782 - RNA, 21 nt, Artificial Sequence
  Description of Artificial Sequence: Synthetic oligonucleotide
guuaacuuacgacuucacauu

SEQ ID NO: 17783 - RNA, 21 nt, Artificial Sequence
  Description of Artificial Sequence: Synthetic oligonucleotide
uuaacuuacgacuucacuauu

SEQ ID NO: 17784 - RNA, 21 nt, Artificial Sequence
  Description of Artificial Sequence: Synthetic oligonucleotide
uaacuuacgacuucacuaauu

SEQ ID NO: 17785 - RNA, 21 nt, Artificial Sequence
  Description of Artificial Sequence: Synthetic oligonucleotide
aacuuacgacuucacuaaauu

SEQ ID NO: 17786 - RNA, 21 nt, Artificial Sequence
  Description of Artificial Sequence: Synthetic oligonucleotide
acuuacgacuucacuaacauu

SEQ ID NO: 17787 - RNA, 21 nt, Artificial Sequence
  Description of Artificial Sequence: Synthetic oligonucleotide
cuuacgacuucacuaacuauu

SEQ ID NO: 17788 - RNA, 21 nt, Artificial Sequence
  Description of Artificial Sequence: Synthetic oligonucleotide
uuacgacuucacuaacugauu

SEQ ID NO: 17789 - RNA, 21 nt, Artificial Sequence
  Description of Artificial Sequence: Synthetic oligonucleotide
uacgacuucacuaacuguauu

SEQ ID NO: 17790 - RNA, 21 nt, Artificial Sequence
  Description of Artificial Sequence: Synthetic oligonucleotide
acgacuucacuaacugugauu

SEQ ID NO: 17791 - RNA, 21 nt, Artificial Sequence
  Description of Artificial Sequence: Synthetic oligonucleotide
cgacuucacuaacugugaauu

SEQ ID NO: 17792 - RNA, 21 nt, Artificial Sequence
  Description of Artificial Sequence: Synthetic oligonucleotide
gacuucacuaacugugacauu

SEQ ID NO: 17793 - RNA, 21 nt, Artificial Sequence
  Description of Artificial Sequence: Synthetic oligonucleotide
acuucacuaacugugacuauu

SEQ ID NO: 17794 - RNA, 21 nt, Artificial Sequence
  Description of Artificial Sequence: Synthetic oligonucleotide
cuucacuaacugugacuuauu

SEQ ID NO: 17795 - RNA, 21 nt, Artificial Sequence
  Description of Artificial Sequence: Synthetic oligonucleotide
uucacuaacugugacuuuauu

SEQ ID NO: 17796 - RNA, 21 nt, Artificial Sequence
  Description of Artificial Sequence: Synthetic oligonucleotide
ucacuaacugugacuuugauu

SEQ ID NO: 17797 - RNA, 21 nt, Artificial Sequence
  Description of Artificial Sequence: Synthetic oligonucleotide
cacuaacugugacuuugaauu

SEQ ID NO: 17798 - RNA, 21 nt, Artificial Sequence
  Description of Artificial Sequence: Synthetic oligonucleotide
acuaacugugacuuugagauu

SEQ ID NO: 17799 - RNA, 21 nt, Artificial Sequence
  Description of Artificial Sequence: Synthetic oligonucleotide
cuaacugugacuuugagaauu

SEQ ID NO: 17800 - RNA, 21 nt, Artificial Sequence
  Description of Artificial Sequence: Synthetic oligonucleotide
uaacugugacuuugagaaauu

SEQ ID NO: 17801 - RNA, 21 nt, Artificial Sequence
  Description of Artificial Sequence: Synthetic oligonucleotide
aacugugacuuugagaagauu

SEQ ID NO: 17802 - RNA, 21 nt, Artificial Sequence
  Description of Artificial Sequence: Synthetic oligonucleotide
acugugacuuugagaagaauu

SEQ ID NO: 17803 - RNA, 21 nt, Artificial Sequence
  Description of Artificial Sequence: Synthetic oligonucleotide
cugugacuuugagaagauauu

SEQ ID NO: 17804 - RNA, 21 nt, Artificial Sequence
  Description of Artificial Sequence: Synthetic oligonucleotide
ugugacuuugagaagauuauu

SEQ ID NO: 17805 - RNA, 21 nt, Artificial Sequence
  Description of Artificial Sequence: Synthetic oligonucleotide
gugacuuugagaagauuaauu

SEQ ID NO: 17806 - RNA, 21 nt, Artificial Sequence
  Description of Artificial Sequence: Synthetic oligonucleotide
ugacuuugagaagauuaaauu

SEQ ID NO: 17807 - RNA, 21 nt, Artificial Sequence
  Description of Artificial Sequence: Synthetic oligonucleotide
gacuuugagaagauuaaaauu

SEQ ID NO: 17808 - RNA, 21 nt, Artificial Sequence
  Description of Artificial Sequence: Synthetic oligonucleotide
acuuugagaagauuaaagauu

SEQ ID NO: 17809 - RNA, 21 nt, Artificial Sequence
  Description of Artificial Sequence: Synthetic oligonucleotide
cuuugagaagauuaaagcauu

SEQ ID NO: 17810 - RNA, 21 nt, Artificial Sequence
  Description of Artificial Sequence: Synthetic oligonucleotide
uuugagaagauuaaagcaauu

SEQ ID NO: 17811 - RNA, 21 nt, Artificial Sequence
  Description of Artificial Sequence: Synthetic oligonucleotide
uugagaagauuaaagcagauu

SEQ ID NO: 17812 - RNA, 21 nt, Artificial Sequence
  Description of Artificial Sequence: Synthetic oligonucleotide
ugagaagauuaaagcagcauu

SEQ ID NO: 17813 - RNA, 21 nt, Artificial Sequence
  Description of Artificial Sequence: Synthetic oligonucleotide
gagaagauuaaagcagccauu

SEQ ID NO: 17814 - RNA, 21 nt, Artificial Sequence
  Description of Artificial Sequence: Synthetic oligonucleotide
agaagauuaaagcagccuauu

SEQ ID NO: 17815 - RNA, 21 nt, Artificial Sequence
  Description of Artificial Sequence: Synthetic oligonucleotide
gaagauuaaagcagccuaauu

SEQ ID NO: 17816 - RNA, 21 nt, Artificial Sequence
  Description of Artificial Sequence: Synthetic oligonucleotide
aagauuaaagcagccuauauu

SEQ ID NO: 17817 - RNA, 21 nt, Artificial Sequence
  Description of Artificial Sequence: Synthetic oligonucleotide
agauuaaagcagccuaucauu

SEQ ID NO: 17818 - RNA, 21 nt, Artificial Sequence
  Description of Artificial Sequence: Synthetic oligonucleotide
gauuaaagcagccuaucuauu

SEQ ID NO: 17819 - RNA, 21 nt, Artificial Sequence
  Description of Artificial Sequence: Synthetic oligonucleotide
auuaaagcagccuaucucauu

SEQ ID NO: 17820 - RNA, 21 nt, Artificial Sequence
  Description of Artificial Sequence: Synthetic oligonucleotide
uuaaagcagccuaucucaauu

SEQ ID NO: 17821 - RNA, 21 nt, Artificial Sequence
  Description of Artificial Sequence: Synthetic oligonucleotide
uaaagcagccuaucucagauu

SEQ ID NO: 17822 - RNA, 21 nt, Artificial Sequence
  Description of Artificial Sequence: Synthetic oligonucleotide
aaagcagccuaucucaguauu

SEQ ID NO: 17823 - RNA, 21 nt, Artificial Sequence
  Description of Artificial Sequence: Synthetic oligonucleotide
aagcagccuaucucaguaauu

SEQ ID NO: 17824 - RNA, 21 nt, Artificial Sequence
  Description of Artificial Sequence: Synthetic oligonucleotide
agcagccuaucucaguacauu

SEQ ID NO: 17825 - RNA, 21 nt, Artificial Sequence
  Description of Artificial Sequence: Synthetic oligonucleotide
gcagccuaucucaguacuauu

SEQ ID NO: 17826 - RNA, 21 nt, Artificial Sequence
  Description of Artificial Sequence: Synthetic oligonucleotide
cagccuaucucaguacuaauu

SEQ ID NO: 17827 - RNA, 21 nt, Artificial Sequence
  Description of Artificial Sequence: Synthetic oligonucleotide
agccuaucucaguacuauauu

SEQ ID NO: 17828 - RNA, 21 nt, Artificial Sequence
  Description of Artificial Sequence: Synthetic oligonucleotide
gccuaucucaguacuauuauu

SEQ ID NO: 17829 - RNA, 21 nt, Artificial Sequence
  Description of Artificial Sequence: Synthetic oligonucleotide
ccuaucucaguacuauuuauu

SEQ ID NO: 17830 - RNA, 21 nt, Artificial Sequence
  Description of Artificial Sequence: Synthetic oligonucleotide
cuaucucaguacuauuucauu

SEQ ID NO: 17831 - RNA, 21 nt, Artificial Sequence
  Description of Artificial Sequence: Synthetic oligonucleotide
uaucucaguacuauuucuauu

SEQ ID NO: 17832 - RNA, 21 nt, Artificial Sequence
  Description of Artificial Sequence: Synthetic oligonucleotide
aucucaguacuauuucuaauu

SEQ ID NO: 17833 - RNA, 21 nt, Artificial Sequence
  Description of Artificial Sequence: Synthetic oligonucleotide
ucucaguacuauuucuaaauu

SEQ ID NO: 17834 - RNA, 21 nt, Artificial Sequence
  Description of Artificial Sequence: Synthetic oligonucleotide
cucaguacuauuucuaaaauu

SEQ ID NO: 17835 - RNA, 21 nt, Artificial Sequence
  Description of Artificial Sequence: Synthetic oligonucleotide
ucaguacuauuucuaaagauu

SEQ ID NO: 17836 - RNA, 21 nt, Artificial Sequence
  Description of Artificial Sequence: Synthetic oligonucleotide
caguacuauuucuaaagaauu

SEQ ID NO: 17837 - RNA, 21 nt, Artificial Sequence
  Description of Artificial Sequence: Synthetic oligonucleotide
aguacuauuucuaaagacauu

SEQ ID NO: 17838 - RNA, 21 nt, Artificial Sequence
  Description of Artificial Sequence: Synthetic oligonucleotide
guacuauuucuaaagaccauu

SEQ ID NO: 17839 - RNA, 21 nt, Artificial Sequence
  Description of Artificial Sequence: Synthetic oligonucleotide
uacuauuucuaaagaccuauu

SEQ ID NO: 17840 - RNA, 21 nt, Artificial Sequence
  Description of Artificial Sequence: Synthetic oligonucleotide
acuauuucuaaagaccugauu

SEQ ID NO: 17841 - RNA, 21 nt, Artificial Sequence
  Description of Artificial Sequence: Synthetic oligonucleotide
cuauuucuaaagaccugaauu

SEQ ID NO: 17842 - RNA, 21 nt, Artificial Sequence
  Description of Artificial Sequence: Synthetic oligonucleotide
uauuucuaaagaccugauauu

SEQ ID NO: 17843 - RNA, 21 nt, Artificial Sequence
  Description of Artificial Sequence: Synthetic oligonucleotide
auuucuaaagaccugauuauu

SEQ ID NO: 17844 - RNA, 21 nt, Artificial Sequence
  Description of Artificial Sequence: Synthetic oligonucleotide
uuucuaaagaccugauuaauu

SEQ ID NO: 17845 - RNA, 21 nt, Artificial Sequence
  Description of Artificial Sequence: Synthetic oligonucleotide
uucuaaagaccugauuacauu

SEQ ID NO: 17846 - RNA, 21 nt, Artificial Sequence
  Description of Artificial Sequence: Synthetic oligonucleotide
ucuaaagaccugauuacaauu

SEQ ID NO: 17847 - RNA, 21 nt, Artificial Sequence
  Description of Artificial Sequence: Synthetic oligonucleotide
cuaaagaccugauuacauauu

SEQ ID NO: 17848 - RNA, 21 nt, Artificial Sequence
  Description of Artificial Sequence: Synthetic oligonucleotide
uaaagaccugauuacauaauu

SEQ ID NO: 17849 - RNA, 21 nt, Artificial Sequence
  Description of Artificial Sequence: Synthetic oligonucleotide
aaagaccugauuacauauauu

SEQ ID NO: 17850 - RNA, 21 nt, Artificial Sequence
  Description of Artificial Sequence: Synthetic oligonucleotide
aagaccugauuacauauaauu

SEQ ID NO: 17851 - RNA, 21 nt, Artificial Sequence
  Description of Artificial Sequence: Synthetic oligonucleotide
agaccugauuacauauauauu

SEQ ID NO: 17852 - RNA, 21 nt, Artificial Sequence
  Description of Artificial Sequence: Synthetic oligonucleotide
gaccugauuacauauaugauu

SEQ ID NO: 17853 - RNA, 21 nt, Artificial Sequence
  Description of Artificial Sequence: Synthetic oligonucleotide
accugauuacauauaugaauu

SEQ ID NO: 17854 - RNA, 21 nt, Artificial Sequence
  Description of Artificial Sequence: Synthetic oligonucleotide
ccugauuacauauaugagauu

SEQ ID NO: 17855 - RNA, 21 nt, Artificial Sequence
  Description of Artificial Sequence: Synthetic oligonucleotide
cugauuacauauaugaguauu

SEQ ID NO: 17856 - RNA, 21 nt, Artificial Sequence
  Description of Artificial Sequence: Synthetic oligonucleotide
ugauuacauauaugagugauu

SEQ ID NO: 17857 - RNA, 21 nt, Artificial Sequence
  Description of Artificial Sequence: Synthetic oligonucleotide
gauuacauauaugaguggauu

SEQ ID NO: 17858 - RNA, 21 nt, Artificial Sequence
  Description of Artificial Sequence: Synthetic oligonucleotide
auuacauauaugagugggauu

SEQ ID NO: 17859 - RNA, 21 nt, Artificial Sequence
  Description of Artificial Sequence: Synthetic oligonucleotide
uuacauauaugagugggaauu

SEQ ID NO: 17860 - RNA, 21 nt, Artificial Sequence
  Description of Artificial Sequence: Synthetic oligonucleotide
uacauauaugagugggacauu

SEQ ID NO: 17861 - RNA, 21 nt, Artificial Sequence
  Description of Artificial Sequence: Synthetic oligonucleotide
acauauaugagugggaccauu

SEQ ID NO: 17862 - RNA, 21 nt, Artificial Sequence
  Description of Artificial Sequence: Synthetic oligonucleotide
cauauaugagugggaccaauu

SEQ ID NO: 17863 - RNA, 21 nt, Artificial Sequence
  Description of Artificial Sequence: Synthetic oligonucleotide
auauaugagugggaccaaauu

SEQ ID NO: 17864 - RNA, 21 nt, Artificial Sequence
  Description of Artificial Sequence: Synthetic oligonucleotide
uauaugagugggaccaaaauu

SEQ ID NO: 17865 - RNA, 21 nt, Artificial Sequence
  Description of Artificial Sequence: Synthetic oligonucleotide
auaugagugggaccaaaaauu

SEQ ID NO: 17866 - RNA, 21 nt, Artificial Sequence
  Description of Artificial Sequence: Synthetic oligonucleotide
uaugagugggaccaaaagauu

SEQ ID NO: 17867 - RNA, 21 nt, Artificial Sequence
  Description of Artificial Sequence: Synthetic oligonucleotide
augagugggaccaaaaguauu

SEQ ID NO: 17868 - RNA, 21 nt, Artificial Sequence
  Description of Artificial Sequence: Synthetic oligonucleotide
ugagugggaccaaaaguaauu

SEQ ID NO: 17869 - RNA, 21 nt, Artificial Sequence
  Description of Artificial Sequence: Synthetic oligonucleotide
gagugggaccaaaaguacauu

SEQ ID NO: 17870 - RNA, 21 nt, Artificial Sequence
  Description of Artificial Sequence: Synthetic oligonucleotide
agugggaccaaaaguaccauu

SEQ ID NO: 17871 - RNA, 21 nt, Artificial Sequence
  Description of Artificial Sequence: Synthetic oligonucleotide
gugggaccaaaaguaccgauu

SEQ ID NO: 17872 - RNA, 21 nt, Artificial Sequence
  Description of Artificial Sequence: Synthetic oligonucleotide
ugggaccaaaaguaccgaauu

SEQ ID NO: 17873 - RNA, 21 nt, Artificial Sequence
  Description of Artificial Sequence: Synthetic oligonucleotide
gggaccaaaaguaccgagauu

SEQ ID NO: 17874 - RNA, 21 nt, Artificial Sequence
  Description of Artificial Sequence: Synthetic oligonucleotide
ggaccaaaaguaccgaguauu

SEQ ID NO: 17875 - RNA, 21 nt, Artificial Sequence
  Description of Artificial Sequence: Synthetic oligonucleotide
gaccaaaaguaccgaguuauu

SEQ ID NO: 17876 - RNA, 21 nt, Artificial Sequence
  Description of Artificial Sequence: Synthetic oligonucleotide
accaaaaguaccgaguucauu

SEQ ID NO: 17877 - RNA, 21 nt, Artificial Sequence
  Description of Artificial Sequence: Synthetic oligonucleotide
ccaaaaguaccgaguucaauu

SEQ ID NO: 17878 - RNA, 21 nt, Artificial Sequence
  Description of Artificial Sequence: Synthetic oligonucleotide
caaaaguaccgaguucaaauu

SEQ ID NO: 17879 - RNA, 21 nt, Artificial Sequence
  Description of Artificial Sequence: Synthetic oligonucleotide
aaaaguaccgaguucaacauu

SEQ ID NO: 17880 - RNA, 21 nt, Artificial Sequence
  Description of Artificial Sequence: Synthetic oligonucleotide
aaaguaccgaguucaacaauu

SEQ ID NO: 17881 - RNA, 21 nt, Artificial Sequence
  Description of Artificial Sequence: Synthetic oligonucleotide
aaguaccgaguucaacaaauu

SEQ ID NO: 17882 - RNA, 21 nt, Artificial Sequence
  Description of Artificial Sequence: Synthetic oligonucleotide
aguaccgaguucaacaacauu

SEQ ID NO: 17883 - RNA, 21 nt, Artificial Sequence
  Description of Artificial Sequence: Synthetic oligonucleotide
guaccgaguucaacaacaauu

SEQ ID NO: 17884 - RNA, 21 nt, Artificial Sequence
  Description of Artificial Sequence: Synthetic oligonucleotide
uaccgaguucaacaacacauu

SEQ ID NO: 17885 - RNA, 21 nt, Artificial Sequence
  Description of Artificial Sequence: Synthetic oligonucleotide
accgaguucaacaacaccauu

SEQ ID NO: 17886 - RNA, 21 nt, Artificial Sequence
  Description of Artificial Sequence: Synthetic oligonucleotide
ccgaguucaacaacaccgauu

SEQ ID NO: 17887 - RNA, 21 nt, Artificial Sequence
  Description of Artificial Sequence: Synthetic oligonucleotide
cgaguucaacaacaccguauu

SEQ ID NO: 17888 - RNA, 21 nt, Artificial Sequence
  Description of Artificial Sequence: Synthetic oligonucleotide
gaguucaacaacaccgucauu

SEQ ID NO: 17889 - RNA, 21 nt, Artificial Sequence
  Description of Artificial Sequence: Synthetic oligonucleotide
aguucaacaacaccgucuauu

SEQ ID NO: 17890 - RNA, 21 nt, Artificial Sequence
  Description of Artificial Sequence: Synthetic oligonucleotide
guucaacaacaccgucucauu

SEQ ID NO: 17891 - RNA, 21 nt, Artificial Sequence
  Description of Artificial Sequence: Synthetic oligonucleotide
uucaacaacaccgucucuauu

SEQ ID NO: 17892 - RNA, 21 nt, Artificial Sequence
  Description of Artificial Sequence: Synthetic oligonucleotide
ucaacaacaccgucucuuauu

SEQ ID NO: 17893 - RNA, 21 nt, Artificial Sequence
  Description of Artificial Sequence: Synthetic oligonucleotide
caacaacaccgucucuugauu

SEQ ID NO: 17894 - RNA, 21 nt, Artificial Sequence
  Description of Artificial Sequence: Synthetic oligonucleotide
aacaacaccgucucuuguauu

SEQ ID NO: 17895 - RNA, 21 nt, Artificial Sequence
  Description of Artificial Sequence: Synthetic oligonucleotide
acaacaccgucucuuguaauu

SEQ ID NO: 17896 - RNA, 21 nt, Artificial Sequence
  Description of Artificial Sequence: Synthetic oligonucleotide
caacaccgucucuuguagauu

SEQ ID NO: 17897 - RNA, 21 nt, Artificial Sequence
  Description of Artificial Sequence: Synthetic oligonucleotide
aacaccgucucuuguagcauu

SEQ ID NO: 17898 - RNA, 21 nt, Artificial Sequence
  Description of Artificial Sequence: Synthetic oligonucleotide
acaccgucucuuguagcaauu

SEQ ID NO: 17899 - RNA, 21 nt, Artificial Sequence
  Description of Artificial Sequence: Synthetic oligonucleotide
caccgucucuuguagcaaauu

SEQ ID NO: 17900 - RNA, 21 nt, Artificial Sequence
  Description of Artificial Sequence: Synthetic oligonucleotide
accgucucuuguagcaauauu

SEQ ID NO: 17901 - RNA, 21 nt, Artificial Sequence
  Description of Artificial Sequence: Synthetic oligonucleotide
ccgucucuuguagcaaucauu

SEQ ID NO: 17902 - RNA, 21 nt, Artificial Sequence
  Description of Artificial Sequence: Synthetic oligonucleotide
cgucucuuguagcaaucgauu

SEQ ID NO: 17903 - RNA, 21 nt, Artificial Sequence
  Description of Artificial Sequence: Synthetic oligonucleotide
gucucuuguagcaaucggauu

SEQ ID NO: 17904 - RNA, 21 nt, Artificial Sequence
  Description of Artificial Sequence: Synthetic oligonucleotide
ucucuuguagcaaucggcauu

SEQ ID NO: 17905 - RNA, 21 nt, Artificial Sequence
  Description of Artificial Sequence: Synthetic oligonucleotide
cucuuguagcaaucggccauu

SEQ ID NO: 17906 - RNA, 21 nt, Artificial Sequence
  Description of Artificial Sequence: Synthetic oligonucleotide
ucuuguagcaaucggccaauu

SEQ ID NO: 17907 - RNA, 21 nt, Artificial Sequence
  Description of Artificial Sequence: Synthetic oligonucleotide
cuuguagcaaucggccacauu

SEQ ID NO: 17908 - RNA, 21 nt, Artificial Sequence
  Description of Artificial Sequence: Synthetic oligonucleotide
uuguagcaaucggccacaauu

SEQ ID NO: 17909 - RNA, 21 nt, Artificial Sequence
  Description of Artificial Sequence: Synthetic oligonucleotide
uguagcaaucggccacauauu

SEQ ID NO: 17910 - RNA, 21 nt, Artificial Sequence
  Description of Artificial Sequence: Synthetic oligonucleotide
guagcaaucggccacauuauu

SEQ ID NO: 17911 - RNA, 21 nt, Artificial Sequence
  Description of Artificial Sequence: Synthetic oligonucleotide
uagcaaucggccacauugauu

SEQ ID NO: 17912 - RNA, 21 nt, Artificial Sequence
  Description of Artificial Sequence: Synthetic oligonucleotide
agcaaucggccacauugcauu

SEQ ID NO: 17913 - RNA, 21 nt, Artificial Sequence
  Description of Artificial Sequence: Synthetic oligonucleotide
gcaaucggccacauugccauu

SEQ ID NO: 17914 - RNA, 21 nt, Artificial Sequence
  Description of Artificial Sequence: Synthetic oligonucleotide
caaucggccacauugccuauu

SEQ ID NO: 17915 - RNA, 21 nt, Artificial Sequence
  Description of Artificial Sequence: Synthetic oligonucleotide
aaucggccacauugccuuauu

SEQ ID NO: 17916 - RNA, 21 nt, Artificial Sequence
  Description of Artificial Sequence: Synthetic oligonucleotide
aucggccacauugccuuaauu

SEQ ID NO: 17917 - RNA, 21 nt, Artificial Sequence
  Description of Artificial Sequence: Synthetic oligonucleotide
ucggccacauugccuuacauu

SEQ ID NO: 17918 - RNA, 21 nt, Artificial Sequence
  Description of Artificial Sequence: Synthetic oligonucleotide
cggccacauugccuuacuauu

SEQ ID NO: 17919 - RNA, 21 nt, Artificial Sequence
  Description of Artificial Sequence: Synthetic oligonucleotide
ggccacauugccuuacugauu

SEQ ID NO: 17920 - RNA, 21 nt, Artificial Sequence
  Description of Artificial Sequence: Synthetic oligonucleotide
gccacauugccuuacugaauu

SEQ ID NO: 17921 - RNA, 21 nt, Artificial Sequence
  Description of Artificial Sequence: Synthetic oligonucleotide
ccacauugccuuacugaaauu

SEQ ID NO: 17922 - RNA, 21 nt, Artificial Sequence
  Description of Artificial Sequence: Synthetic oligonucleotide
cacauugccuuacugaaaauu

SEQ ID NO: 17923 - RNA, 21 nt, Artificial Sequence
  Description of Artificial Sequence: Synthetic oligonucleotide
acauugccuuacugaaauauu

SEQ ID NO: 17924 - RNA, 21 nt, Artificial Sequence
  Description of Artificial Sequence: Synthetic oligonucleotide
cauugccuuacugaaaucauu

SEQ ID NO: 17925 - RNA, 21 nt, Artificial Sequence
  Description of Artificial Sequence: Synthetic oligonucleotide
auugccuuacugaaauccauu

SEQ ID NO: 17926 - RNA, 21 nt, Artificial Sequence
  Description of Artificial Sequence: Synthetic oligonucleotide
uugccuuacugaaauccaauu

SEQ ID NO: 17927 - RNA, 21 nt, Artificial Sequence
  Description of Artificial Sequence: Synthetic oligonucleotide
ugccuuacugaaauccagauu

SEQ ID NO: 17928 - RNA, 21 nt, Artificial Sequence
  Description of Artificial Sequence: Synthetic oligonucleotide
gccuuacugaaauccagaauu

SEQ ID NO: 17929 - RNA, 21 nt, Artificial Sequence
  Description of Artificial Sequence: Synthetic oligonucleotide
ccuuacugaaauccagagauu

SEQ ID NO: 17930 - RNA, 21 nt, Artificial Sequence
  Description of Artificial Sequence: Synthetic oligonucleotide
cuuacugaaauccagagcauu

SEQ ID NO: 17931 - RNA, 21 nt, Artificial Sequence
  Description of Artificial Sequence: Synthetic oligonucleotide
uuacugaaauccagagccauu

SEQ ID NO: 17932 - RNA, 21 nt, Artificial Sequence
  Description of Artificial Sequence: Synthetic oligonucleotide
uacugaaauccagagccuauu

SEQ ID NO: 17933 - RNA, 21 nt, Artificial Sequence
  Description of Artificial Sequence: Synthetic oligonucleotide
acugaaauccagagccuaauu

SEQ ID NO: 17934 - RNA, 21 nt, Artificial Sequence
  Description of Artificial Sequence: Synthetic oligonucleotide
cugaaauccagagccuaaauu

SEQ ID NO: 17935 - RNA, 21 nt, Artificial Sequence
  Description of Artificial Sequence: Synthetic oligonucleotide
ugaaauccagagccuaacauu

SEQ ID NO: 17936 - RNA, 21 nt, Artificial Sequence
  Description of Artificial Sequence: Synthetic oligonucleotide
gaaauccagagccuaaccauu

SEQ ID NO: 17937 - RNA, 21 nt, Artificial Sequence
  Description of Artificial Sequence: Synthetic oligonucleotide
aaauccagagccuaaccuauu

SEQ ID NO: 17938 - RNA, 21 nt, Artificial Sequence
  Description of Artificial Sequence: Synthetic oligonucleotide
aauccagagccuaaccuuauu

SEQ ID NO: 17939 - RNA, 21 nt, Artificial Sequence
  Description of Artificial Sequence: Synthetic oligonucleotide
auccagagccuaaccuucauu

SEQ ID NO: 17940 - RNA, 21 nt, Artificial Sequence
  Description of Artificial Sequence: Synthetic oligonucleotide
uccagagccuaaccuucaauu

SEQ ID NO: 17941 - RNA, 21 nt, Artificial Sequence
  Description of Artificial Sequence: Synthetic oligonucleotide
ccagagccuaaccuucaaauu

SEQ ID NO: 17942 - RNA, 21 nt, Artificial Sequence
  Description of Artificial Sequence: Synthetic oligonucleotide
cagagccuaaccuucaauauu

SEQ ID NO: 17943 - RNA, 21 nt, Artificial Sequence
  Description of Artificial Sequence: Synthetic oligonucleotide
agagccuaaccuucaaucauu

SEQ ID NO: 17944 - RNA, 21 nt, Artificial Sequence
  Description of Artificial Sequence: Synthetic oligonucleotide
gagccuaaccuucaauccauu

SEQ ID NO: 17945 - RNA, 21 nt, Artificial Sequence
  Description of Artificial Sequence: Synthetic oligonucleotide
agccuaaccuucaaucccauu

SEQ ID NO: 17946 - RNA, 21 nt, Artificial Sequence
  Description of Artificial Sequence: Synthetic oligonucleotide
gccuaaccuucaaucccaauu

SEQ ID NO: 17947 - RNA, 21 nt, Artificial Sequence
  Description of Artificial Sequence: Synthetic oligonucleotide
ccuaaccuucaaucccacauu

SEQ ID NO: 17948 - RNA, 21 nt, Artificial Sequence
  Description of Artificial Sequence: Synthetic oligonucleotide
cuaaccuucaaucccaccauu

SEQ ID NO: 17949 - RNA, 21 nt, Artificial Sequence
  Description of Artificial Sequence: Synthetic oligonucleotide
uaaccuucaaucccaccgauu

SEQ ID NO: 17950 - RNA, 21 nt, Artificial Sequence
  Description of Artificial Sequence: Synthetic oligonucleotide
aaccuucaaucccaccgcauu

SEQ ID NO: 17951 - RNA, 21 nt, Artificial Sequence
  Description of Artificial Sequence: Synthetic oligonucleotide
accuucaaucccaccgccauu

SEQ ID NO: 17952 - RNA, 21 nt, Artificial Sequence
  Description of Artificial Sequence: Synthetic oligonucleotide
ccuucaaucccaccgccgauu

SEQ ID NO: 17953 - RNA, 21 nt, Artificial Sequence
  Description of Artificial Sequence: Synthetic oligonucleotide
cuucaaucccaccgccggauu

SEQ ID NO: 17954 - RNA, 21 nt, Artificial Sequence
  Description of Artificial Sequence: Synthetic oligonucleotide
uucaaucccaccgccggcauu

SEQ ID NO: 17955 - RNA, 21 nt, Artificial Sequence
  Description of Artificial Sequence: Synthetic oligonucleotide
ucaaucccaccgccggcuauu

SEQ ID NO: 17956 - RNA, 21 nt, Artificial Sequence
  Description of Artificial Sequence: Synthetic oligonucleotide
caaucccaccgccggcugauu

SEQ ID NO: 17957 - RNA, 21 nt, Artificial Sequence
  Description of Artificial Sequence: Synthetic oligonucleotide
aaucccaccgccggcugcauu

SEQ ID NO: 17958 - RNA, 21 nt, Artificial Sequence
  Description of Artificial Sequence: Synthetic oligonucleotide
aucccaccgccggcugcgauu

SEQ ID NO: 17959 - RNA, 21 nt, Artificial Sequence
  Description of Artificial Sequence: Synthetic oligonucleotide
ucccaccgccggcugcgcauu

SEQ ID NO: 17960 - RNA, 21 nt, Artificial Sequence
  Description of Artificial Sequence: Synthetic oligonucleotide
cccaccgccggcugcgcgauu

SEQ ID NO: 17961 - RNA, 21 nt, Artificial Sequence
  Description of Artificial Sequence: Synthetic oligonucleotide
ccaccgccggcugcgcguauu

SEQ ID NO: 17962 - RNA, 21 nt, Artificial Sequence
  Description of Artificial Sequence: Synthetic oligonucleotide
caccgccggcugcgcgucauu

SEQ ID NO: 17963 - RNA, 21 nt, Artificial Sequence
  Description of Artificial Sequence: Synthetic oligonucleotide
accgccggcugcgcgucgauu

SEQ ID NO: 17964 - RNA, 21 nt, Artificial Sequence
  Description of Artificial Sequence: Synthetic oligonucleotide
ccgccggcugcgcgucgcauu

SEQ ID NO: 17965 - RNA, 21 nt, Artificial Sequence
  Description of Artificial Sequence: Synthetic oligonucleotide
cgccggcugcgcgucgcuauu

SEQ ID NO: 17966 - RNA, 21 nt, Artificial Sequence
  Description of Artificial Sequence: Synthetic oligonucleotide
gccggcugcgcgucgcucauu

SEQ ID NO: 17967 - RNA, 21 nt, Artificial Sequence
  Description of Artificial Sequence: Synthetic oligonucleotide
ccggcugcgcgucgcucgauu

SEQ ID NO: 17968 - RNA, 21 nt, Artificial Sequence
  Description of Artificial Sequence: Synthetic oligonucleotide
cggcugcgcgucgcucgcauu

SEQ ID NO: 17969 - RNA, 21 nt, Artificial Sequence
  Description of Artificial Sequence: Synthetic oligonucleotide
ggcugcgcgucgcucgccauu

SEQ ID NO: 17970 - RNA, 21 nt, Artificial Sequence
  Description of Artificial Sequence: Synthetic oligonucleotide
gcugcgcgucgcucgccaauu

SEQ ID NO: 17971 - RNA, 21 nt, Artificial Sequence
  Description of Artificial Sequence: Synthetic oligonucleotide
cugcgcgucgcucgccaaauu

SEQ ID NO: 17972 - RNA, 21 nt, Artificial Sequence
  Description of Artificial Sequence: Synthetic oligonucleotide
ugcgcgucgcucgccaaaauu

SEQ ID NO: 17973 - RNA, 21 nt, Artificial Sequence
  Description of Artificial Sequence: Synthetic oligonucleotide
gcgcgucgcucgccaaagauu

SEQ ID NO: 17974 - RNA, 21 nt, Artificial Sequence
  Description of Artificial Sequence: Synthetic oligonucleotide
cgcgucgcucgccaaagaauu

SEQ ID NO: 17975 - RNA, 21 nt, Artificial Sequence
  Description of Artificial Sequence: Synthetic oligonucleotide
gcgucgcucgccaaagaaauu

SEQ ID NO: 17976 - RNA, 21 nt, Artificial Sequence
  Description of Artificial Sequence: Synthetic oligonucleotide
cgucgcucgccaaagaaaauu

SEQ ID NO: 17977 - RNA, 21 nt, Artificial Sequence
  Description of Artificial Sequence: Synthetic oligonucleotide
gucgcucgccaaagaaauauu

SEQ ID NO: 17978 - RNA, 21 nt, Artificial Sequence
  Description of Artificial Sequence: Synthetic oligonucleotide
ucgcucgccaaagaaaugauu

SEQ ID NO: 17979 - RNA, 21 nt, Artificial Sequence
  Description of Artificial Sequence: Synthetic oligonucleotide
cgcucgccaaagaaauguauu

SEQ ID NO: 17980 - RNA, 21 nt, Artificial Sequence
  Description of Artificial Sequence: Synthetic oligonucleotide
gcucgccaaagaaauguuauu

SEQ ID NO: 17981 - RNA, 21 nt, Artificial Sequence
  Description of Artificial Sequence: Synthetic oligonucleotide
cucgccaaagaaauguucauu

SEQ ID NO: 17982 - RNA, 21 nt, Artificial Sequence
  Description of Artificial Sequence: Synthetic oligonucleotide
ucgccaaagaaauguucgauu

SEQ ID NO: 17983 - RNA, 21 nt, Artificial Sequence
  Description of Artificial Sequence: Synthetic oligonucleotide
cgccaaagaaauguucgcauu

SEQ ID NO: 17984 - RNA, 21 nt, Artificial Sequence
  Description of Artificial Sequence: Synthetic oligonucleotide
gccaaagaaauguucgccauu

SEQ ID NO: 17985 - RNA, 21 nt, Artificial Sequence
  Description of Artificial Sequence: Synthetic oligonucleotide
ccaaagaaauguucgccaauu

SEQ ID NO: 17986 - RNA, 21 nt, Artificial Sequence
  Description of Artificial Sequence: Synthetic oligonucleotide
caaagaaauguucgccauauu

SEQ ID NO: 17987 - RNA, 21 nt, Artificial Sequence
  Description of Artificial Sequence: Synthetic oligonucleotide
aaagaaauguucgccaugauu

SEQ ID NO: 17988 - RNA, 21 nt, Artificial Sequence
  Description of Artificial Sequence: Synthetic oligonucleotide
aagaaauguucgccaugaauu

SEQ ID NO: 17989 - RNA, 21 nt, Artificial Sequence
  Description of Artificial Sequence: Synthetic oligonucleotide
agaaauguucgccaugaaauu

SEQ ID NO: 17990 - RNA, 21 nt, Artificial Sequence
  Description of Artificial Sequence: Synthetic oligonucleotide
gaaauguucgccaugaaaauu

SEQ ID NO: 17991 - RNA, 21 nt, Artificial Sequence
  Description of Artificial Sequence: Synthetic oligonucleotide
aaauguucgccaugaaaaauu

SEQ ID NO: 17992 - RNA, 21 nt, Artificial Sequence
  Description of Artificial Sequence: Synthetic oligonucleotide
aauguucgccaugaaaacauu

SEQ ID NO: 17993 - RNA, 21 nt, Artificial Sequence
  Description of Artificial Sequence: Synthetic oligonucleotide
auguucgccaugaaaacuauu

SEQ ID NO: 17994 - RNA, 21 nt, Artificial Sequence
  Description of Artificial Sequence: Synthetic oligonucleotide
uguucgccaugaaaacuaauu

SEQ ID NO: 17995 - RNA, 21 nt, Artificial Sequence
  Description of Artificial Sequence: Synthetic oligonucleotide
guucgccaugaaaacuaaauu

SEQ ID NO: 17996 - RNA, 21 nt, Artificial Sequence
  Description of Artificial Sequence: Synthetic oligonucleotide
uucgccaugaaaacuaagauu

SEQ ID NO: 17997 - RNA, 21 nt, Artificial Sequence
  Description of Artificial Sequence: Synthetic oligonucleotide
ucgccaugaaaacuaaggauu

SEQ ID NO: 17998 - RNA, 21 nt, Artificial Sequence
  Description of Artificial Sequence: Synthetic oligonucleotide
cgccaugaaaacuaaggcauu

SEQ ID NO: 17999 - RNA, 21 nt, Artificial Sequence
  Description of Artificial Sequence: Synthetic oligonucleotide
gccaugaaaacuaaggcuauu

SEQ ID NO: 18000 - RNA, 21 nt, Artificial Sequence
  Description of Artificial Sequence: Synthetic oligonucleotide
ccaugaaaacuaaggcugauu

SEQ ID NO: 18001 - RNA, 21 nt, Artificial Sequence
  Description of Artificial Sequence: Synthetic oligonucleotide
caugaaaacuaaggcugcauu

SEQ ID NO: 18002 - RNA, 21 nt, Artificial Sequence
  Description of Artificial Sequence: Synthetic oligonucleotide
augaaaacuaaggcugccauu

SEQ ID NO: 18003 - RNA, 21 nt, Artificial Sequence
  Description of Artificial Sequence: Synthetic oligonucleotide
ugaaaacuaaggcugccuauu

SEQ ID NO: 18004 - RNA, 21 nt, Artificial Sequence
  Description of Artificial Sequence: Synthetic oligonucleotide
gaaaacuaaggcugccuuauu

SEQ ID NO: 18005 - RNA, 21 nt, Artificial Sequence
  Description of Artificial Sequence: Synthetic oligonucleotide
aaaacuaaggcugccuuaauu

SEQ ID NO: 18006 - RNA, 21 nt, Artificial Sequence
  Description of Artificial Sequence: Synthetic oligonucleotide
aaacuaaggcugccuuagauu

SEQ ID NO: 18007 - RNA, 21 nt, Artificial Sequence
  Description of Artificial Sequence: Synthetic oligonucleotide
aacuaaggcugccuuagcauu

SEQ ID NO: 18008 - RNA, 21 nt, Artificial Sequence
  Description of Artificial Sequence: Synthetic oligonucleotide
acuaaggcugccuuagcuauu

SEQ ID NO: 18009 - RNA, 21 nt, Artificial Sequence
  Description of Artificial Sequence: Synthetic oligonucleotide
cuaaggcugccuuagcuaauu

SEQ ID NO: 18010 - RNA, 21 nt, Artificial Sequence
  Description of Artificial Sequence: Synthetic oligonucleotide
uaaggcugccuuagcuauauu

SEQ ID NO: 18011 - RNA, 21 nt, Artificial Sequence
  Description of Artificial Sequence: Synthetic oligonucleotide
aaggcugccuuagcuaucauu

SEQ ID NO: 18012 - RNA, 21 nt, Artificial Sequence
  Description of Artificial Sequence: Synthetic oligonucleotide
aggcugccuuagcuaucuauu

SEQ ID NO: 18013 - RNA, 21 nt, Artificial Sequence
  Description of Artificial Sequence: Synthetic oligonucleotide
ggcugccuuagcuaucugauu

SEQ ID NO: 18014 - RNA, 21 nt, Artificial Sequence
  Description of Artificial Sequence: Synthetic oligonucleotide
gcugccuuagcuaucuggauu

SEQ ID NO: 18015 - RNA, 21 nt, Artificial Sequence
  Description of Artificial Sequence: Synthetic oligonucleotide
cugccuuagcuaucugguauu

SEQ ID NO: 18016 - RNA, 21 nt, Artificial Sequence
  Description of Artificial Sequence: Synthetic oligonucleotide
ugccuuagcuaucuggugauu

SEQ ID NO: 18017 - RNA, 21 nt, Artificial Sequence
  Description of Artificial Sequence: Synthetic oligonucleotide
gccuuagcuaucuggugcauu

SEQ ID NO: 18018 - RNA, 21 nt, Artificial Sequence
  Description of Artificial Sequence: Synthetic oligonucleotide
ccuuagcuaucuggugccauu

SEQ ID NO: 18019 - RNA, 21 nt, Artificial Sequence
  Description of Artificial Sequence: Synthetic oligonucleotide
cuuagcuaucuggugcccauu

SEQ ID NO: 18020 - RNA, 21 nt, Artificial Sequence
  Description of Artificial Sequence: Synthetic oligonucleotide
uuagcuaucuggugcccaauu

SEQ ID NO: 18021 - RNA, 21 nt, Artificial Sequence
  Description of Artificial Sequence: Synthetic oligonucleotide
uagcuaucuggugcccagauu

SEQ ID NO: 18022 - RNA, 21 nt, Artificial Sequence
  Description of Artificial Sequence: Synthetic oligonucleotide
agcuaucuggugcccaggauu

SEQ ID NO: 18023 - RNA, 21 nt, Artificial Sequence
  Description of Artificial Sequence: Synthetic oligonucleotide
gcuaucuggugcccaggcauu

SEQ ID NO: 18024 - RNA, 21 nt, Artificial Sequence
  Description of Artificial Sequence: Synthetic oligonucleotide
cuaucuggugcccaggcuauu

SEQ ID NO: 18025 - RNA, 21 nt, Artificial Sequence
  Description of Artificial Sequence: Synthetic oligonucleotide
uaucuggugcccaggcuaauu

SEQ ID NO: 18026 - RNA, 21 nt, Artificial Sequence
  Description of Artificial Sequence: Synthetic oligonucleotide
aucuggugcccaggcuauauu

SEQ ID NO: 18027 - RNA, 21 nt, Artificial Sequence
  Description of Artificial Sequence: Synthetic oligonucleotide
ucuggugcccaggcuauuauu

SEQ ID NO: 18028 - RNA, 21 nt, Artificial Sequence
  Description of Artificial Sequence: Synthetic oligonucleotide
cuggugcccaggcuauucauu

SEQ ID NO: 18029 - RNA, 21 nt, Artificial Sequence
  Description of Artificial Sequence: Synthetic oligonucleotide
uggugcccaggcuauucgauu

SEQ ID NO: 18030 - RNA, 21 nt, Artificial Sequence
  Description of Artificial Sequence: Synthetic oligonucleotide
ggugcccaggcuauucggauu

SEQ ID NO: 18031 - RNA, 21 nt, Artificial Sequence
  Description of Artificial Sequence: Synthetic oligonucleotide
gugcccaggcuauucggaauu

SEQ ID NO: 18032 - RNA, 21 nt, Artificial Sequence
  Description of Artificial Sequence: Synthetic oligonucleotide
ugcccaggcuauucggaaauu

SEQ ID NO: 18033 - RNA, 21 nt, Artificial Sequence
  Description of Artificial Sequence: Synthetic oligonucleotide
gcccaggcuauucggaaaauu

SEQ ID NO: 18034 - RNA, 21 nt, Artificial Sequence
  Description of Artificial Sequence: Synthetic oligonucleotide
cccaggcuauucggaaacauu

SEQ ID NO: 18035 - RNA, 21 nt, Artificial Sequence
  Description of Artificial Sequence: Synthetic oligonucleotide
ccaggcuauucggaaacuauu

SEQ ID NO: 18036 - RNA, 21 nt, Artificial Sequence
  Description of Artificial Sequence: Synthetic oligonucleotide
caggcuauucggaaacucauu

SEQ ID NO: 18037 - RNA, 21 nt, Artificial Sequence
  Description of Artificial Sequence: Synthetic oligonucleotide
aggcuauucggaaacucaauu

SEQ ID NO: 18038 - RNA, 21 nt, Artificial Sequence
  Description of Artificial Sequence: Synthetic oligonucleotide
ggcuauucggaaacucagauu

SEQ ID NO: 18039 - RNA, 21 nt, Artificial Sequence
  Description of Artificial Sequence: Synthetic oligonucleotide
gcuauucggaaacucagaauu

SEQ ID NO: 18040 - RNA, 21 nt, Artificial Sequence
  Description of Artificial Sequence: Synthetic oligonucleotide
cuauucggaaacucagauauu

SEQ ID NO: 18041 - RNA, 21 nt, Artificial Sequence
  Description of Artificial Sequence: Synthetic oligonucleotide
uauucggaaacucagauaauu

SEQ ID NO: 18042 - RNA, 21 nt, Artificial Sequence
  Description of Artificial Sequence: Synthetic oligonucleotide
auucggaaacucagauaaauu

SEQ ID NO: 18043 - RNA, 21 nt, Artificial Sequence
  Description of Artificial Sequence: Synthetic oligonucleotide
uucggaaacucagauaaaauu

SEQ ID NO: 18044 - RNA, 21 nt, Artificial Sequence
  Description of Artificial Sequence: Synthetic oligonucleotide
ucggaaacucagauaaauauu

SEQ ID NO: 18045 - RNA, 21 nt, Artificial Sequence
  Description of Artificial Sequence: Synthetic oligonucleotide
cggaaacucagauaaaugauu

SEQ ID NO: 18046 - RNA, 21 nt, Artificial Sequence
  Description of Artificial Sequence: Synthetic oligonucleotide
ggaaacucagauaaaugcauu

SEQ ID NO: 18047 - RNA, 21 nt, Artificial Sequence
  Description of Artificial Sequence: Synthetic oligonucleotide
gaaacucagauaaaugcuauu

SEQ ID NO: 18048 - RNA, 21 nt, Artificial Sequence
  Description of Artificial Sequence: Synthetic oligonucleotide
aaacucagauaaaugcuaauu

SEQ ID NO: 18049 - RNA, 21 nt, Artificial Sequence
  Description of Artificial Sequence: Synthetic oligonucleotide
aacucagauaaaugcuacauu

SEQ ID NO: 18050 - RNA, 21 nt, Artificial Sequence
  Description of Artificial Sequence: Synthetic oligonucleotide
acucagauaaaugcuacuauu

SEQ ID NO: 18051 - RNA, 21 nt, Artificial Sequence
  Description of Artificial Sequence: Synthetic oligonucleotide
cucagauaaaugcuacucauu

SEQ ID NO: 18052 - RNA, 21 nt, Artificial Sequence
  Description of Artificial Sequence: Synthetic oligonucleotide
ucagauaaaugcuacucaauu

SEQ ID NO: 18053 - RNA, 21 nt, Artificial Sequence
  Description of Artificial Sequence: Synthetic oligonucleotide
cagauaaaugcuacucagauu

SEQ ID NO: 18054 - RNA, 21 nt, Artificial Sequence
  Description of Artificial Sequence: Synthetic oligonucleotide
agauaaaugcuacucaggauu

SEQ ID NO: 18055 - RNA, 21 nt, Artificial Sequence
  Description of Artificial Sequence: Synthetic oligonucleotide
gauaaaugcuacucaggcauu

SEQ ID NO: 18056 - RNA, 21 nt, Artificial Sequence
  Description of Artificial Sequence: Synthetic oligonucleotide
auaaaugcuacucaggcaauu

SEQ ID NO: 18057 - RNA, 21 nt, Artificial Sequence
  Description of Artificial Sequence: Synthetic oligonucleotide
uaaaugcuacucaggcaaauu

SEQ ID NO: 18058 - RNA, 21 nt, Artificial Sequence
  Description of Artificial Sequence: Synthetic oligonucleotide
aaaugcuacucaggcaauauu

SEQ ID NO: 18059 - RNA, 21 nt, Artificial Sequence
  Description of Artificial Sequence: Synthetic oligonucleotide
aaugcuacucaggcaaugauu

SEQ ID NO: 18060 - RNA, 21 nt, Artificial Sequence
  Description of Artificial Sequence: Synthetic oligonucleotide
augcuacucaggcaaugaauu

SEQ ID NO: 18061 - RNA, 21 nt, Artificial Sequence
  Description of Artificial Sequence: Synthetic oligonucleotide
ugcuacucaggcaaugaaauu

SEQ ID NO: 18062 - RNA, 21 nt, Artificial Sequence
  Description of Artificial Sequence: Synthetic oligonucleotide
gcuacucaggcaaugaagauu

SEQ ID NO: 18063 - RNA, 21 nt, Artificial Sequence
  Description of Artificial Sequence: Synthetic oligonucleotide
cuacucaggcaaugaagaauu

SEQ ID NO: 18064 - RNA, 21 nt, Artificial Sequence
  Description of Artificial Sequence: Synthetic oligonucleotide
uacucaggcaaugaagaaauu

SEQ ID NO: 18065 - RNA, 21 nt, Artificial Sequence
  Description of Artificial Sequence: Synthetic oligonucleotide
acucaggcaaugaagaagauu

SEQ ID NO: 18066 - RNA, 21 nt, Artificial Sequence
  Description of Artificial Sequence: Synthetic oligonucleotide
cucaggcaaugaagaagaauu

SEQ ID NO: 18067 - RNA, 21 nt, Artificial Sequence
  Description of Artificial Sequence: Synthetic oligonucleotide
ucaggcaaugaagaagagauu

SEQ ID NO: 18068 - RNA, 21 nt, Artificial Sequence
  Description of Artificial Sequence: Synthetic oligonucleotide
caggcaaugaagaagaggauu

SEQ ID NO: 18069 - RNA, 21 nt, Artificial Sequence
  Description of Artificial Sequence: Synthetic oligonucleotide
aggcaaugaagaagaggaauu

SEQ ID NO: 18070 - RNA, 21 nt, Artificial Sequence
  Description of Artificial Sequence: Synthetic oligonucleotide
ggcaaugaagaagaggagauu

SEQ ID NO: 18071 - RNA, 21 nt, Artificial Sequence
  Description of Artificial Sequence: Synthetic oligonucleotide
gcaaugaagaagaggagaauu

SEQ ID NO: 18072 - RNA, 21 nt, Artificial Sequence
  Description of Artificial Sequence: Synthetic oligonucleotide
caaugaagaagaggagaaauu

SEQ ID NO: 18073 - RNA, 21 nt, Artificial Sequence
  Description of Artificial Sequence: Synthetic oligonucleotide
aaugaagaagaggagaaaauu

SEQ ID NO: 18074 - RNA, 21 nt, Artificial Sequence
  Description of Artificial Sequence: Synthetic oligonucleotide
augaagaagaggagaaaaauu

SEQ ID NO: 18075 - RNA, 21 nt, Artificial Sequence
  Description of Artificial Sequence: Synthetic oligonucleotide
ugaagaagaggagaaaaaauu

SEQ ID NO: 18076 - RNA, 21 nt, Artificial Sequence
  Description of Artificial Sequence: Synthetic oligonucleotide
gaagaagaggagaaaaagauu

SEQ ID NO: 18077 - RNA, 21 nt, Artificial Sequence
  Description of Artificial Sequence: Synthetic oligonucleotide
aagaagaggagaaaaaggauu

SEQ ID NO: 18078 - RNA, 21 nt, Artificial Sequence
  Description of Artificial Sequence: Synthetic oligonucleotide
agaagaggagaaaaaggaauu

SEQ ID NO: 18079 - RNA, 21 nt, Artificial Sequence
  Description of Artificial Sequence: Synthetic oligonucleotide
gaagaggagaaaaaggaaauu

SEQ ID NO: 18080 - RNA, 21 nt, Artificial Sequence
  Description of Artificial Sequence: Synthetic oligonucleotide
aagaggagaaaaaggaaaauu

SEQ ID NO: 18081 - RNA, 21 nt, Artificial Sequence
  Description of Artificial Sequence: Synthetic oligonucleotide
agaggagaaaaaggaaagauu

SEQ ID NO: 18082 - RNA, 21 nt, Artificial Sequence
  Description of Artificial Sequence: Synthetic oligonucleotide
gaggagaaaaaggaaaguauu

SEQ ID NO: 18083 - RNA, 21 nt, Artificial Sequence
  Description of Artificial Sequence: Synthetic oligonucleotide
aggagaaaaaggaaagucauu

SEQ ID NO: 18084 - RNA, 21 nt, Artificial Sequence
  Description of Artificial Sequence: Synthetic oligonucleotide
ggagaaaaaggaaagucaauu

SEQ ID NO: 18085 - RNA, 21 nt, Artificial Sequence
  Description of Artificial Sequence: Synthetic oligonucleotide
gagaaaaaggaaagucacauu

SEQ ID NO: 18086 - RNA, 21 nt, Artificial Sequence
  Description of Artificial Sequence: Synthetic oligonucleotide
agaaaaaggaaagucacaauu

SEQ ID NO: 18087 - RNA, 21 nt, Artificial Sequence
  Description of Artificial Sequence: Synthetic oligonucleotide
gaaaaaggaaagucacaaauu

SEQ ID NO: 18088 - RNA, 21 nt, Artificial Sequence
  Description of Artificial Sequence: Synthetic oligonucleotide
aaaaaggaaagucacaacauu

SEQ ID NO: 18089 - RNA, 21 nt, Artificial Sequence
  Description of Artificial Sequence: Synthetic oligonucleotide
aaaaggaaagucacaaccauu

SEQ ID NO: 18090 - RNA, 21 nt, Artificial Sequence
  Description of Artificial Sequence: Synthetic oligonucleotide
aaaggaaagucacaaccaauu

SEQ ID NO: 18091 - RNA, 21 nt, Artificial Sequence
  Description of Artificial Sequence: Synthetic oligonucleotide
aaggaaagucacaaccaaauu

SEQ ID NO: 18092 - RNA, 21 nt, Artificial Sequence
  Description of Artificial Sequence: Synthetic oligonucleotide
aggaaagucacaaccaauauu

SEQ ID NO: 18093 - RNA, 21 nt, Artificial Sequence
  Description of Artificial Sequence: Synthetic oligonucleotide
ggaaagucacaaccaauaauu

SEQ ID NO: 18094 - RNA, 21 nt, Artificial Sequence
  Description of Artificial Sequence: Synthetic oligonucleotide
gaaagucacaaccaauaaauu

SEQ ID NO: 18095 - RNA, 21 nt, Artificial Sequence
  Description of Artificial Sequence: Synthetic oligonucleotide
aaagucacaaccaauaaaauu

SEQ ID NO: 18096 - RNA, 21 nt, Artificial Sequence
  Description of Artificial Sequence: Synthetic oligonucleotide
aagucacaaccaauaaauauu

SEQ ID NO: 18097 - RNA, 21 nt, Artificial Sequence
  Description of Artificial Sequence: Synthetic oligonucleotide
agucacaaccaauaaaugauu

SEQ ID NO: 18098 - RNA, 21 nt, Artificial Sequence
  Description of Artificial Sequence: Synthetic oligonucleotide
gucacaaccaauaaauguauu

SEQ ID NO: 18099 - RNA, 21 nt, Artificial Sequence
  Description of Artificial Sequence: Synthetic oligonucleotide
ucacaaccaauaaaugucauu

SEQ ID NO: 18100 - RNA, 21 nt, Artificial Sequence
  Description of Artificial Sequence: Synthetic oligonucleotide
cacaaccaauaaaugucuauu

SEQ ID NO: 18101 - RNA, 21 nt, Artificial Sequence
  Description of Artificial Sequence: Synthetic oligonucleotide
acaaccaauaaaugucugauu

SEQ ID NO: 18102 - RNA, 21 nt, Artificial Sequence
  Description of Artificial Sequence: Synthetic oligonucleotide
caaccaauaaaugucuggauu

SEQ ID NO: 18103 - RNA, 21 nt, Artificial Sequence
  Description of Artificial Sequence: Synthetic oligonucleotide
aaccaauaaaugucuggaauu

SEQ ID NO: 18104 - RNA, 21 nt, Artificial Sequence
  Description of Artificial Sequence: Synthetic oligonucleotide
accaauaaaugucuggaaauu

SEQ ID NO: 18105 - RNA, 21 nt, Artificial Sequence
  Description of Artificial Sequence: Synthetic oligonucleotide
ccaauaaaugucuggaacauu

SEQ ID NO: 18106 - RNA, 21 nt, Artificial Sequence
  Description of Artificial Sequence: Synthetic oligonucleotide
caauaaaugucuggaacaauu

SEQ ID NO: 18107 - RNA, 21 nt, Artificial Sequence
  Description of Artificial Sequence: Synthetic oligonucleotide
aauaaaugucuggaacaaauu

SEQ ID NO: 18108 - RNA, 21 nt, Artificial Sequence
  Description of Artificial Sequence: Synthetic oligonucleotide
auaaaugucuggaacaagauu

SEQ ID NO: 18109 - RNA, 21 nt, Artificial Sequence
  Description of Artificial Sequence: Synthetic oligonucleotide
uaaaugucuggaacaaguauu

SEQ ID NO: 18110 - RNA, 21 nt, Artificial Sequence
  Description of Artificial Sequence: Synthetic oligonucleotide
aaaugucuggaacaagugauu

SEQ ID NO: 18111 - RNA, 21 nt, Artificial Sequence
  Description of Artificial Sequence: Synthetic oligonucleotide
aaugucuggaacaaguguauu

SEQ ID NO: 18112 - RNA, 21 nt, Artificial Sequence
  Description of Artificial Sequence: Synthetic oligonucleotide
augucuggaacaagugucauu

SEQ ID NO: 18113 - RNA, 21 nt, Artificial Sequence
  Description of Artificial Sequence: Synthetic oligonucleotide
ugucuggaacaagugucaauu

SEQ ID NO: 18114 - RNA, 21 nt, Artificial Sequence
  Description of Artificial Sequence: Synthetic oligonucleotide
gucuggaacaagugucacauu

SEQ ID NO: 18115 - RNA, 21 nt, Artificial Sequence
  Description of Artificial Sequence: Synthetic oligonucleotide
ucuggaacaagugucacaauu

SEQ ID NO: 18116 - RNA, 21 nt, Artificial Sequence
  Description of Artificial Sequence: Synthetic oligonucleotide
cuggaacaagugucacaaauu

SEQ ID NO: 18117 - RNA, 21 nt, Artificial Sequence
  Description of Artificial Sequence: Synthetic oligonucleotide
uggaacaagugucacaauauu

SEQ ID NO: 18118 - RNA, 21 nt, Artificial Sequence
  Description of Artificial Sequence: Synthetic oligonucleotide
ggaacaagugucacaauuauu

SEQ ID NO: 18119 - RNA, 21 nt, Artificial Sequence
  Description of Artificial Sequence: Synthetic oligonucleotide
gaacaagugucacaauuaauu

SEQ ID NO: 18120 - RNA, 21 nt, Artificial Sequence
  Description of Artificial Sequence: Synthetic oligonucleotide
aacaagugucacaauuacauu

SEQ ID NO: 18121 - RNA, 21 nt, Artificial Sequence
  Description of Artificial Sequence: Synthetic oligonucleotide
acaagugucacaauuacaauu

SEQ ID NO: 18122 - RNA, 21 nt, Artificial Sequence
  Description of Artificial Sequence: Synthetic oligonucleotide
caagugucacaauuacaaauu

SEQ ID NO: 18123 - RNA, 21 nt, Artificial Sequence
  Description of Artificial Sequence: Synthetic oligonucleotide
aagugucacaauuacaagauu

SEQ ID NO: 18124 - RNA, 21 nt, Artificial Sequence
  Description of Artificial Sequence: Synthetic oligonucleotide
agugucacaauuacaaggauu

SEQ ID NO: 18125 - RNA, 21 nt, Artificial Sequence
  Description of Artificial Sequence: Synthetic oligonucleotide
gugucacaauuacaaggaauu

SEQ ID NO: 18126 - RNA, 21 nt, Artificial Sequence
  Description of Artificial Sequence: Synthetic oligonucleotide
ugucacaauuacaaggauauu

SEQ ID NO: 18127 - RNA, 21 nt, Artificial Sequence
  Description of Artificial Sequence: Synthetic oligonucleotide
gucacaauuacaaggauuauu

SEQ ID NO: 18128 - RNA, 21 nt, Artificial Sequence
  Description of Artificial Sequence: Synthetic oligonucleotide
ucacaauuacaaggauugauu

SEQ ID NO: 18129 - RNA, 21 nt, Artificial Sequence
  Description of Artificial Sequence: Synthetic oligonucleotide
cacaauuacaaggauuguauu

SEQ ID NO: 18130 - RNA, 21 nt, Artificial Sequence
  Description of Artificial Sequence: Synthetic oligonucleotide
acaauuacaaggauugugauu

SEQ ID NO: 18131 - RNA, 21 nt, Artificial Sequence
  Description of Artificial Sequence: Synthetic oligonucleotide
caauuacaaggauuguggauu

SEQ ID NO: 18132 - RNA, 21 nt, Artificial Sequence
  Description of Artificial Sequence: Synthetic oligonucleotide
aauuacaaggauuguggcauu

SEQ ID NO: 18133 - RNA, 21 nt, Artificial Sequence
  Description of Artificial Sequence: Synthetic oligonucleotide
auuacaaggauuguggcgauu

SEQ ID NO: 18134 - RNA, 21 nt, Artificial Sequence
  Description of Artificial Sequence: Synthetic oligonucleotide
uuacaaggauuguggcguauu

SEQ ID NO: 18135 - RNA, 21 nt, Artificial Sequence
  Description of Artificial Sequence: Synthetic oligonucleotide
uacaaggauuguggcgucauu

SEQ ID NO: 18136 - RNA, 21 nt, Artificial Sequence
  Description of Artificial Sequence: Synthetic oligonucleotide
acaaggauuguggcgucgauu

SEQ ID NO: 18137 - RNA, 21 nt, Artificial Sequence
  Description of Artificial Sequence: Synthetic oligonucleotide
caaggauuguggcgucgcauu

SEQ ID NO: 18138 - RNA, 21 nt, Artificial Sequence
  Description of Artificial Sequence: Synthetic oligonucleotide
aaggauuguggcgucgcuauu

SEQ ID NO: 18139 - RNA, 21 nt, Artificial Sequence
  Description of Artificial Sequence: Synthetic oligonucleotide
aggauuguggcgucgcuuauu

SEQ ID NO: 18140 - RNA, 21 nt, Artificial Sequence
  Description of Artificial Sequence: Synthetic oligonucleotide
ggauuguggcgucgcuucauu

SEQ ID NO: 18141 - RNA, 21 nt, Artificial Sequence
  Description of Artificial Sequence: Synthetic oligonucleotide
gauuguggcgucgcuucaauu

SEQ ID NO: 18142 - RNA, 21 nt, Artificial Sequence
  Description of Artificial Sequence: Synthetic oligonucleotide
auuguggcgucgcuucaaauu

SEQ ID NO: 18143 - RNA, 21 nt, Artificial Sequence
  Description of Artificial Sequence: Synthetic oligonucleotide
uuguggcgucgcuucaauauu

SEQ ID NO: 18144 - RNA, 21 nt, Artificial Sequence
  Description of Artificial Sequence: Synthetic oligonucleotide
uguggcgucgcuucaaucauu

SEQ ID NO: 18145 - RNA, 21 nt, Artificial Sequence
  Description of Artificial Sequence: Synthetic oligonucleotide
guggcgucgcuucaaucgauu

SEQ ID NO: 18146 - RNA, 21 nt, Artificial Sequence
  Description of Artificial Sequence: Synthetic oligonucleotide
uggcgucgcuucaaucgaauu

SEQ ID NO: 18147 - RNA, 21 nt, Artificial Sequence
  Description of Artificial Sequence: Synthetic oligonucleotide
ggcgucgcuucaaucgacauu

SEQ ID NO: 18148 - RNA, 21 nt, Artificial Sequence
  Description of Artificial Sequence: Synthetic oligonucleotide
gcgucgcuucaaucgaccauu

SEQ ID NO: 18149 - RNA, 21 nt, Artificial Sequence
  Description of Artificial Sequence: Synthetic oligonucleotide
cgucgcuucaaucgaccuauu

SEQ ID NO: 18150 - RNA, 21 nt, Artificial Sequence
  Description of Artificial Sequence: Synthetic oligonucleotide
gucgcuucaaucgaccuuauu

SEQ ID NO: 18151 - RNA, 21 nt, Artificial Sequence
  Description of Artificial Sequence: Synthetic oligonucleotide
ucgcuucaaucgaccuuuauu

SEQ ID NO: 18152 - RNA, 21 nt, Artificial Sequence
  Description of Artificial Sequence: Synthetic oligonucleotide
cgcuucaaucgaccuuuaauu

SEQ ID NO: 18153 - RNA, 21 nt, Artificial Sequence
  Description of Artificial Sequence: Synthetic oligonucleotide
gcuucaaucgaccuuuacauu

SEQ ID NO: 18154 - RNA, 21 nt, Artificial Sequence
  Description of Artificial Sequence: Synthetic oligonucleotide
cuucaaucgaccuuuacuauu

SEQ ID NO: 18155 - RNA, 21 nt, Artificial Sequence
  Description of Artificial Sequence: Synthetic oligonucleotide
uucaaucgaccuuuacugauu

SEQ ID NO: 18156 - RNA, 21 nt, Artificial Sequence
  Description of Artificial Sequence: Synthetic oligonucleotide
ucaaucgaccuuuacugaauu

SEQ ID NO: 18157 - RNA, 21 nt, Artificial Sequence
  Description of Artificial Sequence: Synthetic oligonucleotide
caaucgaccuuuacugaaauu

SEQ ID NO: 18158 - RNA, 21 nt, Artificial Sequence
  Description of Artificial Sequence: Synthetic oligonucleotide
aaucgaccuuuacugaaaauu

SEQ ID NO: 18159 - RNA, 21 nt, Artificial Sequence
  Description of Artificial Sequence: Synthetic oligonucleotide
aucgaccuuuacugaaacauu

SEQ ID NO: 18160 - RNA, 21 nt, Artificial Sequence
  Description of Artificial Sequence: Synthetic oligonucleotide
ucgaccuuuacugaaacaauu

SEQ ID NO: 18161 - RNA, 21 nt, Artificial Sequence
  Description of Artificial Sequence: Synthetic oligonucleotide
cgaccuuuacugaaacaaauu

SEQ ID NO: 18162 - RNA, 21 nt, Artificial Sequence
  Description of Artificial Sequence: Synthetic oligonucleotide
gaccuuuacugaaacaacauu

SEQ ID NO: 18163 - RNA, 21 nt, Artificial Sequence
  Description of Artificial Sequence: Synthetic oligonucleotide
accuuuacugaaacaacaauu

SEQ ID NO: 18164 - RNA, 21 nt, Artificial Sequence
  Description of Artificial Sequence: Synthetic oligonucleotide
ccuuuacugaaacaacagauu

SEQ ID NO: 18165 - RNA, 21 nt, Artificial Sequence
  Description of Artificial Sequence: Synthetic oligonucleotide
cuuuacugaaacaacaguauu

SEQ ID NO: 18166 - RNA, 21 nt, Artificial Sequence
  Description of Artificial Sequence: Synthetic oligonucleotide
uuuacugaaacaacaguaauu

SEQ ID NO: 18167 - RNA, 21 nt, Artificial Sequence
  Description of Artificial Sequence: Synthetic oligonucleotide
uuacugaaacaacaguaaauu

SEQ ID NO: 18168 - RNA, 21 nt, Artificial Sequence
  Description of Artificial Sequence: Synthetic oligonucleotide
uacugaaacaacaguaaaauu

SEQ ID NO: 18169 - RNA, 21 nt, Artificial Sequence
  Description of Artificial Sequence: Synthetic oligonucleotide
acugaaacaacaguaaacauu

SEQ ID NO: 18170 - RNA, 21 nt, Artificial Sequence
  Description of Artificial Sequence: Synthetic oligonucleotide
cugaaacaacaguaaaccauu

SEQ ID NO: 18171 - RNA, 21 nt, Artificial Sequence
  Description of Artificial Sequence: Synthetic oligonucleotide
ugaaacaacaguaaaccaauu

SEQ ID NO: 18172 - RNA, 21 nt, Artificial Sequence
  Description of Artificial Sequence: Synthetic oligonucleotide
gaaacaacaguaaaccauauu

SEQ ID NO: 18173 - RNA, 21 nt, Artificial Sequence
  Description of Artificial Sequence: Synthetic oligonucleotide
aaacaacaguaaaccaucauu

SEQ ID NO: 18174 - RNA, 21 nt, Artificial Sequence
  Description of Artificial Sequence: Synthetic oligonucleotide
aacaacaguaaaccaucuauu

SEQ ID NO: 18175 - RNA, 21 nt, Artificial Sequence
  Description of Artificial Sequence: Synthetic oligonucleotide
acaacaguaaaccaucuuauu

SEQ ID NO: 18176 - RNA, 21 nt, Artificial Sequence
  Description of Artificial Sequence: Synthetic oligonucleotide
caacaguaaaccaucuuuauu

SEQ ID NO: 18177 - RNA, 21 nt, Artificial Sequence
  Description of Artificial Sequence: Synthetic oligonucleotide
aacaguaaaccaucuuuaauu

SEQ ID NO: 18178 - RNA, 21 nt, Artificial Sequence
  Description of Artificial Sequence: Synthetic oligonucleotide
acaguaaaccaucuuuauauu

SEQ ID NO: 18179 - RNA, 21 nt, Artificial Sequence
  Description of Artificial Sequence: Synthetic oligonucleotide
caguaaaccaucuuuauuauu

SEQ ID NO: 18180 - RNA, 21 nt, Artificial Sequence
  Description of Artificial Sequence: Synthetic oligonucleotide
aguaaaccaucuuuauuaauu

SEQ ID NO: 18181 - RNA, 21 nt, Artificial Sequence
  Description of Artificial Sequence: Synthetic oligonucleotide
guaaaccaucuuuauuauauu

SEQ ID NO: 18182 - RNA, 21 nt, Artificial Sequence
  Description of Artificial Sequence: Synthetic oligonucleotide
uaaaccaucuuuauuaugauu

SEQ ID NO: 18183 - RNA, 21 nt, Artificial Sequence
  Description of Artificial Sequence: Synthetic oligonucleotide
aaaccaucuuuauuauggauu

SEQ ID NO: 18184 - RNA, 21 nt, Artificial Sequence
  Description of Artificial Sequence: Synthetic oligonucleotide
aaccaucuuuauuaugguauu

SEQ ID NO: 18185 - RNA, 21 nt, Artificial Sequence
  Description of Artificial Sequence: Synthetic oligonucleotide
accaucuuuauuauggucauu

SEQ ID NO: 18186 - RNA, 21 nt, Artificial Sequence
  Description of Artificial Sequence: Synthetic oligonucleotide
ccaucuuuauuauggucaauu

SEQ ID NO: 18187 - RNA, 21 nt, Artificial Sequence
  Description of Artificial Sequence: Synthetic oligonucleotide
caucuuuauuauggucauauu

SEQ ID NO: 18188 - RNA, 21 nt, Artificial Sequence
  Description of Artificial Sequence: Synthetic oligonucleotide
aucuuuauuauggucauaauu

SEQ ID NO: 18189 - RNA, 21 nt, Artificial Sequence
  Description of Artificial Sequence: Synthetic oligonucleotide
ucuuuauuauggucauauauu

SEQ ID NO: 18190 - RNA, 21 nt, Artificial Sequence
  Description of Artificial Sequence: Synthetic oligonucleotide
cuuuauuauggucauauuauu

SEQ ID NO: 18191 - RNA, 21 nt, Artificial Sequence
  Description of Artificial Sequence: Synthetic oligonucleotide
uuuauuauggucauauuuauu

SEQ ID NO: 18192 - RNA, 21 nt, Artificial Sequence
  Description of Artificial Sequence: Synthetic oligonucleotide
uuauuauggucauauuucauu

SEQ ID NO: 18193 - RNA, 21 nt, Artificial Sequence
  Description of Artificial Sequence: Synthetic oligonucleotide
uauuauggucauauuucaauu

SEQ ID NO: 18194 - RNA, 21 nt, Artificial Sequence
  Description of Artificial Sequence: Synthetic oligonucleotide
auuauggucauauuucacauu

SEQ ID NO: 18195 - RNA, 21 nt, Artificial Sequence
  Description of Artificial Sequence: Synthetic oligonucleotide
uuauggucauauuucacaauu

SEQ ID NO: 18196 - RNA, 21 nt, Artificial Sequence
  Description of Artificial Sequence: Synthetic oligonucleotide
uauggucauauuucacagauu

SEQ ID NO: 18197 - RNA, 21 nt, Artificial Sequence
  Description of Artificial Sequence: Synthetic oligonucleotide
auggucauauuucacagcauu

SEQ ID NO: 18198 - RNA, 21 nt, Artificial Sequence
  Description of Artificial Sequence: Synthetic oligonucleotide
uggucauauuucacagcaauu

SEQ ID NO: 18199 - RNA, 21 nt, Artificial Sequence
  Description of Artificial Sequence: Synthetic oligonucleotide
ggucauauuucacagcacauu

SEQ ID NO: 18200 - RNA, 21 nt, Artificial Sequence
  Description of Artificial Sequence: Synthetic oligonucleotide
gucauauuucacagcaccauu

SEQ ID NO: 18201 - RNA, 21 nt, Artificial Sequence
  Description of Artificial Sequence: Synthetic oligonucleotide
ucauauuucacagcaccaauu

SEQ ID NO: 18202 - RNA, 21 nt, Artificial Sequence
  Description of Artificial Sequence: Synthetic oligonucleotide
cauauuucacagcaccaaauu

SEQ ID NO: 18203 - RNA, 21 nt, Artificial Sequence
  Description of Artificial Sequence: Synthetic oligonucleotide
auauuucacagcaccaaaauu

SEQ ID NO: 18204 - RNA, 21 nt, Artificial Sequence
  Description of Artificial Sequence: Synthetic oligonucleotide
uauuucacagcaccaaaaauu

SEQ ID NO: 18205 - RNA, 21 nt, Artificial Sequence
  Description of Artificial Sequence: Synthetic oligonucleotide
auuucacagcaccaaaauauu

SEQ ID NO: 18206 - RNA, 21 nt, Artificial Sequence
  Description of Artificial Sequence: Synthetic oligonucleotide
uuucacagcaccaaaauaauu

SEQ ID NO: 18207 - RNA, 21 nt, Artificial Sequence
  Description of Artificial Sequence: Synthetic oligonucleotide
uucacagcaccaaaauaaauu

SEQ ID NO: 18208 - RNA, 21 nt, Artificial Sequence
  Description of Artificial Sequence: Synthetic oligonucleotide
ucacagcaccaaaauaaaauu

SEQ ID NO: 18209 - RNA, 21 nt, Artificial Sequence
  Description of Artificial Sequence: Synthetic oligonucleotide
cacagcaccaaaauaaauauu

SEQ ID NO: 18210 - RNA, 21 nt, Artificial Sequence
  Description of Artificial Sequence: Synthetic oligonucleotide
acagcaccaaaauaaaucauu

SEQ ID NO: 18211 - RNA, 21 nt, Artificial Sequence
  Description of Artificial Sequence: Synthetic oligonucleotide
cagcaccaaaauaaaucaauu

SEQ ID NO: 18212 - RNA, 21 nt, Artificial Sequence
  Description of Artificial Sequence: Synthetic oligonucleotide
agcaccaaaauaaaucauauu

SEQ ID NO: 18213 - RNA, 21 nt, Artificial Sequence
  Description of Artificial Sequence: Synthetic oligonucleotide
gcaccaaaauaaaucaucauu

SEQ ID NO: 18214 - RNA, 21 nt, Artificial Sequence
  Description of Artificial Sequence: Synthetic oligonucleotide
caccaaaauaaaucaucuauu

SEQ ID NO: 18215 - RNA, 21 nt, Artificial Sequence
  Description of Artificial Sequence: Synthetic oligonucleotide
accaaaauaaaucaucuuauu

SEQ ID NO: 18216 - RNA, 21 nt, Artificial Sequence
  Description of Artificial Sequence: Synthetic oligonucleotide
ccaaaauaaaucaucuuuauu

SEQ ID NO: 18217 - RNA, 21 nt, Artificial Sequence
  Description of Artificial Sequence: Synthetic oligonucleotide
caaaauaaaucaucuuuaauu

SEQ ID NO: 18218 - RNA, 21 nt, Artificial Sequence
  Description of Artificial Sequence: Synthetic oligonucleotide
aaaauaaaucaucuuuauauu

SEQ ID NO: 18219 - RNA, 21 nt, Artificial Sequence
  Description of Artificial Sequence: Synthetic oligonucleotide
aaauaaaucaucuuuauuauu

SEQ ID NO: 18220 - RNA, 21 nt, Artificial Sequence
  Description of Artificial Sequence: Synthetic oligonucleotide
aauaaaucaucuuuauuaauu

SEQ ID NO: 18221 - RNA, 21 nt, Artificial Sequence
  Description of Artificial Sequence: Synthetic oligonucleotide
auaaaucaucuuuauuaaauu

SEQ ID NO: 18222 - RNA, 21 nt, Artificial Sequence
  Description of Artificial Sequence: Synthetic oligonucleotide
uaaaucaucuuuauuaagauu

SEQ ID NO: 18223 - RNA, 21 nt, Artificial Sequence
  Description of Artificial Sequence: Synthetic oligonucleotide
aaaucaucuuuauuaaguauu

SEQ ID NO: 18224 - RNA, 21 nt, Artificial Sequence
  Description of Artificial Sequence: Synthetic oligonucleotide
aaucaucuuuauuaaguaauu

SEQ ID NO: 18225 - RNA, 21 nt, Artificial Sequence
  Description of Artificial Sequence: Synthetic oligonucleotide
aucaucuuuauuaaguagauu

SEQ ID NO: 18226 - RNA, 21 nt, Artificial Sequence
  Description of Artificial Sequence: Synthetic oligonucleotide
ucaucuuuauuaaguagaauu

SEQ ID NO: 18227 - RNA, 21 nt, Artificial Sequence
  Description of Artificial Sequence: Synthetic oligonucleotide
caucuuuauuaaguagauauu

SEQ ID NO: 18228 - RNA, 21 nt, Artificial Sequence
  Description of Artificial Sequence: Synthetic oligonucleotide
aucuuuauuaaguagaugauu

SEQ ID NO: 18229 - RNA, 21 nt, Artificial Sequence
  Description of Artificial Sequence: Synthetic oligonucleotide
ucuuuauuaaguagaugaauu

SEQ ID NO: 18230 - RNA, 21 nt, Artificial Sequence
  Description of Artificial Sequence: Synthetic oligonucleotide
cuuuauuaaguagaugaaauu

SEQ ID NO: 18231 - RNA, 21 nt, Artificial Sequence
  Description of Artificial Sequence: Synthetic oligonucleotide
uuuauuaaguagaugaaaauu

SEQ ID NO: 18232 - RNA, 21 nt, Artificial Sequence
  Description of Artificial Sequence: Synthetic oligonucleotide
uuauuaaguagaugaaacauu

SEQ ID NO: 18233 - RNA, 21 nt, Artificial Sequence
  Description of Artificial Sequence: Synthetic oligonucleotide
uauuaaguagaugaaacaauu

SEQ ID NO: 18234 - RNA, 21 nt, Artificial Sequence
  Description of Artificial Sequence: Synthetic oligonucleotide
auuaaguagaugaaacauauu

SEQ ID NO: 18235 - RNA, 21 nt, Artificial Sequence
  Description of Artificial Sequence: Synthetic oligonucleotide
uuaaguagaugaaacauuauu

SEQ ID NO: 18236 - RNA, 21 nt, Artificial Sequence
  Description of Artificial Sequence: Synthetic oligonucleotide
uaaguagaugaaacauuaauu

SEQ ID NO: 18237 - RNA, 21 nt, Artificial Sequence
  Description of Artificial Sequence: Synthetic oligonucleotide
aaguagaugaaacauuaaauu

SEQ ID NO: 18238 - RNA, 21 nt, Artificial Sequence
  Description of Artificial Sequence: Synthetic oligonucleotide
aguagaugaaacauuaacauu

SEQ ID NO: 18239 - RNA, 21 nt, Artificial Sequence
  Description of Artificial Sequence: Synthetic oligonucleotide
guagaugaaacauuaacuauu

SEQ ID NO: 18240 - RNA, 21 nt, Artificial Sequence
  Description of Artificial Sequence: Synthetic oligonucleotide
uagaugaaacauuaacucauu

SEQ ID NO: 18241 - RNA, 21 nt, Artificial Sequence
  Description of Artificial Sequence: Synthetic oligonucleotide
agaugaaacauuaacucuauu

SEQ ID NO: 18242 - RNA, 21 nt, Artificial Sequence
  Description of Artificial Sequence: Synthetic oligonucleotide
gaugaaacauuaacucuaauu

SEQ ID NO: 18243 - RNA, 21 nt, Artificial Sequence
  Description of Artificial Sequence: Synthetic oligonucleotide
augaaacauuaacucuaaauu

SEQ ID NO: 18244 - RNA, 21 nt, Artificial Sequence
  Description of Artificial Sequence: Synthetic oligonucleotide
ugaaacauuaacucuaacauu

SEQ ID NO: 18245 - RNA, 21 nt, Artificial Sequence
  Description of Artificial Sequence: Synthetic oligonucleotide
gaaacauuaacucuaacuauu

SEQ ID NO: 18246 - RNA, 21 nt, Artificial Sequence
  Description of Artificial Sequence: Synthetic oligonucleotide
aaacauuaacucuaacugauu

SEQ ID NO: 18247 - RNA, 21 nt, Artificial Sequence
  Description of Artificial Sequence: Synthetic oligonucleotide
aacauuaacucuaacuguauu

SEQ ID NO: 18248 - RNA, 21 nt, Artificial Sequence
  Description of Artificial Sequence: Synthetic oligonucleotide
acauuaacucuaacugugauu

SEQ ID NO: 18249 - RNA, 21 nt, Artificial Sequence
  Description of Artificial Sequence: Synthetic oligonucleotide
cauuaacucuaacugugaauu

SEQ ID NO: 18250 - RNA, 21 nt, Artificial Sequence
  Description of Artificial Sequence: Synthetic oligonucleotide
auuaacucuaacugugacauu

SEQ ID NO: 18251 - RNA, 21 nt, Artificial Sequence
  Description of Artificial Sequence: Synthetic oligonucleotide
uuaacucuaacugugacaauu

SEQ ID NO: 18252 - RNA, 21 nt, Artificial Sequence
  Description of Artificial Sequence: Synthetic oligonucleotide
uaacucuaacugugacaaauu

SEQ ID NO: 18253 - RNA, 21 nt, Artificial Sequence
  Description of Artificial Sequence: Synthetic oligonucleotide
aacucuaacugugacaaaauu

SEQ ID NO: 18254 - RNA, 21 nt, Artificial Sequence
  Description of Artificial Sequence: Synthetic oligonucleotide
acucuaacugugacaaagauu

SEQ ID NO: 18255 - RNA, 21 nt, Artificial Sequence
  Description of Artificial Sequence: Synthetic oligonucleotide
cucuaacugugacaaagaauu

SEQ ID NO: 18256 - RNA, 21 nt, Artificial Sequence
  Description of Artificial Sequence: Synthetic oligonucleotide
ucuaacugugacaaagaaauu

SEQ ID NO: 18257 - RNA, 21 nt, Artificial Sequence
  Description of Artificial Sequence: Synthetic oligonucleotide
cuaacugugacaaagaagauu

SEQ ID NO: 18258 - RNA, 21 nt, Artificial Sequence
  Description of Artificial Sequence: Synthetic oligonucleotide
uaacugugacaaagaagaauu

SEQ ID NO: 18259 - RNA, 21 nt, Artificial Sequence
  Description of Artificial Sequence: Synthetic oligonucleotide
aacugugacaaagaagacauu

SEQ ID NO: 18260 - RNA, 21 nt, Artificial Sequence
  Description of Artificial Sequence: Synthetic oligonucleotide
acugugacaaagaagaccauu

SEQ ID NO: 18261 - RNA, 21 nt, Artificial Sequence
  Description of Artificial Sequence: Synthetic oligonucleotide
cugugacaaagaagaccaauu

SEQ ID NO: 18262 - RNA, 21 nt, Artificial Sequence
  Description of Artificial Sequence: Synthetic oligonucleotide
ugugacaaagaagaccacauu

SEQ ID NO: 18263 - RNA, 21 nt, Artificial Sequence
  Description of Artificial Sequence: Synthetic oligonucleotide
gugacaaagaagaccacaauu

SEQ ID NO: 18264 - RNA, 21 nt, Artificial Sequence
  Description of Artificial Sequence: Synthetic oligonucleotide
ugacaaagaagaccacaaauu

SEQ ID NO: 18265 - RNA, 21 nt, Artificial Sequence
  Description of Artificial Sequence: Synthetic oligonucleotide
gacaaagaagaccacaaaauu

SEQ ID NO: 18266 - RNA, 21 nt, Artificial Sequence
  Description of Artificial Sequence: Synthetic oligonucleotide
acaaagaagaccacaaauauu

SEQ ID NO: 18267 - RNA, 21 nt, Artificial Sequence
  Description of Artificial Sequence: Synthetic oligonucleotide
caaagaagaccacaaauaauu

SEQ ID NO: 18268 - RNA, 21 nt, Artificial Sequence
  Description of Artificial Sequence: Synthetic oligonucleotide
aaagaagaccacaaauagauu

SEQ ID NO: 18269 - RNA, 21 nt, Artificial Sequence
  Description of Artificial Sequence: Synthetic oligonucleotide
aagaagaccacaaauaguauu

SEQ ID NO: 18270 - RNA, 21 nt, Artificial Sequence
  Description of Artificial Sequence: Synthetic oligonucleotide
agaagaccacaaauaguuauu

SEQ ID NO: 18271 - RNA, 21 nt, Artificial Sequence
  Description of Artificial Sequence: Synthetic oligonucleotide
gaagaccacaaauaguuaauu

SEQ ID NO: 18272 - RNA, 21 nt, Artificial Sequence
  Description of Artificial Sequence: Synthetic oligonucleotide
aagaccacaaauaguuauauu

SEQ ID NO: 18273 - RNA, 21 nt, Artificial Sequence
  Description of Artificial Sequence: Synthetic oligonucleotide
agaccacaaauaguuaucauu

SEQ ID NO: 18274 - RNA, 21 nt, Artificial Sequence
  Description of Artificial Sequence: Synthetic oligonucleotide
gaccacaaauaguuaucuauu

SEQ ID NO: 18275 - RNA, 21 nt, Artificial Sequence
  Description of Artificial Sequence: Synthetic oligonucleotide
accacaaauaguuaucuuauu

SEQ ID NO: 18276 - RNA, 21 nt, Artificial Sequence
  Description of Artificial Sequence: Synthetic oligonucleotide
ccacaaauaguuaucuuuauu

SEQ ID NO: 18277 - RNA, 21 nt, Artificial Sequence
  Description of Artificial Sequence: Synthetic oligonucleotide
cacaaauaguuaucuuuuauu

SEQ ID NO: 18278 - RNA, 21 nt, Artificial Sequence
  Description of Artificial Sequence: Synthetic oligonucleotide
acaaauaguuaucuuuuaauu

SEQ ID NO: 18279 - RNA, 21 nt, Artificial Sequence
  Description of Artificial Sequence: Synthetic oligonucleotide
caaauaguuaucuuuuaaauu

SEQ ID NO: 18280 - RNA, 21 nt, Artificial Sequence
  Description of Artificial Sequence: Synthetic oligonucleotide
aaauaguuaucuuuuaauauu

SEQ ID NO: 18281 - RNA, 21 nt, Artificial Sequence
  Description of Artificial Sequence: Synthetic oligonucleotide
aauaguuaucuuuuaauuauu

SEQ ID NO: 18282 - RNA, 21 nt, Artificial Sequence
  Description of Artificial Sequence: Synthetic oligonucleotide
auaguuaucuuuuaauuaauu

SEQ ID NO: 18283 - RNA, 21 nt, Artificial Sequence
  Description of Artificial Sequence: Synthetic oligonucleotide
uaguuaucuuuuaauuacauu

SEQ ID NO: 18284 - RNA, 21 nt, Artificial Sequence
  Description of Artificial Sequence: Synthetic oligonucleotide
aguuaucuuuuaauuacaauu

SEQ ID NO: 18285 - RNA, 21 nt, Artificial Sequence
  Description of Artificial Sequence: Synthetic oligonucleotide
guuaucuuuuaauuacagauu

SEQ ID NO: 18286 - RNA, 21 nt, Artificial Sequence
  Description of Artificial Sequence: Synthetic oligonucleotide
uuaucuuuuaauuacagaauu

SEQ ID NO: 18287 - RNA, 21 nt, Artificial Sequence
  Description of Artificial Sequence: Synthetic oligonucleotide
uaucuuuuaauuacagaaauu

SEQ ID NO: 18288 - RNA, 21 nt, Artificial Sequence
  Description of Artificial Sequence: Synthetic oligonucleotide
aucuuuuaauuacagaagauu

SEQ ID NO: 18289 - RNA, 21 nt, Artificial Sequence
  Description of Artificial Sequence: Synthetic oligonucleotide
ucuuuuaauuacagaagaauu

SEQ ID NO: 18290 - RNA, 21 nt, Artificial Sequence
  Description of Artificial Sequence: Synthetic oligonucleotide
cuuuuaauuacagaagagauu

SEQ ID NO: 18291 - RNA, 21 nt, Artificial Sequence
  Description of Artificial Sequence: Synthetic oligonucleotide
uuuuaauuacagaagaguauu

SEQ ID NO: 18292 - RNA, 21 nt, Artificial Sequence
  Description of Artificial Sequence: Synthetic oligonucleotide
uuuaauuacagaagaguuauu

SEQ ID NO: 18293 - RNA, 21 nt, Artificial Sequence
  Description of Artificial Sequence: Synthetic oligonucleotide
uuaauuacagaagaguuuauu

SEQ ID NO: 18294 - RNA, 21 nt, Artificial Sequence
  Description of Artificial Sequence: Synthetic oligonucleotide
uaauuacagaagaguuucauu

SEQ ID NO: 18295 - RNA, 21 nt, Artificial Sequence
  Description of Artificial Sequence: Synthetic oligonucleotide
aauuacagaagaguuucuauu

SEQ ID NO: 18296 - RNA, 21 nt, Artificial Sequence
  Description of Artificial Sequence: Synthetic oligonucleotide
auuacagaagaguuucuuauu

SEQ ID NO: 18297 - RNA, 21 nt, Artificial Sequence
  Description of Artificial Sequence: Synthetic oligonucleotide
uuacagaagaguuucuuaauu

SEQ ID NO: 18298 - RNA, 21 nt, Artificial Sequence
  Description of Artificial Sequence: Synthetic oligonucleotide
uacagaagaguuucuuaaauu

SEQ ID NO: 18299 - RNA, 21 nt, Artificial Sequence
  Description of Artificial Sequence: Synthetic oligonucleotide
acagaagaguuucuuaacauu

SEQ ID NO: 18300 - RNA, 21 nt, Artificial Sequence
  Description of Artificial Sequence: Synthetic oligonucleotide
cagaagaguuucuuaacuauu

SEQ ID NO: 18301 - RNA, 21 nt, Artificial Sequence
  Description of Artificial Sequence: Synthetic oligonucleotide
agaagaguuucuuaacuuauu

SEQ ID NO: 18302 - RNA, 21 nt, Artificial Sequence
  Description of Artificial Sequence: Synthetic oligonucleotide
gaagaguuucuuaacuuaauu

SEQ ID NO: 18303 - RNA, 21 nt, Artificial Sequence
  Description of Artificial Sequence: Synthetic oligonucleotide
aagaguuucuuaacuuacauu

SEQ ID NO: 18304 - RNA, 21 nt, Artificial Sequence
  Description of Artificial Sequence: Synthetic oligonucleotide
agaguuucuuaacuuacuauu

SEQ ID NO: 18305 - RNA, 21 nt, Artificial Sequence
  Description of Artificial Sequence: Synthetic oligonucleotide
gaguuucuuaacuuacuuauu

SEQ ID NO: 18306 - RNA, 21 nt, Artificial Sequence
  Description of Artificial Sequence: Synthetic oligonucleotide
aguuucuuaacuuacuuuauu

SEQ ID NO: 18307 - RNA, 21 nt, Artificial Sequence
  Description of Artificial Sequence: Synthetic oligonucleotide
guuucuuaacuuacuuuuauu

SEQ ID NO: 18308 - RNA, 21 nt, Artificial Sequence
  Description of Artificial Sequence: Synthetic oligonucleotide
uuucuuaacuuacuuuugauu

SEQ ID NO: 18309 - RNA, 21 nt, Artificial Sequence
  Description of Artificial Sequence: Synthetic oligonucleotide
uucuuaacuuacuuuuguauu

SEQ ID NO: 18310 - RNA, 21 nt, Artificial Sequence
  Description of Artificial Sequence: Synthetic oligonucleotide
ucuuaacuuacuuuuguaauu

SEQ ID NO: 18311 - RNA, 21 nt, Artificial Sequence
  Description of Artificial Sequence: Synthetic oligonucleotide
cuuaacuuacuuuuguaaauu

SEQ ID NO: 18312 - RNA, 21 nt, Artificial Sequence
  Description of Artificial Sequence: Synthetic oligonucleotide
uuaacuuacuuuuguaagauu

SEQ ID NO: 18313 - RNA, 21 nt, Artificial Sequence
  Description of Artificial Sequence: Synthetic oligonucleotide
uaacuuacuuuuguaaguauu

SEQ ID NO: 18314 - RNA, 21 nt, Artificial Sequence
  Description of Artificial Sequence: Synthetic oligonucleotide
aacuuacuuuuguaaguuauu

SEQ ID NO: 18315 - RNA, 21 nt, Artificial Sequence
  Description of Artificial Sequence: Synthetic oligonucleotide
acuuacuuuuguaaguuuauu

SEQ ID NO: 18316 - RNA, 21 nt, Artificial Sequence
  Description of Artificial Sequence: Synthetic oligonucleotide
cuuacuuuuguaaguuuuauu

SEQ ID NO: 18317 - RNA, 21 nt, Artificial Sequence
  Description of Artificial Sequence: Synthetic oligonucleotide
uuacuuuuguaaguuuuuauu

SEQ ID NO: 18318 - RNA, 21 nt, Artificial Sequence
  Description of Artificial Sequence: Synthetic oligonucleotide
uacuuuuguaaguuuuuaauu

SEQ ID NO: 18319 - RNA, 21 nt, Artificial Sequence
  Description of Artificial Sequence: Synthetic oligonucleotide
acuuuuguaaguuuuuauauu

SEQ ID NO: 18320 - RNA, 21 nt, Artificial Sequence
  Description of Artificial Sequence: Synthetic oligonucleotide
cuuuuguaaguuuuuauuauu

SEQ ID NO: 18321 - RNA, 21 nt, Artificial Sequence
  Description of Artificial Sequence: Synthetic oligonucleotide
uuuuguaaguuuuuauugauu

SEQ ID NO: 18322 - RNA, 21 nt, Artificial Sequence
  Description of Artificial Sequence: Synthetic oligonucleotide
uuuguaaguuuuuauuguauu

SEQ ID NO: 18323 - RNA, 21 nt, Artificial Sequence
  Description of Artificial Sequence: Synthetic oligonucleotide
uuguaaguuuuuauugugauu

SEQ ID NO: 18324 - RNA, 21 nt, Artificial Sequence
  Description of Artificial Sequence: Synthetic oligonucleotide
uguaaguuuuuauuguguauu

SEQ ID NO: 18325 - RNA, 21 nt, Artificial Sequence
  Description of Artificial Sequence: Synthetic oligonucleotide
guaaguuuuuauuguguaauu

SEQ ID NO: 18326 - RNA, 21 nt, Artificial Sequence
  Description of Artificial Sequence: Synthetic oligonucleotide
uaaguuuuuauuguguaaauu

SEQ ID NO: 18327 - RNA, 21 nt, Artificial Sequence
  Description of Artificial Sequence: Synthetic oligonucleotide
aaguuuuuauuguguaagauu

SEQ ID NO: 18328 - RNA, 21 nt, Artificial Sequence
  Description of Artificial Sequence: Synthetic oligonucleotide
aguuuuuauuguguaaguauu

SEQ ID NO: 18329 - RNA, 21 nt, Artificial Sequence
  Description of Artificial Sequence: Synthetic oligonucleotide
guuuuuauuguguaaguuauu

SEQ ID NO: 18330 - RNA, 21 nt, Artificial Sequence
  Description of Artificial Sequence: Synthetic oligonucleotide
uuuuuauuguguaaguuuauu

SEQ ID NO: 18331 - RNA, 21 nt, Artificial Sequence
  Description of Artificial Sequence: Synthetic oligonucleotide
uuuuauuguguaaguuuaauu

SEQ ID NO: 18332 - RNA, 21 nt, Artificial Sequence
  Description of Artificial Sequence: Synthetic oligonucleotide
uuuauuguguaaguuuauauu

SEQ ID NO: 18333 - RNA, 21 nt, Artificial Sequence
  Description of Artificial Sequence: Synthetic oligonucleotide
uuauuguguaaguuuauaauu

SEQ ID NO: 18334 - RNA, 21 nt, Artificial Sequence
  Description of Artificial Sequence: Synthetic oligonucleotide
uauuguguaaguuuauaaauu

SEQ ID NO: 18335 - RNA, 21 nt, Artificial Sequence
  Description of Artificial Sequence: Synthetic oligonucleotide
auuguguaaguuuauaauauu

SEQ ID NO: 18336 - RNA, 21 nt, Artificial Sequence
  Description of Artificial Sequence: Synthetic oligonucleotide
uuguguaaguuuauaaugauu

SEQ ID NO: 18337 - RNA, 21 nt, Artificial Sequence
  Description of Artificial Sequence: Synthetic oligonucleotide
uguguaaguuuauaaugcauu

SEQ ID NO: 18338 - RNA, 21 nt, Artificial Sequence
  Description of Artificial Sequence: Synthetic oligonucleotide
guguaaguuuauaaugcaauu

SEQ ID NO: 18339 - RNA, 21 nt, Artificial Sequence
  Description of Artificial Sequence: Synthetic oligonucleotide
uguaaguuuauaaugcagauu

SEQ ID NO: 18340 - RNA, 21 nt, Artificial Sequence
  Description of Artificial Sequence: Synthetic oligonucleotide
guaaguuuauaaugcaggauu

SEQ ID NO: 18341 - RNA, 21 nt, Artificial Sequence
  Description of Artificial Sequence: Synthetic oligonucleotide
uaaguuuauaaugcagggauu

SEQ ID NO: 18342 - RNA, 21 nt, Artificial Sequence
  Description of Artificial Sequence: Synthetic oligonucleotide
aaguuuauaaugcaggggauu

SEQ ID NO: 18343 - RNA, 21 nt, Artificial Sequence
  Description of Artificial Sequence: Synthetic oligonucleotide
aguuuauaaugcaggggaauu

SEQ ID NO: 18344 - RNA, 21 nt, Artificial Sequence
  Description of Artificial Sequence: Synthetic oligonucleotide
guuuauaaugcaggggaaauu

SEQ ID NO: 18345 - RNA, 21 nt, Artificial Sequence
  Description of Artificial Sequence: Synthetic oligonucleotide
uuuauaaugcaggggaagauu

SEQ ID NO: 18346 - RNA, 21 nt, Artificial Sequence
  Description of Artificial Sequence: Synthetic oligonucleotide
uuauaaugcaggggaaguauu

SEQ ID NO: 18347 - RNA, 21 nt, Artificial Sequence
  Description of Artificial Sequence: Synthetic oligonucleotide
uauaaugcaggggaaguaauu

SEQ ID NO: 18348 - RNA, 21 nt, Artificial Sequence
  Description of Artificial Sequence: Synthetic oligonucleotide
auaaugcaggggaaguacauu

SEQ ID NO: 18349 - RNA, 21 nt, Artificial Sequence
  Description of Artificial Sequence: Synthetic oligonucleotide
uaaugcaggggaaguacuauu

SEQ ID NO: 18350 - RNA, 21 nt, Artificial Sequence
  Description of Artificial Sequence: Synthetic oligonucleotide
aaugcaggggaaguacuaauu

SEQ ID NO: 18351 - RNA, 21 nt, Artificial Sequence
  Description of Artificial Sequence: Synthetic oligonucleotide
augcaggggaaguacuacauu

SEQ ID NO: 18352 - RNA, 21 nt, Artificial Sequence
  Description of Artificial Sequence: Synthetic oligonucleotide
ugcaggggaaguacuacuauu

SEQ ID NO: 18353 - RNA, 21 nt, Artificial Sequence
  Description of Artificial Sequence: Synthetic oligonucleotide
gcaggggaaguacuacucauu

SEQ ID NO: 18354 - RNA, 21 nt, Artificial Sequence
  Description of Artificial Sequence: Synthetic oligonucleotide
caggggaaguacuacuccauu

SEQ ID NO: 18355 - RNA, 21 nt, Artificial Sequence
  Description of Artificial Sequence: Synthetic oligonucleotide
aggggaaguacuacuccuauu

SEQ ID NO: 18356 - RNA, 21 nt, Artificial Sequence
  Description of Artificial Sequence: Synthetic oligonucleotide
ggggaaguacuacuccucauu

SEQ ID NO: 18357 - RNA, 21 nt, Artificial Sequence
  Description of Artificial Sequence: Synthetic oligonucleotide
gggaaguacuacuccucaauu

SEQ ID NO: 18358 - RNA, 21 nt, Artificial Sequence
  Description of Artificial Sequence: Synthetic oligonucleotide
ggaaguacuacuccucaaauu

SEQ ID NO: 18359 - RNA, 21 nt, Artificial Sequence
  Description of Artificial Sequence: Synthetic oligonucleotide
gaaguacuacuccucaaaauu

SEQ ID NO: 18360 - RNA, 21 nt, Artificial Sequence
  Description of Artificial Sequence: Synthetic oligonucleotide
aaguacuacuccucaaauauu

SEQ ID NO: 18361 - RNA, 21 nt, Artificial Sequence
  Description of Artificial Sequence: Synthetic oligonucleotide
aguacuacuccucaaaugauu

SEQ ID NO: 18362 - RNA, 21 nt, Artificial Sequence
  Description of Artificial Sequence: Synthetic oligonucleotide
guacuacuccucaaauguauu

SEQ ID NO: 18363 - RNA, 21 nt, Artificial Sequence
  Description of Artificial Sequence: Synthetic oligonucleotide
uacuacuccucaaauguuauu

SEQ ID NO: 18364 - RNA, 21 nt, Artificial Sequence
  Description of Artificial Sequence: Synthetic oligonucleotide
acuacuccucaaauguugauu

SEQ ID NO: 18365 - RNA, 21 nt, Artificial Sequence
  Description of Artificial Sequence: Synthetic oligonucleotide
cuacuccucaaauguugaauu

SEQ ID NO: 18366 - RNA, 21 nt, Artificial Sequence
  Description of Artificial Sequence: Synthetic oligonucleotide
uacuccucaaauguugagauu

SEQ ID NO: 18367 - RNA, 21 nt, Artificial Sequence
  Description of Artificial Sequence: Synthetic oligonucleotide
acuccucaaauguugaggauu

SEQ ID NO: 18368 - RNA, 21 nt, Artificial Sequence
  Description of Artificial Sequence: Synthetic oligonucleotide
cuccucaaauguugagggauu

SEQ ID NO: 18369 - RNA, 21 nt, Artificial Sequence
  Description of Artificial Sequence: Synthetic oligonucleotide
uccucaaauguugagggaauu

SEQ ID NO: 18370 - RNA, 21 nt, Artificial Sequence
  Description of Artificial Sequence: Synthetic oligonucleotide
ccucaaauguugagggaaauu

SEQ ID NO: 18371 - RNA, 21 nt, Artificial Sequence
  Description of Artificial Sequence: Synthetic oligonucleotide
cucaaauguugagggaagauu

SEQ ID NO: 18372 - RNA, 21 nt, Artificial Sequence
  Description of Artificial Sequence: Synthetic oligonucleotide
ucaaauguugagggaagcauu

SEQ ID NO: 18373 - RNA, 21 nt, Artificial Sequence
  Description of Artificial Sequence: Synthetic oligonucleotide
caaauguugagggaagcuauu

SEQ ID NO: 18374 - RNA, 21 nt, Artificial Sequence
  Description of Artificial Sequence: Synthetic oligonucleotide
aaauguugagggaagcuuauu

SEQ ID NO: 18375 - RNA, 21 nt, Artificial Sequence
  Description of Artificial Sequence: Synthetic oligonucleotide
aauguugagggaagcuucauu

SEQ ID NO: 18376 - RNA, 21 nt, Artificial Sequence
  Description of Artificial Sequence: Synthetic oligonucleotide
auguugagggaagcuuccauu

SEQ ID NO: 18377 - RNA, 21 nt, Artificial Sequence
  Description of Artificial Sequence: Synthetic oligonucleotide
uguugagggaagcuuccaauu

SEQ ID NO: 18378 - RNA, 21 nt, Artificial Sequence
  Description of Artificial Sequence: Synthetic oligonucleotide
guugagggaagcuuccauauu

SEQ ID NO: 18379 - RNA, 21 nt, Artificial Sequence
  Description of Artificial Sequence: Synthetic oligonucleotide
uugagggaagcuuccauaauu

SEQ ID NO: 18380 - RNA, 21 nt, Artificial Sequence
  Description of Artificial Sequence: Synthetic oligonucleotide
ugagggaagcuuccauaaauu

SEQ ID NO: 18381 - RNA, 21 nt, Artificial Sequence
  Description of Artificial Sequence: Synthetic oligonucleotide
gagggaagcuuccauaacauu

SEQ ID NO: 18382 - RNA, 21 nt, Artificial Sequence
  Description of Artificial Sequence: Synthetic oligonucleotide
agggaagcuuccauaacaauu

SEQ ID NO: 18383 - RNA, 21 nt, Artificial Sequence
  Description of Artificial Sequence: Synthetic oligonucleotide
gggaagcuuccauaacauauu

SEQ ID NO: 18384 - RNA, 21 nt, Artificial Sequence
  Description of Artificial Sequence: Synthetic oligonucleotide
ggaagcuuccauaacauuauu

SEQ ID NO: 18385 - RNA, 21 nt, Artificial Sequence
  Description of Artificial Sequence: Synthetic oligonucleotide
gaagcuuccauaacauugauu

SEQ ID NO: 18386 - RNA, 21 nt, Artificial Sequence
  Description of Artificial Sequence: Synthetic oligonucleotide
aagcuuccauaacauugaauu

SEQ ID NO: 18387 - RNA, 21 nt, Artificial Sequence
  Description of Artificial Sequence: Synthetic oligonucleotide
agcuuccauaacauugauauu

SEQ ID NO: 18388 - RNA, 21 nt, Artificial Sequence
  Description of Artificial Sequence: Synthetic oligonucleotide
gcuuccauaacauugaugauu

SEQ ID NO: 18389 - RNA, 21 nt, Artificial Sequence
  Description of Artificial Sequence: Synthetic oligonucleotide
cuuccauaacauugaugaauu

SEQ ID NO: 18390 - RNA, 21 nt, Artificial Sequence
  Description of Artificial Sequence: Synthetic oligonucleotide
uuccauaacauugaugacauu

SEQ ID NO: 18391 - RNA, 21 nt, Artificial Sequence
  Description of Artificial Sequence: Synthetic oligonucleotide
uccauaacauugaugacuauu

SEQ ID NO: 18392 - RNA, 21 nt, Artificial Sequence
  Description of Artificial Sequence: Synthetic oligonucleotide
ccauaacauugaugacugauu

SEQ ID NO: 18393 - RNA, 21 nt, Artificial Sequence
  Description of Artificial Sequence: Synthetic oligonucleotide
cauaacauugaugacuggauu

SEQ ID NO: 18394 - RNA, 21 nt, Artificial Sequence
  Description of Artificial Sequence: Synthetic oligonucleotide
auaacauugaugacuggcauu

SEQ ID NO: 18395 - RNA, 21 nt, Artificial Sequence
  Description of Artificial Sequence: Synthetic oligonucleotide
uaacauugaugacuggcuauu

SEQ ID NO: 18396 - RNA, 21 nt, Artificial Sequence
  Description of Artificial Sequence: Synthetic oligonucleotide
aacauugaugacuggcuuauu

SEQ ID NO: 18397 - RNA, 21 nt, Artificial Sequence
  Description of Artificial Sequence: Synthetic oligonucleotide
acauugaugacuggcuucauu

SEQ ID NO: 18398 - RNA, 21 nt, Artificial Sequence
  Description of Artificial Sequence: Synthetic oligonucleotide
cauugaugacuggcuucaauu

SEQ ID NO: 18399 - RNA, 21 nt, Artificial Sequence
  Description of Artificial Sequence: Synthetic oligonucleotide
auugaugacuggcuucauauu

SEQ ID NO: 18400 - RNA, 21 nt, Artificial Sequence
  Description of Artificial Sequence: Synthetic oligonucleotide
uugaugacuggcuucaugauu

SEQ ID NO: 18401 - RNA, 21 nt, Artificial Sequence
  Description of Artificial Sequence: Synthetic oligonucleotide
ugaugacuggcuucauggauu

SEQ ID NO: 18402 - RNA, 21 nt, Artificial Sequence
  Description of Artificial Sequence: Synthetic oligonucleotide
gaugacuggcuucauggcauu

SEQ ID NO: 18403 - RNA, 21 nt, Artificial Sequence
  Description of Artificial Sequence: Synthetic oligonucleotide
augacuggcuucauggcaauu

SEQ ID NO: 18404 - RNA, 21 nt, Artificial Sequence
  Description of Artificial Sequence: Synthetic oligonucleotide
ugacuggcuucauggcagauu

SEQ ID NO: 18405 - RNA, 21 nt, Artificial Sequence
  Description of Artificial Sequence: Synthetic oligonucleotide
gacuggcuucauggcaguauu

SEQ ID NO: 18406 - RNA, 21 nt, Artificial Sequence
  Description of Artificial Sequence: Synthetic oligonucleotide
acuggcuucauggcaguaauu

SEQ ID NO: 18407 - RNA, 21 nt, Artificial Sequence
  Description of Artificial Sequence: Synthetic oligonucleotide
cuggcuucauggcaguaaauu

SEQ ID NO: 18408 - RNA, 21 nt, Artificial Sequence
  Description of Artificial Sequence: Synthetic oligonucleotide
uggcuucauggcaguaauauu

SEQ ID NO: 18409 - RNA, 21 nt, Artificial Sequence
  Description of Artificial Sequence: Synthetic oligonucleotide
ggcuucauggcaguaauuauu

SEQ ID NO: 18410 - RNA, 21 nt, Artificial Sequence
  Description of Artificial Sequence: Synthetic oligonucleotide
gcuucauggcaguaauucauu

SEQ ID NO: 18411 - RNA, 21 nt, Artificial Sequence
  Description of Artificial Sequence: Synthetic oligonucleotide
cuucauggcaguaauucuauu

SEQ ID NO: 18412 - RNA, 21 nt, Artificial Sequence
  Description of Artificial Sequence: Synthetic oligonucleotide
uucauggcaguaauucucauu

SEQ ID NO: 18413 - RNA, 21 nt, Artificial Sequence
  Description of Artificial Sequence: Synthetic oligonucleotide
ucauggcaguaauucucgauu

SEQ ID NO: 18414 - RNA, 21 nt, Artificial Sequence
  Description of Artificial Sequence: Synthetic oligonucleotide
cauggcaguaauucucggauu

SEQ ID NO: 18415 - RNA, 21 nt, Artificial Sequence
  Description of Artificial Sequence: Synthetic oligonucleotide
auggcaguaauucucggcauu

SEQ ID NO: 18416 - RNA, 21 nt, Artificial Sequence
  Description of Artificial Sequence: Synthetic oligonucleotide
uggcaguaauucucggcuauu

SEQ ID NO: 18417 - RNA, 21 nt, Artificial Sequence
  Description of Artificial Sequence: Synthetic oligonucleotide
ggcaguaauucucggcugauu

SEQ ID NO: 18418 - RNA, 21 nt, Artificial Sequence
  Description of Artificial Sequence: Synthetic oligonucleotide
gcaguaauucucggcuguauu

SEQ ID NO: 18419 - RNA, 21 nt, Artificial Sequence
  Description of Artificial Sequence: Synthetic oligonucleotide
caguaauucucggcuguaauu

SEQ ID NO: 18420 - RNA, 21 nt, Artificial Sequence
  Description of Artificial Sequence: Synthetic oligonucleotide
aguaauucucggcuguagauu

SEQ ID NO: 18421 - RNA, 21 nt, Artificial Sequence
  Description of Artificial Sequence: Synthetic oligonucleotide
guaauucucggcuguaguauu

SEQ ID NO: 18422 - RNA, 21 nt, Artificial Sequence
  Description of Artificial Sequence: Synthetic oligonucleotide
uaauucucggcuguaguuauu

SEQ ID NO: 18423 - RNA, 21 nt, Artificial Sequence
  Description of Artificial Sequence: Synthetic oligonucleotide
aauucucggcuguaguugauu

SEQ ID NO: 18424 - RNA, 21 nt, Artificial Sequence
  Description of Artificial Sequence: Synthetic oligonucleotide
auucucggcuguaguugcauu

SEQ ID NO: 18425 - RNA, 21 nt, Artificial Sequence
  Description of Artificial Sequence: Synthetic oligonucleotide
uucucggcuguaguugcaauu

SEQ ID NO: 18426 - RNA, 21 nt, Artificial Sequence
  Description of Artificial Sequence: Synthetic oligonucleotide
ucucggcuguaguugcauauu

SEQ ID NO: 18427 - RNA, 21 nt, Artificial Sequence
  Description of Artificial Sequence: Synthetic oligonucleotide
cucggcuguaguugcauaauu

SEQ ID NO: 18428 - RNA, 21 nt, Artificial Sequence
  Description of Artificial Sequence: Synthetic oligonucleotide
ucggcuguaguugcauaaauu

SEQ ID NO: 18429 - RNA, 21 nt, Artificial Sequence
  Description of Artificial Sequence: Synthetic oligonucleotide
cggcuguaguugcauaagauu

SEQ ID NO: 18430 - RNA, 21 nt, Artificial Sequence
  Description of Artificial Sequence: Synthetic oligonucleotide
ggcuguaguugcauaagcauu

SEQ ID NO: 18431 - RNA, 21 nt, Artificial Sequence
  Description of Artificial Sequence: Synthetic oligonucleotide
gcuguaguugcauaagcaauu

SEQ ID NO: 18432 - RNA, 21 nt, Artificial Sequence
  Description of Artificial Sequence: Synthetic oligonucleotide
cuguaguugcauaagcauauu

SEQ ID NO: 18433 - RNA, 21 nt, Artificial Sequence
  Description of Artificial Sequence: Synthetic oligonucleotide
uguaguugcauaagcauuauu

SEQ ID NO: 18434 - RNA, 21 nt, Artificial Sequence
  Description of Artificial Sequence: Synthetic oligonucleotide
guaguugcauaagcauugauu

SEQ ID NO: 18435 - RNA, 21 nt, Artificial Sequence
  Description of Artificial Sequence: Synthetic oligonucleotide
uaguugcauaagcauugcauu

SEQ ID NO: 18436 - RNA, 21 nt, Artificial Sequence
  Description of Artificial Sequence: Synthetic oligonucleotide
aguugcauaagcauugcuauu

SEQ ID NO: 18437 - RNA, 21 nt, Artificial Sequence
  Description of Artificial Sequence: Synthetic oligonucleotide
guugcauaagcauugcucauu

SEQ ID NO: 18438 - RNA, 21 nt, Artificial Sequence
  Description of Artificial Sequence: Synthetic oligonucleotide
uugcauaagcauugcucaauu

SEQ ID NO: 18439 - RNA, 21 nt, Artificial Sequence
  Description of Artificial Sequence: Synthetic oligonucleotide
ugcauaagcauugcucaaauu

SEQ ID NO: 18440 - RNA, 21 nt, Artificial Sequence
  Description of Artificial Sequence: Synthetic oligonucleotide
gcauaagcauugcucaagauu

SEQ ID NO: 18441 - RNA, 21 nt, Artificial Sequence
  Description of Artificial Sequence: Synthetic oligonucleotide
cauaagcauugcucaagaauu

SEQ ID NO: 18442 - RNA, 21 nt, Artificial Sequence
  Description of Artificial Sequence: Synthetic oligonucleotide
auaagcauugcucaagagauu

SEQ ID NO: 18443 - RNA, 21 nt, Artificial Sequence
  Description of Artificial Sequence: Synthetic oligonucleotide
uaagcauugcucaagaggauu

SEQ ID NO: 18444 - RNA, 21 nt, Artificial Sequence
  Description of Artificial Sequence: Synthetic oligonucleotide
aagcauugcucaagaggaauu

SEQ ID NO: 18445 - RNA, 21 nt, Artificial Sequence
  Description of Artificial Sequence: Synthetic oligonucleotide
agcauugcucaagaggaaauu

SEQ ID NO: 18446 - RNA, 21 nt, Artificial Sequence
  Description of Artificial Sequence: Synthetic oligonucleotide
gcauugcucaagaggaaaauu

SEQ ID NO: 18447 - RNA, 21 nt, Artificial Sequence
  Description of Artificial Sequence: Synthetic oligonucleotide
cauugcucaagaggaaaaauu

SEQ ID NO: 18448 - RNA, 21 nt, Artificial Sequence
  Description of Artificial Sequence: Synthetic oligonucleotide
auugcucaagaggaaaauauu

SEQ ID NO: 18449 - RNA, 21 nt, Artificial Sequence
  Description of Artificial Sequence: Synthetic oligonucleotide
uugcucaagaggaaaaucauu

SEQ ID NO: 18450 - RNA, 21 nt, Artificial Sequence
  Description of Artificial Sequence: Synthetic oligonucleotide
ugcucaagaggaaaauccauu

SEQ ID NO: 18451 - RNA, 21 nt, Artificial Sequence
  Description of Artificial Sequence: Synthetic oligonucleotide
gcucaagaggaaaauccaauu

SEQ ID NO: 18452 - RNA, 21 nt, Artificial Sequence
  Description of Artificial Sequence: Synthetic oligonucleotide
cucaagaggaaaauccaaauu

SEQ ID NO: 18453 - RNA, 21 nt, Artificial Sequence
  Description of Artificial Sequence: Synthetic oligonucleotide
ucaagaggaaaauccaaaauu

SEQ ID NO: 18454 - RNA, 21 nt, Artificial Sequence
  Description of Artificial Sequence: Synthetic oligonucleotide
caagaggaaaauccaaaaauu

SEQ ID NO: 18455 - RNA, 21 nt, Artificial Sequence
  Description of Artificial Sequence: Synthetic oligonucleotide
aagaggaaaauccaaaagauu

SEQ ID NO: 18456 - RNA, 21 nt, Artificial Sequence
  Description of Artificial Sequence: Synthetic oligonucleotide
agaggaaaauccaaaaguauu

SEQ ID NO: 18457 - RNA, 21 nt, Artificial Sequence
  Description of Artificial Sequence: Synthetic oligonucleotide
gaggaaaauccaaaagugauu

SEQ ID NO: 18458 - RNA, 21 nt, Artificial Sequence
  Description of Artificial Sequence: Synthetic oligonucleotide
aggaaaauccaaaagugcauu

SEQ ID NO: 18459 - RNA, 21 nt, Artificial Sequence
  Description of Artificial Sequence: Synthetic oligonucleotide
ggaaaauccaaaagugcaauu

SEQ ID NO: 18460 - RNA, 21 nt, Artificial Sequence
  Description of Artificial Sequence: Synthetic oligonucleotide
gaaaauccaaaagugcagauu

SEQ ID NO: 18461 - RNA, 21 nt, Artificial Sequence
  Description of Artificial Sequence: Synthetic oligonucleotide
aaaauccaaaagugcagcauu

SEQ ID NO: 18462 - RNA, 21 nt, Artificial Sequence
  Description of Artificial Sequence: Synthetic oligonucleotide
aaauccaaaagugcagcaauu

SEQ ID NO: 18463 - RNA, 21 nt, Artificial Sequence
  Description of Artificial Sequence: Synthetic oligonucleotide
aauccaaaagugcagcagauu

SEQ ID NO: 18464 - RNA, 21 nt, Artificial Sequence
  Description of Artificial Sequence: Synthetic oligonucleotide
auccaaaagugcagcaggauu

SEQ ID NO: 18465 - RNA, 21 nt, Artificial Sequence
  Description of Artificial Sequence: Synthetic oligonucleotide
uccaaaagugcagcaggaauu

SEQ ID NO: 18466 - RNA, 21 nt, Artificial Sequence
  Description of Artificial Sequence: Synthetic oligonucleotide
ccaaaagugcagcaggagauu

SEQ ID NO: 18467 - RNA, 21 nt, Artificial Sequence
  Description of Artificial Sequence: Synthetic oligonucleotide
caaaagugcagcaggagaauu

SEQ ID NO: 18468 - RNA, 21 nt, Artificial Sequence
  Description of Artificial Sequence: Synthetic oligonucleotide
aaaagugcagcaggagaaauu

SEQ ID NO: 18469 - RNA, 21 nt, Artificial Sequence
  Description of Artificial Sequence: Synthetic oligonucleotide
aaagugcagcaggagaacauu

SEQ ID NO: 18470 - RNA, 21 nt, Artificial Sequence
  Description of Artificial Sequence: Synthetic oligonucleotide
aagugcagcaggagaacuauu

SEQ ID NO: 18471 - RNA, 21 nt, Artificial Sequence
  Description of Artificial Sequence: Synthetic oligonucleotide
agugcagcaggagaacucauu

SEQ ID NO: 18472 - RNA, 21 nt, Artificial Sequence
  Description of Artificial Sequence: Synthetic oligonucleotide
gugcagcaggagaacucuauu

SEQ ID NO: 18473 - RNA, 21 nt, Artificial Sequence
  Description of Artificial Sequence: Synthetic oligonucleotide
ugcagcaggagaacucuuauu

SEQ ID NO: 18474 - RNA, 21 nt, Artificial Sequence
  Description of Artificial Sequence: Synthetic oligonucleotide
gcagcaggagaacucuuuauu

SEQ ID NO: 18475 - RNA, 21 nt, Artificial Sequence
  Description of Artificial Sequence: Synthetic oligonucleotide
cagcaggagaacucuuuuauu

SEQ ID NO: 18476 - RNA, 21 nt, Artificial Sequence
  Description of Artificial Sequence: Synthetic oligonucleotide
agcaggagaacucuuuucauu

SEQ ID NO: 18477 - RNA, 21 nt, Artificial Sequence
  Description of Artificial Sequence: Synthetic oligonucleotide
gcaggagaacucuuuuccauu

SEQ ID NO: 18478 - RNA, 21 nt, Artificial Sequence
  Description of Artificial Sequence: Synthetic oligonucleotide
caggagaacucuuuucccauu

SEQ ID NO: 18479 - RNA, 21 nt, Artificial Sequence
  Description of Artificial Sequence: Synthetic oligonucleotide
aggagaacucuuuucccuauu

SEQ ID NO: 18480 - RNA, 21 nt, Artificial Sequence
  Description of Artificial Sequence: Synthetic oligonucleotide
ggagaacucuuuucccugauu

SEQ ID NO: 18481 - RNA, 21 nt, Artificial Sequence
  Description of Artificial Sequence: Synthetic oligonucleotide
gagaacucuuuucccugaauu

SEQ ID NO: 18482 - RNA, 21 nt, Artificial Sequence
  Description of Artificial Sequence: Synthetic oligonucleotide
agaacucuuuucccugaaauu

SEQ ID NO: 18483 - RNA, 21 nt, Artificial Sequence
  Description of Artificial Sequence: Synthetic oligonucleotide
gaacucuuuucccugaaaauu

SEQ ID NO: 18484 - RNA, 21 nt, Artificial Sequence
  Description of Artificial Sequence: Synthetic oligonucleotide
aacucuuuucccugaaaaauu

SEQ ID NO: 18485 - RNA, 21 nt, Artificial Sequence
  Description of Artificial Sequence: Synthetic oligonucleotide
acucuuuucccugaaaaaauu

SEQ ID NO: 18486 - RNA, 21 nt, Artificial Sequence
  Description of Artificial Sequence: Synthetic oligonucleotide
cucuuuucccugaaaaagauu

SEQ ID NO: 18487 - RNA, 21 nt, Artificial Sequence
  Description of Artificial Sequence: Synthetic oligonucleotide
ucuuuucccugaaaaaggauu

SEQ ID NO: 18488 - RNA, 21 nt, Artificial Sequence
  Description of Artificial Sequence: Synthetic oligonucleotide
cuuuucccugaaaaaggaauu

SEQ ID NO: 18489 - RNA, 21 nt, Artificial Sequence
  Description of Artificial Sequence: Synthetic oligonucleotide
uuuucccugaaaaaggaaauu

SEQ ID NO: 18490 - RNA, 21 nt, Artificial Sequence
  Description of Artificial Sequence: Synthetic oligonucleotide
uuucccugaaaaaggaaaauu

SEQ ID NO: 18491 - RNA, 21 nt, Artificial Sequence
  Description of Artificial Sequence: Synthetic oligonucleotide
uucccugaaaaaggaaaaauu

SEQ ID NO: 18492 - RNA, 21 nt, Artificial Sequence
  Description of Artificial Sequence: Synthetic oligonucleotide
ucccugaaaaaggaaaaaauu

SEQ ID NO: 18493 - RNA, 21 nt, Artificial Sequence
  Description of Artificial Sequence: Synthetic oligonucleotide
cccugaaaaaggaaaaauauu

SEQ ID NO: 18494 - RNA, 21 nt, Artificial Sequence
  Description of Artificial Sequence: Synthetic oligonucleotide
ccugaaaaaggaaaaauaauu

SEQ ID NO: 18495 - RNA, 21 nt, Artificial Sequence
  Description of Artificial Sequence: Synthetic oligonucleotide
cugaaaaaggaaaaauauauu

SEQ ID NO: 18496 - RNA, 21 nt, Artificial Sequence
  Description of Artificial Sequence: Synthetic oligonucleotide
ugaaaaaggaaaaauauuauu

SEQ ID NO: 18497 - RNA, 21 nt, Artificial Sequence
  Description of Artificial Sequence: Synthetic oligonucleotide
gaaaaaggaaaaauauugauu

SEQ ID NO: 18498 - RNA, 21 nt, Artificial Sequence
  Description of Artificial Sequence: Synthetic oligonucleotide
aaaaaggaaaaauauugaauu

SEQ ID NO: 18499 - RNA, 21 nt, Artificial Sequence
  Description of Artificial Sequence: Synthetic oligonucleotide
aaaaggaaaaauauugaaauu

SEQ ID NO: 18500 - RNA, 21 nt, Artificial Sequence
  Description of Artificial Sequence: Synthetic oligonucleotide
aaaggaaaaauauugaacauu

SEQ ID NO: 18501 - RNA, 21 nt, Artificial Sequence
  Description of Artificial Sequence: Synthetic oligonucleotide
aaggaaaaauauugaacuauu

SEQ ID NO: 18502 - RNA, 21 nt, Artificial Sequence
  Description of Artificial Sequence: Synthetic oligonucleotide
aggaaaaauauugaacucauu

SEQ ID NO: 18503 - RNA, 21 nt, Artificial Sequence
  Description of Artificial Sequence: Synthetic oligonucleotide
ggaaaaauauugaacucaauu

SEQ ID NO: 18504 - RNA, 21 nt, Artificial Sequence
  Description of Artificial Sequence: Synthetic oligonucleotide
gaaaaauauugaacucaaauu

SEQ ID NO: 18505 - RNA, 21 nt, Artificial Sequence
  Description of Artificial Sequence: Synthetic oligonucleotide
aaaaauauugaacucaauauu

SEQ ID NO: 18506 - RNA, 21 nt, Artificial Sequence
  Description of Artificial Sequence: Synthetic oligonucleotide
aaaauauugaacucaaugauu

SEQ ID NO: 18507 - RNA, 21 nt, Artificial Sequence
  Description of Artificial Sequence: Synthetic oligonucleotide
aaauauugaacucaaugaauu

SEQ ID NO: 18508 - RNA, 21 nt, Artificial Sequence
  Description of Artificial Sequence: Synthetic oligonucleotide
aauauugaacucaaugauauu

SEQ ID NO: 18509 - RNA, 21 nt, Artificial Sequence
  Description of Artificial Sequence: Synthetic oligonucleotide
auauugaacucaaugauaauu

SEQ ID NO: 18510 - RNA, 21 nt, Artificial Sequence
  Description of Artificial Sequence: Synthetic oligonucleotide
uauugaacucaaugauagauu

SEQ ID NO: 18511 - RNA, 21 nt, Artificial Sequence
  Description of Artificial Sequence: Synthetic oligonucleotide
auugaacucaaugauagcauu

SEQ ID NO: 18512 - RNA, 21 nt, Artificial Sequence
  Description of Artificial Sequence: Synthetic oligonucleotide
uugaacucaaugauagcaauu

SEQ ID NO: 18513 - RNA, 21 nt, Artificial Sequence
  Description of Artificial Sequence: Synthetic oligonucleotide
ugaacucaaugauagcacauu

SEQ ID NO: 18514 - RNA, 21 nt, Artificial Sequence
  Description of Artificial Sequence: Synthetic oligonucleotide
gaacucaaugauagcaccauu

SEQ ID NO: 18515 - RNA, 21 nt, Artificial Sequence
  Description of Artificial Sequence: Synthetic oligonucleotide
aacucaaugauagcaccuauu

SEQ ID NO: 18516 - RNA, 21 nt, Artificial Sequence
  Description of Artificial Sequence: Synthetic oligonucleotide
acucaaugauagcaccuaauu

SEQ ID NO: 18517 - RNA, 21 nt, Artificial Sequence
  Description of Artificial Sequence: Synthetic oligonucleotide
cucaaugauagcaccuaaauu

SEQ ID NO: 18518 - RNA, 21 nt, Artificial Sequence
  Description of Artificial Sequence: Synthetic oligonucleotide
ucaaugauagcaccuaaaauu

SEQ ID NO: 18519 - RNA, 21 nt, Artificial Sequence
  Description of Artificial Sequence: Synthetic oligonucleotide
caaugauagcaccuaaacauu

SEQ ID NO: 18520 - RNA, 21 nt, Artificial Sequence
  Description of Artificial Sequence: Synthetic oligonucleotide
aaugauagcaccuaaacuauu

SEQ ID NO: 18521 - RNA, 21 nt, Artificial Sequence
  Description of Artificial Sequence: Synthetic oligonucleotide
augauagcaccuaaacuuauu

SEQ ID NO: 18522 - RNA, 21 nt, Artificial Sequence
  Description of Artificial Sequence: Synthetic oligonucleotide
ugauagcaccuaaacuuaauu

SEQ ID NO: 18523 - RNA, 21 nt, Artificial Sequence
  Description of Artificial Sequence: Synthetic oligonucleotide
gauagcaccuaaacuuacauu

SEQ ID NO: 18524 - RNA, 21 nt, Artificial Sequence
  Description of Artificial Sequence: Synthetic oligonucleotide
auagcaccuaaacuuacaauu

SEQ ID NO: 18525 - RNA, 21 nt, Artificial Sequence
  Description of Artificial Sequence: Synthetic oligonucleotide
uagcaccuaaacuuacauauu

SEQ ID NO: 18526 - RNA, 21 nt, Artificial Sequence
  Description of Artificial Sequence: Synthetic oligonucleotide
agcaccuaaacuuacauuauu

SEQ ID NO: 18527 - RNA, 21 nt, Artificial Sequence
  Description of Artificial Sequence: Synthetic oligonucleotide
gcaccuaaacuuacauuuauu

SEQ ID NO: 18528 - RNA, 21 nt, Artificial Sequence
  Description of Artificial Sequence: Synthetic oligonucleotide
caccuaaacuuacauuuaauu

SEQ ID NO: 18529 - RNA, 21 nt, Artificial Sequence
  Description of Artificial Sequence: Synthetic oligonucleotide
accuaaacuuacauuuaaauu

SEQ ID NO: 18530 - RNA, 21 nt, Artificial Sequence
  Description of Artificial Sequence: Synthetic oligonucleotide
ccuaaacuuacauuuaaaauu

SEQ ID NO: 18531 - RNA, 21 nt, Artificial Sequence
  Description of Artificial Sequence: Synthetic oligonucleotide
cuaaacuuacauuuaaaaauu

SEQ ID NO: 18532 - RNA, 21 nt, Artificial Sequence
  Description of Artificial Sequence: Synthetic oligonucleotide
uaaacuuacauuuaaaagauu

SEQ ID NO: 18533 - RNA, 21 nt, Artificial Sequence
  Description of Artificial Sequence: Synthetic oligonucleotide
aaacuuacauuuaaaagaauu

SEQ ID NO: 18534 - RNA, 21 nt, Artificial Sequence
  Description of Artificial Sequence: Synthetic oligonucleotide
aacuuacauuuaaaagacauu

SEQ ID NO: 18535 - RNA, 21 nt, Artificial Sequence
  Description of Artificial Sequence: Synthetic oligonucleotide
acuuacauuuaaaagacaauu

SEQ ID NO: 18536 - RNA, 21 nt, Artificial Sequence
  Description of Artificial Sequence: Synthetic oligonucleotide
cuuacauuuaaaagacagauu

SEQ ID NO: 18537 - RNA, 21 nt, Artificial Sequence
  Description of Artificial Sequence: Synthetic oligonucleotide
uuacauuuaaaagacagaauu

SEQ ID NO: 18538 - RNA, 21 nt, Artificial Sequence
  Description of Artificial Sequence: Synthetic oligonucleotide
uacauuuaaaagacagacauu

SEQ ID NO: 18539 - RNA, 21 nt, Artificial Sequence
  Description of Artificial Sequence: Synthetic oligonucleotide
acauuuaaaagacagacaauu

SEQ ID NO: 18540 - RNA, 21 nt, Artificial Sequence
  Description of Artificial Sequence: Synthetic oligonucleotide
cauuuaaaagacagacauauu

SEQ ID NO: 18541 - RNA, 21 nt, Artificial Sequence
  Description of Artificial Sequence: Synthetic oligonucleotide
auuuaaaagacagacauuauu

SEQ ID NO: 18542 - RNA, 21 nt, Artificial Sequence
  Description of Artificial Sequence: Synthetic oligonucleotide
uuuaaaagacagacauucauu

SEQ ID NO: 18543 - RNA, 21 nt, Artificial Sequence
  Description of Artificial Sequence: Synthetic oligonucleotide
uuaaaagacagacauuccauu

SEQ ID NO: 18544 - RNA, 21 nt, Artificial Sequence
  Description of Artificial Sequence: Synthetic oligonucleotide
uaaaagacagacauuccuauu

SEQ ID NO: 18545 - RNA, 21 nt, Artificial Sequence
  Description of Artificial Sequence: Synthetic oligonucleotide
aaaagacagacauuccuuauu

SEQ ID NO: 18546 - RNA, 21 nt, Artificial Sequence
  Description of Artificial Sequence: Synthetic oligonucleotide
aaagacagacauuccuucauu

SEQ ID NO: 18547 - RNA, 21 nt, Artificial Sequence
  Description of Artificial Sequence: Synthetic oligonucleotide
aagacagacauuccuucuauu

SEQ ID NO: 18548 - RNA, 21 nt, Artificial Sequence
  Description of Artificial Sequence: Synthetic oligonucleotide
agacagacauuccuucuaauu

SEQ ID NO: 18549 - RNA, 21 nt, Artificial Sequence
  Description of Artificial Sequence: Synthetic oligonucleotide
gacagacauuccuucuacauu

SEQ ID NO: 18550 - RNA, 21 nt, Artificial Sequence
  Description of Artificial Sequence: Synthetic oligonucleotide
acagacauuccuucuacaauu

SEQ ID NO: 18551 - RNA, 21 nt, Artificial Sequence
  Description of Artificial Sequence: Synthetic oligonucleotide
cagacauuccuucuacauauu

SEQ ID NO: 18552 - RNA, 21 nt, Artificial Sequence
  Description of Artificial Sequence: Synthetic oligonucleotide
agacauuccuucuacaugauu

SEQ ID NO: 18553 - RNA, 21 nt, Artificial Sequence
  Description of Artificial Sequence: Synthetic oligonucleotide
gacauuccuucuacauguauu

SEQ ID NO: 18554 - RNA, 21 nt, Artificial Sequence
  Description of Artificial Sequence: Synthetic oligonucleotide
acauuccuucuacauguaauu

SEQ ID NO: 18555 - RNA, 21 nt, Artificial Sequence
  Description of Artificial Sequence: Synthetic oligonucleotide
cauuccuucuacauguaaauu

SEQ ID NO: 18556 - RNA, 21 nt, Artificial Sequence
  Description of Artificial Sequence: Synthetic oligonucleotide
auuccuucuacauguaauauu

SEQ ID NO: 18557 - RNA, 21 nt, Artificial Sequence
  Description of Artificial Sequence: Synthetic oligonucleotide
uuccuucuacauguaaugauu

SEQ ID NO: 18558 - RNA, 21 nt, Artificial Sequence
  Description of Artificial Sequence: Synthetic oligonucleotide
uccuucuacauguaaugaauu

SEQ ID NO: 18559 - RNA, 21 nt, Artificial Sequence
  Description of Artificial Sequence: Synthetic oligonucleotide
ccuucuacauguaaugacauu

SEQ ID NO: 18560 - RNA, 21 nt, Artificial Sequence
  Description of Artificial Sequence: Synthetic oligonucleotide
cuucuacauguaaugacaauu

SEQ ID NO: 18561 - RNA, 21 nt, Artificial Sequence
  Description of Artificial Sequence: Synthetic oligonucleotide
uucuacauguaaugacacauu

SEQ ID NO: 18562 - RNA, 21 nt, Artificial Sequence
  Description of Artificial Sequence: Synthetic oligonucleotide
ucuacauguaaugacacuauu

SEQ ID NO: 18563 - RNA, 21 nt, Artificial Sequence
  Description of Artificial Sequence: Synthetic oligonucleotide
cuacauguaaugacacuuauu

SEQ ID NO: 18564 - RNA, 21 nt, Artificial Sequence
  Description of Artificial Sequence: Synthetic oligonucleotide
uacauguaaugacacuucauu

SEQ ID NO: 18565 - RNA, 21 nt, Artificial Sequence
  Description of Artificial Sequence: Synthetic oligonucleotide
acauguaaugacacuucuauu

SEQ ID NO: 18566 - RNA, 21 nt, Artificial Sequence
  Description of Artificial Sequence: Synthetic oligonucleotide
cauguaaugacacuucuuauu

SEQ ID NO: 18567 - RNA, 21 nt, Artificial Sequence
  Description of Artificial Sequence: Synthetic oligonucleotide
auguaaugacacuucuugauu

SEQ ID NO: 18568 - RNA, 21 nt, Artificial Sequence
  Description of Artificial Sequence: Synthetic oligonucleotide
uguaaugacacuucuuguauu

SEQ ID NO: 18569 - RNA, 21 nt, Artificial Sequence
  Description of Artificial Sequence: Synthetic oligonucleotide
guaaugacacuucuugugauu

SEQ ID NO: 18570 - RNA, 21 nt, Artificial Sequence
  Description of Artificial Sequence: Synthetic oligonucleotide
uaaugacacuucuuguguauu

SEQ ID NO: 18571 - RNA, 21 nt, Artificial Sequence
  Description of Artificial Sequence: Synthetic oligonucleotide
aaugacacuucuuguguuauu

SEQ ID NO: 18572 - RNA, 21 nt, Artificial Sequence
  Description of Artificial Sequence: Synthetic oligonucleotide
augacacuucuuguguuaauu

SEQ ID NO: 18573 - RNA, 21 nt, Artificial Sequence
  Description of Artificial Sequence: Synthetic oligonucleotide
ugacacuucuuguguuaaauu

SEQ ID NO: 18574 - RNA, 21 nt, Artificial Sequence
  Description of Artificial Sequence: Synthetic oligonucleotide
gacacuucuuguguuaaaauu

SEQ ID NO: 18575 - RNA, 21 nt, Artificial Sequence
  Description of Artificial Sequence: Synthetic oligonucleotide
acacuucuuguguuaaacauu

SEQ ID NO: 18576 - RNA, 21 nt, Artificial Sequence
  Description of Artificial Sequence: Synthetic oligonucleotide
cacuucuuguguuaaacuauu

SEQ ID NO: 18577 - RNA, 21 nt, Artificial Sequence
  Description of Artificial Sequence: Synthetic oligonucleotide
acuucuuguguuaaacuaauu

SEQ ID NO: 18578 - RNA, 21 nt, Artificial Sequence
  Description of Artificial Sequence: Synthetic oligonucleotide
cuucuuguguuaaacuaaauu

SEQ ID NO: 18579 - RNA, 21 nt, Artificial Sequence
  Description of Artificial Sequence: Synthetic oligonucleotide
uucuuguguuaaacuaaaauu

SEQ ID NO: 18580 - RNA, 21 nt, Artificial Sequence
  Description of Artificial Sequence: Synthetic oligonucleotide
ucuuguguuaaacuaaaaauu

SEQ ID NO: 18581 - RNA, 21 nt, Artificial Sequence
  Description of Artificial Sequence: Synthetic oligonucleotide
cuuguguuaaacuaaaaaauu

SEQ ID NO: 18582 - RNA, 21 nt, Artificial Sequence
  Description of Artificial Sequence: Synthetic oligonucleotide
uuguguuaaacuaaaaauauu

SEQ ID NO: 18583 - RNA, 21 nt, Artificial Sequence
  Description of Artificial Sequence: Synthetic oligonucleotide
uguguuaaacuaaaaauuauu

SEQ ID NO: 18584 - RNA, 21 nt, Artificial Sequence
  Description of Artificial Sequence: Synthetic oligonucleotide
guguuaaacuaaaaauuuauu

SEQ ID NO: 18585 - RNA, 21 nt, Artificial Sequence
  Description of Artificial Sequence: Synthetic oligonucleotide
uguuaaacuaaaaauuuaauu

SEQ ID NO: 18586 - RNA, 21 nt, Artificial Sequence
  Description of Artificial Sequence: Synthetic oligonucleotide
guuaaacuaaaaauuuacauu

SEQ ID NO: 18587 - RNA, 21 nt, Artificial Sequence
  Description of Artificial Sequence: Synthetic oligonucleotide
uuaaacuaaaaauuuacaauu

SEQ ID NO: 18588 - RNA, 21 nt, Artificial Sequence
  Description of Artificial Sequence: Synthetic oligonucleotide
uaaacuaaaaauuuacaaauu

SEQ ID NO: 18589 - RNA, 21 nt, Artificial Sequence
  Description of Artificial Sequence: Synthetic oligonucleotide
aaacuaaaaauuuacaagauu

SEQ ID NO: 18590 - RNA, 21 nt, Artificial Sequence
  Description of Artificial Sequence: Synthetic oligonucleotide
aacuaaaaauuuacaagaauu

SEQ ID NO: 18591 - RNA, 21 nt, Artificial Sequence
  Description of Artificial Sequence: Synthetic oligonucleotide
acuaaaaauuuacaagagauu

SEQ ID NO: 18592 - RNA, 21 nt, Artificial Sequence
  Description of Artificial Sequence: Synthetic oligonucleotide
cuaaaaauuuacaagagaauu

SEQ ID NO: 18593 - RNA, 21 nt, Artificial Sequence
  Description of Artificial Sequence: Synthetic oligonucleotide
uaaaaauuuacaagagaaauu

SEQ ID NO: 18594 - RNA, 21 nt, Artificial Sequence
  Description of Artificial Sequence: Synthetic oligonucleotide
aaaaauuuacaagagaagauu

SEQ ID NO: 18595 - RNA, 21 nt, Artificial Sequence
  Description of Artificial Sequence: Synthetic oligonucleotide
aaaauuuacaagagaagaauu

SEQ ID NO: 18596 - RNA, 21 nt, Artificial Sequence
  Description of Artificial Sequence: Synthetic oligonucleotide
aaauuuacaagagaagaaauu

SEQ ID NO: 18597 - RNA, 21 nt, Artificial Sequence
  Description of Artificial Sequence: Synthetic oligonucleotide
aauuuacaagagaagaaaauu

SEQ ID NO: 18598 - RNA, 21 nt, Artificial Sequence
  Description of Artificial Sequence: Synthetic oligonucleotide
auuuacaagagaagaaagauu

SEQ ID NO: 18599 - RNA, 21 nt, Artificial Sequence
  Description of Artificial Sequence: Synthetic oligonucleotide
uuuacaagagaagaaaguauu

SEQ ID NO: 18600 - RNA, 21 nt, Artificial Sequence
  Description of Artificial Sequence: Synthetic oligonucleotide
uuacaagagaagaaagugauu

SEQ ID NO: 18601 - RNA, 21 nt, Artificial Sequence
  Description of Artificial Sequence: Synthetic oligonucleotide
uacaagagaagaaagugaauu

SEQ ID NO: 18602 - RNA, 21 nt, Artificial Sequence
  Description of Artificial Sequence: Synthetic oligonucleotide
acaagagaagaaagugaaauu

SEQ ID NO: 18603 - RNA, 21 nt, Artificial Sequence
  Description of Artificial Sequence: Synthetic oligonucleotide
caagagaagaaagugaaaauu

SEQ ID NO: 18604 - RNA, 21 nt, Artificial Sequence
  Description of Artificial Sequence: Synthetic oligonucleotide
aagagaagaaagugaaagauu

SEQ ID NO: 18605 - RNA, 21 nt, Artificial Sequence
  Description of Artificial Sequence: Synthetic oligonucleotide
agagaagaaagugaaagcauu

SEQ ID NO: 18606 - RNA, 21 nt, Artificial Sequence
  Description of Artificial Sequence: Synthetic oligonucleotide
gagaagaaagugaaagcaauu

SEQ ID NO: 18607 - RNA, 21 nt, Artificial Sequence
  Description of Artificial Sequence: Synthetic oligonucleotide
agaagaaagugaaagcaaauu

SEQ ID NO: 18608 - RNA, 21 nt, Artificial Sequence
  Description of Artificial Sequence: Synthetic oligonucleotide
gaagaaagugaaagcaaaauu

SEQ ID NO: 18609 - RNA, 21 nt, Artificial Sequence
  Description of Artificial Sequence: Synthetic oligonucleotide
aagaaagugaaagcaaauauu

SEQ ID NO: 18610 - RNA, 21 nt, Artificial Sequence
  Description of Artificial Sequence: Synthetic oligonucleotide
agaaagugaaagcaaaugauu

SEQ ID NO: 18611 - RNA, 21 nt, Artificial Sequence
  Description of Artificial Sequence: Synthetic oligonucleotide
gaaagugaaagcaaauggauu

SEQ ID NO: 18612 - RNA, 21 nt, Artificial Sequence
  Description of Artificial Sequence: Synthetic oligonucleotide
aaagugaaagcaaaugggauu

SEQ ID NO: 18613 - RNA, 21 nt, Artificial Sequence
  Description of Artificial Sequence: Synthetic oligonucleotide
aagugaaagcaaauggggauu

SEQ ID NO: 18614 - RNA, 21 nt, Artificial Sequence
  Description of Artificial Sequence: Synthetic oligonucleotide
agugaaagcaaaugggguauu

SEQ ID NO: 18615 - RNA, 21 nt, Artificial Sequence
  Description of Artificial Sequence: Synthetic oligonucleotide
gugaaagcaaaugggguuauu

SEQ ID NO: 18616 - RNA, 21 nt, Artificial Sequence
  Description of Artificial Sequence: Synthetic oligonucleotide
ugaaagcaaaugggguuuauu

SEQ ID NO: 18617 - RNA, 21 nt, Artificial Sequence
  Description of Artificial Sequence: Synthetic oligonucleotide
gaaagcaaaugggguuucauu

SEQ ID NO: 18618 - RNA, 21 nt, Artificial Sequence
  Description of Artificial Sequence: Synthetic oligonucleotide
aaagcaaaugggguuucaauu

SEQ ID NO: 18619 - RNA, 21 nt, Artificial Sequence
  Description of Artificial Sequence: Synthetic oligonucleotide
aagcaaaugggguuucacauu

SEQ ID NO: 18620 - RNA, 21 nt, Artificial Sequence
  Description of Artificial Sequence: Synthetic oligonucleotide
agcaaaugggguuucacaauu

SEQ ID NO: 18621 - RNA, 21 nt, Artificial Sequence
  Description of Artificial Sequence: Synthetic oligonucleotide
gcaaaugggguuucacaaauu

SEQ ID NO: 18622 - RNA, 21 nt, Artificial Sequence
  Description of Artificial Sequence: Synthetic oligonucleotide
caaaugggguuucacaaaauu

SEQ ID NO: 18623 - RNA, 21 nt, Artificial Sequence
  Description of Artificial Sequence: Synthetic oligonucleotide
aaaugggguuucacaaauauu

SEQ ID NO: 18624 - RNA, 21 nt, Artificial Sequence
  Description of Artificial Sequence: Synthetic oligonucleotide
aaugggguuucacaaauaauu

SEQ ID NO: 18625 - RNA, 21 nt, Artificial Sequence
  Description of Artificial Sequence: Synthetic oligonucleotide
augggguuucacaaauagauu

SEQ ID NO: 18626 - RNA, 21 nt, Artificial Sequence
  Description of Artificial Sequence: Synthetic oligonucleotide
ugggguuucacaaauaguauu

SEQ ID NO: 18627 - RNA, 21 nt, Artificial Sequence
  Description of Artificial Sequence: Synthetic oligonucleotide
gggguuucacaaauaguuauu

SEQ ID NO: 18628 - RNA, 21 nt, Artificial Sequence
  Description of Artificial Sequence: Synthetic oligonucleotide
ggguuucacaaauaguugauu

SEQ ID NO: 18629 - RNA, 21 nt, Artificial Sequence
  Description of Artificial Sequence: Synthetic oligonucleotide
gguuucacaaauaguuguauu

SEQ ID NO: 18630 - RNA, 21 nt, Artificial Sequence
  Description of Artificial Sequence: Synthetic oligonucleotide
guuucacaaauaguuguaauu

SEQ ID NO: 18631 - RNA, 21 nt, Artificial Sequence
  Description of Artificial Sequence: Synthetic oligonucleotide
uuucacaaauaguuguaaauu

SEQ ID NO: 18632 - RNA, 21 nt, Artificial Sequence
  Description of Artificial Sequence: Synthetic oligonucleotide
uucacaaauaguuguaaaauu

SEQ ID NO: 18633 - RNA, 21 nt, Artificial Sequence
  Description of Artificial Sequence: Synthetic oligonucleotide
ucacaaauaguuguaaauauu

SEQ ID NO: 18634 - RNA, 21 nt, Artificial Sequence
  Description of Artificial Sequence: Synthetic oligonucleotide
cacaaauaguuguaaauaauu

SEQ ID NO: 18635 - RNA, 21 nt, Artificial Sequence
  Description of Artificial Sequence: Synthetic oligonucleotide
acaaauaguuguaaauauauu

SEQ ID NO: 18636 - RNA, 21 nt, Artificial Sequence
  Description of Artificial Sequence: Synthetic oligonucleotide
caaauaguuguaaauauaauu

SEQ ID NO: 18637 - RNA, 21 nt, Artificial Sequence
  Description of Artificial Sequence: Synthetic oligonucleotide
aaauaguuguaaauauagauu

SEQ ID NO: 18638 - RNA, 21 nt, Artificial Sequence
  Description of Artificial Sequence: Synthetic oligonucleotide
aauaguuguaaauauaguauu

SEQ ID NO: 18639 - RNA, 21 nt, Artificial Sequence
  Description of Artificial Sequence: Synthetic oligonucleotide
auaguuguaaauauagugauu

SEQ ID NO: 18640 - RNA, 21 nt, Artificial Sequence
  Description of Artificial Sequence: Synthetic oligonucleotide
uaguuguaaauauagugaauu

SEQ ID NO: 18641 - RNA, 21 nt, Artificial Sequence
  Description of Artificial Sequence: Synthetic oligonucleotide
aguuguaaauauagugaaauu

SEQ ID NO: 18642 - RNA, 21 nt, Artificial Sequence
  Description of Artificial Sequence: Synthetic oligonucleotide
guuguaaauauagugaagauu

SEQ ID NO: 18643 - RNA, 21 nt, Artificial Sequence
  Description of Artificial Sequence: Synthetic oligonucleotide
uuguaaauauagugaagcauu

SEQ ID NO: 18644 - RNA, 21 nt, Artificial Sequence
  Description of Artificial Sequence: Synthetic oligonucleotide
uguaaauauagugaagcaauu

SEQ ID NO: 18645 - RNA, 21 nt, Artificial Sequence
  Description of Artificial Sequence: Synthetic oligonucleotide
guaaauauagugaagcaaauu

SEQ ID NO: 18646 - RNA, 21 nt, Artificial Sequence
  Description of Artificial Sequence: Synthetic oligonucleotide
uaaauauagugaagcaauauu

SEQ ID NO: 18647 - RNA, 21 nt, Artificial Sequence
  Description of Artificial Sequence: Synthetic oligonucleotide
aaauauagugaagcaauuauu

SEQ ID NO: 18648 - RNA, 21 nt, Artificial Sequence
  Description of Artificial Sequence: Synthetic oligonucleotide
aauauagugaagcaauuuauu

SEQ ID NO: 18649 - RNA, 21 nt, Artificial Sequence
  Description of Artificial Sequence: Synthetic oligonucleotide
auauagugaagcaauuugauu

SEQ ID NO: 18650 - RNA, 21 nt, Artificial Sequence
  Description of Artificial Sequence: Synthetic oligonucleotide
uauagugaagcaauuugaauu

SEQ ID NO: 18651 - RNA, 21 nt, Artificial Sequence
  Description of Artificial Sequence: Synthetic oligonucleotide
auagugaagcaauuugaaauu

SEQ ID NO: 18652 - RNA, 21 nt, Artificial Sequence
  Description of Artificial Sequence: Synthetic oligonucleotide
uagugaagcaauuugaaaauu

SEQ ID NO: 18653 - RNA, 21 nt, Artificial Sequence
  Description of Artificial Sequence: Synthetic oligonucleotide
agugaagcaauuugaaauauu

SEQ ID NO: 18654 - RNA, 21 nt, Artificial Sequence
  Description of Artificial Sequence: Synthetic oligonucleotide
gugaagcaauuugaaauaauu

SEQ ID NO: 18655 - RNA, 21 nt, Artificial Sequence
  Description of Artificial Sequence: Synthetic oligonucleotide
ugaagcaauuugaaauaaauu

SEQ ID NO: 18656 - RNA, 21 nt, Artificial Sequence
  Description of Artificial Sequence: Synthetic oligonucleotide
gaagcaauuugaaauaauauu

SEQ ID NO: 18657 - RNA, 21 nt, Artificial Sequence
  Description of Artificial Sequence: Synthetic oligonucleotide
aagcaauuugaaauaauuauu

SEQ ID NO: 18658 - RNA, 21 nt, Artificial Sequence
  Description of Artificial Sequence: Synthetic oligonucleotide
agcaauuugaaauaauuuauu

SEQ ID NO: 18659 - RNA, 21 nt, Artificial Sequence
  Description of Artificial Sequence: Synthetic oligonucleotide
gcaauuugaaauaauuuuauu

SEQ ID NO: 18660 - RNA, 21 nt, Artificial Sequence
  Description of Artificial Sequence: Synthetic oligonucleotide
caauuugaaauaauuuucauu

SEQ ID NO: 18661 - RNA, 21 nt, Artificial Sequence
  Description of Artificial Sequence: Synthetic oligonucleotide
aauuugaaauaauuuucaauu

SEQ ID NO: 18662 - RNA, 21 nt, Artificial Sequence
  Description of Artificial Sequence: Synthetic oligonucleotide
auuugaaauaauuuucaaauu

SEQ ID NO: 18663 - RNA, 21 nt, Artificial Sequence
  Description of Artificial Sequence: Synthetic oligonucleotide
uuugaaauaauuuucaagauu

SEQ ID NO: 18664 - RNA, 21 nt, Artificial Sequence
  Description of Artificial Sequence: Synthetic oligonucleotide
uugaaauaauuuucaagcauu

SEQ ID NO: 18665 - RNA, 21 nt, Artificial Sequence
  Description of Artificial Sequence: Synthetic oligonucleotide
ugaaauaauuuucaagcaauu

SEQ ID NO: 18666 - RNA, 21 nt, Artificial Sequence
  Description of Artificial Sequence: Synthetic oligonucleotide
gaaauaauuuucaagcaaauu

SEQ ID NO: 18667 - RNA, 21 nt, Artificial Sequence
  Description of Artificial Sequence: Synthetic oligonucleotide
aaauaauuuucaagcaaaauu

SEQ ID NO: 18668 - RNA, 21 nt, Artificial Sequence
  Description of Artificial Sequence: Synthetic oligonucleotide
aauaauuuucaagcaaagauu

SEQ ID NO: 18669 - RNA, 21 nt, Artificial Sequence
  Description of Artificial Sequence: Synthetic oligonucleotide
auaauuuucaagcaaaguauu

SEQ ID NO: 18670 - RNA, 21 nt, Artificial Sequence
  Description of Artificial Sequence: Synthetic oligonucleotide
uaauuuucaagcaaaguaauu

SEQ ID NO: 18671 - RNA, 21 nt, Artificial Sequence
  Description of Artificial Sequence: Synthetic oligonucleotide
aauuuucaagcaaaguauauu

SEQ ID NO: 18672 - RNA, 21 nt, Artificial Sequence
  Description of Artificial Sequence: Synthetic oligonucleotide
auuuucaagcaaaguauuauu

SEQ ID NO: 18673 - RNA, 21 nt, Artificial Sequence
  Description of Artificial Sequence: Synthetic oligonucleotide
uuuucaagcaaaguauugauu

SEQ ID NO: 18674 - RNA, 21 nt, Artificial Sequence
  Description of Artificial Sequence: Synthetic oligonucleotide
uuucaagcaaaguauuguauu

SEQ ID NO: 18675 - RNA, 21 nt, Artificial Sequence
  Description of Artificial Sequence: Synthetic oligonucleotide
uucaagcaaaguauugugauu

SEQ ID NO: 18676 - RNA, 21 nt, Artificial Sequence
  Description of Artificial Sequence: Synthetic oligonucleotide
ucaagcaaaguauugugaauu

SEQ ID NO: 18677 - RNA, 21 nt, Artificial Sequence
  Description of Artificial Sequence: Synthetic oligonucleotide
caagcaaaguauugugaaauu

SEQ ID NO: 18678 - RNA, 21 nt, Artificial Sequence
  Description of Artificial Sequence: Synthetic oligonucleotide
aagcaaaguauugugaaaauu

SEQ ID NO: 18679 - RNA, 21 nt, Artificial Sequence
  Description of Artificial Sequence: Synthetic oligonucleotide
agcaaaguauugugaaagauu

SEQ ID NO: 18680 - RNA, 21 nt, Artificial Sequence
  Description of Artificial Sequence: Synthetic oligonucleotide
gcaaaguauugugaaaguauu

SEQ ID NO: 18681 - RNA, 21 nt, Artificial Sequence
  Description of Artificial Sequence: Synthetic oligonucleotide
caaaguauugugaaaguaauu

SEQ ID NO: 18682 - RNA, 21 nt, Artificial Sequence
  Description of Artificial Sequence: Synthetic oligonucleotide
aaaguauugugaaaguauauu

SEQ ID NO: 18683 - RNA, 21 nt, Artificial Sequence
  Description of Artificial Sequence: Synthetic oligonucleotide
aaguauugugaaaguauuauu

SEQ ID NO: 18684 - RNA, 21 nt, Artificial Sequence
  Description of Artificial Sequence: Synthetic oligonucleotide
aguauugugaaaguauucauu

SEQ ID NO: 18685 - RNA, 21 nt, Artificial Sequence
  Description of Artificial Sequence: Synthetic oligonucleotide
guauugugaaaguauucuauu

SEQ ID NO: 18686 - RNA, 21 nt, Artificial Sequence
  Description of Artificial Sequence: Synthetic oligonucleotide
uauugugaaaguauucuaauu

SEQ ID NO: 18687 - RNA, 21 nt, Artificial Sequence
  Description of Artificial Sequence: Synthetic oligonucleotide
auugugaaaguauucuaaauu

SEQ ID NO: 18688 - RNA, 21 nt, Artificial Sequence
  Description of Artificial Sequence: Synthetic oligonucleotide
uugugaaaguauucuaagauu

SEQ ID NO: 18689 - RNA, 21 nt, Artificial Sequence
  Description of Artificial Sequence: Synthetic oligonucleotide
ugugaaaguauucuaagcauu

SEQ ID NO: 18690 - RNA, 21 nt, Artificial Sequence
  Description of Artificial Sequence: Synthetic oligonucleotide
gugaaaguauucuaagccauu

SEQ ID NO: 18691 - RNA, 21 nt, Artificial Sequence
  Description of Artificial Sequence: Synthetic oligonucleotide
ugaaaguauucuaagccaauu

SEQ ID NO: 18692 - RNA, 21 nt, Artificial Sequence
  Description of Artificial Sequence: Synthetic oligonucleotide
gaaaguauucuaagccaaauu

SEQ ID NO: 18693 - RNA, 21 nt, Artificial Sequence
  Description of Artificial Sequence: Synthetic oligonucleotide
aaaguauucuaagccaagauu

SEQ ID NO: 18694 - RNA, 21 nt, Artificial Sequence
  Description of Artificial Sequence: Synthetic oligonucleotide
aaguauucuaagccaaguauu

SEQ ID NO: 18695 - RNA, 21 nt, Artificial Sequence
  Description of Artificial Sequence: Synthetic oligonucleotide
aguauucuaagccaaguuauu

SEQ ID NO: 18696 - RNA, 21 nt, Artificial Sequence
  Description of Artificial Sequence: Synthetic oligonucleotide
guauucuaagccaaguuuauu

SEQ ID NO: 18697 - RNA, 21 nt, Artificial Sequence
  Description of Artificial Sequence: Synthetic oligonucleotide
uauucuaagccaaguuuuauu

SEQ ID NO: 18698 - RNA, 21 nt, Artificial Sequence
  Description of Artificial Sequence: Synthetic oligonucleotide
auucuaagccaaguuuuaauu

SEQ ID NO: 18699 - RNA, 21 nt, Artificial Sequence
  Description of Artificial Sequence: Synthetic oligonucleotide
uucuaagccaaguuuuaaauu

SEQ ID NO: 18700 - RNA, 21 nt, Artificial Sequence
  Description of Artificial Sequence: Synthetic oligonucleotide
ucuaagccaaguuuuaaaauu

SEQ ID NO: 18701 - RNA, 21 nt, Artificial Sequence
  Description of Artificial Sequence: Synthetic oligonucleotide
cuaagccaaguuuuaaauauu

SEQ ID NO: 18702 - RNA, 21 nt, Artificial Sequence
  Description of Artificial Sequence: Synthetic oligonucleotide
uaagccaaguuuuaaauaauu

SEQ ID NO: 18703 - RNA, 21 nt, Artificial Sequence
  Description of Artificial Sequence: Synthetic oligonucleotide
aagccaaguuuuaaauauauu

SEQ ID NO: 18704 - RNA, 21 nt, Artificial Sequence
  Description of Artificial Sequence: Synthetic oligonucleotide
agccaaguuuuaaauauuauu

SEQ ID NO: 18705 - RNA, 21 nt, Artificial Sequence
  Description of Artificial Sequence: Synthetic oligonucleotide
gccaaguuuuaaauauuaauu

SEQ ID NO: 18706 - RNA, 21 nt, Artificial Sequence
  Description of Artificial Sequence: Synthetic oligonucleotide
ccaaguuuuaaauauuauauu

SEQ ID NO: 18707 - RNA, 21 nt, Artificial Sequence
  Description of Artificial Sequence: Synthetic oligonucleotide
caaguuuuaaauauuaucauu

SEQ ID NO: 18708 - RNA, 21 nt, Artificial Sequence
  Description of Artificial Sequence: Synthetic oligonucleotide
aaguuuuaaauauuaucuauu

SEQ ID NO: 18709 - RNA, 21 nt, Artificial Sequence
  Description of Artificial Sequence: Synthetic oligonucleotide
aguuuuaaauauuaucuaauu

SEQ ID NO: 18710 - RNA, 21 nt, Artificial Sequence
  Description of Artificial Sequence: Synthetic oligonucleotide
guuuuaaauauuaucuaaauu

SEQ ID NO: 18711 - RNA, 21 nt, Artificial Sequence
  Description of Artificial Sequence: Synthetic oligonucleotide
uuuuaaauauuaucuaacauu

SEQ ID NO: 18712 - RNA, 21 nt, Artificial Sequence
  Description of Artificial Sequence: Synthetic oligonucleotide
uuuaaauauuaucuaacaauu

SEQ ID NO: 18713 - RNA, 21 nt, Artificial Sequence
  Description of Artificial Sequence: Synthetic oligonucleotide
uuaaauauuaucuaacagauu

SEQ ID NO: 18714 - RNA, 21 nt, Artificial Sequence
  Description of Artificial Sequence: Synthetic oligonucleotide
uaaauauuaucuaacagaauu

SEQ ID NO: 18715 - RNA, 21 nt, Artificial Sequence
  Description of Artificial Sequence: Synthetic oligonucleotide
aaauauuaucuaacagacauu

SEQ ID NO: 18716 - RNA, 21 nt, Artificial Sequence
  Description of Artificial Sequence: Synthetic oligonucleotide
aauauuaucuaacagacaauu

SEQ ID NO: 18717 - RNA, 21 nt, Artificial Sequence
  Description of Artificial Sequence: Synthetic oligonucleotide
auauuaucuaacagacaaauu

SEQ ID NO: 18718 - RNA, 21 nt, Artificial Sequence
  Description of Artificial Sequence: Synthetic oligonucleotide
uauuaucuaacagacaagauu

SEQ ID NO: 18719 - RNA, 21 nt, Artificial Sequence
  Description of Artificial Sequence: Synthetic oligonucleotide
auuaucuaacagacaagaauu

SEQ ID NO: 18720 - RNA, 21 nt, Artificial Sequence
  Description of Artificial Sequence: Synthetic oligonucleotide
uuaucuaacagacaagagauu

SEQ ID NO: 18721 - RNA, 21 nt, Artificial Sequence
  Description of Artificial Sequence: Synthetic oligonucleotide
uaucuaacagacaagaguauu

SEQ ID NO: 18722 - RNA, 21 nt, Artificial Sequence
  Description of Artificial Sequence: Synthetic oligonucleotide
aucuaacagacaagagugauu

SEQ ID NO: 18723 - RNA, 21 nt, Artificial Sequence
  Description of Artificial Sequence: Synthetic oligonucleotide
ucuaacagacaagaguggauu

SEQ ID NO: 18724 - RNA, 21 nt, Artificial Sequence
  Description of Artificial Sequence: Synthetic oligonucleotide
cuaacagacaagagugguauu

SEQ ID NO: 18725 - RNA, 21 nt, Artificial Sequence
  Description of Artificial Sequence: Synthetic oligonucleotide
uaacagacaagagugguaauu

SEQ ID NO: 18726 - RNA, 21 nt, Artificial Sequence
  Description of Artificial Sequence: Synthetic oligonucleotide
aacagacaagagugguauauu

SEQ ID NO: 18727 - RNA, 21 nt, Artificial Sequence
  Description of Artificial Sequence: Synthetic oligonucleotide
acagacaagagugguauaauu

SEQ ID NO: 18728 - RNA, 21 nt, Artificial Sequence
  Description of Artificial Sequence: Synthetic oligonucleotide
cagacaagagugguauauauu

SEQ ID NO: 18729 - RNA, 21 nt, Artificial Sequence
  Description of Artificial Sequence: Synthetic oligonucleotide
agacaagagugguauauaauu

SEQ ID NO: 18730 - RNA, 21 nt, Artificial Sequence
  Description of Artificial Sequence: Synthetic oligonucleotide
gacaagagugguauauacauu

SEQ ID NO: 18731 - RNA, 21 nt, Artificial Sequence
  Description of Artificial Sequence: Synthetic oligonucleotide
acaagagugguauauacaauu

SEQ ID NO: 18732 - RNA, 21 nt, Artificial Sequence
  Description of Artificial Sequence: Synthetic oligonucleotide
caagagugguauauacaaauu

SEQ ID NO: 18733 - RNA, 21 nt, Artificial Sequence
  Description of Artificial Sequence: Synthetic oligonucleotide
aagagugguauauacaagauu

SEQ ID NO: 18734 - RNA, 21 nt, Artificial Sequence
  Description of Artificial Sequence: Synthetic oligonucleotide
agagugguauauacaaguauu

SEQ ID NO: 18735 - RNA, 21 nt, Artificial Sequence
  Description of Artificial Sequence: Synthetic oligonucleotide
gagugguauauacaaguaauu

SEQ ID NO: 18736 - RNA, 21 nt, Artificial Sequence
  Description of Artificial Sequence: Synthetic oligonucleotide
agugguauauacaaguagauu

SEQ ID NO: 18737 - RNA, 21 nt, Artificial Sequence
  Description of Artificial Sequence: Synthetic oligonucleotide
gugguauauacaaguagaauu

SEQ ID NO: 18738 - RNA, 21 nt, Artificial Sequence
  Description of Artificial Sequence: Synthetic oligonucleotide
ugguauauacaaguagauauu

SEQ ID NO: 18739 - RNA, 21 nt, Artificial Sequence
  Description of Artificial Sequence: Synthetic oligonucleotide
gguauauacaaguagaucauu

SEQ ID NO: 18740 - RNA, 21 nt, Artificial Sequence
  Description of Artificial Sequence: Synthetic oligonucleotide
guauauacaaguagauccauu

SEQ ID NO: 18741 - RNA, 21 nt, Artificial Sequence
  Description of Artificial Sequence: Synthetic oligonucleotide
uauauacaaguagauccuauu

SEQ ID NO: 18742 - RNA, 21 nt, Artificial Sequence
  Description of Artificial Sequence: Synthetic oligonucleotide
auauacaaguagauccugauu

SEQ ID NO: 18743 - RNA, 21 nt, Artificial Sequence
  Description of Artificial Sequence: Synthetic oligonucleotide
uauacaaguagauccugaauu

SEQ ID NO: 18744 - RNA, 21 nt, Artificial Sequence
  Description of Artificial Sequence: Synthetic oligonucleotide
auacaaguagauccugagauu

SEQ ID NO: 18745 - RNA, 21 nt, Artificial Sequence
  Description of Artificial Sequence: Synthetic oligonucleotide
uacaaguagauccugagaauu

SEQ ID NO: 18746 - RNA, 21 nt, Artificial Sequence
  Description of Artificial Sequence: Synthetic oligonucleotide
acaaguagauccugagaaauu

SEQ ID NO: 18747 - RNA, 21 nt, Artificial Sequence
  Description of Artificial Sequence: Synthetic oligonucleotide
caaguagauccugagaagauu

SEQ ID NO: 18748 - RNA, 21 nt, Artificial Sequence
  Description of Artificial Sequence: Synthetic oligonucleotide
aaguagauccugagaaguauu

SEQ ID NO: 18749 - RNA, 21 nt, Artificial Sequence
  Description of Artificial Sequence: Synthetic oligonucleotide
aguagauccugagaaguaauu

SEQ ID NO: 18750 - RNA, 21 nt, Artificial Sequence
  Description of Artificial Sequence: Synthetic oligonucleotide
guagauccugagaaguacauu

SEQ ID NO: 18751 - RNA, 21 nt, Artificial Sequence
  Description of Artificial Sequence: Synthetic oligonucleotide
uagauccugagaaguaccauu

SEQ ID NO: 18752 - RNA, 21 nt, Artificial Sequence
  Description of Artificial Sequence: Synthetic oligonucleotide
agauccugagaaguaccuauu

SEQ ID NO: 18753 - RNA, 21 nt, Artificial Sequence
  Description of Artificial Sequence: Synthetic oligonucleotide
gauccugagaaguaccuuauu

SEQ ID NO: 18754 - RNA, 21 nt, Artificial Sequence
  Description of Artificial Sequence: Synthetic oligonucleotide
auccugagaaguaccuuuauu

SEQ ID NO: 18755 - RNA, 21 nt, Artificial Sequence
  Description of Artificial Sequence: Synthetic oligonucleotide
uccugagaaguaccuuugauu

SEQ ID NO: 18756 - RNA, 21 nt, Artificial Sequence
  Description of Artificial Sequence: Synthetic oligonucleotide
ccugagaaguaccuuuguauu

SEQ ID NO: 18757 - RNA, 21 nt, Artificial Sequence
  Description of Artificial Sequence: Synthetic oligonucleotide
cugagaaguaccuuuguuauu

SEQ ID NO: 18758 - RNA, 21 nt, Artificial Sequence
  Description of Artificial Sequence: Synthetic oligonucleotide
ugagaaguaccuuuguuaauu

SEQ ID NO: 18759 - RNA, 21 nt, Artificial Sequence
  Description of Artificial Sequence: Synthetic oligonucleotide
gagaaguaccuuuguuacauu

SEQ ID NO: 18760 - RNA, 21 nt, Artificial Sequence
  Description of Artificial Sequence: Synthetic oligonucleotide
agaaguaccuuuguuacaauu

SEQ ID NO: 18761 - RNA, 21 nt, Artificial Sequence
  Description of Artificial Sequence: Synthetic oligonucleotide
gaaguaccuuuguuacagauu

SEQ ID NO: 18762 - RNA, 21 nt, Artificial Sequence
  Description of Artificial Sequence: Synthetic oligonucleotide
aaguaccuuuguuacagcauu

SEQ ID NO: 18763 - RNA, 21 nt, Artificial Sequence
  Description of Artificial Sequence: Synthetic oligonucleotide
aguaccuuuguuacagcuauu

SEQ ID NO: 18764 - RNA, 21 nt, Artificial Sequence
  Description of Artificial Sequence: Synthetic oligonucleotide
guaccuuuguuacagcuaauu

SEQ ID NO: 18765 - RNA, 21 nt, Artificial Sequence
  Description of Artificial Sequence: Synthetic oligonucleotide
uaccuuuguuacagcuacauu

SEQ ID NO: 18766 - RNA, 21 nt, Artificial Sequence
  Description of Artificial Sequence: Synthetic oligonucleotide
accuuuguuacagcuacuauu

SEQ ID NO: 18767 - RNA, 21 nt, Artificial Sequence
  Description of Artificial Sequence: Synthetic oligonucleotide
ccuuuguuacagcuacuaauu

SEQ ID NO: 18768 - RNA, 21 nt, Artificial Sequence
  Description of Artificial Sequence: Synthetic oligonucleotide
cuuuguuacagcuacuauauu

SEQ ID NO: 18769 - RNA, 21 nt, Artificial Sequence
  Description of Artificial Sequence: Synthetic oligonucleotide
uuuguuacagcuacuauaauu

SEQ ID NO: 18770 - RNA, 21 nt, Artificial Sequence
  Description of Artificial Sequence: Synthetic oligonucleotide
uuguuacagcuacuauaaauu

SEQ ID NO: 18771 - RNA, 21 nt, Artificial Sequence
  Description of Artificial Sequence: Synthetic oligonucleotide
uguuacagcuacuauaaaauu

SEQ ID NO: 18772 - RNA, 21 nt, Artificial Sequence
  Description of Artificial Sequence: Synthetic oligonucleotide
guuacagcuacuauaaauauu

SEQ ID NO: 18773 - RNA, 21 nt, Artificial Sequence
  Description of Artificial Sequence: Synthetic oligonucleotide
uuacagcuacuauaaauaauu

SEQ ID NO: 18774 - RNA, 21 nt, Artificial Sequence
  Description of Artificial Sequence: Synthetic oligonucleotide
uacagcuacuauaaauauauu

SEQ ID NO: 18775 - RNA, 21 nt, Artificial Sequence
  Description of Artificial Sequence: Synthetic oligonucleotide
acagcuacuauaaauauaauu

SEQ ID NO: 18776 - RNA, 21 nt, Artificial Sequence
  Description of Artificial Sequence: Synthetic oligonucleotide
cagcuacuauaaauauacauu

SEQ ID NO: 18777 - RNA, 21 nt, Artificial Sequence
  Description of Artificial Sequence: Synthetic oligonucleotide
agcuacuauaaauauacaauu

SEQ ID NO: 18778 - RNA, 21 nt, Artificial Sequence
  Description of Artificial Sequence: Synthetic oligonucleotide
gcuacuauaaauauacauauu

SEQ ID NO: 18779 - RNA, 21 nt, Artificial Sequence
  Description of Artificial Sequence: Synthetic oligonucleotide
cuacuauaaauauacauaauu

SEQ ID NO: 18780 - RNA, 21 nt, Artificial Sequence
  Description of Artificial Sequence: Synthetic oligonucleotide
uacuauaaauauacauauauu

SEQ ID NO: 18781 - RNA, 21 nt, Artificial Sequence
  Description of Artificial Sequence: Synthetic oligonucleotide
acuauaaauauacauauaauu

SEQ ID NO: 18782 - RNA, 21 nt, Artificial Sequence
  Description of Artificial Sequence: Synthetic oligonucleotide
cuauaaauauacauauaaauu

SEQ ID NO: 18783 - RNA, 21 nt, Artificial Sequence
  Description of Artificial Sequence: Synthetic oligonucleotide
uauaaauauacauauaaaauu

SEQ ID NO: 18784 - RNA, 21 nt, Artificial Sequence
  Description of Artificial Sequence: Synthetic oligonucleotide
auaaauauacauauaaauauu

SEQ ID NO: 18785 - RNA, 21 nt, Artificial Sequence
  Description of Artificial Sequence: Synthetic oligonucleotide
uaaauauacauauaaauuauu

SEQ ID NO: 18786 - RNA, 21 nt, Artificial Sequence
  Description of Artificial Sequence: Synthetic oligonucleotide
aaauauacauauaaauuaauu

SEQ ID NO: 18787 - RNA, 21 nt, Artificial Sequence
  Description of Artificial Sequence: Synthetic oligonucleotide
aauauacauauaaauuauauu

SEQ ID NO: 18788 - RNA, 21 nt, Artificial Sequence
  Description of Artificial Sequence: Synthetic oligonucleotide
auauacauauaaauuauaauu

SEQ ID NO: 18789 - RNA, 21 nt, Artificial Sequence
  Description of Artificial Sequence: Synthetic oligonucleotide
uauacauauaaauuauagauu

SEQ ID NO: 18790 - RNA, 21 nt, Artificial Sequence
  Description of Artificial Sequence: Synthetic oligonucleotide
auacauauaaauuauagaauu

SEQ ID NO: 18791 - RNA, 21 nt, Artificial Sequence
  Description of Artificial Sequence: Synthetic oligonucleotide
uacauauaaauuauagaaauu

SEQ ID NO: 18792 - RNA, 21 nt, Artificial Sequence
  Description of Artificial Sequence: Synthetic oligonucleotide
acauauaaauuauagaauauu

SEQ ID NO: 18793 - RNA, 21 nt, Artificial Sequence
  Description of Artificial Sequence: Synthetic oligonucleotide
cauauaaauuauagaaucauu

SEQ ID NO: 18794 - RNA, 21 nt, Artificial Sequence
  Description of Artificial Sequence: Synthetic oligonucleotide
auauaaauuauagaaucuauu

SEQ ID NO: 18795 - RNA, 21 nt, Artificial Sequence
  Description of Artificial Sequence: Synthetic oligonucleotide
uauaaauuauagaaucuaauu

SEQ ID NO: 18796 - RNA, 21 nt, Artificial Sequence
  Description of Artificial Sequence: Synthetic oligonucleotide
auaaauuauagaaucuacauu

SEQ ID NO: 18797 - RNA, 21 nt, Artificial Sequence
  Description of Artificial Sequence: Synthetic oligonucleotide
uaaauuauagaaucuacuauu

SEQ ID NO: 18798 - RNA, 21 nt, Artificial Sequence
  Description of Artificial Sequence: Synthetic oligonucleotide
aaauuauagaaucuacuuauu

SEQ ID NO: 18799 - RNA, 21 nt, Artificial Sequence
  Description of Artificial Sequence: Synthetic oligonucleotide
aauuauagaaucuacuuuauu

SEQ ID NO: 18800 - RNA, 21 nt, Artificial Sequence
  Description of Artificial Sequence: Synthetic oligonucleotide
auuauagaaucuacuuuaauu

SEQ ID NO: 18801 - RNA, 21 nt, Artificial Sequence
  Description of Artificial Sequence: Synthetic oligonucleotide
uuauagaaucuacuuuaaauu

SEQ ID NO: 18802 - RNA, 21 nt, Artificial Sequence
  Description of Artificial Sequence: Synthetic oligonucleotide
uauagaaucuacuuuaauauu

SEQ ID NO: 18803 - RNA, 21 nt, Artificial Sequence
  Description of Artificial Sequence: Synthetic oligonucleotide
auagaaucuacuuuaauuauu

SEQ ID NO: 18804 - RNA, 21 nt, Artificial Sequence
  Description of Artificial Sequence: Synthetic oligonucleotide
uagaaucuacuuuaauuuauu

SEQ ID NO: 18805 - RNA, 21 nt, Artificial Sequence
  Description of Artificial Sequence: Synthetic oligonucleotide
agaaucuacuuuaauuuaauu

SEQ ID NO: 18806 - RNA, 21 nt, Artificial Sequence
  Description of Artificial Sequence: Synthetic oligonucleotide
gaaucuacuuuaauuuauauu

SEQ ID NO: 18807 - RNA, 21 nt, Artificial Sequence
  Description of Artificial Sequence: Synthetic oligonucleotide
aaucuacuuuaauuuauuauu

SEQ ID NO: 18808 - RNA, 21 nt, Artificial Sequence
  Description of Artificial Sequence: Synthetic oligonucleotide
aucuacuuuaauuuauuuauu

SEQ ID NO: 18809 - RNA, 21 nt, Artificial Sequence
  Description of Artificial Sequence: Synthetic oligonucleotide
ucuacuuuaauuuauuuuauu

SEQ ID NO: 18810 - RNA, 21 nt, Artificial Sequence
  Description of Artificial Sequence: Synthetic oligonucleotide
cuacuuuaauuuauuuugauu

SEQ ID NO: 18811 - RNA, 21 nt, Artificial Sequence
  Description of Artificial Sequence: Synthetic oligonucleotide
uacuuuaauuuauuuuguauu

SEQ ID NO: 18812 - RNA, 21 nt, Artificial Sequence
  Description of Artificial Sequence: Synthetic oligonucleotide
acuuuaauuuauuuugugauu

SEQ ID NO: 18813 - RNA, 21 nt, Artificial Sequence
  Description of Artificial Sequence: Synthetic oligonucleotide
cuuuaauuuauuuugugaauu

SEQ ID NO: 18814 - RNA, 21 nt, Artificial Sequence
  Description of Artificial Sequence: Synthetic oligonucleotide
uuuaauuuauuuugugaaauu

SEQ ID NO: 18815 - RNA, 21 nt, Artificial Sequence
  Description of Artificial Sequence: Synthetic oligonucleotide
uuaauuuauuuugugaacauu

SEQ ID NO: 18816 - RNA, 21 nt, Artificial Sequence
  Description of Artificial Sequence: Synthetic oligonucleotide
uaauuuauuuugugaacaauu

SEQ ID NO: 18817 - RNA, 21 nt, Artificial Sequence
  Description of Artificial Sequence: Synthetic oligonucleotide
aauuuauuuugugaacacauu

SEQ ID NO: 18818 - RNA, 21 nt, Artificial Sequence
  Description of Artificial Sequence: Synthetic oligonucleotide
auuuauuuugugaacacuauu

SEQ ID NO: 18819 - RNA, 21 nt, Artificial Sequence
  Description of Artificial Sequence: Synthetic oligonucleotide
uuuauuuugugaacacuuauu

SEQ ID NO: 18820 - RNA, 21 nt, Artificial Sequence
  Description of Artificial Sequence: Synthetic oligonucleotide
uuauuuugugaacacuuuauu

SEQ ID NO: 18821 - RNA, 21 nt, Artificial Sequence
  Description of Artificial Sequence: Synthetic oligonucleotide
uauuuugugaacacuuuuauu

SEQ ID NO: 18822 - RNA, 21 nt, Artificial Sequence
  Description of Artificial Sequence: Synthetic oligonucleotide
auuuugugaacacuuuugauu

SEQ ID NO: 18823 - RNA, 21 nt, Artificial Sequence
  Description of Artificial Sequence: Synthetic oligonucleotide
uuuugugaacacuuuugaauu

SEQ ID NO: 18824 - RNA, 21 nt, Artificial Sequence
  Description of Artificial Sequence: Synthetic oligonucleotide
uuugugaacacuuuugaaauu

SEQ ID NO: 18825 - RNA, 21 nt, Artificial Sequence
  Description of Artificial Sequence: Synthetic oligonucleotide
uugugaacacuuuugaaaauu

SEQ ID NO: 18826 - RNA, 21 nt, Artificial Sequence
  Description of Artificial Sequence: Synthetic oligonucleotide
ugugaacacuuuugaaaaauu

SEQ ID NO: 18827 - RNA, 21 nt, Artificial Sequence
  Description of Artificial Sequence: Synthetic oligonucleotide
gugaacacuuuugaaaauauu

SEQ ID NO: 18828 - RNA, 21 nt, Artificial Sequence
  Description of Artificial Sequence: Synthetic oligonucleotide
ugaacacuuuugaaaaugauu

SEQ ID NO: 18829 - RNA, 21 nt, Artificial Sequence
  Description of Artificial Sequence: Synthetic oligonucleotide
gaacacuuuugaaaauguauu

SEQ ID NO: 18830 - RNA, 21 nt, Artificial Sequence
  Description of Artificial Sequence: Synthetic oligonucleotide
aacacuuuugaaaauguaauu

SEQ ID NO: 18831 - RNA, 21 nt, Artificial Sequence
  Description of Artificial Sequence: Synthetic oligonucleotide
acacuuuugaaaauguacauu

SEQ ID NO: 18832 - RNA, 21 nt, Artificial Sequence
  Description of Artificial Sequence: Synthetic oligonucleotide
cacuuuugaaaauguacaauu

SEQ ID NO: 18833 - RNA, 21 nt, Artificial Sequence
  Description of Artificial Sequence: Synthetic oligonucleotide
acuuuugaaaauguacauauu

SEQ ID NO: 18834 - RNA, 21 nt, Artificial Sequence
  Description of Artificial Sequence: Synthetic oligonucleotide
cuuuugaaaauguacaugauu

SEQ ID NO: 18835 - RNA, 21 nt, Artificial Sequence
  Description of Artificial Sequence: Synthetic oligonucleotide
uuuugaaaauguacauguauu

SEQ ID NO: 18836 - RNA, 21 nt, Artificial Sequence
  Description of Artificial Sequence: Synthetic oligonucleotide
uuugaaaauguacauguuauu

SEQ ID NO: 18837 - RNA, 21 nt, Artificial Sequence
  Description of Artificial Sequence: Synthetic oligonucleotide
uugaaaauguacauguucauu

SEQ ID NO: 18838 - RNA, 21 nt, Artificial Sequence
  Description of Artificial Sequence: Synthetic oligonucleotide
ugaaaauguacauguuccauu

SEQ ID NO: 18839 - RNA, 21 nt, Artificial Sequence
  Description of Artificial Sequence: Synthetic oligonucleotide
gaaaauguacauguuccuauu

SEQ ID NO: 18840 - RNA, 21 nt, Artificial Sequence
  Description of Artificial Sequence: Synthetic oligonucleotide
aaaauguacauguuccuuauu

SEQ ID NO: 18841 - RNA, 21 nt, Artificial Sequence
  Description of Artificial Sequence: Synthetic oligonucleotide
aaauguacauguuccuuuauu

SEQ ID NO: 18842 - RNA, 21 nt, Artificial Sequence
  Description of Artificial Sequence: Synthetic oligonucleotide
aauguacauguuccuuugauu

SEQ ID NO: 18843 - RNA, 21 nt, Artificial Sequence
  Description of Artificial Sequence: Synthetic oligonucleotide
auguacauguuccuuuguauu

SEQ ID NO: 18844 - RNA, 21 nt, Artificial Sequence
  Description of Artificial Sequence: Synthetic oligonucleotide
uguacauguuccuuuguaauu

SEQ ID NO: 18845 - RNA, 21 nt, Artificial Sequence
  Description of Artificial Sequence: Synthetic oligonucleotide
guacauguuccuuuguaaauu

SEQ ID NO: 18846 - RNA, 21 nt, Artificial Sequence
  Description of Artificial Sequence: Synthetic oligonucleotide
uacauguuccuuuguaauauu

SEQ ID NO: 18847 - RNA, 21 nt, Artificial Sequence
  Description of Artificial Sequence: Synthetic oligonucleotide
acauguuccuuuguaauuauu

SEQ ID NO: 18848 - RNA, 21 nt, Artificial Sequence
  Description of Artificial Sequence: Synthetic oligonucleotide
cauguuccuuuguaauugauu

SEQ ID NO: 18849 - RNA, 21 nt, Artificial Sequence
  Description of Artificial Sequence: Synthetic oligonucleotide
auguuccuuuguaauugaauu

SEQ ID NO: 18850 - RNA, 21 nt, Artificial Sequence
  Description of Artificial Sequence: Synthetic oligonucleotide
uguuccuuuguaauugacauu

SEQ ID NO: 18851 - RNA, 21 nt, Artificial Sequence
  Description of Artificial Sequence: Synthetic oligonucleotide
guuccuuuguaauugacaauu

SEQ ID NO: 18852 - RNA, 21 nt, Artificial Sequence
  Description of Artificial Sequence: Synthetic oligonucleotide
uuccuuuguaauugacacauu

SEQ ID NO: 18853 - RNA, 21 nt, Artificial Sequence
  Description of Artificial Sequence: Synthetic oligonucleotide
uccuuuguaauugacacuauu

SEQ ID NO: 18854 - RNA, 21 nt, Artificial Sequence
  Description of Artificial Sequence: Synthetic oligonucleotide
ccuuuguaauugacacuaauu

SEQ ID NO: 18855 - RNA, 21 nt, Artificial Sequence
  Description of Artificial Sequence: Synthetic oligonucleotide
cuuuguaauugacacuauauu

SEQ ID NO: 18856 - RNA, 21 nt, Artificial Sequence
  Description of Artificial Sequence: Synthetic oligonucleotide
uuuguaauugacacuauaauu

SEQ ID NO: 18857 - RNA, 21 nt, Artificial Sequence
  Description of Artificial Sequence: Synthetic oligonucleotide
uuguaauugacacuauauauu

SEQ ID NO: 18858 - RNA, 21 nt, Artificial Sequence
  Description of Artificial Sequence: Synthetic oligonucleotide
uguaauugacacuauauaauu

SEQ ID NO: 18859 - RNA, 21 nt, Artificial Sequence
  Description of Artificial Sequence: Synthetic oligonucleotide
guaauugacacuauauauauu

SEQ ID NO: 18860 - RNA, 21 nt, Artificial Sequence
  Description of Artificial Sequence: Synthetic oligonucleotide
uaauugacacuauauauuauu

SEQ ID NO: 18861 - RNA, 21 nt, Artificial Sequence
  Description of Artificial Sequence: Synthetic oligonucleotide
aauugacacuauauauuuauu

SEQ ID NO: 18862 - RNA, 21 nt, Artificial Sequence
  Description of Artificial Sequence: Synthetic oligonucleotide
auugacacuauauauuucauu

SEQ ID NO: 18863 - RNA, 21 nt, Artificial Sequence
  Description of Artificial Sequence: Synthetic oligonucleotide
uugacacuauauauuucuauu

SEQ ID NO: 18864 - RNA, 21 nt, Artificial Sequence
  Description of Artificial Sequence: Synthetic oligonucleotide
ugacacuauauauuucuuauu

SEQ ID NO: 18865 - RNA, 21 nt, Artificial Sequence
  Description of Artificial Sequence: Synthetic oligonucleotide
gacacuauauauuucuuaauu

SEQ ID NO: 18866 - RNA, 21 nt, Artificial Sequence
  Description of Artificial Sequence: Synthetic oligonucleotide
acacuauauauuucuuaaauu

SEQ ID NO: 18867 - RNA, 21 nt, Artificial Sequence
  Description of Artificial Sequence: Synthetic oligonucleotide
cacuauauauuucuuaauauu

SEQ ID NO: 18868 - RNA, 21 nt, Artificial Sequence
  Description of Artificial Sequence: Synthetic oligonucleotide
acuauauauuucuuaauaauu

SEQ ID NO: 18869 - RNA, 21 nt, Artificial Sequence
  Description of Artificial Sequence: Synthetic oligonucleotide
cuauauauuucuuaauaaauu

SEQ ID NO: 18870 - RNA, 21 nt, Artificial Sequence
  Description of Artificial Sequence: Synthetic oligonucleotide
uauauauuucuuaauaaaauu

SEQ ID NO: 18871 - RNA, 21 nt, Artificial Sequence
  Description of Artificial Sequence: Synthetic oligonucleotide
auauauuucuuaauaaaaauu

SEQ ID NO: 18872 - RNA, 21 nt, Artificial Sequence
  Description of Artificial Sequence: Synthetic oligonucleotide
uauauuucuuaauaaaauauu

SEQ ID NO: 18873 - RNA, 21 nt, Artificial Sequence
  Description of Artificial Sequence: Synthetic oligonucleotide
auauuucuuaauaaaauaauu

SEQ ID NO: 18874 - RNA, 21 nt, Artificial Sequence
  Description of Artificial Sequence: Synthetic oligonucleotide
uauuucuuaauaaaauaaauu

SEQ ID NO: 18875 - RNA, 21 nt, Artificial Sequence
  Description of Artificial Sequence: Synthetic oligonucleotide
auuucuuaauaaaauaauauu

SEQ ID NO: 18876 - RNA, 21 nt, Artificial Sequence
  Description of Artificial Sequence: Synthetic oligonucleotide
uuucuuaauaaaauaauuauu

SEQ ID NO: 18877 - RNA, 21 nt, Artificial Sequence
  Description of Artificial Sequence: Synthetic oligonucleotide
uucuuaauaaaauaauucauu

SEQ ID NO: 18878 - RNA, 21 nt, Artificial Sequence
  Description of Artificial Sequence: Synthetic oligonucleotide
ucuuaauaaaauaauucuauu

SEQ ID NO: 18879 - RNA, 21 nt, Artificial Sequence
  Description of Artificial Sequence: Synthetic oligonucleotide
cuuaauaaaauaauucucauu

SEQ ID NO: 18880 - RNA, 21 nt, Artificial Sequence
  Description of Artificial Sequence: Synthetic oligonucleotide
uuaauaaaauaauucucaauu

SEQ ID NO: 18881 - RNA, 21 nt, Artificial Sequence
  Description of Artificial Sequence: Synthetic oligonucleotide
uaauaaaauaauucucaaauu

SEQ ID NO: 18882 - RNA, 21 nt, Artificial Sequence
  Description of Artificial Sequence: Synthetic oligonucleotide
aauaaaauaauucucaaaauu

SEQ ID NO: 18883 - RNA, 21 nt, Artificial Sequence
  Description of Artificial Sequence: Synthetic oligonucleotide
auaaaauaauucucaaauauu

SEQ ID NO: 18884 - RNA, 21 nt, Artificial Sequence
  Description of Artificial Sequence: Synthetic oligonucleotide
uaaaauaauucucaaauuauu

SEQ ID NO: 18885 - RNA, 21 nt, Artificial Sequence
  Description of Artificial Sequence: Synthetic oligonucleotide
aaaauaauucucaaauuuauu

SEQ ID NO: 18886 - RNA, 21 nt, Artificial Sequence
  Description of Artificial Sequence: Synthetic oligonucleotide
aaauaauucucaaauuugauu

SEQ ID NO: 18887 - RNA, 21 nt, Artificial Sequence
  Description of Artificial Sequence: Synthetic oligonucleotide
aauaauucucaaauuuguauu

SEQ ID NO: 18888 - RNA, 21 nt, Artificial Sequence
  Description of Artificial Sequence: Synthetic oligonucleotide
auaauucucaaauuuguuauu

SEQ ID NO: 18889 - RNA, 21 nt, Artificial Sequence
  Description of Artificial Sequence: Synthetic oligonucleotide
uaauucucaaauuuguuuauu

SEQ ID NO: 18890 - RNA, 21 nt, Artificial Sequence
  Description of Artificial Sequence: Synthetic oligonucleotide
aauucucaaauuuguuucauu

SEQ ID NO: 18891 - RNA, 21 nt, Artificial Sequence
  Description of Artificial Sequence: Synthetic oligonucleotide
auucucaaauuuguuucuauu

SEQ ID NO: 18892 - RNA, 21 nt, Artificial Sequence
  Description of Artificial Sequence: Synthetic oligonucleotide
uucucaaauuuguuucuuauu

SEQ ID NO: 18893 - RNA, 21 nt, Artificial Sequence
  Description of Artificial Sequence: Synthetic oligonucleotide
ucucaaauuuguuucuuaauu

SEQ ID NO: 18894 - RNA, 21 nt, Artificial Sequence
  Description of Artificial Sequence: Synthetic oligonucleotide
cucaaauuuguuucuuauauu

SEQ ID NO: 18895 - RNA, 21 nt, Artificial Sequence
  Description of Artificial Sequence: Synthetic oligonucleotide
ucaaauuuguuucuuaugauu

SEQ ID NO: 18896 - RNA, 21 nt, Artificial Sequence
  Description of Artificial Sequence: Synthetic oligonucleotide
caaauuuguuucuuaugaauu

SEQ ID NO: 18897 - RNA, 21 nt, Artificial Sequence
  Description of Artificial Sequence: Synthetic oligonucleotide
aaauuuguuucuuaugaaauu

SEQ ID NO: 18898 - RNA, 21 nt, Artificial Sequence
  Description of Artificial Sequence: Synthetic oligonucleotide
aauuuguuucuuaugaauauu

SEQ ID NO: 18899 - RNA, 21 nt, Artificial Sequence
  Description of Artificial Sequence: Synthetic oligonucleotide
auuuguuucuuaugaaucauu

SEQ ID NO: 18900 - RNA, 21 nt, Artificial Sequence
  Description of Artificial Sequence: Synthetic oligonucleotide
uuuguuucuuaugaaucaauu

SEQ ID NO: 18901 - RNA, 21 nt, Artificial Sequence
  Description of Artificial Sequence: Synthetic oligonucleotide
uuguuucuuaugaaucauauu

SEQ ID NO: 18902 - RNA, 21 nt, Artificial Sequence
  Description of Artificial Sequence: Synthetic oligonucleotide
uguuucuuaugaaucaucauu

SEQ ID NO: 18903 - RNA, 21 nt, Artificial Sequence
  Description of Artificial Sequence: Synthetic oligonucleotide
guuucuuaugaaucaucuauu

SEQ ID NO: 18904 - RNA, 21 nt, Artificial Sequence
  Description of Artificial Sequence: Synthetic oligonucleotide
uuucuuaugaaucaucucauu

SEQ ID NO: 18905 - RNA, 21 nt, Artificial Sequence
  Description of Artificial Sequence: Synthetic oligonucleotide
uucuuaugaaucaucucuauu

SEQ ID NO: 18906 - RNA, 21 nt, Artificial Sequence
  Description of Artificial Sequence: Synthetic oligonucleotide
ucuuaugaaucaucucucauu

SEQ ID NO: 18907 - RNA, 21 nt, Artificial Sequence
  Description of Artificial Sequence: Synthetic oligonucleotide
cuuaugaaucaucucucaauu

SEQ ID NO: 18908 - RNA, 21 nt, Artificial Sequence
  Description of Artificial Sequence: Synthetic oligonucleotide
uuaugaaucaucucucaaauu

SEQ ID NO: 18909 - RNA, 21 nt, Artificial Sequence
  Description of Artificial Sequence: Synthetic oligonucleotide
uaugaaucaucucucaaaauu

SEQ ID NO: 18910 - RNA, 21 nt, Artificial Sequence
  Description of Artificial Sequence: Synthetic oligonucleotide
augaaucaucucucaaauauu

SEQ ID NO: 18911 - RNA, 21 nt, Artificial Sequence
  Description of Artificial Sequence: Synthetic oligonucleotide
ugaaucaucucucaaaucauu

SEQ ID NO: 18912 - RNA, 21 nt, Artificial Sequence
  Description of Artificial Sequence: Synthetic oligonucleotide
gaaucaucucucaaaucuauu

SEQ ID NO: 18913 - RNA, 21 nt, Artificial Sequence
  Description of Artificial Sequence: Synthetic oligonucleotide
aaucaucucucaaaucuaauu

SEQ ID NO: 18914 - RNA, 21 nt, Artificial Sequence
  Description of Artificial Sequence: Synthetic oligonucleotide
aucaucucucaaaucuagauu

SEQ ID NO: 18915 - RNA, 21 nt, Artificial Sequence
  Description of Artificial Sequence: Synthetic oligonucleotide
ucaucucucaaaucuaguauu

SEQ ID NO: 18916 - RNA, 21 nt, Artificial Sequence
  Description of Artificial Sequence: Synthetic oligonucleotide
caucucucaaaucuaguuauu

SEQ ID NO: 18917 - RNA, 21 nt, Artificial Sequence
  Description of Artificial Sequence: Synthetic oligonucleotide
aucucucaaaucuaguuaauu

SEQ ID NO: 18918 - RNA, 21 nt, Artificial Sequence
  Description of Artificial Sequence: Synthetic oligonucleotide
ucucucaaaucuaguuagauu

SEQ ID NO: 18919 - RNA, 21 nt, Artificial Sequence
  Description of Artificial Sequence: Synthetic oligonucleotide
cucucaaaucuaguuagaauu

SEQ ID NO: 18920 - RNA, 21 nt, Artificial Sequence
  Description of Artificial Sequence: Synthetic oligonucleotide
ucucaaaucuaguuagacauu

SEQ ID NO: 18921 - RNA, 21 nt, Artificial Sequence
  Description of Artificial Sequence: Synthetic oligonucleotide
cucaaaucuaguuagacaauu

SEQ ID NO: 18922 - RNA, 21 nt, Artificial Sequence
  Description of Artificial Sequence: Synthetic oligonucleotide
ucaaaucuaguuagacaaauu

SEQ ID NO: 18923 - RNA, 21 nt, Artificial Sequence
  Description of Artificial Sequence: Synthetic oligonucleotide
caaaucuaguuagacaauauu

SEQ ID NO: 18924 - RNA, 21 nt, Artificial Sequence
  Description of Artificial Sequence: Synthetic oligonucleotide
aaaucuaguuagacaauuauu

SEQ ID NO: 18925 - RNA, 21 nt, Artificial Sequence
  Description of Artificial Sequence: Synthetic oligonucleotide
aaucuaguuagacaauuuauu

SEQ ID NO: 18926 - RNA, 21 nt, Artificial Sequence
  Description of Artificial Sequence: Synthetic oligonucleotide
aucuaguuagacaauuugauu

SEQ ID NO: 18927 - RNA, 21 nt, Artificial Sequence
  Description of Artificial Sequence: Synthetic oligonucleotide
ucuaguuagacaauuugcauu

SEQ ID NO: 18928 - RNA, 21 nt, Artificial Sequence
  Description of Artificial Sequence: Synthetic oligonucleotide
cuaguuagacaauuugcaauu

SEQ ID NO: 18929 - RNA, 21 nt, Artificial Sequence
  Description of Artificial Sequence: Synthetic oligonucleotide
uaguuagacaauuugcacauu

SEQ ID NO: 18930 - RNA, 21 nt, Artificial Sequence
  Description of Artificial Sequence: Synthetic oligonucleotide
aguuagacaauuugcacaauu

SEQ ID NO: 18931 - RNA, 21 nt, Artificial Sequence
  Description of Artificial Sequence: Synthetic oligonucleotide
guuagacaauuugcacacauu

SEQ ID NO: 18932 - RNA, 21 nt, Artificial Sequence
  Description of Artificial Sequence: Synthetic oligonucleotide
uuagacaauuugcacacaauu

SEQ ID NO: 18933 - RNA, 21 nt, Artificial Sequence
  Description of Artificial Sequence: Synthetic oligonucleotide
uagacaauuugcacacauauu

SEQ ID NO: 18934 - RNA, 21 nt, Artificial Sequence
  Description of Artificial Sequence: Synthetic oligonucleotide
agacaauuugcacacauaauu

SEQ ID NO: 18935 - RNA, 21 nt, Artificial Sequence
  Description of Artificial Sequence: Synthetic oligonucleotide
gacaauuugcacacauacauu

SEQ ID NO: 18936 - RNA, 21 nt, Artificial Sequence
  Description of Artificial Sequence: Synthetic oligonucleotide
acaauuugcacacauacuauu

SEQ ID NO: 18937 - RNA, 21 nt, Artificial Sequence
  Description of Artificial Sequence: Synthetic oligonucleotide
caauuugcacacauacuuauu

SEQ ID NO: 18938 - RNA, 21 nt, Artificial Sequence
  Description of Artificial Sequence: Synthetic oligonucleotide
aauuugcacacauacuuuauu

SEQ ID NO: 18939 - RNA, 21 nt, Artificial Sequence
  Description of Artificial Sequence: Synthetic oligonucleotide
auuugcacacauacuuuuauu

SEQ ID NO: 18940 - RNA, 21 nt, Artificial Sequence
  Description of Artificial Sequence: Synthetic oligonucleotide
uuugcacacauacuuuucauu

SEQ ID NO: 18941 - RNA, 21 nt, Artificial Sequence
  Description of Artificial Sequence: Synthetic oligonucleotide
uugcacacauacuuuucuauu

SEQ ID NO: 18942 - RNA, 21 nt, Artificial Sequence
  Description of Artificial Sequence: Synthetic oligonucleotide
ugcacacauacuuuucuaauu

SEQ ID NO: 18943 - RNA, 21 nt, Artificial Sequence
  Description of Artificial Sequence: Synthetic oligonucleotide
gcacacauacuuuucuaaauu

SEQ ID NO: 18944 - RNA, 21 nt, Artificial Sequence
  Description of Artificial Sequence: Synthetic oligonucleotide
cacacauacuuuucuaagauu

SEQ ID NO: 18945 - RNA, 21 nt, Artificial Sequence
  Description of Artificial Sequence: Synthetic oligonucleotide
acacauacuuuucuaaggauu

SEQ ID NO: 18946 - RNA, 21 nt, Artificial Sequence
  Description of Artificial Sequence: Synthetic oligonucleotide
cacauacuuuucuaagggauu

SEQ ID NO: 18947 - RNA, 21 nt, Artificial Sequence
  Description of Artificial Sequence: Synthetic oligonucleotide
acauacuuuucuaagggaauu

SEQ ID NO: 18948 - RNA, 21 nt, Artificial Sequence
  Description of Artificial Sequence: Synthetic oligonucleotide
cauacuuuucuaagggacauu

SEQ ID NO: 18949 - RNA, 21 nt, Artificial Sequence
  Description of Artificial Sequence: Synthetic oligonucleotide
auacuuuucuaagggacaauu

SEQ ID NO: 18950 - RNA, 21 nt, Artificial Sequence
  Description of Artificial Sequence: Synthetic oligonucleotide
uacuuuucuaagggacauauu

SEQ ID NO: 18951 - RNA, 21 nt, Artificial Sequence
  Description of Artificial Sequence: Synthetic oligonucleotide
acuuuucuaagggacauuauu

SEQ ID NO: 18952 - RNA, 21 nt, Artificial Sequence
  Description of Artificial Sequence: Synthetic oligonucleotide
cuuuucuaagggacauuaauu

SEQ ID NO: 18953 - RNA, 21 nt, Artificial Sequence
  Description of Artificial Sequence: Synthetic oligonucleotide
uuuucuaagggacauuauauu

SEQ ID NO: 18954 - RNA, 21 nt, Artificial Sequence
  Description of Artificial Sequence: Synthetic oligonucleotide
uuucuaagggacauuaucauu

SEQ ID NO: 18955 - RNA, 21 nt, Artificial Sequence
  Description of Artificial Sequence: Synthetic oligonucleotide
uucuaagggacauuaucuauu

SEQ ID NO: 18956 - RNA, 21 nt, Artificial Sequence
  Description of Artificial Sequence: Synthetic oligonucleotide
ucuaagggacauuaucuuauu

SEQ ID NO: 18957 - RNA, 21 nt, Artificial Sequence
  Description of Artificial Sequence: Synthetic oligonucleotide
cuaagggacauuaucuucauu

SEQ ID NO: 18958 - RNA, 21 nt, Artificial Sequence
  Description of Artificial Sequence: Synthetic oligonucleotide
uaagggacauuaucuuccauu

SEQ ID NO: 18959 - RNA, 21 nt, Artificial Sequence
  Description of Artificial Sequence: Synthetic oligonucleotide
aagggacauuaucuuccuauu

SEQ ID NO: 18960 - RNA, 21 nt, Artificial Sequence
  Description of Artificial Sequence: Synthetic oligonucleotide
agggacauuaucuuccuuauu

SEQ ID NO: 18961 - RNA, 21 nt, Artificial Sequence
  Description of Artificial Sequence: Synthetic oligonucleotide
gggacauuaucuuccuucauu

SEQ ID NO: 18962 - RNA, 21 nt, Artificial Sequence
  Description of Artificial Sequence: Synthetic oligonucleotide
ggacauuaucuuccuucaauu

SEQ ID NO: 18963 - RNA, 21 nt, Artificial Sequence
  Description of Artificial Sequence: Synthetic oligonucleotide
gacauuaucuuccuucagauu

SEQ ID NO: 18964 - RNA, 21 nt, Artificial Sequence
  Description of Artificial Sequence: Synthetic oligonucleotide
acauuaucuuccuucaggauu

SEQ ID NO: 18965 - RNA, 21 nt, Artificial Sequence
  Description of Artificial Sequence: Synthetic oligonucleotide
cauuaucuuccuucagguauu

SEQ ID NO: 18966 - RNA, 21 nt, Artificial Sequence
  Description of Artificial Sequence: Synthetic oligonucleotide
auuaucuuccuucagguuauu

SEQ ID NO: 18967 - RNA, 21 nt, Artificial Sequence
  Description of Artificial Sequence: Synthetic oligonucleotide
uuaucuuccuucagguuuauu

SEQ ID NO: 18968 - RNA, 21 nt, Artificial Sequence
  Description of Artificial Sequence: Synthetic oligonucleotide
uaucuuccuucagguuuuauu

SEQ ID NO: 18969 - RNA, 21 nt, Artificial Sequence
  Description of Artificial Sequence: Synthetic oligonucleotide
aucuuccuucagguuuuuauu

SEQ ID NO: 18970 - RNA, 21 nt, Artificial Sequence
  Description of Artificial Sequence: Synthetic oligonucleotide
ucuuccuucagguuuuuaauu

SEQ ID NO: 18971 - RNA, 21 nt, Artificial Sequence
  Description of Artificial Sequence: Synthetic oligonucleotide
cuuccuucagguuuuuacauu

SEQ ID NO: 18972 - RNA, 21 nt, Artificial Sequence
  Description of Artificial Sequence: Synthetic oligonucleotide
uuccuucagguuuuuaccauu

SEQ ID NO: 18973 - RNA, 21 nt, Artificial Sequence
  Description of Artificial Sequence: Synthetic oligonucleotide
uccuucagguuuuuaccuauu

SEQ ID NO: 18974 - RNA, 21 nt, Artificial Sequence
  Description of Artificial Sequence: Synthetic oligonucleotide
ccuucagguuuuuaccucauu

SEQ ID NO: 18975 - RNA, 21 nt, Artificial Sequence
  Description of Artificial Sequence: Synthetic oligonucleotide
cuucagguuuuuaccuccauu

SEQ ID NO: 18976 - RNA, 21 nt, Artificial Sequence
  Description of Artificial Sequence: Synthetic oligonucleotide
uucagguuuuuaccuccaauu

SEQ ID NO: 18977 - RNA, 21 nt, Artificial Sequence
  Description of Artificial Sequence: Synthetic oligonucleotide
ucagguuuuuaccuccacauu

SEQ ID NO: 18978 - RNA, 21 nt, Artificial Sequence
  Description of Artificial Sequence: Synthetic oligonucleotide
cagguuuuuaccuccacuauu

SEQ ID NO: 18979 - RNA, 21 nt, Artificial Sequence
  Description of Artificial Sequence: Synthetic oligonucleotide
agguuuuuaccuccacucauu

SEQ ID NO: 18980 - RNA, 21 nt, Artificial Sequence
  Description of Artificial Sequence: Synthetic oligonucleotide
gguuuuuaccuccacucaauu

SEQ ID NO: 18981 - RNA, 21 nt, Artificial Sequence
  Description of Artificial Sequence: Synthetic oligonucleotide
guuuuuaccuccacucauauu

SEQ ID NO: 18982 - RNA, 21 nt, Artificial Sequence
  Description of Artificial Sequence: Synthetic oligonucleotide
uuuuuaccuccacucaucauu

SEQ ID NO: 18983 - RNA, 21 nt, Artificial Sequence
  Description of Artificial Sequence: Synthetic oligonucleotide
uuuuaccuccacucauccauu

SEQ ID NO: 18984 - RNA, 21 nt, Artificial Sequence
  Description of Artificial Sequence: Synthetic oligonucleotide
uuuaccuccacucauccuauu

SEQ ID NO: 18985 - RNA, 21 nt, Artificial Sequence
  Description of Artificial Sequence: Synthetic oligonucleotide
uuaccuccacucauccuuauu

SEQ ID NO: 18986 - RNA, 21 nt, Artificial Sequence
  Description of Artificial Sequence: Synthetic oligonucleotide
uaccuccacucauccuuaauu

SEQ ID NO: 18987 - RNA, 21 nt, Artificial Sequence
  Description of Artificial Sequence: Synthetic oligonucleotide
accuccacucauccuuagauu

SEQ ID NO: 18988 - RNA, 21 nt, Artificial Sequence
  Description of Artificial Sequence: Synthetic oligonucleotide
ccuccacucauccuuagaauu

SEQ ID NO: 18989 - RNA, 21 nt, Artificial Sequence
  Description of Artificial Sequence: Synthetic oligonucleotide
cuccacucauccuuagagauu

SEQ ID NO: 18990 - RNA, 21 nt, Artificial Sequence
  Description of Artificial Sequence: Synthetic oligonucleotide
uccacucauccuuagagcauu

SEQ ID NO: 18991 - RNA, 21 nt, Artificial Sequence
  Description of Artificial Sequence: Synthetic oligonucleotide
ccacucauccuuagagccauu

SEQ ID NO: 18992 - RNA, 21 nt, Artificial Sequence
  Description of Artificial Sequence: Synthetic oligonucleotide
cacucauccuuagagcccauu

SEQ ID NO: 18993 - RNA, 21 nt, Artificial Sequence
  Description of Artificial Sequence: Synthetic oligonucleotide
acucauccuuagagcccaauu

SEQ ID NO: 18994 - RNA, 21 nt, Artificial Sequence
  Description of Artificial Sequence: Synthetic oligonucleotide
cucauccuuagagcccacauu

SEQ ID NO: 18995 - RNA, 21 nt, Artificial Sequence
  Description of Artificial Sequence: Synthetic oligonucleotide
ucauccuuagagcccacuauu

SEQ ID NO: 18996 - RNA, 21 nt, Artificial Sequence
  Description of Artificial Sequence: Synthetic oligonucleotide
cauccuuagagcccacugauu

SEQ ID NO: 18997 - RNA, 21 nt, Artificial Sequence
  Description of Artificial Sequence: Synthetic oligonucleotide
auccuuagagcccacugaauu

SEQ ID NO: 18998 - RNA, 21 nt, Artificial Sequence
  Description of Artificial Sequence: Synthetic oligonucleotide
uccuuagagcccacugacauu

SEQ ID NO: 18999 - RNA, 21 nt, Artificial Sequence
  Description of Artificial Sequence: Synthetic oligonucleotide
ccuuagagcccacugacuauu

SEQ ID NO: 19000 - RNA, 21 nt, Artificial Sequence
  Description of Artificial Sequence: Synthetic oligonucleotide
cuuagagcccacugacugauu

SEQ ID NO: 19001 - RNA, 21 nt, Artificial Sequence
  Description of Artificial Sequence: Synthetic oligonucleotide
uuagagcccacugacugcauu

SEQ ID NO: 19002 - RNA, 21 nt, Artificial Sequence
  Description of Artificial Sequence: Synthetic oligonucleotide
uagagcccacugacugcuauu

SEQ ID NO: 19003 - RNA, 21 nt, Artificial Sequence
  Description of Artificial Sequence: Synthetic oligonucleotide
agagcccacugacugcucauu

SEQ ID NO: 19004 - RNA, 21 nt, Artificial Sequence
  Description of Artificial Sequence: Synthetic oligonucleotide
gagcccacugacugcuccauu

SEQ ID NO: 19005 - RNA, 21 nt, Artificial Sequence
  Description of Artificial Sequence: Synthetic oligonucleotide
agcccacugacugcucccauu

SEQ ID NO: 19006 - RNA, 21 nt, Artificial Sequence
  Description of Artificial Sequence: Synthetic oligonucleotide
gcccacugacugcuccccauu

SEQ ID NO: 19007 - RNA, 21 nt, Artificial Sequence
  Description of Artificial Sequence: Synthetic oligonucleotide
cccacugacugcuccccuauu

SEQ ID NO: 19008 - RNA, 21 nt, Artificial Sequence
  Description of Artificial Sequence: Synthetic oligonucleotide
ccacugacugcuccccuuauu

SEQ ID NO: 19009 - RNA, 21 nt, Artificial Sequence
  Description of Artificial Sequence: Synthetic oligonucleotide
cacugacugcuccccuuuauu

SEQ ID NO: 19010 - RNA, 21 nt, Artificial Sequence
  Description of Artificial Sequence: Synthetic oligonucleotide
acugacugcuccccuuuaauu

SEQ ID NO: 19011 - RNA, 21 nt, Artificial Sequence
  Description of Artificial Sequence: Synthetic oligonucleotide
cugacugcuccccuuuauauu

SEQ ID NO: 19012 - RNA, 21 nt, Artificial Sequence
  Description of Artificial Sequence: Synthetic oligonucleotide
ugacugcuccccuuuauaauu

SEQ ID NO: 19013 - RNA, 21 nt, Artificial Sequence
  Description of Artificial Sequence: Synthetic oligonucleotide
gacugcuccccuuuauacauu

SEQ ID NO: 19014 - RNA, 21 nt, Artificial Sequence
  Description of Artificial Sequence: Synthetic oligonucleotide
acugcuccccuuuauaccauu

SEQ ID NO: 19015 - RNA, 21 nt, Artificial Sequence
  Description of Artificial Sequence: Synthetic oligonucleotide
cugcuccccuuuauaccuauu

SEQ ID NO: 19016 - RNA, 21 nt, Artificial Sequence
  Description of Artificial Sequence: Synthetic oligonucleotide
ugcuccccuuuauaccugauu

SEQ ID NO: 19017 - RNA, 21 nt, Artificial Sequence
  Description of Artificial Sequence: Synthetic oligonucleotide
gcuccccuuuauaccuguauu

SEQ ID NO: 19018 - RNA, 21 nt, Artificial Sequence
  Description of Artificial Sequence: Synthetic oligonucleotide
cuccccuuuauaccuguuauu

SEQ ID NO: 19019 - RNA, 21 nt, Artificial Sequence
  Description of Artificial Sequence: Synthetic oligonucleotide
uccccuuuauaccuguugauu

SEQ ID NO: 19020 - RNA, 21 nt, Artificial Sequence
  Description of Artificial Sequence: Synthetic oligonucleotide
ccccuuuauaccuguuggauu

SEQ ID NO: 19021 - RNA, 21 nt, Artificial Sequence
  Description of Artificial Sequence: Synthetic oligonucleotide
cccuuuauaccuguuggcauu

SEQ ID NO: 19022 - RNA, 21 nt, Artificial Sequence
  Description of Artificial Sequence: Synthetic oligonucleotide
ccuuuauaccuguuggccauu

SEQ ID NO: 19023 - RNA, 21 nt, Artificial Sequence
  Description of Artificial Sequence: Synthetic oligonucleotide
cuuuauaccuguuggcccauu

SEQ ID NO: 19024 - RNA, 21 nt, Artificial Sequence
  Description of Artificial Sequence: Synthetic oligonucleotide
uuuauaccuguuggcccuauu

SEQ ID NO: 19025 - RNA, 21 nt, Artificial Sequence
  Description of Artificial Sequence: Synthetic oligonucleotide
uuauaccuguuggcccugauu

SEQ ID NO: 19026 - RNA, 21 nt, Artificial Sequence
  Description of Artificial Sequence: Synthetic oligonucleotide
uauaccuguuggcccugcauu

SEQ ID NO: 19027 - RNA, 21 nt, Artificial Sequence
  Description of Artificial Sequence: Synthetic oligonucleotide
auaccuguuggcccugccauu

SEQ ID NO: 19028 - RNA, 21 nt, Artificial Sequence
  Description of Artificial Sequence: Synthetic oligonucleotide
uaccuguuggcccugccuauu

SEQ ID NO: 19029 - RNA, 21 nt, Artificial Sequence
  Description of Artificial Sequence: Synthetic oligonucleotide
accuguuggcccugccuaauu

SEQ ID NO: 19030 - RNA, 21 nt, Artificial Sequence
  Description of Artificial Sequence: Synthetic oligonucleotide
ccuguuggcccugccuauauu

SEQ ID NO: 19031 - RNA, 21 nt, Artificial Sequence
  Description of Artificial Sequence: Synthetic oligonucleotide
cuguuggcccugccuauaauu

SEQ ID NO: 19032 - RNA, 21 nt, Artificial Sequence
  Description of Artificial Sequence: Synthetic oligonucleotide
uguuggcccugccuauagauu

SEQ ID NO: 19033 - RNA, 21 nt, Artificial Sequence
  Description of Artificial Sequence: Synthetic oligonucleotide
guuggcccugccuauaggauu

SEQ ID NO: 19034 - RNA, 21 nt, Artificial Sequence
  Description of Artificial Sequence: Synthetic oligonucleotide
uuggcccugccuauaggaauu

SEQ ID NO: 19035 - RNA, 21 nt, Artificial Sequence
  Description of Artificial Sequence: Synthetic oligonucleotide
uggcccugccuauaggagauu

SEQ ID NO: 19036 - RNA, 21 nt, Artificial Sequence
  Description of Artificial Sequence: Synthetic oligonucleotide
ggcccugccuauaggagaauu

SEQ ID NO: 19037 - RNA, 21 nt, Artificial Sequence
  Description of Artificial Sequence: Synthetic oligonucleotide
gcccugccuauaggagagauu

SEQ ID NO: 19038 - RNA, 21 nt, Artificial Sequence
  Description of Artificial Sequence: Synthetic oligonucleotide
cccugccuauaggagagaauu

SEQ ID NO: 19039 - RNA, 21 nt, Artificial Sequence
  Description of Artificial Sequence: Synthetic oligonucleotide
ccugccuauaggagagaaauu

SEQ ID NO: 19040 - RNA, 21 nt, Artificial Sequence
  Description of Artificial Sequence: Synthetic oligonucleotide
cugccuauaggagagaauauu

SEQ ID NO: 19041 - RNA, 21 nt, Artificial Sequence
  Description of Artificial Sequence: Synthetic oligonucleotide
ugccuauaggagagaauaauu

SEQ ID NO: 19042 - RNA, 21 nt, Artificial Sequence
  Description of Artificial Sequence: Synthetic oligonucleotide
gccuauaggagagaauauauu

SEQ ID NO: 19043 - RNA, 21 nt, Artificial Sequence
  Description of Artificial Sequence: Synthetic oligonucleotide
ccuauaggagagaauauuauu

SEQ ID NO: 19044 - RNA, 21 nt, Artificial Sequence
  Description of Artificial Sequence: Synthetic oligonucleotide
cuauaggagagaauauuuauu

SEQ ID NO: 19045 - RNA, 21 nt, Artificial Sequence
  Description of Artificial Sequence: Synthetic oligonucleotide
uauaggagagaauauuugauu

SEQ ID NO: 19046 - RNA, 21 nt, Artificial Sequence
  Description of Artificial Sequence: Synthetic oligonucleotide
auaggagagaauauuuggauu

SEQ ID NO: 19047 - RNA, 21 nt, Artificial Sequence
  Description of Artificial Sequence: Synthetic oligonucleotide
uaggagagaauauuuggaauu

SEQ ID NO: 19048 - RNA, 21 nt, Artificial Sequence
  Description of Artificial Sequence: Synthetic oligonucleotide
aggagagaauauuuggagauu

SEQ ID NO: 19049 - RNA, 21 nt, Artificial Sequence
  Description of Artificial Sequence: Synthetic oligonucleotide
ggagagaauauuuggagaauu

SEQ ID NO: 19050 - RNA, 21 nt, Artificial Sequence
  Description of Artificial Sequence: Synthetic oligonucleotide
gagagaauauuuggagauauu

SEQ ID NO: 19051 - RNA, 21 nt, Artificial Sequence
  Description of Artificial Sequence: Synthetic oligonucleotide
agagaauauuuggagauaauu

SEQ ID NO: 19052 - RNA, 21 nt, Artificial Sequence
  Description of Artificial Sequence: Synthetic oligonucleotide
gagaauauuuggagauagauu

SEQ ID NO: 19053 - RNA, 21 nt, Artificial Sequence
  Description of Artificial Sequence: Synthetic oligonucleotide
agaauauuuggagauaggauu

SEQ ID NO: 19054 - RNA, 21 nt, Artificial Sequence
  Description of Artificial Sequence: Synthetic oligonucleotide
gaauauuuggagauaggcauu

SEQ ID NO: 19055 - RNA, 21 nt, Artificial Sequence
  Description of Artificial Sequence: Synthetic oligonucleotide
aauauuuggagauaggcaauu

SEQ ID NO: 19056 - RNA, 21 nt, Artificial Sequence
  Description of Artificial Sequence: Synthetic oligonucleotide
auauuuggagauaggcagauu

SEQ ID NO: 19057 - RNA, 21 nt, Artificial Sequence
  Description of Artificial Sequence: Synthetic oligonucleotide
uauuuggagauaggcagcauu

SEQ ID NO: 19058 - RNA, 21 nt, Artificial Sequence
  Description of Artificial Sequence: Synthetic oligonucleotide
auuuggagauaggcagcuauu

SEQ ID NO: 19059 - RNA, 21 nt, Artificial Sequence
  Description of Artificial Sequence: Synthetic oligonucleotide
uuuggagauaggcagcuuauu

SEQ ID NO: 19060 - RNA, 21 nt, Artificial Sequence
  Description of Artificial Sequence: Synthetic oligonucleotide
uuggagauaggcagcuucauu

SEQ ID NO: 19061 - RNA, 21 nt, Artificial Sequence
  Description of Artificial Sequence: Synthetic oligonucleotide
uggagauaggcagcuucaauu

SEQ ID NO: 19062 - RNA, 21 nt, Artificial Sequence
  Description of Artificial Sequence: Synthetic oligonucleotide
ggagauaggcagcuucagauu

SEQ ID NO: 19063 - RNA, 21 nt, Artificial Sequence
  Description of Artificial Sequence: Synthetic oligonucleotide
gagauaggcagcuucaggauu

SEQ ID NO: 19064 - RNA, 21 nt, Artificial Sequence
  Description of Artificial Sequence: Synthetic oligonucleotide
agauaggcagcuucaggaauu

SEQ ID NO: 19065 - RNA, 21 nt, Artificial Sequence
  Description of Artificial Sequence: Synthetic oligonucleotide
gauaggcagcuucaggauauu

SEQ ID NO: 19066 - RNA, 21 nt, Artificial Sequence
  Description of Artificial Sequence: Synthetic oligonucleotide
auaggcagcuucaggaugauu

SEQ ID NO: 19067 - RNA, 21 nt, Artificial Sequence
  Description of Artificial Sequence: Synthetic oligonucleotide
uaggcagcuucaggaugcauu

SEQ ID NO: 19068 - RNA, 21 nt, Artificial Sequence
  Description of Artificial Sequence: Synthetic oligonucleotide
aggcagcuucaggaugcaauu

SEQ ID NO: 19069 - RNA, 21 nt, Artificial Sequence
  Description of Artificial Sequence: Synthetic oligonucleotide
ggcagcuucaggaugcauauu

SEQ ID NO: 19070 - RNA, 21 nt, Artificial Sequence
  Description of Artificial Sequence: Synthetic oligonucleotide
gcagcuucaggaugcauuauu

SEQ ID NO: 19071 - RNA, 21 nt, Artificial Sequence
  Description of Artificial Sequence: Synthetic oligonucleotide
cagcuucaggaugcauugauu

SEQ ID NO: 19072 - RNA, 21 nt, Artificial Sequence
  Description of Artificial Sequence: Synthetic oligonucleotide
agcuucaggaugcauugcauu

SEQ ID NO: 19073 - RNA, 21 nt, Artificial Sequence
  Description of Artificial Sequence: Synthetic oligonucleotide
gcuucaggaugcauugcaauu

SEQ ID NO: 19074 - RNA, 21 nt, Artificial Sequence
  Description of Artificial Sequence: Synthetic oligonucleotide
cuucaggaugcauugcaaauu

SEQ ID NO: 19075 - RNA, 21 nt, Artificial Sequence
  Description of Artificial Sequence: Synthetic oligonucleotide
uucaggaugcauugcaauauu

SEQ ID NO: 19076 - RNA, 21 nt, Artificial Sequence
  Description of Artificial Sequence: Synthetic oligonucleotide
ucaggaugcauugcaaucauu

SEQ ID NO: 19077 - RNA, 21 nt, Artificial Sequence
  Description of Artificial Sequence: Synthetic oligonucleotide
caggaugcauugcaaucaauu

SEQ ID NO: 19078 - RNA, 21 nt, Artificial Sequence
  Description of Artificial Sequence: Synthetic oligonucleotide
aggaugcauugcaaucauauu

SEQ ID NO: 19079 - RNA, 21 nt, Artificial Sequence
  Description of Artificial Sequence: Synthetic oligonucleotide
ggaugcauugcaaucaucauu

SEQ ID NO: 19080 - RNA, 21 nt, Artificial Sequence
  Description of Artificial Sequence: Synthetic oligonucleotide
gaugcauugcaaucauccauu

SEQ ID NO: 19081 - RNA, 21 nt, Artificial Sequence
  Description of Artificial Sequence: Synthetic oligonucleotide
augcauugcaaucauccuauu

SEQ ID NO: 19082 - RNA, 21 nt, Artificial Sequence
  Description of Artificial Sequence: Synthetic oligonucleotide
ugcauugcaaucauccuuauu

SEQ ID NO: 19083 - RNA, 21 nt, Artificial Sequence
  Description of Artificial Sequence: Synthetic oligonucleotide
gcauugcaaucauccuuuauu

SEQ ID NO: 19084 - RNA, 21 nt, Artificial Sequence
  Description of Artificial Sequence: Synthetic oligonucleotide
cauugcaaucauccuuuuauu

SEQ ID NO: 19085 - RNA, 21 nt, Artificial Sequence
  Description of Artificial Sequence: Synthetic oligonucleotide
auugcaaucauccuuuucauu

SEQ ID NO: 19086 - RNA, 21 nt, Artificial Sequence
  Description of Artificial Sequence: Synthetic oligonucleotide
uugcaaucauccuuuucuauu

SEQ ID NO: 19087 - RNA, 21 nt, Artificial Sequence
  Description of Artificial Sequence: Synthetic oligonucleotide
ugcaaucauccuuuucuuauu

SEQ ID NO: 19088 - RNA, 21 nt, Artificial Sequence
  Description of Artificial Sequence: Synthetic oligonucleotide
gcaaucauccuuuucuuaauu

SEQ ID NO: 19089 - RNA, 21 nt, Artificial Sequence
  Description of Artificial Sequence: Synthetic oligonucleotide
caaucauccuuuucuuaaauu

SEQ ID NO: 19090 - RNA, 21 nt, Artificial Sequence
  Description of Artificial Sequence: Synthetic oligonucleotide
aaucauccuuuucuuaaaauu

SEQ ID NO: 19091 - RNA, 21 nt, Artificial Sequence
  Description of Artificial Sequence: Synthetic oligonucleotide
aucauccuuuucuuaaauauu

SEQ ID NO: 19092 - RNA, 21 nt, Artificial Sequence
  Description of Artificial Sequence: Synthetic oligonucleotide
ucauccuuuucuuaaauuauu

SEQ ID NO: 19093 - RNA, 21 nt, Artificial Sequence
  Description of Artificial Sequence: Synthetic oligonucleotide
cauccuuuucuuaaauuaauu

SEQ ID NO: 19094 - RNA, 21 nt, Artificial Sequence
  Description of Artificial Sequence: Synthetic oligonucleotide
auccuuuucuuaaauuauauu

SEQ ID NO: 19095 - RNA, 21 nt, Artificial Sequence
  Description of Artificial Sequence: Synthetic oligonucleotide
uccuuuucuuaaauuaugauu

SEQ ID NO: 19096 - RNA, 21 nt, Artificial Sequence
  Description of Artificial Sequence: Synthetic oligonucleotide
ccuuuucuuaaauuauguauu

SEQ ID NO: 19097 - RNA, 21 nt, Artificial Sequence
  Description of Artificial Sequence: Synthetic oligonucleotide
cuuuucuuaaauuaugucauu

SEQ ID NO: 19098 - RNA, 21 nt, Artificial Sequence
  Description of Artificial Sequence: Synthetic oligonucleotide
uuuucuuaaauuaugucaauu

SEQ ID NO: 19099 - RNA, 21 nt, Artificial Sequence
  Description of Artificial Sequence: Synthetic oligonucleotide
uuucuuaaauuaugucacauu

SEQ ID NO: 19100 - RNA, 21 nt, Artificial Sequence
  Description of Artificial Sequence: Synthetic oligonucleotide
uucuuaaauuaugucacuauu

SEQ ID NO: 19101 - RNA, 21 nt, Artificial Sequence
  Description of Artificial Sequence: Synthetic oligonucleotide
ucuuaaauuaugucacuaauu

SEQ ID NO: 19102 - RNA, 21 nt, Artificial Sequence
  Description of Artificial Sequence: Synthetic oligonucleotide
cuuaaauuaugucacuagauu

SEQ ID NO: 19103 - RNA, 21 nt, Artificial Sequence
  Description of Artificial Sequence: Synthetic oligonucleotide
uuaaauuaugucacuaguauu

SEQ ID NO: 19104 - RNA, 21 nt, Artificial Sequence
  Description of Artificial Sequence: Synthetic oligonucleotide
uaaauuaugucacuagucauu

SEQ ID NO: 19105 - RNA, 21 nt, Artificial Sequence
  Description of Artificial Sequence: Synthetic oligonucleotide
aaauuaugucacuagucuauu

SEQ ID NO: 19106 - RNA, 21 nt, Artificial Sequence
  Description of Artificial Sequence: Synthetic oligonucleotide
aauuaugucacuagucuuauu

SEQ ID NO: 19107 - RNA, 21 nt, Artificial Sequence
  Description of Artificial Sequence: Synthetic oligonucleotide
auuaugucacuagucuuuauu

SEQ ID NO: 19108 - RNA, 21 nt, Artificial Sequence
  Description of Artificial Sequence: Synthetic oligonucleotide
uuaugucacuagucuuuuauu

SEQ ID NO: 19109 - RNA, 21 nt, Artificial Sequence
  Description of Artificial Sequence: Synthetic oligonucleotide
uaugucacuagucuuuuaauu

SEQ ID NO: 19110 - RNA, 21 nt, Artificial Sequence
  Description of Artificial Sequence: Synthetic oligonucleotide
augucacuagucuuuuauauu

SEQ ID NO: 19111 - RNA, 21 nt, Artificial Sequence
  Description of Artificial Sequence: Synthetic oligonucleotide
ugucacuagucuuuuauuauu

SEQ ID NO: 19112 - RNA, 21 nt, Artificial Sequence
  Description of Artificial Sequence: Synthetic oligonucleotide
gucacuagucuuuuauuuauu

SEQ ID NO: 19113 - RNA, 21 nt, Artificial Sequence
  Description of Artificial Sequence: Synthetic oligonucleotide
ucacuagucuuuuauuuuauu

SEQ ID NO: 19114 - RNA, 21 nt, Artificial Sequence
  Description of Artificial Sequence: Synthetic oligonucleotide
cacuagucuuuuauuuuuauu

SEQ ID NO: 19115 - RNA, 21 nt, Artificial Sequence
  Description of Artificial Sequence: Synthetic oligonucleotide
acuagucuuuuauuuuuuauu

SEQ ID NO: 19116 - RNA, 21 nt, Artificial Sequence
  Description of Artificial Sequence: Synthetic oligonucleotide
cuagucuuuuauuuuuucauu

SEQ ID NO: 19117 - RNA, 21 nt, Artificial Sequence
  Description of Artificial Sequence: Synthetic oligonucleotide
uagucuuuuauuuuuuccauu

SEQ ID NO: 19118 - RNA, 21 nt, Artificial Sequence
  Description of Artificial Sequence: Synthetic oligonucleotide
agucuuuuauuuuuucccauu

SEQ ID NO: 19119 - RNA, 21 nt, Artificial Sequence
  Description of Artificial Sequence: Synthetic oligonucleotide
gucuuuuauuuuuuccccauu

SEQ ID NO: 19120 - RNA, 21 nt, Artificial Sequence
  Description of Artificial Sequence: Synthetic oligonucleotide
ucuuuuauuuuuuccccuauu

SEQ ID NO: 19121 - RNA, 21 nt, Artificial Sequence
  Description of Artificial Sequence: Synthetic oligonucleotide
cuuuuauuuuuuccccucauu

SEQ ID NO: 19122 - RNA, 21 nt, Artificial Sequence
  Description of Artificial Sequence: Synthetic oligonucleotide
uuuuauuuuuuccccucuauu

SEQ ID NO: 19123 - RNA, 21 nt, Artificial Sequence
  Description of Artificial Sequence: Synthetic oligonucleotide
uuuauuuuuuccccucuuauu

SEQ ID NO: 19124 - RNA, 21 nt, Artificial Sequence
  Description of Artificial Sequence: Synthetic oligonucleotide
uuauuuuuuccccucuugauu

SEQ ID NO: 19125 - RNA, 21 nt, Artificial Sequence
  Description of Artificial Sequence: Synthetic oligonucleotide
uauuuuuuccccucuugaauu

SEQ ID NO: 19126 - RNA, 21 nt, Artificial Sequence
  Description of Artificial Sequence: Synthetic oligonucleotide
auuuuuuccccucuugaaauu

SEQ ID NO: 19127 - RNA, 21 nt, Artificial Sequence
  Description of Artificial Sequence: Synthetic oligonucleotide
uuuuuuccccucuugaacauu

SEQ ID NO: 19128 - RNA, 21 nt, Artificial Sequence
  Description of Artificial Sequence: Synthetic oligonucleotide
uuuuuccccucuugaacuauu

SEQ ID NO: 19129 - RNA, 21 nt, Artificial Sequence
  Description of Artificial Sequence: Synthetic oligonucleotide
uuuuccccucuugaacuuauu

SEQ ID NO: 19130 - RNA, 21 nt, Artificial Sequence
  Description of Artificial Sequence: Synthetic oligonucleotide
uuuccccucuugaacuuuauu

SEQ ID NO: 19131 - RNA, 21 nt, Artificial Sequence
  Description of Artificial Sequence: Synthetic oligonucleotide
uuccccucuugaacuuucauu

SEQ ID NO: 19132 - RNA, 21 nt, Artificial Sequence
  Description of Artificial Sequence: Synthetic oligonucleotide
uccccucuugaacuuuccauu

SEQ ID NO: 19133 - RNA, 21 nt, Artificial Sequence
  Description of Artificial Sequence: Synthetic oligonucleotide
ccccucuugaacuuuccuauu

SEQ ID NO: 19134 - RNA, 21 nt, Artificial Sequence
  Description of Artificial Sequence: Synthetic oligonucleotide
cccucuugaacuuuccucauu

SEQ ID NO: 19135 - RNA, 21 nt, Artificial Sequence
  Description of Artificial Sequence: Synthetic oligonucleotide
ccucuugaacuuuccucaauu

SEQ ID NO: 19136 - RNA, 21 nt, Artificial Sequence
  Description of Artificial Sequence: Synthetic oligonucleotide
cucuugaacuuuccucacauu

SEQ ID NO: 19137 - RNA, 21 nt, Artificial Sequence
  Description of Artificial Sequence: Synthetic oligonucleotide
ucuugaacuuuccucacaauu

SEQ ID NO: 19138 - RNA, 21 nt, Artificial Sequence
  Description of Artificial Sequence: Synthetic oligonucleotide
cuugaacuuuccucacacauu

SEQ ID NO: 19139 - RNA, 21 nt, Artificial Sequence
  Description of Artificial Sequence: Synthetic oligonucleotide
uugaacuuuccucacaccauu

SEQ ID NO: 19140 - RNA, 21 nt, Artificial Sequence
  Description of Artificial Sequence: Synthetic oligonucleotide
ugaacuuuccucacaccuauu

SEQ ID NO: 19141 - RNA, 21 nt, Artificial Sequence
  Description of Artificial Sequence: Synthetic oligonucleotide
gaacuuuccucacaccugauu

SEQ ID NO: 19142 - RNA, 21 nt, Artificial Sequence
  Description of Artificial Sequence: Synthetic oligonucleotide
aacuuuccucacaccuggauu

SEQ ID NO: 19143 - RNA, 21 nt, Artificial Sequence
  Description of Artificial Sequence: Synthetic oligonucleotide
acuuuccucacaccuggaauu

SEQ ID NO: 19144 - RNA, 21 nt, Artificial Sequence
  Description of Artificial Sequence: Synthetic oligonucleotide
cuuuccucacaccuggaaauu

SEQ ID NO: 19145 - RNA, 21 nt, Artificial Sequence
  Description of Artificial Sequence: Synthetic oligonucleotide
uuuccucacaccuggaagauu

SEQ ID NO: 19146 - RNA, 21 nt, Artificial Sequence
  Description of Artificial Sequence: Synthetic oligonucleotide
uuccucacaccuggaagaauu

SEQ ID NO: 19147 - RNA, 21 nt, Artificial Sequence
  Description of Artificial Sequence: Synthetic oligonucleotide
uccucacaccuggaagaaauu

SEQ ID NO: 19148 - RNA, 21 nt, Artificial Sequence
  Description of Artificial Sequence: Synthetic oligonucleotide
ccucacaccuggaagaaaauu

SEQ ID NO: 19149 - RNA, 21 nt, Artificial Sequence
  Description of Artificial Sequence: Synthetic oligonucleotide
cucacaccuggaagaaacauu

SEQ ID NO: 19150 - RNA, 21 nt, Artificial Sequence
  Description of Artificial Sequence: Synthetic oligonucleotide
ucacaccuggaagaaacaauu

SEQ ID NO: 19151 - RNA, 21 nt, Artificial Sequence
  Description of Artificial Sequence: Synthetic oligonucleotide
cacaccuggaagaaacaaauu

SEQ ID NO: 19152 - RNA, 21 nt, Artificial Sequence
  Description of Artificial Sequence: Synthetic oligonucleotide
acaccuggaagaaacaaaauu

SEQ ID NO: 19153 - RNA, 21 nt, Artificial Sequence
  Description of Artificial Sequence: Synthetic oligonucleotide
caccuggaagaaacaaagauu

SEQ ID NO: 19154 - RNA, 21 nt, Artificial Sequence
  Description of Artificial Sequence: Synthetic oligonucleotide
accuggaagaaacaaaguauu

SEQ ID NO: 19155 - RNA, 21 nt, Artificial Sequence
  Description of Artificial Sequence: Synthetic oligonucleotide
ccuggaagaaacaaaguaauu

SEQ ID NO: 19156 - RNA, 21 nt, Artificial Sequence
  Description of Artificial Sequence: Synthetic oligonucleotide
cuggaagaaacaaaguagauu

SEQ ID NO: 19157 - RNA, 21 nt, Artificial Sequence
  Description of Artificial Sequence: Synthetic oligonucleotide
uggaagaaacaaaguaggauu

SEQ ID NO: 19158 - RNA, 21 nt, Artificial Sequence
  Description of Artificial Sequence: Synthetic oligonucleotide
ggaagaaacaaaguaggaauu

SEQ ID NO: 19159 - RNA, 21 nt, Artificial Sequence
  Description of Artificial Sequence: Synthetic oligonucleotide
gaagaaacaaaguaggaaauu

SEQ ID NO: 19160 - RNA, 21 nt, Artificial Sequence
  Description of Artificial Sequence: Synthetic oligonucleotide
aagaaacaaaguaggaaaauu

SEQ ID NO: 19161 - RNA, 21 nt, Artificial Sequence
  Description of Artificial Sequence: Synthetic oligonucleotide
agaaacaaaguaggaaaaauu

SEQ ID NO: 19162 - RNA, 21 nt, Artificial Sequence
  Description of Artificial Sequence: Synthetic oligonucleotide
gaaacaaaguaggaaaaaauu

SEQ ID NO: 19163 - RNA, 21 nt, Artificial Sequence
  Description of Artificial Sequence: Synthetic oligonucleotide
aaacaaaguaggaaaaagauu

SEQ ID NO: 19164 - RNA, 21 nt, Artificial Sequence
  Description of Artificial Sequence: Synthetic oligonucleotide
aacaaaguaggaaaaaguauu

SEQ ID NO: 19165 - RNA, 21 nt, Artificial Sequence
  Description of Artificial Sequence: Synthetic oligonucleotide
acaaaguaggaaaaagugauu

SEQ ID NO: 19166 - RNA, 21 nt, Artificial Sequence
  Description of Artificial Sequence: Synthetic oligonucleotide
caaaguaggaaaaagugaauu

SEQ ID NO: 19167 - RNA, 21 nt, Artificial Sequence
  Description of Artificial Sequence: Synthetic oligonucleotide
aaaguaggaaaaagugaaauu

SEQ ID NO: 19168 - RNA, 21 nt, Artificial Sequence
  Description of Artificial Sequence: Synthetic oligonucleotide
aaguaggaaaaagugaacauu

SEQ ID NO: 19169 - RNA, 21 nt, Artificial Sequence
  Description of Artificial Sequence: Synthetic oligonucleotide
aguaggaaaaagugaacaauu

SEQ ID NO: 19170 - RNA, 21 nt, Artificial Sequence
  Description of Artificial Sequence: Synthetic oligonucleotide
guaggaaaaagugaacagauu

SEQ ID NO: 19171 - RNA, 21 nt, Artificial Sequence
  Description of Artificial Sequence: Synthetic oligonucleotide
uaggaaaaagugaacaggauu

SEQ ID NO: 19172 - RNA, 21 nt, Artificial Sequence
  Description of Artificial Sequence: Synthetic oligonucleotide
aggaaaaagugaacagggauu

SEQ ID NO: 19173 - RNA, 21 nt, Artificial Sequence
  Description of Artificial Sequence: Synthetic oligonucleotide
ggaaaaagugaacaggggauu

SEQ ID NO: 19174 - RNA, 21 nt, Artificial Sequence
  Description of Artificial Sequence: Synthetic oligonucleotide
gaaaaagugaacaggggaauu

SEQ ID NO: 19175 - RNA, 21 nt, Artificial Sequence
  Description of Artificial Sequence: Synthetic oligonucleotide
aaaaagugaacaggggauauu

SEQ ID NO: 19176 - RNA, 21 nt, Artificial Sequence
  Description of Artificial Sequence: Synthetic oligonucleotide
aaaagugaacaggggaugauu

SEQ ID NO: 19177 - RNA, 21 nt, Artificial Sequence
  Description of Artificial Sequence: Synthetic oligonucleotide
aaagugaacaggggauguauu

SEQ ID NO: 19178 - RNA, 21 nt, Artificial Sequence
  Description of Artificial Sequence: Synthetic oligonucleotide
aagugaacaggggaugucauu

SEQ ID NO: 19179 - RNA, 21 nt, Artificial Sequence
  Description of Artificial Sequence: Synthetic oligonucleotide
agugaacaggggaugucaauu

SEQ ID NO: 19180 - RNA, 21 nt, Artificial Sequence
  Description of Artificial Sequence: Synthetic oligonucleotide
gugaacaggggaugucaaauu

SEQ ID NO: 19181 - RNA, 21 nt, Artificial Sequence
  Description of Artificial Sequence: Synthetic oligonucleotide
ugaacaggggaugucaaaauu

SEQ ID NO: 19182 - RNA, 21 nt, Artificial Sequence
  Description of Artificial Sequence: Synthetic oligonucleotide
gaacaggggaugucaaauauu

SEQ ID NO: 19183 - RNA, 21 nt, Artificial Sequence
  Description of Artificial Sequence: Synthetic oligonucleotide
aacaggggaugucaaaucauu

SEQ ID NO: 19184 - RNA, 21 nt, Artificial Sequence
  Description of Artificial Sequence: Synthetic oligonucleotide
acaggggaugucaaaucgauu

SEQ ID NO: 19185 - RNA, 21 nt, Artificial Sequence
  Description of Artificial Sequence: Synthetic oligonucleotide
caggggaugucaaaucgaauu

SEQ ID NO: 19186 - RNA, 21 nt, Artificial Sequence
  Description of Artificial Sequence: Synthetic oligonucleotide
aggggaugucaaaucgauauu

SEQ ID NO: 19187 - RNA, 21 nt, Artificial Sequence
  Description of Artificial Sequence: Synthetic oligonucleotide
ggggaugucaaaucgauuauu

SEQ ID NO: 19188 - RNA, 21 nt, Artificial Sequence
  Description of Artificial Sequence: Synthetic oligonucleotide
gggaugucaaaucgauucauu

SEQ ID NO: 19189 - RNA, 21 nt, Artificial Sequence
  Description of Artificial Sequence: Synthetic oligonucleotide
ggaugucaaaucgauucuauu

SEQ ID NO: 19190 - RNA, 21 nt, Artificial Sequence
  Description of Artificial Sequence: Synthetic oligonucleotide
gaugucaaaucgauucuuauu

SEQ ID NO: 19191 - RNA, 21 nt, Artificial Sequence
  Description of Artificial Sequence: Synthetic oligonucleotide
augucaaaucgauucuugauu

SEQ ID NO: 19192 - RNA, 21 nt, Artificial Sequence
  Description of Artificial Sequence: Synthetic oligonucleotide
ugucaaaucgauucuugaauu

SEQ ID NO: 19193 - RNA, 21 nt, Artificial Sequence
  Description of Artificial Sequence: Synthetic oligonucleotide
gucaaaucgauucuugaaauu

SEQ ID NO: 19194 - RNA, 21 nt, Artificial Sequence
  Description of Artificial Sequence: Synthetic oligonucleotide
ucaaaucgauucuugaauauu

SEQ ID NO: 19195 - RNA, 21 nt, Artificial Sequence
  Description of Artificial Sequence: Synthetic oligonucleotide
caaaucgauucuugaauuauu

SEQ ID NO: 19196 - RNA, 21 nt, Artificial Sequence
  Description of Artificial Sequence: Synthetic oligonucleotide
aaaucgauucuugaauucauu

SEQ ID NO: 19197 - RNA, 21 nt, Artificial Sequence
  Description of Artificial Sequence: Synthetic oligonucleotide
aaucgauucuugaauuccauu

SEQ ID NO: 19198 - RNA, 21 nt, Artificial Sequence
  Description of Artificial Sequence: Synthetic oligonucleotide
aucgauucuugaauucccauu

SEQ ID NO: 19199 - RNA, 21 nt, Artificial Sequence
  Description of Artificial Sequence: Synthetic oligonucleotide
ucgauucuugaauucccgauu

SEQ ID NO: 19200 - RNA, 21 nt, Artificial Sequence
  Description of Artificial Sequence: Synthetic oligonucleotide
cgauucuugaauucccgcauu

SEQ ID NO: 19201 - RNA, 21 nt, Artificial Sequence
  Description of Artificial Sequence: Synthetic oligonucleotide
gauucuugaauucccgcuauu

SEQ ID NO: 19202 - RNA, 21 nt, Artificial Sequence
  Description of Artificial Sequence: Synthetic oligonucleotide
auucuugaauucccgcugauu

SEQ ID NO: 19203 - RNA, 21 nt, Artificial Sequence
  Description of Artificial Sequence: Synthetic oligonucleotide
uucuugaauucccgcugcauu

SEQ ID NO: 19204 - RNA, 21 nt, Artificial Sequence
  Description of Artificial Sequence: Synthetic oligonucleotide
ucuugaauucccgcugcaauu

SEQ ID NO: 19205 - RNA, 21 nt, Artificial Sequence
  Description of Artificial Sequence: Synthetic oligonucleotide
cuugaauucccgcugcaaauu

SEQ ID NO: 19206 - RNA, 21 nt, Artificial Sequence
  Description of Artificial Sequence: Synthetic oligonucleotide
uugaauucccgcugcaagauu

SEQ ID NO: 19207 - RNA, 21 nt, Artificial Sequence
  Description of Artificial Sequence: Synthetic oligonucleotide
ugaauucccgcugcaagcauu

SEQ ID NO: 19208 - RNA, 21 nt, Artificial Sequence
  Description of Artificial Sequence: Synthetic oligonucleotide
gaauucccgcugcaagcuauu

SEQ ID NO: 19209 - RNA, 21 nt, Artificial Sequence
  Description of Artificial Sequence: Synthetic oligonucleotide
aauucccgcugcaagcuaauu

SEQ ID NO: 19210 - RNA, 21 nt, Artificial Sequence
  Description of Artificial Sequence: Synthetic oligonucleotide
auucccgcugcaagcuagauu

SEQ ID NO: 19211 - RNA, 21 nt, Artificial Sequence
  Description of Artificial Sequence: Synthetic oligonucleotide
uucccgcugcaagcuagaauu

SEQ ID NO: 19212 - RNA, 21 nt, Artificial Sequence
  Description of Artificial Sequence: Synthetic oligonucleotide
ucccgcugcaagcuagagauu

SEQ ID NO: 19213 - RNA, 21 nt, Artificial Sequence
  Description of Artificial Sequence: Synthetic oligonucleotide
cccgcugcaagcuagagcauu

SEQ ID NO: 19214 - RNA, 21 nt, Artificial Sequence
  Description of Artificial Sequence: Synthetic oligonucleotide
ccgcugcaagcuagagccauu

SEQ ID NO: 19215 - RNA, 21 nt, Artificial Sequence
  Description of Artificial Sequence: Synthetic oligonucleotide
cgcugcaagcuagagccgauu

SEQ ID NO: 19216 - RNA, 21 nt, Artificial Sequence
  Description of Artificial Sequence: Synthetic oligonucleotide
gcugcaagcuagagccgcauu

SEQ ID NO: 19217 - RNA, 21 nt, Artificial Sequence
  Description of Artificial Sequence: Synthetic oligonucleotide
cugcaagcuagagccgcaauu

SEQ ID NO: 19218 - RNA, 21 nt, Artificial Sequence
  Description of Artificial Sequence: Synthetic oligonucleotide
ugcaagcuagagccgcagauu

SEQ ID NO: 19219 - RNA, 21 nt, Artificial Sequence
  Description of Artificial Sequence: Synthetic oligonucleotide
gcaagcuagagccgcaggauu

SEQ ID NO: 19220 - RNA, 21 nt, Artificial Sequence
  Description of Artificial Sequence: Synthetic oligonucleotide
caagcuagagccgcaggcauu

SEQ ID NO: 19221 - RNA, 21 nt, Artificial Sequence
  Description of Artificial Sequence: Synthetic oligonucleotide
aagcuagagccgcaggcaauu

SEQ ID NO: 19222 - RNA, 21 nt, Artificial Sequence
  Description of Artificial Sequence: Synthetic oligonucleotide
agcuagagccgcaggcacauu

SEQ ID NO: 19223 - RNA, 21 nt, Artificial Sequence
  Description of Artificial Sequence: Synthetic oligonucleotide
gcuagagccgcaggcaccauu

SEQ ID NO: 19224 - RNA, 21 nt, Artificial Sequence
  Description of Artificial Sequence: Synthetic oligonucleotide
cuagagccgcaggcacccauu

SEQ ID NO: 19225 - RNA, 21 nt, Artificial Sequence
  Description of Artificial Sequence: Synthetic oligonucleotide
uagagccgcaggcacccuauu

SEQ ID NO: 19226 - RNA, 21 nt, Artificial Sequence
  Description of Artificial Sequence: Synthetic oligonucleotide
agagccgcaggcacccucauu

SEQ ID NO: 19227 - RNA, 21 nt, Artificial Sequence
  Description of Artificial Sequence: Synthetic oligonucleotide
gagccgcaggcacccucuauu

SEQ ID NO: 19228 - RNA, 21 nt, Artificial Sequence
  Description of Artificial Sequence: Synthetic oligonucleotide
agccgcaggcacccucucauu

SEQ ID NO: 19229 - RNA, 21 nt, Artificial Sequence
  Description of Artificial Sequence: Synthetic oligonucleotide
gccgcaggcacccucucaauu

SEQ ID NO: 19230 - RNA, 21 nt, Artificial Sequence
  Description of Artificial Sequence: Synthetic oligonucleotide
ccgcaggcacccucucacauu

SEQ ID NO: 19231 - RNA, 21 nt, Artificial Sequence
  Description of Artificial Sequence: Synthetic oligonucleotide
cgcaggcacccucucacuauu

SEQ ID NO: 19232 - RNA, 21 nt, Artificial Sequence
  Description of Artificial Sequence: Synthetic oligonucleotide
gcaggcacccucucacucauu

SEQ ID NO: 19233 - RNA, 21 nt, Artificial Sequence
  Description of Artificial Sequence: Synthetic oligonucleotide
caggcacccucucacucaauu

SEQ ID NO: 19234 - RNA, 21 nt, Artificial Sequence
  Description of Artificial Sequence: Synthetic oligonucleotide
aggcacccucucacucaaauu

SEQ ID NO: 19235 - RNA, 21 nt, Artificial Sequence
  Description of Artificial Sequence: Synthetic oligonucleotide
ggcacccucucacucaauauu

SEQ ID NO: 19236 - RNA, 21 nt, Artificial Sequence
  Description of Artificial Sequence: Synthetic oligonucleotide
gcacccucucacucaauuauu

SEQ ID NO: 19237 - RNA, 21 nt, Artificial Sequence
  Description of Artificial Sequence: Synthetic oligonucleotide
cacccucucacucaauuuauu

SEQ ID NO: 19238 - RNA, 21 nt, Artificial Sequence
  Description of Artificial Sequence: Synthetic oligonucleotide
acccucucacucaauuucauu

SEQ ID NO: 19239 - RNA, 21 nt, Artificial Sequence
  Description of Artificial Sequence: Synthetic oligonucleotide
cccucucacucaauuuccauu

SEQ ID NO: 19240 - RNA, 21 nt, Artificial Sequence
  Description of Artificial Sequence: Synthetic oligonucleotide
ccucucacucaauuuccaauu

SEQ ID NO: 19241 - RNA, 21 nt, Artificial Sequence
  Description of Artificial Sequence: Synthetic oligonucleotide
cucucacucaauuuccacauu

SEQ ID NO: 19242 - RNA, 21 nt, Artificial Sequence
  Description of Artificial Sequence: Synthetic oligonucleotide
ucucacucaauuuccacuauu

SEQ ID NO: 19243 - RNA, 21 nt, Artificial Sequence
  Description of Artificial Sequence: Synthetic oligonucleotide
cucacucaauuuccacucauu

SEQ ID NO: 19244 - RNA, 21 nt, Artificial Sequence
  Description of Artificial Sequence: Synthetic oligonucleotide
ucacucaauuuccacucaauu

SEQ ID NO: 19245 - RNA, 21 nt, Artificial Sequence
  Description of Artificial Sequence: Synthetic oligonucleotide
cacucaauuuccacucagauu

SEQ ID NO: 19246 - RNA, 21 nt, Artificial Sequence
  Description of Artificial Sequence: Synthetic oligonucleotide
acucaauuuccacucagaauu

SEQ ID NO: 19247 - RNA, 21 nt, Artificial Sequence
  Description of Artificial Sequence: Synthetic oligonucleotide
cucaauuuccacucagaaauu

SEQ ID NO: 19248 - RNA, 21 nt, Artificial Sequence
  Description of Artificial Sequence: Synthetic oligonucleotide
ucaauuuccacucagaacauu

SEQ ID NO: 19249 - RNA, 21 nt, Artificial Sequence
  Description of Artificial Sequence: Synthetic oligonucleotide
caauuuccacucagaaccauu

SEQ ID NO: 19250 - RNA, 21 nt, Artificial Sequence
  Description of Artificial Sequence: Synthetic oligonucleotide
aauuuccacucagaacccauu

SEQ ID NO: 19251 - RNA, 21 nt, Artificial Sequence
  Description of Artificial Sequence: Synthetic oligonucleotide
auuuccacucagaacccuauu

SEQ ID NO: 19252 - RNA, 21 nt, Artificial Sequence
  Description of Artificial Sequence: Synthetic oligonucleotide
uuuccacucagaacccuaauu

SEQ ID NO: 19253 - RNA, 21 nt, Artificial Sequence
  Description of Artificial Sequence: Synthetic oligonucleotide
uuccacucagaacccuauauu

SEQ ID NO: 19254 - RNA, 21 nt, Artificial Sequence
  Description of Artificial Sequence: Synthetic oligonucleotide
uccacucagaacccuauaauu

SEQ ID NO: 19255 - RNA, 21 nt, Artificial Sequence
  Description of Artificial Sequence: Synthetic oligonucleotide
ccacucagaacccuauaaauu

SEQ ID NO: 19256 - RNA, 21 nt, Artificial Sequence
  Description of Artificial Sequence: Synthetic oligonucleotide
cacucagaacccuauaaaauu

SEQ ID NO: 19257 - RNA, 21 nt, Artificial Sequence
  Description of Artificial Sequence: Synthetic oligonucleotide
acucagaacccuauaaacauu

SEQ ID NO: 19258 - RNA, 21 nt, Artificial Sequence
  Description of Artificial Sequence: Synthetic oligonucleotide
cucagaacccuauaaacaauu

SEQ ID NO: 19259 - RNA, 21 nt, Artificial Sequence
  Description of Artificial Sequence: Synthetic oligonucleotide
ucagaacccuauaaacacauu

SEQ ID NO: 19260 - RNA, 21 nt, Artificial Sequence
  Description of Artificial Sequence: Synthetic oligonucleotide
cagaacccuauaaacaccauu

SEQ ID NO: 19261 - RNA, 21 nt, Artificial Sequence
  Description of Artificial Sequence: Synthetic oligonucleotide
agaacccuauaaacaccaauu

SEQ ID NO: 19262 - RNA, 21 nt, Artificial Sequence
  Description of Artificial Sequence: Synthetic oligonucleotide
gaacccuauaaacaccagauu

SEQ ID NO: 19263 - RNA, 21 nt, Artificial Sequence
  Description of Artificial Sequence: Synthetic oligonucleotide
aacccuauaaacaccaguauu

SEQ ID NO: 19264 - RNA, 21 nt, Artificial Sequence
  Description of Artificial Sequence: Synthetic oligonucleotide
acccuauaaacaccagugauu

SEQ ID NO: 19265 - RNA, 21 nt, Artificial Sequence
  Description of Artificial Sequence: Synthetic oligonucleotide
cccuauaaacaccaguggauu

SEQ ID NO: 19266 - RNA, 21 nt, Artificial Sequence
  Description of Artificial Sequence: Synthetic oligonucleotide
ccuauaaacaccagugggauu

SEQ ID NO: 19267 - RNA, 21 nt, Artificial Sequence
  Description of Artificial Sequence: Synthetic oligonucleotide
cuauaaacaccagugggaauu

SEQ ID NO: 19268 - RNA, 21 nt, Artificial Sequence
  Description of Artificial Sequence: Synthetic oligonucleotide
uauaaacaccagugggaaauu

SEQ ID NO: 19269 - RNA, 21 nt, Artificial Sequence
  Description of Artificial Sequence: Synthetic oligonucleotide
auaaacaccagugggaagauu

SEQ ID NO: 19270 - RNA, 21 nt, Artificial Sequence
  Description of Artificial Sequence: Synthetic oligonucleotide
uaaacaccagugggaaggauu

SEQ ID NO: 19271 - RNA, 21 nt, Artificial Sequence
  Description of Artificial Sequence: Synthetic oligonucleotide
aaacaccagugggaagggauu

SEQ ID NO: 19272 - RNA, 21 nt, Artificial Sequence
  Description of Artificial Sequence: Synthetic oligonucleotide
aacaccagugggaagggcauu

SEQ ID NO: 19273 - RNA, 21 nt, Artificial Sequence
  Description of Artificial Sequence: Synthetic oligonucleotide
acaccagugggaagggcaauu

SEQ ID NO: 19274 - RNA, 21 nt, Artificial Sequence
  Description of Artificial Sequence: Synthetic oligonucleotide
caccagugggaagggcaaauu

SEQ ID NO: 19275 - RNA, 21 nt, Artificial Sequence
  Description of Artificial Sequence: Synthetic oligonucleotide
accagugggaagggcaacauu

SEQ ID NO: 19276 - RNA, 21 nt, Artificial Sequence
  Description of Artificial Sequence: Synthetic oligonucleotide
ccagugggaagggcaaccauu

SEQ ID NO: 19277 - RNA, 21 nt, Artificial Sequence
  Description of Artificial Sequence: Synthetic oligonucleotide
cagugggaagggcaacccauu

SEQ ID NO: 19278 - RNA, 21 nt, Artificial Sequence
  Description of Artificial Sequence: Synthetic oligonucleotide
agugggaagggcaacccaauu

SEQ ID NO: 19279 - RNA, 21 nt, Artificial Sequence
  Description of Artificial Sequence: Synthetic oligonucleotide
gugggaagggcaacccacauu

SEQ ID NO: 19280 - RNA, 21 nt, Artificial Sequence
  Description of Artificial Sequence: Synthetic oligonucleotide
ugggaagggcaacccacuauu

SEQ ID NO: 19281 - RNA, 21 nt, Artificial Sequence
  Description of Artificial Sequence: Synthetic oligonucleotide
gggaagggcaacccacugauu

SEQ ID NO: 19282 - RNA, 21 nt, Artificial Sequence
  Description of Artificial Sequence: Synthetic oligonucleotide
ggaagggcaacccacugcauu

SEQ ID NO: 19283 - RNA, 21 nt, Artificial Sequence
  Description of Artificial Sequence: Synthetic oligonucleotide
gaagggcaacccacugcaauu

SEQ ID NO: 19284 - RNA, 21 nt, Artificial Sequence
  Description of Artificial Sequence: Synthetic oligonucleotide
aagggcaacccacugcacauu

SEQ ID NO: 19285 - RNA, 21 nt, Artificial Sequence
  Description of Artificial Sequence: Synthetic oligonucleotide
agggcaacccacugcacgauu

SEQ ID NO: 19286 - RNA, 21 nt, Artificial Sequence
  Description of Artificial Sequence: Synthetic oligonucleotide
gggcaacccacugcacguauu

SEQ ID NO: 19287 - RNA, 21 nt, Artificial Sequence
  Description of Artificial Sequence: Synthetic oligonucleotide
ggcaacccacugcacgugauu

SEQ ID NO: 19288 - RNA, 21 nt, Artificial Sequence
  Description of Artificial Sequence: Synthetic oligonucleotide
gcaacccacugcacguggauu

SEQ ID NO: 19289 - RNA, 21 nt, Artificial Sequence
  Description of Artificial Sequence: Synthetic oligonucleotide
caacccacugcacgugggauu

SEQ ID NO: 19290 - RNA, 21 nt, Artificial Sequence
  Description of Artificial Sequence: Synthetic oligonucleotide
aacccacugcacgugggaauu

SEQ ID NO: 19291 - RNA, 21 nt, Artificial Sequence
  Description of Artificial Sequence: Synthetic oligonucleotide
acccacugcacgugggaaauu

SEQ ID NO: 19292 - RNA, 21 nt, Artificial Sequence
  Description of Artificial Sequence: Synthetic oligonucleotide
cccacugcacgugggaauauu

SEQ ID NO: 19293 - RNA, 21 nt, Artificial Sequence
  Description of Artificial Sequence: Synthetic oligonucleotide
ccacugcacgugggaaugauu

SEQ ID NO: 19294 - RNA, 21 nt, Artificial Sequence
  Description of Artificial Sequence: Synthetic oligonucleotide
cacugcacgugggaaugcauu

SEQ ID NO: 19295 - RNA, 21 nt, Artificial Sequence
  Description of Artificial Sequence: Synthetic oligonucleotide
acugcacgugggaaugcaauu

SEQ ID NO: 19296 - RNA, 21 nt, Artificial Sequence
  Description of Artificial Sequence: Synthetic oligonucleotide
cugcacgugggaaugcacauu

SEQ ID NO: 19297 - RNA, 21 nt, Artificial Sequence
  Description of Artificial Sequence: Synthetic oligonucleotide
ugcacgugggaaugcacuauu

SEQ ID NO: 19298 - RNA, 21 nt, Artificial Sequence
  Description of Artificial Sequence: Synthetic oligonucleotide
gcacgugggaaugcacugauu

SEQ ID NO: 19299 - RNA, 21 nt, Artificial Sequence
  Description of Artificial Sequence: Synthetic oligonucleotide
cacgugggaaugcacugaauu

SEQ ID NO: 19300 - RNA, 21 nt, Artificial Sequence
  Description of Artificial Sequence: Synthetic oligonucleotide
acgugggaaugcacugauauu

SEQ ID NO: 19301 - RNA, 21 nt, Artificial Sequence
  Description of Artificial Sequence: Synthetic oligonucleotide
cgugggaaugcacugauuauu

SEQ ID NO: 19302 - RNA, 21 nt, Artificial Sequence
  Description of Artificial Sequence: Synthetic oligonucleotide
gugggaaugcacugauuuauu

SEQ ID NO: 19303 - RNA, 21 nt, Artificial Sequence
  Description of Artificial Sequence: Synthetic oligonucleotide
ugggaaugcacugauuuuauu

SEQ ID NO: 19304 - RNA, 21 nt, Artificial Sequence
  Description of Artificial Sequence: Synthetic oligonucleotide
gggaaugcacugauuuuuauu

SEQ ID NO: 19305 - RNA, 21 nt, Artificial Sequence
  Description of Artificial Sequence: Synthetic oligonucleotide
ggaaugcacugauuuuucauu

SEQ ID NO: 19306 - RNA, 21 nt, Artificial Sequence
  Description of Artificial Sequence: Synthetic oligonucleotide
gaaugcacugauuuuuccauu

SEQ ID NO: 19307 - RNA, 21 nt, Artificial Sequence
  Description of Artificial Sequence: Synthetic oligonucleotide
aaugcacugauuuuuccuauu

SEQ ID NO: 19308 - RNA, 21 nt, Artificial Sequence
  Description of Artificial Sequence: Synthetic oligonucleotide
augcacugauuuuuccuaauu

SEQ ID NO: 19309 - RNA, 21 nt, Artificial Sequence
  Description of Artificial Sequence: Synthetic oligonucleotide
ugcacugauuuuuccuagauu

SEQ ID NO: 19310 - RNA, 21 nt, Artificial Sequence
  Description of Artificial Sequence: Synthetic oligonucleotide
gcacugauuuuuccuaggauu

SEQ ID NO: 19311 - RNA, 21 nt, Artificial Sequence
  Description of Artificial Sequence: Synthetic oligonucleotide
cacugauuuuuccuaggaauu

SEQ ID NO: 19312 - RNA, 21 nt, Artificial Sequence
  Description of Artificial Sequence: Synthetic oligonucleotide
acugauuuuuccuaggagauu

SEQ ID NO: 19313 - RNA, 21 nt, Artificial Sequence
  Description of Artificial Sequence: Synthetic oligonucleotide
cugauuuuuccuaggaguauu

SEQ ID NO: 19314 - RNA, 21 nt, Artificial Sequence
  Description of Artificial Sequence: Synthetic oligonucleotide
ugauuuuuccuaggaguaauu

SEQ ID NO: 19315 - RNA, 21 nt, Artificial Sequence
  Description of Artificial Sequence: Synthetic oligonucleotide
gauuuuuccuaggaguagauu

SEQ ID NO: 19316 - RNA, 21 nt, Artificial Sequence
  Description of Artificial Sequence: Synthetic oligonucleotide
auuuuuccuaggaguagaauu

SEQ ID NO: 19317 - RNA, 21 nt, Artificial Sequence
  Description of Artificial Sequence: Synthetic oligonucleotide
uuuuuccuaggaguagacauu

SEQ ID NO: 19318 - RNA, 21 nt, Artificial Sequence
  Description of Artificial Sequence: Synthetic oligonucleotide
uuuuccuaggaguagacaauu

SEQ ID NO: 19319 - RNA, 21 nt, Artificial Sequence
  Description of Artificial Sequence: Synthetic oligonucleotide
uuuccuaggaguagacauauu

SEQ ID NO: 19320 - RNA, 21 nt, Artificial Sequence
  Description of Artificial Sequence: Synthetic oligonucleotide
uuccuaggaguagacaugauu

SEQ ID NO: 19321 - RNA, 21 nt, Artificial Sequence
  Description of Artificial Sequence: Synthetic oligonucleotide
uccuaggaguagacauguauu

SEQ ID NO: 19322 - RNA, 21 nt, Artificial Sequence
  Description of Artificial Sequence: Synthetic oligonucleotide
ccuaggaguagacauguuauu

SEQ ID NO: 19323 - RNA, 21 nt, Artificial Sequence
  Description of Artificial Sequence: Synthetic oligonucleotide
cuaggaguagacauguucauu

SEQ ID NO: 19324 - RNA, 21 nt, Artificial Sequence
  Description of Artificial Sequence: Synthetic oligonucleotide
uaggaguagacauguuccauu

SEQ ID NO: 19325 - RNA, 21 nt, Artificial Sequence
  Description of Artificial Sequence: Synthetic oligonucleotide
aggaguagacauguuccuauu

SEQ ID NO: 19326 - RNA, 21 nt, Artificial Sequence
  Description of Artificial Sequence: Synthetic oligonucleotide
ggaguagacauguuccucauu

SEQ ID NO: 19327 - RNA, 21 nt, Artificial Sequence
  Description of Artificial Sequence: Synthetic oligonucleotide
gaguagacauguuccucuauu

SEQ ID NO: 19328 - RNA, 21 nt, Artificial Sequence
  Description of Artificial Sequence: Synthetic oligonucleotide
aguagacauguuccucuaauu

SEQ ID NO: 19329 - RNA, 21 nt, Artificial Sequence
  Description of Artificial Sequence: Synthetic oligonucleotide
guagacauguuccucuaaauu

SEQ ID NO: 19330 - RNA, 21 nt, Artificial Sequence
  Description of Artificial Sequence: Synthetic oligonucleotide
uagacauguuccucuaauauu

SEQ ID NO: 19331 - RNA, 21 nt, Artificial Sequence
  Description of Artificial Sequence: Synthetic oligonucleotide
agacauguuccucuaauuauu

SEQ ID NO: 19332 - RNA, 21 nt, Artificial Sequence
  Description of Artificial Sequence: Synthetic oligonucleotide
gacauguuccucuaauuaauu

SEQ ID NO: 19333 - RNA, 21 nt, Artificial Sequence
  Description of Artificial Sequence: Synthetic oligonucleotide
acauguuccucuaauuacauu

SEQ ID NO: 19334 - RNA, 21 nt, Artificial Sequence
  Description of Artificial Sequence: Synthetic oligonucleotide
cauguuccucuaauuacuauu

SEQ ID NO: 19335 - RNA, 21 nt, Artificial Sequence
  Description of Artificial Sequence: Synthetic oligonucleotide
auguuccucuaauuacucauu

SEQ ID NO: 19336 - RNA, 21 nt, Artificial Sequence
  Description of Artificial Sequence: Synthetic oligonucleotide
uguuccucuaauuacuccauu

SEQ ID NO: 19337 - RNA, 21 nt, Artificial Sequence
  Description of Artificial Sequence: Synthetic oligonucleotide
guuccucuaauuacucccauu

SEQ ID NO: 19338 - RNA, 21 nt, Artificial Sequence
  Description of Artificial Sequence: Synthetic oligonucleotide
uuccucuaauuacucccuauu

SEQ ID NO: 19339 - RNA, 21 nt, Artificial Sequence
  Description of Artificial Sequence: Synthetic oligonucleotide
uccucuaauuacucccugauu

SEQ ID NO: 19340 - RNA, 21 nt, Artificial Sequence
  Description of Artificial Sequence: Synthetic oligonucleotide
ccucuaauuacucccugaauu

SEQ ID NO: 19341 - RNA, 21 nt, Artificial Sequence
  Description of Artificial Sequence: Synthetic oligonucleotide
cucuaauuacucccugagauu

SEQ ID NO: 19342 - RNA, 21 nt, Artificial Sequence
  Description of Artificial Sequence: Synthetic oligonucleotide
ucuaauuacucccugaggauu

SEQ ID NO: 19343 - RNA, 21 nt, Artificial Sequence
  Description of Artificial Sequence: Synthetic oligonucleotide
cuaauuacucccugagggauu

SEQ ID NO: 19344 - RNA, 21 nt, Artificial Sequence
  Description of Artificial Sequence: Synthetic oligonucleotide
uaauuacucccugaggguauu

SEQ ID NO: 19345 - RNA, 21 nt, Artificial Sequence
  Description of Artificial Sequence: Synthetic oligonucleotide
aauuacucccugaggguuauu

SEQ ID NO: 19346 - RNA, 21 nt, Artificial Sequence
  Description of Artificial Sequence: Synthetic oligonucleotide
auuacucccugaggguuaauu

SEQ ID NO: 19347 - RNA, 21 nt, Artificial Sequence
  Description of Artificial Sequence: Synthetic oligonucleotide
uuacucccugaggguuagauu

SEQ ID NO: 19348 - RNA, 21 nt, Artificial Sequence
  Description of Artificial Sequence: Synthetic oligonucleotide
uacucccugaggguuaguauu

SEQ ID NO: 19349 - RNA, 21 nt, Artificial Sequence
  Description of Artificial Sequence: Synthetic oligonucleotide
acucccugaggguuaguuauu

SEQ ID NO: 19350 - RNA, 21 nt, Artificial Sequence
  Description of Artificial Sequence: Synthetic oligonucleotide
cucccugaggguuaguugauu

SEQ ID NO: 19351 - RNA, 21 nt, Artificial Sequence
  Description of Artificial Sequence: Synthetic oligonucleotide
ucccugaggguuaguuggauu

SEQ ID NO: 19352 - RNA, 21 nt, Artificial Sequence
  Description of Artificial Sequence: Synthetic oligonucleotide
cccugaggguuaguugggauu

SEQ ID NO: 19353 - RNA, 21 nt, Artificial Sequence
  Description of Artificial Sequence: Synthetic oligonucleotide
ccugaggguuaguuggggauu

SEQ ID NO: 19354 - RNA, 21 nt, Artificial Sequence
  Description of Artificial Sequence: Synthetic oligonucleotide
cugaggguuaguuggggcauu

SEQ ID NO: 19355 - RNA, 21 nt, Artificial Sequence
  Description of Artificial Sequence: Synthetic oligonucleotide
ugaggguuaguuggggcuauu

SEQ ID NO: 19356 - RNA, 21 nt, Artificial Sequence
  Description of Artificial Sequence: Synthetic oligonucleotide
gaggguuaguuggggcuaauu

SEQ ID NO: 19357 - RNA, 21 nt, Artificial Sequence
  Description of Artificial Sequence: Synthetic oligonucleotide
aggguuaguuggggcuaaauu

SEQ ID NO: 19358 - RNA, 21 nt, Artificial Sequence
  Description of Artificial Sequence: Synthetic oligonucleotide
ggguuaguuggggcuaaaauu

SEQ ID NO: 19359 - RNA, 21 nt, Artificial Sequence
  Description of Artificial Sequence: Synthetic oligonucleotide
gguuaguuggggcuaaacauu

SEQ ID NO: 19360 - RNA, 21 nt, Artificial Sequence
  Description of Artificial Sequence: Synthetic oligonucleotide
guuaguuggggcuaaaccauu

SEQ ID NO: 19361 - RNA, 21 nt, Artificial Sequence
  Description of Artificial Sequence: Synthetic oligonucleotide
uuaguuggggcuaaaccaauu

SEQ ID NO: 19362 - RNA, 21 nt, Artificial Sequence
  Description of Artificial Sequence: Synthetic oligonucleotide
uaguuggggcuaaaccauauu

SEQ ID NO: 19363 - RNA, 21 nt, Artificial Sequence
  Description of Artificial Sequence: Synthetic oligonucleotide
aguuggggcuaaaccaugauu

SEQ ID NO: 19364 - RNA, 21 nt, Artificial Sequence
  Description of Artificial Sequence: Synthetic oligonucleotide
guuggggcuaaaccaugaauu

SEQ ID NO: 19365 - RNA, 21 nt, Artificial Sequence
  Description of Artificial Sequence: Synthetic oligonucleotide
uuggggcuaaaccaugacauu

SEQ ID NO: 19366 - RNA, 21 nt, Artificial Sequence
  Description of Artificial Sequence: Synthetic oligonucleotide
uggggcuaaaccaugacaauu

SEQ ID NO: 19367 - RNA, 21 nt, Artificial Sequence
  Description of Artificial Sequence: Synthetic oligonucleotide
ggggcuaaaccaugacagauu

SEQ ID NO: 19368 - RNA, 21 nt, Artificial Sequence
  Description of Artificial Sequence: Synthetic oligonucleotide
gggcuaaaccaugacagaauu

SEQ ID NO: 19369 - RNA, 21 nt, Artificial Sequence
  Description of Artificial Sequence: Synthetic oligonucleotide
ggcuaaaccaugacagaaauu

SEQ ID NO: 19370 - RNA, 21 nt, Artificial Sequence
  Description of Artificial Sequence: Synthetic oligonucleotide
gcuaaaccaugacagaagauu

SEQ ID NO: 19371 - RNA, 21 nt, Artificial Sequence
  Description of Artificial Sequence: Synthetic oligonucleotide
cuaaaccaugacagaaguauu

SEQ ID NO: 19372 - RNA, 21 nt, Artificial Sequence
  Description of Artificial Sequence: Synthetic oligonucleotide
uaaaccaugacagaagugauu

SEQ ID NO: 19373 - RNA, 21 nt, Artificial Sequence
  Description of Artificial Sequence: Synthetic oligonucleotide
aaaccaugacagaaguggauu

SEQ ID NO: 19374 - RNA, 21 nt, Artificial Sequence
  Description of Artificial Sequence: Synthetic oligonucleotide
aaccaugacagaagugggauu

SEQ ID NO: 19375 - RNA, 21 nt, Artificial Sequence
  Description of Artificial Sequence: Synthetic oligonucleotide
accaugacagaaguggggauu

SEQ ID NO: 19376 - RNA, 21 nt, Artificial Sequence
  Description of Artificial Sequence: Synthetic oligonucleotide
ccaugacagaaguggggaauu

SEQ ID NO: 19377 - RNA, 21 nt, Artificial Sequence
  Description of Artificial Sequence: Synthetic oligonucleotide
caugacagaaguggggaaauu

SEQ ID NO: 19378 - RNA, 21 nt, Artificial Sequence
  Description of Artificial Sequence: Synthetic oligonucleotide
augacagaaguggggaagauu

SEQ ID NO: 19379 - RNA, 21 nt, Artificial Sequence
  Description of Artificial Sequence: Synthetic oligonucleotide
ugacagaaguggggaaguauu

SEQ ID NO: 19380 - RNA, 21 nt, Artificial Sequence
  Description of Artificial Sequence: Synthetic oligonucleotide
gacagaaguggggaaguuauu

SEQ ID NO: 19381 - RNA, 21 nt, Artificial Sequence
  Description of Artificial Sequence: Synthetic oligonucleotide
acagaaguggggaaguucauu

SEQ ID NO: 19382 - RNA, 21 nt, Artificial Sequence
  Description of Artificial Sequence: Synthetic oligonucleotide
cagaaguggggaaguucaauu

SEQ ID NO: 19383 - RNA, 21 nt, Artificial Sequence
  Description of Artificial Sequence: Synthetic oligonucleotide
agaaguggggaaguucaaauu

SEQ ID NO: 19384 - RNA, 21 nt, Artificial Sequence
  Description of Artificial Sequence: Synthetic oligonucleotide
gaaguggggaaguucaauauu

SEQ ID NO: 19385 - RNA, 21 nt, Artificial Sequence
  Description of Artificial Sequence: Synthetic oligonucleotide
aaguggggaaguucaaugauu

SEQ ID NO: 19386 - RNA, 21 nt, Artificial Sequence
  Description of Artificial Sequence: Synthetic oligonucleotide
aguggggaaguucaauguauu

SEQ ID NO: 19387 - RNA, 21 nt, Artificial Sequence
  Description of Artificial Sequence: Synthetic oligonucleotide
guggggaaguucaaugucauu

SEQ ID NO: 19388 - RNA, 21 nt, Artificial Sequence
  Description of Artificial Sequence: Synthetic oligonucleotide
uggggaaguucaauguccauu

SEQ ID NO: 19389 - RNA, 21 nt, Artificial Sequence
  Description of Artificial Sequence: Synthetic oligonucleotide
ggggaaguucaauguccuauu

SEQ ID NO: 19390 - RNA, 21 nt, Artificial Sequence
  Description of Artificial Sequence: Synthetic oligonucleotide
gggaaguucaauguccuuauu

SEQ ID NO: 19391 - RNA, 21 nt, Artificial Sequence
  Description of Artificial Sequence: Synthetic oligonucleotide
ggaaguucaauguccuuaauu

SEQ ID NO: 19392 - RNA, 21 nt, Artificial Sequence
  Description of Artificial Sequence: Synthetic oligonucleotide
gaaguucaauguccuuaaauu

SEQ ID NO: 19393 - RNA, 21 nt, Artificial Sequence
  Description of Artificial Sequence: Synthetic oligonucleotide
aaguucaauguccuuaaaauu

SEQ ID NO: 19394 - RNA, 21 nt, Artificial Sequence
  Description of Artificial Sequence: Synthetic oligonucleotide
aguucaauguccuuaaauauu

SEQ ID NO: 19395 - RNA, 21 nt, Artificial Sequence
  Description of Artificial Sequence: Synthetic oligonucleotide
guucaauguccuuaaaucauu

SEQ ID NO: 19396 - RNA, 21 nt, Artificial Sequence
  Description of Artificial Sequence: Synthetic oligonucleotide
uucaauguccuuaaauccauu

SEQ ID NO: 19397 - RNA, 21 nt, Artificial Sequence
  Description of Artificial Sequence: Synthetic oligonucleotide
ucaauguccuuaaauccaauu

SEQ ID NO: 19398 - RNA, 21 nt, Artificial Sequence
  Description of Artificial Sequence: Synthetic oligonucleotide
caauguccuuaaauccauauu

SEQ ID NO: 19399 - RNA, 21 nt, Artificial Sequence
  Description of Artificial Sequence: Synthetic oligonucleotide
aauguccuuaaauccaucauu

SEQ ID NO: 19400 - RNA, 21 nt, Artificial Sequence
  Description of Artificial Sequence: Synthetic oligonucleotide
auguccuuaaauccaucuauu

SEQ ID NO: 19401 - RNA, 21 nt, Artificial Sequence
  Description of Artificial Sequence: Synthetic oligonucleotide
uguccuuaaauccaucuuauu

SEQ ID NO: 19402 - RNA, 21 nt, Artificial Sequence
  Description of Artificial Sequence: Synthetic oligonucleotide
guccuuaaauccaucuuaauu

SEQ ID NO: 19403 - RNA, 21 nt, Artificial Sequence
  Description of Artificial Sequence: Synthetic oligonucleotide
uccuuaaauccaucuuacauu

SEQ ID NO: 19404 - RNA, 21 nt, Artificial Sequence
  Description of Artificial Sequence: Synthetic oligonucleotide
ccuuaaauccaucuuacuauu

SEQ ID NO: 19405 - RNA, 21 nt, Artificial Sequence
  Description of Artificial Sequence: Synthetic oligonucleotide
cuuaaauccaucuuacuuauu

SEQ ID NO: 19406 - RNA, 21 nt, Artificial Sequence
  Description of Artificial Sequence: Synthetic oligonucleotide
uuaaauccaucuuacuugauu

SEQ ID NO: 19407 - RNA, 21 nt, Artificial Sequence
  Description of Artificial Sequence: Synthetic oligonucleotide
uaaauccaucuuacuugcauu

SEQ ID NO: 19408 - RNA, 21 nt, Artificial Sequence
  Description of Artificial Sequence: Synthetic oligonucleotide
aaauccaucuuacuugccauu

SEQ ID NO: 19409 - RNA, 21 nt, Artificial Sequence
  Description of Artificial Sequence: Synthetic oligonucleotide
aauccaucuuacuugccaauu

SEQ ID NO: 19410 - RNA, 21 nt, Artificial Sequence
  Description of Artificial Sequence: Synthetic oligonucleotide
auccaucuuacuugccaaauu

SEQ ID NO: 19411 - RNA, 21 nt, Artificial Sequence
  Description of Artificial Sequence: Synthetic oligonucleotide
uccaucuuacuugccaacauu

SEQ ID NO: 19412 - RNA, 21 nt, Artificial Sequence
  Description of Artificial Sequence: Synthetic oligonucleotide
ccaucuuacuugccaacaauu

SEQ ID NO: 19413 - RNA, 21 nt, Artificial Sequence
  Description of Artificial Sequence: Synthetic oligonucleotide
caucuuacuugccaacagauu

SEQ ID NO: 19414 - RNA, 21 nt, Artificial Sequence
  Description of Artificial Sequence: Synthetic oligonucleotide
aucuuacuugccaacaggauu

SEQ ID NO: 19415 - RNA, 21 nt, Artificial Sequence
  Description of Artificial Sequence: Synthetic oligonucleotide
ucuuacuugccaacagguauu

SEQ ID NO: 19416 - RNA, 21 nt, Artificial Sequence
  Description of Artificial Sequence: Synthetic oligonucleotide
cuuacuugccaacagguaauu

SEQ ID NO: 19417 - RNA, 21 nt, Artificial Sequence
  Description of Artificial Sequence: Synthetic oligonucleotide
uuacuugccaacagguaaauu

SEQ ID NO: 19418 - RNA, 21 nt, Artificial Sequence
  Description of Artificial Sequence: Synthetic oligonucleotide
uacuugccaacagguaagauu

SEQ ID NO: 19419 - RNA, 21 nt, Artificial Sequence
  Description of Artificial Sequence: Synthetic oligonucleotide
acuugccaacagguaagaauu

SEQ ID NO: 19420 - RNA, 21 nt, Artificial Sequence
  Description of Artificial Sequence: Synthetic oligonucleotide
cuugccaacagguaagagauu

SEQ ID NO: 19421 - RNA, 21 nt, Artificial Sequence
  Description of Artificial Sequence: Synthetic oligonucleotide
uugccaacagguaagaggauu

SEQ ID NO: 19422 - RNA, 21 nt, Artificial Sequence
  Description of Artificial Sequence: Synthetic oligonucleotide
ugccaacagguaagaggaauu

SEQ ID NO: 19423 - RNA, 21 nt, Artificial Sequence
  Description of Artificial Sequence: Synthetic oligonucleotide
gccaacagguaagaggaaauu

SEQ ID NO: 19424 - RNA, 21 nt, Artificial Sequence
  Description of Artificial Sequence: Synthetic oligonucleotide
ccaacagguaagaggaagauu

SEQ ID NO: 19425 - RNA, 21 nt, Artificial Sequence
  Description of Artificial Sequence: Synthetic oligonucleotide
caacagguaagaggaagcauu

SEQ ID NO: 19426 - RNA, 21 nt, Artificial Sequence
  Description of Artificial Sequence: Synthetic oligonucleotide
aacagguaagaggaagcuauu

SEQ ID NO: 19427 - RNA, 21 nt, Artificial Sequence
  Description of Artificial Sequence: Synthetic oligonucleotide
acagguaagaggaagcuuauu

SEQ ID NO: 19428 - RNA, 21 nt, Artificial Sequence
  Description of Artificial Sequence: Synthetic oligonucleotide
cagguaagaggaagcuuaauu

SEQ ID NO: 19429 - RNA, 21 nt, Artificial Sequence
  Description of Artificial Sequence: Synthetic oligonucleotide
agguaagaggaagcuuacauu

SEQ ID NO: 19430 - RNA, 21 nt, Artificial Sequence
  Description of Artificial Sequence: Synthetic oligonucleotide
gguaagaggaagcuuacaauu

SEQ ID NO: 19431 - RNA, 21 nt, Artificial Sequence
  Description of Artificial Sequence: Synthetic oligonucleotide
guaagaggaagcuuacauauu

SEQ ID NO: 19432 - RNA, 21 nt, Artificial Sequence
  Description of Artificial Sequence: Synthetic oligonucleotide
uaagaggaagcuuacauuauu

SEQ ID NO: 19433 - RNA, 21 nt, Artificial Sequence
  Description of Artificial Sequence: Synthetic oligonucleotide
aagaggaagcuuacauuaauu

SEQ ID NO: 19434 - RNA, 21 nt, Artificial Sequence
  Description of Artificial Sequence: Synthetic oligonucleotide
agaggaagcuuacauuacauu

SEQ ID NO: 19435 - RNA, 21 nt, Artificial Sequence
  Description of Artificial Sequence: Synthetic oligonucleotide
gaggaagcuuacauuacaauu

SEQ ID NO: 19436 - RNA, 21 nt, Artificial Sequence
  Description of Artificial Sequence: Synthetic oligonucleotide
aggaagcuuacauuacauauu

SEQ ID NO: 19437 - RNA, 21 nt, Artificial Sequence
  Description of Artificial Sequence: Synthetic oligonucleotide
ggaagcuuacauuacaugauu

SEQ ID NO: 19438 - RNA, 21 nt, Artificial Sequence
  Description of Artificial Sequence: Synthetic oligonucleotide
gaagcuuacauuacauguauu

SEQ ID NO: 19439 - RNA, 21 nt, Artificial Sequence
  Description of Artificial Sequence: Synthetic oligonucleotide
aagcuuacauuacaugucauu

SEQ ID NO: 19440 - RNA, 21 nt, Artificial Sequence
  Description of Artificial Sequence: Synthetic oligonucleotide
agcuuacauuacauguccauu

SEQ ID NO: 19441 - RNA, 21 nt, Artificial Sequence
  Description of Artificial Sequence: Synthetic oligonucleotide
gcuuacauuacauguccaauu

SEQ ID NO: 19442 - RNA, 21 nt, Artificial Sequence
  Description of Artificial Sequence: Synthetic oligonucleotide
cuuacauuacauguccagauu

SEQ ID NO: 19443 - RNA, 21 nt, Artificial Sequence
  Description of Artificial Sequence: Synthetic oligonucleotide
uuacauuacauguccaguauu

SEQ ID NO: 19444 - RNA, 21 nt, Artificial Sequence
  Description of Artificial Sequence: Synthetic oligonucleotide
uacauuacauguccagucauu

SEQ ID NO: 19445 - RNA, 21 nt, Artificial Sequence
  Description of Artificial Sequence: Synthetic oligonucleotide
acauuacauguccaguccauu

SEQ ID NO: 19446 - RNA, 21 nt, Artificial Sequence
  Description of Artificial Sequence: Synthetic oligonucleotide
cauuacauguccaguccaauu

SEQ ID NO: 19447 - RNA, 21 nt, Artificial Sequence
  Description of Artificial Sequence: Synthetic oligonucleotide
auuacauguccaguccacauu

SEQ ID NO: 19448 - RNA, 21 nt, Artificial Sequence
  Description of Artificial Sequence: Synthetic oligonucleotide
uuacauguccaguccacaauu

SEQ ID NO: 19449 - RNA, 21 nt, Artificial Sequence
  Description of Artificial Sequence: Synthetic oligonucleotide
uacauguccaguccacauauu

SEQ ID NO: 19450 - RNA, 21 nt, Artificial Sequence
  Description of Artificial Sequence: Synthetic oligonucleotide
acauguccaguccacauuauu

SEQ ID NO: 19451 - RNA, 21 nt, Artificial Sequence
  Description of Artificial Sequence: Synthetic oligonucleotide
cauguccaguccacauuuauu

SEQ ID NO: 19452 - RNA, 21 nt, Artificial Sequence
  Description of Artificial Sequence: Synthetic oligonucleotide
auguccaguccacauuuaauu

SEQ ID NO: 19453 - RNA, 21 nt, Artificial Sequence
  Description of Artificial Sequence: Synthetic oligonucleotide
uguccaguccacauuuaaauu

SEQ ID NO: 19454 - RNA, 21 nt, Artificial Sequence
  Description of Artificial Sequence: Synthetic oligonucleotide
guccaguccacauuuaaaauu

SEQ ID NO: 19455 - RNA, 21 nt, Artificial Sequence
  Description of Artificial Sequence: Synthetic oligonucleotide
uccaguccacauuuaaagauu

SEQ ID NO: 19456 - RNA, 21 nt, Artificial Sequence
  Description of Artificial Sequence: Synthetic oligonucleotide
ccaguccacauuuaaagaauu

SEQ ID NO: 19457 - RNA, 21 nt, Artificial Sequence
  Description of Artificial Sequence: Synthetic oligonucleotide
caguccacauuuaaagagauu

SEQ ID NO: 19458 - RNA, 21 nt, Artificial Sequence
  Description of Artificial Sequence: Synthetic oligonucleotide
aguccacauuuaaagagcauu

SEQ ID NO: 19459 - RNA, 21 nt, Artificial Sequence
  Description of Artificial Sequence: Synthetic oligonucleotide
guccacauuuaaagagcaauu

SEQ ID NO: 19460 - RNA, 21 nt, Artificial Sequence
  Description of Artificial Sequence: Synthetic oligonucleotide
uccacauuuaaagagcacauu

SEQ ID NO: 19461 - RNA, 21 nt, Artificial Sequence
  Description of Artificial Sequence: Synthetic oligonucleotide
ccacauuuaaagagcacuauu

SEQ ID NO: 19462 - RNA, 21 nt, Artificial Sequence
  Description of Artificial Sequence: Synthetic oligonucleotide
cacauuuaaagagcacuuauu

SEQ ID NO: 19463 - RNA, 21 nt, Artificial Sequence
  Description of Artificial Sequence: Synthetic oligonucleotide
acauuuaaagagcacuuaauu

SEQ ID NO: 19464 - RNA, 21 nt, Artificial Sequence
  Description of Artificial Sequence: Synthetic oligonucleotide
cauuuaaagagcacuuacauu

SEQ ID NO: 19465 - RNA, 21 nt, Artificial Sequence
  Description of Artificial Sequence: Synthetic oligonucleotide
auuuaaagagcacuuacuauu

SEQ ID NO: 19466 - RNA, 21 nt, Artificial Sequence
  Description of Artificial Sequence: Synthetic oligonucleotide
uuuaaagagcacuuacugauu

SEQ ID NO: 19467 - RNA, 21 nt, Artificial Sequence
  Description of Artificial Sequence: Synthetic oligonucleotide
uuaaagagcacuuacuguauu

SEQ ID NO: 19468 - RNA, 21 nt, Artificial Sequence
  Description of Artificial Sequence: Synthetic oligonucleotide
uaaagagcacuuacugugauu

SEQ ID NO: 19469 - RNA, 21 nt, Artificial Sequence
  Description of Artificial Sequence: Synthetic oligonucleotide
aaagagcacuuacuguggauu

SEQ ID NO: 19470 - RNA, 21 nt, Artificial Sequence
  Description of Artificial Sequence: Synthetic oligonucleotide
aagagcacuuacuguggaauu

SEQ ID NO: 19471 - RNA, 21 nt, Artificial Sequence
  Description of Artificial Sequence: Synthetic oligonucleotide
agagcacuuacuguggaaauu

SEQ ID NO: 19472 - RNA, 21 nt, Artificial Sequence
  Description of Artificial Sequence: Synthetic oligonucleotide
gagcacuuacuguggaacauu

SEQ ID NO: 19473 - RNA, 21 nt, Artificial Sequence
  Description of Artificial Sequence: Synthetic oligonucleotide
agcacuuacuguggaacaauu

SEQ ID NO: 19474 - RNA, 21 nt, Artificial Sequence
  Description of Artificial Sequence: Synthetic oligonucleotide
gcacuuacuguggaacaaauu

SEQ ID NO: 19475 - RNA, 21 nt, Artificial Sequence
  Description of Artificial Sequence: Synthetic oligonucleotide
cacuuacuguggaacaagauu

SEQ ID NO: 19476 - RNA, 21 nt, Artificial Sequence
  Description of Artificial Sequence: Synthetic oligonucleotide
acuuacuguggaacaagcauu

SEQ ID NO: 19477 - RNA, 21 nt, Artificial Sequence
  Description of Artificial Sequence: Synthetic oligonucleotide
cuuacuguggaacaagccauu

SEQ ID NO: 19478 - RNA, 21 nt, Artificial Sequence
  Description of Artificial Sequence: Synthetic oligonucleotide
uuacuguggaacaagccuauu

SEQ ID NO: 19479 - RNA, 21 nt, Artificial Sequence
  Description of Artificial Sequence: Synthetic oligonucleotide
uacuguggaacaagccuuauu

SEQ ID NO: 19480 - RNA, 21 nt, Artificial Sequence
  Description of Artificial Sequence: Synthetic oligonucleotide
acuguggaacaagccuucauu

SEQ ID NO: 19481 - RNA, 21 nt, Artificial Sequence
  Description of Artificial Sequence: Synthetic oligonucleotide
cuguggaacaagccuucaauu

SEQ ID NO: 19482 - RNA, 21 nt, Artificial Sequence
  Description of Artificial Sequence: Synthetic oligonucleotide
uguggaacaagccuucagauu

SEQ ID NO: 19483 - RNA, 21 nt, Artificial Sequence
  Description of Artificial Sequence: Synthetic oligonucleotide
guggaacaagccuucagcauu

SEQ ID NO: 19484 - RNA, 21 nt, Artificial Sequence
  Description of Artificial Sequence: Synthetic oligonucleotide
uggaacaagccuucagccauu

SEQ ID NO: 19485 - RNA, 21 nt, Artificial Sequence
  Description of Artificial Sequence: Synthetic oligonucleotide
ggaacaagccuucagccaauu

SEQ ID NO: 19486 - RNA, 21 nt, Artificial Sequence
  Description of Artificial Sequence: Synthetic oligonucleotide
gaacaagccuucagccaaauu

SEQ ID NO: 19487 - RNA, 21 nt, Artificial Sequence
  Description of Artificial Sequence: Synthetic oligonucleotide
aacaagccuucagccaaaauu

SEQ ID NO: 19488 - RNA, 21 nt, Artificial Sequence
  Description of Artificial Sequence: Synthetic oligonucleotide
acaagccuucagccaaacauu

SEQ ID NO: 19489 - RNA, 21 nt, Artificial Sequence
  Description of Artificial Sequence: Synthetic oligonucleotide
caagccuucagccaaacaauu

SEQ ID NO: 19490 - RNA, 21 nt, Artificial Sequence
  Description of Artificial Sequence: Synthetic oligonucleotide
aagccuucagccaaacaaauu

SEQ ID NO: 19491 - RNA, 21 nt, Artificial Sequence
  Description of Artificial Sequence: Synthetic oligonucleotide
agccuucagccaaacaauauu

SEQ ID NO: 19492 - RNA, 21 nt, Artificial Sequence
  Description of Artificial Sequence: Synthetic oligonucleotide
gccuucagccaaacaaugauu

SEQ ID NO: 19493 - RNA, 21 nt, Artificial Sequence
  Description of Artificial Sequence: Synthetic oligonucleotide
ccuucagccaaacaauggauu

SEQ ID NO: 19494 - RNA, 21 nt, Artificial Sequence
  Description of Artificial Sequence: Synthetic oligonucleotide
cuucagccaaacaaugggauu

SEQ ID NO: 19495 - RNA, 21 nt, Artificial Sequence
  Description of Artificial Sequence: Synthetic oligonucleotide
uucagccaaacaauggggauu

SEQ ID NO: 19496 - RNA, 21 nt, Artificial Sequence
  Description of Artificial Sequence: Synthetic oligonucleotide
ucagccaaacaauggggaauu

SEQ ID NO: 19497 - RNA, 21 nt, Artificial Sequence
  Description of Artificial Sequence: Synthetic oligonucleotide
cagccaaacaauggggauauu

SEQ ID NO: 19498 - RNA, 21 nt, Artificial Sequence
  Description of Artificial Sequence: Synthetic oligonucleotide
agccaaacaauggggauaauu

SEQ ID NO: 19499 - RNA, 21 nt, Artificial Sequence
  Description of Artificial Sequence: Synthetic oligonucleotide
gccaaacaauggggauagauu

SEQ ID NO: 19500 - RNA, 21 nt, Artificial Sequence
  Description of Artificial Sequence: Synthetic oligonucleotide
ccaaacaauggggauagaauu

SEQ ID NO: 19501 - RNA, 21 nt, Artificial Sequence
  Description of Artificial Sequence: Synthetic oligonucleotide
caaacaauggggauagaaauu

SEQ ID NO: 19502 - RNA, 21 nt, Artificial Sequence
  Description of Artificial Sequence: Synthetic oligonucleotide
aaacaauggggauagaaaauu

SEQ ID NO: 19503 - RNA, 21 nt, Artificial Sequence
  Description of Artificial Sequence: Synthetic oligonucleotide
aacaauggggauagaaaaauu

SEQ ID NO: 19504 - RNA, 21 nt, Artificial Sequence
  Description of Artificial Sequence: Synthetic oligonucleotide
acaauggggauagaaaagauu

SEQ ID NO: 19505 - RNA, 21 nt, Artificial Sequence
  Description of Artificial Sequence: Synthetic oligonucleotide
caauggggauagaaaaguauu

SEQ ID NO: 19506 - RNA, 21 nt, Artificial Sequence
  Description of Artificial Sequence: Synthetic oligonucleotide
aauggggauagaaaaguaauu

SEQ ID NO: 19507 - RNA, 21 nt, Artificial Sequence
  Description of Artificial Sequence: Synthetic oligonucleotide
auggggauagaaaaguagauu

SEQ ID NO: 19508 - RNA, 21 nt, Artificial Sequence
  Description of Artificial Sequence: Synthetic oligonucleotide
uggggauagaaaaguaggauu

SEQ ID NO: 19509 - RNA, 21 nt, Artificial Sequence
  Description of Artificial Sequence: Synthetic oligonucleotide
ggggauagaaaaguagguauu

SEQ ID NO: 19510 - RNA, 21 nt, Artificial Sequence
  Description of Artificial Sequence: Synthetic oligonucleotide
gggauagaaaaguagguaauu

SEQ ID NO: 19511 - RNA, 21 nt, Artificial Sequence
  Description of Artificial Sequence: Synthetic oligonucleotide
ggauagaaaaguagguaaauu

SEQ ID NO: 19512 - RNA, 21 nt, Artificial Sequence
  Description of Artificial Sequence: Synthetic oligonucleotide
gauagaaaaguagguaagauu

SEQ ID NO: 19513 - RNA, 21 nt, Artificial Sequence
  Description of Artificial Sequence: Synthetic oligonucleotide
auagaaaaguagguaagaauu

SEQ ID NO: 19514 - RNA, 21 nt, Artificial Sequence
  Description of Artificial Sequence: Synthetic oligonucleotide
uagaaaaguagguaagacauu

SEQ ID NO: 19515 - RNA, 21 nt, Artificial Sequence
  Description of Artificial Sequence: Synthetic oligonucleotide
agaaaaguagguaagacuauu

SEQ ID NO: 19516 - RNA, 21 nt, Artificial Sequence
  Description of Artificial Sequence: Synthetic oligonucleotide
gaaaaguagguaagacucauu

SEQ ID NO: 19517 - RNA, 21 nt, Artificial Sequence
  Description of Artificial Sequence: Synthetic oligonucleotide
aaaaguagguaagacucaauu

SEQ ID NO: 19518 - RNA, 21 nt, Artificial Sequence
  Description of Artificial Sequence: Synthetic oligonucleotide
aaaguagguaagacucagauu

SEQ ID NO: 19519 - RNA, 21 nt, Artificial Sequence
  Description of Artificial Sequence: Synthetic oligonucleotide
aaguagguaagacucagcauu

SEQ ID NO: 19520 - RNA, 21 nt, Artificial Sequence
  Description of Artificial Sequence: Synthetic oligonucleotide
aguagguaagacucagccauu

SEQ ID NO: 19521 - RNA, 21 nt, Artificial Sequence
  Description of Artificial Sequence: Synthetic oligonucleotide
guagguaagacucagccuauu

SEQ ID NO: 19522 - RNA, 21 nt, Artificial Sequence
  Description of Artificial Sequence: Synthetic oligonucleotide
uagguaagacucagccuuauu

SEQ ID NO: 19523 - RNA, 21 nt, Artificial Sequence
  Description of Artificial Sequence: Synthetic oligonucleotide
agguaagacucagccuuuauu

SEQ ID NO: 19524 - RNA, 21 nt, Artificial Sequence
  Description of Artificial Sequence: Synthetic oligonucleotide
gguaagacucagccuuugauu

SEQ ID NO: 19525 - RNA, 21 nt, Artificial Sequence
  Description of Artificial Sequence: Synthetic oligonucleotide
guaagacucagccuuuguauu

SEQ ID NO: 19526 - RNA, 21 nt, Artificial Sequence
  Description of Artificial Sequence: Synthetic oligonucleotide
uaagacucagccuuugucauu

SEQ ID NO: 19527 - RNA, 21 nt, Artificial Sequence
  Description of Artificial Sequence: Synthetic oligonucleotide
aagacucagccuuuguccauu

SEQ ID NO: 19528 - RNA, 21 nt, Artificial Sequence
  Description of Artificial Sequence: Synthetic oligonucleotide
agacucagccuuuguccaauu

SEQ ID NO: 19529 - RNA, 21 nt, Artificial Sequence
  Description of Artificial Sequence: Synthetic oligonucleotide
gacucagccuuuguccagauu

SEQ ID NO: 19530 - RNA, 21 nt, Artificial Sequence
  Description of Artificial Sequence: Synthetic oligonucleotide
acucagccuuuguccagaauu

SEQ ID NO: 19531 - RNA, 21 nt, Artificial Sequence
  Description of Artificial Sequence: Synthetic oligonucleotide
cucagccuuuguccagagauu

SEQ ID NO: 19532 - RNA, 21 nt, Artificial Sequence
  Description of Artificial Sequence: Synthetic oligonucleotide
ucagccuuuguccagagaauu

SEQ ID NO: 19533 - RNA, 21 nt, Artificial Sequence
  Description of Artificial Sequence: Synthetic oligonucleotide
cagccuuuguccagagaaauu

SEQ ID NO: 19534 - RNA, 21 nt, Artificial Sequence
  Description of Artificial Sequence: Synthetic oligonucleotide
agccuuuguccagagaagauu

SEQ ID NO: 19535 - RNA, 21 nt, Artificial Sequence
  Description of Artificial Sequence: Synthetic oligonucleotide
gccuuuguccagagaagcauu

SEQ ID NO: 19536 - RNA, 21 nt, Artificial Sequence
  Description of Artificial Sequence: Synthetic oligonucleotide
ccuuuguccagagaagcuauu

SEQ ID NO: 19537 - RNA, 21 nt, Artificial Sequence
  Description of Artificial Sequence: Synthetic oligonucleotide
cuuuguccagagaagcucauu

SEQ ID NO: 19538 - RNA, 21 nt, Artificial Sequence
  Description of Artificial Sequence: Synthetic oligonucleotide
uuuguccagagaagcucaauu

SEQ ID NO: 19539 - RNA, 21 nt, Artificial Sequence
  Description of Artificial Sequence: Synthetic oligonucleotide
uuguccagagaagcucagauu

SEQ ID NO: 19540 - RNA, 21 nt, Artificial Sequence
  Description of Artificial Sequence: Synthetic oligonucleotide
uguccagagaagcucaggauu

SEQ ID NO: 19541 - RNA, 21 nt, Artificial Sequence
  Description of Artificial Sequence: Synthetic oligonucleotide
guccagagaagcucagggauu

SEQ ID NO: 19542 - RNA, 21 nt, Artificial Sequence
  Description of Artificial Sequence: Synthetic oligonucleotide
uccagagaagcucaggguauu

SEQ ID NO: 19543 - RNA, 21 nt, Artificial Sequence
  Description of Artificial Sequence: Synthetic oligonucleotide
ccagagaagcucaggguaauu

SEQ ID NO: 19544 - RNA, 21 nt, Artificial Sequence
  Description of Artificial Sequence: Synthetic oligonucleotide
cagagaagcucaggguauauu

SEQ ID NO: 19545 - RNA, 21 nt, Artificial Sequence
  Description of Artificial Sequence: Synthetic oligonucleotide
agagaagcucaggguauaauu

SEQ ID NO: 19546 - RNA, 21 nt, Artificial Sequence
  Description of Artificial Sequence: Synthetic oligonucleotide
gagaagcucaggguauagauu

SEQ ID NO: 19547 - RNA, 21 nt, Artificial Sequence
  Description of Artificial Sequence: Synthetic oligonucleotide
agaagcucaggguauagcauu

SEQ ID NO: 19548 - RNA, 21 nt, Artificial Sequence
  Description of Artificial Sequence: Synthetic oligonucleotide
gaagcucaggguauagcuauu

SEQ ID NO: 19549 - RNA, 21 nt, Artificial Sequence
  Description of Artificial Sequence: Synthetic oligonucleotide
aagcucaggguauagcugauu

SEQ ID NO: 19550 - RNA, 21 nt, Artificial Sequence
  Description of Artificial Sequence: Synthetic oligonucleotide
agcucaggguauagcugaauu

SEQ ID NO: 19551 - RNA, 21 nt, Artificial Sequence
  Description of Artificial Sequence: Synthetic oligonucleotide
gcucaggguauagcugaaauu

SEQ ID NO: 19552 - RNA, 21 nt, Artificial Sequence
  Description of Artificial Sequence: Synthetic oligonucleotide
cucaggguauagcugaauauu

SEQ ID NO: 19553 - RNA, 21 nt, Artificial Sequence
  Description of Artificial Sequence: Synthetic oligonucleotide
ucaggguauagcugaauaauu

SEQ ID NO: 19554 - RNA, 21 nt, Artificial Sequence
  Description of Artificial Sequence: Synthetic oligonucleotide
caggguauagcugaauagauu

SEQ ID NO: 19555 - RNA, 21 nt, Artificial Sequence
  Description of Artificial Sequence: Synthetic oligonucleotide
aggguauagcugaauaggauu

SEQ ID NO: 19556 - RNA, 21 nt, Artificial Sequence
  Description of Artificial Sequence: Synthetic oligonucleotide
ggguauagcugaauaggcauu

SEQ ID NO: 19557 - RNA, 21 nt, Artificial Sequence
  Description of Artificial Sequence: Synthetic oligonucleotide
gguauagcugaauaggcaauu

SEQ ID NO: 19558 - RNA, 21 nt, Artificial Sequence
  Description of Artificial Sequence: Synthetic oligonucleotide
guauagcugaauaggcagauu

SEQ ID NO: 19559 - RNA, 21 nt, Artificial Sequence
  Description of Artificial Sequence: Synthetic oligonucleotide
uauagcugaauaggcaguauu

SEQ ID NO: 19560 - RNA, 21 nt, Artificial Sequence
  Description of Artificial Sequence: Synthetic oligonucleotide
auagcugaauaggcaguuauu

SEQ ID NO: 19561 - RNA, 21 nt, Artificial Sequence
  Description of Artificial Sequence: Synthetic oligonucleotide
uagcugaauaggcaguuuauu

SEQ ID NO: 19562 - RNA, 21 nt, Artificial Sequence
  Description of Artificial Sequence: Synthetic oligonucleotide
agcugaauaggcaguuucauu

SEQ ID NO: 19563 - RNA, 21 nt, Artificial Sequence
  Description of Artificial Sequence: Synthetic oligonucleotide
gcugaauaggcaguuucuauu

SEQ ID NO: 19564 - RNA, 21 nt, Artificial Sequence
  Description of Artificial Sequence: Synthetic oligonucleotide
cugaauaggcaguuucuuauu

SEQ ID NO: 19565 - RNA, 21 nt, Artificial Sequence
  Description of Artificial Sequence: Synthetic oligonucleotide
ugaauaggcaguuucuuuauu

SEQ ID NO: 19566 - RNA, 21 nt, Artificial Sequence
  Description of Artificial Sequence: Synthetic oligonucleotide
gaauaggcaguuucuuuuauu

SEQ ID NO: 19567 - RNA, 21 nt, Artificial Sequence
  Description of Artificial Sequence: Synthetic oligonucleotide
aauaggcaguuucuuuugauu

SEQ ID NO: 19568 - RNA, 21 nt, Artificial Sequence
  Description of Artificial Sequence: Synthetic oligonucleotide
auaggcaguuucuuuuguauu

SEQ ID NO: 19569 - RNA, 21 nt, Artificial Sequence
  Description of Artificial Sequence: Synthetic oligonucleotide
uaggcaguuucuuuugucauu

SEQ ID NO: 19570 - RNA, 21 nt, Artificial Sequence
  Description of Artificial Sequence: Synthetic oligonucleotide
aggcaguuucuuuuguccauu

SEQ ID NO: 19571 - RNA, 21 nt, Artificial Sequence
  Description of Artificial Sequence: Synthetic oligonucleotide
ggcaguuucuuuuguccuauu

SEQ ID NO: 19572 - RNA, 21 nt, Artificial Sequence
  Description of Artificial Sequence: Synthetic oligonucleotide
gcaguuucuuuuguccugauu

SEQ ID NO: 19573 - RNA, 21 nt, Artificial Sequence
  Description of Artificial Sequence: Synthetic oligonucleotide
caguuucuuuuguccugaauu

SEQ ID NO: 19574 - RNA, 21 nt, Artificial Sequence
  Description of Artificial Sequence: Synthetic oligonucleotide
aguuucuuuuguccugagauu

SEQ ID NO: 19575 - RNA, 21 nt, Artificial Sequence
  Description of Artificial Sequence: Synthetic oligonucleotide
guuucuuuuguccugaggauu

SEQ ID NO: 19576 - RNA, 21 nt, Artificial Sequence
  Description of Artificial Sequence: Synthetic oligonucleotide
uuucuuuuguccugaggaauu

SEQ ID NO: 19577 - RNA, 21 nt, Artificial Sequence
  Description of Artificial Sequence: Synthetic oligonucleotide
uucuuuuguccugaggaaauu

SEQ ID NO: 19578 - RNA, 21 nt, Artificial Sequence
  Description of Artificial Sequence: Synthetic oligonucleotide
ucuuuuguccugaggaaaauu

SEQ ID NO: 19579 - RNA, 21 nt, Artificial Sequence
  Description of Artificial Sequence: Synthetic oligonucleotide
cuuuuguccugaggaaaaauu

SEQ ID NO: 19580 - RNA, 21 nt, Artificial Sequence
  Description of Artificial Sequence: Synthetic oligonucleotide
uuuuguccugaggaaaauauu

SEQ ID NO: 19581 - RNA, 21 nt, Artificial Sequence
  Description of Artificial Sequence: Synthetic oligonucleotide
uuuguccugaggaaaaucauu

SEQ ID NO: 19582 - RNA, 21 nt, Artificial Sequence
  Description of Artificial Sequence: Synthetic oligonucleotide
uuguccugaggaaaaucaauu

SEQ ID NO: 19583 - RNA, 21 nt, Artificial Sequence
  Description of Artificial Sequence: Synthetic oligonucleotide
uguccugaggaaaaucagauu

SEQ ID NO: 19584 - RNA, 21 nt, Artificial Sequence
  Description of Artificial Sequence: Synthetic oligonucleotide
guccugaggaaaaucaggauu

SEQ ID NO: 19585 - RNA, 21 nt, Artificial Sequence
  Description of Artificial Sequence: Synthetic oligonucleotide
uccugaggaaaaucaggaauu

SEQ ID NO: 19586 - RNA, 21 nt, Artificial Sequence
  Description of Artificial Sequence: Synthetic oligonucleotide
ccugaggaaaaucaggacauu

SEQ ID NO: 19587 - RNA, 21 nt, Artificial Sequence
  Description of Artificial Sequence: Synthetic oligonucleotide
cugaggaaaaucaggacaauu

SEQ ID NO: 19588 - RNA, 21 nt, Artificial Sequence
  Description of Artificial Sequence: Synthetic oligonucleotide
ugaggaaaaucaggacauauu

SEQ ID NO: 19589 - RNA, 21 nt, Artificial Sequence
  Description of Artificial Sequence: Synthetic oligonucleotide
gaggaaaaucaggacaugauu

SEQ ID NO: 19590 - RNA, 21 nt, Artificial Sequence
  Description of Artificial Sequence: Synthetic oligonucleotide
aggaaaaucaggacaugcauu

SEQ ID NO: 19591 - RNA, 21 nt, Artificial Sequence
  Description of Artificial Sequence: Synthetic oligonucleotide
ggaaaaucaggacaugccauu

SEQ ID NO: 19592 - RNA, 21 nt, Artificial Sequence
  Description of Artificial Sequence: Synthetic oligonucleotide
gaaaaucaggacaugccuauu

SEQ ID NO: 19593 - RNA, 21 nt, Artificial Sequence
  Description of Artificial Sequence: Synthetic oligonucleotide
aaaaucaggacaugccugauu

SEQ ID NO: 19594 - RNA, 21 nt, Artificial Sequence
  Description of Artificial Sequence: Synthetic oligonucleotide
aaaucaggacaugccugcauu

SEQ ID NO: 19595 - RNA, 21 nt, Artificial Sequence
  Description of Artificial Sequence: Synthetic oligonucleotide
aaucaggacaugccugcuauu

SEQ ID NO: 19596 - RNA, 21 nt, Artificial Sequence
  Description of Artificial Sequence: Synthetic oligonucleotide
aucaggacaugccugcuuauu

SEQ ID NO: 19597 - RNA, 21 nt, Artificial Sequence
  Description of Artificial Sequence: Synthetic oligonucleotide
ucaggacaugccugcuuuauu

SEQ ID NO: 19598 - RNA, 21 nt, Artificial Sequence
  Description of Artificial Sequence: Synthetic oligonucleotide
caggacaugccugcuuucauu

SEQ ID NO: 19599 - RNA, 21 nt, Artificial Sequence
  Description of Artificial Sequence: Synthetic oligonucleotide
aggacaugccugcuuucuauu

SEQ ID NO: 19600 - RNA, 21 nt, Artificial Sequence
  Description of Artificial Sequence: Synthetic oligonucleotide
ggacaugccugcuuucuaauu

SEQ ID NO: 19601 - RNA, 21 nt, Artificial Sequence
  Description of Artificial Sequence: Synthetic oligonucleotide
gacaugccugcuuucuaaauu

SEQ ID NO: 19602 - RNA, 21 nt, Artificial Sequence
  Description of Artificial Sequence: Synthetic oligonucleotide
acaugccugcuuucuaaaauu

SEQ ID NO: 19603 - RNA, 21 nt, Artificial Sequence
  Description of Artificial Sequence: Synthetic oligonucleotide
caugccugcuuucuaaaaauu

SEQ ID NO: 19604 - RNA, 21 nt, Artificial Sequence
  Description of Artificial Sequence: Synthetic oligonucleotide
augccugcuuucuaaaaaauu

SEQ ID NO: 19605 - RNA, 21 nt, Artificial Sequence
  Description of Artificial Sequence: Synthetic oligonucleotide
ugccugcuuucuaaaaauauu

SEQ ID NO: 19606 - RNA, 21 nt, Artificial Sequence
  Description of Artificial Sequence: Synthetic oligonucleotide
gccugcuuucuaaaaaucauu

SEQ ID NO: 19607 - RNA, 21 nt, Artificial Sequence
  Description of Artificial Sequence: Synthetic oligonucleotide
ccugcuuucuaaaaaucuauu

SEQ ID NO: 19608 - RNA, 21 nt, Artificial Sequence
  Description of Artificial Sequence: Synthetic oligonucleotide
cugcuuucuaaaaaucuuauu

SEQ ID NO: 19609 - RNA, 21 nt, Artificial Sequence
  Description of Artificial Sequence: Synthetic oligonucleotide
ugcuuucuaaaaaucuucauu

SEQ ID NO: 19610 - RNA, 21 nt, Artificial Sequence
  Description of Artificial Sequence: Synthetic oligonucleotide
gcuuucuaaaaaucuuccauu

SEQ ID NO: 19611 - RNA, 21 nt, Artificial Sequence
  Description of Artificial Sequence: Synthetic oligonucleotide
cuuucuaaaaaucuuccuauu

SEQ ID NO: 19612 - RNA, 21 nt, Artificial Sequence
  Description of Artificial Sequence: Synthetic oligonucleotide
uuucuaaaaaucuuccucauu

SEQ ID NO: 19613 - RNA, 21 nt, Artificial Sequence
  Description of Artificial Sequence: Synthetic oligonucleotide
uucuaaaaaucuuccucuauu

SEQ ID NO: 19614 - RNA, 21 nt, Artificial Sequence
  Description of Artificial Sequence: Synthetic oligonucleotide
ucuaaaaaucuuccucugauu

SEQ ID NO: 19615 - RNA, 21 nt, Artificial Sequence
  Description of Artificial Sequence: Synthetic oligonucleotide
cuaaaaaucuuccucugaauu

SEQ ID NO: 19616 - RNA, 21 nt, Artificial Sequence
  Description of Artificial Sequence: Synthetic oligonucleotide
uaaaaaucuuccucugaaauu

SEQ ID NO: 19617 - RNA, 21 nt, Artificial Sequence
  Description of Artificial Sequence: Synthetic oligonucleotide
aaaaaucuuccucugaagauu

SEQ ID NO: 19618 - RNA, 21 nt, Artificial Sequence
  Description of Artificial Sequence: Synthetic oligonucleotide
aaaaucuuccucugaagaauu

SEQ ID NO: 19619 - RNA, 21 nt, Artificial Sequence
  Description of Artificial Sequence: Synthetic oligonucleotide
aaaucuuccucugaagacauu

SEQ ID NO: 19620 - RNA, 21 nt, Artificial Sequence
  Description of Artificial Sequence: Synthetic oligonucleotide
aaucuuccucugaagaccauu

SEQ ID NO: 19621 - RNA, 21 nt, Artificial Sequence
  Description of Artificial Sequence: Synthetic oligonucleotide
aucuuccucugaagaccuauu

SEQ ID NO: 19622 - RNA, 21 nt, Artificial Sequence
  Description of Artificial Sequence: Synthetic oligonucleotide
ucuuccucugaagaccugauu

SEQ ID NO: 19623 - RNA, 21 nt, Artificial Sequence
  Description of Artificial Sequence: Synthetic oligonucleotide
cuuccucugaagaccugaauu

SEQ ID NO: 19624 - RNA, 21 nt, Artificial Sequence
  Description of Artificial Sequence: Synthetic oligonucleotide
uuccucugaagaccugacauu

SEQ ID NO: 19625 - RNA, 21 nt, Artificial Sequence
  Description of Artificial Sequence: Synthetic oligonucleotide
uccucugaagaccugaccauu

SEQ ID NO: 19626 - RNA, 21 nt, Artificial Sequence
  Description of Artificial Sequence: Synthetic oligonucleotide
ccucugaagaccugacccauu

SEQ ID NO: 19627 - RNA, 21 nt, Artificial Sequence
  Description of Artificial Sequence: Synthetic oligonucleotide
cucugaagaccugacccaauu

SEQ ID NO: 19628 - RNA, 21 nt, Artificial Sequence
  Description of Artificial Sequence: Synthetic oligonucleotide
ucugaagaccugacccaaauu

SEQ ID NO: 19629 - RNA, 21 nt, Artificial Sequence
  Description of Artificial Sequence: Synthetic oligonucleotide
cugaagaccugacccaagauu

SEQ ID NO: 19630 - RNA, 21 nt, Artificial Sequence
  Description of Artificial Sequence: Synthetic oligonucleotide
ugaagaccugacccaagcauu

SEQ ID NO: 19631 - RNA, 21 nt, Artificial Sequence
  Description of Artificial Sequence: Synthetic oligonucleotide
gaagaccugacccaagcuauu

SEQ ID NO: 19632 - RNA, 21 nt, Artificial Sequence
  Description of Artificial Sequence: Synthetic oligonucleotide
aagaccugacccaagcucauu

SEQ ID NO: 19633 - RNA, 21 nt, Artificial Sequence
  Description of Artificial Sequence: Synthetic oligonucleotide
agaccugacccaagcucuauu

SEQ ID NO: 19634 - RNA, 21 nt, Artificial Sequence
  Description of Artificial Sequence: Synthetic oligonucleotide
gaccugacccaagcucuuauu

SEQ ID NO: 19635 - RNA, 21 nt, Artificial Sequence
  Description of Artificial Sequence: Synthetic oligonucleotide
accugacccaagcucuuaauu

SEQ ID NO: 19636 - RNA, 21 nt, Artificial Sequence
  Description of Artificial Sequence: Synthetic oligonucleotide
ccugacccaagcucuuaaauu

SEQ ID NO: 19637 - RNA, 21 nt, Artificial Sequence
  Description of Artificial Sequence: Synthetic oligonucleotide
cugacccaagcucuuaaaauu

SEQ ID NO: 19638 - RNA, 21 nt, Artificial Sequence
  Description of Artificial Sequence: Synthetic oligonucleotide
ugacccaagcucuuaaauauu

SEQ ID NO: 19639 - RNA, 21 nt, Artificial Sequence
  Description of Artificial Sequence: Synthetic oligonucleotide
gacccaagcucuuaaaugauu

SEQ ID NO: 19640 - RNA, 21 nt, Artificial Sequence
  Description of Artificial Sequence: Synthetic oligonucleotide
acccaagcucuuaaaugcauu

SEQ ID NO: 19641 - RNA, 21 nt, Artificial Sequence
  Description of Artificial Sequence: Synthetic oligonucleotide
cccaagcucuuaaaugcuauu

SEQ ID NO: 19642 - RNA, 21 nt, Artificial Sequence
  Description of Artificial Sequence: Synthetic oligonucleotide
ccaagcucuuaaaugcuaauu

SEQ ID NO: 19643 - RNA, 21 nt, Artificial Sequence
  Description of Artificial Sequence: Synthetic oligonucleotide
caagcucuuaaaugcuauauu

SEQ ID NO: 19644 - RNA, 21 nt, Artificial Sequence
  Description of Artificial Sequence: Synthetic oligonucleotide
aagcucuuaaaugcuauuauu

SEQ ID NO: 19645 - RNA, 21 nt, Artificial Sequence
  Description of Artificial Sequence: Synthetic oligonucleotide
agcucuuaaaugcuauugauu

SEQ ID NO: 19646 - RNA, 21 nt, Artificial Sequence
  Description of Artificial Sequence: Synthetic oligonucleotide
gcucuuaaaugcuauuguauu

SEQ ID NO: 19647 - RNA, 21 nt, Artificial Sequence
  Description of Artificial Sequence: Synthetic oligonucleotide
cucuuaaaugcuauuguaauu

SEQ ID NO: 19648 - RNA, 21 nt, Artificial Sequence
  Description of Artificial Sequence: Synthetic oligonucleotide
ucuuaaaugcuauuguaaauu

SEQ ID NO: 19649 - RNA, 21 nt, Artificial Sequence
  Description of Artificial Sequence: Synthetic oligonucleotide
cuuaaaugcuauuguaagauu

SEQ ID NO: 19650 - RNA, 21 nt, Artificial Sequence
  Description of Artificial Sequence: Synthetic oligonucleotide
uuaaaugcuauuguaagaauu

SEQ ID NO: 19651 - RNA, 21 nt, Artificial Sequence
  Description of Artificial Sequence: Synthetic oligonucleotide
uaaaugcuauuguaagagauu

SEQ ID NO: 19652 - RNA, 21 nt, Artificial Sequence
  Description of Artificial Sequence: Synthetic oligonucleotide
aaaugcuauuguaagagaauu

SEQ ID NO: 19653 - RNA, 21 nt, Artificial Sequence
  Description of Artificial Sequence: Synthetic oligonucleotide
aaugcuauuguaagagaaauu

SEQ ID NO: 19654 - RNA, 21 nt, Artificial Sequence
  Description of Artificial Sequence: Synthetic oligonucleotide
augcuauuguaagagaaaauu

SEQ ID NO: 19655 - RNA, 21 nt, Artificial Sequence
  Description of Artificial Sequence: Synthetic oligonucleotide
ugcuauuguaagagaaauauu

SEQ ID NO: 19656 - RNA, 21 nt, Artificial Sequence
  Description of Artificial Sequence: Synthetic oligonucleotide
gcuauuguaagagaaauuauu

SEQ ID NO: 19657 - RNA, 21 nt, Artificial Sequence
  Description of Artificial Sequence: Synthetic oligonucleotide
cuauuguaagagaaauuuauu

SEQ ID NO: 19658 - RNA, 21 nt, Artificial Sequence
  Description of Artificial Sequence: Synthetic oligonucleotide
uauuguaagagaaauuucauu

SEQ ID NO: 19659 - RNA, 21 nt, Artificial Sequence
  Description of Artificial Sequence: Synthetic oligonucleotide
auuguaagagaaauuucuauu

SEQ ID NO: 19660 - RNA, 21 nt, Artificial Sequence
  Description of Artificial Sequence: Synthetic oligonucleotide
uuguaagagaaauuucuuauu

SEQ ID NO: 19661 - RNA, 21 nt, Artificial Sequence
  Description of Artificial Sequence: Synthetic oligonucleotide
uguaagagaaauuucuuuauu

SEQ ID NO: 19662 - RNA, 21 nt, Artificial Sequence
  Description of Artificial Sequence: Synthetic oligonucleotide
guaagagaaauuucuuugauu

SEQ ID NO: 19663 - RNA, 21 nt, Artificial Sequence
  Description of Artificial Sequence: Synthetic oligonucleotide
uaagagaaauuucuuuguauu

SEQ ID NO: 19664 - RNA, 21 nt, Artificial Sequence
  Description of Artificial Sequence: Synthetic oligonucleotide
aagagaaauuucuuugucauu

SEQ ID NO: 19665 - RNA, 21 nt, Artificial Sequence
  Description of Artificial Sequence: Synthetic oligonucleotide
agagaaauuucuuugucuauu

SEQ ID NO: 19666 - RNA, 21 nt, Artificial Sequence
  Description of Artificial Sequence: Synthetic oligonucleotide
gagaaauuucuuugucuaauu

SEQ ID NO: 19667 - RNA, 21 nt, Artificial Sequence
  Description of Artificial Sequence: Synthetic oligonucleotide
agaaauuucuuugucuauauu

SEQ ID NO: 19668 - RNA, 21 nt, Artificial Sequence
  Description of Artificial Sequence: Synthetic oligonucleotide
gaaauuucuuugucuauuauu

SEQ ID NO: 19669 - RNA, 21 nt, Artificial Sequence
  Description of Artificial Sequence: Synthetic oligonucleotide
aaauuucuuugucuauuaauu

SEQ ID NO: 19670 - RNA, 21 nt, Artificial Sequence
  Description of Artificial Sequence: Synthetic oligonucleotide
aauuucuuugucuauuaaauu

SEQ ID NO: 19671 - RNA, 21 nt, Artificial Sequence
  Description of Artificial Sequence: Synthetic oligonucleotide
auuucuuugucuauuaacauu

SEQ ID NO: 19672 - RNA, 21 nt, Artificial Sequence
  Description of Artificial Sequence: Synthetic oligonucleotide
uuucuuugucuauuaacuauu

SEQ ID NO: 19673 - RNA, 21 nt, Artificial Sequence
  Description of Artificial Sequence: Synthetic oligonucleotide
uucuuugucuauuaacucauu

SEQ ID NO: 19674 - RNA, 21 nt, Artificial Sequence
  Description of Artificial Sequence: Synthetic oligonucleotide
ucuuugucuauuaacuccauu

SEQ ID NO: 19675 - RNA, 21 nt, Artificial Sequence
  Description of Artificial Sequence: Synthetic oligonucleotide
cuuugucuauuaacuccaauu

SEQ ID NO: 19676 - RNA, 21 nt, Artificial Sequence
  Description of Artificial Sequence: Synthetic oligonucleotide
uuugucuauuaacuccauauu

SEQ ID NO: 19677 - RNA, 21 nt, Artificial Sequence
  Description of Artificial Sequence: Synthetic oligonucleotide
uugucuauuaacuccauuauu

SEQ ID NO: 19678 - RNA, 21 nt, Artificial Sequence
  Description of Artificial Sequence: Synthetic oligonucleotide
ugucuauuaacuccauuuauu

SEQ ID NO: 19679 - RNA, 21 nt, Artificial Sequence
  Description of Artificial Sequence: Synthetic oligonucleotide
gucuauuaacuccauuuuauu

SEQ ID NO: 19680 - RNA, 21 nt, Artificial Sequence
  Description of Artificial Sequence: Synthetic oligonucleotide
ucuauuaacuccauuuuaauu

SEQ ID NO: 19681 - RNA, 21 nt, Artificial Sequence
  Description of Artificial Sequence: Synthetic oligonucleotide
cuauuaacuccauuuuagauu

SEQ ID NO: 19682 - RNA, 21 nt, Artificial Sequence
  Description of Artificial Sequence: Synthetic oligonucleotide
uauuaacuccauuuuaguauu

SEQ ID NO: 19683 - RNA, 21 nt, Artificial Sequence
  Description of Artificial Sequence: Synthetic oligonucleotide
auuaacuccauuuuaguaauu

SEQ ID NO: 19684 - RNA, 21 nt, Artificial Sequence
  Description of Artificial Sequence: Synthetic oligonucleotide
uuaacuccauuuuaguagauu

SEQ ID NO: 19685 - RNA, 21 nt, Artificial Sequence
  Description of Artificial Sequence: Synthetic oligonucleotide
uaacuccauuuuaguaggauu

SEQ ID NO: 19686 - RNA, 21 nt, Artificial Sequence
  Description of Artificial Sequence: Synthetic oligonucleotide
aacuccauuuuaguagggauu

SEQ ID NO: 19687 - RNA, 21 nt, Artificial Sequence
  Description of Artificial Sequence: Synthetic oligonucleotide
acuccauuuuaguagggaauu

SEQ ID NO: 19688 - RNA, 21 nt, Artificial Sequence
  Description of Artificial Sequence: Synthetic oligonucleotide
cuccauuuuaguagggauauu

SEQ ID NO: 19689 - RNA, 21 nt, Artificial Sequence
  Description of Artificial Sequence: Synthetic oligonucleotide
uccauuuuaguagggauuauu

SEQ ID NO: 19690 - RNA, 21 nt, Artificial Sequence
  Description of Artificial Sequence: Synthetic oligonucleotide
ccauuuuaguagggauucauu

SEQ ID NO: 19691 - RNA, 21 nt, Artificial Sequence
  Description of Artificial Sequence: Synthetic oligonucleotide
cauuuuaguagggauucaauu

SEQ ID NO: 19692 - RNA, 21 nt, Artificial Sequence
  Description of Artificial Sequence: Synthetic oligonucleotide
auuuuaguagggauucacauu

SEQ ID NO: 19693 - RNA, 21 nt, Artificial Sequence
  Description of Artificial Sequence: Synthetic oligonucleotide
uuuuaguagggauucacuauu

SEQ ID NO: 19694 - RNA, 21 nt, Artificial Sequence
  Description of Artificial Sequence: Synthetic oligonucleotide
uuuaguagggauucacugauu

SEQ ID NO: 19695 - RNA, 21 nt, Artificial Sequence
  Description of Artificial Sequence: Synthetic oligonucleotide
uuaguagggauucacugaauu

SEQ ID NO: 19696 - RNA, 21 nt, Artificial Sequence
  Description of Artificial Sequence: Synthetic oligonucleotide
uaguagggauucacugacauu

SEQ ID NO: 19697 - RNA, 21 nt, Artificial Sequence
  Description of Artificial Sequence: Synthetic oligonucleotide
aguagggauucacugacuauu

SEQ ID NO: 19698 - RNA, 21 nt, Artificial Sequence
  Description of Artificial Sequence: Synthetic oligonucleotide
guagggauucacugacuaauu

SEQ ID NO: 19699 - RNA, 21 nt, Artificial Sequence
  Description of Artificial Sequence: Synthetic oligonucleotide
uagggauucacugacuagauu

SEQ ID NO: 19700 - RNA, 21 nt, Artificial Sequence
  Description of Artificial Sequence: Synthetic oligonucleotide
agggauucacugacuagaauu

SEQ ID NO: 19701 - RNA, 21 nt, Artificial Sequence
  Description of Artificial Sequence: Synthetic oligonucleotide
gggauucacugacuagauauu

SEQ ID NO: 19702 - RNA, 21 nt, Artificial Sequence
  Description of Artificial Sequence: Synthetic oligonucleotide
ggauucacugacuagauuauu

SEQ ID NO: 19703 - RNA, 21 nt, Artificial Sequence
  Description of Artificial Sequence: Synthetic oligonucleotide
gauucacugacuagauuuauu

SEQ ID NO: 19704 - RNA, 21 nt, Artificial Sequence
  Description of Artificial Sequence: Synthetic oligonucleotide
auucacugacuagauuuuauu

SEQ ID NO: 19705 - RNA, 21 nt, Artificial Sequence
  Description of Artificial Sequence: Synthetic oligonucleotide
uucacugacuagauuuuaauu

SEQ ID NO: 19706 - RNA, 21 nt, Artificial Sequence
  Description of Artificial Sequence: Synthetic oligonucleotide
ucacugacuagauuuuacauu

SEQ ID NO: 19707 - RNA, 21 nt, Artificial Sequence
  Description of Artificial Sequence: Synthetic oligonucleotide
cacugacuagauuuuacuauu

SEQ ID NO: 19708 - RNA, 21 nt, Artificial Sequence
  Description of Artificial Sequence: Synthetic oligonucleotide
acugacuagauuuuacugauu

SEQ ID NO: 19709 - RNA, 21 nt, Artificial Sequence
  Description of Artificial Sequence: Synthetic oligonucleotide
cugacuagauuuuacugaauu

SEQ ID NO: 19710 - RNA, 21 nt, Artificial Sequence
  Description of Artificial Sequence: Synthetic oligonucleotide
ugacuagauuuuacugaaauu

SEQ ID NO: 19711 - RNA, 21 nt, Artificial Sequence
  Description of Artificial Sequence: Synthetic oligonucleotide
gacuagauuuuacugaacauu

SEQ ID NO: 19712 - RNA, 21 nt, Artificial Sequence
  Description of Artificial Sequence: Synthetic oligonucleotide
acuagauuuuacugaacuauu

SEQ ID NO: 19713 - RNA, 21 nt, Artificial Sequence
  Description of Artificial Sequence: Synthetic oligonucleotide
cuagauuuuacugaacuaauu

SEQ ID NO: 19714 - RNA, 21 nt, Artificial Sequence
  Description of Artificial Sequence: Synthetic oligonucleotide
uagauuuuacugaacuauauu

SEQ ID NO: 19715 - RNA, 21 nt, Artificial Sequence
  Description of Artificial Sequence: Synthetic oligonucleotide
agauuuuacugaacuaugauu

SEQ ID NO: 19716 - RNA, 21 nt, Artificial Sequence
  Description of Artificial Sequence: Synthetic oligonucleotide
gauuuuacugaacuaugaauu

SEQ ID NO: 19717 - RNA, 21 nt, Artificial Sequence
  Description of Artificial Sequence: Synthetic oligonucleotide
auuuuacugaacuaugaaauu

SEQ ID NO: 19718 - RNA, 21 nt, Artificial Sequence
  Description of Artificial Sequence: Synthetic oligonucleotide
uuuuacugaacuaugaaaauu

SEQ ID NO: 19719 - RNA, 21 nt, Artificial Sequence
  Description of Artificial Sequence: Synthetic oligonucleotide
uuuacugaacuaugaaaaauu

SEQ ID NO: 19720 - RNA, 21 nt, Artificial Sequence
  Description of Artificial Sequence: Synthetic oligonucleotide
uuacugaacuaugaaaauauu

SEQ ID NO: 19721 - RNA, 21 nt, Artificial Sequence
  Description of Artificial Sequence: Synthetic oligonucleotide
uacugaacuaugaaaauaauu

SEQ ID NO: 19722 - RNA, 21 nt, Artificial Sequence
  Description of Artificial Sequence: Synthetic oligonucleotide
acugaacuaugaaaauaaauu

SEQ ID NO: 19723 - RNA, 21 nt, Artificial Sequence
  Description of Artificial Sequence: Synthetic oligonucleotide
cugaacuaugaaaauaaaauu

SEQ ID NO: 19724 - RNA, 21 nt, Artificial Sequence
  Description of Artificial Sequence: Synthetic oligonucleotide
ugaacuaugaaaauaaauauu

SEQ ID NO: 19725 - RNA, 21 nt, Artificial Sequence
  Description of Artificial Sequence: Synthetic oligonucleotide
gaacuaugaaaauaaauaauu

SEQ ID NO: 19726 - RNA, 21 nt, Artificial Sequence
  Description of Artificial Sequence: Synthetic oligonucleotide
aacuaugaaaauaaauacauu

SEQ ID NO: 19727 - RNA, 21 nt, Artificial Sequence
  Description of Artificial Sequence: Synthetic oligonucleotide
acuaugaaaauaaauacaauu

SEQ ID NO: 19728 - RNA, 21 nt, Artificial Sequence
  Description of Artificial Sequence: Synthetic oligonucleotide
cuaugaaaauaaauacacauu

SEQ ID NO: 19729 - RNA, 21 nt, Artificial Sequence
  Description of Artificial Sequence: Synthetic oligonucleotide
uaugaaaauaaauacacaauu

SEQ ID NO: 19730 - RNA, 21 nt, Artificial Sequence
  Description of Artificial Sequence: Synthetic oligonucleotide
augaaaauaaauacacauauu

SEQ ID NO: 19731 - RNA, 21 nt, Artificial Sequence
  Description of Artificial Sequence: Synthetic oligonucleotide
ugaaaauaaauacacauaauu

SEQ ID NO: 19732 - RNA, 21 nt, Artificial Sequence
  Description of Artificial Sequence: Synthetic oligonucleotide
gaaaauaaauacacauaaauu

SEQ ID NO: 19733 - RNA, 21 nt, Artificial Sequence
  Description of Artificial Sequence: Synthetic oligonucleotide
aaaauaaauacacauaauauu

SEQ ID NO: 19734 - RNA, 21 nt, Artificial Sequence
  Description of Artificial Sequence: Synthetic oligonucleotide
aaauaaauacacauaauuauu

SEQ ID NO: 19735 - RNA, 21 nt, Artificial Sequence
  Description of Artificial Sequence: Synthetic oligonucleotide
aauaaauacacauaauuuauu

SEQ ID NO: 19736 - RNA, 21 nt, Artificial Sequence
  Description of Artificial Sequence: Synthetic oligonucleotide
auaaauacacauaauuuuauu

SEQ ID NO: 19737 - RNA, 21 nt, Artificial Sequence
  Description of Artificial Sequence: Synthetic oligonucleotide
uaaauacacauaauuuuuauu

SEQ ID NO: 19738 - RNA, 21 nt, Artificial Sequence
  Description of Artificial Sequence: Synthetic oligonucleotide
aaauacacauaauuuuucauu

SEQ ID NO: 19739 - RNA, 21 nt, Artificial Sequence
  Description of Artificial Sequence: Synthetic oligonucleotide
aauacacauaauuuuucaauu

SEQ ID NO: 19740 - RNA, 21 nt, Artificial Sequence
  Description of Artificial Sequence: Synthetic oligonucleotide
auacacauaauuuuucacauu

SEQ ID NO: 19741 - RNA, 21 nt, Artificial Sequence
  Description of Artificial Sequence: Synthetic oligonucleotide
uacacauaauuuuucacaauu

SEQ ID NO: 19742 - RNA, 21 nt, Artificial Sequence
  Description of Artificial Sequence: Synthetic oligonucleotide
acacauaauuuuucacaaauu

SEQ ID NO: 19743 - RNA, 21 nt, Artificial Sequence
  Description of Artificial Sequence: Synthetic oligonucleotide
cacauaauuuuucacaaaauu

SEQ ID NO: 19744 - RNA, 21 nt, Artificial Sequence
  Description of Artificial Sequence: Synthetic oligonucleotide
acauaauuuuucacaaaaauu

SEQ ID NO: 19745 - RNA, 21 nt, Artificial Sequence
  Description of Artificial Sequence: Synthetic oligonucleotide
cauaauuuuucacaaaauauu

SEQ ID NO: 19746 - RNA, 21 nt, Artificial Sequence
  Description of Artificial Sequence: Synthetic oligonucleotide
auaauuuuucacaaaauuauu

SEQ ID NO: 19747 - RNA, 21 nt, Artificial Sequence
  Description of Artificial Sequence: Synthetic oligonucleotide
uaauuuuucacaaaauuuauu

SEQ ID NO: 19748 - RNA, 21 nt, Artificial Sequence
  Description of Artificial Sequence: Synthetic oligonucleotide
aauuuuucacaaaauuuuauu

SEQ ID NO: 19749 - RNA, 21 nt, Artificial Sequence
  Description of Artificial Sequence: Synthetic oligonucleotide
auuuuucacaaaauuuugauu

SEQ ID NO: 19750 - RNA, 21 nt, Artificial Sequence
  Description of Artificial Sequence: Synthetic oligonucleotide
uuuuucacaaaauuuuggauu

SEQ ID NO: 19751 - RNA, 21 nt, Artificial Sequence
  Description of Artificial Sequence: Synthetic oligonucleotide
uuuucacaaaauuuugggauu

SEQ ID NO: 19752 - RNA, 21 nt, Artificial Sequence
  Description of Artificial Sequence: Synthetic oligonucleotide
uuucacaaaauuuugggcauu

SEQ ID NO: 19753 - RNA, 21 nt, Artificial Sequence
  Description of Artificial Sequence: Synthetic oligonucleotide
uucacaaaauuuugggccauu

SEQ ID NO: 19754 - RNA, 21 nt, Artificial Sequence
  Description of Artificial Sequence: Synthetic oligonucleotide
ucacaaaauuuugggcccauu

SEQ ID NO: 19755 - RNA, 21 nt, Artificial Sequence
  Description of Artificial Sequence: Synthetic oligonucleotide
cacaaaauuuugggcccaauu

SEQ ID NO: 19756 - RNA, 21 nt, Artificial Sequence
  Description of Artificial Sequence: Synthetic oligonucleotide
acaaaauuuugggcccaaauu

SEQ ID NO: 19757 - RNA, 21 nt, Artificial Sequence
  Description of Artificial Sequence: Synthetic oligonucleotide
caaaauuuugggcccaauauu

SEQ ID NO: 19758 - RNA, 21 nt, Artificial Sequence
  Description of Artificial Sequence: Synthetic oligonucleotide
aaaauuuugggcccaauuauu

SEQ ID NO: 19759 - RNA, 21 nt, Artificial Sequence
  Description of Artificial Sequence: Synthetic oligonucleotide
aaauuuugggcccaauucauu

SEQ ID NO: 19760 - RNA, 21 nt, Artificial Sequence
  Description of Artificial Sequence: Synthetic oligonucleotide
aauuuugggcccaauuccauu

SEQ ID NO: 19761 - RNA, 21 nt, Artificial Sequence
  Description of Artificial Sequence: Synthetic oligonucleotide
auuuugggcccaauucccauu

SEQ ID NO: 19762 - RNA, 21 nt, Artificial Sequence
  Description of Artificial Sequence: Synthetic oligonucleotide
uuuugggcccaauuccccauu

SEQ ID NO: 19763 - RNA, 21 nt, Artificial Sequence
  Description of Artificial Sequence: Synthetic oligonucleotide
uuugggcccaauuccccuauu

SEQ ID NO: 19764 - RNA, 21 nt, Artificial Sequence
  Description of Artificial Sequence: Synthetic oligonucleotide
uugggcccaauuccccuaauu

SEQ ID NO: 19765 - RNA, 21 nt, Artificial Sequence
  Description of Artificial Sequence: Synthetic oligonucleotide
ugggcccaauuccccuaaauu

SEQ ID NO: 19766 - RNA, 21 nt, Artificial Sequence
  Description of Artificial Sequence: Synthetic oligonucleotide
gggcccaauuccccuaaaauu

SEQ ID NO: 19767 - RNA, 21 nt, Artificial Sequence
  Description of Artificial Sequence: Synthetic oligonucleotide
ggcccaauuccccuaaaaauu

SEQ ID NO: 19768 - RNA, 21 nt, Artificial Sequence
  Description of Artificial Sequence: Synthetic oligonucleotide
gcccaauuccccuaaaagauu

SEQ ID NO: 19769 - RNA, 21 nt, Artificial Sequence
  Description of Artificial Sequence: Synthetic oligonucleotide
cccaauuccccuaaaagaauu

SEQ ID NO: 19770 - RNA, 21 nt, Artificial Sequence
  Description of Artificial Sequence: Synthetic oligonucleotide
ccaauuccccuaaaagaaauu

SEQ ID NO: 19771 - RNA, 21 nt, Artificial Sequence
  Description of Artificial Sequence: Synthetic oligonucleotide
caauuccccuaaaagaauauu

SEQ ID NO: 19772 - RNA, 21 nt, Artificial Sequence
  Description of Artificial Sequence: Synthetic oligonucleotide
aauuccccuaaaagaauuauu

SEQ ID NO: 19773 - RNA, 21 nt, Artificial Sequence
  Description of Artificial Sequence: Synthetic oligonucleotide
auuccccuaaaagaauugauu

SEQ ID NO: 19774 - RNA, 21 nt, Artificial Sequence
  Description of Artificial Sequence: Synthetic oligonucleotide
uuccccuaaaagaauugaauu

SEQ ID NO: 19775 - RNA, 21 nt, Artificial Sequence
  Description of Artificial Sequence: Synthetic oligonucleotide
uccccuaaaagaauugagauu

SEQ ID NO: 19776 - RNA, 21 nt, Artificial Sequence
  Description of Artificial Sequence: Synthetic oligonucleotide
ccccuaaaagaauugaggauu

SEQ ID NO: 19777 - RNA, 21 nt, Artificial Sequence
  Description of Artificial Sequence: Synthetic oligonucleotide
cccuaaaagaauugaggaauu

SEQ ID NO: 19778 - RNA, 21 nt, Artificial Sequence
  Description of Artificial Sequence: Synthetic oligonucleotide
ccuaaaagaauugaggauauu

SEQ ID NO: 19779 - RNA, 21 nt, Artificial Sequence
  Description of Artificial Sequence: Synthetic oligonucleotide
cuaaaagaauugaggauuauu

SEQ ID NO: 19780 - RNA, 21 nt, Artificial Sequence
  Description of Artificial Sequence: Synthetic oligonucleotide
uaaaagaauugaggauuaauu

SEQ ID NO: 19781 - RNA, 21 nt, Artificial Sequence
  Description of Artificial Sequence: Synthetic oligonucleotide
aaaagaauugaggauuagauu

SEQ ID NO: 19782 - RNA, 21 nt, Artificial Sequence
  Description of Artificial Sequence: Synthetic oligonucleotide
aaagaauugaggauuaggauu

SEQ ID NO: 19783 - RNA, 21 nt, Artificial Sequence
  Description of Artificial Sequence: Synthetic oligonucleotide
aagaauugaggauuagggauu

SEQ ID NO: 19784 - RNA, 21 nt, Artificial Sequence
  Description of Artificial Sequence: Synthetic oligonucleotide
agaauugaggauuagggaauu

SEQ ID NO: 19785 - RNA, 21 nt, Artificial Sequence
  Description of Artificial Sequence: Synthetic oligonucleotide
gaauugaggauuagggagauu

SEQ ID NO: 19786 - RNA, 21 nt, Artificial Sequence
  Description of Artificial Sequence: Synthetic oligonucleotide
aauugaggauuagggagaauu

SEQ ID NO: 19787 - RNA, 21 nt, Artificial Sequence
  Description of Artificial Sequence: Synthetic oligonucleotide
auugaggauuagggagaaauu

SEQ ID NO: 19788 - RNA, 21 nt, Artificial Sequence
  Description of Artificial Sequence: Synthetic oligonucleotide
uugaggauuagggagaaaauu

SEQ ID NO: 19789 - RNA, 21 nt, Artificial Sequence
  Description of Artificial Sequence: Synthetic oligonucleotide
ugaggauuagggagaaagauu

SEQ ID NO: 19790 - RNA, 21 nt, Artificial Sequence
  Description of Artificial Sequence: Synthetic oligonucleotide
gaggauuagggagaaaggauu

SEQ ID NO: 19791 - RNA, 21 nt, Artificial Sequence
  Description of Artificial Sequence: Synthetic oligonucleotide
aggauuagggagaaaggaauu

SEQ ID NO: 19792 - RNA, 21 nt, Artificial Sequence
  Description of Artificial Sequence: Synthetic oligonucleotide
ggauuagggagaaaggagauu

SEQ ID NO: 19793 - RNA, 21 nt, Artificial Sequence
  Description of Artificial Sequence: Synthetic oligonucleotide
gauuagggagaaaggagaauu

SEQ ID NO: 19794 - RNA, 21 nt, Artificial Sequence
  Description of Artificial Sequence: Synthetic oligonucleotide
auuagggagaaaggagacauu

SEQ ID NO: 19795 - RNA, 21 nt, Artificial Sequence
  Description of Artificial Sequence: Synthetic oligonucleotide
uuagggagaaaggagacaauu

SEQ ID NO: 19796 - RNA, 21 nt, Artificial Sequence
  Description of Artificial Sequence: Synthetic oligonucleotide
uagggagaaaggagacaaauu

SEQ ID NO: 19797 - RNA, 21 nt, Artificial Sequence
  Description of Artificial Sequence: Synthetic oligonucleotide
agggagaaaggagacaacauu

SEQ ID NO: 19798 - RNA, 21 nt, Artificial Sequence
  Description of Artificial Sequence: Synthetic oligonucleotide
gggagaaaggagacaacuauu

SEQ ID NO: 19799 - RNA, 21 nt, Artificial Sequence
  Description of Artificial Sequence: Synthetic oligonucleotide
ggagaaaggagacaacucauu

SEQ ID NO: 19800 - RNA, 21 nt, Artificial Sequence
  Description of Artificial Sequence: Synthetic oligonucleotide
gagaaaggagacaacucaauu

SEQ ID NO: 19801 - RNA, 21 nt, Artificial Sequence
  Description of Artificial Sequence: Synthetic oligonucleotide
agaaaggagacaacucaaauu

SEQ ID NO: 19802 - RNA, 21 nt, Artificial Sequence
  Description of Artificial Sequence: Synthetic oligonucleotide
gaaaggagacaacucaaaauu

SEQ ID NO: 19803 - RNA, 21 nt, Artificial Sequence
  Description of Artificial Sequence: Synthetic oligonucleotide
aaaggagacaacucaaagauu

SEQ ID NO: 19804 - RNA, 21 nt, Artificial Sequence
  Description of Artificial Sequence: Synthetic oligonucleotide
aaggagacaacucaaaguauu

SEQ ID NO: 19805 - RNA, 21 nt, Artificial Sequence
  Description of Artificial Sequence: Synthetic oligonucleotide
aggagacaacucaaagucauu

SEQ ID NO: 19806 - RNA, 21 nt, Artificial Sequence
  Description of Artificial Sequence: Synthetic oligonucleotide
ggagacaacucaaagucaauu

SEQ ID NO: 19807 - RNA, 21 nt, Artificial Sequence
  Description of Artificial Sequence: Synthetic oligonucleotide
gagacaacucaaagucauauu

SEQ ID NO: 19808 - RNA, 21 nt, Artificial Sequence
  Description of Artificial Sequence: Synthetic oligonucleotide
agacaacucaaagucaucauu

SEQ ID NO: 19809 - RNA, 21 nt, Artificial Sequence
  Description of Artificial Sequence: Synthetic oligonucleotide
gacaacucaaagucauccauu

SEQ ID NO: 19810 - RNA, 21 nt, Artificial Sequence
  Description of Artificial Sequence: Synthetic oligonucleotide
acaacucaaagucaucccauu

SEQ ID NO: 19811 - RNA, 21 nt, Artificial Sequence
  Description of Artificial Sequence: Synthetic oligonucleotide
caacucaaagucaucccaauu

SEQ ID NO: 19812 - RNA, 21 nt, Artificial Sequence
  Description of Artificial Sequence: Synthetic oligonucleotide
aacucaaagucaucccauauu

SEQ ID NO: 19813 - RNA, 21 nt, Artificial Sequence
  Description of Artificial Sequence: Synthetic oligonucleotide
acucaaagucaucccauuauu

SEQ ID NO: 19814 - RNA, 21 nt, Artificial Sequence
  Description of Artificial Sequence: Synthetic oligonucleotide
cucaaagucaucccauuaauu

SEQ ID NO: 19815 - RNA, 21 nt, Artificial Sequence
  Description of Artificial Sequence: Synthetic oligonucleotide
ucaaagucaucccauuaaauu

SEQ ID NO: 19816 - RNA, 21 nt, Artificial Sequence
  Description of Artificial Sequence: Synthetic oligonucleotide
caaagucaucccauuaagauu

SEQ ID NO: 19817 - RNA, 21 nt, Artificial Sequence
  Description of Artificial Sequence: Synthetic oligonucleotide
aaagucaucccauuaaguauu

SEQ ID NO: 19818 - RNA, 21 nt, Artificial Sequence
  Description of Artificial Sequence: Synthetic oligonucleotide
aagucaucccauuaagugauu

SEQ ID NO: 19819 - RNA, 21 nt, Artificial Sequence
  Description of Artificial Sequence: Synthetic oligonucleotide
agucaucccauuaagugcauu

SEQ ID NO: 19820 - RNA, 21 nt, Artificial Sequence
  Description of Artificial Sequence: Synthetic oligonucleotide
gucaucccauuaagugcaauu

SEQ ID NO: 19821 - RNA, 21 nt, Artificial Sequence
  Description of Artificial Sequence: Synthetic oligonucleotide
ucaucccauuaagugcagauu

SEQ ID NO: 19822 - RNA, 21 nt, Artificial Sequence
  Description of Artificial Sequence: Synthetic oligonucleotide
caucccauuaagugcaguauu

SEQ ID NO: 19823 - RNA, 21 nt, Artificial Sequence
  Description of Artificial Sequence: Synthetic oligonucleotide
aucccauuaagugcaguuauu

SEQ ID NO: 19824 - RNA, 21 nt, Artificial Sequence
  Description of Artificial Sequence: Synthetic oligonucleotide
ucccauuaagugcaguuuauu

SEQ ID NO: 19825 - RNA, 21 nt, Artificial Sequence
  Description of Artificial Sequence: Synthetic oligonucleotide
cccauuaagugcaguuucauu

SEQ ID NO: 19826 - RNA, 21 nt, Artificial Sequence
  Description of Artificial Sequence: Synthetic oligonucleotide
ccauuaagugcaguuucuauu

SEQ ID NO: 19827 - RNA, 21 nt, Artificial Sequence
  Description of Artificial Sequence: Synthetic oligonucleotide
cauuaagugcaguuucuuauu

SEQ ID NO: 19828 - RNA, 21 nt, Artificial Sequence
  Description of Artificial Sequence: Synthetic oligonucleotide
auuaagugcaguuucuuuauu

SEQ ID NO: 19829 - RNA, 21 nt, Artificial Sequence
  Description of Artificial Sequence: Synthetic oligonucleotide
uuaagugcaguuucuuugauu

SEQ ID NO: 19830 - RNA, 21 nt, Artificial Sequence
  Description of Artificial Sequence: Synthetic oligonucleotide
uaagugcaguuucuuugaauu

SEQ ID NO: 19831 - RNA, 21 nt, Artificial Sequence
  Description of Artificial Sequence: Synthetic oligonucleotide
aagugcaguuucuuugaaauu

SEQ ID NO: 19832 - RNA, 21 nt, Artificial Sequence
  Description of Artificial Sequence: Synthetic oligonucleotide
agugcaguuucuuugaauauu

SEQ ID NO: 19833 - RNA, 21 nt, Artificial Sequence
  Description of Artificial Sequence: Synthetic oligonucleotide
gugcaguuucuuugaaucauu

SEQ ID NO: 19834 - RNA, 21 nt, Artificial Sequence
  Description of Artificial Sequence: Synthetic oligonucleotide
ugcaguuucuuugaaucuauu

SEQ ID NO: 19835 - RNA, 21 nt, Artificial Sequence
  Description of Artificial Sequence: Synthetic oligonucleotide
gcaguuucuuugaaucuuauu

SEQ ID NO: 19836 - RNA, 21 nt, Artificial Sequence
  Description of Artificial Sequence: Synthetic oligonucleotide
caguuucuuugaaucuucauu

SEQ ID NO: 19837 - RNA, 21 nt, Artificial Sequence
  Description of Artificial Sequence: Synthetic oligonucleotide
aguuucuuugaaucuucuauu

SEQ ID NO: 19838 - RNA, 21 nt, Artificial Sequence
  Description of Artificial Sequence: Synthetic oligonucleotide
guuucuuugaaucuucugauu

SEQ ID NO: 19839 - RNA, 21 nt, Artificial Sequence
  Description of Artificial Sequence: Synthetic oligonucleotide
uuucuuugaaucuucugcauu

SEQ ID NO: 19840 - RNA, 21 nt, Artificial Sequence
  Description of Artificial Sequence: Synthetic oligonucleotide
uucuuugaaucuucugcuauu

SEQ ID NO: 19841 - RNA, 21 nt, Artificial Sequence
  Description of Artificial Sequence: Synthetic oligonucleotide
ucuuugaaucuucugcuuauu

SEQ ID NO: 19842 - RNA, 21 nt, Artificial Sequence
  Description of Artificial Sequence: Synthetic oligonucleotide
cuuugaaucuucugcuuuauu

SEQ ID NO: 19843 - RNA, 21 nt, Artificial Sequence
  Description of Artificial Sequence: Synthetic oligonucleotide
uuugaaucuucugcuuuaauu

SEQ ID NO: 19844 - RNA, 21 nt, Artificial Sequence
  Description of Artificial Sequence: Synthetic oligonucleotide
uugaaucuucugcuuuauauu

SEQ ID NO: 19845 - RNA, 21 nt, Artificial Sequence
  Description of Artificial Sequence: Synthetic oligonucleotide
ugaaucuucugcuuuaucauu

SEQ ID NO: 19846 - RNA, 21 nt, Artificial Sequence
  Description of Artificial Sequence: Synthetic oligonucleotide
gaaucuucugcuuuaucuauu

SEQ ID NO: 19847 - RNA, 21 nt, Artificial Sequence
  Description of Artificial Sequence: Synthetic oligonucleotide
aaucuucugcuuuaucuuauu

SEQ ID NO: 19848 - RNA, 21 nt, Artificial Sequence
  Description of Artificial Sequence: Synthetic oligonucleotide
aucuucugcuuuaucuuuauu

SEQ ID NO: 19849 - RNA, 21 nt, Artificial Sequence
  Description of Artificial Sequence: Synthetic oligonucleotide
ucuucugcuuuaucuuuaauu

SEQ ID NO: 19850 - RNA, 21 nt, Artificial Sequence
  Description of Artificial Sequence: Synthetic oligonucleotide
cuucugcuuuaucuuuaaauu

SEQ ID NO: 19851 - RNA, 21 nt, Artificial Sequence
  Description of Artificial Sequence: Synthetic oligonucleotide
uucugcuuuaucuuuaaaauu

SEQ ID NO: 19852 - RNA, 21 nt, Artificial Sequence
  Description of Artificial Sequence: Synthetic oligonucleotide
ucugcuuuaucuuuaaaaauu

SEQ ID NO: 19853 - RNA, 21 nt, Artificial Sequence
  Description of Artificial Sequence: Synthetic oligonucleotide
cugcuuuaucuuuaaaaaauu

SEQ ID NO: 19854 - RNA, 21 nt, Artificial Sequence
  Description of Artificial Sequence: Synthetic oligonucleotide
ugcuuuaucuuuaaaaauauu

SEQ ID NO: 19855 - RNA, 21 nt, Artificial Sequence
  Description of Artificial Sequence: Synthetic oligonucleotide
gcuuuaucuuuaaaaauuauu

SEQ ID NO: 19856 - RNA, 21 nt, Artificial Sequence
  Description of Artificial Sequence: Synthetic oligonucleotide
cuuuaucuuuaaaaauuuauu

SEQ ID NO: 19857 - RNA, 21 nt, Artificial Sequence
  Description of Artificial Sequence: Synthetic oligonucleotide
uuuaucuuuaaaaauuugauu

SEQ ID NO: 19858 - RNA, 21 nt, Artificial Sequence
  Description of Artificial Sequence: Synthetic oligonucleotide
uuaucuuuaaaaauuuguauu

SEQ ID NO: 19859 - RNA, 21 nt, Artificial Sequence
  Description of Artificial Sequence: Synthetic oligonucleotide
uaucuuuaaaaauuuguaauu

SEQ ID NO: 19860 - RNA, 21 nt, Artificial Sequence
  Description of Artificial Sequence: Synthetic oligonucleotide
aucuuuaaaaauuuguauauu

SEQ ID NO: 19861 - RNA, 21 nt, Artificial Sequence
  Description of Artificial Sequence: Synthetic oligonucleotide
ucuuuaaaaauuuguauaauu

SEQ ID NO: 19862 - RNA, 21 nt, Artificial Sequence
  Description of Artificial Sequence: Synthetic oligonucleotide
cuuuaaaaauuuguauaaauu

SEQ ID NO: 19863 - RNA, 21 nt, Artificial Sequence
  Description of Artificial Sequence: Synthetic oligonucleotide
uuuaaaaauuuguauaauauu

SEQ ID NO: 19864 - RNA, 21 nt, Artificial Sequence
  Description of Artificial Sequence: Synthetic oligonucleotide
uuaaaaauuuguauaauuauu

SEQ ID NO: 19865 - RNA, 21 nt, Artificial Sequence
  Description of Artificial Sequence: Synthetic oligonucleotide
uaaaaauuuguauaauuuauu

SEQ ID NO: 19866 - RNA, 21 nt, Artificial Sequence
  Description of Artificial Sequence: Synthetic oligonucleotide
aaaaauuuguauaauuuaauu

SEQ ID NO: 19867 - RNA, 21 nt, Artificial Sequence
  Description of Artificial Sequence: Synthetic oligonucleotide
aaaauuuguauaauuuauauu

SEQ ID NO: 19868 - RNA, 21 nt, Artificial Sequence
  Description of Artificial Sequence: Synthetic oligonucleotide
aaauuuguauaauuuauaauu

SEQ ID NO: 19869 - RNA, 21 nt, Artificial Sequence
  Description of Artificial Sequence: Synthetic oligonucleotide
aauuuguauaauuuauauauu

SEQ ID NO: 19870 - RNA, 21 nt, Artificial Sequence
  Description of Artificial Sequence: Synthetic oligonucleotide
auuuguauaauuuauauaauu

SEQ ID NO: 19871 - RNA, 21 nt, Artificial Sequence
  Description of Artificial Sequence: Synthetic oligonucleotide
uuuguauaauuuauauauauu

SEQ ID NO: 19872 - RNA, 21 nt, Artificial Sequence
  Description of Artificial Sequence: Synthetic oligonucleotide
uuguauaauuuauauauuauu

SEQ ID NO: 19873 - RNA, 21 nt, Artificial Sequence
  Description of Artificial Sequence: Synthetic oligonucleotide
uguauaauuuauauauuuauu

SEQ ID NO: 19874 - RNA, 21 nt, Artificial Sequence
  Description of Artificial Sequence: Synthetic oligonucleotide
guauaauuuauauauuuuauu

SEQ ID NO: 19875 - RNA, 21 nt, Artificial Sequence
  Description of Artificial Sequence: Synthetic oligonucleotide
uauaauuuauauauuuuaauu

SEQ ID NO: 19876 - RNA, 21 nt, Artificial Sequence
  Description of Artificial Sequence: Synthetic oligonucleotide
auaauuuauauauuuuauauu

SEQ ID NO: 19877 - RNA, 21 nt, Artificial Sequence
  Description of Artificial Sequence: Synthetic oligonucleotide
uaauuuauauauuuuauuauu

SEQ ID NO: 19878 - RNA, 21 nt, Artificial Sequence
  Description of Artificial Sequence: Synthetic oligonucleotide
aauuuauauauuuuauucauu

SEQ ID NO: 19879 - RNA, 21 nt, Artificial Sequence
  Description of Artificial Sequence: Synthetic oligonucleotide
auuuauauauuuuauucuauu

SEQ ID NO: 19880 - RNA, 21 nt, Artificial Sequence
  Description of Artificial Sequence: Synthetic oligonucleotide
uuuauauauuuuauucuaauu

SEQ ID NO: 19881 - RNA, 21 nt, Artificial Sequence
  Description of Artificial Sequence: Synthetic oligonucleotide
uuauauauuuuauucuauauu

SEQ ID NO: 19882 - RNA, 21 nt, Artificial Sequence
  Description of Artificial Sequence: Synthetic oligonucleotide
uauauauuuuauucuaugauu

SEQ ID NO: 19883 - RNA, 21 nt, Artificial Sequence
  Description of Artificial Sequence: Synthetic oligonucleotide
auauauuuuauucuauguauu

SEQ ID NO: 19884 - RNA, 21 nt, Artificial Sequence
  Description of Artificial Sequence: Synthetic oligonucleotide
uauauuuuauucuaugugauu

SEQ ID NO: 19885 - RNA, 21 nt, Artificial Sequence
  Description of Artificial Sequence: Synthetic oligonucleotide
auauuuuauucuauguguauu

SEQ ID NO: 19886 - RNA, 21 nt, Artificial Sequence
  Description of Artificial Sequence: Synthetic oligonucleotide
uauuuuauucuauguguuauu

SEQ ID NO: 19887 - RNA, 21 nt, Artificial Sequence
  Description of Artificial Sequence: Synthetic oligonucleotide
auuuuauucuauguguucauu

SEQ ID NO: 19888 - RNA, 21 nt, Artificial Sequence
  Description of Artificial Sequence: Synthetic oligonucleotide
uuuuauucuauguguuccauu

SEQ ID NO: 19889 - RNA, 21 nt, Artificial Sequence
  Description of Artificial Sequence: Synthetic oligonucleotide
uuuauucuauguguuccaauu

SEQ ID NO: 19890 - RNA, 21 nt, Artificial Sequence
  Description of Artificial Sequence: Synthetic oligonucleotide
uuauucuauguguuccauauu

SEQ ID NO: 19891 - RNA, 21 nt, Artificial Sequence
  Description of Artificial Sequence: Synthetic oligonucleotide
uauucuauguguuccauaauu

SEQ ID NO: 19892 - RNA, 21 nt, Artificial Sequence
  Description of Artificial Sequence: Synthetic oligonucleotide
auucuauguguuccauagauu

SEQ ID NO: 19893 - RNA, 21 nt, Artificial Sequence
  Description of Artificial Sequence: Synthetic oligonucleotide
uucuauguguuccauagaauu

SEQ ID NO: 19894 - RNA, 21 nt, Artificial Sequence
  Description of Artificial Sequence: Synthetic oligonucleotide
ucuauguguuccauagauauu

SEQ ID NO: 19895 - RNA, 21 nt, Artificial Sequence
  Description of Artificial Sequence: Synthetic oligonucleotide
cuauguguuccauagauaauu

SEQ ID NO: 19896 - RNA, 21 nt, Artificial Sequence
  Description of Artificial Sequence: Synthetic oligonucleotide
uauguguuccauagauauauu

SEQ ID NO: 19897 - RNA, 21 nt, Artificial Sequence
  Description of Artificial Sequence: Synthetic oligonucleotide
auguguuccauagauaucauu

SEQ ID NO: 19898 - RNA, 21 nt, Artificial Sequence
  Description of Artificial Sequence: Synthetic oligonucleotide
uguguuccauagauaucuauu

SEQ ID NO: 19899 - RNA, 21 nt, Artificial Sequence
  Description of Artificial Sequence: Synthetic oligonucleotide
guguuccauagauaucuuauu

SEQ ID NO: 19900 - RNA, 21 nt, Artificial Sequence
  Description of Artificial Sequence: Synthetic oligonucleotide
uguuccauagauaucuuaauu

SEQ ID NO: 19901 - RNA, 21 nt, Artificial Sequence
  Description of Artificial Sequence: Synthetic oligonucleotide
guuccauagauaucuuaaauu

SEQ ID NO: 19902 - RNA, 21 nt, Artificial Sequence
  Description of Artificial Sequence: Synthetic oligonucleotide
uuccauagauaucuuaauauu

SEQ ID NO: 19903 - RNA, 21 nt, Artificial Sequence
  Description of Artificial Sequence: Synthetic oligonucleotide
uccauagauaucuuaaugauu

SEQ ID NO: 19904 - RNA, 21 nt, Artificial Sequence
  Description of Artificial Sequence: Synthetic oligonucleotide
ccauagauaucuuaauguauu

SEQ ID NO: 19905 - RNA, 21 nt, Artificial Sequence
  Description of Artificial Sequence: Synthetic oligonucleotide
cauagauaucuuaauguaauu

SEQ ID NO: 19906 - RNA, 21 nt, Artificial Sequence
  Description of Artificial Sequence: Synthetic oligonucleotide
auagauaucuuaauguaaauu

SEQ ID NO: 19907 - RNA, 21 nt, Artificial Sequence
  Description of Artificial Sequence: Synthetic oligonucleotide
uagauaucuuaauguaaaauu

SEQ ID NO: 19908 - RNA, 21 nt, Artificial Sequence
  Description of Artificial Sequence: Synthetic oligonucleotide
agauaucuuaauguaaaaauu

SEQ ID NO: 19909 - RNA, 21 nt, Artificial Sequence
  Description of Artificial Sequence: Synthetic oligonucleotide
gauaucuuaauguaaaauauu

SEQ ID NO: 19910 - RNA, 21 nt, Artificial Sequence
  Description of Artificial Sequence: Synthetic oligonucleotide
auaucuuaauguaaaauuauu

SEQ ID NO: 19911 - RNA, 21 nt, Artificial Sequence
  Description of Artificial Sequence: Synthetic oligonucleotide
uaucuuaauguaaaauuaauu

SEQ ID NO: 19912 - RNA, 21 nt, Artificial Sequence
  Description of Artificial Sequence: Synthetic oligonucleotide
aucuuaauguaaaauuagauu

SEQ ID NO: 19913 - RNA, 21 nt, Artificial Sequence
  Description of Artificial Sequence: Synthetic oligonucleotide
ucuuaauguaaaauuaguauu

SEQ ID NO: 19914 - RNA, 21 nt, Artificial Sequence
  Description of Artificial Sequence: Synthetic oligonucleotide
cuuaauguaaaauuagucauu

SEQ ID NO: 19915 - RNA, 21 nt, Artificial Sequence
  Description of Artificial Sequence: Synthetic oligonucleotide
uuaauguaaaauuagucaauu

SEQ ID NO: 19916 - RNA, 21 nt, Artificial Sequence
  Description of Artificial Sequence: Synthetic oligonucleotide
uaauguaaaauuagucauauu

SEQ ID NO: 19917 - RNA, 21 nt, Artificial Sequence
  Description of Artificial Sequence: Synthetic oligonucleotide
aauguaaaauuagucauuauu

SEQ ID NO: 19918 - RNA, 21 nt, Artificial Sequence
  Description of Artificial Sequence: Synthetic oligonucleotide
auguaaaauuagucauuuauu

SEQ ID NO: 19919 - RNA, 21 nt, Artificial Sequence
  Description of Artificial Sequence: Synthetic oligonucleotide
uguaaaauuagucauuuaauu

SEQ ID NO: 19920 - RNA, 21 nt, Artificial Sequence
  Description of Artificial Sequence: Synthetic oligonucleotide
guaaaauuagucauuuaaauu

SEQ ID NO: 19921 - RNA, 21 nt, Artificial Sequence
  Description of Artificial Sequence: Synthetic oligonucleotide
uaaaauuagucauuuaaaauu

SEQ ID NO: 19922 - RNA, 21 nt, Artificial Sequence
  Description of Artificial Sequence: Synthetic oligonucleotide
aaaauuagucauuuaaauauu

SEQ ID NO: 19923 - RNA, 21 nt, Artificial Sequence
  Description of Artificial Sequence: Synthetic oligonucleotide
aaauuagucauuuaaauuauu

SEQ ID NO: 19924 - RNA, 21 nt, Artificial Sequence
  Description of Artificial Sequence: Synthetic oligonucleotide
aauuagucauuuaaauuaauu

SEQ ID NO: 19925 - RNA, 21 nt, Artificial Sequence
  Description of Artificial Sequence: Synthetic oligonucleotide
auuagucauuuaaauuacauu

SEQ ID NO: 19926 - RNA, 21 nt, Artificial Sequence
  Description of Artificial Sequence: Synthetic oligonucleotide
uuagucauuuaaauuacaauu

SEQ ID NO: 19927 - RNA, 21 nt, Artificial Sequence
  Description of Artificial Sequence: Synthetic oligonucleotide
uagucauuuaaauuacacauu

SEQ ID NO: 19928 - RNA, 21 nt, Artificial Sequence
  Description of Artificial Sequence: Synthetic oligonucleotide
agucauuuaaauuacacuauu

SEQ ID NO: 19929 - RNA, 21 nt, Artificial Sequence
  Description of Artificial Sequence: Synthetic oligonucleotide
gucauuuaaauuacacugauu

SEQ ID NO: 19930 - RNA, 21 nt, Artificial Sequence
  Description of Artificial Sequence: Synthetic oligonucleotide
ucauuuaaauuacacuguauu

SEQ ID NO: 19931 - RNA, 21 nt, Artificial Sequence
  Description of Artificial Sequence: Synthetic oligonucleotide
cauuuaaauuacacugucauu

SEQ ID NO: 19932 - RNA, 21 nt, Artificial Sequence
  Description of Artificial Sequence: Synthetic oligonucleotide
auuuaaauuacacugucaauu

SEQ ID NO: 19933 - RNA, 21 nt, Artificial Sequence
  Description of Artificial Sequence: Synthetic oligonucleotide
uuuaaauuacacugucaaauu

SEQ ID NO: 19934 - RNA, 21 nt, Artificial Sequence
  Description of Artificial Sequence: Synthetic oligonucleotide
uuaaauuacacugucaauauu

SEQ ID NO: 19935 - RNA, 21 nt, Artificial Sequence
  Description of Artificial Sequence: Synthetic oligonucleotide
uaaauuacacugucaauuauu

SEQ ID NO: 19936 - RNA, 21 nt, Artificial Sequence
  Description of Artificial Sequence: Synthetic oligonucleotide
aaauuacacugucaauuaauu

SEQ ID NO: 19937 - RNA, 21 nt, Artificial Sequence
  Description of Artificial Sequence: Synthetic oligonucleotide
aauuacacugucaauuaaauu

SEQ ID NO: 19938 - RNA, 21 nt, Artificial Sequence
  Description of Artificial Sequence: Synthetic oligonucleotide
auuacacugucaauuaaaauu

SEQ ID NO: 19939 - RNA, 21 nt, Artificial Sequence
  Description of Artificial Sequence: Synthetic oligonucleotide
uuacacugucaauuaaaaauu

SEQ ID NO: 19940 - RNA, 21 nt, Artificial Sequence
  Description of Artificial Sequence: Synthetic oligonucleotide
uacacugucaauuaaaagauu

SEQ ID NO: 19941 - RNA, 21 nt, Artificial Sequence
  Description of Artificial Sequence: Synthetic oligonucleotide
acacugucaauuaaaaguauu

SEQ ID NO: 19942 - RNA, 21 nt, Artificial Sequence
  Description of Artificial Sequence: Synthetic oligonucleotide
cacugucaauuaaaaguaauu

SEQ ID NO: 19943 - RNA, 21 nt, Artificial Sequence
  Description of Artificial Sequence: Synthetic oligonucleotide
acugucaauuaaaaguaaauu

SEQ ID NO: 19944 - RNA, 21 nt, Artificial Sequence
  Description of Artificial Sequence: Synthetic oligonucleotide
cugucaauuaaaaguaauauu

SEQ ID NO: 19945 - RNA, 21 nt, Artificial Sequence
  Description of Artificial Sequence: Synthetic oligonucleotide
ugucaauuaaaaguaaugauu

SEQ ID NO: 19946 - RNA, 21 nt, Artificial Sequence
  Description of Artificial Sequence: Synthetic oligonucleotide
gucaauuaaaaguaauggauu

SEQ ID NO: 19947 - RNA, 21 nt, Artificial Sequence
  Description of Artificial Sequence: Synthetic oligonucleotide
ucaauuaaaaguaaugggauu

SEQ ID NO: 19948 - RNA, 21 nt, Artificial Sequence
  Description of Artificial Sequence: Synthetic oligonucleotide
caauuaaaaguaaugggcauu

SEQ ID NO: 19949 - RNA, 21 nt, Artificial Sequence
  Description of Artificial Sequence: Synthetic oligonucleotide
aauuaaaaguaaugggcaauu

SEQ ID NO: 19950 - RNA, 21 nt, Artificial Sequence
  Description of Artificial Sequence: Synthetic oligonucleotide
auuaaaaguaaugggcaaauu

SEQ ID NO: 19951 - RNA, 21 nt, Artificial Sequence
  Description of Artificial Sequence: Synthetic oligonucleotide
uuaaaaguaaugggcaagauu

SEQ ID NO: 19952 - RNA, 21 nt, Artificial Sequence
  Description of Artificial Sequence: Synthetic oligonucleotide
uaaaaguaaugggcaagaauu

SEQ ID NO: 19953 - RNA, 21 nt, Artificial Sequence
  Description of Artificial Sequence: Synthetic oligonucleotide
aaaaguaaugggcaagagauu

SEQ ID NO: 19954 - RNA, 21 nt, Artificial Sequence
  Description of Artificial Sequence: Synthetic oligonucleotide
aaaguaaugggcaagagaauu

SEQ ID NO: 19955 - RNA, 21 nt, Artificial Sequence
  Description of Artificial Sequence: Synthetic oligonucleotide
aaguaaugggcaagagauauu

SEQ ID NO: 19956 - RNA, 21 nt, Artificial Sequence
  Description of Artificial Sequence: Synthetic oligonucleotide
aguaaugggcaagagauuauu

SEQ ID NO: 19957 - RNA, 21 nt, Artificial Sequence
  Description of Artificial Sequence: Synthetic oligonucleotide
guaaugggcaagagauugauu

SEQ ID NO: 19958 - RNA, 21 nt, Artificial Sequence
  Description of Artificial Sequence: Synthetic oligonucleotide
uaaugggcaagagauugcauu

SEQ ID NO: 19959 - RNA, 21 nt, Artificial Sequence
  Description of Artificial Sequence: Synthetic oligonucleotide
aaugggcaagagauugcaauu

SEQ ID NO: 19960 - RNA, 21 nt, Artificial Sequence
  Description of Artificial Sequence: Synthetic oligonucleotide
augggcaagagauugcauauu

SEQ ID NO: 19961 - RNA, 21 nt, Artificial Sequence
  Description of Artificial Sequence: Synthetic oligonucleotide
ugggcaagagauugcaucauu

SEQ ID NO: 19962 - RNA, 21 nt, Artificial Sequence
  Description of Artificial Sequence: Synthetic oligonucleotide
gggcaagagauugcaucaauu

SEQ ID NO: 19963 - RNA, 21 nt, Artificial Sequence
  Description of Artificial Sequence: Synthetic oligonucleotide
ggcaagagauugcaucauauu

SEQ ID NO: 19964 - RNA, 21 nt, Artificial Sequence
  Description of Artificial Sequence: Synthetic oligonucleotide
gcaagagauugcaucauaauu

SEQ ID NO: 19965 - RNA, 21 nt, Artificial Sequence
  Description of Artificial Sequence: Synthetic oligonucleotide
caagagauugcaucauacauu

SEQ ID NO: 19966 - RNA, 21 nt, Artificial Sequence
  Description of Artificial Sequence: Synthetic oligonucleotide
aagagauugcaucauacuauu

SEQ ID NO: 19967 - RNA, 21 nt, Artificial Sequence
  Description of Artificial Sequence: Synthetic oligonucleotide
agagauugcaucauacuaauu

SEQ ID NO: 19968 - RNA, 21 nt, Artificial Sequence
  Description of Artificial Sequence: Synthetic oligonucleotide
gagauugcaucauacuaaauu

SEQ ID NO: 19969 - RNA, 21 nt, Artificial Sequence
  Description of Artificial Sequence: Synthetic oligonucleotide
agauugcaucauacuaauauu

SEQ ID NO: 19970 - RNA, 21 nt, Artificial Sequence
  Description of Artificial Sequence: Synthetic oligonucleotide
gauugcaucauacuaauuauu

SEQ ID NO: 19971 - RNA, 21 nt, Artificial Sequence
  Description of Artificial Sequence: Synthetic oligonucleotide
auugcaucauacuaauuuauu

SEQ ID NO: 19972 - RNA, 21 nt, Artificial Sequence
  Description of Artificial Sequence: Synthetic oligonucleotide
uugcaucauacuaauuuaauu

SEQ ID NO: 19973 - RNA, 21 nt, Artificial Sequence
  Description of Artificial Sequence: Synthetic oligonucleotide
ugcaucauacuaauuuagauu

SEQ ID NO: 19974 - RNA, 21 nt, Artificial Sequence
  Description of Artificial Sequence: Synthetic oligonucleotide
gcaucauacuaauuuaguauu

SEQ ID NO: 19975 - RNA, 21 nt, Artificial Sequence
  Description of Artificial Sequence: Synthetic oligonucleotide
caucauacuaauuuaguaauu

SEQ ID NO: 19976 - RNA, 21 nt, Artificial Sequence
  Description of Artificial Sequence: Synthetic oligonucleotide
aucauacuaauuuaguaaauu

SEQ ID NO: 19977 - RNA, 21 nt, Artificial Sequence
  Description of Artificial Sequence: Synthetic oligonucleotide
ucauacuaauuuaguaagauu

SEQ ID NO: 19978 - RNA, 21 nt, Artificial Sequence
  Description of Artificial Sequence: Synthetic oligonucleotide
cauacuaauuuaguaagaauu

SEQ ID NO: 19979 - RNA, 21 nt, Artificial Sequence
  Description of Artificial Sequence: Synthetic oligonucleotide
auacuaauuuaguaagaaauu

SEQ ID NO: 19980 - RNA, 21 nt, Artificial Sequence
  Description of Artificial Sequence: Synthetic oligonucleotide
uacuaauuuaguaagaacauu

SEQ ID NO: 19981 - RNA, 21 nt, Artificial Sequence
  Description of Artificial Sequence: Synthetic oligonucleotide
acuaauuuaguaagaacgauu

SEQ ID NO: 19982 - RNA, 21 nt, Artificial Sequence
  Description of Artificial Sequence: Synthetic oligonucleotide
cuaauuuaguaagaacguauu

SEQ ID NO: 19983 - RNA, 21 nt, Artificial Sequence
  Description of Artificial Sequence: Synthetic oligonucleotide
uaauuuaguaagaacguuauu

SEQ ID NO: 19984 - RNA, 21 nt, Artificial Sequence
  Description of Artificial Sequence: Synthetic oligonucleotide
aauuuaguaagaacguucauu

SEQ ID NO: 19985 - RNA, 21 nt, Artificial Sequence
  Description of Artificial Sequence: Synthetic oligonucleotide
auuuaguaagaacguuccauu

SEQ ID NO: 19986 - RNA, 21 nt, Artificial Sequence
  Description of Artificial Sequence: Synthetic oligonucleotide
uuuaguaagaacguucccauu

SEQ ID NO: 19987 - RNA, 21 nt, Artificial Sequence
  Description of Artificial Sequence: Synthetic oligonucleotide
uuaguaagaacguucccaauu

SEQ ID NO: 19988 - RNA, 21 nt, Artificial Sequence
  Description of Artificial Sequence: Synthetic oligonucleotide
uaguaagaacguucccaaauu

SEQ ID NO: 19989 - RNA, 21 nt, Artificial Sequence
  Description of Artificial Sequence: Synthetic oligonucleotide
aguaagaacguucccaaaauu

SEQ ID NO: 19990 - RNA, 21 nt, Artificial Sequence
  Description of Artificial Sequence: Synthetic oligonucleotide
guaagaacguucccaaauauu

SEQ ID NO: 19991 - RNA, 21 nt, Artificial Sequence
  Description of Artificial Sequence: Synthetic oligonucleotide
uaagaacguucccaaaugauu

SEQ ID NO: 19992 - RNA, 21 nt, Artificial Sequence
  Description of Artificial Sequence: Synthetic oligonucleotide
aagaacguucccaaauguauu

SEQ ID NO: 19993 - RNA, 21 nt, Artificial Sequence
  Description of Artificial Sequence: Synthetic oligonucleotide
agaacguucccaaauguuauu

SEQ ID NO: 19994 - RNA, 21 nt, Artificial Sequence
  Description of Artificial Sequence: Synthetic oligonucleotide
gaacguucccaaauguugauu

SEQ ID NO: 19995 - RNA, 21 nt, Artificial Sequence
  Description of Artificial Sequence: Synthetic oligonucleotide
aacguucccaaauguuguauu

SEQ ID NO: 19996 - RNA, 21 nt, Artificial Sequence
  Description of Artificial Sequence: Synthetic oligonucleotide
acguucccaaauguuguaauu

SEQ ID NO: 19997 - RNA, 21 nt, Artificial Sequence
  Description of Artificial Sequence: Synthetic oligonucleotide
cguucccaaauguuguaaauu

SEQ ID NO: 19998 - RNA, 21 nt, Artificial Sequence
  Description of Artificial Sequence: Synthetic oligonucleotide
guucccaaauguuguaacauu

SEQ ID NO: 19999 - RNA, 21 nt, Artificial Sequence
  Description of Artificial Sequence: Synthetic oligonucleotide
uucccaaauguuguaacaauu

SEQ ID NO: 20000 - RNA, 21 nt, Artificial Sequence
  Description of Artificial Sequence: Synthetic oligonucleotide
ucccaaauguuguaacaaauu

SEQ ID NO: 20001 - RNA, 21 nt, Artificial Sequence
  Description of Artificial Sequence: Synthetic oligonucleotide
cccaaauguuguaacaauauu

SEQ ID NO: 20002 - RNA, 21 nt, Artificial Sequence
  Description of Artificial Sequence: Synthetic oligonucleotide
ccaaauguuguaacaaugauu

SEQ ID NO: 20003 - RNA, 21 nt, Artificial Sequence
  Description of Artificial Sequence: Synthetic oligonucleotide
caaauguuguaacaauguauu

SEQ ID NO: 20004 - RNA, 21 nt, Artificial Sequence
  Description of Artificial Sequence: Synthetic oligonucleotide
aaauguuguaacaaugugauu

SEQ ID NO: 20005 - RNA, 21 nt, Artificial Sequence
  Description of Artificial Sequence: Synthetic oligonucleotide
aauguuguaacaauguggauu

SEQ ID NO: 20006 - RNA, 21 nt, Artificial Sequence
  Description of Artificial Sequence: Synthetic oligonucleotide
auguuguaacaauguggaauu

SEQ ID NO: 20007 - RNA, 21 nt, Artificial Sequence
  Description of Artificial Sequence: Synthetic oligonucleotide
uguuguaacaauguggauauu

SEQ ID NO: 20008 - RNA, 21 nt, Artificial Sequence
  Description of Artificial Sequence: Synthetic oligonucleotide
guuguaacaauguggaucauu

SEQ ID NO: 20009 - RNA, 21 nt, Artificial Sequence
  Description of Artificial Sequence: Synthetic oligonucleotide
uuguaacaauguggaucaauu

SEQ ID NO: 20010 - RNA, 21 nt, Artificial Sequence
  Description of Artificial Sequence: Synthetic oligonucleotide
uguaacaauguggaucauauu

SEQ ID NO: 20011 - RNA, 21 nt, Artificial Sequence
  Description of Artificial Sequence: Synthetic oligonucleotide
guaacaauguggaucauaauu

SEQ ID NO: 20012 - RNA, 21 nt, Artificial Sequence
  Description of Artificial Sequence: Synthetic oligonucleotide
uaacaauguggaucauacauu

SEQ ID NO: 20013 - RNA, 21 nt, Artificial Sequence
  Description of Artificial Sequence: Synthetic oligonucleotide
aacaauguggaucauacaauu

SEQ ID NO: 20014 - RNA, 21 nt, Artificial Sequence
  Description of Artificial Sequence: Synthetic oligonucleotide
acaauguggaucauacauauu

SEQ ID NO: 20015 - RNA, 21 nt, Artificial Sequence
  Description of Artificial Sequence: Synthetic oligonucleotide
caauguggaucauacaucauu

SEQ ID NO: 20016 - RNA, 21 nt, Artificial Sequence
  Description of Artificial Sequence: Synthetic oligonucleotide
aauguggaucauacaucuauu

SEQ ID NO: 20017 - RNA, 21 nt, Artificial Sequence
  Description of Artificial Sequence: Synthetic oligonucleotide
auguggaucauacaucucauu

SEQ ID NO: 20018 - RNA, 21 nt, Artificial Sequence
  Description of Artificial Sequence: Synthetic oligonucleotide
uguggaucauacaucucuauu

SEQ ID NO: 20019 - RNA, 21 nt, Artificial Sequence
  Description of Artificial Sequence: Synthetic oligonucleotide
guggaucauacaucucugauu

SEQ ID NO: 20020 - RNA, 21 nt, Artificial Sequence
  Description of Artificial Sequence: Synthetic oligonucleotide
uggaucauacaucucuggauu

SEQ ID NO: 20021 - RNA, 21 nt, Artificial Sequence
  Description of Artificial Sequence: Synthetic oligonucleotide
ggaucauacaucucugguauu

SEQ ID NO: 20022 - RNA, 21 nt, Artificial Sequence
  Description of Artificial Sequence: Synthetic oligonucleotide
gaucauacaucucugguuauu

SEQ ID NO: 20023 - RNA, 21 nt, Artificial Sequence
  Description of Artificial Sequence: Synthetic oligonucleotide
aucauacaucucugguuuauu

SEQ ID NO: 20024 - RNA, 21 nt, Artificial Sequence
  Description of Artificial Sequence: Synthetic oligonucleotide
ucauacaucucugguuuuauu

SEQ ID NO: 20025 - RNA, 21 nt, Artificial Sequence
  Description of Artificial Sequence: Synthetic oligonucleotide
cauacaucucugguuuuuauu

SEQ ID NO: 20026 - RNA, 21 nt, Artificial Sequence
  Description of Artificial Sequence: Synthetic oligonucleotide
auacaucucugguuuuuuauu

SEQ ID NO: 20027 - RNA, 21 nt, Artificial Sequence
  Description of Artificial Sequence: Synthetic oligonucleotide
uacaucucugguuuuuuaauu

SEQ ID NO: 20028 - RNA, 21 nt, Artificial Sequence
  Description of Artificial Sequence: Synthetic oligonucleotide
acaucucugguuuuuuaaauu

SEQ ID NO: 20029 - RNA, 21 nt, Artificial Sequence
  Description of Artificial Sequence: Synthetic oligonucleotide
caucucugguuuuuuaaaauu

SEQ ID NO: 20030 - RNA, 21 nt, Artificial Sequence
  Description of Artificial Sequence: Synthetic oligonucleotide
aucucugguuuuuuaaauauu

SEQ ID NO: 20031 - RNA, 21 nt, Artificial Sequence
  Description of Artificial Sequence: Synthetic oligonucleotide
ucucugguuuuuuaaaugauu

SEQ ID NO: 20032 - RNA, 21 nt, Artificial Sequence
  Description of Artificial Sequence: Synthetic oligonucleotide
cucugguuuuuuaaauguauu

SEQ ID NO: 20033 - RNA, 21 nt, Artificial Sequence
  Description of Artificial Sequence: Synthetic oligonucleotide
ucugguuuuuuaaauguaauu

SEQ ID NO: 20034 - RNA, 21 nt, Artificial Sequence
  Description of Artificial Sequence: Synthetic oligonucleotide
cugguuuuuuaaauguauauu

SEQ ID NO: 20035 - RNA, 21 nt, Artificial Sequence
  Description of Artificial Sequence: Synthetic oligonucleotide
ugguuuuuuaaauguauuauu

SEQ ID NO: 20036 - RNA, 21 nt, Artificial Sequence
  Description of Artificial Sequence: Synthetic oligonucleotide
gguuuuuuaaauguauugauu

SEQ ID NO: 20037 - RNA, 21 nt, Artificial Sequence
  Description of Artificial Sequence: Synthetic oligonucleotide
guuuuuuaaauguauugaauu

SEQ ID NO: 20038 - RNA, 21 nt, Artificial Sequence
  Description of Artificial Sequence: Synthetic oligonucleotide
uuuuuuaaauguauugagauu

SEQ ID NO: 20039 - RNA, 21 nt, Artificial Sequence
  Description of Artificial Sequence: Synthetic oligonucleotide
uuuuuaaauguauugaggauu

SEQ ID NO: 20040 - RNA, 21 nt, Artificial Sequence
  Description of Artificial Sequence: Synthetic oligonucleotide
uuuuaaauguauugaggcauu

SEQ ID NO: 20041 - RNA, 21 nt, Artificial Sequence
  Description of Artificial Sequence: Synthetic oligonucleotide
uuuaaauguauugaggcuauu

SEQ ID NO: 20042 - RNA, 21 nt, Artificial Sequence
  Description of Artificial Sequence: Synthetic oligonucleotide
uuaaauguauugaggcuuauu

SEQ ID NO: 20043 - RNA, 21 nt, Artificial Sequence
  Description of Artificial Sequence: Synthetic oligonucleotide
uaaauguauugaggcuuuauu

SEQ ID NO: 20044 - RNA, 21 nt, Artificial Sequence
  Description of Artificial Sequence: Synthetic oligonucleotide
aaauguauugaggcuuucauu

SEQ ID NO: 20045 - RNA, 21 nt, Artificial Sequence
  Description of Artificial Sequence: Synthetic oligonucleotide
aauguauugaggcuuucuauu

SEQ ID NO: 20046 - RNA, 21 nt, Artificial Sequence
  Description of Artificial Sequence: Synthetic oligonucleotide
auguauugaggcuuucuuauu

SEQ ID NO: 20047 - RNA, 21 nt, Artificial Sequence
  Description of Artificial Sequence: Synthetic oligonucleotide
uguauugaggcuuucuugauu

SEQ ID NO: 20048 - RNA, 21 nt, Artificial Sequence
  Description of Artificial Sequence: Synthetic oligonucleotide
guauugaggcuuucuuggauu

SEQ ID NO: 20049 - RNA, 21 nt, Artificial Sequence
  Description of Artificial Sequence: Synthetic oligonucleotide
uauugaggcuuucuugguauu

SEQ ID NO: 20050 - RNA, 21 nt, Artificial Sequence
  Description of Artificial Sequence: Synthetic oligonucleotide
auugaggcuuucuuggugauu

SEQ ID NO: 20051 - RNA, 21 nt, Artificial Sequence
  Description of Artificial Sequence: Synthetic oligonucleotide
uugaggcuuucuugguggauu

SEQ ID NO: 20052 - RNA, 21 nt, Artificial Sequence
  Description of Artificial Sequence: Synthetic oligonucleotide
ugaggcuuucuugguggaauu

SEQ ID NO: 20053 - RNA, 21 nt, Artificial Sequence
  Description of Artificial Sequence: Synthetic oligonucleotide
gaggcuuucuugguggacauu

SEQ ID NO: 20054 - RNA, 21 nt, Artificial Sequence
  Description of Artificial Sequence: Synthetic oligonucleotide
aggcuuucuugguggacuauu

SEQ ID NO: 20055 - RNA, 21 nt, Artificial Sequence
  Description of Artificial Sequence: Synthetic oligonucleotide
ggcuuucuugguggacuaauu

SEQ ID NO: 20056 - RNA, 21 nt, Artificial Sequence
  Description of Artificial Sequence: Synthetic oligonucleotide
gcuuucuugguggacuagauu

SEQ ID NO: 20057 - RNA, 21 nt, Artificial Sequence
  Description of Artificial Sequence: Synthetic oligonucleotide
cuuucuugguggacuaguauu

SEQ ID NO: 20058 - RNA, 21 nt, Artificial Sequence
  Description of Artificial Sequence: Synthetic oligonucleotide
uuucuugguggacuaguaauu

SEQ ID NO: 20059 - RNA, 21 nt, Artificial Sequence
  Description of Artificial Sequence: Synthetic oligonucleotide
uucuugguggacuaguauauu

SEQ ID NO: 20060 - RNA, 21 nt, Artificial Sequence
  Description of Artificial Sequence: Synthetic oligonucleotide
ucuugguggacuaguauaauu

SEQ ID NO: 20061 - RNA, 21 nt, Artificial Sequence
  Description of Artificial Sequence: Synthetic oligonucleotide
cuugguggacuaguauagauu

SEQ ID NO: 20062 - RNA, 21 nt, Artificial Sequence
  Description of Artificial Sequence: Synthetic oligonucleotide
uugguggacuaguauaguauu

SEQ ID NO: 20063 - RNA, 21 nt, Artificial Sequence
  Description of Artificial Sequence: Synthetic oligonucleotide
ugguggacuaguauaguaauu

SEQ ID NO: 20064 - RNA, 21 nt, Artificial Sequence
  Description of Artificial Sequence: Synthetic oligonucleotide
gguggacuaguauaguauauu

SEQ ID NO: 20065 - RNA, 21 nt, Artificial Sequence
  Description of Artificial Sequence: Synthetic oligonucleotide
guggacuaguauaguauaauu

SEQ ID NO: 20066 - RNA, 21 nt, Artificial Sequence
  Description of Artificial Sequence: Synthetic oligonucleotide
uggacuaguauaguauacauu

SEQ ID NO: 20067 - RNA, 21 nt, Artificial Sequence
  Description of Artificial Sequence: Synthetic oligonucleotide
ggacuaguauaguauacgauu

SEQ ID NO: 20068 - RNA, 21 nt, Artificial Sequence
  Description of Artificial Sequence: Synthetic oligonucleotide
gacuaguauaguauacggauu

SEQ ID NO: 20069 - RNA, 21 nt, Artificial Sequence
  Description of Artificial Sequence: Synthetic oligonucleotide
acuaguauaguauacgguauu

SEQ ID NO: 20070 - RNA, 21 nt, Artificial Sequence
  Description of Artificial Sequence: Synthetic oligonucleotide
cuaguauaguauacggucauu

SEQ ID NO: 20071 - RNA, 21 nt, Artificial Sequence
  Description of Artificial Sequence: Synthetic oligonucleotide
uaguauaguauacggucaauu

SEQ ID NO: 20072 - RNA, 21 nt, Artificial Sequence
  Description of Artificial Sequence: Synthetic oligonucleotide
aguauaguauacggucagauu

SEQ ID NO: 20073 - RNA, 21 nt, Artificial Sequence
  Description of Artificial Sequence: Synthetic oligonucleotide
guauaguauacggucaguauu

SEQ ID NO: 20074 - RNA, 21 nt, Artificial Sequence
  Description of Artificial Sequence: Synthetic oligonucleotide
uauaguauacggucaguuauu

SEQ ID NO: 20075 - RNA, 21 nt, Artificial Sequence
  Description of Artificial Sequence: Synthetic oligonucleotide
auaguauacggucaguuaauu

SEQ ID NO: 20076 - RNA, 21 nt, Artificial Sequence
  Description of Artificial Sequence: Synthetic oligonucleotide
uaguauacggucaguuauauu

SEQ ID NO: 20077 - RNA, 21 nt, Artificial Sequence
  Description of Artificial Sequence: Synthetic oligonucleotide
aguauacggucaguuaugauu

SEQ ID NO: 20078 - RNA, 21 nt, Artificial Sequence
  Description of Artificial Sequence: Synthetic oligonucleotide
guauacggucaguuauguauu

SEQ ID NO: 20079 - RNA, 21 nt, Artificial Sequence
  Description of Artificial Sequence: Synthetic oligonucleotide
uauacggucaguuaugucauu

SEQ ID NO: 20080 - RNA, 21 nt, Artificial Sequence
  Description of Artificial Sequence: Synthetic oligonucleotide
auacggucaguuaugucaauu

SEQ ID NO: 20081 - RNA, 21 nt, Artificial Sequence
  Description of Artificial Sequence: Synthetic oligonucleotide
uacggucaguuaugucaaauu

SEQ ID NO: 20082 - RNA, 21 nt, Artificial Sequence
  Description of Artificial Sequence: Synthetic oligonucleotide
acggucaguuaugucaauauu

SEQ ID NO: 20083 - RNA, 21 nt, Artificial Sequence
  Description of Artificial Sequence: Synthetic oligonucleotide
cggucaguuaugucaaugauu

SEQ ID NO: 20084 - RNA, 21 nt, Artificial Sequence
  Description of Artificial Sequence: Synthetic oligonucleotide
ggucaguuaugucaauguauu

SEQ ID NO: 20085 - RNA, 21 nt, Artificial Sequence
  Description of Artificial Sequence: Synthetic oligonucleotide
gucaguuaugucaauguuauu

SEQ ID NO: 20086 - RNA, 21 nt, Artificial Sequence
  Description of Artificial Sequence: Synthetic oligonucleotide
ucaguuaugucaauguuuauu

SEQ ID NO: 20087 - RNA, 21 nt, Artificial Sequence
  Description of Artificial Sequence: Synthetic oligonucleotide
caguuaugucaauguuucauu

SEQ ID NO: 20088 - RNA, 21 nt, Artificial Sequence
  Description of Artificial Sequence: Synthetic oligonucleotide
aguuaugucaauguuucaauu

SEQ ID NO: 20089 - RNA, 21 nt, Artificial Sequence
  Description of Artificial Sequence: Synthetic oligonucleotide
guuaugucaauguuucauauu

SEQ ID NO: 20090 - RNA, 21 nt, Artificial Sequence
  Description of Artificial Sequence: Synthetic oligonucleotide
uuaugucaauguuucaugauu

SEQ ID NO: 20091 - RNA, 21 nt, Artificial Sequence
  Description of Artificial Sequence: Synthetic oligonucleotide
uaugucaauguuucauggauu

SEQ ID NO: 20092 - RNA, 21 nt, Artificial Sequence
  Description of Artificial Sequence: Synthetic oligonucleotide
augucaauguuucaugguauu

SEQ ID NO: 20093 - RNA, 21 nt, Artificial Sequence
  Description of Artificial Sequence: Synthetic oligonucleotide
ugucaauguuucauggucauu

SEQ ID NO: 20094 - RNA, 21 nt, Artificial Sequence
  Description of Artificial Sequence: Synthetic oligonucleotide
gucaauguuucauggucaauu

SEQ ID NO: 20095 - RNA, 21 nt, Artificial Sequence
  Description of Artificial Sequence: Synthetic oligonucleotide
ucaauguuucauggucaaauu

SEQ ID NO: 20096 - RNA, 21 nt, Artificial Sequence
  Description of Artificial Sequence: Synthetic oligonucleotide
caauguuucauggucaauauu

SEQ ID NO: 20097 - RNA, 21 nt, Artificial Sequence
  Description of Artificial Sequence: Synthetic oligonucleotide
aauguuucauggucaauaauu

SEQ ID NO: 20098 - RNA, 21 nt, Artificial Sequence
  Description of Artificial Sequence: Synthetic oligonucleotide
auguuucauggucaauaaauu

SEQ ID NO: 20099 - RNA, 21 nt, Artificial Sequence
  Description of Artificial Sequence: Synthetic oligonucleotide
uguuucauggucaauaaaauu

SEQ ID NO: 20100 - RNA, 21 nt, Artificial Sequence
  Description of Artificial Sequence: Synthetic oligonucleotide
guuucauggucaauaaaaauu

SEQ ID NO: 20101 - RNA, 21 nt, Artificial Sequence
  Description of Artificial Sequence: Synthetic oligonucleotide
uuucauggucaauaaaaaauu

SEQ ID NO: 20102 - RNA, 21 nt, Artificial Sequence
  Description of Artificial Sequence: Synthetic oligonucleotide
uucauggucaauaaaaagauu

SEQ ID NO: 20103 - RNA, 21 nt, Artificial Sequence
  Description of Artificial Sequence: Synthetic oligonucleotide
ucauggucaauaaaaaggauu

SEQ ID NO: 20104 - RNA, 21 nt, Artificial Sequence
  Description of Artificial Sequence: Synthetic oligonucleotide
cauggucaauaaaaaggaauu

SEQ ID NO: 20105 - RNA, 21 nt, Artificial Sequence
  Description of Artificial Sequence: Synthetic oligonucleotide
auggucaauaaaaaggaaauu

SEQ ID NO: 20106 - RNA, 21 nt, Artificial Sequence
  Description of Artificial Sequence: Synthetic oligonucleotide
uggucaauaaaaaggaagauu

SEQ ID NO: 20107 - RNA, 21 nt, Artificial Sequence
  Description of Artificial Sequence: Synthetic oligonucleotide
ggucaauaaaaaggaaguauu

SEQ ID NO: 20108 - RNA, 21 nt, Artificial Sequence
  Description of Artificial Sequence: Synthetic oligonucleotide
gucaauaaaaaggaaguuauu

SEQ ID NO: 20109 - RNA, 21 nt, Artificial Sequence
  Description of Artificial Sequence: Synthetic oligonucleotide
ucaauaaaaaggaaguugauu

SEQ ID NO: 20110 - RNA, 21 nt, Artificial Sequence
  Description of Artificial Sequence: Synthetic oligonucleotide
caauaaaaaggaaguugcauu

SEQ ID NO: 20111 - RNA, 21 nt, Artificial Sequence
  Description of Artificial Sequence: Synthetic oligonucleotide
aauaaaaaggaaguugcaauu

SEQ ID NO: 20112 - RNA, 21 nt, Artificial Sequence
  Description of Artificial Sequence: Synthetic oligonucleotide
auaaaaaggaaguugcaaauu

SEQ ID NO: 20113 - RNA, 21 nt, Artificial Sequence
  Description of Artificial Sequence: Synthetic oligonucleotide
uaaaaaggaaguugcaaaauu

SEQ ID NO: 20114 - RNA, 21 nt, Artificial Sequence
  Description of Artificial Sequence: Synthetic oligonucleotide
aaaaaggaaguugcaaauauu

SEQ ID NO: 20115 - RNA, 21 nt, Artificial Sequence
  Description of Artificial Sequence: Synthetic oligonucleotide
aaaaggaaguugcaaauuauu

SEQ ID NO: 20116 - RNA, 21 nt, Artificial Sequence
  Description of Artificial Sequence: Synthetic oligonucleotide
aaaggaaguugcaaauugauu

SEQ ID NO: 20117 - RNA, 21 nt, Artificial Sequence
  Description of Artificial Sequence: Synthetic oligonucleotide
aaggaaguugcaaauuguauu

SEQ ID NO: 20118 - RNA, 21 nt, Artificial Sequence
  Description of Artificial Sequence: Synthetic oligonucleotide
aggaaguugcaaauugugauu

SEQ ID NO: 20119 - RNA, 21 nt, Artificial Sequence
  Description of Artificial Sequence: Synthetic oligonucleotide
aucagggagacuccaacuauu

SEQ ID NO: 20120 - RNA, 21 nt, Artificial Sequence
  Description of Artificial Sequence: Synthetic oligonucleotide
ucagggagacuccaacuuauu

SEQ ID NO: 20121 - RNA, 21 nt, Artificial Sequence
  Description of Artificial Sequence: Synthetic oligonucleotide
cagggagacuccaacuuaauu

SEQ ID NO: 20122 - RNA, 21 nt, Artificial Sequence
  Description of Artificial Sequence: Synthetic oligonucleotide
agggagacuccaacuuaaauu

SEQ ID NO: 20123 - RNA, 21 nt, Artificial Sequence
  Description of Artificial Sequence: Synthetic oligonucleotide
gggagacuccaacuuaagauu

SEQ ID NO: 20124 - RNA, 21 nt, Artificial Sequence
  Description of Artificial Sequence: Synthetic oligonucleotide
ggagacuccaacuuaaggauu

SEQ ID NO: 20125 - RNA, 21 nt, Artificial Sequence
  Description of Artificial Sequence: Synthetic oligonucleotide
gagacuccaacuuaaggcauu

SEQ ID NO: 20126 - RNA, 21 nt, Artificial Sequence
  Description of Artificial Sequence: Synthetic oligonucleotide
agacuccaacuuaaggcaauu

SEQ ID NO: 20127 - RNA, 21 nt, Artificial Sequence
  Description of Artificial Sequence: Synthetic oligonucleotide
gacuccaacuuaaggcaaauu

SEQ ID NO: 20128 - RNA, 21 nt, Artificial Sequence
  Description of Artificial Sequence: Synthetic oligonucleotide
acuccaacuuaaggcaacauu

SEQ ID NO: 20129 - RNA, 21 nt, Artificial Sequence
  Description of Artificial Sequence: Synthetic oligonucleotide
cuccaacuuaaggcaacaauu

SEQ ID NO: 20130 - RNA, 21 nt, Artificial Sequence
  Description of Artificial Sequence: Synthetic oligonucleotide
uccaacuuaaggcaacagauu

SEQ ID NO: 20131 - RNA, 21 nt, Artificial Sequence
  Description of Artificial Sequence: Synthetic oligonucleotide
ccaacuuaaggcaacagcauu

SEQ ID NO: 20132 - RNA, 21 nt, Artificial Sequence
  Description of Artificial Sequence: Synthetic oligonucleotide
caacuuaaggcaacagcaauu

SEQ ID NO: 20133 - RNA, 21 nt, Artificial Sequence
  Description of Artificial Sequence: Synthetic oligonucleotide
aacuuaaggcaacagcauauu

SEQ ID NO: 20134 - RNA, 21 nt, Artificial Sequence
  Description of Artificial Sequence: Synthetic oligonucleotide
acuuaaggcaacagcaugauu

SEQ ID NO: 20135 - RNA, 21 nt, Artificial Sequence
  Description of Artificial Sequence: Synthetic oligonucleotide
cuuaaggcaacagcauggauu

SEQ ID NO: 20136 - RNA, 21 nt, Artificial Sequence
  Description of Artificial Sequence: Synthetic oligonucleotide
uuaaggcaacagcaugggauu

SEQ ID NO: 20137 - RNA, 21 nt, Artificial Sequence
  Description of Artificial Sequence: Synthetic oligonucleotide
uaaggcaacagcauggguauu

SEQ ID NO: 20138 - RNA, 21 nt, Artificial Sequence
  Description of Artificial Sequence: Synthetic oligonucleotide
aaggcaacagcaugggugauu

SEQ ID NO: 20139 - RNA, 21 nt, Artificial Sequence
  Description of Artificial Sequence: Synthetic oligonucleotide
aggcaacagcaugggugaauu

SEQ ID NO: 20140 - RNA, 21 nt, Artificial Sequence
  Description of Artificial Sequence: Synthetic oligonucleotide
ggcaacagcaugggugaaauu

SEQ ID NO: 20141 - RNA, 21 nt, Artificial Sequence
  Description of Artificial Sequence: Synthetic oligonucleotide
gcaacagcaugggugaauauu

SEQ ID NO: 20142 - RNA, 21 nt, Artificial Sequence
  Description of Artificial Sequence: Synthetic oligonucleotide
caacagcaugggugaauaauu

SEQ ID NO: 20143 - RNA, 21 nt, Artificial Sequence
  Description of Artificial Sequence: Synthetic oligonucleotide
aacagcaugggugaauaaauu

SEQ ID NO: 20144 - RNA, 21 nt, Artificial Sequence
  Description of Artificial Sequence: Synthetic oligonucleotide
acagcaugggugaauaagauu

SEQ ID NO: 20145 - RNA, 21 nt, Artificial Sequence
  Description of Artificial Sequence: Synthetic oligonucleotide
cagcaugggugaauaaggauu

SEQ ID NO: 20146 - RNA, 21 nt, Artificial Sequence
  Description of Artificial Sequence: Synthetic oligonucleotide
agcaugggugaauaagggauu

SEQ ID NO: 20147 - RNA, 21 nt, Artificial Sequence
  Description of Artificial Sequence: Synthetic oligonucleotide
gcaugggugaauaagggcauu

SEQ ID NO: 20148 - RNA, 21 nt, Artificial Sequence
  Description of Artificial Sequence: Synthetic oligonucleotide
caugggugaauaagggcuauu

SEQ ID NO: 20149 - RNA, 21 nt, Artificial Sequence
  Description of Artificial Sequence: Synthetic oligonucleotide
augggugaauaagggcuuauu

SEQ ID NO: 20150 - RNA, 21 nt, Artificial Sequence
  Description of Artificial Sequence: Synthetic oligonucleotide
ugggugaauaagggcuucauu

SEQ ID NO: 20151 - RNA, 21 nt, Artificial Sequence
  Description of Artificial Sequence: Synthetic oligonucleotide
gggugaauaagggcuuccauu

SEQ ID NO: 20152 - RNA, 21 nt, Artificial Sequence
  Description of Artificial Sequence: Synthetic oligonucleotide
ggugaauaagggcuuccuauu

SEQ ID NO: 20153 - RNA, 21 nt, Artificial Sequence
  Description of Artificial Sequence: Synthetic oligonucleotide
gugaauaagggcuuccugauu

SEQ ID NO: 20154 - RNA, 21 nt, Artificial Sequence
  Description of Artificial Sequence: Synthetic oligonucleotide
ugaauaagggcuuccuguauu

SEQ ID NO: 20155 - RNA, 21 nt, Artificial Sequence
  Description of Artificial Sequence: Synthetic oligonucleotide
gaauaagggcuuccugugauu

SEQ ID NO: 20156 - RNA, 21 nt, Artificial Sequence
  Description of Artificial Sequence: Synthetic oligonucleotide
aauaagggcuuccuguggauu

SEQ ID NO: 20157 - RNA, 21 nt, Artificial Sequence
  Description of Artificial Sequence: Synthetic oligonucleotide
auaagggcuuccuguggaauu

SEQ ID NO: 20158 - RNA, 21 nt, Artificial Sequence
  Description of Artificial Sequence: Synthetic oligonucleotide
uaagggcuuccuguggacauu

SEQ ID NO: 20159 - RNA, 21 nt, Artificial Sequence
  Description of Artificial Sequence: Synthetic oligonucleotide
aagggcuuccuguggacuauu

SEQ ID NO: 20160 - RNA, 21 nt, Artificial Sequence
  Description of Artificial Sequence: Synthetic oligonucleotide
agggcuuccuguggacugauu

SEQ ID NO: 20161 - RNA, 21 nt, Artificial Sequence
  Description of Artificial Sequence: Synthetic oligonucleotide
gggcuuccuguggacuggauu

SEQ ID NO: 20162 - RNA, 21 nt, Artificial Sequence
  Description of Artificial Sequence: Synthetic oligonucleotide
ggcuuccuguggacuggcauu

SEQ ID NO: 20163 - RNA, 21 nt, Artificial Sequence
  Description of Artificial Sequence: Synthetic oligonucleotide
gcuuccuguggacuggcaauu

SEQ ID NO: 20164 - RNA, 21 nt, Artificial Sequence
  Description of Artificial Sequence: Synthetic oligonucleotide
cuuccuguggacuggcaaauu

SEQ ID NO: 20165 - RNA, 21 nt, Artificial Sequence
  Description of Artificial Sequence: Synthetic oligonucleotide
uuccuguggacuggcaauauu

SEQ ID NO: 20166 - RNA, 21 nt, Artificial Sequence
  Description of Artificial Sequence: Synthetic oligonucleotide
uccuguggacuggcaaugauu

SEQ ID NO: 20167 - RNA, 21 nt, Artificial Sequence
  Description of Artificial Sequence: Synthetic oligonucleotide
ccuguggacuggcaaugaauu

SEQ ID NO: 20168 - RNA, 21 nt, Artificial Sequence
  Description of Artificial Sequence: Synthetic oligonucleotide
cuguggacuggcaaugagauu

SEQ ID NO: 20169 - RNA, 21 nt, Artificial Sequence
  Description of Artificial Sequence: Synthetic oligonucleotide
uguggacuggcaaugagaauu

SEQ ID NO: 20170 - RNA, 21 nt, Artificial Sequence
  Description of Artificial Sequence: Synthetic oligonucleotide
guggacuggcaaugagagauu

SEQ ID NO: 20171 - RNA, 21 nt, Artificial Sequence
  Description of Artificial Sequence: Synthetic oligonucleotide
uggacuggcaaugagaggauu

SEQ ID NO: 20172 - RNA, 21 nt, Artificial Sequence
  Description of Artificial Sequence: Synthetic oligonucleotide
ggacuggcaaugagaggcauu

SEQ ID NO: 20173 - RNA, 21 nt, Artificial Sequence
  Description of Artificial Sequence: Synthetic oligonucleotide
gacuggcaaugagaggcaauu

SEQ ID NO: 20174 - RNA, 21 nt, Artificial Sequence
  Description of Artificial Sequence: Synthetic oligonucleotide
acuggcaaugagaggcaaauu

SEQ ID NO: 20175 - RNA, 21 nt, Artificial Sequence
  Description of Artificial Sequence: Synthetic oligonucleotide
cuggcaaugagaggcaaaauu

SEQ ID NO: 20176 - RNA, 21 nt, Artificial Sequence
  Description of Artificial Sequence: Synthetic oligonucleotide
uggcaaugagaggcaaaaauu

SEQ ID NO: 20177 - RNA, 21 nt, Artificial Sequence
  Description of Artificial Sequence: Synthetic oligonucleotide
ggcaaugagaggcaaaacauu

SEQ ID NO: 20178 - RNA, 21 nt, Artificial Sequence
  Description of Artificial Sequence: Synthetic oligonucleotide
gcaaugagaggcaaaaccauu

SEQ ID NO: 20179 - RNA, 21 nt, Artificial Sequence
  Description of Artificial Sequence: Synthetic oligonucleotide
caaugagaggcaaaaccuauu

SEQ ID NO: 20180 - RNA, 21 nt, Artificial Sequence
  Description of Artificial Sequence: Synthetic oligonucleotide
aaugagaggcaaaaccugauu

SEQ ID NO: 20181 - RNA, 21 nt, Artificial Sequence
  Description of Artificial Sequence: Synthetic oligonucleotide
augagaggcaaaaccuggauu

SEQ ID NO: 20182 - RNA, 21 nt, Artificial Sequence
  Description of Artificial Sequence: Synthetic oligonucleotide
ugagaggcaaaaccugguauu

SEQ ID NO: 20183 - RNA, 21 nt, Artificial Sequence
  Description of Artificial Sequence: Synthetic oligonucleotide
gagaggcaaaaccuggugauu

SEQ ID NO: 20184 - RNA, 21 nt, Artificial Sequence
  Description of Artificial Sequence: Synthetic oligonucleotide
agaggcaaaaccuggugcauu

SEQ ID NO: 20185 - RNA, 21 nt, Artificial Sequence
  Description of Artificial Sequence: Synthetic oligonucleotide
gaggcaaaaccuggugcuauu

SEQ ID NO: 20186 - RNA, 21 nt, Artificial Sequence
  Description of Artificial Sequence: Synthetic oligonucleotide
aggcaaaaccuggugcuuauu

SEQ ID NO: 20187 - RNA, 21 nt, Artificial Sequence
  Description of Artificial Sequence: Synthetic oligonucleotide
ggcaaaaccuggugcuugauu

SEQ ID NO: 20188 - RNA, 21 nt, Artificial Sequence
  Description of Artificial Sequence: Synthetic oligonucleotide
gcaaaaccuggugcuugaauu

SEQ ID NO: 20189 - RNA, 21 nt, Artificial Sequence
  Description of Artificial Sequence: Synthetic oligonucleotide
caaaaccuggugcuugagauu

SEQ ID NO: 20190 - RNA, 21 nt, Artificial Sequence
  Description of Artificial Sequence: Synthetic oligonucleotide
aaaaccuggugcuugagcauu

SEQ ID NO: 20191 - RNA, 21 nt, Artificial Sequence
  Description of Artificial Sequence: Synthetic oligonucleotide
aaaccuggugcuugagcaauu

SEQ ID NO: 20192 - RNA, 21 nt, Artificial Sequence
  Description of Artificial Sequence: Synthetic oligonucleotide
aaccuggugcuugagcacauu

SEQ ID NO: 20193 - RNA, 21 nt, Artificial Sequence
  Description of Artificial Sequence: Synthetic oligonucleotide
accuggugcuugagcacuauu

SEQ ID NO: 20194 - RNA, 21 nt, Artificial Sequence
  Description of Artificial Sequence: Synthetic oligonucleotide
ccuggugcuugagcacugauu

SEQ ID NO: 20195 - RNA, 21 nt, Artificial Sequence
  Description of Artificial Sequence: Synthetic oligonucleotide
cuggugcuugagcacuggauu

SEQ ID NO: 20196 - RNA, 21 nt, Artificial Sequence
  Description of Artificial Sequence: Synthetic oligonucleotide
uggugcuugagcacuggcauu

SEQ ID NO: 20197 - RNA, 21 nt, Artificial Sequence
  Description of Artificial Sequence: Synthetic oligonucleotide
ggugcuugagcacuggccauu

SEQ ID NO: 20198 - RNA, 21 nt, Artificial Sequence
  Description of Artificial Sequence: Synthetic oligonucleotide
gugcuugagcacuggcccauu

SEQ ID NO: 20199 - RNA, 21 nt, Artificial Sequence
  Description of Artificial Sequence: Synthetic oligonucleotide
ugcuugagcacuggccccauu

SEQ ID NO: 20200 - RNA, 21 nt, Artificial Sequence
  Description of Artificial Sequence: Synthetic oligonucleotide
gcuugagcacuggccccuauu

SEQ ID NO: 20201 - RNA, 21 nt, Artificial Sequence
  Description of Artificial Sequence: Synthetic oligonucleotide
cuugagcacuggccccuaauu

SEQ ID NO: 20202 - RNA, 21 nt, Artificial Sequence
  Description of Artificial Sequence: Synthetic oligonucleotide
uugagcacuggccccuaaauu

SEQ ID NO: 20203 - RNA, 21 nt, Artificial Sequence
  Description of Artificial Sequence: Synthetic oligonucleotide
ugagcacuggccccuaagauu

SEQ ID NO: 20204 - RNA, 21 nt, Artificial Sequence
  Description of Artificial Sequence: Synthetic oligonucleotide
gagcacuggccccuaaggauu

SEQ ID NO: 20205 - RNA, 21 nt, Artificial Sequence
  Description of Artificial Sequence: Synthetic oligonucleotide
agcacuggccccuaaggcauu

SEQ ID NO: 20206 - RNA, 21 nt, Artificial Sequence
  Description of Artificial Sequence: Synthetic oligonucleotide
gcacuggccccuaaggcaauu

SEQ ID NO: 20207 - RNA, 21 nt, Artificial Sequence
  Description of Artificial Sequence: Synthetic oligonucleotide
cacuggccccuaaggcagauu

SEQ ID NO: 20208 - RNA, 21 nt, Artificial Sequence
  Description of Artificial Sequence: Synthetic oligonucleotide
acuggccccuaaggcaggauu

SEQ ID NO: 20209 - RNA, 21 nt, Artificial Sequence
  Description of Artificial Sequence: Synthetic oligonucleotide
cuggccccuaaggcaggcauu

SEQ ID NO: 20210 - RNA, 21 nt, Artificial Sequence
  Description of Artificial Sequence: Synthetic oligonucleotide
uggccccuaaggcaggccauu

SEQ ID NO: 20211 - RNA, 21 nt, Artificial Sequence
  Description of Artificial Sequence: Synthetic oligonucleotide
ggccccuaaggcaggccuauu

SEQ ID NO: 20212 - RNA, 21 nt, Artificial Sequence
  Description of Artificial Sequence: Synthetic oligonucleotide
gccccuaaggcaggccuuauu

SEQ ID NO: 20213 - RNA, 21 nt, Artificial Sequence
  Description of Artificial Sequence: Synthetic oligonucleotide
ccccuaaggcaggccuuaauu

SEQ ID NO: 20214 - RNA, 21 nt, Artificial Sequence
  Description of Artificial Sequence: Synthetic oligonucleotide
cccuaaggcaggccuuacauu

SEQ ID NO: 20215 - RNA, 21 nt, Artificial Sequence
  Description of Artificial Sequence: Synthetic oligonucleotide
ccuaaggcaggccuuacaauu

SEQ ID NO: 20216 - RNA, 21 nt, Artificial Sequence
  Description of Artificial Sequence: Synthetic oligonucleotide
cuaaggcaggccuuacagauu

SEQ ID NO: 20217 - RNA, 21 nt, Artificial Sequence
  Description of Artificial Sequence: Synthetic oligonucleotide
uaaggcaggccuuacagaauu

SEQ ID NO: 20218 - RNA, 21 nt, Artificial Sequence
  Description of Artificial Sequence: Synthetic oligonucleotide
aaggcaggccuuacagauauu

SEQ ID NO: 20219 - RNA, 21 nt, Artificial Sequence
  Description of Artificial Sequence: Synthetic oligonucleotide
aggcaggccuuacagaucauu

SEQ ID NO: 20220 - RNA, 21 nt, Artificial Sequence
  Description of Artificial Sequence: Synthetic oligonucleotide
ggcaggccuuacagaucuauu

SEQ ID NO: 20221 - RNA, 21 nt, Artificial Sequence
  Description of Artificial Sequence: Synthetic oligonucleotide
gcaggccuuacagaucucauu

SEQ ID NO: 20222 - RNA, 21 nt, Artificial Sequence
  Description of Artificial Sequence: Synthetic oligonucleotide
caggccuuacagaucucuauu

SEQ ID NO: 20223 - RNA, 21 nt, Artificial Sequence
  Description of Artificial Sequence: Synthetic oligonucleotide
aggccuuacagaucucuuauu

SEQ ID NO: 20224 - RNA, 21 nt, Artificial Sequence
  Description of Artificial Sequence: Synthetic oligonucleotide
ggccuuacagaucucuuaauu

SEQ ID NO: 20225 - RNA, 21 nt, Artificial Sequence
  Description of Artificial Sequence: Synthetic oligonucleotide
gccuuacagaucucuuacauu

SEQ ID NO: 20226 - RNA, 21 nt, Artificial Sequence
  Description of Artificial Sequence: Synthetic oligonucleotide
ccuuacagaucucuuacaauu

SEQ ID NO: 20227 - RNA, 21 nt, Artificial Sequence
  Description of Artificial Sequence: Synthetic oligonucleotide
cuuacagaucucuuacacauu

SEQ ID NO: 20228 - RNA, 21 nt, Artificial Sequence
  Description of Artificial Sequence: Synthetic oligonucleotide
uuacagaucucuuacacuauu

SEQ ID NO: 20229 - RNA, 21 nt, Artificial Sequence
  Description of Artificial Sequence: Synthetic oligonucleotide
uacagaucucuuacacucauu

SEQ ID NO: 20230 - RNA, 21 nt, Artificial Sequence
  Description of Artificial Sequence: Synthetic oligonucleotide
acagaucucuuacacucgauu

SEQ ID NO: 20231 - RNA, 21 nt, Artificial Sequence
  Description of Artificial Sequence: Synthetic oligonucleotide
cagaucucuuacacucguauu

SEQ ID NO: 20232 - RNA, 21 nt, Artificial Sequence
  Description of Artificial Sequence: Synthetic oligonucleotide
agaucucuuacacucgugauu

SEQ ID NO: 20233 - RNA, 21 nt, Artificial Sequence
  Description of Artificial Sequence: Synthetic oligonucleotide
gaucucuuacacucguggauu

SEQ ID NO: 20234 - RNA, 21 nt, Artificial Sequence
  Description of Artificial Sequence: Synthetic oligonucleotide
aucucuuacacucgugguauu

SEQ ID NO: 20235 - RNA, 21 nt, Artificial Sequence
  Description of Artificial Sequence: Synthetic oligonucleotide
ucucuuacacucguggugauu

SEQ ID NO: 20236 - RNA, 21 nt, Artificial Sequence
  Description of Artificial Sequence: Synthetic oligonucleotide
cucuuacacucgugguggauu

SEQ ID NO: 20237 - RNA, 21 nt, Artificial Sequence
  Description of Artificial Sequence: Synthetic oligonucleotide
ucuuacacucguggugggauu

SEQ ID NO: 20238 - RNA, 21 nt, Artificial Sequence
  Description of Artificial Sequence: Synthetic oligonucleotide
cuuacacucguggugggaauu

SEQ ID NO: 20239 - RNA, 21 nt, Artificial Sequence
  Description of Artificial Sequence: Synthetic oligonucleotide
uuacacucguggugggaaauu

SEQ ID NO: 20240 - RNA, 21 nt, Artificial Sequence
  Description of Artificial Sequence: Synthetic oligonucleotide
uacacucguggugggaagauu

SEQ ID NO: 20241 - RNA, 21 nt, Artificial Sequence
  Description of Artificial Sequence: Synthetic oligonucleotide
acacucguggugggaagaauu

SEQ ID NO: 20242 - RNA, 21 nt, Artificial Sequence
  Description of Artificial Sequence: Synthetic oligonucleotide
cacucguggugggaagagauu

SEQ ID NO: 20243 - RNA, 21 nt, Artificial Sequence
  Description of Artificial Sequence: Synthetic oligonucleotide
acucguggugggaagaguauu

SEQ ID NO: 20244 - RNA, 21 nt, Artificial Sequence
  Description of Artificial Sequence: Synthetic oligonucleotide
cucguggugggaagaguuauu

SEQ ID NO: 20245 - RNA, 21 nt, Artificial Sequence
  Description of Artificial Sequence: Synthetic oligonucleotide
ucguggugggaagaguuuauu

SEQ ID NO: 20246 - RNA, 21 nt, Artificial Sequence
  Description of Artificial Sequence: Synthetic oligonucleotide
cguggugggaagaguuuaauu

SEQ ID NO: 20247 - RNA, 21 nt, Artificial Sequence
  Description of Artificial Sequence: Synthetic oligonucleotide
guggugggaagaguuuagauu

SEQ ID NO: 20248 - RNA, 21 nt, Artificial Sequence
  Description of Artificial Sequence: Synthetic oligonucleotide
uggugggaagaguuuaguauu

SEQ ID NO: 20249 - RNA, 21 nt, Artificial Sequence
  Description of Artificial Sequence: Synthetic oligonucleotide
ggugggaagaguuuagugauu

SEQ ID NO: 20250 - RNA, 21 nt, Artificial Sequence
  Description of Artificial Sequence: Synthetic oligonucleotide
gugggaagaguuuaguguauu

SEQ ID NO: 20251 - RNA, 21 nt, Artificial Sequence
  Description of Artificial Sequence: Synthetic oligonucleotide
ugggaagaguuuagugugauu

SEQ ID NO: 20252 - RNA, 21 nt, Artificial Sequence
  Description of Artificial Sequence: Synthetic oligonucleotide
gggaagaguuuagugugaauu

SEQ ID NO: 20253 - RNA, 21 nt, Artificial Sequence
  Description of Artificial Sequence: Synthetic oligonucleotide
ggaagaguuuagugugaaauu

SEQ ID NO: 20254 - RNA, 21 nt, Artificial Sequence
  Description of Artificial Sequence: Synthetic oligonucleotide
gaagaguuuagugugaaaauu

SEQ ID NO: 20255 - RNA, 21 nt, Artificial Sequence
  Description of Artificial Sequence: Synthetic oligonucleotide
aagaguuuagugugaaacauu

SEQ ID NO: 20256 - RNA, 21 nt, Artificial Sequence
  Description of Artificial Sequence: Synthetic oligonucleotide
agaguuuagugugaaacuauu

SEQ ID NO: 20257 - RNA, 21 nt, Artificial Sequence
  Description of Artificial Sequence: Synthetic oligonucleotide
gaguuuagugugaaacugauu

SEQ ID NO: 20258 - RNA, 21 nt, Artificial Sequence
  Description of Artificial Sequence: Synthetic oligonucleotide
aguuuagugugaaacuggauu

SEQ ID NO: 20259 - RNA, 21 nt, Artificial Sequence
  Description of Artificial Sequence: Synthetic oligonucleotide
guuuagugugaaacugggauu

SEQ ID NO: 20260 - RNA, 21 nt, Artificial Sequence
  Description of Artificial Sequence: Synthetic oligonucleotide
uuuagugugaaacuggggauu

SEQ ID NO: 20261 - RNA, 21 nt, Artificial Sequence
  Description of Artificial Sequence: Synthetic oligonucleotide
uuagugugaaacugggguauu

SEQ ID NO: 20262 - RNA, 21 nt, Artificial Sequence
  Description of Artificial Sequence: Synthetic oligonucleotide
uagugugaaacuggggugauu

SEQ ID NO: 20263 - RNA, 21 nt, Artificial Sequence
  Description of Artificial Sequence: Synthetic oligonucleotide
agugugaaacugggguggauu

SEQ ID NO: 20264 - RNA, 21 nt, Artificial Sequence
  Description of Artificial Sequence: Synthetic oligonucleotide
gugugaaacugggguggaauu

SEQ ID NO: 20265 - RNA, 21 nt, Artificial Sequence
  Description of Artificial Sequence: Synthetic oligonucleotide
ugugaaacugggguggaaauu

SEQ ID NO: 20266 - RNA, 21 nt, Artificial Sequence
  Description of Artificial Sequence: Synthetic oligonucleotide
gugaaacugggguggaauauu

SEQ ID NO: 20267 - RNA, 21 nt, Artificial Sequence
  Description of Artificial Sequence: Synthetic oligonucleotide
ugaaacugggguggaauuauu

SEQ ID NO: 20268 - RNA, 21 nt, Artificial Sequence
  Description of Artificial Sequence: Synthetic oligonucleotide
gaaacugggguggaauugauu

SEQ ID NO: 20269 - RNA, 21 nt, Artificial Sequence
  Description of Artificial Sequence: Synthetic oligonucleotide
aaacugggguggaauuggauu

SEQ ID NO: 20270 - RNA, 21 nt, Artificial Sequence
  Description of Artificial Sequence: Synthetic oligonucleotide
aacugggguggaauugggauu

SEQ ID NO: 20271 - RNA, 21 nt, Artificial Sequence
  Description of Artificial Sequence: Synthetic oligonucleotide
acugggguggaauuggguauu

SEQ ID NO: 20272 - RNA, 21 nt, Artificial Sequence
  Description of Artificial Sequence: Synthetic oligonucleotide
cugggguggaauugggugauu

SEQ ID NO: 20273 - RNA, 21 nt, Artificial Sequence
  Description of Artificial Sequence: Synthetic oligonucleotide
ugggguggaauuggguguauu

SEQ ID NO: 20274 - RNA, 21 nt, Artificial Sequence
  Description of Artificial Sequence: Synthetic oligonucleotide
gggguggaauugggugucauu

SEQ ID NO: 20275 - RNA, 21 nt, Artificial Sequence
  Description of Artificial Sequence: Synthetic oligonucleotide
ggguggaauuggguguccauu

SEQ ID NO: 20276 - RNA, 21 nt, Artificial Sequence
  Description of Artificial Sequence: Synthetic oligonucleotide
gguggaauuggguguccaauu

SEQ ID NO: 20277 - RNA, 21 nt, Artificial Sequence
  Description of Artificial Sequence: Synthetic oligonucleotide
guggaauuggguguccacauu

SEQ ID NO: 20278 - RNA, 21 nt, Artificial Sequence
  Description of Artificial Sequence: Synthetic oligonucleotide
uggaauuggguguccacgauu

SEQ ID NO: 20279 - RNA, 21 nt, Artificial Sequence
  Description of Artificial Sequence: Synthetic oligonucleotide
ggaauuggguguccacguauu

SEQ ID NO: 20280 - RNA, 21 nt, Artificial Sequence
  Description of Artificial Sequence: Synthetic oligonucleotide
gaauuggguguccacguaauu

SEQ ID NO: 20281 - RNA, 21 nt, Artificial Sequence
  Description of Artificial Sequence: Synthetic oligonucleotide
aauuggguguccacguauauu

SEQ ID NO: 20282 - RNA, 21 nt, Artificial Sequence
  Description of Artificial Sequence: Synthetic oligonucleotide
auuggguguccacguaugauu

SEQ ID NO: 20283 - RNA, 21 nt, Artificial Sequence
  Description of Artificial Sequence: Synthetic oligonucleotide
uuggguguccacguauguauu

SEQ ID NO: 20284 - RNA, 21 nt, Artificial Sequence
  Description of Artificial Sequence: Synthetic oligonucleotide
uggguguccacguauguuauu

SEQ ID NO: 20285 - RNA, 21 nt, Artificial Sequence
  Description of Artificial Sequence: Synthetic oligonucleotide
ggguguccacguauguucauu

SEQ ID NO: 20286 - RNA, 21 nt, Artificial Sequence
  Description of Artificial Sequence: Synthetic oligonucleotide
gguguccacguauguuccauu

SEQ ID NO: 20287 - RNA, 21 nt, Artificial Sequence
  Description of Artificial Sequence: Synthetic oligonucleotide
guguccacguauguucccauu

SEQ ID NO: 20288 - RNA, 21 nt, Artificial Sequence
  Description of Artificial Sequence: Synthetic oligonucleotide
uguccacguauguucccuauu

SEQ ID NO: 20289 - RNA, 21 nt, Artificial Sequence
  Description of Artificial Sequence: Synthetic oligonucleotide
guccacguauguucccuuauu

SEQ ID NO: 20290 - RNA, 21 nt, Artificial Sequence
  Description of Artificial Sequence: Synthetic oligonucleotide
uccacguauguucccuuuauu

SEQ ID NO: 20291 - RNA, 21 nt, Artificial Sequence
  Description of Artificial Sequence: Synthetic oligonucleotide
ccacguauguucccuuuuauu

SEQ ID NO: 20292 - RNA, 21 nt, Artificial Sequence
  Description of Artificial Sequence: Synthetic oligonucleotide
cacguauguucccuuuugauu

SEQ ID NO: 20293 - RNA, 21 nt, Artificial Sequence
  Description of Artificial Sequence: Synthetic oligonucleotide
acguauguucccuuuugcauu

SEQ ID NO: 20294 - RNA, 21 nt, Artificial Sequence
  Description of Artificial Sequence: Synthetic oligonucleotide
cguauguucccuuuugccauu

SEQ ID NO: 20295 - RNA, 21 nt, Artificial Sequence
  Description of Artificial Sequence: Synthetic oligonucleotide
guauguucccuuuugccuauu

SEQ ID NO: 20296 - RNA, 21 nt, Artificial Sequence
  Description of Artificial Sequence: Synthetic oligonucleotide
uauguucccuuuugccuuauu

SEQ ID NO: 20297 - RNA, 21 nt, Artificial Sequence
  Description of Artificial Sequence: Synthetic oligonucleotide
auguucccuuuugccuuaauu

SEQ ID NO: 20298 - RNA, 21 nt, Artificial Sequence
  Description of Artificial Sequence: Synthetic oligonucleotide
uguucccuuuugccuuacauu

SEQ ID NO: 20299 - RNA, 21 nt, Artificial Sequence
  Description of Artificial Sequence: Synthetic oligonucleotide
guucccuuuugccuuacuauu

SEQ ID NO: 20300 - RNA, 21 nt, Artificial Sequence
  Description of Artificial Sequence: Synthetic oligonucleotide
uucccuuuugccuuacuaauu

SEQ ID NO: 20301 - RNA, 21 nt, Artificial Sequence
  Description of Artificial Sequence: Synthetic oligonucleotide
ucccuuuugccuuacuauauu

SEQ ID NO: 20302 - RNA, 21 nt, Artificial Sequence
  Description of Artificial Sequence: Synthetic oligonucleotide
cccuuuugccuuacuauaauu

SEQ ID NO: 20303 - RNA, 21 nt, Artificial Sequence
  Description of Artificial Sequence: Synthetic oligonucleotide
ccuuuugccuuacuauauauu

SEQ ID NO: 20304 - RNA, 21 nt, Artificial Sequence
  Description of Artificial Sequence: Synthetic oligonucleotide
cuuuugccuuacuauaugauu

SEQ ID NO: 20305 - RNA, 21 nt, Artificial Sequence
  Description of Artificial Sequence: Synthetic oligonucleotide
uuuugccuuacuauauguauu

SEQ ID NO: 20306 - RNA, 21 nt, Artificial Sequence
  Description of Artificial Sequence: Synthetic oligonucleotide
uuugccuuacuauauguuauu

SEQ ID NO: 20307 - RNA, 21 nt, Artificial Sequence
  Description of Artificial Sequence: Synthetic oligonucleotide
uugccuuacuauauguucauu

SEQ ID NO: 20308 - RNA, 21 nt, Artificial Sequence
  Description of Artificial Sequence: Synthetic oligonucleotide
ugccuuacuauauguucuauu

SEQ ID NO: 20309 - RNA, 21 nt, Artificial Sequence
  Description of Artificial Sequence: Synthetic oligonucleotide
gccuuacuauauguucugauu

SEQ ID NO: 20310 - RNA, 21 nt, Artificial Sequence
  Description of Artificial Sequence: Synthetic oligonucleotide
ccuuacuauauguucuguauu

SEQ ID NO: 20311 - RNA, 21 nt, Artificial Sequence
  Description of Artificial Sequence: Synthetic oligonucleotide
cuuacuauauguucugucauu

SEQ ID NO: 20312 - RNA, 21 nt, Artificial Sequence
  Description of Artificial Sequence: Synthetic oligonucleotide
uuacuauauguucugucaauu

SEQ ID NO: 20313 - RNA, 21 nt, Artificial Sequence
  Description of Artificial Sequence: Synthetic oligonucleotide
uacuauauguucugucagauu

SEQ ID NO: 20314 - RNA, 21 nt, Artificial Sequence
  Description of Artificial Sequence: Synthetic oligonucleotide
acuauauguucugucaguauu

SEQ ID NO: 20315 - RNA, 21 nt, Artificial Sequence
  Description of Artificial Sequence: Synthetic oligonucleotide
cuauauguucugucaguuauu

SEQ ID NO: 20316 - RNA, 21 nt, Artificial Sequence
  Description of Artificial Sequence: Synthetic oligonucleotide
uauauguucugucaguuuauu

SEQ ID NO: 20317 - RNA, 21 nt, Artificial Sequence
  Description of Artificial Sequence: Synthetic oligonucleotide
auauguucugucaguuucauu

SEQ ID NO: 20318 - RNA, 21 nt, Artificial Sequence
  Description of Artificial Sequence: Synthetic oligonucleotide
uauguucugucaguuucuauu

SEQ ID NO: 20319 - RNA, 21 nt, Artificial Sequence
  Description of Artificial Sequence: Synthetic oligonucleotide
auguucugucaguuucuuauu

SEQ ID NO: 20320 - RNA, 21 nt, Artificial Sequence
  Description of Artificial Sequence: Synthetic oligonucleotide
uguucugucaguuucuuuauu

SEQ ID NO: 20321 - RNA, 21 nt, Artificial Sequence
  Description of Artificial Sequence: Synthetic oligonucleotide
guucugucaguuucuuucauu

SEQ ID NO: 20322 - RNA, 21 nt, Artificial Sequence
  Description of Artificial Sequence: Synthetic oligonucleotide
uucugucaguuucuuucaauu

SEQ ID NO: 20323 - RNA, 21 nt, Artificial Sequence
  Description of Artificial Sequence: Synthetic oligonucleotide
ucugucaguuucuuucagauu

SEQ ID NO: 20324 - RNA, 21 nt, Artificial Sequence
  Description of Artificial Sequence: Synthetic oligonucleotide
cugucaguuucuuucaggauu

SEQ ID NO: 20325 - RNA, 21 nt, Artificial Sequence
  Description of Artificial Sequence: Synthetic oligonucleotide
ugucaguuucuuucaggaauu

SEQ ID NO: 20326 - RNA, 21 nt, Artificial Sequence
  Description of Artificial Sequence: Synthetic oligonucleotide
gucaguuucuuucaggaaauu

SEQ ID NO: 20327 - RNA, 21 nt, Artificial Sequence
  Description of Artificial Sequence: Synthetic oligonucleotide
ucaguuucuuucaggaaaauu

SEQ ID NO: 20328 - RNA, 21 nt, Artificial Sequence
  Description of Artificial Sequence: Synthetic oligonucleotide
caguuucuuucaggaaaaauu

SEQ ID NO: 20329 - RNA, 21 nt, Artificial Sequence
  Description of Artificial Sequence: Synthetic oligonucleotide
aguuucuuucaggaaaauauu

SEQ ID NO: 20330 - RNA, 21 nt, Artificial Sequence
  Description of Artificial Sequence: Synthetic oligonucleotide
guuucuuucaggaaaaucauu

SEQ ID NO: 20331 - RNA, 21 nt, Artificial Sequence
  Description of Artificial Sequence: Synthetic oligonucleotide
uuucuuucaggaaaaucuauu

SEQ ID NO: 20332 - RNA, 21 nt, Artificial Sequence
  Description of Artificial Sequence: Synthetic oligonucleotide
uucuuucaggaaaaucuuauu

SEQ ID NO: 20333 - RNA, 21 nt, Artificial Sequence
  Description of Artificial Sequence: Synthetic oligonucleotide
ucuuucaggaaaaucuucauu

SEQ ID NO: 20334 - RNA, 21 nt, Artificial Sequence
  Description of Artificial Sequence: Synthetic oligonucleotide
cuuucaggaaaaucuucaauu

SEQ ID NO: 20335 - RNA, 21 nt, Artificial Sequence
  Description of Artificial Sequence: Synthetic oligonucleotide
uuucaggaaaaucuucauauu

SEQ ID NO: 20336 - RNA, 21 nt, Artificial Sequence
  Description of Artificial Sequence: Synthetic oligonucleotide
uucaggaaaaucuucaucauu

SEQ ID NO: 20337 - RNA, 21 nt, Artificial Sequence
  Description of Artificial Sequence: Synthetic oligonucleotide
ucaggaaaaucuucaucuauu

SEQ ID NO: 20338 - RNA, 21 nt, Artificial Sequence
  Description of Artificial Sequence: Synthetic oligonucleotide
caggaaaaucuucaucuuauu

SEQ ID NO: 20339 - RNA, 21 nt, Artificial Sequence
  Description of Artificial Sequence: Synthetic oligonucleotide
aggaaaaucuucaucuuaauu

SEQ ID NO: 20340 - RNA, 21 nt, Artificial Sequence
  Description of Artificial Sequence: Synthetic oligonucleotide
ggaaaaucuucaucuuacauu

SEQ ID NO: 20341 - RNA, 21 nt, Artificial Sequence
  Description of Artificial Sequence: Synthetic oligonucleotide
gaaaaucuucaucuuacaauu

SEQ ID NO: 20342 - RNA, 21 nt, Artificial Sequence
  Description of Artificial Sequence: Synthetic oligonucleotide
aaaaucuucaucuuacaaauu

SEQ ID NO: 20343 - RNA, 21 nt, Artificial Sequence
  Description of Artificial Sequence: Synthetic oligonucleotide
aaaucuucaucuuacaacauu

SEQ ID NO: 20344 - RNA, 21 nt, Artificial Sequence
  Description of Artificial Sequence: Synthetic oligonucleotide
aaucuucaucuuacaacuauu

SEQ ID NO: 20345 - RNA, 21 nt, Artificial Sequence
  Description of Artificial Sequence: Synthetic oligonucleotide
aucuucaucuuacaacuuauu

SEQ ID NO: 20346 - RNA, 21 nt, Artificial Sequence
  Description of Artificial Sequence: Synthetic oligonucleotide
ucuucaucuuacaacuugauu

SEQ ID NO: 20347 - RNA, 21 nt, Artificial Sequence
  Description of Artificial Sequence: Synthetic oligonucleotide
cuucaucuuacaacuuguauu

SEQ ID NO: 20348 - RNA, 21 nt, Artificial Sequence
  Description of Artificial Sequence: Synthetic oligonucleotide
uucaucuuacaacuuguaauu

SEQ ID NO: 20349 - RNA, 21 nt, Artificial Sequence
  Description of Artificial Sequence: Synthetic oligonucleotide
ucaucuuacaacuuguagauu

SEQ ID NO: 20350 - RNA, 21 nt, Artificial Sequence
  Description of Artificial Sequence: Synthetic oligonucleotide
caucuuacaacuuguaggauu

SEQ ID NO: 20351 - RNA, 21 nt, Artificial Sequence
  Description of Artificial Sequence: Synthetic oligonucleotide
aucuuacaacuuguagggauu

SEQ ID NO: 20352 - RNA, 21 nt, Artificial Sequence
  Description of Artificial Sequence: Synthetic oligonucleotide
ucuuacaacuuguagggcauu

SEQ ID NO: 20353 - RNA, 21 nt, Artificial Sequence
  Description of Artificial Sequence: Synthetic oligonucleotide
cuuacaacuuguagggcuauu

SEQ ID NO: 20354 - RNA, 21 nt, Artificial Sequence
  Description of Artificial Sequence: Synthetic oligonucleotide
uuacaacuuguagggcugauu

SEQ ID NO: 20355 - RNA, 21 nt, Artificial Sequence
  Description of Artificial Sequence: Synthetic oligonucleotide
uacaacuuguagggcuggauu

SEQ ID NO: 20356 - RNA, 21 nt, Artificial Sequence
  Description of Artificial Sequence: Synthetic oligonucleotide
acaacuuguagggcugguauu

SEQ ID NO: 20357 - RNA, 21 nt, Artificial Sequence
  Description of Artificial Sequence: Synthetic oligonucleotide
caacuuguagggcuggugauu

SEQ ID NO: 20358 - RNA, 21 nt, Artificial Sequence
  Description of Artificial Sequence: Synthetic oligonucleotide
aacuuguagggcugguguauu

SEQ ID NO: 20359 - RNA, 21 nt, Artificial Sequence
  Description of Artificial Sequence: Synthetic oligonucleotide
acuuguagggcugguguuauu

SEQ ID NO: 20360 - RNA, 21 nt, Artificial Sequence
  Description of Artificial Sequence: Synthetic oligonucleotide
cuuguagggcugguguuaauu

SEQ ID NO: 20361 - RNA, 21 nt, Artificial Sequence
  Description of Artificial Sequence: Synthetic oligonucleotide
uuguagggcugguguuaaauu

SEQ ID NO: 20362 - RNA, 21 nt, Artificial Sequence
  Description of Artificial Sequence: Synthetic oligonucleotide
uguagggcugguguuaacauu

SEQ ID NO: 20363 - RNA, 21 nt, Artificial Sequence
  Description of Artificial Sequence: Synthetic oligonucleotide
guagggcugguguuaacuauu

SEQ ID NO: 20364 - RNA, 21 nt, Artificial Sequence
  Description of Artificial Sequence: Synthetic oligonucleotide
uagggcugguguuaacuuauu

SEQ ID NO: 20365 - RNA, 21 nt, Artificial Sequence
  Description of Artificial Sequence: Synthetic oligonucleotide
agggcugguguuaacuuaauu

SEQ ID NO: 20366 - RNA, 21 nt, Artificial Sequence
  Description of Artificial Sequence: Synthetic oligonucleotide
gggcugguguuaacuuacauu

SEQ ID NO: 20367 - RNA, 21 nt, Artificial Sequence
  Description of Artificial Sequence: Synthetic oligonucleotide
ggcugguguuaacuuacgauu

SEQ ID NO: 20368 - RNA, 21 nt, Artificial Sequence
  Description of Artificial Sequence: Synthetic oligonucleotide
gcugguguuaacuuacgaauu

SEQ ID NO: 20369 - RNA, 21 nt, Artificial Sequence
  Description of Artificial Sequence: Synthetic oligonucleotide
cugguguuaacuuacgacauu

SEQ ID NO: 20370 - RNA, 21 nt, Artificial Sequence
  Description of Artificial Sequence: Synthetic oligonucleotide
ugguguuaacuuacgacuauu

SEQ ID NO: 20371 - RNA, 21 nt, Artificial Sequence
  Description of Artificial Sequence: Synthetic oligonucleotide
gguguuaacuuacgacuuauu

SEQ ID NO: 20372 - RNA, 21 nt, Artificial Sequence
  Description of Artificial Sequence: Synthetic oligonucleotide
guguuaacuuacgacuucauu

SEQ ID NO: 20373 - RNA, 21 nt, Artificial Sequence
  Description of Artificial Sequence: Synthetic oligonucleotide
uguuaacuuacgacuucaauu

SEQ ID NO: 20374 - RNA, 21 nt, Artificial Sequence
  Description of Artificial Sequence: Synthetic oligonucleotide
guuaacuuacgacuucacauu

SEQ ID NO: 20375 - RNA, 21 nt, Artificial Sequence
  Description of Artificial Sequence: Synthetic oligonucleotide
uuaacuuacgacuucacuauu

SEQ ID NO: 20376 - RNA, 21 nt, Artificial Sequence
  Description of Artificial Sequence: Synthetic oligonucleotide
uaacuuacgacuucacuaauu

SEQ ID NO: 20377 - RNA, 21 nt, Artificial Sequence
  Description of Artificial Sequence: Synthetic oligonucleotide
aacuuacgacuucacuaaauu

SEQ ID NO: 20378 - RNA, 21 nt, Artificial Sequence
  Description of Artificial Sequence: Synthetic oligonucleotide
acuuacgacuucacuaacauu

SEQ ID NO: 20379 - RNA, 21 nt, Artificial Sequence
  Description of Artificial Sequence: Synthetic oligonucleotide
cuuacgacuucacuaacuauu

SEQ ID NO: 20380 - RNA, 21 nt, Artificial Sequence
  Description of Artificial Sequence: Synthetic oligonucleotide
uuacgacuucacuaacugauu

SEQ ID NO: 20381 - RNA, 21 nt, Artificial Sequence
  Description of Artificial Sequence: Synthetic oligonucleotide
uacgacuucacuaacuguauu

SEQ ID NO: 20382 - RNA, 21 nt, Artificial Sequence
  Description of Artificial Sequence: Synthetic oligonucleotide
acgacuucacuaacugugauu

SEQ ID NO: 20383 - RNA, 21 nt, Artificial Sequence
  Description of Artificial Sequence: Synthetic oligonucleotide
cgacuucacuaacugugaauu

SEQ ID NO: 20384 - RNA, 21 nt, Artificial Sequence
  Description of Artificial Sequence: Synthetic oligonucleotide
gacuucacuaacugugacauu

SEQ ID NO: 20385 - RNA, 21 nt, Artificial Sequence
  Description of Artificial Sequence: Synthetic oligonucleotide
acuucacuaacugugacuauu

SEQ ID NO: 20386 - RNA, 21 nt, Artificial Sequence
  Description of Artificial Sequence: Synthetic oligonucleotide
cuucacuaacugugacuuauu

SEQ ID NO: 20387 - RNA, 21 nt, Artificial Sequence
  Description of Artificial Sequence: Synthetic oligonucleotide
uucacuaacugugacuuuauu

SEQ ID NO: 20388 - RNA, 21 nt, Artificial Sequence
  Description of Artificial Sequence: Synthetic oligonucleotide
ucacuaacugugacuuugauu

SEQ ID NO: 20389 - RNA, 21 nt, Artificial Sequence
  Description of Artificial Sequence: Synthetic oligonucleotide
cacuaacugugacuuugaauu

SEQ ID NO: 20390 - RNA, 21 nt, Artificial Sequence
  Description of Artificial Sequence: Synthetic oligonucleotide
acuaacugugacuuugagauu

SEQ ID NO: 20391 - RNA, 21 nt, Artificial Sequence
  Description of Artificial Sequence: Synthetic oligonucleotide
cuaacugugacuuugagaauu

SEQ ID NO: 20392 - RNA, 21 nt, Artificial Sequence
  Description of Artificial Sequence: Synthetic oligonucleotide
uaacugugacuuugagaaauu

SEQ ID NO: 20393 - RNA, 21 nt, Artificial Sequence
  Description of Artificial Sequence: Synthetic oligonucleotide
aacugugacuuugagaagauu

SEQ ID NO: 20394 - RNA, 21 nt, Artificial Sequence
  Description of Artificial Sequence: Synthetic oligonucleotide
acugugacuuugagaagaauu

SEQ ID NO: 20395 - RNA, 21 nt, Artificial Sequence
  Description of Artificial Sequence: Synthetic oligonucleotide
cugugacuuugagaagauauu

SEQ ID NO: 20396 - RNA, 21 nt, Artificial Sequence
  Description of Artificial Sequence: Synthetic oligonucleotide
ugugacuuugagaagauuauu

SEQ ID NO: 20397 - RNA, 21 nt, Artificial Sequence
  Description of Artificial Sequence: Synthetic oligonucleotide
gugacuuugagaagauuaauu

SEQ ID NO: 20398 - RNA, 21 nt, Artificial Sequence
  Description of Artificial Sequence: Synthetic oligonucleotide
ugacuuugagaagauuaaauu

SEQ ID NO: 20399 - RNA, 21 nt, Artificial Sequence
  Description of Artificial Sequence: Synthetic oligonucleotide
gacuuugagaagauuaaaauu

SEQ ID NO: 20400 - RNA, 21 nt, Artificial Sequence
  Description of Artificial Sequence: Synthetic oligonucleotide
acuuugagaagauuaaagauu

SEQ ID NO: 20401 - RNA, 21 nt, Artificial Sequence
  Description of Artificial Sequence: Synthetic oligonucleotide
cuuugagaagauuaaagcauu

SEQ ID NO: 20402 - RNA, 21 nt, Artificial Sequence
  Description of Artificial Sequence: Synthetic oligonucleotide
uuugagaagauuaaagcaauu

SEQ ID NO: 20403 - RNA, 21 nt, Artificial Sequence
  Description of Artificial Sequence: Synthetic oligonucleotide
uugagaagauuaaagcagauu

SEQ ID NO: 20404 - RNA, 21 nt, Artificial Sequence
  Description of Artificial Sequence: Synthetic oligonucleotide
ugagaagauuaaagcagcauu

SEQ ID NO: 20405 - RNA, 21 nt, Artificial Sequence
  Description of Artificial Sequence: Synthetic oligonucleotide
gagaagauuaaagcagccauu

SEQ ID NO: 20406 - RNA, 21 nt, Artificial Sequence
  Description of Artificial Sequence: Synthetic oligonucleotide
agaagauuaaagcagccuauu

SEQ ID NO: 20407 - RNA, 21 nt, Artificial Sequence
  Description of Artificial Sequence: Synthetic oligonucleotide
gaagauuaaagcagccuaauu

SEQ ID NO: 20408 - RNA, 21 nt, Artificial Sequence
  Description of Artificial Sequence: Synthetic oligonucleotide
aagauuaaagcagccuauauu

SEQ ID NO: 20409 - RNA, 21 nt, Artificial Sequence
  Description of Artificial Sequence: Synthetic oligonucleotide
agauuaaagcagccuaucauu

SEQ ID NO: 20410 - RNA, 21 nt, Artificial Sequence
  Description of Artificial Sequence: Synthetic oligonucleotide
gauuaaagcagccuaucuauu

SEQ ID NO: 20411 - RNA, 21 nt, Artificial Sequence
  Description of Artificial Sequence: Synthetic oligonucleotide
auuaaagcagccuaucucauu

SEQ ID NO: 20412 - RNA, 21 nt, Artificial Sequence
  Description of Artificial Sequence: Synthetic oligonucleotide
uuaaagcagccuaucucaauu

SEQ ID NO: 20413 - RNA, 21 nt, Artificial Sequence
  Description of Artificial Sequence: Synthetic oligonucleotide
uaaagcagccuaucucagauu

SEQ ID NO: 20414 - RNA, 21 nt, Artificial Sequence
  Description of Artificial Sequence: Synthetic oligonucleotide
aaagcagccuaucucaguauu

SEQ ID NO: 20415 - RNA, 21 nt, Artificial Sequence
  Description of Artificial Sequence: Synthetic oligonucleotide
aagcagccuaucucaguaauu

SEQ ID NO: 20416 - RNA, 21 nt, Artificial Sequence
  Description of Artificial Sequence: Synthetic oligonucleotide
agcagccuaucucaguacauu

SEQ ID NO: 20417 - RNA, 21 nt, Artificial Sequence
  Description of Artificial Sequence: Synthetic oligonucleotide
gcagccuaucucaguacuauu

SEQ ID NO: 20418 - RNA, 21 nt, Artificial Sequence
  Description of Artificial Sequence: Synthetic oligonucleotide
cagccuaucucaguacuaauu

SEQ ID NO: 20419 - RNA, 21 nt, Artificial Sequence
  Description of Artificial Sequence: Synthetic oligonucleotide
agccuaucucaguacuauauu

SEQ ID NO: 20420 - RNA, 21 nt, Artificial Sequence
  Description of Artificial Sequence: Synthetic oligonucleotide
gccuaucucaguacuauuauu

SEQ ID NO: 20421 - RNA, 21 nt, Artificial Sequence
  Description of Artificial Sequence: Synthetic oligonucleotide
ccuaucucaguacuauuuauu

SEQ ID NO: 20422 - RNA, 21 nt, Artificial Sequence
  Description of Artificial Sequence: Synthetic oligonucleotide
cuaucucaguacuauuucauu

SEQ ID NO: 20423 - RNA, 21 nt, Artificial Sequence
  Description of Artificial Sequence: Synthetic oligonucleotide
uaucucaguacuauuucuauu

SEQ ID NO: 20424 - RNA, 21 nt, Artificial Sequence
  Description of Artificial Sequence: Synthetic oligonucleotide
aucucaguacuauuucuaauu

SEQ ID NO: 20425 - RNA, 21 nt, Artificial Sequence
  Description of Artificial Sequence: Synthetic oligonucleotide
ucucaguacuauuucuaaauu

SEQ ID NO: 20426 - RNA, 21 nt, Artificial Sequence
  Description of Artificial Sequence: Synthetic oligonucleotide
cucaguacuauuucuaaaauu

SEQ ID NO: 20427 - RNA, 21 nt, Artificial Sequence
  Description of Artificial Sequence: Synthetic oligonucleotide
ucaguacuauuucuaaagauu

SEQ ID NO: 20428 - RNA, 21 nt, Artificial Sequence
  Description of Artificial Sequence: Synthetic oligonucleotide
caguacuauuucuaaagaauu

SEQ ID NO: 20429 - RNA, 21 nt, Artificial Sequence
  Description of Artificial Sequence: Synthetic oligonucleotide
aguacuauuucuaaagacauu

SEQ ID NO: 20430 - RNA, 21 nt, Artificial Sequence
  Description of Artificial Sequence: Synthetic oligonucleotide
guacuauuucuaaagaccauu

SEQ ID NO: 20431 - RNA, 21 nt, Artificial Sequence
  Description of Artificial Sequence: Synthetic oligonucleotide
uacuauuucuaaagaccuauu

SEQ ID NO: 20432 - RNA, 21 nt, Artificial Sequence
  Description of Artificial Sequence: Synthetic oligonucleotide
acuauuucuaaagaccugauu

SEQ ID NO: 20433 - RNA, 21 nt, Artificial Sequence
  Description of Artificial Sequence: Synthetic oligonucleotide
cuauuucuaaagaccugaauu

SEQ ID NO: 20434 - RNA, 21 nt, Artificial Sequence
  Description of Artificial Sequence: Synthetic oligonucleotide
uauuucuaaagaccugauauu

SEQ ID NO: 20435 - RNA, 21 nt, Artificial Sequence
  Description of Artificial Sequence: Synthetic oligonucleotide
auuucuaaagaccugauuauu

SEQ ID NO: 20436 - RNA, 21 nt, Artificial Sequence
  Description of Artificial Sequence: Synthetic oligonucleotide
uuucuaaagaccugauuaauu

SEQ ID NO: 20437 - RNA, 21 nt, Artificial Sequence
  Description of Artificial Sequence: Synthetic oligonucleotide
uucuaaagaccugauuacauu

SEQ ID NO: 20438 - RNA, 21 nt, Artificial Sequence
  Description of Artificial Sequence: Synthetic oligonucleotide
ucuaaagaccugauuacaauu

SEQ ID NO: 20439 - RNA, 21 nt, Artificial Sequence
  Description of Artificial Sequence: Synthetic oligonucleotide
cuaaagaccugauuacauauu

SEQ ID NO: 20440 - RNA, 21 nt, Artificial Sequence
  Description of Artificial Sequence: Synthetic oligonucleotide
uaaagaccugauuacauaauu

SEQ ID NO: 20441 - RNA, 21 nt, Artificial Sequence
  Description of Artificial Sequence: Synthetic oligonucleotide
aaagaccugauuacauauauu

SEQ ID NO: 20442 - RNA, 21 nt, Artificial Sequence
  Description of Artificial Sequence: Synthetic oligonucleotide
aagaccugauuacauauaauu

SEQ ID NO: 20443 - RNA, 21 nt, Artificial Sequence
  Description of Artificial Sequence: Synthetic oligonucleotide
agaccugauuacauauauauu

SEQ ID NO: 20444 - RNA, 21 nt, Artificial Sequence
  Description of Artificial Sequence: Synthetic oligonucleotide
gaccugauuacauauaugauu

SEQ ID NO: 20445 - RNA, 21 nt, Artificial Sequence
  Description of Artificial Sequence: Synthetic oligonucleotide
accugauuacauauaugaauu

SEQ ID NO: 20446 - RNA, 21 nt, Artificial Sequence
  Description of Artificial Sequence: Synthetic oligonucleotide
ccugauuacauauaugagauu

SEQ ID NO: 20447 - RNA, 21 nt, Artificial Sequence
  Description of Artificial Sequence: Synthetic oligonucleotide
cugauuacauauaugaguauu

SEQ ID NO: 20448 - RNA, 21 nt, Artificial Sequence
  Description of Artificial Sequence: Synthetic oligonucleotide
ugauuacauauaugagugauu

SEQ ID NO: 20449 - RNA, 21 nt, Artificial Sequence
  Description of Artificial Sequence: Synthetic oligonucleotide
gauuacauauaugaguggauu

SEQ ID NO: 20450 - RNA, 21 nt, Artificial Sequence
  Description of Artificial Sequence: Synthetic oligonucleotide
auuacauauaugagugggauu

SEQ ID NO: 20451 - RNA, 21 nt, Artificial Sequence
  Description of Artificial Sequence: Synthetic oligonucleotide
uuacauauaugagugggaauu

SEQ ID NO: 20452 - RNA, 21 nt, Artificial Sequence
  Description of Artificial Sequence: Synthetic oligonucleotide
uacauauaugagugggacauu

SEQ ID NO: 20453 - RNA, 21 nt, Artificial Sequence
  Description of Artificial Sequence: Synthetic oligonucleotide
acauauaugagugggaccauu

SEQ ID NO: 20454 - RNA, 21 nt, Artificial Sequence
  Description of Artificial Sequence: Synthetic oligonucleotide
cauauaugagugggaccaauu

SEQ ID NO: 20455 - RNA, 21 nt, Artificial Sequence
  Description of Artificial Sequence: Synthetic oligonucleotide
auauaugagugggaccaaauu

SEQ ID NO: 20456 - RNA, 21 nt, Artificial Sequence
  Description of Artificial Sequence: Synthetic oligonucleotide
uauaugagugggaccaaaauu

SEQ ID NO: 20457 - RNA, 21 nt, Artificial Sequence
  Description of Artificial Sequence: Synthetic oligonucleotide
auaugagugggaccaaaaauu

SEQ ID NO: 20458 - RNA, 21 nt, Artificial Sequence
  Description of Artificial Sequence: Synthetic oligonucleotide
uaugagugggaccaaaagauu

SEQ ID NO: 20459 - RNA, 21 nt, Artificial Sequence
  Description of Artificial Sequence: Synthetic oligonucleotide
augagugggaccaaaaguauu

SEQ ID NO: 20460 - RNA, 21 nt, Artificial Sequence
  Description of Artificial Sequence: Synthetic oligonucleotide
ugagugggaccaaaaguaauu

SEQ ID NO: 20461 - RNA, 21 nt, Artificial Sequence
  Description of Artificial Sequence: Synthetic oligonucleotide
gagugggaccaaaaguacauu

SEQ ID NO: 20462 - RNA, 21 nt, Artificial Sequence
  Description of Artificial Sequence: Synthetic oligonucleotide
agugggaccaaaaguaccauu

SEQ ID NO: 20463 - RNA, 21 nt, Artificial Sequence
  Description of Artificial Sequence: Synthetic oligonucleotide
gugggaccaaaaguaccgauu

SEQ ID NO: 20464 - RNA, 21 nt, Artificial Sequence
  Description of Artificial Sequence: Synthetic oligonucleotide
ugggaccaaaaguaccgaauu

SEQ ID NO: 20465 - RNA, 21 nt, Artificial Sequence
  Description of Artificial Sequence: Synthetic oligonucleotide
gggaccaaaaguaccgagauu

SEQ ID NO: 20466 - RNA, 21 nt, Artificial Sequence
  Description of Artificial Sequence: Synthetic oligonucleotide
ggaccaaaaguaccgaguauu

SEQ ID NO: 20467 - RNA, 21 nt, Artificial Sequence
  Description of Artificial Sequence: Synthetic oligonucleotide
gaccaaaaguaccgaguuauu

SEQ ID NO: 20468 - RNA, 21 nt, Artificial Sequence
  Description of Artificial Sequence: Synthetic oligonucleotide
accaaaaguaccgaguucauu

SEQ ID NO: 20469 - RNA, 21 nt, Artificial Sequence
  Description of Artificial Sequence: Synthetic oligonucleotide
ccaaaaguaccgaguucaauu

SEQ ID NO: 20470 - RNA, 21 nt, Artificial Sequence
  Description of Artificial Sequence: Synthetic oligonucleotide
caaaaguaccgaguucaaauu

SEQ ID NO: 20471 - RNA, 21 nt, Artificial Sequence
  Description of Artificial Sequence: Synthetic oligonucleotide
aaaaguaccgaguucaacauu

SEQ ID NO: 20472 - RNA, 21 nt, Artificial Sequence
  Description of Artificial Sequence: Synthetic oligonucleotide
aaaguaccgaguucaacaauu

SEQ ID NO: 20473 - RNA, 21 nt, Artificial Sequence
  Description of Artificial Sequence: Synthetic oligonucleotide
aaguaccgaguucaacaaauu

SEQ ID NO: 20474 - RNA, 21 nt, Artificial Sequence
  Description of Artificial Sequence: Synthetic oligonucleotide
aguaccgaguucaacaacauu

SEQ ID NO: 20475 - RNA, 21 nt, Artificial Sequence
  Description of Artificial Sequence: Synthetic oligonucleotide
guaccgaguucaacaacaauu

SEQ ID NO: 20476 - RNA, 21 nt, Artificial Sequence
  Description of Artificial Sequence: Synthetic oligonucleotide
uaccgaguucaacaacacauu

SEQ ID NO: 20477 - RNA, 21 nt, Artificial Sequence
  Description of Artificial Sequence: Synthetic oligonucleotide
accgaguucaacaacaccauu

SEQ ID NO: 20478 - RNA, 21 nt, Artificial Sequence
  Description of Artificial Sequence: Synthetic oligonucleotide
ccgaguucaacaacaccgauu

SEQ ID NO: 20479 - RNA, 21 nt, Artificial Sequence
  Description of Artificial Sequence: Synthetic oligonucleotide
cgaguucaacaacaccguauu

SEQ ID NO: 20480 - RNA, 21 nt, Artificial Sequence
  Description of Artificial Sequence: Synthetic oligonucleotide
gaguucaacaacaccgucauu

SEQ ID NO: 20481 - RNA, 21 nt, Artificial Sequence
  Description of Artificial Sequence: Synthetic oligonucleotide
aguucaacaacaccgucuauu

SEQ ID NO: 20482 - RNA, 21 nt, Artificial Sequence
  Description of Artificial Sequence: Synthetic oligonucleotide
guucaacaacaccgucucauu

SEQ ID NO: 20483 - RNA, 21 nt, Artificial Sequence
  Description of Artificial Sequence: Synthetic oligonucleotide
uucaacaacaccgucucuauu

SEQ ID NO: 20484 - RNA, 21 nt, Artificial Sequence
  Description of Artificial Sequence: Synthetic oligonucleotide
ucaacaacaccgucucuuauu

SEQ ID NO: 20485 - RNA, 21 nt, Artificial Sequence
  Description of Artificial Sequence: Synthetic oligonucleotide
caacaacaccgucucuugauu

SEQ ID NO: 20486 - RNA, 21 nt, Artificial Sequence
  Description of Artificial Sequence: Synthetic oligonucleotide
aacaacaccgucucuuguauu

SEQ ID NO: 20487 - RNA, 21 nt, Artificial Sequence
  Description of Artificial Sequence: Synthetic oligonucleotide
acaacaccgucucuuguaauu

SEQ ID NO: 20488 - RNA, 21 nt, Artificial Sequence
  Description of Artificial Sequence: Synthetic oligonucleotide
caacaccgucucuuguagauu

SEQ ID NO: 20489 - RNA, 21 nt, Artificial Sequence
  Description of Artificial Sequence: Synthetic oligonucleotide
aacaccgucucuuguagcauu

SEQ ID NO: 20490 - RNA, 21 nt, Artificial Sequence
  Description of Artificial Sequence: Synthetic oligonucleotide
acaccgucucuuguagcaauu

SEQ ID NO: 20491 - RNA, 21 nt, Artificial Sequence
  Description of Artificial Sequence: Synthetic oligonucleotide
caccgucucuuguagcaaauu

SEQ ID NO: 20492 - RNA, 21 nt, Artificial Sequence
  Description of Artificial Sequence: Synthetic oligonucleotide
accgucucuuguagcaauauu

SEQ ID NO: 20493 - RNA, 21 nt, Artificial Sequence
  Description of Artificial Sequence: Synthetic oligonucleotide
ccgucucuuguagcaaucauu

SEQ ID NO: 20494 - RNA, 21 nt, Artificial Sequence
  Description of Artificial Sequence: Synthetic oligonucleotide
cgucucuuguagcaaucgauu

SEQ ID NO: 20495 - RNA, 21 nt, Artificial Sequence
  Description of Artificial Sequence: Synthetic oligonucleotide
gucucuuguagcaaucggauu

SEQ ID NO: 20496 - RNA, 21 nt, Artificial Sequence
  Description of Artificial Sequence: Synthetic oligonucleotide
ucucuuguagcaaucggcauu

SEQ ID NO: 20497 - RNA, 21 nt, Artificial Sequence
  Description of Artificial Sequence: Synthetic oligonucleotide
cucuuguagcaaucggccauu

SEQ ID NO: 20498 - RNA, 21 nt, Artificial Sequence
  Description of Artificial Sequence: Synthetic oligonucleotide
ucuuguagcaaucggccaauu

SEQ ID NO: 20499 - RNA, 21 nt, Artificial Sequence
  Description of Artificial Sequence: Synthetic oligonucleotide
cuuguagcaaucggccacauu

SEQ ID NO: 20500 - RNA, 21 nt, Artificial Sequence
  Description of Artificial Sequence: Synthetic oligonucleotide
uuguagcaaucggccacaauu

SEQ ID NO: 20501 - RNA, 21 nt, Artificial Sequence
  Description of Artificial Sequence: Synthetic oligonucleotide
uguagcaaucggccacauauu

SEQ ID NO: 20502 - RNA, 21 nt, Artificial Sequence
  Description of Artificial Sequence: Synthetic oligonucleotide
guagcaaucggccacauuauu

SEQ ID NO: 20503 - RNA, 21 nt, Artificial Sequence
  Description of Artificial Sequence: Synthetic oligonucleotide
uagcaaucggccacauugauu

SEQ ID NO: 20504 - RNA, 21 nt, Artificial Sequence
  Description of Artificial Sequence: Synthetic oligonucleotide
agcaaucggccacauugcauu

SEQ ID NO: 20505 - RNA, 21 nt, Artificial Sequence
  Description of Artificial Sequence: Synthetic oligonucleotide
gcaaucggccacauugccauu

SEQ ID NO: 20506 - RNA, 21 nt, Artificial Sequence
  Description of Artificial Sequence: Synthetic oligonucleotide
caaucggccacauugccuauu

SEQ ID NO: 20507 - RNA, 21 nt, Artificial Sequence
  Description of Artificial Sequence: Synthetic oligonucleotide
aaucggccacauugccuuauu

SEQ ID NO: 20508 - RNA, 21 nt, Artificial Sequence
  Description of Artificial Sequence: Synthetic oligonucleotide
aucggccacauugccuuaauu

SEQ ID NO: 20509 - RNA, 21 nt, Artificial Sequence
  Description of Artificial Sequence: Synthetic oligonucleotide
ucggccacauugccuuacauu

SEQ ID NO: 20510 - RNA, 21 nt, Artificial Sequence
  Description of Artificial Sequence: Synthetic oligonucleotide
cggccacauugccuuacuauu

SEQ ID NO: 20511 - RNA, 21 nt, Artificial Sequence
  Description of Artificial Sequence: Synthetic oligonucleotide
ggccacauugccuuacugauu

SEQ ID NO: 20512 - RNA, 21 nt, Artificial Sequence
  Description of Artificial Sequence: Synthetic oligonucleotide
gccacauugccuuacugaauu

SEQ ID NO: 20513 - RNA, 21 nt, Artificial Sequence
  Description of Artificial Sequence: Synthetic oligonucleotide
ccacauugccuuacugaaauu

SEQ ID NO: 20514 - RNA, 21 nt, Artificial Sequence
  Description of Artificial Sequence: Synthetic oligonucleotide
cacauugccuuacugaaaauu

SEQ ID NO: 20515 - RNA, 21 nt, Artificial Sequence
  Description of Artificial Sequence: Synthetic oligonucleotide
acauugccuuacugaaauauu

SEQ ID NO: 20516 - RNA, 21 nt, Artificial Sequence
  Description of Artificial Sequence: Synthetic oligonucleotide
cauugccuuacugaaaucauu

SEQ ID NO: 20517 - RNA, 21 nt, Artificial Sequence
  Description of Artificial Sequence: Synthetic oligonucleotide
auugccuuacugaaauccauu

SEQ ID NO: 20518 - RNA, 21 nt, Artificial Sequence
  Description of Artificial Sequence: Synthetic oligonucleotide
uugccuuacugaaauccaauu

SEQ ID NO: 20519 - RNA, 21 nt, Artificial Sequence
  Description of Artificial Sequence: Synthetic oligonucleotide
ugccuuacugaaauccagauu

SEQ ID NO: 20520 - RNA, 21 nt, Artificial Sequence
  Description of Artificial Sequence: Synthetic oligonucleotide
gccuuacugaaauccagaauu

SEQ ID NO: 20521 - RNA, 21 nt, Artificial Sequence
  Description of Artificial Sequence: Synthetic oligonucleotide
ccuuacugaaauccagagauu

SEQ ID NO: 20522 - RNA, 21 nt, Artificial Sequence
  Description of Artificial Sequence: Synthetic oligonucleotide
cuuacugaaauccagagcauu

SEQ ID NO: 20523 - RNA, 21 nt, Artificial Sequence
  Description of Artificial Sequence: Synthetic oligonucleotide
uuacugaaauccagagccauu

SEQ ID NO: 20524 - RNA, 21 nt, Artificial Sequence
  Description of Artificial Sequence: Synthetic oligonucleotide
uacugaaauccagagccuauu

SEQ ID NO: 20525 - RNA, 21 nt, Artificial Sequence
  Description of Artificial Sequence: Synthetic oligonucleotide
acugaaauccagagccuaauu

SEQ ID NO: 20526 - RNA, 21 nt, Artificial Sequence
  Description of Artificial Sequence: Synthetic oligonucleotide
cugaaauccagagccuaaauu

SEQ ID NO: 20527 - RNA, 21 nt, Artificial Sequence
  Description of Artificial Sequence: Synthetic oligonucleotide
ugaaauccagagccuaacauu

SEQ ID NO: 20528 - RNA, 21 nt, Artificial Sequence
  Description of Artificial Sequence: Synthetic oligonucleotide
gaaauccagagccuaaccauu

SEQ ID NO: 20529 - RNA, 21 nt, Artificial Sequence
  Description of Artificial Sequence: Synthetic oligonucleotide
aaauccagagccuaaccuauu

SEQ ID NO: 20530 - RNA, 21 nt, Artificial Sequence
  Description of Artificial Sequence: Synthetic oligonucleotide
aauccagagccuaaccuuauu

SEQ ID NO: 20531 - RNA, 21 nt, Artificial Sequence
  Description of Artificial Sequence: Synthetic oligonucleotide
auccagagccuaaccuucauu

SEQ ID NO: 20532 - RNA, 21 nt, Artificial Sequence
  Description of Artificial Sequence: Synthetic oligonucleotide
uccagagccuaaccuucaauu

SEQ ID NO: 20533 - RNA, 21 nt, Artificial Sequence
  Description of Artificial Sequence: Synthetic oligonucleotide
ccagagccuaaccuucaaauu

SEQ ID NO: 20534 - RNA, 21 nt, Artificial Sequence
  Description of Artificial Sequence: Synthetic oligonucleotide
cagagccuaaccuucaauauu

SEQ ID NO: 20535 - RNA, 21 nt, Artificial Sequence
  Description of Artificial Sequence: Synthetic oligonucleotide
agagccuaaccuucaaucauu

SEQ ID NO: 20536 - RNA, 21 nt, Artificial Sequence
  Description of Artificial Sequence: Synthetic oligonucleotide
gagccuaaccuucaauccauu

SEQ ID NO: 20537 - RNA, 21 nt, Artificial Sequence
  Description of Artificial Sequence: Synthetic oligonucleotide
agccuaaccuucaaucccauu

SEQ ID NO: 20538 - RNA, 21 nt, Artificial Sequence
  Description of Artificial Sequence: Synthetic oligonucleotide
gccuaaccuucaaucccaauu

SEQ ID NO: 20539 - RNA, 21 nt, Artificial Sequence
  Description of Artificial Sequence: Synthetic oligonucleotide
ccuaaccuucaaucccacauu

SEQ ID NO: 20540 - RNA, 21 nt, Artificial Sequence
  Description of Artificial Sequence: Synthetic oligonucleotide
cuaaccuucaaucccaccauu

SEQ ID NO: 20541 - RNA, 21 nt, Artificial Sequence
  Description of Artificial Sequence: Synthetic oligonucleotide
uaaccuucaaucccaccgauu

SEQ ID NO: 20542 - RNA, 21 nt, Artificial Sequence
  Description of Artificial Sequence: Synthetic oligonucleotide
aaccuucaaucccaccgcauu

SEQ ID NO: 20543 - RNA, 21 nt, Artificial Sequence
  Description of Artificial Sequence: Synthetic oligonucleotide
accuucaaucccaccgccauu

SEQ ID NO: 20544 - RNA, 21 nt, Artificial Sequence
  Description of Artificial Sequence: Synthetic oligonucleotide
ccuucaaucccaccgccgauu

SEQ ID NO: 20545 - RNA, 21 nt, Artificial Sequence
  Description of Artificial Sequence: Synthetic oligonucleotide
cuucaaucccaccgccggauu

SEQ ID NO: 20546 - RNA, 21 nt, Artificial Sequence
  Description of Artificial Sequence: Synthetic oligonucleotide
uucaaucccaccgccggcauu

SEQ ID NO: 20547 - RNA, 21 nt, Artificial Sequence
  Description of Artificial Sequence: Synthetic oligonucleotide
ucaaucccaccgccggcuauu

SEQ ID NO: 20548 - RNA, 21 nt, Artificial Sequence
  Description of Artificial Sequence: Synthetic oligonucleotide
caaucccaccgccggcugauu

SEQ ID NO: 20549 - RNA, 21 nt, Artificial Sequence
  Description of Artificial Sequence: Synthetic oligonucleotide
aaucccaccgccggcugcauu

SEQ ID NO: 20550 - RNA, 21 nt, Artificial Sequence
  Description of Artificial Sequence: Synthetic oligonucleotide
aucccaccgccggcugcgauu

SEQ ID NO: 20551 - RNA, 21 nt, Artificial Sequence
  Description of Artificial Sequence: Synthetic oligonucleotide
ucccaccgccggcugcgcauu

SEQ ID NO: 20552 - RNA, 21 nt, Artificial Sequence
  Description of Artificial Sequence: Synthetic oligonucleotide
cccaccgccggcugcgcgauu

SEQ ID NO: 20553 - RNA, 21 nt, Artificial Sequence
  Description of Artificial Sequence: Synthetic oligonucleotide
ccaccgccggcugcgcguauu

SEQ ID NO: 20554 - RNA, 21 nt, Artificial Sequence
  Description of Artificial Sequence: Synthetic oligonucleotide
caccgccggcugcgcgucauu

SEQ ID NO: 20555 - RNA, 21 nt, Artificial Sequence
  Description of Artificial Sequence: Synthetic oligonucleotide
accgccggcugcgcgucgauu

SEQ ID NO: 20556 - RNA, 21 nt, Artificial Sequence
  Description of Artificial Sequence: Synthetic oligonucleotide
ccgccggcugcgcgucgcauu

SEQ ID NO: 20557 - RNA, 21 nt, Artificial Sequence
  Description of Artificial Sequence: Synthetic oligonucleotide
cgccggcugcgcgucgcuauu

SEQ ID NO: 20558 - RNA, 21 nt, Artificial Sequence
  Description of Artificial Sequence: Synthetic oligonucleotide
gccggcugcgcgucgcucauu

SEQ ID NO: 20559 - RNA, 21 nt, Artificial Sequence
  Description of Artificial Sequence: Synthetic oligonucleotide
ccggcugcgcgucgcucgauu

SEQ ID NO: 20560 - RNA, 21 nt, Artificial Sequence
  Description of Artificial Sequence: Synthetic oligonucleotide
cggcugcgcgucgcucgcauu

SEQ ID NO: 20561 - RNA, 21 nt, Artificial Sequence
  Description of Artificial Sequence: Synthetic oligonucleotide
ggcugcgcgucgcucgccauu

SEQ ID NO: 20562 - RNA, 21 nt, Artificial Sequence
  Description of Artificial Sequence: Synthetic oligonucleotide
gcugcgcgucgcucgccaauu

SEQ ID NO: 20563 - RNA, 21 nt, Artificial Sequence
  Description of Artificial Sequence: Synthetic oligonucleotide
cugcgcgucgcucgccaaauu

SEQ ID NO: 20564 - RNA, 21 nt, Artificial Sequence
  Description of Artificial Sequence: Synthetic oligonucleotide
ugcgcgucgcucgccaaaauu

SEQ ID NO: 20565 - RNA, 21 nt, Artificial Sequence
  Description of Artificial Sequence: Synthetic oligonucleotide
gcgcgucgcucgccaaagauu

SEQ ID NO: 20566 - RNA, 21 nt, Artificial Sequence
  Description of Artificial Sequence: Synthetic oligonucleotide
cgcgucgcucgccaaagaauu

SEQ ID NO: 20567 - RNA, 21 nt, Artificial Sequence
  Description of Artificial Sequence: Synthetic oligonucleotide
gcgucgcucgccaaagaaauu

SEQ ID NO: 20568 - RNA, 21 nt, Artificial Sequence
  Description of Artificial Sequence: Synthetic oligonucleotide
cgucgcucgccaaagaaaauu

SEQ ID NO: 20569 - RNA, 21 nt, Artificial Sequence
  Description of Artificial Sequence: Synthetic oligonucleotide
gucgcucgccaaagaaauauu

SEQ ID NO: 20570 - RNA, 21 nt, Artificial Sequence
  Description of Artificial Sequence: Synthetic oligonucleotide
ucgcucgccaaagaaaugauu

SEQ ID NO: 20571 - RNA, 21 nt, Artificial Sequence
  Description of Artificial Sequence: Synthetic oligonucleotide
cgcucgccaaagaaauguauu

SEQ ID NO: 20572 - RNA, 21 nt, Artificial Sequence
  Description of Artificial Sequence: Synthetic oligonucleotide
gcucgccaaagaaauguuauu

SEQ ID NO: 20573 - RNA, 21 nt, Artificial Sequence
  Description of Artificial Sequence: Synthetic oligonucleotide
cucgccaaagaaauguucauu

SEQ ID NO: 20574 - RNA, 21 nt, Artificial Sequence
  Description of Artificial Sequence: Synthetic oligonucleotide
ucgccaaagaaauguucgauu

SEQ ID NO: 20575 - RNA, 21 nt, Artificial Sequence
  Description of Artificial Sequence: Synthetic oligonucleotide
cgccaaagaaauguucgcauu

SEQ ID NO: 20576 - RNA, 21 nt, Artificial Sequence
  Description of Artificial Sequence: Synthetic oligonucleotide
gccaaagaaauguucgccauu

SEQ ID NO: 20577 - RNA, 21 nt, Artificial Sequence
  Description of Artificial Sequence: Synthetic oligonucleotide
ccaaagaaauguucgccaauu

SEQ ID NO: 20578 - RNA, 21 nt, Artificial Sequence
  Description of Artificial Sequence: Synthetic oligonucleotide
caaagaaauguucgccauauu

SEQ ID NO: 20579 - RNA, 21 nt, Artificial Sequence
  Description of Artificial Sequence: Synthetic oligonucleotide
aaagaaauguucgccaugauu

SEQ ID NO: 20580 - RNA, 21 nt, Artificial Sequence
  Description of Artificial Sequence: Synthetic oligonucleotide
aagaaauguucgccaugaauu

SEQ ID NO: 20581 - RNA, 21 nt, Artificial Sequence
  Description of Artificial Sequence: Synthetic oligonucleotide
agaaauguucgccaugaaauu

SEQ ID NO: 20582 - RNA, 21 nt, Artificial Sequence
  Description of Artificial Sequence: Synthetic oligonucleotide
gaaauguucgccaugaaaauu

SEQ ID NO: 20583 - RNA, 21 nt, Artificial Sequence
  Description of Artificial Sequence: Synthetic oligonucleotide
aaauguucgccaugaaaaauu

SEQ ID NO: 20584 - RNA, 21 nt, Artificial Sequence
  Description of Artificial Sequence: Synthetic oligonucleotide
aauguucgccaugaaaacauu

SEQ ID NO: 20585 - RNA, 21 nt, Artificial Sequence
  Description of Artificial Sequence: Synthetic oligonucleotide
auguucgccaugaaaacuauu

SEQ ID NO: 20586 - RNA, 21 nt, Artificial Sequence
  Description of Artificial Sequence: Synthetic oligonucleotide
uguucgccaugaaaacuaauu

SEQ ID NO: 20587 - RNA, 21 nt, Artificial Sequence
  Description of Artificial Sequence: Synthetic oligonucleotide
guucgccaugaaaacuaaauu

SEQ ID NO: 20588 - RNA, 21 nt, Artificial Sequence
  Description of Artificial Sequence: Synthetic oligonucleotide
uucgccaugaaaacuaagauu

SEQ ID NO: 20589 - RNA, 21 nt, Artificial Sequence
  Description of Artificial Sequence: Synthetic oligonucleotide
ucgccaugaaaacuaaggauu

SEQ ID NO: 20590 - RNA, 21 nt, Artificial Sequence
  Description of Artificial Sequence: Synthetic oligonucleotide
cgccaugaaaacuaaggcauu

SEQ ID NO: 20591 - RNA, 21 nt, Artificial Sequence
  Description of Artificial Sequence: Synthetic oligonucleotide
gccaugaaaacuaaggcuauu

SEQ ID NO: 20592 - RNA, 21 nt, Artificial Sequence
  Description of Artificial Sequence: Synthetic oligonucleotide
ccaugaaaacuaaggcugauu

SEQ ID NO: 20593 - RNA, 21 nt, Artificial Sequence
  Description of Artificial Sequence: Synthetic oligonucleotide
caugaaaacuaaggcugcauu

SEQ ID NO: 20594 - RNA, 21 nt, Artificial Sequence
  Description of Artificial Sequence: Synthetic oligonucleotide
augaaaacuaaggcugccauu

SEQ ID NO: 20595 - RNA, 21 nt, Artificial Sequence
  Description of Artificial Sequence: Synthetic oligonucleotide
ugaaaacuaaggcugccuauu

SEQ ID NO: 20596 - RNA, 21 nt, Artificial Sequence
  Description of Artificial Sequence: Synthetic oligonucleotide
gaaaacuaaggcugccuuauu

SEQ ID NO: 20597 - RNA, 21 nt, Artificial Sequence
  Description of Artificial Sequence: Synthetic oligonucleotide
aaaacuaaggcugccuuaauu

SEQ ID NO: 20598 - RNA, 21 nt, Artificial Sequence
  Description of Artificial Sequence: Synthetic oligonucleotide
aaacuaaggcugccuuagauu

SEQ ID NO: 20599 - RNA, 21 nt, Artificial Sequence
  Description of Artificial Sequence: Synthetic oligonucleotide
aacuaaggcugccuuagcauu

SEQ ID NO: 20600 - RNA, 21 nt, Artificial Sequence
  Description of Artificial Sequence: Synthetic oligonucleotide
acuaaggcugccuuagcuauu

SEQ ID NO: 20601 - RNA, 21 nt, Artificial Sequence
  Description of Artificial Sequence: Synthetic oligonucleotide
cuaaggcugccuuagcuaauu

SEQ ID NO: 20602 - RNA, 21 nt, Artificial Sequence
  Description of Artificial Sequence: Synthetic oligonucleotide
uaaggcugccuuagcuauauu

SEQ ID NO: 20603 - RNA, 21 nt, Artificial Sequence
  Description of Artificial Sequence: Synthetic oligonucleotide
aaggcugccuuagcuaucauu

SEQ ID NO: 20604 - RNA, 21 nt, Artificial Sequence
  Description of Artificial Sequence: Synthetic oligonucleotide
aggcugccuuagcuaucuauu

SEQ ID NO: 20605 - RNA, 21 nt, Artificial Sequence
  Description of Artificial Sequence: Synthetic oligonucleotide
ggcugccuuagcuaucugauu

SEQ ID NO: 20606 - RNA, 21 nt, Artificial Sequence
  Description of Artificial Sequence: Synthetic oligonucleotide
gcugccuuagcuaucuggauu

SEQ ID NO: 20607 - RNA, 21 nt, Artificial Sequence
  Description of Artificial Sequence: Synthetic oligonucleotide
cugccuuagcuaucugguauu

SEQ ID NO: 20608 - RNA, 21 nt, Artificial Sequence
  Description of Artificial Sequence: Synthetic oligonucleotide
ugccuuagcuaucuggugauu

SEQ ID NO: 20609 - RNA, 21 nt, Artificial Sequence
  Description of Artificial Sequence: Synthetic oligonucleotide
gccuuagcuaucuggugcauu

SEQ ID NO: 20610 - RNA, 21 nt, Artificial Sequence
  Description of Artificial Sequence: Synthetic oligonucleotide
ccuuagcuaucuggugccauu

SEQ ID NO: 20611 - RNA, 21 nt, Artificial Sequence
  Description of Artificial Sequence: Synthetic oligonucleotide
cuuagcuaucuggugcccauu

SEQ ID NO: 20612 - RNA, 21 nt, Artificial Sequence
  Description of Artificial Sequence: Synthetic oligonucleotide
uuagcuaucuggugcccaauu

SEQ ID NO: 20613 - RNA, 21 nt, Artificial Sequence
  Description of Artificial Sequence: Synthetic oligonucleotide
uagcuaucuggugcccagauu

SEQ ID NO: 20614 - RNA, 21 nt, Artificial Sequence
  Description of Artificial Sequence: Synthetic oligonucleotide
agcuaucuggugcccaggauu

SEQ ID NO: 20615 - RNA, 21 nt, Artificial Sequence
  Description of Artificial Sequence: Synthetic oligonucleotide
gcuaucuggugcccaggcauu

SEQ ID NO: 20616 - RNA, 21 nt, Artificial Sequence
  Description of Artificial Sequence: Synthetic oligonucleotide
cuaucuggugcccaggcuauu

SEQ ID NO: 20617 - RNA, 21 nt, Artificial Sequence
  Description of Artificial Sequence: Synthetic oligonucleotide
uaucuggugcccaggcuaauu

SEQ ID NO: 20618 - RNA, 21 nt, Artificial Sequence
  Description of Artificial Sequence: Synthetic oligonucleotide
aucuggugcccaggcuauauu

SEQ ID NO: 20619 - RNA, 21 nt, Artificial Sequence
  Description of Artificial Sequence: Synthetic oligonucleotide
ucuggugcccaggcuauuauu

SEQ ID NO: 20620 - RNA, 21 nt, Artificial Sequence
  Description of Artificial Sequence: Synthetic oligonucleotide
cuggugcccaggcuauucauu

SEQ ID NO: 20621 - RNA, 21 nt, Artificial Sequence
  Description of Artificial Sequence: Synthetic oligonucleotide
uggugcccaggcuauucgauu

SEQ ID NO: 20622 - RNA, 21 nt, Artificial Sequence
  Description of Artificial Sequence: Synthetic oligonucleotide
ggugcccaggcuauucggauu

SEQ ID NO: 20623 - RNA, 21 nt, Artificial Sequence
  Description of Artificial Sequence: Synthetic oligonucleotide
gugcccaggcuauucggaauu

SEQ ID NO: 20624 - RNA, 21 nt, Artificial Sequence
  Description of Artificial Sequence: Synthetic oligonucleotide
ugcccaggcuauucggaaauu

SEQ ID NO: 20625 - RNA, 21 nt, Artificial Sequence
  Description of Artificial Sequence: Synthetic oligonucleotide
gcccaggcuauucggaaaauu

SEQ ID NO: 20626 - RNA, 21 nt, Artificial Sequence
  Description of Artificial Sequence: Synthetic oligonucleotide
cccaggcuauucggaaacauu

SEQ ID NO: 20627 - RNA, 21 nt, Artificial Sequence
  Description of Artificial Sequence: Synthetic oligonucleotide
ccaggcuauucggaaacuauu

SEQ ID NO: 20628 - RNA, 21 nt, Artificial Sequence
  Description of Artificial Sequence: Synthetic oligonucleotide
caggcuauucggaaacucauu

SEQ ID NO: 20629 - RNA, 21 nt, Artificial Sequence
  Description of Artificial Sequence: Synthetic oligonucleotide
aggcuauucggaaacucaauu

SEQ ID NO: 20630 - RNA, 21 nt, Artificial Sequence
  Description of Artificial Sequence: Synthetic oligonucleotide
ggcuauucggaaacucagauu

SEQ ID NO: 20631 - RNA, 21 nt, Artificial Sequence
  Description of Artificial Sequence: Synthetic oligonucleotide
gcuauucggaaacucagaauu

SEQ ID NO: 20632 - RNA, 21 nt, Artificial Sequence
  Description of Artificial Sequence: Synthetic oligonucleotide
cuauucggaaacucagauauu

SEQ ID NO: 20633 - RNA, 21 nt, Artificial Sequence
  Description of Artificial Sequence: Synthetic oligonucleotide
uauucggaaacucagauaauu

SEQ ID NO: 20634 - RNA, 21 nt, Artificial Sequence
  Description of Artificial Sequence: Synthetic oligonucleotide
auucggaaacucagauaaauu

SEQ ID NO: 20635 - RNA, 21 nt, Artificial Sequence
  Description of Artificial Sequence: Synthetic oligonucleotide
uucggaaacucagauaaaauu

SEQ ID NO: 20636 - RNA, 21 nt, Artificial Sequence
  Description of Artificial Sequence: Synthetic oligonucleotide
ucggaaacucagauaaauauu

SEQ ID NO: 20637 - RNA, 21 nt, Artificial Sequence
  Description of Artificial Sequence: Synthetic oligonucleotide
cggaaacucagauaaaugauu

SEQ ID NO: 20638 - RNA, 21 nt, Artificial Sequence
  Description of Artificial Sequence: Synthetic oligonucleotide
ggaaacucagauaaaugcauu

SEQ ID NO: 20639 - RNA, 21 nt, Artificial Sequence
  Description of Artificial Sequence: Synthetic oligonucleotide
gaaacucagauaaaugcuauu

SEQ ID NO: 20640 - RNA, 21 nt, Artificial Sequence
  Description of Artificial Sequence: Synthetic oligonucleotide
aaacucagauaaaugcuaauu

SEQ ID NO: 20641 - RNA, 21 nt, Artificial Sequence
  Description of Artificial Sequence: Synthetic oligonucleotide
aacucagauaaaugcuacauu

SEQ ID NO: 20642 - RNA, 21 nt, Artificial Sequence
  Description of Artificial Sequence: Synthetic oligonucleotide
acucagauaaaugcuacuauu

SEQ ID NO: 20643 - RNA, 21 nt, Artificial Sequence
  Description of Artificial Sequence: Synthetic oligonucleotide
cucagauaaaugcuacucauu

SEQ ID NO: 20644 - RNA, 21 nt, Artificial Sequence
  Description of Artificial Sequence: Synthetic oligonucleotide
ucagauaaaugcuacucaauu

SEQ ID NO: 20645 - RNA, 21 nt, Artificial Sequence
  Description of Artificial Sequence: Synthetic oligonucleotide
cagauaaaugcuacucagauu

SEQ ID NO: 20646 - RNA, 21 nt, Artificial Sequence
  Description of Artificial Sequence: Synthetic oligonucleotide
agauaaaugcuacucaggauu

SEQ ID NO: 20647 - RNA, 21 nt, Artificial Sequence
  Description of Artificial Sequence: Synthetic oligonucleotide
gauaaaugcuacucaggcauu

SEQ ID NO: 20648 - RNA, 21 nt, Artificial Sequence
  Description of Artificial Sequence: Synthetic oligonucleotide
auaaaugcuacucaggcaauu

SEQ ID NO: 20649 - RNA, 21 nt, Artificial Sequence
  Description of Artificial Sequence: Synthetic oligonucleotide
uaaaugcuacucaggcaaauu

SEQ ID NO: 20650 - RNA, 21 nt, Artificial Sequence
  Description of Artificial Sequence: Synthetic oligonucleotide
aaaugcuacucaggcaauauu

SEQ ID NO: 20651 - RNA, 21 nt, Artificial Sequence
  Description of Artificial Sequence: Synthetic oligonucleotide
aaugcuacucaggcaaugauu

SEQ ID NO: 20652 - RNA, 21 nt, Artificial Sequence
  Description of Artificial Sequence: Synthetic oligonucleotide
augcuacucaggcaaugaauu

SEQ ID NO: 20653 - RNA, 21 nt, Artificial Sequence
  Description of Artificial Sequence: Synthetic oligonucleotide
ugcuacucaggcaaugaaauu

SEQ ID NO: 20654 - RNA, 21 nt, Artificial Sequence
  Description of Artificial Sequence: Synthetic oligonucleotide
gcuacucaggcaaugaagauu

SEQ ID NO: 20655 - RNA, 21 nt, Artificial Sequence
  Description of Artificial Sequence: Synthetic oligonucleotide
cuacucaggcaaugaagaauu

SEQ ID NO: 20656 - RNA, 21 nt, Artificial Sequence
  Description of Artificial Sequence: Synthetic oligonucleotide
uacucaggcaaugaagaaauu

SEQ ID NO: 20657 - RNA, 21 nt, Artificial Sequence
  Description of Artificial Sequence: Synthetic oligonucleotide
acucaggcaaugaagaagauu

SEQ ID NO: 20658 - RNA, 21 nt, Artificial Sequence
  Description of Artificial Sequence: Synthetic oligonucleotide
cucaggcaaugaagaagaauu

SEQ ID NO: 20659 - RNA, 21 nt, Artificial Sequence
  Description of Artificial Sequence: Synthetic oligonucleotide
ucaggcaaugaagaagagauu

SEQ ID NO: 20660 - RNA, 21 nt, Artificial Sequence
  Description of Artificial Sequence: Synthetic oligonucleotide
caggcaaugaagaagaggauu

SEQ ID NO: 20661 - RNA, 21 nt, Artificial Sequence
  Description of Artificial Sequence: Synthetic oligonucleotide
aggcaaugaagaagaggaauu

SEQ ID NO: 20662 - RNA, 21 nt, Artificial Sequence
  Description of Artificial Sequence: Synthetic oligonucleotide
ggcaaugaagaagaggagauu

SEQ ID NO: 20663 - RNA, 21 nt, Artificial Sequence
  Description of Artificial Sequence: Synthetic oligonucleotide
gcaaugaagaagaggagaauu

SEQ ID NO: 20664 - RNA, 21 nt, Artificial Sequence
  Description of Artificial Sequence: Synthetic oligonucleotide
caaugaagaagaggagaaauu

SEQ ID NO: 20665 - RNA, 21 nt, Artificial Sequence
  Description of Artificial Sequence: Synthetic oligonucleotide
aaugaagaagaggagaaaauu

SEQ ID NO: 20666 - RNA, 21 nt, Artificial Sequence
  Description of Artificial Sequence: Synthetic oligonucleotide
augaagaagaggagaaaaauu

SEQ ID NO: 20667 - RNA, 21 nt, Artificial Sequence
  Description of Artificial Sequence: Synthetic oligonucleotide
ugaagaagaggagaaaaaauu

SEQ ID NO: 20668 - RNA, 21 nt, Artificial Sequence
  Description of Artificial Sequence: Synthetic oligonucleotide
gaagaagaggagaaaaagauu

SEQ ID NO: 20669 - RNA, 21 nt, Artificial Sequence
  Description of Artificial Sequence: Synthetic oligonucleotide
aagaagaggagaaaaaggauu

SEQ ID NO: 20670 - RNA, 21 nt, Artificial Sequence
  Description of Artificial Sequence: Synthetic oligonucleotide
agaagaggagaaaaaggaauu

SEQ ID NO: 20671 - RNA, 21 nt, Artificial Sequence
  Description of Artificial Sequence: Synthetic oligonucleotide
gaagaggagaaaaaggaaauu

SEQ ID NO: 20672 - RNA, 21 nt, Artificial Sequence
  Description of Artificial Sequence: Synthetic oligonucleotide
aagaggagaaaaaggaaaauu

SEQ ID NO: 20673 - RNA, 21 nt, Artificial Sequence
  Description of Artificial Sequence: Synthetic oligonucleotide
agaggagaaaaaggaaagauu

SEQ ID NO: 20674 - RNA, 21 nt, Artificial Sequence
  Description of Artificial Sequence: Synthetic oligonucleotide
gaggagaaaaaggaaaguauu

SEQ ID NO: 20675 - RNA, 21 nt, Artificial Sequence
  Description of Artificial Sequence: Synthetic oligonucleotide
aggagaaaaaggaaagucauu

SEQ ID NO: 20676 - RNA, 21 nt, Artificial Sequence
  Description of Artificial Sequence: Synthetic oligonucleotide
ggagaaaaaggaaagucaauu

SEQ ID NO: 20677 - RNA, 21 nt, Artificial Sequence
  Description of Artificial Sequence: Synthetic oligonucleotide
gagaaaaaggaaagucacauu

SEQ ID NO: 20678 - RNA, 21 nt, Artificial Sequence
  Description of Artificial Sequence: Synthetic oligonucleotide
agaaaaaggaaagucacaauu

SEQ ID NO: 20679 - RNA, 21 nt, Artificial Sequence
  Description of Artificial Sequence: Synthetic oligonucleotide
gaaaaaggaaagucacaaauu

SEQ ID NO: 20680 - RNA, 21 nt, Artificial Sequence
  Description of Artificial Sequence: Synthetic oligonucleotide
aaaaaggaaagucacaacauu

SEQ ID NO: 20681 - RNA, 21 nt, Artificial Sequence
  Description of Artificial Sequence: Synthetic oligonucleotide
aaaaggaaagucacaaccauu

SEQ ID NO: 20682 - RNA, 21 nt, Artificial Sequence
  Description of Artificial Sequence: Synthetic oligonucleotide
aaaggaaagucacaaccaauu

SEQ ID NO: 20683 - RNA, 21 nt, Artificial Sequence
  Description of Artificial Sequence: Synthetic oligonucleotide
aaggaaagucacaaccaaauu

SEQ ID NO: 20684 - RNA, 21 nt, Artificial Sequence
  Description of Artificial Sequence: Synthetic oligonucleotide
aggaaagucacaaccaauauu

SEQ ID NO: 20685 - RNA, 21 nt, Artificial Sequence
  Description of Artificial Sequence: Synthetic oligonucleotide
ggaaagucacaaccaauaauu

SEQ ID NO: 20686 - RNA, 21 nt, Artificial Sequence
  Description of Artificial Sequence: Synthetic oligonucleotide
gaaagucacaaccaauaaauu

SEQ ID NO: 20687 - RNA, 21 nt, Artificial Sequence
  Description of Artificial Sequence: Synthetic oligonucleotide
aaagucacaaccaauaaaauu

SEQ ID NO: 20688 - RNA, 21 nt, Artificial Sequence
  Description of Artificial Sequence: Synthetic oligonucleotide
aagucacaaccaauaaauauu

SEQ ID NO: 20689 - RNA, 21 nt, Artificial Sequence
  Description of Artificial Sequence: Synthetic oligonucleotide
agucacaaccaauaaaugauu

SEQ ID NO: 20690 - RNA, 21 nt, Artificial Sequence
  Description of Artificial Sequence: Synthetic oligonucleotide
gucacaaccaauaaauguauu

SEQ ID NO: 20691 - RNA, 21 nt, Artificial Sequence
  Description of Artificial Sequence: Synthetic oligonucleotide
ucacaaccaauaaaugucauu

SEQ ID NO: 20692 - RNA, 21 nt, Artificial Sequence
  Description of Artificial Sequence: Synthetic oligonucleotide
cacaaccaauaaaugucuauu

SEQ ID NO: 20693 - RNA, 21 nt, Artificial Sequence
  Description of Artificial Sequence: Synthetic oligonucleotide
acaaccaauaaaugucugauu

SEQ ID NO: 20694 - RNA, 21 nt, Artificial Sequence
  Description of Artificial Sequence: Synthetic oligonucleotide
caaccaauaaaugucuggauu

SEQ ID NO: 20695 - RNA, 21 nt, Artificial Sequence
  Description of Artificial Sequence: Synthetic oligonucleotide
aaccaauaaaugucuggaauu

SEQ ID NO: 20696 - RNA, 21 nt, Artificial Sequence
  Description of Artificial Sequence: Synthetic oligonucleotide
accaauaaaugucuggaaauu

SEQ ID NO: 20697 - RNA, 21 nt, Artificial Sequence
  Description of Artificial Sequence: Synthetic oligonucleotide
ccaauaaaugucuggaacauu

SEQ ID NO: 20698 - RNA, 21 nt, Artificial Sequence
  Description of Artificial Sequence: Synthetic oligonucleotide
caauaaaugucuggaacaauu

SEQ ID NO: 20699 - RNA, 21 nt, Artificial Sequence
  Description of Artificial Sequence: Synthetic oligonucleotide
aauaaaugucuggaacaaauu

SEQ ID NO: 20700 - RNA, 21 nt, Artificial Sequence
  Description of Artificial Sequence: Synthetic oligonucleotide
auaaaugucuggaacaagauu

SEQ ID NO: 20701 - RNA, 21 nt, Artificial Sequence
  Description of Artificial Sequence: Synthetic oligonucleotide
uaaaugucuggaacaaguauu

SEQ ID NO: 20702 - RNA, 21 nt, Artificial Sequence
  Description of Artificial Sequence: Synthetic oligonucleotide
aaaugucuggaacaagugauu

SEQ ID NO: 20703 - RNA, 21 nt, Artificial Sequence
  Description of Artificial Sequence: Synthetic oligonucleotide
aaugucuggaacaaguguauu

SEQ ID NO: 20704 - RNA, 21 nt, Artificial Sequence
  Description of Artificial Sequence: Synthetic oligonucleotide
augucuggaacaagugucauu

SEQ ID NO: 20705 - RNA, 21 nt, Artificial Sequence
  Description of Artificial Sequence: Synthetic oligonucleotide
ugucuggaacaagugucaauu

SEQ ID NO: 20706 - RNA, 21 nt, Artificial Sequence
  Description of Artificial Sequence: Synthetic oligonucleotide
gucuggaacaagugucacauu

SEQ ID NO: 20707 - RNA, 21 nt, Artificial Sequence
  Description of Artificial Sequence: Synthetic oligonucleotide
ucuggaacaagugucacaauu

SEQ ID NO: 20708 - RNA, 21 nt, Artificial Sequence
  Description of Artificial Sequence: Synthetic oligonucleotide
cuggaacaagugucacaaauu

SEQ ID NO: 20709 - RNA, 21 nt, Artificial Sequence
  Description of Artificial Sequence: Synthetic oligonucleotide
uggaacaagugucacaauauu

SEQ ID NO: 20710 - RNA, 21 nt, Artificial Sequence
  Description of Artificial Sequence: Synthetic oligonucleotide
ggaacaagugucacaauuauu

SEQ ID NO: 20711 - RNA, 21 nt, Artificial Sequence
  Description of Artificial Sequence: Synthetic oligonucleotide
gaacaagugucacaauuaauu

SEQ ID NO: 20712 - RNA, 21 nt, Artificial Sequence
  Description of Artificial Sequence: Synthetic oligonucleotide
aacaagugucacaauuacauu

SEQ ID NO: 20713 - RNA, 21 nt, Artificial Sequence
  Description of Artificial Sequence: Synthetic oligonucleotide
acaagugucacaauuacaauu

SEQ ID NO: 20714 - RNA, 21 nt, Artificial Sequence
  Description of Artificial Sequence: Synthetic oligonucleotide
caagugucacaauuacaaauu

SEQ ID NO: 20715 - RNA, 21 nt, Artificial Sequence
  Description of Artificial Sequence: Synthetic oligonucleotide
aagugucacaauuacaagauu

SEQ ID NO: 20716 - RNA, 21 nt, Artificial Sequence
  Description of Artificial Sequence: Synthetic oligonucleotide
agugucacaauuacaaggauu

SEQ ID NO: 20717 - RNA, 21 nt, Artificial Sequence
  Description of Artificial Sequence: Synthetic oligonucleotide
gugucacaauuacaaggaauu

SEQ ID NO: 20718 - RNA, 21 nt, Artificial Sequence
  Description of Artificial Sequence: Synthetic oligonucleotide
ugucacaauuacaaggauauu

SEQ ID NO: 20719 - RNA, 21 nt, Artificial Sequence
  Description of Artificial Sequence: Synthetic oligonucleotide
gucacaauuacaaggauuauu

SEQ ID NO: 20720 - RNA, 21 nt, Artificial Sequence
  Description of Artificial Sequence: Synthetic oligonucleotide
ucacaauuacaaggauugauu

SEQ ID NO: 20721 - RNA, 21 nt, Artificial Sequence
  Description of Artificial Sequence: Synthetic oligonucleotide
cacaauuacaaggauuguauu

SEQ ID NO: 20722 - RNA, 21 nt, Artificial Sequence
  Description of Artificial Sequence: Synthetic oligonucleotide
acaauuacaaggauugugauu

SEQ ID NO: 20723 - RNA, 21 nt, Artificial Sequence
  Description of Artificial Sequence: Synthetic oligonucleotide
caauuacaaggauuguggauu

SEQ ID NO: 20724 - RNA, 21 nt, Artificial Sequence
  Description of Artificial Sequence: Synthetic oligonucleotide
aauuacaaggauuguggcauu

SEQ ID NO: 20725 - RNA, 21 nt, Artificial Sequence
  Description of Artificial Sequence: Synthetic oligonucleotide
auuacaaggauuguggcgauu

SEQ ID NO: 20726 - RNA, 21 nt, Artificial Sequence
  Description of Artificial Sequence: Synthetic oligonucleotide
uuacaaggauuguggcguauu

SEQ ID NO: 20727 - RNA, 21 nt, Artificial Sequence
  Description of Artificial Sequence: Synthetic oligonucleotide
uacaaggauuguggcgucauu

SEQ ID NO: 20728 - RNA, 21 nt, Artificial Sequence
  Description of Artificial Sequence: Synthetic oligonucleotide
acaaggauuguggcgucgauu

SEQ ID NO: 20729 - RNA, 21 nt, Artificial Sequence
  Description of Artificial Sequence: Synthetic oligonucleotide
caaggauuguggcgucgcauu

SEQ ID NO: 20730 - RNA, 21 nt, Artificial Sequence
  Description of Artificial Sequence: Synthetic oligonucleotide
aaggauuguggcgucgcuauu

SEQ ID NO: 20731 - RNA, 21 nt, Artificial Sequence
  Description of Artificial Sequence: Synthetic oligonucleotide
aggauuguggcgucgcuuauu

SEQ ID NO: 20732 - RNA, 21 nt, Artificial Sequence
  Description of Artificial Sequence: Synthetic oligonucleotide
ggauuguggcgucgcuucauu

SEQ ID NO: 20733 - RNA, 21 nt, Artificial Sequence
  Description of Artificial Sequence: Synthetic oligonucleotide
gauuguggcgucgcuucaauu

SEQ ID NO: 20734 - RNA, 21 nt, Artificial Sequence
  Description of Artificial Sequence: Synthetic oligonucleotide
auuguggcgucgcuucaaauu

SEQ ID NO: 20735 - RNA, 21 nt, Artificial Sequence
  Description of Artificial Sequence: Synthetic oligonucleotide
uuguggcgucgcuucaauauu

SEQ ID NO: 20736 - RNA, 21 nt, Artificial Sequence
  Description of Artificial Sequence: Synthetic oligonucleotide
uguggcgucgcuucaaucauu

SEQ ID NO: 20737 - RNA, 21 nt, Artificial Sequence
  Description of Artificial Sequence: Synthetic oligonucleotide
guggcgucgcuucaaucgauu

SEQ ID NO: 20738 - RNA, 21 nt, Artificial Sequence
  Description of Artificial Sequence: Synthetic oligonucleotide
uggcgucgcuucaaucgaauu

SEQ ID NO: 20739 - RNA, 21 nt, Artificial Sequence
  Description of Artificial Sequence: Synthetic oligonucleotide
ggcgucgcuucaaucgacauu

SEQ ID NO: 20740 - RNA, 21 nt, Artificial Sequence
  Description of Artificial Sequence: Synthetic oligonucleotide
gcgucgcuucaaucgaccauu

SEQ ID NO: 20741 - RNA, 21 nt, Artificial Sequence
  Description of Artificial Sequence: Synthetic oligonucleotide
cgucgcuucaaucgaccuauu

SEQ ID NO: 20742 - RNA, 21 nt, Artificial Sequence
  Description of Artificial Sequence: Synthetic oligonucleotide
gucgcuucaaucgaccuuauu

SEQ ID NO: 20743 - RNA, 21 nt, Artificial Sequence
  Description of Artificial Sequence: Synthetic oligonucleotide
ucgcuucaaucgaccuuuauu

SEQ ID NO: 20744 - RNA, 21 nt, Artificial Sequence
  Description of Artificial Sequence: Synthetic oligonucleotide
cgcuucaaucgaccuuuaauu

SEQ ID NO: 20745 - RNA, 21 nt, Artificial Sequence
  Description of Artificial Sequence: Synthetic oligonucleotide
gcuucaaucgaccuuuacauu

SEQ ID NO: 20746 - RNA, 21 nt, Artificial Sequence
  Description of Artificial Sequence: Synthetic oligonucleotide
cuucaaucgaccuuuacuauu

SEQ ID NO: 20747 - RNA, 21 nt, Artificial Sequence
  Description of Artificial Sequence: Synthetic oligonucleotide
uucaaucgaccuuuacugauu

SEQ ID NO: 20748 - RNA, 21 nt, Artificial Sequence
  Description of Artificial Sequence: Synthetic oligonucleotide
ucaaucgaccuuuacugaauu

SEQ ID NO: 20749 - RNA, 21 nt, Artificial Sequence
  Description of Artificial Sequence: Synthetic oligonucleotide
caaucgaccuuuacugaaauu

SEQ ID NO: 20750 - RNA, 21 nt, Artificial Sequence
  Description of Artificial Sequence: Synthetic oligonucleotide
aaucgaccuuuacugaaaauu

SEQ ID NO: 20751 - RNA, 21 nt, Artificial Sequence
  Description of Artificial Sequence: Synthetic oligonucleotide
aucgaccuuuacugaaacauu

SEQ ID NO: 20752 - RNA, 21 nt, Artificial Sequence
  Description of Artificial Sequence: Synthetic oligonucleotide
ucgaccuuuacugaaacaauu

SEQ ID NO: 20753 - RNA, 21 nt, Artificial Sequence
  Description of Artificial Sequence: Synthetic oligonucleotide
cgaccuuuacugaaacaaauu

SEQ ID NO: 20754 - RNA, 21 nt, Artificial Sequence
  Description of Artificial Sequence: Synthetic oligonucleotide
gaccuuuacugaaacaacauu

SEQ ID NO: 20755 - RNA, 21 nt, Artificial Sequence
  Description of Artificial Sequence: Synthetic oligonucleotide
accuuuacugaaacaacaauu

SEQ ID NO: 20756 - RNA, 21 nt, Artificial Sequence
  Description of Artificial Sequence: Synthetic oligonucleotide
ccuuuacugaaacaacagauu

SEQ ID NO: 20757 - RNA, 21 nt, Artificial Sequence
  Description of Artificial Sequence: Synthetic oligonucleotide
cuuuacugaaacaacaguauu

SEQ ID NO: 20758 - RNA, 21 nt, Artificial Sequence
  Description of Artificial Sequence: Synthetic oligonucleotide
uuuacugaaacaacaguaauu

SEQ ID NO: 20759 - RNA, 21 nt, Artificial Sequence
  Description of Artificial Sequence: Synthetic oligonucleotide
uuacugaaacaacaguaaauu

SEQ ID NO: 20760 - RNA, 21 nt, Artificial Sequence
  Description of Artificial Sequence: Synthetic oligonucleotide
uacugaaacaacaguaaaauu

SEQ ID NO: 20761 - RNA, 21 nt, Artificial Sequence
  Description of Artificial Sequence: Synthetic oligonucleotide
acugaaacaacaguaaacauu

SEQ ID NO: 20762 - RNA, 21 nt, Artificial Sequence
  Description of Artificial Sequence: Synthetic oligonucleotide
cugaaacaacaguaaaccauu

SEQ ID NO: 20763 - RNA, 21 nt, Artificial Sequence
  Description of Artificial Sequence: Synthetic oligonucleotide
ugaaacaacaguaaaccaauu

SEQ ID NO: 20764 - RNA, 21 nt, Artificial Sequence
  Description of Artificial Sequence: Synthetic oligonucleotide
gaaacaacaguaaaccauauu

SEQ ID NO: 20765 - RNA, 21 nt, Artificial Sequence
  Description of Artificial Sequence: Synthetic oligonucleotide
aaacaacaguaaaccaucauu

SEQ ID NO: 20766 - RNA, 21 nt, Artificial Sequence
  Description of Artificial Sequence: Synthetic oligonucleotide
aacaacaguaaaccaucuauu

SEQ ID NO: 20767 - RNA, 21 nt, Artificial Sequence
  Description of Artificial Sequence: Synthetic oligonucleotide
acaacaguaaaccaucuuauu

SEQ ID NO: 20768 - RNA, 21 nt, Artificial Sequence
  Description of Artificial Sequence: Synthetic oligonucleotide
caacaguaaaccaucuuuauu

SEQ ID NO: 20769 - RNA, 21 nt, Artificial Sequence
  Description of Artificial Sequence: Synthetic oligonucleotide
aacaguaaaccaucuuuaauu

SEQ ID NO: 20770 - RNA, 21 nt, Artificial Sequence
  Description of Artificial Sequence: Synthetic oligonucleotide
acaguaaaccaucuuuauauu

SEQ ID NO: 20771 - RNA, 21 nt, Artificial Sequence
  Description of Artificial Sequence: Synthetic oligonucleotide
caguaaaccaucuuuauuauu

SEQ ID NO: 20772 - RNA, 21 nt, Artificial Sequence
  Description of Artificial Sequence: Synthetic oligonucleotide
aguaaaccaucuuuauuaauu

SEQ ID NO: 20773 - RNA, 21 nt, Artificial Sequence
  Description of Artificial Sequence: Synthetic oligonucleotide
guaaaccaucuuuauuauauu

SEQ ID NO: 20774 - RNA, 21 nt, Artificial Sequence
  Description of Artificial Sequence: Synthetic oligonucleotide
uaaaccaucuuuauuaugauu

SEQ ID NO: 20775 - RNA, 21 nt, Artificial Sequence
  Description of Artificial Sequence: Synthetic oligonucleotide
aaaccaucuuuauuauggauu

SEQ ID NO: 20776 - RNA, 21 nt, Artificial Sequence
  Description of Artificial Sequence: Synthetic oligonucleotide
aaccaucuuuauuaugguauu

SEQ ID NO: 20777 - RNA, 21 nt, Artificial Sequence
  Description of Artificial Sequence: Synthetic oligonucleotide
accaucuuuauuauggucauu

SEQ ID NO: 20778 - RNA, 21 nt, Artificial Sequence
  Description of Artificial Sequence: Synthetic oligonucleotide
ccaucuuuauuauggucaauu

SEQ ID NO: 20779 - RNA, 21 nt, Artificial Sequence
  Description of Artificial Sequence: Synthetic oligonucleotide
caucuuuauuauggucauauu

SEQ ID NO: 20780 - RNA, 21 nt, Artificial Sequence
  Description of Artificial Sequence: Synthetic oligonucleotide
aucuuuauuauggucauaauu

SEQ ID NO: 20781 - RNA, 21 nt, Artificial Sequence
  Description of Artificial Sequence: Synthetic oligonucleotide
ucuuuauuauggucauauauu

SEQ ID NO: 20782 - RNA, 21 nt, Artificial Sequence
  Description of Artificial Sequence: Synthetic oligonucleotide
cuuuauuauggucauauuauu

SEQ ID NO: 20783 - RNA, 21 nt, Artificial Sequence
  Description of Artificial Sequence: Synthetic oligonucleotide
uuuauuauggucauauuuauu

SEQ ID NO: 20784 - RNA, 21 nt, Artificial Sequence
  Description of Artificial Sequence: Synthetic oligonucleotide
uuauuauggucauauuucauu

SEQ ID NO: 20785 - RNA, 21 nt, Artificial Sequence
  Description of Artificial Sequence: Synthetic oligonucleotide
uauuauggucauauuucaauu

SEQ ID NO: 20786 - RNA, 21 nt, Artificial Sequence
  Description of Artificial Sequence: Synthetic oligonucleotide
auuauggucauauuucacauu

SEQ ID NO: 20787 - RNA, 21 nt, Artificial Sequence
  Description of Artificial Sequence: Synthetic oligonucleotide
uuauggucauauuucacaauu

SEQ ID NO: 20788 - RNA, 21 nt, Artificial Sequence
  Description of Artificial Sequence: Synthetic oligonucleotide
uauggucauauuucacagauu

SEQ ID NO: 20789 - RNA, 21 nt, Artificial Sequence
  Description of Artificial Sequence: Synthetic oligonucleotide
auggucauauuucacagcauu

SEQ ID NO: 20790 - RNA, 21 nt, Artificial Sequence
  Description of Artificial Sequence: Synthetic oligonucleotide
uggucauauuucacagcaauu

SEQ ID NO: 20791 - RNA, 21 nt, Artificial Sequence
  Description of Artificial Sequence: Synthetic oligonucleotide
ggucauauuucacagcacauu

SEQ ID NO: 20792 - RNA, 21 nt, Artificial Sequence
  Description of Artificial Sequence: Synthetic oligonucleotide
gucauauuucacagcaccauu

SEQ ID NO: 20793 - RNA, 21 nt, Artificial Sequence
  Description of Artificial Sequence: Synthetic oligonucleotide
ucauauuucacagcaccaauu

SEQ ID NO: 20794 - RNA, 21 nt, Artificial Sequence
  Description of Artificial Sequence: Synthetic oligonucleotide
cauauuucacagcaccaaauu

SEQ ID NO: 20795 - RNA, 21 nt, Artificial Sequence
  Description of Artificial Sequence: Synthetic oligonucleotide
auauuucacagcaccaaaauu

SEQ ID NO: 20796 - RNA, 21 nt, Artificial Sequence
  Description of Artificial Sequence: Synthetic oligonucleotide
uauuucacagcaccaaaaauu

SEQ ID NO: 20797 - RNA, 21 nt, Artificial Sequence
  Description of Artificial Sequence: Synthetic oligonucleotide
auuucacagcaccaaaauauu

SEQ ID NO: 20798 - RNA, 21 nt, Artificial Sequence
  Description of Artificial Sequence: Synthetic oligonucleotide
uuucacagcaccaaaauaauu

SEQ ID NO: 20799 - RNA, 21 nt, Artificial Sequence
  Description of Artificial Sequence: Synthetic oligonucleotide
uucacagcaccaaaauaaauu

SEQ ID NO: 20800 - RNA, 21 nt, Artificial Sequence
  Description of Artificial Sequence: Synthetic oligonucleotide
ucacagcaccaaaauaaaauu

SEQ ID NO: 20801 - RNA, 21 nt, Artificial Sequence
  Description of Artificial Sequence: Synthetic oligonucleotide
cacagcaccaaaauaaauauu

SEQ ID NO: 20802 - RNA, 21 nt, Artificial Sequence
  Description of Artificial Sequence: Synthetic oligonucleotide
acagcaccaaaauaaaucauu

SEQ ID NO: 20803 - RNA, 21 nt, Artificial Sequence
  Description of Artificial Sequence: Synthetic oligonucleotide
cagcaccaaaauaaaucaauu

SEQ ID NO: 20804 - RNA, 21 nt, Artificial Sequence
  Description of Artificial Sequence: Synthetic oligonucleotide
agcaccaaaauaaaucauauu

SEQ ID NO: 20805 - RNA, 21 nt, Artificial Sequence
  Description of Artificial Sequence: Synthetic oligonucleotide
gcaccaaaauaaaucaucauu

SEQ ID NO: 20806 - RNA, 21 nt, Artificial Sequence
  Description of Artificial Sequence: Synthetic oligonucleotide
caccaaaauaaaucaucuauu

SEQ ID NO: 20807 - RNA, 21 nt, Artificial Sequence
  Description of Artificial Sequence: Synthetic oligonucleotide
accaaaauaaaucaucuuauu

SEQ ID NO: 20808 - RNA, 21 nt, Artificial Sequence
  Description of Artificial Sequence: Synthetic oligonucleotide
ccaaaauaaaucaucuuuauu

SEQ ID NO: 20809 - RNA, 21 nt, Artificial Sequence
  Description of Artificial Sequence: Synthetic oligonucleotide
caaaauaaaucaucuuuaauu

SEQ ID NO: 20810 - RNA, 21 nt, Artificial Sequence
  Description of Artificial Sequence: Synthetic oligonucleotide
aaaauaaaucaucuuuauauu

SEQ ID NO: 20811 - RNA, 21 nt, Artificial Sequence
  Description of Artificial Sequence: Synthetic oligonucleotide
aaauaaaucaucuuuauuauu

SEQ ID NO: 20812 - RNA, 21 nt, Artificial Sequence
  Description of Artificial Sequence: Synthetic oligonucleotide
aauaaaucaucuuuauuaauu

SEQ ID NO: 20813 - RNA, 21 nt, Artificial Sequence
  Description of Artificial Sequence: Synthetic oligonucleotide
auaaaucaucuuuauuaaauu

SEQ ID NO: 20814 - RNA, 21 nt, Artificial Sequence
  Description of Artificial Sequence: Synthetic oligonucleotide
uaaaucaucuuuauuaagauu

SEQ ID NO: 20815 - RNA, 21 nt, Artificial Sequence
  Description of Artificial Sequence: Synthetic oligonucleotide
aaaucaucuuuauuaaguauu

SEQ ID NO: 20816 - RNA, 21 nt, Artificial Sequence
  Description of Artificial Sequence: Synthetic oligonucleotide
aaucaucuuuauuaaguaauu

SEQ ID NO: 20817 - RNA, 21 nt, Artificial Sequence
  Description of Artificial Sequence: Synthetic oligonucleotide
aucaucuuuauuaaguagauu

SEQ ID NO: 20818 - RNA, 21 nt, Artificial Sequence
  Description of Artificial Sequence: Synthetic oligonucleotide
ucaucuuuauuaaguagaauu

SEQ ID NO: 20819 - RNA, 21 nt, Artificial Sequence
  Description of Artificial Sequence: Synthetic oligonucleotide
caucuuuauuaaguagauauu

SEQ ID NO: 20820 - RNA, 21 nt, Artificial Sequence
  Description of Artificial Sequence: Synthetic oligonucleotide
aucuuuauuaaguagaugauu

SEQ ID NO: 20821 - RNA, 21 nt, Artificial Sequence
  Description of Artificial Sequence: Synthetic oligonucleotide
ucuuuauuaaguagaugaauu

SEQ ID NO: 20822 - RNA, 21 nt, Artificial Sequence
  Description of Artificial Sequence: Synthetic oligonucleotide
cuuuauuaaguagaugaaauu

SEQ ID NO: 20823 - RNA, 21 nt, Artificial Sequence
  Description of Artificial Sequence: Synthetic oligonucleotide
uuuauuaaguagaugaaaauu

SEQ ID NO: 20824 - RNA, 21 nt, Artificial Sequence
  Description of Artificial Sequence: Synthetic oligonucleotide
uuauuaaguagaugaaacauu

SEQ ID NO: 20825 - RNA, 21 nt, Artificial Sequence
  Description of Artificial Sequence: Synthetic oligonucleotide
uauuaaguagaugaaacaauu

SEQ ID NO: 20826 - RNA, 21 nt, Artificial Sequence
  Description of Artificial Sequence: Synthetic oligonucleotide
auuaaguagaugaaacauauu

SEQ ID NO: 20827 - RNA, 21 nt, Artificial Sequence
  Description of Artificial Sequence: Synthetic oligonucleotide
uuaaguagaugaaacauuauu

SEQ ID NO: 20828 - RNA, 21 nt, Artificial Sequence
  Description of Artificial Sequence: Synthetic oligonucleotide
uaaguagaugaaacauuaauu

SEQ ID NO: 20829 - RNA, 21 nt, Artificial Sequence
  Description of Artificial Sequence: Synthetic oligonucleotide
aaguagaugaaacauuaaauu

SEQ ID NO: 20830 - RNA, 21 nt, Artificial Sequence
  Description of Artificial Sequence: Synthetic oligonucleotide
aguagaugaaacauuaacauu

SEQ ID NO: 20831 - RNA, 21 nt, Artificial Sequence
  Description of Artificial Sequence: Synthetic oligonucleotide
guagaugaaacauuaacuauu

SEQ ID NO: 20832 - RNA, 21 nt, Artificial Sequence
  Description of Artificial Sequence: Synthetic oligonucleotide
uagaugaaacauuaacucauu

SEQ ID NO: 20833 - RNA, 21 nt, Artificial Sequence
  Description of Artificial Sequence: Synthetic oligonucleotide
agaugaaacauuaacucuauu

SEQ ID NO: 20834 - RNA, 21 nt, Artificial Sequence
  Description of Artificial Sequence: Synthetic oligonucleotide
gaugaaacauuaacucuaauu

SEQ ID NO: 20835 - RNA, 21 nt, Artificial Sequence
  Description of Artificial Sequence: Synthetic oligonucleotide
augaaacauuaacucuaaauu

SEQ ID NO: 20836 - RNA, 21 nt, Artificial Sequence
  Description of Artificial Sequence: Synthetic oligonucleotide
ugaaacauuaacucuaacauu

SEQ ID NO: 20837 - RNA, 21 nt, Artificial Sequence
  Description of Artificial Sequence: Synthetic oligonucleotide
gaaacauuaacucuaacuauu

SEQ ID NO: 20838 - RNA, 21 nt, Artificial Sequence
  Description of Artificial Sequence: Synthetic oligonucleotide
aaacauuaacucuaacugauu

SEQ ID NO: 20839 - RNA, 21 nt, Artificial Sequence
  Description of Artificial Sequence: Synthetic oligonucleotide
aacauuaacucuaacuguauu

SEQ ID NO: 20840 - RNA, 21 nt, Artificial Sequence
  Description of Artificial Sequence: Synthetic oligonucleotide
acauuaacucuaacugugauu

SEQ ID NO: 20841 - RNA, 21 nt, Artificial Sequence
  Description of Artificial Sequence: Synthetic oligonucleotide
cauuaacucuaacugugaauu

SEQ ID NO: 20842 - RNA, 21 nt, Artificial Sequence
  Description of Artificial Sequence: Synthetic oligonucleotide
auuaacucuaacugugacauu

SEQ ID NO: 20843 - RNA, 21 nt, Artificial Sequence
  Description of Artificial Sequence: Synthetic oligonucleotide
uuaacucuaacugugacaauu

SEQ ID NO: 20844 - RNA, 21 nt, Artificial Sequence
  Description of Artificial Sequence: Synthetic oligonucleotide
uaacucuaacugugacaaauu

SEQ ID NO: 20845 - RNA, 21 nt, Artificial Sequence
  Description of Artificial Sequence: Synthetic oligonucleotide
aacucuaacugugacaaaauu

SEQ ID NO: 20846 - RNA, 21 nt, Artificial Sequence
  Description of Artificial Sequence: Synthetic oligonucleotide
acucuaacugugacaaagauu

SEQ ID NO: 20847 - RNA, 21 nt, Artificial Sequence
  Description of Artificial Sequence: Synthetic oligonucleotide
cucuaacugugacaaagaauu

SEQ ID NO: 20848 - RNA, 21 nt, Artificial Sequence
  Description of Artificial Sequence: Synthetic oligonucleotide
ucuaacugugacaaagaaauu

SEQ ID NO: 20849 - RNA, 21 nt, Artificial Sequence
  Description of Artificial Sequence: Synthetic oligonucleotide
cuaacugugacaaagaagauu

SEQ ID NO: 20850 - RNA, 21 nt, Artificial Sequence
  Description of Artificial Sequence: Synthetic oligonucleotide
uaacugugacaaagaagaauu

SEQ ID NO: 20851 - RNA, 21 nt, Artificial Sequence
  Description of Artificial Sequence: Synthetic oligonucleotide
aacugugacaaagaagacauu

SEQ ID NO: 20852 - RNA, 21 nt, Artificial Sequence
  Description of Artificial Sequence: Synthetic oligonucleotide
acugugacaaagaagaccauu

SEQ ID NO: 20853 - RNA, 21 nt, Artificial Sequence
  Description of Artificial Sequence: Synthetic oligonucleotide
cugugacaaagaagaccaauu

SEQ ID NO: 20854 - RNA, 21 nt, Artificial Sequence
  Description of Artificial Sequence: Synthetic oligonucleotide
ugugacaaagaagaccacauu

SEQ ID NO: 20855 - RNA, 21 nt, Artificial Sequence
  Description of Artificial Sequence: Synthetic oligonucleotide
gugacaaagaagaccacaauu

SEQ ID NO: 20856 - RNA, 21 nt, Artificial Sequence
  Description of Artificial Sequence: Synthetic oligonucleotide
ugacaaagaagaccacaaauu

SEQ ID NO: 20857 - RNA, 21 nt, Artificial Sequence
  Description of Artificial Sequence: Synthetic oligonucleotide
gacaaagaagaccacaaaauu

SEQ ID NO: 20858 - RNA, 21 nt, Artificial Sequence
  Description of Artificial Sequence: Synthetic oligonucleotide
acaaagaagaccacaaauauu

SEQ ID NO: 20859 - RNA, 21 nt, Artificial Sequence
  Description of Artificial Sequence: Synthetic oligonucleotide
caaagaagaccacaaauaauu

SEQ ID NO: 20860 - RNA, 21 nt, Artificial Sequence
  Description of Artificial Sequence: Synthetic oligonucleotide
aaagaagaccacaaauagauu

SEQ ID NO: 20861 - RNA, 21 nt, Artificial Sequence
  Description of Artificial Sequence: Synthetic oligonucleotide
aagaagaccacaaauaguauu

SEQ ID NO: 20862 - RNA, 21 nt, Artificial Sequence
  Description of Artificial Sequence: Synthetic oligonucleotide
agaagaccacaaauaguuauu

SEQ ID NO: 20863 - RNA, 21 nt, Artificial Sequence
  Description of Artificial Sequence: Synthetic oligonucleotide
gaagaccacaaauaguuaauu

SEQ ID NO: 20864 - RNA, 21 nt, Artificial Sequence
  Description of Artificial Sequence: Synthetic oligonucleotide
aagaccacaaauaguuauauu

SEQ ID NO: 20865 - RNA, 21 nt, Artificial Sequence
  Description of Artificial Sequence: Synthetic oligonucleotide
agaccacaaauaguuaucauu

SEQ ID NO: 20866 - RNA, 21 nt, Artificial Sequence
  Description of Artificial Sequence: Synthetic oligonucleotide
gaccacaaauaguuaucuauu

SEQ ID NO: 20867 - RNA, 21 nt, Artificial Sequence
  Description of Artificial Sequence: Synthetic oligonucleotide
accacaaauaguuaucuuauu

SEQ ID NO: 20868 - RNA, 21 nt, Artificial Sequence
  Description of Artificial Sequence: Synthetic oligonucleotide
ccacaaauaguuaucuuuauu

SEQ ID NO: 20869 - RNA, 21 nt, Artificial Sequence
  Description of Artificial Sequence: Synthetic oligonucleotide
cacaaauaguuaucuuuuauu

SEQ ID NO: 20870 - RNA, 21 nt, Artificial Sequence
  Description of Artificial Sequence: Synthetic oligonucleotide
acaaauaguuaucuuuuaauu

SEQ ID NO: 20871 - RNA, 21 nt, Artificial Sequence
  Description of Artificial Sequence: Synthetic oligonucleotide
caaauaguuaucuuuuaaauu

SEQ ID NO: 20872 - RNA, 21 nt, Artificial Sequence
  Description of Artificial Sequence: Synthetic oligonucleotide
aaauaguuaucuuuuaauauu

SEQ ID NO: 20873 - RNA, 21 nt, Artificial Sequence
  Description of Artificial Sequence: Synthetic oligonucleotide
aauaguuaucuuuuaauuauu

SEQ ID NO: 20874 - RNA, 21 nt, Artificial Sequence
  Description of Artificial Sequence: Synthetic oligonucleotide
auaguuaucuuuuaauuaauu

SEQ ID NO: 20875 - RNA, 21 nt, Artificial Sequence
  Description of Artificial Sequence: Synthetic oligonucleotide
uaguuaucuuuuaauuacauu

SEQ ID NO: 20876 - RNA, 21 nt, Artificial Sequence
  Description of Artificial Sequence: Synthetic oligonucleotide
aguuaucuuuuaauuacaauu

SEQ ID NO: 20877 - RNA, 21 nt, Artificial Sequence
  Description of Artificial Sequence: Synthetic oligonucleotide
guuaucuuuuaauuacagauu

SEQ ID NO: 20878 - RNA, 21 nt, Artificial Sequence
  Description of Artificial Sequence: Synthetic oligonucleotide
uuaucuuuuaauuacagaauu

SEQ ID NO: 20879 - RNA, 21 nt, Artificial Sequence
  Description of Artificial Sequence: Synthetic oligonucleotide
uaucuuuuaauuacagaaauu

SEQ ID NO: 20880 - RNA, 21 nt, Artificial Sequence
  Description of Artificial Sequence: Synthetic oligonucleotide
aucuuuuaauuacagaagauu

SEQ ID NO: 20881 - RNA, 21 nt, Artificial Sequence
  Description of Artificial Sequence: Synthetic oligonucleotide
ucuuuuaauuacagaagaauu

SEQ ID NO: 20882 - RNA, 21 nt, Artificial Sequence
  Description of Artificial Sequence: Synthetic oligonucleotide
cuuuuaauuacagaagagauu

SEQ ID NO: 20883 - RNA, 21 nt, Artificial Sequence
  Description of Artificial Sequence: Synthetic oligonucleotide
uuuuaauuacagaagaguauu

SEQ ID NO: 20884 - RNA, 21 nt, Artificial Sequence
  Description of Artificial Sequence: Synthetic oligonucleotide
uuuaauuacagaagaguuauu

SEQ ID NO: 20885 - RNA, 21 nt, Artificial Sequence
  Description of Artificial Sequence: Synthetic oligonucleotide
uuaauuacagaagaguuuauu

SEQ ID NO: 20886 - RNA, 21 nt, Artificial Sequence
  Description of Artificial Sequence: Synthetic oligonucleotide
uaauuacagaagaguuucauu

SEQ ID NO: 20887 - RNA, 21 nt, Artificial Sequence
  Description of Artificial Sequence: Synthetic oligonucleotide
aauuacagaagaguuucuauu

SEQ ID NO: 20888 - RNA, 21 nt, Artificial Sequence
  Description of Artificial Sequence: Synthetic oligonucleotide
auuacagaagaguuucuuauu

SEQ ID NO: 20889 - RNA, 21 nt, Artificial Sequence
  Description of Artificial Sequence: Synthetic oligonucleotide
uuacagaagaguuucuuaauu

SEQ ID NO: 20890 - RNA, 21 nt, Artificial Sequence
  Description of Artificial Sequence: Synthetic oligonucleotide
uacagaagaguuucuuaaauu

SEQ ID NO: 20891 - RNA, 21 nt, Artificial Sequence
  Description of Artificial Sequence: Synthetic oligonucleotide
acagaagaguuucuuaacauu

SEQ ID NO: 20892 - RNA, 21 nt, Artificial Sequence
  Description of Artificial Sequence: Synthetic oligonucleotide
cagaagaguuucuuaacuauu

SEQ ID NO: 20893 - RNA, 21 nt, Artificial Sequence
  Description of Artificial Sequence: Synthetic oligonucleotide
agaagaguuucuuaacuuauu

SEQ ID NO: 20894 - RNA, 21 nt, Artificial Sequence
  Description of Artificial Sequence: Synthetic oligonucleotide
gaagaguuucuuaacuuaauu

SEQ ID NO: 20895 - RNA, 21 nt, Artificial Sequence
  Description of Artificial Sequence: Synthetic oligonucleotide
aagaguuucuuaacuuacauu

SEQ ID NO: 20896 - RNA, 21 nt, Artificial Sequence
  Description of Artificial Sequence: Synthetic oligonucleotide
agaguuucuuaacuuacuauu

SEQ ID NO: 20897 - RNA, 21 nt, Artificial Sequence
  Description of Artificial Sequence: Synthetic oligonucleotide
gaguuucuuaacuuacuuauu

SEQ ID NO: 20898 - RNA, 21 nt, Artificial Sequence
  Description of Artificial Sequence: Synthetic oligonucleotide
aguuucuuaacuuacuuuauu

SEQ ID NO: 20899 - RNA, 21 nt, Artificial Sequence
  Description of Artificial Sequence: Synthetic oligonucleotide
guuucuuaacuuacuuuuauu

SEQ ID NO: 20900 - RNA, 21 nt, Artificial Sequence
  Description of Artificial Sequence: Synthetic oligonucleotide
uuucuuaacuuacuuuugauu

SEQ ID NO: 20901 - RNA, 21 nt, Artificial Sequence
  Description of Artificial Sequence: Synthetic oligonucleotide
uucuuaacuuacuuuuguauu

SEQ ID NO: 20902 - RNA, 21 nt, Artificial Sequence
  Description of Artificial Sequence: Synthetic oligonucleotide
ucuuaacuuacuuuuguaauu

SEQ ID NO: 20903 - RNA, 21 nt, Artificial Sequence
  Description of Artificial Sequence: Synthetic oligonucleotide
cuuaacuuacuuuuguaaauu

SEQ ID NO: 20904 - RNA, 21 nt, Artificial Sequence
  Description of Artificial Sequence: Synthetic oligonucleotide
uuaacuuacuuuuguaagauu

SEQ ID NO: 20905 - RNA, 21 nt, Artificial Sequence
  Description of Artificial Sequence: Synthetic oligonucleotide
uaacuuacuuuuguaaguauu

SEQ ID NO: 20906 - RNA, 21 nt, Artificial Sequence
  Description of Artificial Sequence: Synthetic oligonucleotide
aacuuacuuuuguaaguuauu

SEQ ID NO: 20907 - RNA, 21 nt, Artificial Sequence
  Description of Artificial Sequence: Synthetic oligonucleotide
acuuacuuuuguaaguuuauu

SEQ ID NO: 20908 - RNA, 21 nt, Artificial Sequence
  Description of Artificial Sequence: Synthetic oligonucleotide
cuuacuuuuguaaguuuuauu

SEQ ID NO: 20909 - RNA, 21 nt, Artificial Sequence
  Description of Artificial Sequence: Synthetic oligonucleotide
uuacuuuuguaaguuuuuauu

SEQ ID NO: 20910 - RNA, 21 nt, Artificial Sequence
  Description of Artificial Sequence: Synthetic oligonucleotide
uacuuuuguaaguuuuuaauu

SEQ ID NO: 20911 - RNA, 21 nt, Artificial Sequence
  Description of Artificial Sequence: Synthetic oligonucleotide
acuuuuguaaguuuuuauauu

SEQ ID NO: 20912 - RNA, 21 nt, Artificial Sequence
  Description of Artificial Sequence: Synthetic oligonucleotide
cuuuuguaaguuuuuauuauu

SEQ ID NO: 20913 - RNA, 21 nt, Artificial Sequence
  Description of Artificial Sequence: Synthetic oligonucleotide
uuuuguaaguuuuuauugauu

SEQ ID NO: 20914 - RNA, 21 nt, Artificial Sequence
  Description of Artificial Sequence: Synthetic oligonucleotide
uuuguaaguuuuuauuguauu

SEQ ID NO: 20915 - RNA, 21 nt, Artificial Sequence
  Description of Artificial Sequence: Synthetic oligonucleotide
uuguaaguuuuuauugugauu

SEQ ID NO: 20916 - RNA, 21 nt, Artificial Sequence
  Description of Artificial Sequence: Synthetic oligonucleotide
uguaaguuuuuauuguguauu

SEQ ID NO: 20917 - RNA, 21 nt, Artificial Sequence
  Description of Artificial Sequence: Synthetic oligonucleotide
guaaguuuuuauuguguaauu

SEQ ID NO: 20918 - RNA, 21 nt, Artificial Sequence
  Description of Artificial Sequence: Synthetic oligonucleotide
uaaguuuuuauuguguaaauu

SEQ ID NO: 20919 - RNA, 21 nt, Artificial Sequence
  Description of Artificial Sequence: Synthetic oligonucleotide
aaguuuuuauuguguaagauu

SEQ ID NO: 20920 - RNA, 21 nt, Artificial Sequence
  Description of Artificial Sequence: Synthetic oligonucleotide
aguuuuuauuguguaaguauu

SEQ ID NO: 20921 - RNA, 21 nt, Artificial Sequence
  Description of Artificial Sequence: Synthetic oligonucleotide
guuuuuauuguguaaguuauu

SEQ ID NO: 20922 - RNA, 21 nt, Artificial Sequence
  Description of Artificial Sequence: Synthetic oligonucleotide
uuuuuauuguguaaguuuauu

SEQ ID NO: 20923 - RNA, 21 nt, Artificial Sequence
  Description of Artificial Sequence: Synthetic oligonucleotide
uuuuauuguguaaguuuaauu

SEQ ID NO: 20924 - RNA, 21 nt, Artificial Sequence
  Description of Artificial Sequence: Synthetic oligonucleotide
uuuauuguguaaguuuauauu

SEQ ID NO: 20925 - RNA, 21 nt, Artificial Sequence
  Description of Artificial Sequence: Synthetic oligonucleotide
uuauuguguaaguuuauaauu

SEQ ID NO: 20926 - RNA, 21 nt, Artificial Sequence
  Description of Artificial Sequence: Synthetic oligonucleotide
uauuguguaaguuuauaaauu

SEQ ID NO: 20927 - RNA, 21 nt, Artificial Sequence
  Description of Artificial Sequence: Synthetic oligonucleotide
auuguguaaguuuauaauauu

SEQ ID NO: 20928 - RNA, 21 nt, Artificial Sequence
  Description of Artificial Sequence: Synthetic oligonucleotide
uuguguaaguuuauaaugauu

SEQ ID NO: 20929 - RNA, 21 nt, Artificial Sequence
  Description of Artificial Sequence: Synthetic oligonucleotide
uguguaaguuuauaaugcauu

SEQ ID NO: 20930 - RNA, 21 nt, Artificial Sequence
  Description of Artificial Sequence: Synthetic oligonucleotide
guguaaguuuauaaugcaauu

SEQ ID NO: 20931 - RNA, 21 nt, Artificial Sequence
  Description of Artificial Sequence: Synthetic oligonucleotide
uguaaguuuauaaugcagauu

SEQ ID NO: 20932 - RNA, 21 nt, Artificial Sequence
  Description of Artificial Sequence: Synthetic oligonucleotide
guaaguuuauaaugcaggauu

SEQ ID NO: 20933 - RNA, 21 nt, Artificial Sequence
  Description of Artificial Sequence: Synthetic oligonucleotide
uaaguuuauaaugcagggauu

SEQ ID NO: 20934 - RNA, 21 nt, Artificial Sequence
  Description of Artificial Sequence: Synthetic oligonucleotide
aaguuuauaaugcaggggauu

SEQ ID NO: 20935 - RNA, 21 nt, Artificial Sequence
  Description of Artificial Sequence: Synthetic oligonucleotide
aguuuauaaugcaggggaauu

SEQ ID NO: 20936 - RNA, 21 nt, Artificial Sequence
  Description of Artificial Sequence: Synthetic oligonucleotide
guuuauaaugcaggggaaauu

SEQ ID NO: 20937 - RNA, 21 nt, Artificial Sequence
  Description of Artificial Sequence: Synthetic oligonucleotide
uuuauaaugcaggggaagauu

SEQ ID NO: 20938 - RNA, 21 nt, Artificial Sequence
  Description of Artificial Sequence: Synthetic oligonucleotide
uuauaaugcaggggaaguauu

SEQ ID NO: 20939 - RNA, 21 nt, Artificial Sequence
  Description of Artificial Sequence: Synthetic oligonucleotide
uauaaugcaggggaaguaauu

SEQ ID NO: 20940 - RNA, 21 nt, Artificial Sequence
  Description of Artificial Sequence: Synthetic oligonucleotide
auaaugcaggggaaguacauu

SEQ ID NO: 20941 - RNA, 21 nt, Artificial Sequence
  Description of Artificial Sequence: Synthetic oligonucleotide
uaaugcaggggaaguacuauu

SEQ ID NO: 20942 - RNA, 21 nt, Artificial Sequence
  Description of Artificial Sequence: Synthetic oligonucleotide
aaugcaggggaaguacuaauu

SEQ ID NO: 20943 - RNA, 21 nt, Artificial Sequence
  Description of Artificial Sequence: Synthetic oligonucleotide
augcaggggaaguacuacauu

SEQ ID NO: 20944 - RNA, 21 nt, Artificial Sequence
  Description of Artificial Sequence: Synthetic oligonucleotide
ugcaggggaaguacuacuauu

SEQ ID NO: 20945 - RNA, 21 nt, Artificial Sequence
  Description of Artificial Sequence: Synthetic oligonucleotide
gcaggggaaguacuacucauu

SEQ ID NO: 20946 - RNA, 21 nt, Artificial Sequence
  Description of Artificial Sequence: Synthetic oligonucleotide
caggggaaguacuacuccauu

SEQ ID NO: 20947 - RNA, 21 nt, Artificial Sequence
  Description of Artificial Sequence: Synthetic oligonucleotide
aggggaaguacuacuccuauu

SEQ ID NO: 20948 - RNA, 21 nt, Artificial Sequence
  Description of Artificial Sequence: Synthetic oligonucleotide
ggggaaguacuacuccucauu

SEQ ID NO: 20949 - RNA, 21 nt, Artificial Sequence
  Description of Artificial Sequence: Synthetic oligonucleotide
gggaaguacuacuccucaauu

SEQ ID NO: 20950 - RNA, 21 nt, Artificial Sequence
  Description of Artificial Sequence: Synthetic oligonucleotide
ggaaguacuacuccucaaauu

SEQ ID NO: 20951 - RNA, 21 nt, Artificial Sequence
  Description of Artificial Sequence: Synthetic oligonucleotide
gaaguacuacuccucaaaauu

SEQ ID NO: 20952 - RNA, 21 nt, Artificial Sequence
  Description of Artificial Sequence: Synthetic oligonucleotide
aaguacuacuccucaaauauu

SEQ ID NO: 20953 - RNA, 21 nt, Artificial Sequence
  Description of Artificial Sequence: Synthetic oligonucleotide
aguacuacuccucaaaugauu

SEQ ID NO: 20954 - RNA, 21 nt, Artificial Sequence
  Description of Artificial Sequence: Synthetic oligonucleotide
guacuacuccucaaauguauu

SEQ ID NO: 20955 - RNA, 21 nt, Artificial Sequence
  Description of Artificial Sequence: Synthetic oligonucleotide
uacuacuccucaaauguuauu

SEQ ID NO: 20956 - RNA, 21 nt, Artificial Sequence
  Description of Artificial Sequence: Synthetic oligonucleotide
acuacuccucaaauguugauu

SEQ ID NO: 20957 - RNA, 21 nt, Artificial Sequence
  Description of Artificial Sequence: Synthetic oligonucleotide
cuacuccucaaauguugaauu

SEQ ID NO: 20958 - RNA, 21 nt, Artificial Sequence
  Description of Artificial Sequence: Synthetic oligonucleotide
uacuccucaaauguugagauu

SEQ ID NO: 20959 - RNA, 21 nt, Artificial Sequence
  Description of Artificial Sequence: Synthetic oligonucleotide
acuccucaaauguugaggauu

SEQ ID NO: 20960 - RNA, 21 nt, Artificial Sequence
  Description of Artificial Sequence: Synthetic oligonucleotide
cuccucaaauguugagggauu

SEQ ID NO: 20961 - RNA, 21 nt, Artificial Sequence
  Description of Artificial Sequence: Synthetic oligonucleotide
uccucaaauguugagggaauu

SEQ ID NO: 20962 - RNA, 21 nt, Artificial Sequence
  Description of Artificial Sequence: Synthetic oligonucleotide
ccucaaauguugagggaaauu

SEQ ID NO: 20963 - RNA, 21 nt, Artificial Sequence
  Description of Artificial Sequence: Synthetic oligonucleotide
cucaaauguugagggaagauu

SEQ ID NO: 20964 - RNA, 21 nt, Artificial Sequence
  Description of Artificial Sequence: Synthetic oligonucleotide
ucaaauguugagggaagcauu

SEQ ID NO: 20965 - RNA, 21 nt, Artificial Sequence
  Description of Artificial Sequence: Synthetic oligonucleotide
caaauguugagggaagcuauu

SEQ ID NO: 20966 - RNA, 21 nt, Artificial Sequence
  Description of Artificial Sequence: Synthetic oligonucleotide
aaauguugagggaagcuuauu

SEQ ID NO: 20967 - RNA, 21 nt, Artificial Sequence
  Description of Artificial Sequence: Synthetic oligonucleotide
aauguugagggaagcuucauu

SEQ ID NO: 20968 - RNA, 21 nt, Artificial Sequence
  Description of Artificial Sequence: Synthetic oligonucleotide
auguugagggaagcuuccauu

SEQ ID NO: 20969 - RNA, 21 nt, Artificial Sequence
  Description of Artificial Sequence: Synthetic oligonucleotide
uguugagggaagcuuccaauu

SEQ ID NO: 20970 - RNA, 21 nt, Artificial Sequence
  Description of Artificial Sequence: Synthetic oligonucleotide
guugagggaagcuuccauauu

SEQ ID NO: 20971 - RNA, 21 nt, Artificial Sequence
  Description of Artificial Sequence: Synthetic oligonucleotide
uugagggaagcuuccauaauu

SEQ ID NO: 20972 - RNA, 21 nt, Artificial Sequence
  Description of Artificial Sequence: Synthetic oligonucleotide
ugagggaagcuuccauaaauu

SEQ ID NO: 20973 - RNA, 21 nt, Artificial Sequence
  Description of Artificial Sequence: Synthetic oligonucleotide
gagggaagcuuccauaacauu

SEQ ID NO: 20974 - RNA, 21 nt, Artificial Sequence
  Description of Artificial Sequence: Synthetic oligonucleotide
agggaagcuuccauaacaauu

SEQ ID NO: 20975 - RNA, 21 nt, Artificial Sequence
  Description of Artificial Sequence: Synthetic oligonucleotide
gggaagcuuccauaacauauu

SEQ ID NO: 20976 - RNA, 21 nt, Artificial Sequence
  Description of Artificial Sequence: Synthetic oligonucleotide
ggaagcuuccauaacauuauu

SEQ ID NO: 20977 - RNA, 21 nt, Artificial Sequence
  Description of Artificial Sequence: Synthetic oligonucleotide
gaagcuuccauaacauugauu

SEQ ID NO: 20978 - RNA, 21 nt, Artificial Sequence
  Description of Artificial Sequence: Synthetic oligonucleotide
aagcuuccauaacauugaauu

SEQ ID NO: 20979 - RNA, 21 nt, Artificial Sequence
  Description of Artificial Sequence: Synthetic oligonucleotide
agcuuccauaacauugauauu

SEQ ID NO: 20980 - RNA, 21 nt, Artificial Sequence
  Description of Artificial Sequence: Synthetic oligonucleotide
gcuuccauaacauugaugauu

SEQ ID NO: 20981 - RNA, 21 nt, Artificial Sequence
  Description of Artificial Sequence: Synthetic oligonucleotide
cuuccauaacauugaugaauu

SEQ ID NO: 20982 - RNA, 21 nt, Artificial Sequence
  Description of Artificial Sequence: Synthetic oligonucleotide
uuccauaacauugaugacauu

SEQ ID NO: 20983 - RNA, 21 nt, Artificial Sequence
  Description of Artificial Sequence: Synthetic oligonucleotide
uccauaacauugaugacuauu

SEQ ID NO: 20984 - RNA, 21 nt, Artificial Sequence
  Description of Artificial Sequence: Synthetic oligonucleotide
ccauaacauugaugacugauu

SEQ ID NO: 20985 - RNA, 21 nt, Artificial Sequence
  Description of Artificial Sequence: Synthetic oligonucleotide
cauaacauugaugacuggauu

SEQ ID NO: 20986 - RNA, 21 nt, Artificial Sequence
  Description of Artificial Sequence: Synthetic oligonucleotide
auaacauugaugacuggcauu

SEQ ID NO: 20987 - RNA, 21 nt, Artificial Sequence
  Description of Artificial Sequence: Synthetic oligonucleotide
uaacauugaugacuggcuauu

SEQ ID NO: 20988 - RNA, 21 nt, Artificial Sequence
  Description of Artificial Sequence: Synthetic oligonucleotide
aacauugaugacuggcuuauu

SEQ ID NO: 20989 - RNA, 21 nt, Artificial Sequence
  Description of Artificial Sequence: Synthetic oligonucleotide
acauugaugacuggcuucauu

SEQ ID NO: 20990 - RNA, 21 nt, Artificial Sequence
  Description of Artificial Sequence: Synthetic oligonucleotide
cauugaugacuggcuucaauu

SEQ ID NO: 20991 - RNA, 21 nt, Artificial Sequence
  Description of Artificial Sequence: Synthetic oligonucleotide
auugaugacuggcuucauauu

SEQ ID NO: 20992 - RNA, 21 nt, Artificial Sequence
  Description of Artificial Sequence: Synthetic oligonucleotide
uugaugacuggcuucaugauu

SEQ ID NO: 20993 - RNA, 21 nt, Artificial Sequence
  Description of Artificial Sequence: Synthetic oligonucleotide
ugaugacuggcuucauggauu

SEQ ID NO: 20994 - RNA, 21 nt, Artificial Sequence
  Description of Artificial Sequence: Synthetic oligonucleotide
gaugacuggcuucauggcauu

SEQ ID NO: 20995 - RNA, 21 nt, Artificial Sequence
  Description of Artificial Sequence: Synthetic oligonucleotide
augacuggcuucauggcaauu

SEQ ID NO: 20996 - RNA, 21 nt, Artificial Sequence
  Description of Artificial Sequence: Synthetic oligonucleotide
ugacuggcuucauggcagauu

SEQ ID NO: 20997 - RNA, 21 nt, Artificial Sequence
  Description of Artificial Sequence: Synthetic oligonucleotide
gacuggcuucauggcaguauu

SEQ ID NO: 20998 - RNA, 21 nt, Artificial Sequence
  Description of Artificial Sequence: Synthetic oligonucleotide
acuggcuucauggcaguaauu

SEQ ID NO: 20999 - RNA, 21 nt, Artificial Sequence
  Description of Artificial Sequence: Synthetic oligonucleotide
cuggcuucauggcaguaaauu

SEQ ID NO: 21000 - RNA, 21 nt, Artificial Sequence
  Description of Artificial Sequence: Synthetic oligonucleotide
uggcuucauggcaguaauauu

SEQ ID NO: 21001 - RNA, 21 nt, Artificial Sequence
  Description of Artificial Sequence: Synthetic oligonucleotide
ggcuucauggcaguaauuauu

SEQ ID NO: 21002 - RNA, 21 nt, Artificial Sequence
  Description of Artificial Sequence: Synthetic oligonucleotide
gcuucauggcaguaauucauu

SEQ ID NO: 21003 - RNA, 21 nt, Artificial Sequence
  Description of Artificial Sequence: Synthetic oligonucleotide
cuucauggcaguaauucuauu

SEQ ID NO: 21004 - RNA, 21 nt, Artificial Sequence
  Description of Artificial Sequence: Synthetic oligonucleotide
uucauggcaguaauucucauu

SEQ ID NO: 21005 - RNA, 21 nt, Artificial Sequence
  Description of Artificial Sequence: Synthetic oligonucleotide
ucauggcaguaauucucgauu

SEQ ID NO: 21006 - RNA, 21 nt, Artificial Sequence
  Description of Artificial Sequence: Synthetic oligonucleotide
cauggcaguaauucucggauu

SEQ ID NO: 21007 - RNA, 21 nt, Artificial Sequence
  Description of Artificial Sequence: Synthetic oligonucleotide
auggcaguaauucucggcauu

SEQ ID NO: 21008 - RNA, 21 nt, Artificial Sequence
  Description of Artificial Sequence: Synthetic oligonucleotide
uggcaguaauucucggcuauu

SEQ ID NO: 21009 - RNA, 21 nt, Artificial Sequence
  Description of Artificial Sequence: Synthetic oligonucleotide
ggcaguaauucucggcugauu

SEQ ID NO: 21010 - RNA, 21 nt, Artificial Sequence
  Description of Artificial Sequence: Synthetic oligonucleotide
gcaguaauucucggcuguauu

SEQ ID NO: 21011 - RNA, 21 nt, Artificial Sequence
  Description of Artificial Sequence: Synthetic oligonucleotide
caguaauucucggcuguaauu

SEQ ID NO: 21012 - RNA, 21 nt, Artificial Sequence
  Description of Artificial Sequence: Synthetic oligonucleotide
aguaauucucggcuguagauu

SEQ ID NO: 21013 - RNA, 21 nt, Artificial Sequence
  Description of Artificial Sequence: Synthetic oligonucleotide
guaauucucggcuguaguauu

SEQ ID NO: 21014 - RNA, 21 nt, Artificial Sequence
  Description of Artificial Sequence: Synthetic oligonucleotide
uaauucucggcuguaguuauu

SEQ ID NO: 21015 - RNA, 21 nt, Artificial Sequence
  Description of Artificial Sequence: Synthetic oligonucleotide
aauucucggcuguaguugauu

SEQ ID NO: 21016 - RNA, 21 nt, Artificial Sequence
  Description of Artificial Sequence: Synthetic oligonucleotide
auucucggcuguaguugcauu

SEQ ID NO: 21017 - RNA, 21 nt, Artificial Sequence
  Description of Artificial Sequence: Synthetic oligonucleotide
uucucggcuguaguugcaauu

SEQ ID NO: 21018 - RNA, 21 nt, Artificial Sequence
  Description of Artificial Sequence: Synthetic oligonucleotide
ucucggcuguaguugcauauu

SEQ ID NO: 21019 - RNA, 21 nt, Artificial Sequence
  Description of Artificial Sequence: Synthetic oligonucleotide
cucggcuguaguugcauaauu

SEQ ID NO: 21020 - RNA, 21 nt, Artificial Sequence
  Description of Artificial Sequence: Synthetic oligonucleotide
ucggcuguaguugcauaaauu

SEQ ID NO: 21021 - RNA, 21 nt, Artificial Sequence
  Description of Artificial Sequence: Synthetic oligonucleotide
cggcuguaguugcauaagauu

SEQ ID NO: 21022 - RNA, 21 nt, Artificial Sequence
  Description of Artificial Sequence: Synthetic oligonucleotide
ggcuguaguugcauaagcauu

SEQ ID NO: 21023 - RNA, 21 nt, Artificial Sequence
  Description of Artificial Sequence: Synthetic oligonucleotide
gcuguaguugcauaagcaauu

SEQ ID NO: 21024 - RNA, 21 nt, Artificial Sequence
  Description of Artificial Sequence: Synthetic oligonucleotide
cuguaguugcauaagcauauu

SEQ ID NO: 21025 - RNA, 21 nt, Artificial Sequence
  Description of Artificial Sequence: Synthetic oligonucleotide
uguaguugcauaagcauuauu

SEQ ID NO: 21026 - RNA, 21 nt, Artificial Sequence
  Description of Artificial Sequence: Synthetic oligonucleotide
guaguugcauaagcauugauu

SEQ ID NO: 21027 - RNA, 21 nt, Artificial Sequence
  Description of Artificial Sequence: Synthetic oligonucleotide
uaguugcauaagcauugcauu

SEQ ID NO: 21028 - RNA, 21 nt, Artificial Sequence
  Description of Artificial Sequence: Synthetic oligonucleotide
aguugcauaagcauugcuauu

SEQ ID NO: 21029 - RNA, 21 nt, Artificial Sequence
  Description of Artificial Sequence: Synthetic oligonucleotide
guugcauaagcauugcucauu

SEQ ID NO: 21030 - RNA, 21 nt, Artificial Sequence
  Description of Artificial Sequence: Synthetic oligonucleotide
uugcauaagcauugcucaauu

SEQ ID NO: 21031 - RNA, 21 nt, Artificial Sequence
  Description of Artificial Sequence: Synthetic oligonucleotide
ugcauaagcauugcucaaauu

SEQ ID NO: 21032 - RNA, 21 nt, Artificial Sequence
  Description of Artificial Sequence: Synthetic oligonucleotide
gcauaagcauugcucaagauu

SEQ ID NO: 21033 - RNA, 21 nt, Artificial Sequence
  Description of Artificial Sequence: Synthetic oligonucleotide
cauaagcauugcucaagaauu

SEQ ID NO: 21034 - RNA, 21 nt, Artificial Sequence
  Description of Artificial Sequence: Synthetic oligonucleotide
auaagcauugcucaagagauu

SEQ ID NO: 21035 - RNA, 21 nt, Artificial Sequence
  Description of Artificial Sequence: Synthetic oligonucleotide
uaagcauugcucaagaggauu

SEQ ID NO: 21036 - RNA, 21 nt, Artificial Sequence
  Description of Artificial Sequence: Synthetic oligonucleotide
aagcauugcucaagaggaauu

SEQ ID NO: 21037 - RNA, 21 nt, Artificial Sequence
  Description of Artificial Sequence: Synthetic oligonucleotide
agcauugcucaagaggaaauu

SEQ ID NO: 21038 - RNA, 21 nt, Artificial Sequence
  Description of Artificial Sequence: Synthetic oligonucleotide
gcauugcucaagaggaaaauu

SEQ ID NO: 21039 - RNA, 21 nt, Artificial Sequence
  Description of Artificial Sequence: Synthetic oligonucleotide
cauugcucaagaggaaaaauu

SEQ ID NO: 21040 - RNA, 21 nt, Artificial Sequence
  Description of Artificial Sequence: Synthetic oligonucleotide
auugcucaagaggaaaauauu

SEQ ID NO: 21041 - RNA, 21 nt, Artificial Sequence
  Description of Artificial Sequence: Synthetic oligonucleotide
uugcucaagaggaaaaucauu

SEQ ID NO: 21042 - RNA, 21 nt, Artificial Sequence
  Description of Artificial Sequence: Synthetic oligonucleotide
ugcucaagaggaaaauccauu

SEQ ID NO: 21043 - RNA, 21 nt, Artificial Sequence
  Description of Artificial Sequence: Synthetic oligonucleotide
gcucaagaggaaaauccaauu

SEQ ID NO: 21044 - RNA, 21 nt, Artificial Sequence
  Description of Artificial Sequence: Synthetic oligonucleotide
cucaagaggaaaauccaaauu

SEQ ID NO: 21045 - RNA, 21 nt, Artificial Sequence
  Description of Artificial Sequence: Synthetic oligonucleotide
ucaagaggaaaauccaaaauu

SEQ ID NO: 21046 - RNA, 21 nt, Artificial Sequence
  Description of Artificial Sequence: Synthetic oligonucleotide
caagaggaaaauccaaaaauu

SEQ ID NO: 21047 - RNA, 21 nt, Artificial Sequence
  Description of Artificial Sequence: Synthetic oligonucleotide
aagaggaaaauccaaaagauu

SEQ ID NO: 21048 - RNA, 21 nt, Artificial Sequence
  Description of Artificial Sequence: Synthetic oligonucleotide
agaggaaaauccaaaaguauu

SEQ ID NO: 21049 - RNA, 21 nt, Artificial Sequence
  Description of Artificial Sequence: Synthetic oligonucleotide
gaggaaaauccaaaagugauu

SEQ ID NO: 21050 - RNA, 21 nt, Artificial Sequence
  Description of Artificial Sequence: Synthetic oligonucleotide
aggaaaauccaaaagugcauu

SEQ ID NO: 21051 - RNA, 21 nt, Artificial Sequence
  Description of Artificial Sequence: Synthetic oligonucleotide
ggaaaauccaaaagugcaauu

SEQ ID NO: 21052 - RNA, 21 nt, Artificial Sequence
  Description of Artificial Sequence: Synthetic oligonucleotide
gaaaauccaaaagugcagauu

SEQ ID NO: 21053 - RNA, 21 nt, Artificial Sequence
  Description of Artificial Sequence: Synthetic oligonucleotide
aaaauccaaaagugcagcauu

SEQ ID NO: 21054 - RNA, 21 nt, Artificial Sequence
  Description of Artificial Sequence: Synthetic oligonucleotide
aaauccaaaagugcagcaauu

SEQ ID NO: 21055 - RNA, 21 nt, Artificial Sequence
  Description of Artificial Sequence: Synthetic oligonucleotide
aauccaaaagugcagcagauu

SEQ ID NO: 21056 - RNA, 21 nt, Artificial Sequence
  Description of Artificial Sequence: Synthetic oligonucleotide
auccaaaagugcagcaggauu

SEQ ID NO: 21057 - RNA, 21 nt, Artificial Sequence
  Description of Artificial Sequence: Synthetic oligonucleotide
uccaaaagugcagcaggaauu

SEQ ID NO: 21058 - RNA, 21 nt, Artificial Sequence
  Description of Artificial Sequence: Synthetic oligonucleotide
ccaaaagugcagcaggagauu

SEQ ID NO: 21059 - RNA, 21 nt, Artificial Sequence
  Description of Artificial Sequence: Synthetic oligonucleotide
caaaagugcagcaggagaauu

SEQ ID NO: 21060 - RNA, 21 nt, Artificial Sequence
  Description of Artificial Sequence: Synthetic oligonucleotide
aaaagugcagcaggagaaauu

SEQ ID NO: 21061 - RNA, 21 nt, Artificial Sequence
  Description of Artificial Sequence: Synthetic oligonucleotide
aaagugcagcaggagaacauu

SEQ ID NO: 21062 - RNA, 21 nt, Artificial Sequence
  Description of Artificial Sequence: Synthetic oligonucleotide
aagugcagcaggagaacuauu

SEQ ID NO: 21063 - RNA, 21 nt, Artificial Sequence
  Description of Artificial Sequence: Synthetic oligonucleotide
agugcagcaggagaacucauu

SEQ ID NO: 21064 - RNA, 21 nt, Artificial Sequence
  Description of Artificial Sequence: Synthetic oligonucleotide
gugcagcaggagaacucuauu

SEQ ID NO: 21065 - RNA, 21 nt, Artificial Sequence
  Description of Artificial Sequence: Synthetic oligonucleotide
ugcagcaggagaacucuuauu

SEQ ID NO: 21066 - RNA, 21 nt, Artificial Sequence
  Description of Artificial Sequence: Synthetic oligonucleotide
gcagcaggagaacucuuuauu

SEQ ID NO: 21067 - RNA, 21 nt, Artificial Sequence
  Description of Artificial Sequence: Synthetic oligonucleotide
cagcaggagaacucuuuuauu

SEQ ID NO: 21068 - RNA, 21 nt, Artificial Sequence
  Description of Artificial Sequence: Synthetic oligonucleotide
agcaggagaacucuuuucauu

SEQ ID NO: 21069 - RNA, 21 nt, Artificial Sequence
  Description of Artificial Sequence: Synthetic oligonucleotide
gcaggagaacucuuuuccauu

SEQ ID NO: 21070 - RNA, 21 nt, Artificial Sequence
  Description of Artificial Sequence: Synthetic oligonucleotide
caggagaacucuuuucccauu

SEQ ID NO: 21071 - RNA, 21 nt, Artificial Sequence
  Description of Artificial Sequence: Synthetic oligonucleotide
aggagaacucuuuucccuauu

SEQ ID NO: 21072 - RNA, 21 nt, Artificial Sequence
  Description of Artificial Sequence: Synthetic oligonucleotide
ggagaacucuuuucccugauu

SEQ ID NO: 21073 - RNA, 21 nt, Artificial Sequence
  Description of Artificial Sequence: Synthetic oligonucleotide
gagaacucuuuucccugaauu

SEQ ID NO: 21074 - RNA, 21 nt, Artificial Sequence
  Description of Artificial Sequence: Synthetic oligonucleotide
agaacucuuuucccugaaauu

SEQ ID NO: 21075 - RNA, 21 nt, Artificial Sequence
  Description of Artificial Sequence: Synthetic oligonucleotide
gaacucuuuucccugaaaauu

SEQ ID NO: 21076 - RNA, 21 nt, Artificial Sequence
  Description of Artificial Sequence: Synthetic oligonucleotide
aacucuuuucccugaaaaauu

SEQ ID NO: 21077 - RNA, 21 nt, Artificial Sequence
  Description of Artificial Sequence: Synthetic oligonucleotide
acucuuuucccugaaaaaauu

SEQ ID NO: 21078 - RNA, 21 nt, Artificial Sequence
  Description of Artificial Sequence: Synthetic oligonucleotide
cucuuuucccugaaaaagauu

SEQ ID NO: 21079 - RNA, 21 nt, Artificial Sequence
  Description of Artificial Sequence: Synthetic oligonucleotide
ucuuuucccugaaaaaggauu

SEQ ID NO: 21080 - RNA, 21 nt, Artificial Sequence
  Description of Artificial Sequence: Synthetic oligonucleotide
cuuuucccugaaaaaggaauu

SEQ ID NO: 21081 - RNA, 21 nt, Artificial Sequence
  Description of Artificial Sequence: Synthetic oligonucleotide
uuuucccugaaaaaggaaauu

SEQ ID NO: 21082 - RNA, 21 nt, Artificial Sequence
  Description of Artificial Sequence: Synthetic oligonucleotide
uuucccugaaaaaggaaaauu

SEQ ID NO: 21083 - RNA, 21 nt, Artificial Sequence
  Description of Artificial Sequence: Synthetic oligonucleotide
uucccugaaaaaggaaaaauu

SEQ ID NO: 21084 - RNA, 21 nt, Artificial Sequence
  Description of Artificial Sequence: Synthetic oligonucleotide
ucccugaaaaaggaaaaaauu

SEQ ID NO: 21085 - RNA, 21 nt, Artificial Sequence
  Description of Artificial Sequence: Synthetic oligonucleotide
cccugaaaaaggaaaaauauu

SEQ ID NO: 21086 - RNA, 21 nt, Artificial Sequence
  Description of Artificial Sequence: Synthetic oligonucleotide
ccugaaaaaggaaaaauaauu

SEQ ID NO: 21087 - RNA, 21 nt, Artificial Sequence
  Description of Artificial Sequence: Synthetic oligonucleotide
cugaaaaaggaaaaauauauu

SEQ ID NO: 21088 - RNA, 21 nt, Artificial Sequence
  Description of Artificial Sequence: Synthetic oligonucleotide
ugaaaaaggaaaaauauuauu

SEQ ID NO: 21089 - RNA, 21 nt, Artificial Sequence
  Description of Artificial Sequence: Synthetic oligonucleotide
gaaaaaggaaaaauauugauu

SEQ ID NO: 21090 - RNA, 21 nt, Artificial Sequence
  Description of Artificial Sequence: Synthetic oligonucleotide
aaaaaggaaaaauauugaauu

SEQ ID NO: 21091 - RNA, 21 nt, Artificial Sequence
  Description of Artificial Sequence: Synthetic oligonucleotide
aaaaggaaaaauauugaaauu

SEQ ID NO: 21092 - RNA, 21 nt, Artificial Sequence
  Description of Artificial Sequence: Synthetic oligonucleotide
aaaggaaaaauauugaacauu

SEQ ID NO: 21093 - RNA, 21 nt, Artificial Sequence
  Description of Artificial Sequence: Synthetic oligonucleotide
aaggaaaaauauugaacuauu

SEQ ID NO: 21094 - RNA, 21 nt, Artificial Sequence
  Description of Artificial Sequence: Synthetic oligonucleotide
aggaaaaauauugaacucauu

SEQ ID NO: 21095 - RNA, 21 nt, Artificial Sequence
  Description of Artificial Sequence: Synthetic oligonucleotide
ggaaaaauauugaacucaauu

SEQ ID NO: 21096 - RNA, 21 nt, Artificial Sequence
  Description of Artificial Sequence: Synthetic oligonucleotide
gaaaaauauugaacucaaauu

SEQ ID NO: 21097 - RNA, 21 nt, Artificial Sequence
  Description of Artificial Sequence: Synthetic oligonucleotide
aaaaauauugaacucaauauu

SEQ ID NO: 21098 - RNA, 21 nt, Artificial Sequence
  Description of Artificial Sequence: Synthetic oligonucleotide
aaaauauugaacucaaugauu

SEQ ID NO: 21099 - RNA, 21 nt, Artificial Sequence
  Description of Artificial Sequence: Synthetic oligonucleotide
aaauauugaacucaaugaauu

SEQ ID NO: 21100 - RNA, 21 nt, Artificial Sequence
  Description of Artificial Sequence: Synthetic oligonucleotide
aauauugaacucaaugauauu

SEQ ID NO: 21101 - RNA, 21 nt, Artificial Sequence
  Description of Artificial Sequence: Synthetic oligonucleotide
auauugaacucaaugauaauu

SEQ ID NO: 21102 - RNA, 21 nt, Artificial Sequence
  Description of Artificial Sequence: Synthetic oligonucleotide
uauugaacucaaugauagauu

SEQ ID NO: 21103 - RNA, 21 nt, Artificial Sequence
  Description of Artificial Sequence: Synthetic oligonucleotide
auugaacucaaugauagcauu

SEQ ID NO: 21104 - RNA, 21 nt, Artificial Sequence
  Description of Artificial Sequence: Synthetic oligonucleotide
uugaacucaaugauagcaauu

SEQ ID NO: 21105 - RNA, 21 nt, Artificial Sequence
  Description of Artificial Sequence: Synthetic oligonucleotide
ugaacucaaugauagcacauu

SEQ ID NO: 21106 - RNA, 21 nt, Artificial Sequence
  Description of Artificial Sequence: Synthetic oligonucleotide
gaacucaaugauagcaccauu

SEQ ID NO: 21107 - RNA, 21 nt, Artificial Sequence
  Description of Artificial Sequence: Synthetic oligonucleotide
aacucaaugauagcaccuauu

SEQ ID NO: 21108 - RNA, 21 nt, Artificial Sequence
  Description of Artificial Sequence: Synthetic oligonucleotide
acucaaugauagcaccuaauu

SEQ ID NO: 21109 - RNA, 21 nt, Artificial Sequence
  Description of Artificial Sequence: Synthetic oligonucleotide
cucaaugauagcaccuaaauu

SEQ ID NO: 21110 - RNA, 21 nt, Artificial Sequence
  Description of Artificial Sequence: Synthetic oligonucleotide
ucaaugauagcaccuaaaauu

SEQ ID NO: 21111 - RNA, 21 nt, Artificial Sequence
  Description of Artificial Sequence: Synthetic oligonucleotide
caaugauagcaccuaaacauu

SEQ ID NO: 21112 - RNA, 21 nt, Artificial Sequence
  Description of Artificial Sequence: Synthetic oligonucleotide
aaugauagcaccuaaacuauu

SEQ ID NO: 21113 - RNA, 21 nt, Artificial Sequence
  Description of Artificial Sequence: Synthetic oligonucleotide
augauagcaccuaaacuuauu

SEQ ID NO: 21114 - RNA, 21 nt, Artificial Sequence
  Description of Artificial Sequence: Synthetic oligonucleotide
ugauagcaccuaaacuuaauu

SEQ ID NO: 21115 - RNA, 21 nt, Artificial Sequence
  Description of Artificial Sequence: Synthetic oligonucleotide
gauagcaccuaaacuuacauu

SEQ ID NO: 21116 - RNA, 21 nt, Artificial Sequence
  Description of Artificial Sequence: Synthetic oligonucleotide
auagcaccuaaacuuacaauu

SEQ ID NO: 21117 - RNA, 21 nt, Artificial Sequence
  Description of Artificial Sequence: Synthetic oligonucleotide
uagcaccuaaacuuacauauu

SEQ ID NO: 21118 - RNA, 21 nt, Artificial Sequence
  Description of Artificial Sequence: Synthetic oligonucleotide
agcaccuaaacuuacauuauu

SEQ ID NO: 21119 - RNA, 21 nt, Artificial Sequence
  Description of Artificial Sequence: Synthetic oligonucleotide
gcaccuaaacuuacauuuauu

SEQ ID NO: 21120 - RNA, 21 nt, Artificial Sequence
  Description of Artificial Sequence: Synthetic oligonucleotide
caccuaaacuuacauuuaauu

SEQ ID NO: 21121 - RNA, 21 nt, Artificial Sequence
  Description of Artificial Sequence: Synthetic oligonucleotide
accuaaacuuacauuuaaauu

SEQ ID NO: 21122 - RNA, 21 nt, Artificial Sequence
  Description of Artificial Sequence: Synthetic oligonucleotide
ccuaaacuuacauuuaaaauu

SEQ ID NO: 21123 - RNA, 21 nt, Artificial Sequence
  Description of Artificial Sequence: Synthetic oligonucleotide
cuaaacuuacauuuaaaaauu

SEQ ID NO: 21124 - RNA, 21 nt, Artificial Sequence
  Description of Artificial Sequence: Synthetic oligonucleotide
uaaacuuacauuuaaaagauu

SEQ ID NO: 21125 - RNA, 21 nt, Artificial Sequence
  Description of Artificial Sequence: Synthetic oligonucleotide
aaacuuacauuuaaaagaauu

SEQ ID NO: 21126 - RNA, 21 nt, Artificial Sequence
  Description of Artificial Sequence: Synthetic oligonucleotide
aacuuacauuuaaaagacauu

SEQ ID NO: 21127 - RNA, 21 nt, Artificial Sequence
  Description of Artificial Sequence: Synthetic oligonucleotide
acuuacauuuaaaagacaauu

SEQ ID NO: 21128 - RNA, 21 nt, Artificial Sequence
  Description of Artificial Sequence: Synthetic oligonucleotide
cuuacauuuaaaagacagauu

SEQ ID NO: 21129 - RNA, 21 nt, Artificial Sequence
  Description of Artificial Sequence: Synthetic oligonucleotide
uuacauuuaaaagacagaauu

SEQ ID NO: 21130 - RNA, 21 nt, Artificial Sequence
  Description of Artificial Sequence: Synthetic oligonucleotide
uacauuuaaaagacagacauu

SEQ ID NO: 21131 - RNA, 21 nt, Artificial Sequence
  Description of Artificial Sequence: Synthetic oligonucleotide
acauuuaaaagacagacaauu

SEQ ID NO: 21132 - RNA, 21 nt, Artificial Sequence
  Description of Artificial Sequence: Synthetic oligonucleotide
cauuuaaaagacagacauauu

SEQ ID NO: 21133 - RNA, 21 nt, Artificial Sequence
  Description of Artificial Sequence: Synthetic oligonucleotide
auuuaaaagacagacauuauu

SEQ ID NO: 21134 - RNA, 21 nt, Artificial Sequence
  Description of Artificial Sequence: Synthetic oligonucleotide
uuuaaaagacagacauucauu

SEQ ID NO: 21135 - RNA, 21 nt, Artificial Sequence
  Description of Artificial Sequence: Synthetic oligonucleotide
uuaaaagacagacauuccauu

SEQ ID NO: 21136 - RNA, 21 nt, Artificial Sequence
  Description of Artificial Sequence: Synthetic oligonucleotide
uaaaagacagacauuccuauu

SEQ ID NO: 21137 - RNA, 21 nt, Artificial Sequence
  Description of Artificial Sequence: Synthetic oligonucleotide
aaaagacagacauuccuuauu

SEQ ID NO: 21138 - RNA, 21 nt, Artificial Sequence
  Description of Artificial Sequence: Synthetic oligonucleotide
aaagacagacauuccuucauu

SEQ ID NO: 21139 - RNA, 21 nt, Artificial Sequence
  Description of Artificial Sequence: Synthetic oligonucleotide
aagacagacauuccuucuauu

SEQ ID NO: 21140 - RNA, 21 nt, Artificial Sequence
  Description of Artificial Sequence: Synthetic oligonucleotide
agacagacauuccuucuaauu

SEQ ID NO: 21141 - RNA, 21 nt, Artificial Sequence
  Description of Artificial Sequence: Synthetic oligonucleotide
gacagacauuccuucuacauu

SEQ ID NO: 21142 - RNA, 21 nt, Artificial Sequence
  Description of Artificial Sequence: Synthetic oligonucleotide
acagacauuccuucuacaauu

SEQ ID NO: 21143 - RNA, 21 nt, Artificial Sequence
  Description of Artificial Sequence: Synthetic oligonucleotide
cagacauuccuucuacauauu

SEQ ID NO: 21144 - RNA, 21 nt, Artificial Sequence
  Description of Artificial Sequence: Synthetic oligonucleotide
agacauuccuucuacaugauu

SEQ ID NO: 21145 - RNA, 21 nt, Artificial Sequence
  Description of Artificial Sequence: Synthetic oligonucleotide
gacauuccuucuacauguauu

SEQ ID NO: 21146 - RNA, 21 nt, Artificial Sequence
  Description of Artificial Sequence: Synthetic oligonucleotide
acauuccuucuacauguaauu

SEQ ID NO: 21147 - RNA, 21 nt, Artificial Sequence
  Description of Artificial Sequence: Synthetic oligonucleotide
cauuccuucuacauguaaauu

SEQ ID NO: 21148 - RNA, 21 nt, Artificial Sequence
  Description of Artificial Sequence: Synthetic oligonucleotide
auuccuucuacauguaauauu

SEQ ID NO: 21149 - RNA, 21 nt, Artificial Sequence
  Description of Artificial Sequence: Synthetic oligonucleotide
uuccuucuacauguaaugauu

SEQ ID NO: 21150 - RNA, 21 nt, Artificial Sequence
  Description of Artificial Sequence: Synthetic oligonucleotide
uccuucuacauguaaugaauu

SEQ ID NO: 21151 - RNA, 21 nt, Artificial Sequence
  Description of Artificial Sequence: Synthetic oligonucleotide
ccuucuacauguaaugacauu

SEQ ID NO: 21152 - RNA, 21 nt, Artificial Sequence
  Description of Artificial Sequence: Synthetic oligonucleotide
cuucuacauguaaugacaauu

SEQ ID NO: 21153 - RNA, 21 nt, Artificial Sequence
  Description of Artificial Sequence: Synthetic oligonucleotide
uucuacauguaaugacacauu

SEQ ID NO: 21154 - RNA, 21 nt, Artificial Sequence
  Description of Artificial Sequence: Synthetic oligonucleotide
ucuacauguaaugacacuauu

SEQ ID NO: 21155 - RNA, 21 nt, Artificial Sequence
  Description of Artificial Sequence: Synthetic oligonucleotide
cuacauguaaugacacuuauu

SEQ ID NO: 21156 - RNA, 21 nt, Artificial Sequence
  Description of Artificial Sequence: Synthetic oligonucleotide
uacauguaaugacacuucauu

SEQ ID NO: 21157 - RNA, 21 nt, Artificial Sequence
  Description of Artificial Sequence: Synthetic oligonucleotide
acauguaaugacacuucuauu

SEQ ID NO: 21158 - RNA, 21 nt, Artificial Sequence
  Description of Artificial Sequence: Synthetic oligonucleotide
cauguaaugacacuucuuauu

SEQ ID NO: 21159 - RNA, 21 nt, Artificial Sequence
  Description of Artificial Sequence: Synthetic oligonucleotide
auguaaugacacuucuugauu

SEQ ID NO: 21160 - RNA, 21 nt, Artificial Sequence
  Description of Artificial Sequence: Synthetic oligonucleotide
uguaaugacacuucuuguauu

SEQ ID NO: 21161 - RNA, 21 nt, Artificial Sequence
  Description of Artificial Sequence: Synthetic oligonucleotide
guaaugacacuucuugugauu

SEQ ID NO: 21162 - RNA, 21 nt, Artificial Sequence
  Description of Artificial Sequence: Synthetic oligonucleotide
uaaugacacuucuuguguauu

SEQ ID NO: 21163 - RNA, 21 nt, Artificial Sequence
  Description of Artificial Sequence: Synthetic oligonucleotide
aaugacacuucuuguguuauu

SEQ ID NO: 21164 - RNA, 21 nt, Artificial Sequence
  Description of Artificial Sequence: Synthetic oligonucleotide
augacacuucuuguguuaauu

SEQ ID NO: 21165 - RNA, 21 nt, Artificial Sequence
  Description of Artificial Sequence: Synthetic oligonucleotide
ugacacuucuuguguuaaauu

SEQ ID NO: 21166 - RNA, 21 nt, Artificial Sequence
  Description of Artificial Sequence: Synthetic oligonucleotide
gacacuucuuguguuaaaauu

SEQ ID NO: 21167 - RNA, 21 nt, Artificial Sequence
  Description of Artificial Sequence: Synthetic oligonucleotide
acacuucuuguguuaaacauu

SEQ ID NO: 21168 - RNA, 21 nt, Artificial Sequence
  Description of Artificial Sequence: Synthetic oligonucleotide
cacuucuuguguuaaacuauu

SEQ ID NO: 21169 - RNA, 21 nt, Artificial Sequence
  Description of Artificial Sequence: Synthetic oligonucleotide
acuucuuguguuaaacuaauu

SEQ ID NO: 21170 - RNA, 21 nt, Artificial Sequence
  Description of Artificial Sequence: Synthetic oligonucleotide
cuucuuguguuaaacuaaauu

SEQ ID NO: 21171 - RNA, 21 nt, Artificial Sequence
  Description of Artificial Sequence: Synthetic oligonucleotide
uucuuguguuaaacuaaaauu

SEQ ID NO: 21172 - RNA, 21 nt, Artificial Sequence
  Description of Artificial Sequence: Synthetic oligonucleotide
ucuuguguuaaacuaaaaauu

SEQ ID NO: 21173 - RNA, 21 nt, Artificial Sequence
  Description of Artificial Sequence: Synthetic oligonucleotide
cuuguguuaaacuaaaaaauu

SEQ ID NO: 21174 - RNA, 21 nt, Artificial Sequence
  Description of Artificial Sequence: Synthetic oligonucleotide
uuguguuaaacuaaaaauauu

SEQ ID NO: 21175 - RNA, 21 nt, Artificial Sequence
  Description of Artificial Sequence: Synthetic oligonucleotide
uguguuaaacuaaaaauuauu

SEQ ID NO: 21176 - RNA, 21 nt, Artificial Sequence
  Description of Artificial Sequence: Synthetic oligonucleotide
guguuaaacuaaaaauuuauu

SEQ ID NO: 21177 - RNA, 21 nt, Artificial Sequence
  Description of Artificial Sequence: Synthetic oligonucleotide
uguuaaacuaaaaauuuaauu

SEQ ID NO: 21178 - RNA, 21 nt, Artificial Sequence
  Description of Artificial Sequence: Synthetic oligonucleotide
guuaaacuaaaaauuuacauu

SEQ ID NO: 21179 - RNA, 21 nt, Artificial Sequence
  Description of Artificial Sequence: Synthetic oligonucleotide
uuaaacuaaaaauuuacaauu

SEQ ID NO: 21180 - RNA, 21 nt, Artificial Sequence
  Description of Artificial Sequence: Synthetic oligonucleotide
uaaacuaaaaauuuacaaauu

SEQ ID NO: 21181 - RNA, 21 nt, Artificial Sequence
  Description of Artificial Sequence: Synthetic oligonucleotide
aaacuaaaaauuuacaagauu

SEQ ID NO: 21182 - RNA, 21 nt, Artificial Sequence
  Description of Artificial Sequence: Synthetic oligonucleotide
aacuaaaaauuuacaagaauu

SEQ ID NO: 21183 - RNA, 21 nt, Artificial Sequence
  Description of Artificial Sequence: Synthetic oligonucleotide
acuaaaaauuuacaagagauu

SEQ ID NO: 21184 - RNA, 21 nt, Artificial Sequence
  Description of Artificial Sequence: Synthetic oligonucleotide
cuaaaaauuuacaagagaauu

SEQ ID NO: 21185 - RNA, 21 nt, Artificial Sequence
  Description of Artificial Sequence: Synthetic oligonucleotide
uaaaaauuuacaagagaaauu

SEQ ID NO: 21186 - RNA, 21 nt, Artificial Sequence
  Description of Artificial Sequence: Synthetic oligonucleotide
aaaaauuuacaagagaagauu

SEQ ID NO: 21187 - RNA, 21 nt, Artificial Sequence
  Description of Artificial Sequence: Synthetic oligonucleotide
aaaauuuacaagagaagaauu

SEQ ID NO: 21188 - RNA, 21 nt, Artificial Sequence
  Description of Artificial Sequence: Synthetic oligonucleotide
aaauuuacaagagaagaaauu

SEQ ID NO: 21189 - RNA, 21 nt, Artificial Sequence
  Description of Artificial Sequence: Synthetic oligonucleotide
aauuuacaagagaagaaaauu

SEQ ID NO: 21190 - RNA, 21 nt, Artificial Sequence
  Description of Artificial Sequence: Synthetic oligonucleotide
auuuacaagagaagaaagauu

SEQ ID NO: 21191 - RNA, 21 nt, Artificial Sequence
  Description of Artificial Sequence: Synthetic oligonucleotide
uuuacaagagaagaaaguauu

SEQ ID NO: 21192 - RNA, 21 nt, Artificial Sequence
  Description of Artificial Sequence: Synthetic oligonucleotide
uuacaagagaagaaagugauu

SEQ ID NO: 21193 - RNA, 21 nt, Artificial Sequence
  Description of Artificial Sequence: Synthetic oligonucleotide
uacaagagaagaaagugaauu

SEQ ID NO: 21194 - RNA, 21 nt, Artificial Sequence
  Description of Artificial Sequence: Synthetic oligonucleotide
acaagagaagaaagugaaauu

SEQ ID NO: 21195 - RNA, 21 nt, Artificial Sequence
  Description of Artificial Sequence: Synthetic oligonucleotide
caagagaagaaagugaaaauu

SEQ ID NO: 21196 - RNA, 21 nt, Artificial Sequence
  Description of Artificial Sequence: Synthetic oligonucleotide
aagagaagaaagugaaagauu

SEQ ID NO: 21197 - RNA, 21 nt, Artificial Sequence
  Description of Artificial Sequence: Synthetic oligonucleotide
agagaagaaagugaaagcauu

SEQ ID NO: 21198 - RNA, 21 nt, Artificial Sequence
  Description of Artificial Sequence: Synthetic oligonucleotide
gagaagaaagugaaagcaauu

SEQ ID NO: 21199 - RNA, 21 nt, Artificial Sequence
  Description of Artificial Sequence: Synthetic oligonucleotide
agaagaaagugaaagcaaauu

SEQ ID NO: 21200 - RNA, 21 nt, Artificial Sequence
  Description of Artificial Sequence: Synthetic oligonucleotide
gaagaaagugaaagcaaaauu

SEQ ID NO: 21201 - RNA, 21 nt, Artificial Sequence
  Description of Artificial Sequence: Synthetic oligonucleotide
aagaaagugaaagcaaauauu

SEQ ID NO: 21202 - RNA, 21 nt, Artificial Sequence
  Description of Artificial Sequence: Synthetic oligonucleotide
agaaagugaaagcaaaugauu

SEQ ID NO: 21203 - RNA, 21 nt, Artificial Sequence
  Description of Artificial Sequence: Synthetic oligonucleotide
gaaagugaaagcaaauggauu

SEQ ID NO: 21204 - RNA, 21 nt, Artificial Sequence
  Description of Artificial Sequence: Synthetic oligonucleotide
aaagugaaagcaaaugggauu

SEQ ID NO: 21205 - RNA, 21 nt, Artificial Sequence
  Description of Artificial Sequence: Synthetic oligonucleotide
aagugaaagcaaauggggauu

SEQ ID NO: 21206 - RNA, 21 nt, Artificial Sequence
  Description of Artificial Sequence: Synthetic oligonucleotide
agugaaagcaaaugggguauu

SEQ ID NO: 21207 - RNA, 21 nt, Artificial Sequence
  Description of Artificial Sequence: Synthetic oligonucleotide
gugaaagcaaaugggguuauu

SEQ ID NO: 21208 - RNA, 21 nt, Artificial Sequence
  Description of Artificial Sequence: Synthetic oligonucleotide
ugaaagcaaaugggguuuauu

SEQ ID NO: 21209 - RNA, 21 nt, Artificial Sequence
  Description of Artificial Sequence: Synthetic oligonucleotide
gaaagcaaaugggguuucauu

SEQ ID NO: 21210 - RNA, 21 nt, Artificial Sequence
  Description of Artificial Sequence: Synthetic oligonucleotide
aaagcaaaugggguuucaauu

SEQ ID NO: 21211 - RNA, 21 nt, Artificial Sequence
  Description of Artificial Sequence: Synthetic oligonucleotide
aagcaaaugggguuucacauu

SEQ ID NO: 21212 - RNA, 21 nt, Artificial Sequence
  Description of Artificial Sequence: Synthetic oligonucleotide
agcaaaugggguuucacaauu

SEQ ID NO: 21213 - RNA, 21 nt, Artificial Sequence
  Description of Artificial Sequence: Synthetic oligonucleotide
gcaaaugggguuucacaaauu

SEQ ID NO: 21214 - RNA, 21 nt, Artificial Sequence
  Description of Artificial Sequence: Synthetic oligonucleotide
caaaugggguuucacaaaauu

SEQ ID NO: 21215 - RNA, 21 nt, Artificial Sequence
  Description of Artificial Sequence: Synthetic oligonucleotide
aaaugggguuucacaaauauu

SEQ ID NO: 21216 - RNA, 21 nt, Artificial Sequence
  Description of Artificial Sequence: Synthetic oligonucleotide
aaugggguuucacaaauaauu

SEQ ID NO: 21217 - RNA, 21 nt, Artificial Sequence
  Description of Artificial Sequence: Synthetic oligonucleotide
augggguuucacaaauagauu

SEQ ID NO: 21218 - RNA, 21 nt, Artificial Sequence
  Description of Artificial Sequence: Synthetic oligonucleotide
ugggguuucacaaauaguauu

SEQ ID NO: 21219 - RNA, 21 nt, Artificial Sequence
  Description of Artificial Sequence: Synthetic oligonucleotide
gggguuucacaaauaguuauu

SEQ ID NO: 21220 - RNA, 21 nt, Artificial Sequence
  Description of Artificial Sequence: Synthetic oligonucleotide
ggguuucacaaauaguugauu

SEQ ID NO: 21221 - RNA, 21 nt, Artificial Sequence
  Description of Artificial Sequence: Synthetic oligonucleotide
gguuucacaaauaguuguauu

SEQ ID NO: 21222 - RNA, 21 nt, Artificial Sequence
  Description of Artificial Sequence: Synthetic oligonucleotide
guuucacaaauaguuguaauu

SEQ ID NO: 21223 - RNA, 21 nt, Artificial Sequence
  Description of Artificial Sequence: Synthetic oligonucleotide
uuucacaaauaguuguaaauu

SEQ ID NO: 21224 - RNA, 21 nt, Artificial Sequence
  Description of Artificial Sequence: Synthetic oligonucleotide
uucacaaauaguuguaaaauu

SEQ ID NO: 21225 - RNA, 21 nt, Artificial Sequence
  Description of Artificial Sequence: Synthetic oligonucleotide
ucacaaauaguuguaaauauu

SEQ ID NO: 21226 - RNA, 21 nt, Artificial Sequence
  Description of Artificial Sequence: Synthetic oligonucleotide
cacaaauaguuguaaauaauu

SEQ ID NO: 21227 - RNA, 21 nt, Artificial Sequence
  Description of Artificial Sequence: Synthetic oligonucleotide
acaaauaguuguaaauauauu

SEQ ID NO: 21228 - RNA, 21 nt, Artificial Sequence
  Description of Artificial Sequence: Synthetic oligonucleotide
caaauaguuguaaauauaauu

SEQ ID NO: 21229 - RNA, 21 nt, Artificial Sequence
  Description of Artificial Sequence: Synthetic oligonucleotide
aaauaguuguaaauauagauu

SEQ ID NO: 21230 - RNA, 21 nt, Artificial Sequence
  Description of Artificial Sequence: Synthetic oligonucleotide
aauaguuguaaauauaguauu

SEQ ID NO: 21231 - RNA, 21 nt, Artificial Sequence
  Description of Artificial Sequence: Synthetic oligonucleotide
auaguuguaaauauagugauu

SEQ ID NO: 21232 - RNA, 21 nt, Artificial Sequence
  Description of Artificial Sequence: Synthetic oligonucleotide
uaguuguaaauauagugaauu

SEQ ID NO: 21233 - RNA, 21 nt, Artificial Sequence
  Description of Artificial Sequence: Synthetic oligonucleotide
aguuguaaauauagugaaauu

SEQ ID NO: 21234 - RNA, 21 nt, Artificial Sequence
  Description of Artificial Sequence: Synthetic oligonucleotide
guuguaaauauagugaagauu

SEQ ID NO: 21235 - RNA, 21 nt, Artificial Sequence
  Description of Artificial Sequence: Synthetic oligonucleotide
uuguaaauauagugaagcauu

SEQ ID NO: 21236 - RNA, 21 nt, Artificial Sequence
  Description of Artificial Sequence: Synthetic oligonucleotide
uguaaauauagugaagcaauu

SEQ ID NO: 21237 - RNA, 21 nt, Artificial Sequence
  Description of Artificial Sequence: Synthetic oligonucleotide
guaaauauagugaagcaaauu

SEQ ID NO: 21238 - RNA, 21 nt, Artificial Sequence
  Description of Artificial Sequence: Synthetic oligonucleotide
uaaauauagugaagcaauauu

SEQ ID NO: 21239 - RNA, 21 nt, Artificial Sequence
  Description of Artificial Sequence: Synthetic oligonucleotide
aaauauagugaagcaauuauu

SEQ ID NO: 21240 - RNA, 21 nt, Artificial Sequence
  Description of Artificial Sequence: Synthetic oligonucleotide
aauauagugaagcaauuuauu

SEQ ID NO: 21241 - RNA, 21 nt, Artificial Sequence
  Description of Artificial Sequence: Synthetic oligonucleotide
auauagugaagcaauuugauu

SEQ ID NO: 21242 - RNA, 21 nt, Artificial Sequence
  Description of Artificial Sequence: Synthetic oligonucleotide
uauagugaagcaauuugaauu

SEQ ID NO: 21243 - RNA, 21 nt, Artificial Sequence
  Description of Artificial Sequence: Synthetic oligonucleotide
auagugaagcaauuugaaauu

SEQ ID NO: 21244 - RNA, 21 nt, Artificial Sequence
  Description of Artificial Sequence: Synthetic oligonucleotide
uagugaagcaauuugaaaauu

SEQ ID NO: 21245 - RNA, 21 nt, Artificial Sequence
  Description of Artificial Sequence: Synthetic oligonucleotide
agugaagcaauuugaaauauu

SEQ ID NO: 21246 - RNA, 21 nt, Artificial Sequence
  Description of Artificial Sequence: Synthetic oligonucleotide
gugaagcaauuugaaauaauu

SEQ ID NO: 21247 - RNA, 21 nt, Artificial Sequence
  Description of Artificial Sequence: Synthetic oligonucleotide
ugaagcaauuugaaauaaauu

SEQ ID NO: 21248 - RNA, 21 nt, Artificial Sequence
  Description of Artificial Sequence: Synthetic oligonucleotide
gaagcaauuugaaauaauauu

SEQ ID NO: 21249 - RNA, 21 nt, Artificial Sequence
  Description of Artificial Sequence: Synthetic oligonucleotide
aagcaauuugaaauaauuauu

SEQ ID NO: 21250 - RNA, 21 nt, Artificial Sequence
  Description of Artificial Sequence: Synthetic oligonucleotide
agcaauuugaaauaauuuauu

SEQ ID NO: 21251 - RNA, 21 nt, Artificial Sequence
  Description of Artificial Sequence: Synthetic oligonucleotide
gcaauuugaaauaauuuuauu

SEQ ID NO: 21252 - RNA, 21 nt, Artificial Sequence
  Description of Artificial Sequence: Synthetic oligonucleotide
caauuugaaauaauuuucauu

SEQ ID NO: 21253 - RNA, 21 nt, Artificial Sequence
  Description of Artificial Sequence: Synthetic oligonucleotide
aauuugaaauaauuuucaauu

SEQ ID NO: 21254 - RNA, 21 nt, Artificial Sequence
  Description of Artificial Sequence: Synthetic oligonucleotide
auuugaaauaauuuucaaauu

SEQ ID NO: 21255 - RNA, 21 nt, Artificial Sequence
  Description of Artificial Sequence: Synthetic oligonucleotide
uuugaaauaauuuucaagauu

SEQ ID NO: 21256 - RNA, 21 nt, Artificial Sequence
  Description of Artificial Sequence: Synthetic oligonucleotide
uugaaauaauuuucaagcauu

SEQ ID NO: 21257 - RNA, 21 nt, Artificial Sequence
  Description of Artificial Sequence: Synthetic oligonucleotide
ugaaauaauuuucaagcaauu

SEQ ID NO: 21258 - RNA, 21 nt, Artificial Sequence
  Description of Artificial Sequence: Synthetic oligonucleotide
gaaauaauuuucaagcaaauu

SEQ ID NO: 21259 - RNA, 21 nt, Artificial Sequence
  Description of Artificial Sequence: Synthetic oligonucleotide
aaauaauuuucaagcaaaauu

SEQ ID NO: 21260 - RNA, 21 nt, Artificial Sequence
  Description of Artificial Sequence: Synthetic oligonucleotide
aauaauuuucaagcaaagauu

SEQ ID NO: 21261 - RNA, 21 nt, Artificial Sequence
  Description of Artificial Sequence: Synthetic oligonucleotide
auaauuuucaagcaaaguauu

SEQ ID NO: 21262 - RNA, 21 nt, Artificial Sequence
  Description of Artificial Sequence: Synthetic oligonucleotide
uaauuuucaagcaaaguaauu

SEQ ID NO: 21263 - RNA, 21 nt, Artificial Sequence
  Description of Artificial Sequence: Synthetic oligonucleotide
aauuuucaagcaaaguauauu

SEQ ID NO: 21264 - RNA, 21 nt, Artificial Sequence
  Description of Artificial Sequence: Synthetic oligonucleotide
auuuucaagcaaaguauuauu

SEQ ID NO: 21265 - RNA, 21 nt, Artificial Sequence
  Description of Artificial Sequence: Synthetic oligonucleotide
uuuucaagcaaaguauugauu

SEQ ID NO: 21266 - RNA, 21 nt, Artificial Sequence
  Description of Artificial Sequence: Synthetic oligonucleotide
uuucaagcaaaguauuguauu

SEQ ID NO: 21267 - RNA, 21 nt, Artificial Sequence
  Description of Artificial Sequence: Synthetic oligonucleotide
uucaagcaaaguauugugauu

SEQ ID NO: 21268 - RNA, 21 nt, Artificial Sequence
  Description of Artificial Sequence: Synthetic oligonucleotide
ucaagcaaaguauugugaauu

SEQ ID NO: 21269 - RNA, 21 nt, Artificial Sequence
  Description of Artificial Sequence: Synthetic oligonucleotide
caagcaaaguauugugaaauu

SEQ ID NO: 21270 - RNA, 21 nt, Artificial Sequence
  Description of Artificial Sequence: Synthetic oligonucleotide
aagcaaaguauugugaaaauu

SEQ ID NO: 21271 - RNA, 21 nt, Artificial Sequence
  Description of Artificial Sequence: Synthetic oligonucleotide
agcaaaguauugugaaagauu

SEQ ID NO: 21272 - RNA, 21 nt, Artificial Sequence
  Description of Artificial Sequence: Synthetic oligonucleotide
gcaaaguauugugaaaguauu

SEQ ID NO: 21273 - RNA, 21 nt, Artificial Sequence
  Description of Artificial Sequence: Synthetic oligonucleotide
caaaguauugugaaaguaauu

SEQ ID NO: 21274 - RNA, 21 nt, Artificial Sequence
  Description of Artificial Sequence: Synthetic oligonucleotide
aaaguauugugaaaguauauu

SEQ ID NO: 21275 - RNA, 21 nt, Artificial Sequence
  Description of Artificial Sequence: Synthetic oligonucleotide
aaguauugugaaaguauuauu

SEQ ID NO: 21276 - RNA, 21 nt, Artificial Sequence
  Description of Artificial Sequence: Synthetic oligonucleotide
aguauugugaaaguauucauu

SEQ ID NO: 21277 - RNA, 21 nt, Artificial Sequence
  Description of Artificial Sequence: Synthetic oligonucleotide
guauugugaaaguauucuauu

SEQ ID NO: 21278 - RNA, 21 nt, Artificial Sequence
  Description of Artificial Sequence: Synthetic oligonucleotide
uauugugaaaguauucuaauu

SEQ ID NO: 21279 - RNA, 21 nt, Artificial Sequence
  Description of Artificial Sequence: Synthetic oligonucleotide
auugugaaaguauucuaaauu

SEQ ID NO: 21280 - RNA, 21 nt, Artificial Sequence
  Description of Artificial Sequence: Synthetic oligonucleotide
uugugaaaguauucuaagauu

SEQ ID NO: 21281 - RNA, 21 nt, Artificial Sequence
  Description of Artificial Sequence: Synthetic oligonucleotide
ugugaaaguauucuaagcauu

SEQ ID NO: 21282 - RNA, 21 nt, Artificial Sequence
  Description of Artificial Sequence: Synthetic oligonucleotide
gugaaaguauucuaagccauu

SEQ ID NO: 21283 - RNA, 21 nt, Artificial Sequence
  Description of Artificial Sequence: Synthetic oligonucleotide
ugaaaguauucuaagccaauu

SEQ ID NO: 21284 - RNA, 21 nt, Artificial Sequence
  Description of Artificial Sequence: Synthetic oligonucleotide
gaaaguauucuaagccaaauu

SEQ ID NO: 21285 - RNA, 21 nt, Artificial Sequence
  Description of Artificial Sequence: Synthetic oligonucleotide
aaaguauucuaagccaagauu

SEQ ID NO: 21286 - RNA, 21 nt, Artificial Sequence
  Description of Artificial Sequence: Synthetic oligonucleotide
aaguauucuaagccaaguauu

SEQ ID NO: 21287 - RNA, 21 nt, Artificial Sequence
  Description of Artificial Sequence: Synthetic oligonucleotide
aguauucuaagccaaguuauu

SEQ ID NO: 21288 - RNA, 21 nt, Artificial Sequence
  Description of Artificial Sequence: Synthetic oligonucleotide
guauucuaagccaaguuuauu

SEQ ID NO: 21289 - RNA, 21 nt, Artificial Sequence
  Description of Artificial Sequence: Synthetic oligonucleotide
uauucuaagccaaguuuuauu

SEQ ID NO: 21290 - RNA, 21 nt, Artificial Sequence
  Description of Artificial Sequence: Synthetic oligonucleotide
auucuaagccaaguuuuaauu

SEQ ID NO: 21291 - RNA, 21 nt, Artificial Sequence
  Description of Artificial Sequence: Synthetic oligonucleotide
uucuaagccaaguuuuaaauu

SEQ ID NO: 21292 - RNA, 21 nt, Artificial Sequence
  Description of Artificial Sequence: Synthetic oligonucleotide
ucuaagccaaguuuuaaaauu

SEQ ID NO: 21293 - RNA, 21 nt, Artificial Sequence
  Description of Artificial Sequence: Synthetic oligonucleotide
cuaagccaaguuuuaaauauu

SEQ ID NO: 21294 - RNA, 21 nt, Artificial Sequence
  Description of Artificial Sequence: Synthetic oligonucleotide
uaagccaaguuuuaaauaauu

SEQ ID NO: 21295 - RNA, 21 nt, Artificial Sequence
  Description of Artificial Sequence: Synthetic oligonucleotide
aagccaaguuuuaaauauauu

SEQ ID NO: 21296 - RNA, 21 nt, Artificial Sequence
  Description of Artificial Sequence: Synthetic oligonucleotide
agccaaguuuuaaauauuauu

SEQ ID NO: 21297 - RNA, 21 nt, Artificial Sequence
  Description of Artificial Sequence: Synthetic oligonucleotide
gccaaguuuuaaauauuaauu

SEQ ID NO: 21298 - RNA, 21 nt, Artificial Sequence
  Description of Artificial Sequence: Synthetic oligonucleotide
ccaaguuuuaaauauuauauu

SEQ ID NO: 21299 - RNA, 21 nt, Artificial Sequence
  Description of Artificial Sequence: Synthetic oligonucleotide
caaguuuuaaauauuaucauu

SEQ ID NO: 21300 - RNA, 21 nt, Artificial Sequence
  Description of Artificial Sequence: Synthetic oligonucleotide
aaguuuuaaauauuaucuauu

SEQ ID NO: 21301 - RNA, 21 nt, Artificial Sequence
  Description of Artificial Sequence: Synthetic oligonucleotide
aguuuuaaauauuaucuaauu

SEQ ID NO: 21302 - RNA, 21 nt, Artificial Sequence
  Description of Artificial Sequence: Synthetic oligonucleotide
guuuuaaauauuaucuaaauu

SEQ ID NO: 21303 - RNA, 21 nt, Artificial Sequence
  Description of Artificial Sequence: Synthetic oligonucleotide
uuuuaaauauuaucuaacauu

SEQ ID NO: 21304 - RNA, 21 nt, Artificial Sequence
  Description of Artificial Sequence: Synthetic oligonucleotide
uuuaaauauuaucuaacaauu

SEQ ID NO: 21305 - RNA, 21 nt, Artificial Sequence
  Description of Artificial Sequence: Synthetic oligonucleotide
uuaaauauuaucuaacagauu

SEQ ID NO: 21306 - RNA, 21 nt, Artificial Sequence
  Description of Artificial Sequence: Synthetic oligonucleotide
uaaauauuaucuaacagaauu

SEQ ID NO: 21307 - RNA, 21 nt, Artificial Sequence
  Description of Artificial Sequence: Synthetic oligonucleotide
aaauauuaucuaacagacauu

SEQ ID NO: 21308 - RNA, 21 nt, Artificial Sequence
  Description of Artificial Sequence: Synthetic oligonucleotide
aauauuaucuaacagacaauu

SEQ ID NO: 21309 - RNA, 21 nt, Artificial Sequence
  Description of Artificial Sequence: Synthetic oligonucleotide
auauuaucuaacagacaaauu

SEQ ID NO: 21310 - RNA, 21 nt, Artificial Sequence
  Description of Artificial Sequence: Synthetic oligonucleotide
uauuaucuaacagacaagauu

SEQ ID NO: 21311 - RNA, 21 nt, Artificial Sequence
  Description of Artificial Sequence: Synthetic oligonucleotide
auuaucuaacagacaagaauu

SEQ ID NO: 21312 - RNA, 21 nt, Artificial Sequence
  Description of Artificial Sequence: Synthetic oligonucleotide
uuaucuaacagacaagagauu

SEQ ID NO: 21313 - RNA, 21 nt, Artificial Sequence
  Description of Artificial Sequence: Synthetic oligonucleotide
uaucuaacagacaagaguauu

SEQ ID NO: 21314 - RNA, 21 nt, Artificial Sequence
  Description of Artificial Sequence: Synthetic oligonucleotide
aucuaacagacaagagugauu

SEQ ID NO: 21315 - RNA, 21 nt, Artificial Sequence
  Description of Artificial Sequence: Synthetic oligonucleotide
ucuaacagacaagaguggauu

SEQ ID NO: 21316 - RNA, 21 nt, Artificial Sequence
  Description of Artificial Sequence: Synthetic oligonucleotide
cuaacagacaagagugguauu

SEQ ID NO: 21317 - RNA, 21 nt, Artificial Sequence
  Description of Artificial Sequence: Synthetic oligonucleotide
uaacagacaagagugguaauu

SEQ ID NO: 21318 - RNA, 21 nt, Artificial Sequence
  Description of Artificial Sequence: Synthetic oligonucleotide
aacagacaagagugguauauu

SEQ ID NO: 21319 - RNA, 21 nt, Artificial Sequence
  Description of Artificial Sequence: Synthetic oligonucleotide
acagacaagagugguauaauu

SEQ ID NO: 21320 - RNA, 21 nt, Artificial Sequence
  Description of Artificial Sequence: Synthetic oligonucleotide
cagacaagagugguauauauu

SEQ ID NO: 21321 - RNA, 21 nt, Artificial Sequence
  Description of Artificial Sequence: Synthetic oligonucleotide
agacaagagugguauauaauu

SEQ ID NO: 21322 - RNA, 21 nt, Artificial Sequence
  Description of Artificial Sequence: Synthetic oligonucleotide
gacaagagugguauauacauu

SEQ ID NO: 21323 - RNA, 21 nt, Artificial Sequence
  Description of Artificial Sequence: Synthetic oligonucleotide
acaagagugguauauacaauu

SEQ ID NO: 21324 - RNA, 21 nt, Artificial Sequence
  Description of Artificial Sequence: Synthetic oligonucleotide
caagagugguauauacaaauu

SEQ ID NO: 21325 - RNA, 21 nt, Artificial Sequence
  Description of Artificial Sequence: Synthetic oligonucleotide
aagagugguauauacaagauu

SEQ ID NO: 21326 - RNA, 21 nt, Artificial Sequence
  Description of Artificial Sequence: Synthetic oligonucleotide
agagugguauauacaaguauu

SEQ ID NO: 21327 - RNA, 21 nt, Artificial Sequence
  Description of Artificial Sequence: Synthetic oligonucleotide
gagugguauauacaaguaauu

SEQ ID NO: 21328 - RNA, 21 nt, Artificial Sequence
  Description of Artificial Sequence: Synthetic oligonucleotide
agugguauauacaaguagauu

SEQ ID NO: 21329 - RNA, 21 nt, Artificial Sequence
  Description of Artificial Sequence: Synthetic oligonucleotide
gugguauauacaaguagaauu

SEQ ID NO: 21330 - RNA, 21 nt, Artificial Sequence
  Description of Artificial Sequence: Synthetic oligonucleotide
ugguauauacaaguagauauu

SEQ ID NO: 21331 - RNA, 21 nt, Artificial Sequence
  Description of Artificial Sequence: Synthetic oligonucleotide
gguauauacaaguagaucauu

SEQ ID NO: 21332 - RNA, 21 nt, Artificial Sequence
  Description of Artificial Sequence: Synthetic oligonucleotide
guauauacaaguagauccauu

SEQ ID NO: 21333 - RNA, 21 nt, Artificial Sequence
  Description of Artificial Sequence: Synthetic oligonucleotide
uauauacaaguagauccuauu

SEQ ID NO: 21334 - RNA, 21 nt, Artificial Sequence
  Description of Artificial Sequence: Synthetic oligonucleotide
auauacaaguagauccugauu

SEQ ID NO: 21335 - RNA, 21 nt, Artificial Sequence
  Description of Artificial Sequence: Synthetic oligonucleotide
uauacaaguagauccugaauu

SEQ ID NO: 21336 - RNA, 21 nt, Artificial Sequence
  Description of Artificial Sequence: Synthetic oligonucleotide
auacaaguagauccugagauu

SEQ ID NO: 21337 - RNA, 21 nt, Artificial Sequence
  Description of Artificial Sequence: Synthetic oligonucleotide
uacaaguagauccugagaauu

SEQ ID NO: 21338 - RNA, 21 nt, Artificial Sequence
  Description of Artificial Sequence: Synthetic oligonucleotide
acaaguagauccugagaaauu

SEQ ID NO: 21339 - RNA, 21 nt, Artificial Sequence
  Description of Artificial Sequence: Synthetic oligonucleotide
caaguagauccugagaagauu

SEQ ID NO: 21340 - RNA, 21 nt, Artificial Sequence
  Description of Artificial Sequence: Synthetic oligonucleotide
aaguagauccugagaaguauu

SEQ ID NO: 21341 - RNA, 21 nt, Artificial Sequence
  Description of Artificial Sequence: Synthetic oligonucleotide
aguagauccugagaaguaauu

SEQ ID NO: 21342 - RNA, 21 nt, Artificial Sequence
  Description of Artificial Sequence: Synthetic oligonucleotide
guagauccugagaaguacauu

SEQ ID NO: 21343 - RNA, 21 nt, Artificial Sequence
  Description of Artificial Sequence: Synthetic oligonucleotide
uagauccugagaaguaccauu

SEQ ID NO: 21344 - RNA, 21 nt, Artificial Sequence
  Description of Artificial Sequence: Synthetic oligonucleotide
agauccugagaaguaccuauu

SEQ ID NO: 21345 - RNA, 21 nt, Artificial Sequence
  Description of Artificial Sequence: Synthetic oligonucleotide
gauccugagaaguaccuuauu

SEQ ID NO: 21346 - RNA, 21 nt, Artificial Sequence
  Description of Artificial Sequence: Synthetic oligonucleotide
auccugagaaguaccuuuauu

SEQ ID NO: 21347 - RNA, 21 nt, Artificial Sequence
  Description of Artificial Sequence: Synthetic oligonucleotide
uccugagaaguaccuuugauu

SEQ ID NO: 21348 - RNA, 21 nt, Artificial Sequence
  Description of Artificial Sequence: Synthetic oligonucleotide
ccugagaaguaccuuuguauu

SEQ ID NO: 21349 - RNA, 21 nt, Artificial Sequence
  Description of Artificial Sequence: Synthetic oligonucleotide
cugagaaguaccuuuguuauu

SEQ ID NO: 21350 - RNA, 21 nt, Artificial Sequence
  Description of Artificial Sequence: Synthetic oligonucleotide
ugagaaguaccuuuguuaauu

SEQ ID NO: 21351 - RNA, 21 nt, Artificial Sequence
  Description of Artificial Sequence: Synthetic oligonucleotide
gagaaguaccuuuguuacauu

SEQ ID NO: 21352 - RNA, 21 nt, Artificial Sequence
  Description of Artificial Sequence: Synthetic oligonucleotide
agaaguaccuuuguuacaauu

SEQ ID NO: 21353 - RNA, 21 nt, Artificial Sequence
  Description of Artificial Sequence: Synthetic oligonucleotide
gaaguaccuuuguuacagauu

SEQ ID NO: 21354 - RNA, 21 nt, Artificial Sequence
  Description of Artificial Sequence: Synthetic oligonucleotide
aaguaccuuuguuacagcauu

SEQ ID NO: 21355 - RNA, 21 nt, Artificial Sequence
  Description of Artificial Sequence: Synthetic oligonucleotide
aguaccuuuguuacagcuauu

SEQ ID NO: 21356 - RNA, 21 nt, Artificial Sequence
  Description of Artificial Sequence: Synthetic oligonucleotide
guaccuuuguuacagcuaauu

SEQ ID NO: 21357 - RNA, 21 nt, Artificial Sequence
  Description of Artificial Sequence: Synthetic oligonucleotide
uaccuuuguuacagcuacauu

SEQ ID NO: 21358 - RNA, 21 nt, Artificial Sequence
  Description of Artificial Sequence: Synthetic oligonucleotide
accuuuguuacagcuacuauu

SEQ ID NO: 21359 - RNA, 21 nt, Artificial Sequence
  Description of Artificial Sequence: Synthetic oligonucleotide
ccuuuguuacagcuacuaauu

SEQ ID NO: 21360 - RNA, 21 nt, Artificial Sequence
  Description of Artificial Sequence: Synthetic oligonucleotide
cuuuguuacagcuacuauauu

SEQ ID NO: 21361 - RNA, 21 nt, Artificial Sequence
  Description of Artificial Sequence: Synthetic oligonucleotide
uuuguuacagcuacuauaauu

SEQ ID NO: 21362 - RNA, 21 nt, Artificial Sequence
  Description of Artificial Sequence: Synthetic oligonucleotide
uuguuacagcuacuauaaauu

SEQ ID NO: 21363 - RNA, 21 nt, Artificial Sequence
  Description of Artificial Sequence: Synthetic oligonucleotide
uguuacagcuacuauaaaauu

SEQ ID NO: 21364 - RNA, 21 nt, Artificial Sequence
  Description of Artificial Sequence: Synthetic oligonucleotide
guuacagcuacuauaaauauu

SEQ ID NO: 21365 - RNA, 21 nt, Artificial Sequence
  Description of Artificial Sequence: Synthetic oligonucleotide
uuacagcuacuauaaauaauu

SEQ ID NO: 21366 - RNA, 21 nt, Artificial Sequence
  Description of Artificial Sequence: Synthetic oligonucleotide
uacagcuacuauaaauauauu

SEQ ID NO: 21367 - RNA, 21 nt, Artificial Sequence
  Description of Artificial Sequence: Synthetic oligonucleotide
acagcuacuauaaauauaauu

SEQ ID NO: 21368 - RNA, 21 nt, Artificial Sequence
  Description of Artificial Sequence: Synthetic oligonucleotide
cagcuacuauaaauauacauu

SEQ ID NO: 21369 - RNA, 21 nt, Artificial Sequence
  Description of Artificial Sequence: Synthetic oligonucleotide
agcuacuauaaauauacaauu

SEQ ID NO: 21370 - RNA, 21 nt, Artificial Sequence
  Description of Artificial Sequence: Synthetic oligonucleotide
gcuacuauaaauauacauauu

SEQ ID NO: 21371 - RNA, 21 nt, Artificial Sequence
  Description of Artificial Sequence: Synthetic oligonucleotide
cuacuauaaauauacauaauu

SEQ ID NO: 21372 - RNA, 21 nt, Artificial Sequence
  Description of Artificial Sequence: Synthetic oligonucleotide
uacuauaaauauacauauauu

SEQ ID NO: 21373 - RNA, 21 nt, Artificial Sequence
  Description of Artificial Sequence: Synthetic oligonucleotide
acuauaaauauacauauaauu

SEQ ID NO: 21374 - RNA, 21 nt, Artificial Sequence
  Description of Artificial Sequence: Synthetic oligonucleotide
cuauaaauauacauauaaauu

SEQ ID NO: 21375 - RNA, 21 nt, Artificial Sequence
  Description of Artificial Sequence: Synthetic oligonucleotide
uauaaauauacauauaaaauu

SEQ ID NO: 21376 - RNA, 21 nt, Artificial Sequence
  Description of Artificial Sequence: Synthetic oligonucleotide
auaaauauacauauaaauauu

SEQ ID NO: 21377 - RNA, 21 nt, Artificial Sequence
  Description of Artificial Sequence: Synthetic oligonucleotide
uaaauauacauauaaauuauu

SEQ ID NO: 21378 - RNA, 21 nt, Artificial Sequence
  Description of Artificial Sequence: Synthetic oligonucleotide
aaauauacauauaaauuaauu

SEQ ID NO: 21379 - RNA, 21 nt, Artificial Sequence
  Description of Artificial Sequence: Synthetic oligonucleotide
aauauacauauaaauuauauu

SEQ ID NO: 21380 - RNA, 21 nt, Artificial Sequence
  Description of Artificial Sequence: Synthetic oligonucleotide
auauacauauaaauuauaauu

SEQ ID NO: 21381 - RNA, 21 nt, Artificial Sequence
  Description of Artificial Sequence: Synthetic oligonucleotide
uauacauauaaauuauagauu

SEQ ID NO: 21382 - RNA, 21 nt, Artificial Sequence
  Description of Artificial Sequence: Synthetic oligonucleotide
auacauauaaauuauagaauu

SEQ ID NO: 21383 - RNA, 21 nt, Artificial Sequence
  Description of Artificial Sequence: Synthetic oligonucleotide
uacauauaaauuauagaaauu

SEQ ID NO: 21384 - RNA, 21 nt, Artificial Sequence
  Description of Artificial Sequence: Synthetic oligonucleotide
acauauaaauuauagaauauu

SEQ ID NO: 21385 - RNA, 21 nt, Artificial Sequence
  Description of Artificial Sequence: Synthetic oligonucleotide
cauauaaauuauagaaucauu

SEQ ID NO: 21386 - RNA, 21 nt, Artificial Sequence
  Description of Artificial Sequence: Synthetic oligonucleotide
auauaaauuauagaaucuauu

SEQ ID NO: 21387 - RNA, 21 nt, Artificial Sequence
  Description of Artificial Sequence: Synthetic oligonucleotide
uauaaauuauagaaucuaauu

SEQ ID NO: 21388 - RNA, 21 nt, Artificial Sequence
  Description of Artificial Sequence: Synthetic oligonucleotide
auaaauuauagaaucuacauu

SEQ ID NO: 21389 - RNA, 21 nt, Artificial Sequence
  Description of Artificial Sequence: Synthetic oligonucleotide
uaaauuauagaaucuacuauu

SEQ ID NO: 21390 - RNA, 21 nt, Artificial Sequence
  Description of Artificial Sequence: Synthetic oligonucleotide
aaauuauagaaucuacuuauu

SEQ ID NO: 21391 - RNA, 21 nt, Artificial Sequence
  Description of Artificial Sequence: Synthetic oligonucleotide
aauuauagaaucuacuuuauu

SEQ ID NO: 21392 - RNA, 21 nt, Artificial Sequence
  Description of Artificial Sequence: Synthetic oligonucleotide
auuauagaaucuacuuuaauu

SEQ ID NO: 21393 - RNA, 21 nt, Artificial Sequence
  Description of Artificial Sequence: Synthetic oligonucleotide
uuauagaaucuacuuuaaauu

SEQ ID NO: 21394 - RNA, 21 nt, Artificial Sequence
  Description of Artificial Sequence: Synthetic oligonucleotide
uauagaaucuacuuuaauauu

SEQ ID NO: 21395 - RNA, 21 nt, Artificial Sequence
  Description of Artificial Sequence: Synthetic oligonucleotide
auagaaucuacuuuaauuauu

SEQ ID NO: 21396 - RNA, 21 nt, Artificial Sequence
  Description of Artificial Sequence: Synthetic oligonucleotide
uagaaucuacuuuaauuuauu

SEQ ID NO: 21397 - RNA, 21 nt, Artificial Sequence
  Description of Artificial Sequence: Synthetic oligonucleotide
agaaucuacuuuaauuuaauu

SEQ ID NO: 21398 - RNA, 21 nt, Artificial Sequence
  Description of Artificial Sequence: Synthetic oligonucleotide
gaaucuacuuuaauuuauauu

SEQ ID NO: 21399 - RNA, 21 nt, Artificial Sequence
  Description of Artificial Sequence: Synthetic oligonucleotide
aaucuacuuuaauuuauuauu

SEQ ID NO: 21400 - RNA, 21 nt, Artificial Sequence
  Description of Artificial Sequence: Synthetic oligonucleotide
aucuacuuuaauuuauuuauu

SEQ ID NO: 21401 - RNA, 21 nt, Artificial Sequence
  Description of Artificial Sequence: Synthetic oligonucleotide
ucuacuuuaauuuauuuuauu

SEQ ID NO: 21402 - RNA, 21 nt, Artificial Sequence
  Description of Artificial Sequence: Synthetic oligonucleotide
cuacuuuaauuuauuuugauu

SEQ ID NO: 21403 - RNA, 21 nt, Artificial Sequence
  Description of Artificial Sequence: Synthetic oligonucleotide
uacuuuaauuuauuuuguauu

SEQ ID NO: 21404 - RNA, 21 nt, Artificial Sequence
  Description of Artificial Sequence: Synthetic oligonucleotide
acuuuaauuuauuuugugauu

SEQ ID NO: 21405 - RNA, 21 nt, Artificial Sequence
  Description of Artificial Sequence: Synthetic oligonucleotide
cuuuaauuuauuuugugaauu

SEQ ID NO: 21406 - RNA, 21 nt, Artificial Sequence
  Description of Artificial Sequence: Synthetic oligonucleotide
uuuaauuuauuuugugaaauu

SEQ ID NO: 21407 - RNA, 21 nt, Artificial Sequence
  Description of Artificial Sequence: Synthetic oligonucleotide
uuaauuuauuuugugaacauu

SEQ ID NO: 21408 - RNA, 21 nt, Artificial Sequence
  Description of Artificial Sequence: Synthetic oligonucleotide
uaauuuauuuugugaacaauu

SEQ ID NO: 21409 - RNA, 21 nt, Artificial Sequence
  Description of Artificial Sequence: Synthetic oligonucleotide
aauuuauuuugugaacacauu

SEQ ID NO: 21410 - RNA, 21 nt, Artificial Sequence
  Description of Artificial Sequence: Synthetic oligonucleotide
auuuauuuugugaacacuauu

SEQ ID NO: 21411 - RNA, 21 nt, Artificial Sequence
  Description of Artificial Sequence: Synthetic oligonucleotide
uuuauuuugugaacacuuauu

SEQ ID NO: 21412 - RNA, 21 nt, Artificial Sequence
  Description of Artificial Sequence: Synthetic oligonucleotide
uuauuuugugaacacuuuauu

SEQ ID NO: 21413 - RNA, 21 nt, Artificial Sequence
  Description of Artificial Sequence: Synthetic oligonucleotide
uauuuugugaacacuuuuauu

SEQ ID NO: 21414 - RNA, 21 nt, Artificial Sequence
  Description of Artificial Sequence: Synthetic oligonucleotide
auuuugugaacacuuuugauu

SEQ ID NO: 21415 - RNA, 21 nt, Artificial Sequence
  Description of Artificial Sequence: Synthetic oligonucleotide
uuuugugaacacuuuugaauu

SEQ ID NO: 21416 - RNA, 21 nt, Artificial Sequence
  Description of Artificial Sequence: Synthetic oligonucleotide
uuugugaacacuuuugaaauu

SEQ ID NO: 21417 - RNA, 21 nt, Artificial Sequence
  Description of Artificial Sequence: Synthetic oligonucleotide
uugugaacacuuuugaaaauu

SEQ ID NO: 21418 - RNA, 21 nt, Artificial Sequence
  Description of Artificial Sequence: Synthetic oligonucleotide
ugugaacacuuuugaaaaauu

SEQ ID NO: 21419 - RNA, 21 nt, Artificial Sequence
  Description of Artificial Sequence: Synthetic oligonucleotide
gugaacacuuuugaaaauauu

SEQ ID NO: 21420 - RNA, 21 nt, Artificial Sequence
  Description of Artificial Sequence: Synthetic oligonucleotide
ugaacacuuuugaaaaugauu

SEQ ID NO: 21421 - RNA, 21 nt, Artificial Sequence
  Description of Artificial Sequence: Synthetic oligonucleotide
gaacacuuuugaaaauguauu

SEQ ID NO: 21422 - RNA, 21 nt, Artificial Sequence
  Description of Artificial Sequence: Synthetic oligonucleotide
aacacuuuugaaaauguaauu

SEQ ID NO: 21423 - RNA, 21 nt, Artificial Sequence
  Description of Artificial Sequence: Synthetic oligonucleotide
acacuuuugaaaauguacauu

SEQ ID NO: 21424 - RNA, 21 nt, Artificial Sequence
  Description of Artificial Sequence: Synthetic oligonucleotide
cacuuuugaaaauguacaauu

SEQ ID NO: 21425 - RNA, 21 nt, Artificial Sequence
  Description of Artificial Sequence: Synthetic oligonucleotide
acuuuugaaaauguacauauu

SEQ ID NO: 21426 - RNA, 21 nt, Artificial Sequence
  Description of Artificial Sequence: Synthetic oligonucleotide
cuuuugaaaauguacaugauu

SEQ ID NO: 21427 - RNA, 21 nt, Artificial Sequence
  Description of Artificial Sequence: Synthetic oligonucleotide
uuuugaaaauguacauguauu

SEQ ID NO: 21428 - RNA, 21 nt, Artificial Sequence
  Description of Artificial Sequence: Synthetic oligonucleotide
uuugaaaauguacauguuauu

SEQ ID NO: 21429 - RNA, 21 nt, Artificial Sequence
  Description of Artificial Sequence: Synthetic oligonucleotide
uugaaaauguacauguucauu

SEQ ID NO: 21430 - RNA, 21 nt, Artificial Sequence
  Description of Artificial Sequence: Synthetic oligonucleotide
ugaaaauguacauguuccauu

SEQ ID NO: 21431 - RNA, 21 nt, Artificial Sequence
  Description of Artificial Sequence: Synthetic oligonucleotide
gaaaauguacauguuccuauu

SEQ ID NO: 21432 - RNA, 21 nt, Artificial Sequence
  Description of Artificial Sequence: Synthetic oligonucleotide
aaaauguacauguuccuuauu

SEQ ID NO: 21433 - RNA, 21 nt, Artificial Sequence
  Description of Artificial Sequence: Synthetic oligonucleotide
aaauguacauguuccuuuauu

SEQ ID NO: 21434 - RNA, 21 nt, Artificial Sequence
  Description of Artificial Sequence: Synthetic oligonucleotide
aauguacauguuccuuugauu

SEQ ID NO: 21435 - RNA, 21 nt, Artificial Sequence
  Description of Artificial Sequence: Synthetic oligonucleotide
auguacauguuccuuuguauu

SEQ ID NO: 21436 - RNA, 21 nt, Artificial Sequence
  Description of Artificial Sequence: Synthetic oligonucleotide
uguacauguuccuuuguaauu

SEQ ID NO: 21437 - RNA, 21 nt, Artificial Sequence
  Description of Artificial Sequence: Synthetic oligonucleotide
guacauguuccuuuguaaauu

SEQ ID NO: 21438 - RNA, 21 nt, Artificial Sequence
  Description of Artificial Sequence: Synthetic oligonucleotide
uacauguuccuuuguaauauu

SEQ ID NO: 21439 - RNA, 21 nt, Artificial Sequence
  Description of Artificial Sequence: Synthetic oligonucleotide
acauguuccuuuguaauuauu

SEQ ID NO: 21440 - RNA, 21 nt, Artificial Sequence
  Description of Artificial Sequence: Synthetic oligonucleotide
cauguuccuuuguaauugauu

SEQ ID NO: 21441 - RNA, 21 nt, Artificial Sequence
  Description of Artificial Sequence: Synthetic oligonucleotide
auguuccuuuguaauugaauu

SEQ ID NO: 21442 - RNA, 21 nt, Artificial Sequence
  Description of Artificial Sequence: Synthetic oligonucleotide
uguuccuuuguaauugacauu

SEQ ID NO: 21443 - RNA, 21 nt, Artificial Sequence
  Description of Artificial Sequence: Synthetic oligonucleotide
guuccuuuguaauugacaauu

SEQ ID NO: 21444 - RNA, 21 nt, Artificial Sequence
  Description of Artificial Sequence: Synthetic oligonucleotide
uuccuuuguaauugacacauu

SEQ ID NO: 21445 - RNA, 21 nt, Artificial Sequence
  Description of Artificial Sequence: Synthetic oligonucleotide
uccuuuguaauugacacuauu

SEQ ID NO: 21446 - RNA, 21 nt, Artificial Sequence
  Description of Artificial Sequence: Synthetic oligonucleotide
ccuuuguaauugacacuaauu

SEQ ID NO: 21447 - RNA, 21 nt, Artificial Sequence
  Description of Artificial Sequence: Synthetic oligonucleotide
cuuuguaauugacacuauauu

SEQ ID NO: 21448 - RNA, 21 nt, Artificial Sequence
  Description of Artificial Sequence: Synthetic oligonucleotide
uuuguaauugacacuauaauu

SEQ ID NO: 21449 - RNA, 21 nt, Artificial Sequence
  Description of Artificial Sequence: Synthetic oligonucleotide
uuguaauugacacuauauauu

SEQ ID NO: 21450 - RNA, 21 nt, Artificial Sequence
  Description of Artificial Sequence: Synthetic oligonucleotide
uguaauugacacuauauaauu

SEQ ID NO: 21451 - RNA, 21 nt, Artificial Sequence
  Description of Artificial Sequence: Synthetic oligonucleotide
guaauugacacuauauauauu

SEQ ID NO: 21452 - RNA, 21 nt, Artificial Sequence
  Description of Artificial Sequence: Synthetic oligonucleotide
uaauugacacuauauauuauu

SEQ ID NO: 21453 - RNA, 21 nt, Artificial Sequence
  Description of Artificial Sequence: Synthetic oligonucleotide
aauugacacuauauauuuauu

SEQ ID NO: 21454 - RNA, 21 nt, Artificial Sequence
  Description of Artificial Sequence: Synthetic oligonucleotide
auugacacuauauauuucauu

SEQ ID NO: 21455 - RNA, 21 nt, Artificial Sequence
  Description of Artificial Sequence: Synthetic oligonucleotide
uugacacuauauauuucuauu

SEQ ID NO: 21456 - RNA, 21 nt, Artificial Sequence
  Description of Artificial Sequence: Synthetic oligonucleotide
ugacacuauauauuucuuauu

SEQ ID NO: 21457 - RNA, 21 nt, Artificial Sequence
  Description of Artificial Sequence: Synthetic oligonucleotide
gacacuauauauuucuuaauu

SEQ ID NO: 21458 - RNA, 21 nt, Artificial Sequence
  Description of Artificial Sequence: Synthetic oligonucleotide
acacuauauauuucuuaaauu

SEQ ID NO: 21459 - RNA, 21 nt, Artificial Sequence
  Description of Artificial Sequence: Synthetic oligonucleotide
cacuauauauuucuuaauauu

SEQ ID NO: 21460 - RNA, 21 nt, Artificial Sequence
  Description of Artificial Sequence: Synthetic oligonucleotide
acuauauauuucuuaauaauu

SEQ ID NO: 21461 - RNA, 21 nt, Artificial Sequence
  Description of Artificial Sequence: Synthetic oligonucleotide
cuauauauuucuuaauaaauu

SEQ ID NO: 21462 - RNA, 21 nt, Artificial Sequence
  Description of Artificial Sequence: Synthetic oligonucleotide
uauauauuucuuaauaaaauu

SEQ ID NO: 21463 - RNA, 21 nt, Artificial Sequence
  Description of Artificial Sequence: Synthetic oligonucleotide
auauauuucuuaauaaaaauu

SEQ ID NO: 21464 - RNA, 21 nt, Artificial Sequence
  Description of Artificial Sequence: Synthetic oligonucleotide
uauauuucuuaauaaaauauu

SEQ ID NO: 21465 - RNA, 21 nt, Artificial Sequence
  Description of Artificial Sequence: Synthetic oligonucleotide
auauuucuuaauaaaauaauu

SEQ ID NO: 21466 - RNA, 21 nt, Artificial Sequence
  Description of Artificial Sequence: Synthetic oligonucleotide
uauuucuuaauaaaauaaauu

SEQ ID NO: 21467 - RNA, 21 nt, Artificial Sequence
  Description of Artificial Sequence: Synthetic oligonucleotide
auuucuuaauaaaauaauauu

SEQ ID NO: 21468 - RNA, 21 nt, Artificial Sequence
  Description of Artificial Sequence: Synthetic oligonucleotide
uuucuuaauaaaauaauuauu

SEQ ID NO: 21469 - RNA, 21 nt, Artificial Sequence
  Description of Artificial Sequence: Synthetic oligonucleotide
uucuuaauaaaauaauucauu

SEQ ID NO: 21470 - RNA, 21 nt, Artificial Sequence
  Description of Artificial Sequence: Synthetic oligonucleotide
ucuuaauaaaauaauucuauu

SEQ ID NO: 21471 - RNA, 21 nt, Artificial Sequence
  Description of Artificial Sequence: Synthetic oligonucleotide
cuuaauaaaauaauucucauu

SEQ ID NO: 21472 - RNA, 21 nt, Artificial Sequence
  Description of Artificial Sequence: Synthetic oligonucleotide
uuaauaaaauaauucucaauu

SEQ ID NO: 21473 - RNA, 21 nt, Artificial Sequence
  Description of Artificial Sequence: Synthetic oligonucleotide
uaauaaaauaauucucaaauu

SEQ ID NO: 21474 - RNA, 21 nt, Artificial Sequence
  Description of Artificial Sequence: Synthetic oligonucleotide
aauaaaauaauucucaaaauu

SEQ ID NO: 21475 - RNA, 21 nt, Artificial Sequence
  Description of Artificial Sequence: Synthetic oligonucleotide
auaaaauaauucucaaauauu

SEQ ID NO: 21476 - RNA, 21 nt, Artificial Sequence
  Description of Artificial Sequence: Synthetic oligonucleotide
uaaaauaauucucaaauuauu

SEQ ID NO: 21477 - RNA, 21 nt, Artificial Sequence
  Description of Artificial Sequence: Synthetic oligonucleotide
aaaauaauucucaaauuuauu

SEQ ID NO: 21478 - RNA, 21 nt, Artificial Sequence
  Description of Artificial Sequence: Synthetic oligonucleotide
aaauaauucucaaauuugauu

SEQ ID NO: 21479 - RNA, 21 nt, Artificial Sequence
  Description of Artificial Sequence: Synthetic oligonucleotide
aauaauucucaaauuuguauu

SEQ ID NO: 21480 - RNA, 21 nt, Artificial Sequence
  Description of Artificial Sequence: Synthetic oligonucleotide
auaauucucaaauuuguuauu

SEQ ID NO: 21481 - RNA, 21 nt, Artificial Sequence
  Description of Artificial Sequence: Synthetic oligonucleotide
uaauucucaaauuuguuuauu

SEQ ID NO: 21482 - RNA, 21 nt, Artificial Sequence
  Description of Artificial Sequence: Synthetic oligonucleotide
aauucucaaauuuguuucauu

SEQ ID NO: 21483 - RNA, 21 nt, Artificial Sequence
  Description of Artificial Sequence: Synthetic oligonucleotide
auucucaaauuuguuucuauu

SEQ ID NO: 21484 - RNA, 21 nt, Artificial Sequence
  Description of Artificial Sequence: Synthetic oligonucleotide
uucucaaauuuguuucuuauu

SEQ ID NO: 21485 - RNA, 21 nt, Artificial Sequence
  Description of Artificial Sequence: Synthetic oligonucleotide
ucucaaauuuguuucuuaauu

SEQ ID NO: 21486 - RNA, 21 nt, Artificial Sequence
  Description of Artificial Sequence: Synthetic oligonucleotide
cucaaauuuguuucuuauauu

SEQ ID NO: 21487 - RNA, 21 nt, Artificial Sequence
  Description of Artificial Sequence: Synthetic oligonucleotide
ucaaauuuguuucuuaugauu

SEQ ID NO: 21488 - RNA, 21 nt, Artificial Sequence
  Description of Artificial Sequence: Synthetic oligonucleotide
caaauuuguuucuuaugaauu

SEQ ID NO: 21489 - RNA, 21 nt, Artificial Sequence
  Description of Artificial Sequence: Synthetic oligonucleotide
aaauuuguuucuuaugaaauu

SEQ ID NO: 21490 - RNA, 21 nt, Artificial Sequence
  Description of Artificial Sequence: Synthetic oligonucleotide
aauuuguuucuuaugaauauu

SEQ ID NO: 21491 - RNA, 21 nt, Artificial Sequence
  Description of Artificial Sequence: Synthetic oligonucleotide
auuuguuucuuaugaaucauu

SEQ ID NO: 21492 - RNA, 21 nt, Artificial Sequence
  Description of Artificial Sequence: Synthetic oligonucleotide
uuuguuucuuaugaaucaauu

SEQ ID NO: 21493 - RNA, 21 nt, Artificial Sequence
  Description of Artificial Sequence: Synthetic oligonucleotide
uuguuucuuaugaaucauauu

SEQ ID NO: 21494 - RNA, 21 nt, Artificial Sequence
  Description of Artificial Sequence: Synthetic oligonucleotide
uguuucuuaugaaucaucauu

SEQ ID NO: 21495 - RNA, 21 nt, Artificial Sequence
  Description of Artificial Sequence: Synthetic oligonucleotide
guuucuuaugaaucaucuauu

SEQ ID NO: 21496 - RNA, 21 nt, Artificial Sequence
  Description of Artificial Sequence: Synthetic oligonucleotide
uuucuuaugaaucaucucauu

SEQ ID NO: 21497 - RNA, 21 nt, Artificial Sequence
  Description of Artificial Sequence: Synthetic oligonucleotide
uucuuaugaaucaucucuauu

SEQ ID NO: 21498 - RNA, 21 nt, Artificial Sequence
  Description of Artificial Sequence: Synthetic oligonucleotide
ucuuaugaaucaucucucauu

SEQ ID NO: 21499 - RNA, 21 nt, Artificial Sequence
  Description of Artificial Sequence: Synthetic oligonucleotide
cuuaugaaucaucucucaauu

SEQ ID NO: 21500 - RNA, 21 nt, Artificial Sequence
  Description of Artificial Sequence: Synthetic oligonucleotide
uuaugaaucaucucucaaauu

SEQ ID NO: 21501 - RNA, 21 nt, Artificial Sequence
  Description of Artificial Sequence: Synthetic oligonucleotide
uaugaaucaucucucaaaauu

SEQ ID NO: 21502 - RNA, 21 nt, Artificial Sequence
  Description of Artificial Sequence: Synthetic oligonucleotide
augaaucaucucucaaauauu

SEQ ID NO: 21503 - RNA, 21 nt, Artificial Sequence
  Description of Artificial Sequence: Synthetic oligonucleotide
ugaaucaucucucaaaucauu

SEQ ID NO: 21504 - RNA, 21 nt, Artificial Sequence
  Description of Artificial Sequence: Synthetic oligonucleotide
gaaucaucucucaaaucuauu

SEQ ID NO: 21505 - RNA, 21 nt, Artificial Sequence
  Description of Artificial Sequence: Synthetic oligonucleotide
aaucaucucucaaaucuaauu

SEQ ID NO: 21506 - RNA, 21 nt, Artificial Sequence
  Description of Artificial Sequence: Synthetic oligonucleotide
aucaucucucaaaucuagauu

SEQ ID NO: 21507 - RNA, 21 nt, Artificial Sequence
  Description of Artificial Sequence: Synthetic oligonucleotide
ucaucucucaaaucuaguauu

SEQ ID NO: 21508 - RNA, 21 nt, Artificial Sequence
  Description of Artificial Sequence: Synthetic oligonucleotide
caucucucaaaucuaguuauu

SEQ ID NO: 21509 - RNA, 21 nt, Artificial Sequence
  Description of Artificial Sequence: Synthetic oligonucleotide
aucucucaaaucuaguuaauu

SEQ ID NO: 21510 - RNA, 21 nt, Artificial Sequence
  Description of Artificial Sequence: Synthetic oligonucleotide
ucucucaaaucuaguuagauu

SEQ ID NO: 21511 - RNA, 21 nt, Artificial Sequence
  Description of Artificial Sequence: Synthetic oligonucleotide
cucucaaaucuaguuagaauu

SEQ ID NO: 21512 - RNA, 21 nt, Artificial Sequence
  Description of Artificial Sequence: Synthetic oligonucleotide
ucucaaaucuaguuagacauu

SEQ ID NO: 21513 - RNA, 21 nt, Artificial Sequence
  Description of Artificial Sequence: Synthetic oligonucleotide
cucaaaucuaguuagacaauu

SEQ ID NO: 21514 - RNA, 21 nt, Artificial Sequence
  Description of Artificial Sequence: Synthetic oligonucleotide
ucaaaucuaguuagacaaauu

SEQ ID NO: 21515 - RNA, 21 nt, Artificial Sequence
  Description of Artificial Sequence: Synthetic oligonucleotide
caaaucuaguuagacaauauu

SEQ ID NO: 21516 - RNA, 21 nt, Artificial Sequence
  Description of Artificial Sequence: Synthetic oligonucleotide
aaaucuaguuagacaauuauu

SEQ ID NO: 21517 - RNA, 21 nt, Artificial Sequence
  Description of Artificial Sequence: Synthetic oligonucleotide
aaucuaguuagacaauuuauu

SEQ ID NO: 21518 - RNA, 21 nt, Artificial Sequence
  Description of Artificial Sequence: Synthetic oligonucleotide
aucuaguuagacaauuugauu

SEQ ID NO: 21519 - RNA, 21 nt, Artificial Sequence
  Description of Artificial Sequence: Synthetic oligonucleotide
ucuaguuagacaauuugcauu

SEQ ID NO: 21520 - RNA, 21 nt, Artificial Sequence
  Description of Artificial Sequence: Synthetic oligonucleotide
cuaguuagacaauuugcaauu

SEQ ID NO: 21521 - RNA, 21 nt, Artificial Sequence
  Description of Artificial Sequence: Synthetic oligonucleotide
uaguuagacaauuugcacauu

SEQ ID NO: 21522 - RNA, 21 nt, Artificial Sequence
  Description of Artificial Sequence: Synthetic oligonucleotide
aguuagacaauuugcacaauu

SEQ ID NO: 21523 - RNA, 21 nt, Artificial Sequence
  Description of Artificial Sequence: Synthetic oligonucleotide
guuagacaauuugcacacauu

SEQ ID NO: 21524 - RNA, 21 nt, Artificial Sequence
  Description of Artificial Sequence: Synthetic oligonucleotide
uuagacaauuugcacacaauu

SEQ ID NO: 21525 - RNA, 21 nt, Artificial Sequence
  Description of Artificial Sequence: Synthetic oligonucleotide
uagacaauuugcacacauauu

SEQ ID NO: 21526 - RNA, 21 nt, Artificial Sequence
  Description of Artificial Sequence: Synthetic oligonucleotide
agacaauuugcacacauaauu

SEQ ID NO: 21527 - RNA, 21 nt, Artificial Sequence
  Description of Artificial Sequence: Synthetic oligonucleotide
gacaauuugcacacauacauu

SEQ ID NO: 21528 - RNA, 21 nt, Artificial Sequence
  Description of Artificial Sequence: Synthetic oligonucleotide
acaauuugcacacauacuauu

SEQ ID NO: 21529 - RNA, 21 nt, Artificial Sequence
  Description of Artificial Sequence: Synthetic oligonucleotide
caauuugcacacauacuuauu

SEQ ID NO: 21530 - RNA, 21 nt, Artificial Sequence
  Description of Artificial Sequence: Synthetic oligonucleotide
aauuugcacacauacuuuauu

SEQ ID NO: 21531 - RNA, 21 nt, Artificial Sequence
  Description of Artificial Sequence: Synthetic oligonucleotide
auuugcacacauacuuuuauu

SEQ ID NO: 21532 - RNA, 21 nt, Artificial Sequence
  Description of Artificial Sequence: Synthetic oligonucleotide
uuugcacacauacuuuucauu

SEQ ID NO: 21533 - RNA, 21 nt, Artificial Sequence
  Description of Artificial Sequence: Synthetic oligonucleotide
uugcacacauacuuuucuauu

SEQ ID NO: 21534 - RNA, 21 nt, Artificial Sequence
  Description of Artificial Sequence: Synthetic oligonucleotide
ugcacacauacuuuucuaauu

SEQ ID NO: 21535 - RNA, 21 nt, Artificial Sequence
  Description of Artificial Sequence: Synthetic oligonucleotide
gcacacauacuuuucuaaauu

SEQ ID NO: 21536 - RNA, 21 nt, Artificial Sequence
  Description of Artificial Sequence: Synthetic oligonucleotide
cacacauacuuuucuaagauu

SEQ ID NO: 21537 - RNA, 21 nt, Artificial Sequence
  Description of Artificial Sequence: Synthetic oligonucleotide
acacauacuuuucuaaggauu

SEQ ID NO: 21538 - RNA, 21 nt, Artificial Sequence
  Description of Artificial Sequence: Synthetic oligonucleotide
cacauacuuuucuaagggauu

SEQ ID NO: 21539 - RNA, 21 nt, Artificial Sequence
  Description of Artificial Sequence: Synthetic oligonucleotide
acauacuuuucuaagggaauu

SEQ ID NO: 21540 - RNA, 21 nt, Artificial Sequence
  Description of Artificial Sequence: Synthetic oligonucleotide
cauacuuuucuaagggacauu

SEQ ID NO: 21541 - RNA, 21 nt, Artificial Sequence
  Description of Artificial Sequence: Synthetic oligonucleotide
auacuuuucuaagggacaauu

SEQ ID NO: 21542 - RNA, 21 nt, Artificial Sequence
  Description of Artificial Sequence: Synthetic oligonucleotide
uacuuuucuaagggacauauu

SEQ ID NO: 21543 - RNA, 21 nt, Artificial Sequence
  Description of Artificial Sequence: Synthetic oligonucleotide
acuuuucuaagggacauuauu

SEQ ID NO: 21544 - RNA, 21 nt, Artificial Sequence
  Description of Artificial Sequence: Synthetic oligonucleotide
cuuuucuaagggacauuaauu

SEQ ID NO: 21545 - RNA, 21 nt, Artificial Sequence
  Description of Artificial Sequence: Synthetic oligonucleotide
uuuucuaagggacauuauauu

SEQ ID NO: 21546 - RNA, 21 nt, Artificial Sequence
  Description of Artificial Sequence: Synthetic oligonucleotide
uuucuaagggacauuaucauu

SEQ ID NO: 21547 - RNA, 21 nt, Artificial Sequence
  Description of Artificial Sequence: Synthetic oligonucleotide
uucuaagggacauuaucuauu

SEQ ID NO: 21548 - RNA, 21 nt, Artificial Sequence
  Description of Artificial Sequence: Synthetic oligonucleotide
ucuaagggacauuaucuuauu

SEQ ID NO: 21549 - RNA, 21 nt, Artificial Sequence
  Description of Artificial Sequence: Synthetic oligonucleotide
cuaagggacauuaucuucauu

SEQ ID NO: 21550 - RNA, 21 nt, Artificial Sequence
  Description of Artificial Sequence: Synthetic oligonucleotide
uaagggacauuaucuuccauu

SEQ ID NO: 21551 - RNA, 21 nt, Artificial Sequence
  Description of Artificial Sequence: Synthetic oligonucleotide
aagggacauuaucuuccuauu

SEQ ID NO: 21552 - RNA, 21 nt, Artificial Sequence
  Description of Artificial Sequence: Synthetic oligonucleotide
agggacauuaucuuccuuauu

SEQ ID NO: 21553 - RNA, 21 nt, Artificial Sequence
  Description of Artificial Sequence: Synthetic oligonucleotide
gggacauuaucuuccuucauu

SEQ ID NO: 21554 - RNA, 21 nt, Artificial Sequence
  Description of Artificial Sequence: Synthetic oligonucleotide
ggacauuaucuuccuucaauu

SEQ ID NO: 21555 - RNA, 21 nt, Artificial Sequence
  Description of Artificial Sequence: Synthetic oligonucleotide
gacauuaucuuccuucagauu

SEQ ID NO: 21556 - RNA, 21 nt, Artificial Sequence
  Description of Artificial Sequence: Synthetic oligonucleotide
acauuaucuuccuucaggauu

SEQ ID NO: 21557 - RNA, 21 nt, Artificial Sequence
  Description of Artificial Sequence: Synthetic oligonucleotide
cauuaucuuccuucagguauu

SEQ ID NO: 21558 - RNA, 21 nt, Artificial Sequence
  Description of Artificial Sequence: Synthetic oligonucleotide
auuaucuuccuucagguuauu

SEQ ID NO: 21559 - RNA, 21 nt, Artificial Sequence
  Description of Artificial Sequence: Synthetic oligonucleotide
uuaucuuccuucagguuuauu

SEQ ID NO: 21560 - RNA, 21 nt, Artificial Sequence
  Description of Artificial Sequence: Synthetic oligonucleotide
uaucuuccuucagguuuuauu

SEQ ID NO: 21561 - RNA, 21 nt, Artificial Sequence
  Description of Artificial Sequence: Synthetic oligonucleotide
aucuuccuucagguuuuuauu

SEQ ID NO: 21562 - RNA, 21 nt, Artificial Sequence
  Description of Artificial Sequence: Synthetic oligonucleotide
ucuuccuucagguuuuuaauu

SEQ ID NO: 21563 - RNA, 21 nt, Artificial Sequence
  Description of Artificial Sequence: Synthetic oligonucleotide
cuuccuucagguuuuuacauu

SEQ ID NO: 21564 - RNA, 21 nt, Artificial Sequence
  Description of Artificial Sequence: Synthetic oligonucleotide
uuccuucagguuuuuaccauu

SEQ ID NO: 21565 - RNA, 21 nt, Artificial Sequence
  Description of Artificial Sequence: Synthetic oligonucleotide
uccuucagguuuuuaccuauu

SEQ ID NO: 21566 - RNA, 21 nt, Artificial Sequence
  Description of Artificial Sequence: Synthetic oligonucleotide
ccuucagguuuuuaccucauu

SEQ ID NO: 21567 - RNA, 21 nt, Artificial Sequence
  Description of Artificial Sequence: Synthetic oligonucleotide
cuucagguuuuuaccuccauu

SEQ ID NO: 21568 - RNA, 21 nt, Artificial Sequence
  Description of Artificial Sequence: Synthetic oligonucleotide
uucagguuuuuaccuccaauu

SEQ ID NO: 21569 - RNA, 21 nt, Artificial Sequence
  Description of Artificial Sequence: Synthetic oligonucleotide
ucagguuuuuaccuccacauu

SEQ ID NO: 21570 - RNA, 21 nt, Artificial Sequence
  Description of Artificial Sequence: Synthetic oligonucleotide
cagguuuuuaccuccacuauu

SEQ ID NO: 21571 - RNA, 21 nt, Artificial Sequence
  Description of Artificial Sequence: Synthetic oligonucleotide
agguuuuuaccuccacucauu

SEQ ID NO: 21572 - RNA, 21 nt, Artificial Sequence
  Description of Artificial Sequence: Synthetic oligonucleotide
gguuuuuaccuccacucaauu

SEQ ID NO: 21573 - RNA, 21 nt, Artificial Sequence
  Description of Artificial Sequence: Synthetic oligonucleotide
guuuuuaccuccacucauauu

SEQ ID NO: 21574 - RNA, 21 nt, Artificial Sequence
  Description of Artificial Sequence: Synthetic oligonucleotide
uuuuuaccuccacucaucauu

SEQ ID NO: 21575 - RNA, 21 nt, Artificial Sequence
  Description of Artificial Sequence: Synthetic oligonucleotide
uuuuaccuccacucauccauu

SEQ ID NO: 21576 - RNA, 21 nt, Artificial Sequence
  Description of Artificial Sequence: Synthetic oligonucleotide
uuuaccuccacucauccuauu

SEQ ID NO: 21577 - RNA, 21 nt, Artificial Sequence
  Description of Artificial Sequence: Synthetic oligonucleotide
uuaccuccacucauccuuauu

SEQ ID NO: 21578 - RNA, 21 nt, Artificial Sequence
  Description of Artificial Sequence: Synthetic oligonucleotide
uaccuccacucauccuuaauu

SEQ ID NO: 21579 - RNA, 21 nt, Artificial Sequence
  Description of Artificial Sequence: Synthetic oligonucleotide
accuccacucauccuuagauu

SEQ ID NO: 21580 - RNA, 21 nt, Artificial Sequence
  Description of Artificial Sequence: Synthetic oligonucleotide
ccuccacucauccuuagaauu

SEQ ID NO: 21581 - RNA, 21 nt, Artificial Sequence
  Description of Artificial Sequence: Synthetic oligonucleotide
cuccacucauccuuagagauu

SEQ ID NO: 21582 - RNA, 21 nt, Artificial Sequence
  Description of Artificial Sequence: Synthetic oligonucleotide
uccacucauccuuagagcauu

SEQ ID NO: 21583 - RNA, 21 nt, Artificial Sequence
  Description of Artificial Sequence: Synthetic oligonucleotide
ccacucauccuuagagccauu

SEQ ID NO: 21584 - RNA, 21 nt, Artificial Sequence
  Description of Artificial Sequence: Synthetic oligonucleotide
cacucauccuuagagcccauu

SEQ ID NO: 21585 - RNA, 21 nt, Artificial Sequence
  Description of Artificial Sequence: Synthetic oligonucleotide
acucauccuuagagcccaauu

SEQ ID NO: 21586 - RNA, 21 nt, Artificial Sequence
  Description of Artificial Sequence: Synthetic oligonucleotide
cucauccuuagagcccacauu

SEQ ID NO: 21587 - RNA, 21 nt, Artificial Sequence
  Description of Artificial Sequence: Synthetic oligonucleotide
ucauccuuagagcccacuauu

SEQ ID NO: 21588 - RNA, 21 nt, Artificial Sequence
  Description of Artificial Sequence: Synthetic oligonucleotide
cauccuuagagcccacugauu

SEQ ID NO: 21589 - RNA, 21 nt, Artificial Sequence
  Description of Artificial Sequence: Synthetic oligonucleotide
auccuuagagcccacugaauu

SEQ ID NO: 21590 - RNA, 21 nt, Artificial Sequence
  Description of Artificial Sequence: Synthetic oligonucleotide
uccuuagagcccacugacauu

SEQ ID NO: 21591 - RNA, 21 nt, Artificial Sequence
  Description of Artificial Sequence: Synthetic oligonucleotide
ccuuagagcccacugacuauu

SEQ ID NO: 21592 - RNA, 21 nt, Artificial Sequence
  Description of Artificial Sequence: Synthetic oligonucleotide
cuuagagcccacugacugauu

SEQ ID NO: 21593 - RNA, 21 nt, Artificial Sequence
  Description of Artificial Sequence: Synthetic oligonucleotide
uuagagcccacugacugcauu

SEQ ID NO: 21594 - RNA, 21 nt, Artificial Sequence
  Description of Artificial Sequence: Synthetic oligonucleotide
uagagcccacugacugcuauu

SEQ ID NO: 21595 - RNA, 21 nt, Artificial Sequence
  Description of Artificial Sequence: Synthetic oligonucleotide
agagcccacugacugcucauu

SEQ ID NO: 21596 - RNA, 21 nt, Artificial Sequence
  Description of Artificial Sequence: Synthetic oligonucleotide
gagcccacugacugcuccauu

SEQ ID NO: 21597 - RNA, 21 nt, Artificial Sequence
  Description of Artificial Sequence: Synthetic oligonucleotide
agcccacugacugcucccauu

SEQ ID NO: 21598 - RNA, 21 nt, Artificial Sequence
  Description of Artificial Sequence: Synthetic oligonucleotide
gcccacugacugcuccccauu

SEQ ID NO: 21599 - RNA, 21 nt, Artificial Sequence
  Description of Artificial Sequence: Synthetic oligonucleotide
cccacugacugcuccccuauu

SEQ ID NO: 21600 - RNA, 21 nt, Artificial Sequence
  Description of Artificial Sequence: Synthetic oligonucleotide
ccacugacugcuccccuuauu

SEQ ID NO: 21601 - RNA, 21 nt, Artificial Sequence
  Description of Artificial Sequence: Synthetic oligonucleotide
cacugacugcuccccuuuauu

SEQ ID NO: 21602 - RNA, 21 nt, Artificial Sequence
  Description of Artificial Sequence: Synthetic oligonucleotide
acugacugcuccccuuuaauu

SEQ ID NO: 21603 - RNA, 21 nt, Artificial Sequence
  Description of Artificial Sequence: Synthetic oligonucleotide
cugacugcuccccuuuauauu

SEQ ID NO: 21604 - RNA, 21 nt, Artificial Sequence
  Description of Artificial Sequence: Synthetic oligonucleotide
ugacugcuccccuuuauaauu

SEQ ID NO: 21605 - RNA, 21 nt, Artificial Sequence
  Description of Artificial Sequence: Synthetic oligonucleotide
gacugcuccccuuuauacauu

SEQ ID NO: 21606 - RNA, 21 nt, Artificial Sequence
  Description of Artificial Sequence: Synthetic oligonucleotide
acugcuccccuuuauaccauu

SEQ ID NO: 21607 - RNA, 21 nt, Artificial Sequence
  Description of Artificial Sequence: Synthetic oligonucleotide
cugcuccccuuuauaccuauu

SEQ ID NO: 21608 - RNA, 21 nt, Artificial Sequence
  Description of Artificial Sequence: Synthetic oligonucleotide
ugcuccccuuuauaccugauu

SEQ ID NO: 21609 - RNA, 21 nt, Artificial Sequence
  Description of Artificial Sequence: Synthetic oligonucleotide
gcuccccuuuauaccuguauu

SEQ ID NO: 21610 - RNA, 21 nt, Artificial Sequence
  Description of Artificial Sequence: Synthetic oligonucleotide
cuccccuuuauaccuguuauu

SEQ ID NO: 21611 - RNA, 21 nt, Artificial Sequence
  Description of Artificial Sequence: Synthetic oligonucleotide
uccccuuuauaccuguugauu

SEQ ID NO: 21612 - RNA, 21 nt, Artificial Sequence
  Description of Artificial Sequence: Synthetic oligonucleotide
ccccuuuauaccuguuggauu

SEQ ID NO: 21613 - RNA, 21 nt, Artificial Sequence
  Description of Artificial Sequence: Synthetic oligonucleotide
cccuuuauaccuguuggcauu

SEQ ID NO: 21614 - RNA, 21 nt, Artificial Sequence
  Description of Artificial Sequence: Synthetic oligonucleotide
ccuuuauaccuguuggccauu

SEQ ID NO: 21615 - RNA, 21 nt, Artificial Sequence
  Description of Artificial Sequence: Synthetic oligonucleotide
cuuuauaccuguuggcccauu

SEQ ID NO: 21616 - RNA, 21 nt, Artificial Sequence
  Description of Artificial Sequence: Synthetic oligonucleotide
uuuauaccuguuggcccuauu

SEQ ID NO: 21617 - RNA, 21 nt, Artificial Sequence
  Description of Artificial Sequence: Synthetic oligonucleotide
uuauaccuguuggcccugauu

SEQ ID NO: 21618 - RNA, 21 nt, Artificial Sequence
  Description of Artificial Sequence: Synthetic oligonucleotide
uauaccuguuggcccugcauu

SEQ ID NO: 21619 - RNA, 21 nt, Artificial Sequence
  Description of Artificial Sequence: Synthetic oligonucleotide
auaccuguuggcccugccauu

SEQ ID NO: 21620 - RNA, 21 nt, Artificial Sequence
  Description of Artificial Sequence: Synthetic oligonucleotide
uaccuguuggcccugccuauu

SEQ ID NO: 21621 - RNA, 21 nt, Artificial Sequence
  Description of Artificial Sequence: Synthetic oligonucleotide
accuguuggcccugccuaauu

SEQ ID NO: 21622 - RNA, 21 nt, Artificial Sequence
  Description of Artificial Sequence: Synthetic oligonucleotide
ccuguuggcccugccuauauu

SEQ ID NO: 21623 - RNA, 21 nt, Artificial Sequence
  Description of Artificial Sequence: Synthetic oligonucleotide
cuguuggcccugccuauaauu

SEQ ID NO: 21624 - RNA, 21 nt, Artificial Sequence
  Description of Artificial Sequence: Synthetic oligonucleotide
uguuggcccugccuauagauu

SEQ ID NO: 21625 - RNA, 21 nt, Artificial Sequence
  Description of Artificial Sequence: Synthetic oligonucleotide
guuggcccugccuauaggauu

SEQ ID NO: 21626 - RNA, 21 nt, Artificial Sequence
  Description of Artificial Sequence: Synthetic oligonucleotide
uuggcccugccuauaggaauu

SEQ ID NO: 21627 - RNA, 21 nt, Artificial Sequence
  Description of Artificial Sequence: Synthetic oligonucleotide
uggcccugccuauaggagauu

SEQ ID NO: 21628 - RNA, 21 nt, Artificial Sequence
  Description of Artificial Sequence: Synthetic oligonucleotide
ggcccugccuauaggagaauu

SEQ ID NO: 21629 - RNA, 21 nt, Artificial Sequence
  Description of Artificial Sequence: Synthetic oligonucleotide
gcccugccuauaggagagauu

SEQ ID NO: 21630 - RNA, 21 nt, Artificial Sequence
  Description of Artificial Sequence: Synthetic oligonucleotide
cccugccuauaggagagaauu

SEQ ID NO: 21631 - RNA, 21 nt, Artificial Sequence
  Description of Artificial Sequence: Synthetic oligonucleotide
ccugccuauaggagagaaauu

SEQ ID NO: 21632 - RNA, 21 nt, Artificial Sequence
  Description of Artificial Sequence: Synthetic oligonucleotide
cugccuauaggagagaauauu

SEQ ID NO: 21633 - RNA, 21 nt, Artificial Sequence
  Description of Artificial Sequence: Synthetic oligonucleotide
ugccuauaggagagaauaauu

SEQ ID NO: 21634 - RNA, 21 nt, Artificial Sequence
  Description of Artificial Sequence: Synthetic oligonucleotide
gccuauaggagagaauauauu

SEQ ID NO: 21635 - RNA, 21 nt, Artificial Sequence
  Description of Artificial Sequence: Synthetic oligonucleotide
ccuauaggagagaauauuauu

SEQ ID NO: 21636 - RNA, 21 nt, Artificial Sequence
  Description of Artificial Sequence: Synthetic oligonucleotide
cuauaggagagaauauuuauu

SEQ ID NO: 21637 - RNA, 21 nt, Artificial Sequence
  Description of Artificial Sequence: Synthetic oligonucleotide
uauaggagagaauauuugauu

SEQ ID NO: 21638 - RNA, 21 nt, Artificial Sequence
  Description of Artificial Sequence: Synthetic oligonucleotide
auaggagagaauauuuggauu

SEQ ID NO: 21639 - RNA, 21 nt, Artificial Sequence
  Description of Artificial Sequence: Synthetic oligonucleotide
uaggagagaauauuuggaauu

SEQ ID NO: 21640 - RNA, 21 nt, Artificial Sequence
  Description of Artificial Sequence: Synthetic oligonucleotide
aggagagaauauuuggagauu

SEQ ID NO: 21641 - RNA, 21 nt, Artificial Sequence
  Description of Artificial Sequence: Synthetic oligonucleotide
ggagagaauauuuggagaauu

SEQ ID NO: 21642 - RNA, 21 nt, Artificial Sequence
  Description of Artificial Sequence: Synthetic oligonucleotide
gagagaauauuuggagauauu

SEQ ID NO: 21643 - RNA, 21 nt, Artificial Sequence
  Description of Artificial Sequence: Synthetic oligonucleotide
agagaauauuuggagauaauu

SEQ ID NO: 21644 - RNA, 21 nt, Artificial Sequence
  Description of Artificial Sequence: Synthetic oligonucleotide
gagaauauuuggagauagauu

SEQ ID NO: 21645 - RNA, 21 nt, Artificial Sequence
  Description of Artificial Sequence: Synthetic oligonucleotide
agaauauuuggagauaggauu

SEQ ID NO: 21646 - RNA, 21 nt, Artificial Sequence
  Description of Artificial Sequence: Synthetic oligonucleotide
gaauauuuggagauaggcauu

SEQ ID NO: 21647 - RNA, 21 nt, Artificial Sequence
  Description of Artificial Sequence: Synthetic oligonucleotide
aauauuuggagauaggcaauu

SEQ ID NO: 21648 - RNA, 21 nt, Artificial Sequence
  Description of Artificial Sequence: Synthetic oligonucleotide
auauuuggagauaggcagauu

SEQ ID NO: 21649 - RNA, 21 nt, Artificial Sequence
  Description of Artificial Sequence: Synthetic oligonucleotide
uauuuggagauaggcagcauu

SEQ ID NO: 21650 - RNA, 21 nt, Artificial Sequence
  Description of Artificial Sequence: Synthetic oligonucleotide
auuuggagauaggcagcuauu

SEQ ID NO: 21651 - RNA, 21 nt, Artificial Sequence
  Description of Artificial Sequence: Synthetic oligonucleotide
uuuggagauaggcagcuuauu

SEQ ID NO: 21652 - RNA, 21 nt, Artificial Sequence
  Description of Artificial Sequence: Synthetic oligonucleotide
uuggagauaggcagcuucauu

SEQ ID NO: 21653 - RNA, 21 nt, Artificial Sequence
  Description of Artificial Sequence: Synthetic oligonucleotide
uggagauaggcagcuucaauu

SEQ ID NO: 21654 - RNA, 21 nt, Artificial Sequence
  Description of Artificial Sequence: Synthetic oligonucleotide
ggagauaggcagcuucagauu

SEQ ID NO: 21655 - RNA, 21 nt, Artificial Sequence
  Description of Artificial Sequence: Synthetic oligonucleotide
gagauaggcagcuucaggauu

SEQ ID NO: 21656 - RNA, 21 nt, Artificial Sequence
  Description of Artificial Sequence: Synthetic oligonucleotide
agauaggcagcuucaggaauu

SEQ ID NO: 21657 - RNA, 21 nt, Artificial Sequence
  Description of Artificial Sequence: Synthetic oligonucleotide
gauaggcagcuucaggauauu

SEQ ID NO: 21658 - RNA, 21 nt, Artificial Sequence
  Description of Artificial Sequence: Synthetic oligonucleotide
auaggcagcuucaggaugauu

SEQ ID NO: 21659 - RNA, 21 nt, Artificial Sequence
  Description of Artificial Sequence: Synthetic oligonucleotide
uaggcagcuucaggaugcauu

SEQ ID NO: 21660 - RNA, 21 nt, Artificial Sequence
  Description of Artificial Sequence: Synthetic oligonucleotide
aggcagcuucaggaugcaauu

SEQ ID NO: 21661 - RNA, 21 nt, Artificial Sequence
  Description of Artificial Sequence: Synthetic oligonucleotide
ggcagcuucaggaugcauauu

SEQ ID NO: 21662 - RNA, 21 nt, Artificial Sequence
  Description of Artificial Sequence: Synthetic oligonucleotide
gcagcuucaggaugcauuauu

SEQ ID NO: 21663 - RNA, 21 nt, Artificial Sequence
  Description of Artificial Sequence: Synthetic oligonucleotide
cagcuucaggaugcauugauu

SEQ ID NO: 21664 - RNA, 21 nt, Artificial Sequence
  Description of Artificial Sequence: Synthetic oligonucleotide
agcuucaggaugcauugcauu

SEQ ID NO: 21665 - RNA, 21 nt, Artificial Sequence
  Description of Artificial Sequence: Synthetic oligonucleotide
gcuucaggaugcauugcaauu

SEQ ID NO: 21666 - RNA, 21 nt, Artificial Sequence
  Description of Artificial Sequence: Synthetic oligonucleotide
cuucaggaugcauugcaaauu

SEQ ID NO: 21667 - RNA, 21 nt, Artificial Sequence
  Description of Artificial Sequence: Synthetic oligonucleotide
uucaggaugcauugcaauauu

SEQ ID NO: 21668 - RNA, 21 nt, Artificial Sequence
  Description of Artificial Sequence: Synthetic oligonucleotide
ucaggaugcauugcaaucauu

SEQ ID NO: 21669 - RNA, 21 nt, Artificial Sequence
  Description of Artificial Sequence: Synthetic oligonucleotide
caggaugcauugcaaucaauu

SEQ ID NO: 21670 - RNA, 21 nt, Artificial Sequence
  Description of Artificial Sequence: Synthetic oligonucleotide
aggaugcauugcaaucauauu

SEQ ID NO: 21671 - RNA, 21 nt, Artificial Sequence
  Description of Artificial Sequence: Synthetic oligonucleotide
ggaugcauugcaaucaucauu

SEQ ID NO: 21672 - RNA, 21 nt, Artificial Sequence
  Description of Artificial Sequence: Synthetic oligonucleotide
gaugcauugcaaucauccauu

SEQ ID NO: 21673 - RNA, 21 nt, Artificial Sequence
  Description of Artificial Sequence: Synthetic oligonucleotide
augcauugcaaucauccuauu

SEQ ID NO: 21674 - RNA, 21 nt, Artificial Sequence
  Description of Artificial Sequence: Synthetic oligonucleotide
ugcauugcaaucauccuuauu

SEQ ID NO: 21675 - RNA, 21 nt, Artificial Sequence
  Description of Artificial Sequence: Synthetic oligonucleotide
gcauugcaaucauccuuuauu

SEQ ID NO: 21676 - RNA, 21 nt, Artificial Sequence
  Description of Artificial Sequence: Synthetic oligonucleotide
cauugcaaucauccuuuuauu

SEQ ID NO: 21677 - RNA, 21 nt, Artificial Sequence
  Description of Artificial Sequence: Synthetic oligonucleotide
auugcaaucauccuuuucauu

SEQ ID NO: 21678 - RNA, 21 nt, Artificial Sequence
  Description of Artificial Sequence: Synthetic oligonucleotide
uugcaaucauccuuuucuauu

SEQ ID NO: 21679 - RNA, 21 nt, Artificial Sequence
  Description of Artificial Sequence: Synthetic oligonucleotide
ugcaaucauccuuuucuuauu

SEQ ID NO: 21680 - RNA, 21 nt, Artificial Sequence
  Description of Artificial Sequence: Synthetic oligonucleotide
gcaaucauccuuuucuuaauu

SEQ ID NO: 21681 - RNA, 21 nt, Artificial Sequence
  Description of Artificial Sequence: Synthetic oligonucleotide
caaucauccuuuucuuaaauu

SEQ ID NO: 21682 - RNA, 21 nt, Artificial Sequence
  Description of Artificial Sequence: Synthetic oligonucleotide
aaucauccuuuucuuaaaauu

SEQ ID NO: 21683 - RNA, 21 nt, Artificial Sequence
  Description of Artificial Sequence: Synthetic oligonucleotide
aucauccuuuucuuaaauauu

SEQ ID NO: 21684 - RNA, 21 nt, Artificial Sequence
  Description of Artificial Sequence: Synthetic oligonucleotide
ucauccuuuucuuaaauuauu

SEQ ID NO: 21685 - RNA, 21 nt, Artificial Sequence
  Description of Artificial Sequence: Synthetic oligonucleotide
cauccuuuucuuaaauuaauu

SEQ ID NO: 21686 - RNA, 21 nt, Artificial Sequence
  Description of Artificial Sequence: Synthetic oligonucleotide
auccuuuucuuaaauuauauu

SEQ ID NO: 21687 - RNA, 21 nt, Artificial Sequence
  Description of Artificial Sequence: Synthetic oligonucleotide
uccuuuucuuaaauuaugauu

SEQ ID NO: 21688 - RNA, 21 nt, Artificial Sequence
  Description of Artificial Sequence: Synthetic oligonucleotide
ccuuuucuuaaauuauguauu

SEQ ID NO: 21689 - RNA, 21 nt, Artificial Sequence
  Description of Artificial Sequence: Synthetic oligonucleotide
cuuuucuuaaauuaugucauu

SEQ ID NO: 21690 - RNA, 21 nt, Artificial Sequence
  Description of Artificial Sequence: Synthetic oligonucleotide
uuuucuuaaauuaugucaauu

SEQ ID NO: 21691 - RNA, 21 nt, Artificial Sequence
  Description of Artificial Sequence: Synthetic oligonucleotide
uuucuuaaauuaugucacauu

SEQ ID NO: 21692 - RNA, 21 nt, Artificial Sequence
  Description of Artificial Sequence: Synthetic oligonucleotide
uucuuaaauuaugucacuauu

SEQ ID NO: 21693 - RNA, 21 nt, Artificial Sequence
  Description of Artificial Sequence: Synthetic oligonucleotide
ucuuaaauuaugucacuaauu

SEQ ID NO: 21694 - RNA, 21 nt, Artificial Sequence
  Description of Artificial Sequence: Synthetic oligonucleotide
cuuaaauuaugucacuagauu

SEQ ID NO: 21695 - RNA, 21 nt, Artificial Sequence
  Description of Artificial Sequence: Synthetic oligonucleotide
uuaaauuaugucacuaguauu

SEQ ID NO: 21696 - RNA, 21 nt, Artificial Sequence
  Description of Artificial Sequence: Synthetic oligonucleotide
uaaauuaugucacuagucauu

SEQ ID NO: 21697 - RNA, 21 nt, Artificial Sequence
  Description of Artificial Sequence: Synthetic oligonucleotide
aaauuaugucacuagucuauu

SEQ ID NO: 21698 - RNA, 21 nt, Artificial Sequence
  Description of Artificial Sequence: Synthetic oligonucleotide
aauuaugucacuagucuuauu

SEQ ID NO: 21699 - RNA, 21 nt, Artificial Sequence
  Description of Artificial Sequence: Synthetic oligonucleotide
auuaugucacuagucuuuauu

SEQ ID NO: 21700 - RNA, 21 nt, Artificial Sequence
  Description of Artificial Sequence: Synthetic oligonucleotide
uuaugucacuagucuuuuauu

SEQ ID NO: 21701 - RNA, 21 nt, Artificial Sequence
  Description of Artificial Sequence: Synthetic oligonucleotide
uaugucacuagucuuuuaauu

SEQ ID NO: 21702 - RNA, 21 nt, Artificial Sequence
  Description of Artificial Sequence: Synthetic oligonucleotide
augucacuagucuuuuauauu

SEQ ID NO: 21703 - RNA, 21 nt, Artificial Sequence
  Description of Artificial Sequence: Synthetic oligonucleotide
ugucacuagucuuuuauuauu

SEQ ID NO: 21704 - RNA, 21 nt, Artificial Sequence
  Description of Artificial Sequence: Synthetic oligonucleotide
gucacuagucuuuuauuuauu

SEQ ID NO: 21705 - RNA, 21 nt, Artificial Sequence
  Description of Artificial Sequence: Synthetic oligonucleotide
ucacuagucuuuuauuuuauu

SEQ ID NO: 21706 - RNA, 21 nt, Artificial Sequence
  Description of Artificial Sequence: Synthetic oligonucleotide
cacuagucuuuuauuuuuauu

SEQ ID NO: 21707 - RNA, 21 nt, Artificial Sequence
  Description of Artificial Sequence: Synthetic oligonucleotide
acuagucuuuuauuuuuuauu

SEQ ID NO: 21708 - RNA, 21 nt, Artificial Sequence
  Description of Artificial Sequence: Synthetic oligonucleotide
cuagucuuuuauuuuuucauu

SEQ ID NO: 21709 - RNA, 21 nt, Artificial Sequence
  Description of Artificial Sequence: Synthetic oligonucleotide
uagucuuuuauuuuuuccauu

SEQ ID NO: 21710 - RNA, 21 nt, Artificial Sequence
  Description of Artificial Sequence: Synthetic oligonucleotide
agucuuuuauuuuuucccauu

SEQ ID NO: 21711 - RNA, 21 nt, Artificial Sequence
  Description of Artificial Sequence: Synthetic oligonucleotide
gucuuuuauuuuuuccccauu

SEQ ID NO: 21712 - RNA, 21 nt, Artificial Sequence
  Description of Artificial Sequence: Synthetic oligonucleotide
ucuuuuauuuuuuccccuauu

SEQ ID NO: 21713 - RNA, 21 nt, Artificial Sequence
  Description of Artificial Sequence: Synthetic oligonucleotide
cuuuuauuuuuuccccucauu

SEQ ID NO: 21714 - RNA, 21 nt, Artificial Sequence
  Description of Artificial Sequence: Synthetic oligonucleotide
uuuuauuuuuuccccucuauu

SEQ ID NO: 21715 - RNA, 21 nt, Artificial Sequence
  Description of Artificial Sequence: Synthetic oligonucleotide
uuuauuuuuuccccucuuauu

SEQ ID NO: 21716 - RNA, 21 nt, Artificial Sequence
  Description of Artificial Sequence: Synthetic oligonucleotide
uuauuuuuuccccucuugauu

SEQ ID NO: 21717 - RNA, 21 nt, Artificial Sequence
  Description of Artificial Sequence: Synthetic oligonucleotide
uauuuuuuccccucuugaauu

SEQ ID NO: 21718 - RNA, 21 nt, Artificial Sequence
  Description of Artificial Sequence: Synthetic oligonucleotide
auuuuuuccccucuugaaauu

SEQ ID NO: 21719 - RNA, 21 nt, Artificial Sequence
  Description of Artificial Sequence: Synthetic oligonucleotide
uuuuuuccccucuugaacauu

SEQ ID NO: 21720 - RNA, 21 nt, Artificial Sequence
  Description of Artificial Sequence: Synthetic oligonucleotide
uuuuuccccucuugaacuauu

SEQ ID NO: 21721 - RNA, 21 nt, Artificial Sequence
  Description of Artificial Sequence: Synthetic oligonucleotide
uuuuccccucuugaacuuauu

SEQ ID NO: 21722 - RNA, 21 nt, Artificial Sequence
  Description of Artificial Sequence: Synthetic oligonucleotide
uuuccccucuugaacuuuauu

SEQ ID NO: 21723 - RNA, 21 nt, Artificial Sequence
  Description of Artificial Sequence: Synthetic oligonucleotide
uuccccucuugaacuuucauu

SEQ ID NO: 21724 - RNA, 21 nt, Artificial Sequence
  Description of Artificial Sequence: Synthetic oligonucleotide
uccccucuugaacuuuccauu

SEQ ID NO: 21725 - RNA, 21 nt, Artificial Sequence
  Description of Artificial Sequence: Synthetic oligonucleotide
ccccucuugaacuuuccuauu

SEQ ID NO: 21726 - RNA, 21 nt, Artificial Sequence
  Description of Artificial Sequence: Synthetic oligonucleotide
cccucuugaacuuuccucauu

SEQ ID NO: 21727 - RNA, 21 nt, Artificial Sequence
  Description of Artificial Sequence: Synthetic oligonucleotide
ccucuugaacuuuccucaauu

SEQ ID NO: 21728 - RNA, 21 nt, Artificial Sequence
  Description of Artificial Sequence: Synthetic oligonucleotide
cucuugaacuuuccucacauu

SEQ ID NO: 21729 - RNA, 21 nt, Artificial Sequence
  Description of Artificial Sequence: Synthetic oligonucleotide
ucuugaacuuuccucacaauu

SEQ ID NO: 21730 - RNA, 21 nt, Artificial Sequence
  Description of Artificial Sequence: Synthetic oligonucleotide
cuugaacuuuccucacacauu

SEQ ID NO: 21731 - RNA, 21 nt, Artificial Sequence
  Description of Artificial Sequence: Synthetic oligonucleotide
uugaacuuuccucacaccauu

SEQ ID NO: 21732 - RNA, 21 nt, Artificial Sequence
  Description of Artificial Sequence: Synthetic oligonucleotide
ugaacuuuccucacaccuauu

SEQ ID NO: 21733 - RNA, 21 nt, Artificial Sequence
  Description of Artificial Sequence: Synthetic oligonucleotide
gaacuuuccucacaccugauu

SEQ ID NO: 21734 - RNA, 21 nt, Artificial Sequence
  Description of Artificial Sequence: Synthetic oligonucleotide
aacuuuccucacaccuggauu

SEQ ID NO: 21735 - RNA, 21 nt, Artificial Sequence
  Description of Artificial Sequence: Synthetic oligonucleotide
acuuuccucacaccuggaauu

SEQ ID NO: 21736 - RNA, 21 nt, Artificial Sequence
  Description of Artificial Sequence: Synthetic oligonucleotide
cuuuccucacaccuggaaauu

SEQ ID NO: 21737 - RNA, 21 nt, Artificial Sequence
  Description of Artificial Sequence: Synthetic oligonucleotide
uuuccucacaccuggaagauu

SEQ ID NO: 21738 - RNA, 21 nt, Artificial Sequence
  Description of Artificial Sequence: Synthetic oligonucleotide
uuccucacaccuggaagaauu

SEQ ID NO: 21739 - RNA, 21 nt, Artificial Sequence
  Description of Artificial Sequence: Synthetic oligonucleotide
uccucacaccuggaagaaauu

SEQ ID NO: 21740 - RNA, 21 nt, Artificial Sequence
  Description of Artificial Sequence: Synthetic oligonucleotide
ccucacaccuggaagaaaauu

SEQ ID NO: 21741 - RNA, 21 nt, Artificial Sequence
  Description of Artificial Sequence: Synthetic oligonucleotide
cucacaccuggaagaaacauu

SEQ ID NO: 21742 - RNA, 21 nt, Artificial Sequence
  Description of Artificial Sequence: Synthetic oligonucleotide
ucacaccuggaagaaacaauu

SEQ ID NO: 21743 - RNA, 21 nt, Artificial Sequence
  Description of Artificial Sequence: Synthetic oligonucleotide
cacaccuggaagaaacaaauu

SEQ ID NO: 21744 - RNA, 21 nt, Artificial Sequence
  Description of Artificial Sequence: Synthetic oligonucleotide
acaccuggaagaaacaaaauu

SEQ ID NO: 21745 - RNA, 21 nt, Artificial Sequence
  Description of Artificial Sequence: Synthetic oligonucleotide
caccuggaagaaacaaagauu

SEQ ID NO: 21746 - RNA, 21 nt, Artificial Sequence
  Description of Artificial Sequence: Synthetic oligonucleotide
accuggaagaaacaaaguauu

SEQ ID NO: 21747 - RNA, 21 nt, Artificial Sequence
  Description of Artificial Sequence: Synthetic oligonucleotide
ccuggaagaaacaaaguaauu

SEQ ID NO: 21748 - RNA, 21 nt, Artificial Sequence
  Description of Artificial Sequence: Synthetic oligonucleotide
cuggaagaaacaaaguagauu

SEQ ID NO: 21749 - RNA, 21 nt, Artificial Sequence
  Description of Artificial Sequence: Synthetic oligonucleotide
uggaagaaacaaaguaggauu

SEQ ID NO: 21750 - RNA, 21 nt, Artificial Sequence
  Description of Artificial Sequence: Synthetic oligonucleotide
ggaagaaacaaaguaggaauu

SEQ ID NO: 21751 - RNA, 21 nt, Artificial Sequence
  Description of Artificial Sequence: Synthetic oligonucleotide
gaagaaacaaaguaggaaauu

SEQ ID NO: 21752 - RNA, 21 nt, Artificial Sequence
  Description of Artificial Sequence: Synthetic oligonucleotide
aagaaacaaaguaggaaaauu

SEQ ID NO: 21753 - RNA, 21 nt, Artificial Sequence
  Description of Artificial Sequence: Synthetic oligonucleotide
agaaacaaaguaggaaaaauu

SEQ ID NO: 21754 - RNA, 21 nt, Artificial Sequence
  Description of Artificial Sequence: Synthetic oligonucleotide
gaaacaaaguaggaaaaaauu

SEQ ID NO: 21755 - RNA, 21 nt, Artificial Sequence
  Description of Artificial Sequence: Synthetic oligonucleotide
aaacaaaguaggaaaaagauu

SEQ ID NO: 21756 - RNA, 21 nt, Artificial Sequence
  Description of Artificial Sequence: Synthetic oligonucleotide
aacaaaguaggaaaaaguauu

SEQ ID NO: 21757 - RNA, 21 nt, Artificial Sequence
  Description of Artificial Sequence: Synthetic oligonucleotide
acaaaguaggaaaaagugauu

SEQ ID NO: 21758 - RNA, 21 nt, Artificial Sequence
  Description of Artificial Sequence: Synthetic oligonucleotide
caaaguaggaaaaagugaauu

SEQ ID NO: 21759 - RNA, 21 nt, Artificial Sequence
  Description of Artificial Sequence: Synthetic oligonucleotide
aaaguaggaaaaagugaaauu

SEQ ID NO: 21760 - RNA, 21 nt, Artificial Sequence
  Description of Artificial Sequence: Synthetic oligonucleotide
aaguaggaaaaagugaacauu

SEQ ID NO: 21761 - RNA, 21 nt, Artificial Sequence
  Description of Artificial Sequence: Synthetic oligonucleotide
aguaggaaaaagugaacaauu

SEQ ID NO: 21762 - RNA, 21 nt, Artificial Sequence
  Description of Artificial Sequence: Synthetic oligonucleotide
guaggaaaaagugaacagauu

SEQ ID NO: 21763 - RNA, 21 nt, Artificial Sequence
  Description of Artificial Sequence: Synthetic oligonucleotide
uaggaaaaagugaacaggauu

SEQ ID NO: 21764 - RNA, 21 nt, Artificial Sequence
  Description of Artificial Sequence: Synthetic oligonucleotide
aggaaaaagugaacagggauu

SEQ ID NO: 21765 - RNA, 21 nt, Artificial Sequence
  Description of Artificial Sequence: Synthetic oligonucleotide
ggaaaaagugaacaggggauu

SEQ ID NO: 21766 - RNA, 21 nt, Artificial Sequence
  Description of Artificial Sequence: Synthetic oligonucleotide
gaaaaagugaacaggggaauu

SEQ ID NO: 21767 - RNA, 21 nt, Artificial Sequence
  Description of Artificial Sequence: Synthetic oligonucleotide
aaaaagugaacaggggauauu

SEQ ID NO: 21768 - RNA, 21 nt, Artificial Sequence
  Description of Artificial Sequence: Synthetic oligonucleotide
aaaagugaacaggggaugauu

SEQ ID NO: 21769 - RNA, 21 nt, Artificial Sequence
  Description of Artificial Sequence: Synthetic oligonucleotide
aaagugaacaggggauguauu

SEQ ID NO: 21770 - RNA, 21 nt, Artificial Sequence
  Description of Artificial Sequence: Synthetic oligonucleotide
aagugaacaggggaugucauu

SEQ ID NO: 21771 - RNA, 21 nt, Artificial Sequence
  Description of Artificial Sequence: Synthetic oligonucleotide
agugaacaggggaugucaauu

SEQ ID NO: 21772 - RNA, 21 nt, Artificial Sequence
  Description of Artificial Sequence: Synthetic oligonucleotide
gugaacaggggaugucaaauu

SEQ ID NO: 21773 - RNA, 21 nt, Artificial Sequence
  Description of Artificial Sequence: Synthetic oligonucleotide
ugaacaggggaugucaaaauu

SEQ ID NO: 21774 - RNA, 21 nt, Artificial Sequence
  Description of Artificial Sequence: Synthetic oligonucleotide
gaacaggggaugucaaauauu

SEQ ID NO: 21775 - RNA, 21 nt, Artificial Sequence
  Description of Artificial Sequence: Synthetic oligonucleotide
aacaggggaugucaaaucauu

SEQ ID NO: 21776 - RNA, 21 nt, Artificial Sequence
  Description of Artificial Sequence: Synthetic oligonucleotide
acaggggaugucaaaucgauu

SEQ ID NO: 21777 - RNA, 21 nt, Artificial Sequence
  Description of Artificial Sequence: Synthetic oligonucleotide
caggggaugucaaaucgaauu

SEQ ID NO: 21778 - RNA, 21 nt, Artificial Sequence
  Description of Artificial Sequence: Synthetic oligonucleotide
aggggaugucaaaucgauauu

SEQ ID NO: 21779 - RNA, 21 nt, Artificial Sequence
  Description of Artificial Sequence: Synthetic oligonucleotide
ggggaugucaaaucgauuauu

SEQ ID NO: 21780 - RNA, 21 nt, Artificial Sequence
  Description of Artificial Sequence: Synthetic oligonucleotide
gggaugucaaaucgauucauu

SEQ ID NO: 21781 - RNA, 21 nt, Artificial Sequence
  Description of Artificial Sequence: Synthetic oligonucleotide
ggaugucaaaucgauucuauu

SEQ ID NO: 21782 - RNA, 21 nt, Artificial Sequence
  Description of Artificial Sequence: Synthetic oligonucleotide
gaugucaaaucgauucuuauu

SEQ ID NO: 21783 - RNA, 21 nt, Artificial Sequence
  Description of Artificial Sequence: Synthetic oligonucleotide
augucaaaucgauucuugauu

SEQ ID NO: 21784 - RNA, 21 nt, Artificial Sequence
  Description of Artificial Sequence: Synthetic oligonucleotide
ugucaaaucgauucuugaauu

SEQ ID NO: 21785 - RNA, 21 nt, Artificial Sequence
  Description of Artificial Sequence: Synthetic oligonucleotide
gucaaaucgauucuugaaauu

SEQ ID NO: 21786 - RNA, 21 nt, Artificial Sequence
  Description of Artificial Sequence: Synthetic oligonucleotide
ucaaaucgauucuugaauauu

SEQ ID NO: 21787 - RNA, 21 nt, Artificial Sequence
  Description of Artificial Sequence: Synthetic oligonucleotide
caaaucgauucuugaauuauu

SEQ ID NO: 21788 - RNA, 21 nt, Artificial Sequence
  Description of Artificial Sequence: Synthetic oligonucleotide
aaaucgauucuugaauucauu

SEQ ID NO: 21789 - RNA, 21 nt, Artificial Sequence
  Description of Artificial Sequence: Synthetic oligonucleotide
aaucgauucuugaauuccauu

SEQ ID NO: 21790 - RNA, 21 nt, Artificial Sequence
  Description of Artificial Sequence: Synthetic oligonucleotide
aucgauucuugaauucccauu

SEQ ID NO: 21791 - RNA, 21 nt, Artificial Sequence
  Description of Artificial Sequence: Synthetic oligonucleotide
ucgauucuugaauucccgauu

SEQ ID NO: 21792 - RNA, 21 nt, Artificial Sequence
  Description of Artificial Sequence: Synthetic oligonucleotide
cgauucuugaauucccgcauu

SEQ ID NO: 21793 - RNA, 21 nt, Artificial Sequence
  Description of Artificial Sequence: Synthetic oligonucleotide
gauucuugaauucccgcuauu

SEQ ID NO: 21794 - RNA, 21 nt, Artificial Sequence
  Description of Artificial Sequence: Synthetic oligonucleotide
auucuugaauucccgcugauu

SEQ ID NO: 21795 - RNA, 21 nt, Artificial Sequence
  Description of Artificial Sequence: Synthetic oligonucleotide
uucuugaauucccgcugcauu

SEQ ID NO: 21796 - RNA, 21 nt, Artificial Sequence
  Description of Artificial Sequence: Synthetic oligonucleotide
ucuugaauucccgcugcaauu

SEQ ID NO: 21797 - RNA, 21 nt, Artificial Sequence
  Description of Artificial Sequence: Synthetic oligonucleotide
cuugaauucccgcugcaaauu

SEQ ID NO: 21798 - RNA, 21 nt, Artificial Sequence
  Description of Artificial Sequence: Synthetic oligonucleotide
uugaauucccgcugcaagauu

SEQ ID NO: 21799 - RNA, 21 nt, Artificial Sequence
  Description of Artificial Sequence: Synthetic oligonucleotide
ugaauucccgcugcaagcauu

SEQ ID NO: 21800 - RNA, 21 nt, Artificial Sequence
  Description of Artificial Sequence: Synthetic oligonucleotide
gaauucccgcugcaagcuauu

SEQ ID NO: 21801 - RNA, 21 nt, Artificial Sequence
  Description of Artificial Sequence: Synthetic oligonucleotide
aauucccgcugcaagcuaauu

SEQ ID NO: 21802 - RNA, 21 nt, Artificial Sequence
  Description of Artificial Sequence: Synthetic oligonucleotide
auucccgcugcaagcuagauu

SEQ ID NO: 21803 - RNA, 21 nt, Artificial Sequence
  Description of Artificial Sequence: Synthetic oligonucleotide
uucccgcugcaagcuagaauu

SEQ ID NO: 21804 - RNA, 21 nt, Artificial Sequence
  Description of Artificial Sequence: Synthetic oligonucleotide
ucccgcugcaagcuagagauu

SEQ ID NO: 21805 - RNA, 21 nt, Artificial Sequence
  Description of Artificial Sequence: Synthetic oligonucleotide
cccgcugcaagcuagagcauu

SEQ ID NO: 21806 - RNA, 21 nt, Artificial Sequence
  Description of Artificial Sequence: Synthetic oligonucleotide
ccgcugcaagcuagagccauu

SEQ ID NO: 21807 - RNA, 21 nt, Artificial Sequence
  Description of Artificial Sequence: Synthetic oligonucleotide
cgcugcaagcuagagccgauu

SEQ ID NO: 21808 - RNA, 21 nt, Artificial Sequence
  Description of Artificial Sequence: Synthetic oligonucleotide
gcugcaagcuagagccgcauu

SEQ ID NO: 21809 - RNA, 21 nt, Artificial Sequence
  Description of Artificial Sequence: Synthetic oligonucleotide
cugcaagcuagagccgcaauu

SEQ ID NO: 21810 - RNA, 21 nt, Artificial Sequence
  Description of Artificial Sequence: Synthetic oligonucleotide
ugcaagcuagagccgcagauu

SEQ ID NO: 21811 - RNA, 21 nt, Artificial Sequence
  Description of Artificial Sequence: Synthetic oligonucleotide
gcaagcuagagccgcaggauu

SEQ ID NO: 21812 - RNA, 21 nt, Artificial Sequence
  Description of Artificial Sequence: Synthetic oligonucleotide
caagcuagagccgcaggcauu

SEQ ID NO: 21813 - RNA, 21 nt, Artificial Sequence
  Description of Artificial Sequence: Synthetic oligonucleotide
aagcuagagccgcaggcaauu

SEQ ID NO: 21814 - RNA, 21 nt, Artificial Sequence
  Description of Artificial Sequence: Synthetic oligonucleotide
agcuagagccgcaggcacauu

SEQ ID NO: 21815 - RNA, 21 nt, Artificial Sequence
  Description of Artificial Sequence: Synthetic oligonucleotide
gcuagagccgcaggcaccauu

SEQ ID NO: 21816 - RNA, 21 nt, Artificial Sequence
  Description of Artificial Sequence: Synthetic oligonucleotide
cuagagccgcaggcacccauu

SEQ ID NO: 21817 - RNA, 21 nt, Artificial Sequence
  Description of Artificial Sequence: Synthetic oligonucleotide
uagagccgcaggcacccuauu

SEQ ID NO: 21818 - RNA, 21 nt, Artificial Sequence
  Description of Artificial Sequence: Synthetic oligonucleotide
agagccgcaggcacccucauu

SEQ ID NO: 21819 - RNA, 21 nt, Artificial Sequence
  Description of Artificial Sequence: Synthetic oligonucleotide
gagccgcaggcacccucuauu

SEQ ID NO: 21820 - RNA, 21 nt, Artificial Sequence
  Description of Artificial Sequence: Synthetic oligonucleotide
agccgcaggcacccucucauu

SEQ ID NO: 21821 - RNA, 21 nt, Artificial Sequence
  Description of Artificial Sequence: Synthetic oligonucleotide
gccgcaggcacccucucaauu

SEQ ID NO: 21822 - RNA, 21 nt, Artificial Sequence
  Description of Artificial Sequence: Synthetic oligonucleotide
ccgcaggcacccucucacauu

SEQ ID NO: 21823 - RNA, 21 nt, Artificial Sequence
  Description of Artificial Sequence: Synthetic oligonucleotide
cgcaggcacccucucacuauu

SEQ ID NO: 21824 - RNA, 21 nt, Artificial Sequence
  Description of Artificial Sequence: Synthetic oligonucleotide
gcaggcacccucucacucauu

SEQ ID NO: 21825 - RNA, 21 nt, Artificial Sequence
  Description of Artificial Sequence: Synthetic oligonucleotide
caggcacccucucacucaauu

SEQ ID NO: 21826 - RNA, 21 nt, Artificial Sequence
  Description of Artificial Sequence: Synthetic oligonucleotide
aggcacccucucacucaaauu

SEQ ID NO: 21827 - RNA, 21 nt, Artificial Sequence
  Description of Artificial Sequence: Synthetic oligonucleotide
ggcacccucucacucaauauu

SEQ ID NO: 21828 - RNA, 21 nt, Artificial Sequence
  Description of Artificial Sequence: Synthetic oligonucleotide
gcacccucucacucaauuauu

SEQ ID NO: 21829 - RNA, 21 nt, Artificial Sequence
  Description of Artificial Sequence: Synthetic oligonucleotide
cacccucucacucaauuuauu

SEQ ID NO: 21830 - RNA, 21 nt, Artificial Sequence
  Description of Artificial Sequence: Synthetic oligonucleotide
acccucucacucaauuucauu

SEQ ID NO: 21831 - RNA, 21 nt, Artificial Sequence
  Description of Artificial Sequence: Synthetic oligonucleotide
cccucucacucaauuuccauu

SEQ ID NO: 21832 - RNA, 21 nt, Artificial Sequence
  Description of Artificial Sequence: Synthetic oligonucleotide
ccucucacucaauuuccaauu

SEQ ID NO: 21833 - RNA, 21 nt, Artificial Sequence
  Description of Artificial Sequence: Synthetic oligonucleotide
cucucacucaauuuccacauu

SEQ ID NO: 21834 - RNA, 21 nt, Artificial Sequence
  Description of Artificial Sequence: Synthetic oligonucleotide
ucucacucaauuuccacuauu

SEQ ID NO: 21835 - RNA, 21 nt, Artificial Sequence
  Description of Artificial Sequence: Synthetic oligonucleotide
cucacucaauuuccacucauu

SEQ ID NO: 21836 - RNA, 21 nt, Artificial Sequence
  Description of Artificial Sequence: Synthetic oligonucleotide
ucacucaauuuccacucaauu

SEQ ID NO: 21837 - RNA, 21 nt, Artificial Sequence
  Description of Artificial Sequence: Synthetic oligonucleotide
cacucaauuuccacucagauu

SEQ ID NO: 21838 - RNA, 21 nt, Artificial Sequence
  Description of Artificial Sequence: Synthetic oligonucleotide
acucaauuuccacucagaauu

SEQ ID NO: 21839 - RNA, 21 nt, Artificial Sequence
  Description of Artificial Sequence: Synthetic oligonucleotide
cucaauuuccacucagaaauu

SEQ ID NO: 21840 - RNA, 21 nt, Artificial Sequence
  Description of Artificial Sequence: Synthetic oligonucleotide
ucaauuuccacucagaacauu

SEQ ID NO: 21841 - RNA, 21 nt, Artificial Sequence
  Description of Artificial Sequence: Synthetic oligonucleotide
caauuuccacucagaaccauu

SEQ ID NO: 21842 - RNA, 21 nt, Artificial Sequence
  Description of Artificial Sequence: Synthetic oligonucleotide
aauuuccacucagaacccauu

SEQ ID NO: 21843 - RNA, 21 nt, Artificial Sequence
  Description of Artificial Sequence: Synthetic oligonucleotide
auuuccacucagaacccuauu

SEQ ID NO: 21844 - RNA, 21 nt, Artificial Sequence
  Description of Artificial Sequence: Synthetic oligonucleotide
uuuccacucagaacccuaauu

SEQ ID NO: 21845 - RNA, 21 nt, Artificial Sequence
  Description of Artificial Sequence: Synthetic oligonucleotide
uuccacucagaacccuauauu

SEQ ID NO: 21846 - RNA, 21 nt, Artificial Sequence
  Description of Artificial Sequence: Synthetic oligonucleotide
uccacucagaacccuauaauu

SEQ ID NO: 21847 - RNA, 21 nt, Artificial Sequence
  Description of Artificial Sequence: Synthetic oligonucleotide
ccacucagaacccuauaaauu

SEQ ID NO: 21848 - RNA, 21 nt, Artificial Sequence
  Description of Artificial Sequence: Synthetic oligonucleotide
cacucagaacccuauaaaauu

SEQ ID NO: 21849 - RNA, 21 nt, Artificial Sequence
  Description of Artificial Sequence: Synthetic oligonucleotide
acucagaacccuauaaacauu

SEQ ID NO: 21850 - RNA, 21 nt, Artificial Sequence
  Description of Artificial Sequence: Synthetic oligonucleotide
cucagaacccuauaaacaauu

SEQ ID NO: 21851 - RNA, 21 nt, Artificial Sequence
  Description of Artificial Sequence: Synthetic oligonucleotide
ucagaacccuauaaacacauu

SEQ ID NO: 21852 - RNA, 21 nt, Artificial Sequence
  Description of Artificial Sequence: Synthetic oligonucleotide
cagaacccuauaaacaccauu

SEQ ID NO: 21853 - RNA, 21 nt, Artificial Sequence
  Description of Artificial Sequence: Synthetic oligonucleotide
agaacccuauaaacaccaauu

SEQ ID NO: 21854 - RNA, 21 nt, Artificial Sequence
  Description of Artificial Sequence: Synthetic oligonucleotide
gaacccuauaaacaccagauu

SEQ ID NO: 21855 - RNA, 21 nt, Artificial Sequence
  Description of Artificial Sequence: Synthetic oligonucleotide
aacccuauaaacaccaguauu

SEQ ID NO: 21856 - RNA, 21 nt, Artificial Sequence
  Description of Artificial Sequence: Synthetic oligonucleotide
acccuauaaacaccagugauu

SEQ ID NO: 21857 - RNA, 21 nt, Artificial Sequence
  Description of Artificial Sequence: Synthetic oligonucleotide
cccuauaaacaccaguggauu

SEQ ID NO: 21858 - RNA, 21 nt, Artificial Sequence
  Description of Artificial Sequence: Synthetic oligonucleotide
ccuauaaacaccagugggauu

SEQ ID NO: 21859 - RNA, 21 nt, Artificial Sequence
  Description of Artificial Sequence: Synthetic oligonucleotide
cuauaaacaccagugggaauu

SEQ ID NO: 21860 - RNA, 21 nt, Artificial Sequence
  Description of Artificial Sequence: Synthetic oligonucleotide
uauaaacaccagugggaaauu

SEQ ID NO: 21861 - RNA, 21 nt, Artificial Sequence
  Description of Artificial Sequence: Synthetic oligonucleotide
auaaacaccagugggaagauu

SEQ ID NO: 21862 - RNA, 21 nt, Artificial Sequence
  Description of Artificial Sequence: Synthetic oligonucleotide
uaaacaccagugggaaggauu

SEQ ID NO: 21863 - RNA, 21 nt, Artificial Sequence
  Description of Artificial Sequence: Synthetic oligonucleotide
aaacaccagugggaagggauu

SEQ ID NO: 21864 - RNA, 21 nt, Artificial Sequence
  Description of Artificial Sequence: Synthetic oligonucleotide
aacaccagugggaagggcauu

SEQ ID NO: 21865 - RNA, 21 nt, Artificial Sequence
  Description of Artificial Sequence: Synthetic oligonucleotide
acaccagugggaagggcaauu

SEQ ID NO: 21866 - RNA, 21 nt, Artificial Sequence
  Description of Artificial Sequence: Synthetic oligonucleotide
caccagugggaagggcaaauu

SEQ ID NO: 21867 - RNA, 21 nt, Artificial Sequence
  Description of Artificial Sequence: Synthetic oligonucleotide
accagugggaagggcaacauu

SEQ ID NO: 21868 - RNA, 21 nt, Artificial Sequence
  Description of Artificial Sequence: Synthetic oligonucleotide
ccagugggaagggcaaccauu

SEQ ID NO: 21869 - RNA, 21 nt, Artificial Sequence
  Description of Artificial Sequence: Synthetic oligonucleotide
cagugggaagggcaacccauu

SEQ ID NO: 21870 - RNA, 21 nt, Artificial Sequence
  Description of Artificial Sequence: Synthetic oligonucleotide
agugggaagggcaacccaauu

SEQ ID NO: 21871 - RNA, 21 nt, Artificial Sequence
  Description of Artificial Sequence: Synthetic oligonucleotide
gugggaagggcaacccacauu

SEQ ID NO: 21872 - RNA, 21 nt, Artificial Sequence
  Description of Artificial Sequence: Synthetic oligonucleotide
ugggaagggcaacccacuauu

SEQ ID NO: 21873 - RNA, 21 nt, Artificial Sequence
  Description of Artificial Sequence: Synthetic oligonucleotide
gggaagggcaacccacugauu

SEQ ID NO: 21874 - RNA, 21 nt, Artificial Sequence
  Description of Artificial Sequence: Synthetic oligonucleotide
ggaagggcaacccacugcauu

SEQ ID NO: 21875 - RNA, 21 nt, Artificial Sequence
  Description of Artificial Sequence: Synthetic oligonucleotide
gaagggcaacccacugcaauu

SEQ ID NO: 21876 - RNA, 21 nt, Artificial Sequence
  Description of Artificial Sequence: Synthetic oligonucleotide
aagggcaacccacugcacauu

SEQ ID NO: 21877 - RNA, 21 nt, Artificial Sequence
  Description of Artificial Sequence: Synthetic oligonucleotide
agggcaacccacugcacgauu

SEQ ID NO: 21878 - RNA, 21 nt, Artificial Sequence
  Description of Artificial Sequence: Synthetic oligonucleotide
gggcaacccacugcacguauu

SEQ ID NO: 21879 - RNA, 21 nt, Artificial Sequence
  Description of Artificial Sequence: Synthetic oligonucleotide
ggcaacccacugcacgugauu

SEQ ID NO: 21880 - RNA, 21 nt, Artificial Sequence
  Description of Artificial Sequence: Synthetic oligonucleotide
gcaacccacugcacguggauu

SEQ ID NO: 21881 - RNA, 21 nt, Artificial Sequence
  Description of Artificial Sequence: Synthetic oligonucleotide
caacccacugcacgugggauu

SEQ ID NO: 21882 - RNA, 21 nt, Artificial Sequence
  Description of Artificial Sequence: Synthetic oligonucleotide
aacccacugcacgugggaauu

SEQ ID NO: 21883 - RNA, 21 nt, Artificial Sequence
  Description of Artificial Sequence: Synthetic oligonucleotide
acccacugcacgugggaaauu

SEQ ID NO: 21884 - RNA, 21 nt, Artificial Sequence
  Description of Artificial Sequence: Synthetic oligonucleotide
cccacugcacgugggaauauu

SEQ ID NO: 21885 - RNA, 21 nt, Artificial Sequence
  Description of Artificial Sequence: Synthetic oligonucleotide
ccacugcacgugggaaugauu

SEQ ID NO: 21886 - RNA, 21 nt, Artificial Sequence
  Description of Artificial Sequence: Synthetic oligonucleotide
cacugcacgugggaaugcauu

SEQ ID NO: 21887 - RNA, 21 nt, Artificial Sequence
  Description of Artificial Sequence: Synthetic oligonucleotide
acugcacgugggaaugcaauu

SEQ ID NO: 21888 - RNA, 21 nt, Artificial Sequence
  Description of Artificial Sequence: Synthetic oligonucleotide
cugcacgugggaaugcacauu

SEQ ID NO: 21889 - RNA, 21 nt, Artificial Sequence
  Description of Artificial Sequence: Synthetic oligonucleotide
ugcacgugggaaugcacuauu

SEQ ID NO: 21890 - RNA, 21 nt, Artificial Sequence
  Description of Artificial Sequence: Synthetic oligonucleotide
gcacgugggaaugcacugauu

SEQ ID NO: 21891 - RNA, 21 nt, Artificial Sequence
  Description of Artificial Sequence: Synthetic oligonucleotide
cacgugggaaugcacugaauu

SEQ ID NO: 21892 - RNA, 21 nt, Artificial Sequence
  Description of Artificial Sequence: Synthetic oligonucleotide
acgugggaaugcacugauauu

SEQ ID NO: 21893 - RNA, 21 nt, Artificial Sequence
  Description of Artificial Sequence: Synthetic oligonucleotide
cgugggaaugcacugauuauu

SEQ ID NO: 21894 - RNA, 21 nt, Artificial Sequence
  Description of Artificial Sequence: Synthetic oligonucleotide
gugggaaugcacugauuuauu

SEQ ID NO: 21895 - RNA, 21 nt, Artificial Sequence
  Description of Artificial Sequence: Synthetic oligonucleotide
ugggaaugcacugauuuuauu

SEQ ID NO: 21896 - RNA, 21 nt, Artificial Sequence
  Description of Artificial Sequence: Synthetic oligonucleotide
gggaaugcacugauuuuuauu

SEQ ID NO: 21897 - RNA, 21 nt, Artificial Sequence
  Description of Artificial Sequence: Synthetic oligonucleotide
ggaaugcacugauuuuucauu

SEQ ID NO: 21898 - RNA, 21 nt, Artificial Sequence
  Description of Artificial Sequence: Synthetic oligonucleotide
gaaugcacugauuuuuccauu

SEQ ID NO: 21899 - RNA, 21 nt, Artificial Sequence
  Description of Artificial Sequence: Synthetic oligonucleotide
aaugcacugauuuuuccuauu

SEQ ID NO: 21900 - RNA, 21 nt, Artificial Sequence
  Description of Artificial Sequence: Synthetic oligonucleotide
augcacugauuuuuccuaauu

SEQ ID NO: 21901 - RNA, 21 nt, Artificial Sequence
  Description of Artificial Sequence: Synthetic oligonucleotide
ugcacugauuuuuccuagauu

SEQ ID NO: 21902 - RNA, 21 nt, Artificial Sequence
  Description of Artificial Sequence: Synthetic oligonucleotide
gcacugauuuuuccuaggauu

SEQ ID NO: 21903 - RNA, 21 nt, Artificial Sequence
  Description of Artificial Sequence: Synthetic oligonucleotide
cacugauuuuuccuaggaauu

SEQ ID NO: 21904 - RNA, 21 nt, Artificial Sequence
  Description of Artificial Sequence: Synthetic oligonucleotide
acugauuuuuccuaggagauu

SEQ ID NO: 21905 - RNA, 21 nt, Artificial Sequence
  Description of Artificial Sequence: Synthetic oligonucleotide
cugauuuuuccuaggaguauu

SEQ ID NO: 21906 - RNA, 21 nt, Artificial Sequence
  Description of Artificial Sequence: Synthetic oligonucleotide
ugauuuuuccuaggaguaauu

SEQ ID NO: 21907 - RNA, 21 nt, Artificial Sequence
  Description of Artificial Sequence: Synthetic oligonucleotide
gauuuuuccuaggaguagauu

SEQ ID NO: 21908 - RNA, 21 nt, Artificial Sequence
  Description of Artificial Sequence: Synthetic oligonucleotide
auuuuuccuaggaguagaauu

SEQ ID NO: 21909 - RNA, 21 nt, Artificial Sequence
  Description of Artificial Sequence: Synthetic oligonucleotide
uuuuuccuaggaguagacauu

SEQ ID NO: 21910 - RNA, 21 nt, Artificial Sequence
  Description of Artificial Sequence: Synthetic oligonucleotide
uuuuccuaggaguagacaauu

SEQ ID NO: 21911 - RNA, 21 nt, Artificial Sequence
  Description of Artificial Sequence: Synthetic oligonucleotide
uuuccuaggaguagacauauu

SEQ ID NO: 21912 - RNA, 21 nt, Artificial Sequence
  Description of Artificial Sequence: Synthetic oligonucleotide
uuccuaggaguagacaugauu

SEQ ID NO: 21913 - RNA, 21 nt, Artificial Sequence
  Description of Artificial Sequence: Synthetic oligonucleotide
uccuaggaguagacauguauu

SEQ ID NO: 21914 - RNA, 21 nt, Artificial Sequence
  Description of Artificial Sequence: Synthetic oligonucleotide
ccuaggaguagacauguuauu

SEQ ID NO: 21915 - RNA, 21 nt, Artificial Sequence
  Description of Artificial Sequence: Synthetic oligonucleotide
cuaggaguagacauguucauu

SEQ ID NO: 21916 - RNA, 21 nt, Artificial Sequence
  Description of Artificial Sequence: Synthetic oligonucleotide
uaggaguagacauguuccauu

SEQ ID NO: 21917 - RNA, 21 nt, Artificial Sequence
  Description of Artificial Sequence: Synthetic oligonucleotide
aggaguagacauguuccuauu

SEQ ID NO: 21918 - RNA, 21 nt, Artificial Sequence
  Description of Artificial Sequence: Synthetic oligonucleotide
ggaguagacauguuccucauu

SEQ ID NO: 21919 - RNA, 21 nt, Artificial Sequence
  Description of Artificial Sequence: Synthetic oligonucleotide
gaguagacauguuccucuauu

SEQ ID NO: 21920 - RNA, 21 nt, Artificial Sequence
  Description of Artificial Sequence: Synthetic oligonucleotide
aguagacauguuccucuaauu

SEQ ID NO: 21921 - RNA, 21 nt, Artificial Sequence
  Description of Artificial Sequence: Synthetic oligonucleotide
guagacauguuccucuaaauu

SEQ ID NO: 21922 - RNA, 21 nt, Artificial Sequence
  Description of Artificial Sequence: Synthetic oligonucleotide
uagacauguuccucuaauauu

SEQ ID NO: 21923 - RNA, 21 nt, Artificial Sequence
  Description of Artificial Sequence: Synthetic oligonucleotide
agacauguuccucuaauuauu

SEQ ID NO: 21924 - RNA, 21 nt, Artificial Sequence
  Description of Artificial Sequence: Synthetic oligonucleotide
gacauguuccucuaauuaauu

SEQ ID NO: 21925 - RNA, 21 nt, Artificial Sequence
  Description of Artificial Sequence: Synthetic oligonucleotide
acauguuccucuaauuacauu

SEQ ID NO: 21926 - RNA, 21 nt, Artificial Sequence
  Description of Artificial Sequence: Synthetic oligonucleotide
cauguuccucuaauuacuauu

SEQ ID NO: 21927 - RNA, 21 nt, Artificial Sequence
  Description of Artificial Sequence: Synthetic oligonucleotide
auguuccucuaauuacucauu

SEQ ID NO: 21928 - RNA, 21 nt, Artificial Sequence
  Description of Artificial Sequence: Synthetic oligonucleotide
uguuccucuaauuacuccauu

SEQ ID NO: 21929 - RNA, 21 nt, Artificial Sequence
  Description of Artificial Sequence: Synthetic oligonucleotide
guuccucuaauuacucccauu

SEQ ID NO: 21930 - RNA, 21 nt, Artificial Sequence
  Description of Artificial Sequence: Synthetic oligonucleotide
uuccucuaauuacucccuauu

SEQ ID NO: 21931 - RNA, 21 nt, Artificial Sequence
  Description of Artificial Sequence: Synthetic oligonucleotide
uccucuaauuacucccugauu

SEQ ID NO: 21932 - RNA, 21 nt, Artificial Sequence
  Description of Artificial Sequence: Synthetic oligonucleotide
ccucuaauuacucccugaauu

SEQ ID NO: 21933 - RNA, 21 nt, Artificial Sequence
  Description of Artificial Sequence: Synthetic oligonucleotide
cucuaauuacucccugagauu

SEQ ID NO: 21934 - RNA, 21 nt, Artificial Sequence
  Description of Artificial Sequence: Synthetic oligonucleotide
ucuaauuacucccugaggauu

SEQ ID NO: 21935 - RNA, 21 nt, Artificial Sequence
  Description of Artificial Sequence: Synthetic oligonucleotide
cuaauuacucccugagggauu

SEQ ID NO: 21936 - RNA, 21 nt, Artificial Sequence
  Description of Artificial Sequence: Synthetic oligonucleotide
uaauuacucccugaggguauu

SEQ ID NO: 21937 - RNA, 21 nt, Artificial Sequence
  Description of Artificial Sequence: Synthetic oligonucleotide
aauuacucccugaggguuauu

SEQ ID NO: 21938 - RNA, 21 nt, Artificial Sequence
  Description of Artificial Sequence: Synthetic oligonucleotide
auuacucccugaggguuaauu

SEQ ID NO: 21939 - RNA, 21 nt, Artificial Sequence
  Description of Artificial Sequence: Synthetic oligonucleotide
uuacucccugaggguuagauu

SEQ ID NO: 21940 - RNA, 21 nt, Artificial Sequence
  Description of Artificial Sequence: Synthetic oligonucleotide
uacucccugaggguuaguauu

SEQ ID NO: 21941 - RNA, 21 nt, Artificial Sequence
  Description of Artificial Sequence: Synthetic oligonucleotide
acucccugaggguuaguuauu

SEQ ID NO: 21942 - RNA, 21 nt, Artificial Sequence
  Description of Artificial Sequence: Synthetic oligonucleotide
cucccugaggguuaguugauu

SEQ ID NO: 21943 - RNA, 21 nt, Artificial Sequence
  Description of Artificial Sequence: Synthetic oligonucleotide
ucccugaggguuaguuggauu

SEQ ID NO: 21944 - RNA, 21 nt, Artificial Sequence
  Description of Artificial Sequence: Synthetic oligonucleotide
cccugaggguuaguugggauu

SEQ ID NO: 21945 - RNA, 21 nt, Artificial Sequence
  Description of Artificial Sequence: Synthetic oligonucleotide
ccugaggguuaguuggggauu

SEQ ID NO: 21946 - RNA, 21 nt, Artificial Sequence
  Description of Artificial Sequence: Synthetic oligonucleotide
cugaggguuaguuggggcauu

SEQ ID NO: 21947 - RNA, 21 nt, Artificial Sequence
  Description of Artificial Sequence: Synthetic oligonucleotide
ugaggguuaguuggggcuauu

SEQ ID NO: 21948 - RNA, 21 nt, Artificial Sequence
  Description of Artificial Sequence: Synthetic oligonucleotide
gaggguuaguuggggcuaauu

SEQ ID NO: 21949 - RNA, 21 nt, Artificial Sequence
  Description of Artificial Sequence: Synthetic oligonucleotide
aggguuaguuggggcuaaauu

SEQ ID NO: 21950 - RNA, 21 nt, Artificial Sequence
  Description of Artificial Sequence: Synthetic oligonucleotide
ggguuaguuggggcuaaaauu

SEQ ID NO: 21951 - RNA, 21 nt, Artificial Sequence
  Description of Artificial Sequence: Synthetic oligonucleotide
gguuaguuggggcuaaacauu

SEQ ID NO: 21952 - RNA, 21 nt, Artificial Sequence
  Description of Artificial Sequence: Synthetic oligonucleotide
guuaguuggggcuaaaccauu

SEQ ID NO: 21953 - RNA, 21 nt, Artificial Sequence
  Description of Artificial Sequence: Synthetic oligonucleotide
uuaguuggggcuaaaccaauu

SEQ ID NO: 21954 - RNA, 21 nt, Artificial Sequence
  Description of Artificial Sequence: Synthetic oligonucleotide
uaguuggggcuaaaccauauu

SEQ ID NO: 21955 - RNA, 21 nt, Artificial Sequence
  Description of Artificial Sequence: Synthetic oligonucleotide
aguuggggcuaaaccaugauu

SEQ ID NO: 21956 - RNA, 21 nt, Artificial Sequence
  Description of Artificial Sequence: Synthetic oligonucleotide
guuggggcuaaaccaugaauu

SEQ ID NO: 21957 - RNA, 21 nt, Artificial Sequence
  Description of Artificial Sequence: Synthetic oligonucleotide
uuggggcuaaaccaugacauu

SEQ ID NO: 21958 - RNA, 21 nt, Artificial Sequence
  Description of Artificial Sequence: Synthetic oligonucleotide
uggggcuaaaccaugacaauu

SEQ ID NO: 21959 - RNA, 21 nt, Artificial Sequence
  Description of Artificial Sequence: Synthetic oligonucleotide
ggggcuaaaccaugacagauu

SEQ ID NO: 21960 - RNA, 21 nt, Artificial Sequence
  Description of Artificial Sequence: Synthetic oligonucleotide
gggcuaaaccaugacagaauu

SEQ ID NO: 21961 - RNA, 21 nt, Artificial Sequence
  Description of Artificial Sequence: Synthetic oligonucleotide
ggcuaaaccaugacagaaauu

SEQ ID NO: 21962 - RNA, 21 nt, Artificial Sequence
  Description of Artificial Sequence: Synthetic oligonucleotide
gcuaaaccaugacagaagauu

SEQ ID NO: 21963 - RNA, 21 nt, Artificial Sequence
  Description of Artificial Sequence: Synthetic oligonucleotide
cuaaaccaugacagaaguauu

SEQ ID NO: 21964 - RNA, 21 nt, Artificial Sequence
  Description of Artificial Sequence: Synthetic oligonucleotide
uaaaccaugacagaagugauu

SEQ ID NO: 21965 - RNA, 21 nt, Artificial Sequence
  Description of Artificial Sequence: Synthetic oligonucleotide
aaaccaugacagaaguggauu

SEQ ID NO: 21966 - RNA, 21 nt, Artificial Sequence
  Description of Artificial Sequence: Synthetic oligonucleotide
aaccaugacagaagugggauu

SEQ ID NO: 21967 - RNA, 21 nt, Artificial Sequence
  Description of Artificial Sequence: Synthetic oligonucleotide
accaugacagaaguggggauu

SEQ ID NO: 21968 - RNA, 21 nt, Artificial Sequence
  Description of Artificial Sequence: Synthetic oligonucleotide
ccaugacagaaguggggaauu

SEQ ID NO: 21969 - RNA, 21 nt, Artificial Sequence
  Description of Artificial Sequence: Synthetic oligonucleotide
caugacagaaguggggaaauu

SEQ ID NO: 21970 - RNA, 21 nt, Artificial Sequence
  Description of Artificial Sequence: Synthetic oligonucleotide
augacagaaguggggaagauu

SEQ ID NO: 21971 - RNA, 21 nt, Artificial Sequence
  Description of Artificial Sequence: Synthetic oligonucleotide
ugacagaaguggggaaguauu

SEQ ID NO: 21972 - RNA, 21 nt, Artificial Sequence
  Description of Artificial Sequence: Synthetic oligonucleotide
gacagaaguggggaaguuauu

SEQ ID NO: 21973 - RNA, 21 nt, Artificial Sequence
  Description of Artificial Sequence: Synthetic oligonucleotide
acagaaguggggaaguucauu

SEQ ID NO: 21974 - RNA, 21 nt, Artificial Sequence
  Description of Artificial Sequence: Synthetic oligonucleotide
cagaaguggggaaguucaauu

SEQ ID NO: 21975 - RNA, 21 nt, Artificial Sequence
  Description of Artificial Sequence: Synthetic oligonucleotide
agaaguggggaaguucaaauu

SEQ ID NO: 21976 - RNA, 21 nt, Artificial Sequence
  Description of Artificial Sequence: Synthetic oligonucleotide
gaaguggggaaguucaauauu

SEQ ID NO: 21977 - RNA, 21 nt, Artificial Sequence
  Description of Artificial Sequence: Synthetic oligonucleotide
aaguggggaaguucaaugauu

SEQ ID NO: 21978 - RNA, 21 nt, Artificial Sequence
  Description of Artificial Sequence: Synthetic oligonucleotide
aguggggaaguucaauguauu

SEQ ID NO: 21979 - RNA, 21 nt, Artificial Sequence
  Description of Artificial Sequence: Synthetic oligonucleotide
guggggaaguucaaugucauu

SEQ ID NO: 21980 - RNA, 21 nt, Artificial Sequence
  Description of Artificial Sequence: Synthetic oligonucleotide
uggggaaguucaauguccauu

SEQ ID NO: 21981 - RNA, 21 nt, Artificial Sequence
  Description of Artificial Sequence: Synthetic oligonucleotide
ggggaaguucaauguccuauu

SEQ ID NO: 21982 - RNA, 21 nt, Artificial Sequence
  Description of Artificial Sequence: Synthetic oligonucleotide
gggaaguucaauguccuuauu

SEQ ID NO: 21983 - RNA, 21 nt, Artificial Sequence
  Description of Artificial Sequence: Synthetic oligonucleotide
ggaaguucaauguccuuaauu

SEQ ID NO: 21984 - RNA, 21 nt, Artificial Sequence
  Description of Artificial Sequence: Synthetic oligonucleotide
gaaguucaauguccuuaaauu

SEQ ID NO: 21985 - RNA, 21 nt, Artificial Sequence
  Description of Artificial Sequence: Synthetic oligonucleotide
aaguucaauguccuuaaaauu

SEQ ID NO: 21986 - RNA, 21 nt, Artificial Sequence
  Description of Artificial Sequence: Synthetic oligonucleotide
aguucaauguccuuaaauauu

SEQ ID NO: 21987 - RNA, 21 nt, Artificial Sequence
  Description of Artificial Sequence: Synthetic oligonucleotide
guucaauguccuuaaaucauu

SEQ ID NO: 21988 - RNA, 21 nt, Artificial Sequence
  Description of Artificial Sequence: Synthetic oligonucleotide
uucaauguccuuaaauccauu

SEQ ID NO: 21989 - RNA, 21 nt, Artificial Sequence
  Description of Artificial Sequence: Synthetic oligonucleotide
ucaauguccuuaaauccaauu

SEQ ID NO: 21990 - RNA, 21 nt, Artificial Sequence
  Description of Artificial Sequence: Synthetic oligonucleotide
caauguccuuaaauccauauu

SEQ ID NO: 21991 - RNA, 21 nt, Artificial Sequence
  Description of Artificial Sequence: Synthetic oligonucleotide
aauguccuuaaauccaucauu

SEQ ID NO: 21992 - RNA, 21 nt, Artificial Sequence
  Description of Artificial Sequence: Synthetic oligonucleotide
auguccuuaaauccaucuauu

SEQ ID NO: 21993 - RNA, 21 nt, Artificial Sequence
  Description of Artificial Sequence: Synthetic oligonucleotide
uguccuuaaauccaucuuauu

SEQ ID NO: 21994 - RNA, 21 nt, Artificial Sequence
  Description of Artificial Sequence: Synthetic oligonucleotide
guccuuaaauccaucuuaauu

SEQ ID NO: 21995 - RNA, 21 nt, Artificial Sequence
  Description of Artificial Sequence: Synthetic oligonucleotide
uccuuaaauccaucuuacauu

SEQ ID NO: 21996 - RNA, 21 nt, Artificial Sequence
  Description of Artificial Sequence: Synthetic oligonucleotide
ccuuaaauccaucuuacuauu

SEQ ID NO: 21997 - RNA, 21 nt, Artificial Sequence
  Description of Artificial Sequence: Synthetic oligonucleotide
cuuaaauccaucuuacuuauu

SEQ ID NO: 21998 - RNA, 21 nt, Artificial Sequence
  Description of Artificial Sequence: Synthetic oligonucleotide
uuaaauccaucuuacuugauu

SEQ ID NO: 21999 - RNA, 21 nt, Artificial Sequence
  Description of Artificial Sequence: Synthetic oligonucleotide
uaaauccaucuuacuugcauu

SEQ ID NO: 22000 - RNA, 21 nt, Artificial Sequence
  Description of Artificial Sequence: Synthetic oligonucleotide
aaauccaucuuacuugccauu

SEQ ID NO: 22001 - RNA, 21 nt, Artificial Sequence
  Description of Artificial Sequence: Synthetic oligonucleotide
aauccaucuuacuugccaauu

SEQ ID NO: 22002 - RNA, 21 nt, Artificial Sequence
  Description of Artificial Sequence: Synthetic oligonucleotide
auccaucuuacuugccaaauu

SEQ ID NO: 22003 - RNA, 21 nt, Artificial Sequence
  Description of Artificial Sequence: Synthetic oligonucleotide
uccaucuuacuugccaacauu

SEQ ID NO: 22004 - RNA, 21 nt, Artificial Sequence
  Description of Artificial Sequence: Synthetic oligonucleotide
ccaucuuacuugccaacaauu

SEQ ID NO: 22005 - RNA, 21 nt, Artificial Sequence
  Description of Artificial Sequence: Synthetic oligonucleotide
caucuuacuugccaacagauu

SEQ ID NO: 22006 - RNA, 21 nt, Artificial Sequence
  Description of Artificial Sequence: Synthetic oligonucleotide
aucuuacuugccaacaggauu

SEQ ID NO: 22007 - RNA, 21 nt, Artificial Sequence
  Description of Artificial Sequence: Synthetic oligonucleotide
ucuuacuugccaacagguauu

SEQ ID NO: 22008 - RNA, 21 nt, Artificial Sequence
  Description of Artificial Sequence: Synthetic oligonucleotide
cuuacuugccaacagguaauu

SEQ ID NO: 22009 - RNA, 21 nt, Artificial Sequence
  Description of Artificial Sequence: Synthetic oligonucleotide
uuacuugccaacagguaaauu

SEQ ID NO: 22010 - RNA, 21 nt, Artificial Sequence
  Description of Artificial Sequence: Synthetic oligonucleotide
uacuugccaacagguaagauu

SEQ ID NO: 22011 - RNA, 21 nt, Artificial Sequence
  Description of Artificial Sequence: Synthetic oligonucleotide
acuugccaacagguaagaauu

SEQ ID NO: 22012 - RNA, 21 nt, Artificial Sequence
  Description of Artificial Sequence: Synthetic oligonucleotide
cuugccaacagguaagagauu

SEQ ID NO: 22013 - RNA, 21 nt, Artificial Sequence
  Description of Artificial Sequence: Synthetic oligonucleotide
uugccaacagguaagaggauu

SEQ ID NO: 22014 - RNA, 21 nt, Artificial Sequence
  Description of Artificial Sequence: Synthetic oligonucleotide
ugccaacagguaagaggaauu

SEQ ID NO: 22015 - RNA, 21 nt, Artificial Sequence
  Description of Artificial Sequence: Synthetic oligonucleotide
gccaacagguaagaggaaauu

SEQ ID NO: 22016 - RNA, 21 nt, Artificial Sequence
  Description of Artificial Sequence: Synthetic oligonucleotide
ccaacagguaagaggaagauu

SEQ ID NO: 22017 - RNA, 21 nt, Artificial Sequence
  Description of Artificial Sequence: Synthetic oligonucleotide
caacagguaagaggaagcauu

SEQ ID NO: 22018 - RNA, 21 nt, Artificial Sequence
  Description of Artificial Sequence: Synthetic oligonucleotide
aacagguaagaggaagcuauu

SEQ ID NO: 22019 - RNA, 21 nt, Artificial Sequence
  Description of Artificial Sequence: Synthetic oligonucleotide
acagguaagaggaagcuuauu

SEQ ID NO: 22020 - RNA, 21 nt, Artificial Sequence
  Description of Artificial Sequence: Synthetic oligonucleotide
cagguaagaggaagcuuaauu

SEQ ID NO: 22021 - RNA, 21 nt, Artificial Sequence
  Description of Artificial Sequence: Synthetic oligonucleotide
agguaagaggaagcuuacauu

SEQ ID NO: 22022 - RNA, 21 nt, Artificial Sequence
  Description of Artificial Sequence: Synthetic oligonucleotide
gguaagaggaagcuuacaauu

SEQ ID NO: 22023 - RNA, 21 nt, Artificial Sequence
  Description of Artificial Sequence: Synthetic oligonucleotide
guaagaggaagcuuacauauu

SEQ ID NO: 22024 - RNA, 21 nt, Artificial Sequence
  Description of Artificial Sequence: Synthetic oligonucleotide
uaagaggaagcuuacauuauu

SEQ ID NO: 22025 - RNA, 21 nt, Artificial Sequence
  Description of Artificial Sequence: Synthetic oligonucleotide
aagaggaagcuuacauuaauu

SEQ ID NO: 22026 - RNA, 21 nt, Artificial Sequence
  Description of Artificial Sequence: Synthetic oligonucleotide
agaggaagcuuacauuacauu

SEQ ID NO: 22027 - RNA, 21 nt, Artificial Sequence
  Description of Artificial Sequence: Synthetic oligonucleotide
gaggaagcuuacauuacaauu

SEQ ID NO: 22028 - RNA, 21 nt, Artificial Sequence
  Description of Artificial Sequence: Synthetic oligonucleotide
aggaagcuuacauuacauauu

SEQ ID NO: 22029 - RNA, 21 nt, Artificial Sequence
  Description of Artificial Sequence: Synthetic oligonucleotide
ggaagcuuacauuacaugauu

SEQ ID NO: 22030 - RNA, 21 nt, Artificial Sequence
  Description of Artificial Sequence: Synthetic oligonucleotide
gaagcuuacauuacauguauu

SEQ ID NO: 22031 - RNA, 21 nt, Artificial Sequence
  Description of Artificial Sequence: Synthetic oligonucleotide
aagcuuacauuacaugucauu

SEQ ID NO: 22032 - RNA, 21 nt, Artificial Sequence
  Description of Artificial Sequence: Synthetic oligonucleotide
agcuuacauuacauguccauu

SEQ ID NO: 22033 - RNA, 21 nt, Artificial Sequence
  Description of Artificial Sequence: Synthetic oligonucleotide
gcuuacauuacauguccaauu

SEQ ID NO: 22034 - RNA, 21 nt, Artificial Sequence
  Description of Artificial Sequence: Synthetic oligonucleotide
cuuacauuacauguccagauu

SEQ ID NO: 22035 - RNA, 21 nt, Artificial Sequence
  Description of Artificial Sequence: Synthetic oligonucleotide
uuacauuacauguccaguauu

SEQ ID NO: 22036 - RNA, 21 nt, Artificial Sequence
  Description of Artificial Sequence: Synthetic oligonucleotide
uacauuacauguccagucauu

SEQ ID NO: 22037 - RNA, 21 nt, Artificial Sequence
  Description of Artificial Sequence: Synthetic oligonucleotide
acauuacauguccaguccauu

SEQ ID NO: 22038 - RNA, 21 nt, Artificial Sequence
  Description of Artificial Sequence: Synthetic oligonucleotide
cauuacauguccaguccaauu

SEQ ID NO: 22039 - RNA, 21 nt, Artificial Sequence
  Description of Artificial Sequence: Synthetic oligonucleotide
auuacauguccaguccacauu

SEQ ID NO: 22040 - RNA, 21 nt, Artificial Sequence
  Description of Artificial Sequence: Synthetic oligonucleotide
uuacauguccaguccacaauu

SEQ ID NO: 22041 - RNA, 21 nt, Artificial Sequence
  Description of Artificial Sequence: Synthetic oligonucleotide
uacauguccaguccacauauu

SEQ ID NO: 22042 - RNA, 21 nt, Artificial Sequence
  Description of Artificial Sequence: Synthetic oligonucleotide
acauguccaguccacauuauu

SEQ ID NO: 22043 - RNA, 21 nt, Artificial Sequence
  Description of Artificial Sequence: Synthetic oligonucleotide
cauguccaguccacauuuauu

SEQ ID NO: 22044 - RNA, 21 nt, Artificial Sequence
  Description of Artificial Sequence: Synthetic oligonucleotide
auguccaguccacauuuaauu

SEQ ID NO: 22045 - RNA, 21 nt, Artificial Sequence
  Description of Artificial Sequence: Synthetic oligonucleotide
uguccaguccacauuuaaauu

SEQ ID NO: 22046 - RNA, 21 nt, Artificial Sequence
  Description of Artificial Sequence: Synthetic oligonucleotide
guccaguccacauuuaaaauu

SEQ ID NO: 22047 - RNA, 21 nt, Artificial Sequence
  Description of Artificial Sequence: Synthetic oligonucleotide
uccaguccacauuuaaagauu

SEQ ID NO: 22048 - RNA, 21 nt, Artificial Sequence
  Description of Artificial Sequence: Synthetic oligonucleotide
ccaguccacauuuaaagaauu

SEQ ID NO: 22049 - RNA, 21 nt, Artificial Sequence
  Description of Artificial Sequence: Synthetic oligonucleotide
caguccacauuuaaagagauu

SEQ ID NO: 22050 - RNA, 21 nt, Artificial Sequence
  Description of Artificial Sequence: Synthetic oligonucleotide
aguccacauuuaaagagcauu

SEQ ID NO: 22051 - RNA, 21 nt, Artificial Sequence
  Description of Artificial Sequence: Synthetic oligonucleotide
guccacauuuaaagagcaauu

SEQ ID NO: 22052 - RNA, 21 nt, Artificial Sequence
  Description of Artificial Sequence: Synthetic oligonucleotide
uccacauuuaaagagcacauu

SEQ ID NO: 22053 - RNA, 21 nt, Artificial Sequence
  Description of Artificial Sequence: Synthetic oligonucleotide
ccacauuuaaagagcacuauu

SEQ ID NO: 22054 - RNA, 21 nt, Artificial Sequence
  Description of Artificial Sequence: Synthetic oligonucleotide
cacauuuaaagagcacuuauu

SEQ ID NO: 22055 - RNA, 21 nt, Artificial Sequence
  Description of Artificial Sequence: Synthetic oligonucleotide
acauuuaaagagcacuuaauu

SEQ ID NO: 22056 - RNA, 21 nt, Artificial Sequence
  Description of Artificial Sequence: Synthetic oligonucleotide
cauuuaaagagcacuuacauu

SEQ ID NO: 22057 - RNA, 21 nt, Artificial Sequence
  Description of Artificial Sequence: Synthetic oligonucleotide
auuuaaagagcacuuacuauu

SEQ ID NO: 22058 - RNA, 21 nt, Artificial Sequence
  Description of Artificial Sequence: Synthetic oligonucleotide
uuuaaagagcacuuacugauu

SEQ ID NO: 22059 - RNA, 21 nt, Artificial Sequence
  Description of Artificial Sequence: Synthetic oligonucleotide
uuaaagagcacuuacuguauu

SEQ ID NO: 22060 - RNA, 21 nt, Artificial Sequence
  Description of Artificial Sequence: Synthetic oligonucleotide
uaaagagcacuuacugugauu

SEQ ID NO: 22061 - RNA, 21 nt, Artificial Sequence
  Description of Artificial Sequence: Synthetic oligonucleotide
aaagagcacuuacuguggauu

SEQ ID NO: 22062 - RNA, 21 nt, Artificial Sequence
  Description of Artificial Sequence: Synthetic oligonucleotide
aagagcacuuacuguggaauu

SEQ ID NO: 22063 - RNA, 21 nt, Artificial Sequence
  Description of Artificial Sequence: Synthetic oligonucleotide
agagcacuuacuguggaaauu

SEQ ID NO: 22064 - RNA, 21 nt, Artificial Sequence
  Description of Artificial Sequence: Synthetic oligonucleotide
gagcacuuacuguggaacauu

SEQ ID NO: 22065 - RNA, 21 nt, Artificial Sequence
  Description of Artificial Sequence: Synthetic oligonucleotide
agcacuuacuguggaacaauu

SEQ ID NO: 22066 - RNA, 21 nt, Artificial Sequence
  Description of Artificial Sequence: Synthetic oligonucleotide
gcacuuacuguggaacaaauu

SEQ ID NO: 22067 - RNA, 21 nt, Artificial Sequence
  Description of Artificial Sequence: Synthetic oligonucleotide
cacuuacuguggaacaagauu

SEQ ID NO: 22068 - RNA, 21 nt, Artificial Sequence
  Description of Artificial Sequence: Synthetic oligonucleotide
acuuacuguggaacaagcauu

SEQ ID NO: 22069 - RNA, 21 nt, Artificial Sequence
  Description of Artificial Sequence: Synthetic oligonucleotide
cuuacuguggaacaagccauu

SEQ ID NO: 22070 - RNA, 21 nt, Artificial Sequence
  Description of Artificial Sequence: Synthetic oligonucleotide
uuacuguggaacaagccuauu

SEQ ID NO: 22071 - RNA, 21 nt, Artificial Sequence
  Description of Artificial Sequence: Synthetic oligonucleotide
uacuguggaacaagccuuauu

SEQ ID NO: 22072 - RNA, 21 nt, Artificial Sequence
  Description of Artificial Sequence: Synthetic oligonucleotide
acuguggaacaagccuucauu

SEQ ID NO: 22073 - RNA, 21 nt, Artificial Sequence
  Description of Artificial Sequence: Synthetic oligonucleotide
cuguggaacaagccuucaauu

SEQ ID NO: 22074 - RNA, 21 nt, Artificial Sequence
  Description of Artificial Sequence: Synthetic oligonucleotide
uguggaacaagccuucagauu

SEQ ID NO: 22075 - RNA, 21 nt, Artificial Sequence
  Description of Artificial Sequence: Synthetic oligonucleotide
guggaacaagccuucagcauu

SEQ ID NO: 22076 - RNA, 21 nt, Artificial Sequence
  Description of Artificial Sequence: Synthetic oligonucleotide
uggaacaagccuucagccauu

SEQ ID NO: 22077 - RNA, 21 nt, Artificial Sequence
  Description of Artificial Sequence: Synthetic oligonucleotide
ggaacaagccuucagccaauu

SEQ ID NO: 22078 - RNA, 21 nt, Artificial Sequence
  Description of Artificial Sequence: Synthetic oligonucleotide
gaacaagccuucagccaaauu

SEQ ID NO: 22079 - RNA, 21 nt, Artificial Sequence
  Description of Artificial Sequence: Synthetic oligonucleotide
aacaagccuucagccaaaauu

SEQ ID NO: 22080 - RNA, 21 nt, Artificial Sequence
  Description of Artificial Sequence: Synthetic oligonucleotide
acaagccuucagccaaacauu

SEQ ID NO: 22081 - RNA, 21 nt, Artificial Sequence
  Description of Artificial Sequence: Synthetic oligonucleotide
caagccuucagccaaacaauu

SEQ ID NO: 22082 - RNA, 21 nt, Artificial Sequence
  Description of Artificial Sequence: Synthetic oligonucleotide
aagccuucagccaaacaaauu

SEQ ID NO: 22083 - RNA, 21 nt, Artificial Sequence
  Description of Artificial Sequence: Synthetic oligonucleotide
agccuucagccaaacaauauu

SEQ ID NO: 22084 - RNA, 21 nt, Artificial Sequence
  Description of Artificial Sequence: Synthetic oligonucleotide
gccuucagccaaacaaugauu

SEQ ID NO: 22085 - RNA, 21 nt, Artificial Sequence
  Description of Artificial Sequence: Synthetic oligonucleotide
ccuucagccaaacaauggauu

SEQ ID NO: 22086 - RNA, 21 nt, Artificial Sequence
  Description of Artificial Sequence: Synthetic oligonucleotide
cuucagccaaacaaugggauu

SEQ ID NO: 22087 - RNA, 21 nt, Artificial Sequence
  Description of Artificial Sequence: Synthetic oligonucleotide
uucagccaaacaauggggauu

SEQ ID NO: 22088 - RNA, 21 nt, Artificial Sequence
  Description of Artificial Sequence: Synthetic oligonucleotide
ucagccaaacaauggggaauu

SEQ ID NO: 22089 - RNA, 21 nt, Artificial Sequence
  Description of Artificial Sequence: Synthetic oligonucleotide
cagccaaacaauggggauauu

SEQ ID NO: 22090 - RNA, 21 nt, Artificial Sequence
  Description of Artificial Sequence: Synthetic oligonucleotide
agccaaacaauggggauaauu

SEQ ID NO: 22091 - RNA, 21 nt, Artificial Sequence
  Description of Artificial Sequence: Synthetic oligonucleotide
gccaaacaauggggauagauu

SEQ ID NO: 22092 - RNA, 21 nt, Artificial Sequence
  Description of Artificial Sequence: Synthetic oligonucleotide
ccaaacaauggggauagaauu

SEQ ID NO: 22093 - RNA, 21 nt, Artificial Sequence
  Description of Artificial Sequence: Synthetic oligonucleotide
caaacaauggggauagaaauu

SEQ ID NO: 22094 - RNA, 21 nt, Artificial Sequence
  Description of Artificial Sequence: Synthetic oligonucleotide
aaacaauggggauagaaaauu

SEQ ID NO: 22095 - RNA, 21 nt, Artificial Sequence
  Description of Artificial Sequence: Synthetic oligonucleotide
aacaauggggauagaaaaauu

SEQ ID NO: 22096 - RNA, 21 nt, Artificial Sequence
  Description of Artificial Sequence: Synthetic oligonucleotide
acaauggggauagaaaagauu

SEQ ID NO: 22097 - RNA, 21 nt, Artificial Sequence
  Description of Artificial Sequence: Synthetic oligonucleotide
caauggggauagaaaaguauu

SEQ ID NO: 22098 - RNA, 21 nt, Artificial Sequence
  Description of Artificial Sequence: Synthetic oligonucleotide
aauggggauagaaaaguaauu

SEQ ID NO: 22099 - RNA, 21 nt, Artificial Sequence
  Description of Artificial Sequence: Synthetic oligonucleotide
auggggauagaaaaguagauu

SEQ ID NO: 22100 - RNA, 21 nt, Artificial Sequence
  Description of Artificial Sequence: Synthetic oligonucleotide
uggggauagaaaaguaggauu

SEQ ID NO: 22101 - RNA, 21 nt, Artificial Sequence
  Description of Artificial Sequence: Synthetic oligonucleotide
ggggauagaaaaguagguauu

SEQ ID NO: 22102 - RNA, 21 nt, Artificial Sequence
  Description of Artificial Sequence: Synthetic oligonucleotide
gggauagaaaaguagguaauu

SEQ ID NO: 22103 - RNA, 21 nt, Artificial Sequence
  Description of Artificial Sequence: Synthetic oligonucleotide
ggauagaaaaguagguaaauu

SEQ ID NO: 22104 - RNA, 21 nt, Artificial Sequence
  Description of Artificial Sequence: Synthetic oligonucleotide
gauagaaaaguagguaagauu

SEQ ID NO: 22105 - RNA, 21 nt, Artificial Sequence
  Description of Artificial Sequence: Synthetic oligonucleotide
auagaaaaguagguaagaauu

SEQ ID NO: 22106 - RNA, 21 nt, Artificial Sequence
  Description of Artificial Sequence: Synthetic oligonucleotide
uagaaaaguagguaagacauu

SEQ ID NO: 22107 - RNA, 21 nt, Artificial Sequence
  Description of Artificial Sequence: Synthetic oligonucleotide
agaaaaguagguaagacuauu

SEQ ID NO: 22108 - RNA, 21 nt, Artificial Sequence
  Description of Artificial Sequence: Synthetic oligonucleotide
gaaaaguagguaagacucauu

SEQ ID NO: 22109 - RNA, 21 nt, Artificial Sequence
  Description of Artificial Sequence: Synthetic oligonucleotide
aaaaguagguaagacucaauu

SEQ ID NO: 22110 - RNA, 21 nt, Artificial Sequence
  Description of Artificial Sequence: Synthetic oligonucleotide
aaaguagguaagacucagauu

SEQ ID NO: 22111 - RNA, 21 nt, Artificial Sequence
  Description of Artificial Sequence: Synthetic oligonucleotide
aaguagguaagacucagcauu

SEQ ID NO: 22112 - RNA, 21 nt, Artificial Sequence
  Description of Artificial Sequence: Synthetic oligonucleotide
aguagguaagacucagccauu

SEQ ID NO: 22113 - RNA, 21 nt, Artificial Sequence
  Description of Artificial Sequence: Synthetic oligonucleotide
guagguaagacucagccuauu

SEQ ID NO: 22114 - RNA, 21 nt, Artificial Sequence
  Description of Artificial Sequence: Synthetic oligonucleotide
uagguaagacucagccuuauu

SEQ ID NO: 22115 - RNA, 21 nt, Artificial Sequence
  Description of Artificial Sequence: Synthetic oligonucleotide
agguaagacucagccuuuauu

SEQ ID NO: 22116 - RNA, 21 nt, Artificial Sequence
  Description of Artificial Sequence: Synthetic oligonucleotide
gguaagacucagccuuugauu

SEQ ID NO: 22117 - RNA, 21 nt, Artificial Sequence
  Description of Artificial Sequence: Synthetic oligonucleotide
guaagacucagccuuuguauu

SEQ ID NO: 22118 - RNA, 21 nt, Artificial Sequence
  Description of Artificial Sequence: Synthetic oligonucleotide
uaagacucagccuuugucauu

SEQ ID NO: 22119 - RNA, 21 nt, Artificial Sequence
  Description of Artificial Sequence: Synthetic oligonucleotide
aagacucagccuuuguccauu

SEQ ID NO: 22120 - RNA, 21 nt, Artificial Sequence
  Description of Artificial Sequence: Synthetic oligonucleotide
agacucagccuuuguccaauu

SEQ ID NO: 22121 - RNA, 21 nt, Artificial Sequence
  Description of Artificial Sequence: Synthetic oligonucleotide
gacucagccuuuguccagauu

SEQ ID NO: 22122 - RNA, 21 nt, Artificial Sequence
  Description of Artificial Sequence: Synthetic oligonucleotide
acucagccuuuguccagaauu

SEQ ID NO: 22123 - RNA, 21 nt, Artificial Sequence
  Description of Artificial Sequence: Synthetic oligonucleotide
cucagccuuuguccagagauu

SEQ ID NO: 22124 - RNA, 21 nt, Artificial Sequence
  Description of Artificial Sequence: Synthetic oligonucleotide
ucagccuuuguccagagaauu

SEQ ID NO: 22125 - RNA, 21 nt, Artificial Sequence
  Description of Artificial Sequence: Synthetic oligonucleotide
cagccuuuguccagagaaauu

SEQ ID NO: 22126 - RNA, 21 nt, Artificial Sequence
  Description of Artificial Sequence: Synthetic oligonucleotide
agccuuuguccagagaagauu

SEQ ID NO: 22127 - RNA, 21 nt, Artificial Sequence
  Description of Artificial Sequence: Synthetic oligonucleotide
gccuuuguccagagaagcauu

SEQ ID NO: 22128 - RNA, 21 nt, Artificial Sequence
  Description of Artificial Sequence: Synthetic oligonucleotide
ccuuuguccagagaagcuauu

SEQ ID NO: 22129 - RNA, 21 nt, Artificial Sequence
  Description of Artificial Sequence: Synthetic oligonucleotide
cuuuguccagagaagcucauu

SEQ ID NO: 22130 - RNA, 21 nt, Artificial Sequence
  Description of Artificial Sequence: Synthetic oligonucleotide
uuuguccagagaagcucaauu

SEQ ID NO: 22131 - RNA, 21 nt, Artificial Sequence
  Description of Artificial Sequence: Synthetic oligonucleotide
uuguccagagaagcucagauu

SEQ ID NO: 22132 - RNA, 21 nt, Artificial Sequence
  Description of Artificial Sequence: Synthetic oligonucleotide
uguccagagaagcucaggauu

SEQ ID NO: 22133 - RNA, 21 nt, Artificial Sequence
  Description of Artificial Sequence: Synthetic oligonucleotide
guccagagaagcucagggauu

SEQ ID NO: 22134 - RNA, 21 nt, Artificial Sequence
  Description of Artificial Sequence: Synthetic oligonucleotide
uccagagaagcucaggguauu

SEQ ID NO: 22135 - RNA, 21 nt, Artificial Sequence
  Description of Artificial Sequence: Synthetic oligonucleotide
ccagagaagcucaggguaauu

SEQ ID NO: 22136 - RNA, 21 nt, Artificial Sequence
  Description of Artificial Sequence: Synthetic oligonucleotide
cagagaagcucaggguauauu

SEQ ID NO: 22137 - RNA, 21 nt, Artificial Sequence
  Description of Artificial Sequence: Synthetic oligonucleotide
agagaagcucaggguauaauu

SEQ ID NO: 22138 - RNA, 21 nt, Artificial Sequence
  Description of Artificial Sequence: Synthetic oligonucleotide
gagaagcucaggguauagauu

SEQ ID NO: 22139 - RNA, 21 nt, Artificial Sequence
  Description of Artificial Sequence: Synthetic oligonucleotide
agaagcucaggguauagcauu

SEQ ID NO: 22140 - RNA, 21 nt, Artificial Sequence
  Description of Artificial Sequence: Synthetic oligonucleotide
gaagcucaggguauagcuauu

SEQ ID NO: 22141 - RNA, 21 nt, Artificial Sequence
  Description of Artificial Sequence: Synthetic oligonucleotide
aagcucaggguauagcugauu

SEQ ID NO: 22142 - RNA, 21 nt, Artificial Sequence
  Description of Artificial Sequence: Synthetic oligonucleotide
agcucaggguauagcugaauu

SEQ ID NO: 22143 - RNA, 21 nt, Artificial Sequence
  Description of Artificial Sequence: Synthetic oligonucleotide
gcucaggguauagcugaaauu

SEQ ID NO: 22144 - RNA, 21 nt, Artificial Sequence
  Description of Artificial Sequence: Synthetic oligonucleotide
cucaggguauagcugaauauu

SEQ ID NO: 22145 - RNA, 21 nt, Artificial Sequence
  Description of Artificial Sequence: Synthetic oligonucleotide
ucaggguauagcugaauaauu

SEQ ID NO: 22146 - RNA, 21 nt, Artificial Sequence
  Description of Artificial Sequence: Synthetic oligonucleotide
caggguauagcugaauagauu

SEQ ID NO: 22147 - RNA, 21 nt, Artificial Sequence
  Description of Artificial Sequence: Synthetic oligonucleotide
aggguauagcugaauaggauu

SEQ ID NO: 22148 - RNA, 21 nt, Artificial Sequence
  Description of Artificial Sequence: Synthetic oligonucleotide
ggguauagcugaauaggcauu

SEQ ID NO: 22149 - RNA, 21 nt, Artificial Sequence
  Description of Artificial Sequence: Synthetic oligonucleotide
gguauagcugaauaggcaauu

SEQ ID NO: 22150 - RNA, 21 nt, Artificial Sequence
  Description of Artificial Sequence: Synthetic oligonucleotide
guauagcugaauaggcagauu

SEQ ID NO: 22151 - RNA, 21 nt, Artificial Sequence
  Description of Artificial Sequence: Synthetic oligonucleotide
uauagcugaauaggcaguauu

SEQ ID NO: 22152 - RNA, 21 nt, Artificial Sequence
  Description of Artificial Sequence: Synthetic oligonucleotide
auagcugaauaggcaguuauu

SEQ ID NO: 22153 - RNA, 21 nt, Artificial Sequence
  Description of Artificial Sequence: Synthetic oligonucleotide
uagcugaauaggcaguuuauu

SEQ ID NO: 22154 - RNA, 21 nt, Artificial Sequence
  Description of Artificial Sequence: Synthetic oligonucleotide
agcugaauaggcaguuucauu

SEQ ID NO: 22155 - RNA, 21 nt, Artificial Sequence
  Description of Artificial Sequence: Synthetic oligonucleotide
gcugaauaggcaguuucuauu

SEQ ID NO: 22156 - RNA, 21 nt, Artificial Sequence
  Description of Artificial Sequence: Synthetic oligonucleotide
cugaauaggcaguuucuuauu

SEQ ID NO: 22157 - RNA, 21 nt, Artificial Sequence
  Description of Artificial Sequence: Synthetic oligonucleotide
ugaauaggcaguuucuuuauu

SEQ ID NO: 22158 - RNA, 21 nt, Artificial Sequence
  Description of Artificial Sequence: Synthetic oligonucleotide
gaauaggcaguuucuuuuauu

SEQ ID NO: 22159 - RNA, 21 nt, Artificial Sequence
  Description of Artificial Sequence: Synthetic oligonucleotide
aauaggcaguuucuuuugauu

SEQ ID NO: 22160 - RNA, 21 nt, Artificial Sequence
  Description of Artificial Sequence: Synthetic oligonucleotide
auaggcaguuucuuuuguauu

SEQ ID NO: 22161 - RNA, 21 nt, Artificial Sequence
  Description of Artificial Sequence: Synthetic oligonucleotide
uaggcaguuucuuuugucauu

SEQ ID NO: 22162 - RNA, 21 nt, Artificial Sequence
  Description of Artificial Sequence: Synthetic oligonucleotide
aggcaguuucuuuuguccauu

SEQ ID NO: 22163 - RNA, 21 nt, Artificial Sequence
  Description of Artificial Sequence: Synthetic oligonucleotide
ggcaguuucuuuuguccuauu

SEQ ID NO: 22164 - RNA, 21 nt, Artificial Sequence
  Description of Artificial Sequence: Synthetic oligonucleotide
gcaguuucuuuuguccugauu

SEQ ID NO: 22165 - RNA, 21 nt, Artificial Sequence
  Description of Artificial Sequence: Synthetic oligonucleotide
caguuucuuuuguccugaauu

SEQ ID NO: 22166 - RNA, 21 nt, Artificial Sequence
  Description of Artificial Sequence: Synthetic oligonucleotide
aguuucuuuuguccugagauu

SEQ ID NO: 22167 - RNA, 21 nt, Artificial Sequence
  Description of Artificial Sequence: Synthetic oligonucleotide
guuucuuuuguccugaggauu

SEQ ID NO: 22168 - RNA, 21 nt, Artificial Sequence
  Description of Artificial Sequence: Synthetic oligonucleotide
uuucuuuuguccugaggaauu

SEQ ID NO: 22169 - RNA, 21 nt, Artificial Sequence
  Description of Artificial Sequence: Synthetic oligonucleotide
uucuuuuguccugaggaaauu

SEQ ID NO: 22170 - RNA, 21 nt, Artificial Sequence
  Description of Artificial Sequence: Synthetic oligonucleotide
ucuuuuguccugaggaaaauu

SEQ ID NO: 22171 - RNA, 21 nt, Artificial Sequence
  Description of Artificial Sequence: Synthetic oligonucleotide
cuuuuguccugaggaaaaauu

SEQ ID NO: 22172 - RNA, 21 nt, Artificial Sequence
  Description of Artificial Sequence: Synthetic oligonucleotide
uuuuguccugaggaaaauauu

SEQ ID NO: 22173 - RNA, 21 nt, Artificial Sequence
  Description of Artificial Sequence: Synthetic oligonucleotide
uuuguccugaggaaaaucauu

SEQ ID NO: 22174 - RNA, 21 nt, Artificial Sequence
  Description of Artificial Sequence: Synthetic oligonucleotide
uuguccugaggaaaaucaauu

SEQ ID NO: 22175 - RNA, 21 nt, Artificial Sequence
  Description of Artificial Sequence: Synthetic oligonucleotide
uguccugaggaaaaucagauu

SEQ ID NO: 22176 - RNA, 21 nt, Artificial Sequence
  Description of Artificial Sequence: Synthetic oligonucleotide
guccugaggaaaaucaggauu

SEQ ID NO: 22177 - RNA, 21 nt, Artificial Sequence
  Description of Artificial Sequence: Synthetic oligonucleotide
uccugaggaaaaucaggaauu

SEQ ID NO: 22178 - RNA, 21 nt, Artificial Sequence
  Description of Artificial Sequence: Synthetic oligonucleotide
ccugaggaaaaucaggacauu

SEQ ID NO: 22179 - RNA, 21 nt, Artificial Sequence
  Description of Artificial Sequence: Synthetic oligonucleotide
cugaggaaaaucaggacaauu

SEQ ID NO: 22180 - RNA, 21 nt, Artificial Sequence
  Description of Artificial Sequence: Synthetic oligonucleotide
ugaggaaaaucaggacauauu

SEQ ID NO: 22181 - RNA, 21 nt, Artificial Sequence
  Description of Artificial Sequence: Synthetic oligonucleotide
gaggaaaaucaggacaugauu

SEQ ID NO: 22182 - RNA, 21 nt, Artificial Sequence
  Description of Artificial Sequence: Synthetic oligonucleotide
aggaaaaucaggacaugcauu

SEQ ID NO: 22183 - RNA, 21 nt, Artificial Sequence
  Description of Artificial Sequence: Synthetic oligonucleotide
ggaaaaucaggacaugccauu

SEQ ID NO: 22184 - RNA, 21 nt, Artificial Sequence
  Description of Artificial Sequence: Synthetic oligonucleotide
gaaaaucaggacaugccuauu

SEQ ID NO: 22185 - RNA, 21 nt, Artificial Sequence
  Description of Artificial Sequence: Synthetic oligonucleotide
aaaaucaggacaugccugauu

SEQ ID NO: 22186 - RNA, 21 nt, Artificial Sequence
  Description of Artificial Sequence: Synthetic oligonucleotide
aaaucaggacaugccugcauu

SEQ ID NO: 22187 - RNA, 21 nt, Artificial Sequence
  Description of Artificial Sequence: Synthetic oligonucleotide
aaucaggacaugccugcuauu

SEQ ID NO: 22188 - RNA, 21 nt, Artificial Sequence
  Description of Artificial Sequence: Synthetic oligonucleotide
aucaggacaugccugcuuauu

SEQ ID NO: 22189 - RNA, 21 nt, Artificial Sequence
  Description of Artificial Sequence: Synthetic oligonucleotide
ucaggacaugccugcuuuauu

SEQ ID NO: 22190 - RNA, 21 nt, Artificial Sequence
  Description of Artificial Sequence: Synthetic oligonucleotide
caggacaugccugcuuucauu

SEQ ID NO: 22191 - RNA, 21 nt, Artificial Sequence
  Description of Artificial Sequence: Synthetic oligonucleotide
aggacaugccugcuuucuauu

SEQ ID NO: 22192 - RNA, 21 nt, Artificial Sequence
  Description of Artificial Sequence: Synthetic oligonucleotide
ggacaugccugcuuucuaauu

SEQ ID NO: 22193 - RNA, 21 nt, Artificial Sequence
  Description of Artificial Sequence: Synthetic oligonucleotide
gacaugccugcuuucuaaauu

SEQ ID NO: 22194 - RNA, 21 nt, Artificial Sequence
  Description of Artificial Sequence: Synthetic oligonucleotide
acaugccugcuuucuaaaauu

SEQ ID NO: 22195 - RNA, 21 nt, Artificial Sequence
  Description of Artificial Sequence: Synthetic oligonucleotide
caugccugcuuucuaaaaauu

SEQ ID NO: 22196 - RNA, 21 nt, Artificial Sequence
  Description of Artificial Sequence: Synthetic oligonucleotide
augccugcuuucuaaaaaauu

SEQ ID NO: 22197 - RNA, 21 nt, Artificial Sequence
  Description of Artificial Sequence: Synthetic oligonucleotide
ugccugcuuucuaaaaauauu

SEQ ID NO: 22198 - RNA, 21 nt, Artificial Sequence
  Description of Artificial Sequence: Synthetic oligonucleotide
gccugcuuucuaaaaaucauu

SEQ ID NO: 22199 - RNA, 21 nt, Artificial Sequence
  Description of Artificial Sequence: Synthetic oligonucleotide
ccugcuuucuaaaaaucuauu

SEQ ID NO: 22200 - RNA, 21 nt, Artificial Sequence
  Description of Artificial Sequence: Synthetic oligonucleotide
cugcuuucuaaaaaucuuauu

SEQ ID NO: 22201 - RNA, 21 nt, Artificial Sequence
  Description of Artificial Sequence: Synthetic oligonucleotide
ugcuuucuaaaaaucuucauu

SEQ ID NO: 22202 - RNA, 21 nt, Artificial Sequence
  Description of Artificial Sequence: Synthetic oligonucleotide
gcuuucuaaaaaucuuccauu

SEQ ID NO: 22203 - RNA, 21 nt, Artificial Sequence
  Description of Artificial Sequence: Synthetic oligonucleotide
cuuucuaaaaaucuuccuauu

SEQ ID NO: 22204 - RNA, 21 nt, Artificial Sequence
  Description of Artificial Sequence: Synthetic oligonucleotide
uuucuaaaaaucuuccucauu

SEQ ID NO: 22205 - RNA, 21 nt, Artificial Sequence
  Description of Artificial Sequence: Synthetic oligonucleotide
uucuaaaaaucuuccucuauu

SEQ ID NO: 22206 - RNA, 21 nt, Artificial Sequence
  Description of Artificial Sequence: Synthetic oligonucleotide
ucuaaaaaucuuccucugauu

SEQ ID NO: 22207 - RNA, 21 nt, Artificial Sequence
  Description of Artificial Sequence: Synthetic oligonucleotide
cuaaaaaucuuccucugaauu

SEQ ID NO: 22208 - RNA, 21 nt, Artificial Sequence
  Description of Artificial Sequence: Synthetic oligonucleotide
uaaaaaucuuccucugaaauu

SEQ ID NO: 22209 - RNA, 21 nt, Artificial Sequence
  Description of Artificial Sequence: Synthetic oligonucleotide
aaaaaucuuccucugaagauu

SEQ ID NO: 22210 - RNA, 21 nt, Artificial Sequence
  Description of Artificial Sequence: Synthetic oligonucleotide
aaaaucuuccucugaagaauu

SEQ ID NO: 22211 - RNA, 21 nt, Artificial Sequence
  Description of Artificial Sequence: Synthetic oligonucleotide
aaaucuuccucugaagacauu

SEQ ID NO: 22212 - RNA, 21 nt, Artificial Sequence
  Description of Artificial Sequence: Synthetic oligonucleotide
aaucuuccucugaagaccauu

SEQ ID NO: 22213 - RNA, 21 nt, Artificial Sequence
  Description of Artificial Sequence: Synthetic oligonucleotide
aucuuccucugaagaccuauu

SEQ ID NO: 22214 - RNA, 21 nt, Artificial Sequence
  Description of Artificial Sequence: Synthetic oligonucleotide
ucuuccucugaagaccugauu

SEQ ID NO: 22215 - RNA, 21 nt, Artificial Sequence
  Description of Artificial Sequence: Synthetic oligonucleotide
cuuccucugaagaccugaauu

SEQ ID NO: 22216 - RNA, 21 nt, Artificial Sequence
  Description of Artificial Sequence: Synthetic oligonucleotide
uuccucugaagaccugacauu

SEQ ID NO: 22217 - RNA, 21 nt, Artificial Sequence
  Description of Artificial Sequence: Synthetic oligonucleotide
uccucugaagaccugaccauu

SEQ ID NO: 22218 - RNA, 21 nt, Artificial Sequence
  Description of Artificial Sequence: Synthetic oligonucleotide
ccucugaagaccugacccauu

SEQ ID NO: 22219 - RNA, 21 nt, Artificial Sequence
  Description of Artificial Sequence: Synthetic oligonucleotide
cucugaagaccugacccaauu

SEQ ID NO: 22220 - RNA, 21 nt, Artificial Sequence
  Description of Artificial Sequence: Synthetic oligonucleotide
ucugaagaccugacccaaauu

SEQ ID NO: 22221 - RNA, 21 nt, Artificial Sequence
  Description of Artificial Sequence: Synthetic oligonucleotide
cugaagaccugacccaagauu

SEQ ID NO: 22222 - RNA, 21 nt, Artificial Sequence
  Description of Artificial Sequence: Synthetic oligonucleotide
ugaagaccugacccaagcauu

SEQ ID NO: 22223 - RNA, 21 nt, Artificial Sequence
  Description of Artificial Sequence: Synthetic oligonucleotide
gaagaccugacccaagcuauu

SEQ ID NO: 22224 - RNA, 21 nt, Artificial Sequence
  Description of Artificial Sequence: Synthetic oligonucleotide
aagaccugacccaagcucauu

SEQ ID NO: 22225 - RNA, 21 nt, Artificial Sequence
  Description of Artificial Sequence: Synthetic oligonucleotide
agaccugacccaagcucuauu

SEQ ID NO: 22226 - RNA, 21 nt, Artificial Sequence
  Description of Artificial Sequence: Synthetic oligonucleotide
gaccugacccaagcucuuauu

SEQ ID NO: 22227 - RNA, 21 nt, Artificial Sequence
  Description of Artificial Sequence: Synthetic oligonucleotide
accugacccaagcucuuaauu

SEQ ID NO: 22228 - RNA, 21 nt, Artificial Sequence
  Description of Artificial Sequence: Synthetic oligonucleotide
ccugacccaagcucuuaaauu

SEQ ID NO: 22229 - RNA, 21 nt, Artificial Sequence
  Description of Artificial Sequence: Synthetic oligonucleotide
cugacccaagcucuuaaaauu

SEQ ID NO: 22230 - RNA, 21 nt, Artificial Sequence
  Description of Artificial Sequence: Synthetic oligonucleotide
ugacccaagcucuuaaauauu

SEQ ID NO: 22231 - RNA, 21 nt, Artificial Sequence
  Description of Artificial Sequence: Synthetic oligonucleotide
gacccaagcucuuaaaugauu

SEQ ID NO: 22232 - RNA, 21 nt, Artificial Sequence
  Description of Artificial Sequence: Synthetic oligonucleotide
acccaagcucuuaaaugcauu

SEQ ID NO: 22233 - RNA, 21 nt, Artificial Sequence
  Description of Artificial Sequence: Synthetic oligonucleotide
cccaagcucuuaaaugcuauu

SEQ ID NO: 22234 - RNA, 21 nt, Artificial Sequence
  Description of Artificial Sequence: Synthetic oligonucleotide
ccaagcucuuaaaugcuaauu

SEQ ID NO: 22235 - RNA, 21 nt, Artificial Sequence
  Description of Artificial Sequence: Synthetic oligonucleotide
caagcucuuaaaugcuauauu

SEQ ID NO: 22236 - RNA, 21 nt, Artificial Sequence
  Description of Artificial Sequence: Synthetic oligonucleotide
aagcucuuaaaugcuauuauu

SEQ ID NO: 22237 - RNA, 21 nt, Artificial Sequence
  Description of Artificial Sequence: Synthetic oligonucleotide
agcucuuaaaugcuauugauu

SEQ ID NO: 22238 - RNA, 21 nt, Artificial Sequence
  Description of Artificial Sequence: Synthetic oligonucleotide
gcucuuaaaugcuauuguauu

SEQ ID NO: 22239 - RNA, 21 nt, Artificial Sequence
  Description of Artificial Sequence: Synthetic oligonucleotide
cucuuaaaugcuauuguaauu

SEQ ID NO: 22240 - RNA, 21 nt, Artificial Sequence
  Description of Artificial Sequence: Synthetic oligonucleotide
ucuuaaaugcuauuguaaauu

SEQ ID NO: 22241 - RNA, 21 nt, Artificial Sequence
  Description of Artificial Sequence: Synthetic oligonucleotide
cuuaaaugcuauuguaagauu

SEQ ID NO: 22242 - RNA, 21 nt, Artificial Sequence
  Description of Artificial Sequence: Synthetic oligonucleotide
uuaaaugcuauuguaagaauu

SEQ ID NO: 22243 - RNA, 21 nt, Artificial Sequence
  Description of Artificial Sequence: Synthetic oligonucleotide
uaaaugcuauuguaagagauu

SEQ ID NO: 22244 - RNA, 21 nt, Artificial Sequence
  Description of Artificial Sequence: Synthetic oligonucleotide
aaaugcuauuguaagagaauu

SEQ ID NO: 22245 - RNA, 21 nt, Artificial Sequence
  Description of Artificial Sequence: Synthetic oligonucleotide
aaugcuauuguaagagaaauu

SEQ ID NO: 22246 - RNA, 21 nt, Artificial Sequence
  Description of Artificial Sequence: Synthetic oligonucleotide
augcuauuguaagagaaaauu

SEQ ID NO: 22247 - RNA, 21 nt, Artificial Sequence
  Description of Artificial Sequence: Synthetic oligonucleotide
ugcuauuguaagagaaauauu

SEQ ID NO: 22248 - RNA, 21 nt, Artificial Sequence
  Description of Artificial Sequence: Synthetic oligonucleotide
gcuauuguaagagaaauuauu

SEQ ID NO: 22249 - RNA, 21 nt, Artificial Sequence
  Description of Artificial Sequence: Synthetic oligonucleotide
cuauuguaagagaaauuuauu

SEQ ID NO: 22250 - RNA, 21 nt, Artificial Sequence
  Description of Artificial Sequence: Synthetic oligonucleotide
uauuguaagagaaauuucauu

SEQ ID NO: 22251 - RNA, 21 nt, Artificial Sequence
  Description of Artificial Sequence: Synthetic oligonucleotide
auuguaagagaaauuucuauu

SEQ ID NO: 22252 - RNA, 21 nt, Artificial Sequence
  Description of Artificial Sequence: Synthetic oligonucleotide
uuguaagagaaauuucuuauu

SEQ ID NO: 22253 - RNA, 21 nt, Artificial Sequence
  Description of Artificial Sequence: Synthetic oligonucleotide
uguaagagaaauuucuuuauu

SEQ ID NO: 22254 - RNA, 21 nt, Artificial Sequence
  Description of Artificial Sequence: Synthetic oligonucleotide
guaagagaaauuucuuugauu

SEQ ID NO: 22255 - RNA, 21 nt, Artificial Sequence
  Description of Artificial Sequence: Synthetic oligonucleotide
uaagagaaauuucuuuguauu

SEQ ID NO: 22256 - RNA, 21 nt, Artificial Sequence
  Description of Artificial Sequence: Synthetic oligonucleotide
aagagaaauuucuuugucauu

SEQ ID NO: 22257 - RNA, 21 nt, Artificial Sequence
  Description of Artificial Sequence: Synthetic oligonucleotide
agagaaauuucuuugucuauu

SEQ ID NO: 22258 - RNA, 21 nt, Artificial Sequence
  Description of Artificial Sequence: Synthetic oligonucleotide
gagaaauuucuuugucuaauu

SEQ ID NO: 22259 - RNA, 21 nt, Artificial Sequence
  Description of Artificial Sequence: Synthetic oligonucleotide
agaaauuucuuugucuauauu

SEQ ID NO: 22260 - RNA, 21 nt, Artificial Sequence
  Description of Artificial Sequence: Synthetic oligonucleotide
gaaauuucuuugucuauuauu

SEQ ID NO: 22261 - RNA, 21 nt, Artificial Sequence
  Description of Artificial Sequence: Synthetic oligonucleotide
aaauuucuuugucuauuaauu

SEQ ID NO: 22262 - RNA, 21 nt, Artificial Sequence
  Description of Artificial Sequence: Synthetic oligonucleotide
aauuucuuugucuauuaaauu

SEQ ID NO: 22263 - RNA, 21 nt, Artificial Sequence
  Description of Artificial Sequence: Synthetic oligonucleotide
auuucuuugucuauuaacauu

SEQ ID NO: 22264 - RNA, 21 nt, Artificial Sequence
  Description of Artificial Sequence: Synthetic oligonucleotide
uuucuuugucuauuaacuauu

SEQ ID NO: 22265 - RNA, 21 nt, Artificial Sequence
  Description of Artificial Sequence: Synthetic oligonucleotide
uucuuugucuauuaacucauu

SEQ ID NO: 22266 - RNA, 21 nt, Artificial Sequence
  Description of Artificial Sequence: Synthetic oligonucleotide
ucuuugucuauuaacuccauu

SEQ ID NO: 22267 - RNA, 21 nt, Artificial Sequence
  Description of Artificial Sequence: Synthetic oligonucleotide
cuuugucuauuaacuccaauu

SEQ ID NO: 22268 - RNA, 21 nt, Artificial Sequence
  Description of Artificial Sequence: Synthetic oligonucleotide
uuugucuauuaacuccauauu

SEQ ID NO: 22269 - RNA, 21 nt, Artificial Sequence
  Description of Artificial Sequence: Synthetic oligonucleotide
uugucuauuaacuccauuauu

SEQ ID NO: 22270 - RNA, 21 nt, Artificial Sequence
  Description of Artificial Sequence: Synthetic oligonucleotide
ugucuauuaacuccauuuauu

SEQ ID NO: 22271 - RNA, 21 nt, Artificial Sequence
  Description of Artificial Sequence: Synthetic oligonucleotide
gucuauuaacuccauuuuauu

SEQ ID NO: 22272 - RNA, 21 nt, Artificial Sequence
  Description of Artificial Sequence: Synthetic oligonucleotide
ucuauuaacuccauuuuaauu

SEQ ID NO: 22273 - RNA, 21 nt, Artificial Sequence
  Description of Artificial Sequence: Synthetic oligonucleotide
cuauuaacuccauuuuagauu

SEQ ID NO: 22274 - RNA, 21 nt, Artificial Sequence
  Description of Artificial Sequence: Synthetic oligonucleotide
uauuaacuccauuuuaguauu

SEQ ID NO: 22275 - RNA, 21 nt, Artificial Sequence
  Description of Artificial Sequence: Synthetic oligonucleotide
auuaacuccauuuuaguaauu

SEQ ID NO: 22276 - RNA, 21 nt, Artificial Sequence
  Description of Artificial Sequence: Synthetic oligonucleotide
uuaacuccauuuuaguagauu

SEQ ID NO: 22277 - RNA, 21 nt, Artificial Sequence
  Description of Artificial Sequence: Synthetic oligonucleotide
uaacuccauuuuaguaggauu

SEQ ID NO: 22278 - RNA, 21 nt, Artificial Sequence
  Description of Artificial Sequence: Synthetic oligonucleotide
aacuccauuuuaguagggauu

SEQ ID NO: 22279 - RNA, 21 nt, Artificial Sequence
  Description of Artificial Sequence: Synthetic oligonucleotide
acuccauuuuaguagggaauu

SEQ ID NO: 22280 - RNA, 21 nt, Artificial Sequence
  Description of Artificial Sequence: Synthetic oligonucleotide
cuccauuuuaguagggauauu

SEQ ID NO: 22281 - RNA, 21 nt, Artificial Sequence
  Description of Artificial Sequence: Synthetic oligonucleotide
uccauuuuaguagggauuauu

SEQ ID NO: 22282 - RNA, 21 nt, Artificial Sequence
  Description of Artificial Sequence: Synthetic oligonucleotide
ccauuuuaguagggauucauu

SEQ ID NO: 22283 - RNA, 21 nt, Artificial Sequence
  Description of Artificial Sequence: Synthetic oligonucleotide
cauuuuaguagggauucaauu

SEQ ID NO: 22284 - RNA, 21 nt, Artificial Sequence
  Description of Artificial Sequence: Synthetic oligonucleotide
auuuuaguagggauucacauu

SEQ ID NO: 22285 - RNA, 21 nt, Artificial Sequence
  Description of Artificial Sequence: Synthetic oligonucleotide
uuuuaguagggauucacuauu

SEQ ID NO: 22286 - RNA, 21 nt, Artificial Sequence
  Description of Artificial Sequence: Synthetic oligonucleotide
uuuaguagggauucacugauu

SEQ ID NO: 22287 - RNA, 21 nt, Artificial Sequence
  Description of Artificial Sequence: Synthetic oligonucleotide
uuaguagggauucacugaauu

SEQ ID NO: 22288 - RNA, 21 nt, Artificial Sequence
  Description of Artificial Sequence: Synthetic oligonucleotide
uaguagggauucacugacauu

SEQ ID NO: 22289 - RNA, 21 nt, Artificial Sequence
  Description of Artificial Sequence: Synthetic oligonucleotide
aguagggauucacugacuauu

SEQ ID NO: 22290 - RNA, 21 nt, Artificial Sequence
  Description of Artificial Sequence: Synthetic oligonucleotide
guagggauucacugacuaauu

SEQ ID NO: 22291 - RNA, 21 nt, Artificial Sequence
  Description of Artificial Sequence: Synthetic oligonucleotide
uagggauucacugacuagauu

SEQ ID NO: 22292 - RNA, 21 nt, Artificial Sequence
  Description of Artificial Sequence: Synthetic oligonucleotide
agggauucacugacuagaauu

SEQ ID NO: 22293 - RNA, 21 nt, Artificial Sequence
  Description of Artificial Sequence: Synthetic oligonucleotide
gggauucacugacuagauauu

SEQ ID NO: 22294 - RNA, 21 nt, Artificial Sequence
  Description of Artificial Sequence: Synthetic oligonucleotide
ggauucacugacuagauuauu

SEQ ID NO: 22295 - RNA, 21 nt, Artificial Sequence
  Description of Artificial Sequence: Synthetic oligonucleotide
gauucacugacuagauuuauu

SEQ ID NO: 22296 - RNA, 21 nt, Artificial Sequence
  Description of Artificial Sequence: Synthetic oligonucleotide
auucacugacuagauuuuauu

SEQ ID NO: 22297 - RNA, 21 nt, Artificial Sequence
  Description of Artificial Sequence: Synthetic oligonucleotide
uucacugacuagauuuuaauu

SEQ ID NO: 22298 - RNA, 21 nt, Artificial Sequence
  Description of Artificial Sequence: Synthetic oligonucleotide
ucacugacuagauuuuacauu

SEQ ID NO: 22299 - RNA, 21 nt, Artificial Sequence
  Description of Artificial Sequence: Synthetic oligonucleotide
cacugacuagauuuuacuauu

SEQ ID NO: 22300 - RNA, 21 nt, Artificial Sequence
  Description of Artificial Sequence: Synthetic oligonucleotide
acugacuagauuuuacugauu

SEQ ID NO: 22301 - RNA, 21 nt, Artificial Sequence
  Description of Artificial Sequence: Synthetic oligonucleotide
cugacuagauuuuacugaauu

SEQ ID NO: 22302 - RNA, 21 nt, Artificial Sequence
  Description of Artificial Sequence: Synthetic oligonucleotide
ugacuagauuuuacugaaauu

SEQ ID NO: 22303 - RNA, 21 nt, Artificial Sequence
  Description of Artificial Sequence: Synthetic oligonucleotide
gacuagauuuuacugaacauu

SEQ ID NO: 22304 - RNA, 21 nt, Artificial Sequence
  Description of Artificial Sequence: Synthetic oligonucleotide
acuagauuuuacugaacuauu

SEQ ID NO: 22305 - RNA, 21 nt, Artificial Sequence
  Description of Artificial Sequence: Synthetic oligonucleotide
cuagauuuuacugaacuaauu

SEQ ID NO: 22306 - RNA, 21 nt, Artificial Sequence
  Description of Artificial Sequence: Synthetic oligonucleotide
uagauuuuacugaacuauauu

SEQ ID NO: 22307 - RNA, 21 nt, Artificial Sequence
  Description of Artificial Sequence: Synthetic oligonucleotide
agauuuuacugaacuaugauu

SEQ ID NO: 22308 - RNA, 21 nt, Artificial Sequence
  Description of Artificial Sequence: Synthetic oligonucleotide
gauuuuacugaacuaugaauu

SEQ ID NO: 22309 - RNA, 21 nt, Artificial Sequence
  Description of Artificial Sequence: Synthetic oligonucleotide
auuuuacugaacuaugaaauu

SEQ ID NO: 22310 - RNA, 21 nt, Artificial Sequence
  Description of Artificial Sequence: Synthetic oligonucleotide
uuuuacugaacuaugaaaauu

SEQ ID NO: 22311 - RNA, 21 nt, Artificial Sequence
  Description of Artificial Sequence: Synthetic oligonucleotide
uuuacugaacuaugaaaaauu

SEQ ID NO: 22312 - RNA, 21 nt, Artificial Sequence
  Description of Artificial Sequence: Synthetic oligonucleotide
uuacugaacuaugaaaauauu

SEQ ID NO: 22313 - RNA, 21 nt, Artificial Sequence
  Description of Artificial Sequence: Synthetic oligonucleotide
uacugaacuaugaaaauaauu

SEQ ID NO: 22314 - RNA, 21 nt, Artificial Sequence
  Description of Artificial Sequence: Synthetic oligonucleotide
acugaacuaugaaaauaaauu

SEQ ID NO: 22315 - RNA, 21 nt, Artificial Sequence
  Description of Artificial Sequence: Synthetic oligonucleotide
cugaacuaugaaaauaaaauu

SEQ ID NO: 22316 - RNA, 21 nt, Artificial Sequence
  Description of Artificial Sequence: Synthetic oligonucleotide
ugaacuaugaaaauaaauauu

SEQ ID NO: 22317 - RNA, 21 nt, Artificial Sequence
  Description of Artificial Sequence: Synthetic oligonucleotide
gaacuaugaaaauaaauaauu

SEQ ID NO: 22318 - RNA, 21 nt, Artificial Sequence
  Description of Artificial Sequence: Synthetic oligonucleotide
aacuaugaaaauaaauacauu

SEQ ID NO: 22319 - RNA, 21 nt, Artificial Sequence
  Description of Artificial Sequence: Synthetic oligonucleotide
acuaugaaaauaaauacaauu

SEQ ID NO: 22320 - RNA, 21 nt, Artificial Sequence
  Description of Artificial Sequence: Synthetic oligonucleotide
cuaugaaaauaaauacacauu

SEQ ID NO: 22321 - RNA, 21 nt, Artificial Sequence
  Description of Artificial Sequence: Synthetic oligonucleotide
uaugaaaauaaauacacaauu

SEQ ID NO: 22322 - RNA, 21 nt, Artificial Sequence
  Description of Artificial Sequence: Synthetic oligonucleotide
augaaaauaaauacacauauu

SEQ ID NO: 22323 - RNA, 21 nt, Artificial Sequence
  Description of Artificial Sequence: Synthetic oligonucleotide
ugaaaauaaauacacauaauu

SEQ ID NO: 22324 - RNA, 21 nt, Artificial Sequence
  Description of Artificial Sequence: Synthetic oligonucleotide
gaaaauaaauacacauaaauu

SEQ ID NO: 22325 - RNA, 21 nt, Artificial Sequence
  Description of Artificial Sequence: Synthetic oligonucleotide
aaaauaaauacacauaauauu

SEQ ID NO: 22326 - RNA, 21 nt, Artificial Sequence
  Description of Artificial Sequence: Synthetic oligonucleotide
aaauaaauacacauaauuauu

SEQ ID NO: 22327 - RNA, 21 nt, Artificial Sequence
  Description of Artificial Sequence: Synthetic oligonucleotide
aauaaauacacauaauuuauu

SEQ ID NO: 22328 - RNA, 21 nt, Artificial Sequence
  Description of Artificial Sequence: Synthetic oligonucleotide
auaaauacacauaauuuuauu

SEQ ID NO: 22329 - RNA, 21 nt, Artificial Sequence
  Description of Artificial Sequence: Synthetic oligonucleotide
uaaauacacauaauuuuuauu

SEQ ID NO: 22330 - RNA, 21 nt, Artificial Sequence
  Description of Artificial Sequence: Synthetic oligonucleotide
aaauacacauaauuuuucauu

SEQ ID NO: 22331 - RNA, 21 nt, Artificial Sequence
  Description of Artificial Sequence: Synthetic oligonucleotide
aauacacauaauuuuucaauu

SEQ ID NO: 22332 - RNA, 21 nt, Artificial Sequence
  Description of Artificial Sequence: Synthetic oligonucleotide
auacacauaauuuuucacauu

SEQ ID NO: 22333 - RNA, 21 nt, Artificial Sequence
  Description of Artificial Sequence: Synthetic oligonucleotide
uacacauaauuuuucacaauu

SEQ ID NO: 22334 - RNA, 21 nt, Artificial Sequence
  Description of Artificial Sequence: Synthetic oligonucleotide
acacauaauuuuucacaaauu

SEQ ID NO: 22335 - RNA, 21 nt, Artificial Sequence
  Description of Artificial Sequence: Synthetic oligonucleotide
cacauaauuuuucacaaaauu

SEQ ID NO: 22336 - RNA, 21 nt, Artificial Sequence
  Description of Artificial Sequence: Synthetic oligonucleotide
acauaauuuuucacaaaaauu

SEQ ID NO: 22337 - RNA, 21 nt, Artificial Sequence
  Description of Artificial Sequence: Synthetic oligonucleotide
cauaauuuuucacaaaauauu

SEQ ID NO: 22338 - RNA, 21 nt, Artificial Sequence
  Description of Artificial Sequence: Synthetic oligonucleotide
auaauuuuucacaaaauuauu

SEQ ID NO: 22339 - RNA, 21 nt, Artificial Sequence
  Description of Artificial Sequence: Synthetic oligonucleotide
uaauuuuucacaaaauuuauu

SEQ ID NO: 22340 - RNA, 21 nt, Artificial Sequence
  Description of Artificial Sequence: Synthetic oligonucleotide
aauuuuucacaaaauuuuauu

SEQ ID NO: 22341 - RNA, 21 nt, Artificial Sequence
  Description of Artificial Sequence: Synthetic oligonucleotide
auuuuucacaaaauuuugauu

SEQ ID NO: 22342 - RNA, 21 nt, Artificial Sequence
  Description of Artificial Sequence: Synthetic oligonucleotide
uuuuucacaaaauuuuggauu

SEQ ID NO: 22343 - RNA, 21 nt, Artificial Sequence
  Description of Artificial Sequence: Synthetic oligonucleotide
uuuucacaaaauuuugggauu

SEQ ID NO: 22344 - RNA, 21 nt, Artificial Sequence
  Description of Artificial Sequence: Synthetic oligonucleotide
uuucacaaaauuuugggcauu

SEQ ID NO: 22345 - RNA, 21 nt, Artificial Sequence
  Description of Artificial Sequence: Synthetic oligonucleotide
uucacaaaauuuugggccauu

SEQ ID NO: 22346 - RNA, 21 nt, Artificial Sequence
  Description of Artificial Sequence: Synthetic oligonucleotide
ucacaaaauuuugggcccauu

SEQ ID NO: 22347 - RNA, 21 nt, Artificial Sequence
  Description of Artificial Sequence: Synthetic oligonucleotide
cacaaaauuuugggcccaauu

SEQ ID NO: 22348 - RNA, 21 nt, Artificial Sequence
  Description of Artificial Sequence: Synthetic oligonucleotide
acaaaauuuugggcccaaauu

SEQ ID NO: 22349 - RNA, 21 nt, Artificial Sequence
  Description of Artificial Sequence: Synthetic oligonucleotide
caaaauuuugggcccaauauu

SEQ ID NO: 22350 - RNA, 21 nt, Artificial Sequence
  Description of Artificial Sequence: Synthetic oligonucleotide
aaaauuuugggcccaauuauu

SEQ ID NO: 22351 - RNA, 21 nt, Artificial Sequence
  Description of Artificial Sequence: Synthetic oligonucleotide
aaauuuugggcccaauucauu

SEQ ID NO: 22352 - RNA, 21 nt, Artificial Sequence
  Description of Artificial Sequence: Synthetic oligonucleotide
aauuuugggcccaauuccauu

SEQ ID NO: 22353 - RNA, 21 nt, Artificial Sequence
  Description of Artificial Sequence: Synthetic oligonucleotide
auuuugggcccaauucccauu

SEQ ID NO: 22354 - RNA, 21 nt, Artificial Sequence
  Description of Artificial Sequence: Synthetic oligonucleotide
uuuugggcccaauuccccauu

SEQ ID NO: 22355 - RNA, 21 nt, Artificial Sequence
  Description of Artificial Sequence: Synthetic oligonucleotide
uuugggcccaauuccccuauu

SEQ ID NO: 22356 - RNA, 21 nt, Artificial Sequence
  Description of Artificial Sequence: Synthetic oligonucleotide
uugggcccaauuccccuaauu

SEQ ID NO: 22357 - RNA, 21 nt, Artificial Sequence
  Description of Artificial Sequence: Synthetic oligonucleotide
ugggcccaauuccccuaaauu

SEQ ID NO: 22358 - RNA, 21 nt, Artificial Sequence
  Description of Artificial Sequence: Synthetic oligonucleotide
gggcccaauuccccuaaaauu

SEQ ID NO: 22359 - RNA, 21 nt, Artificial Sequence
  Description of Artificial Sequence: Synthetic oligonucleotide
ggcccaauuccccuaaaaauu

SEQ ID NO: 22360 - RNA, 21 nt, Artificial Sequence
  Description of Artificial Sequence: Synthetic oligonucleotide
gcccaauuccccuaaaagauu

SEQ ID NO: 22361 - RNA, 21 nt, Artificial Sequence
  Description of Artificial Sequence: Synthetic oligonucleotide
cccaauuccccuaaaagaauu

SEQ ID NO: 22362 - RNA, 21 nt, Artificial Sequence
  Description of Artificial Sequence: Synthetic oligonucleotide
ccaauuccccuaaaagaaauu

SEQ ID NO: 22363 - RNA, 21 nt, Artificial Sequence
  Description of Artificial Sequence: Synthetic oligonucleotide
caauuccccuaaaagaauauu

SEQ ID NO: 22364 - RNA, 21 nt, Artificial Sequence
  Description of Artificial Sequence: Synthetic oligonucleotide
aauuccccuaaaagaauuauu

SEQ ID NO: 22365 - RNA, 21 nt, Artificial Sequence
  Description of Artificial Sequence: Synthetic oligonucleotide
auuccccuaaaagaauugauu

SEQ ID NO: 22366 - RNA, 21 nt, Artificial Sequence
  Description of Artificial Sequence: Synthetic oligonucleotide
uuccccuaaaagaauugaauu

SEQ ID NO: 22367 - RNA, 21 nt, Artificial Sequence
  Description of Artificial Sequence: Synthetic oligonucleotide
uccccuaaaagaauugagauu

SEQ ID NO: 22368 - RNA, 21 nt, Artificial Sequence
  Description of Artificial Sequence: Synthetic oligonucleotide
ccccuaaaagaauugaggauu

SEQ ID NO: 22369 - RNA, 21 nt, Artificial Sequence
  Description of Artificial Sequence: Synthetic oligonucleotide
cccuaaaagaauugaggaauu

SEQ ID NO: 22370 - RNA, 21 nt, Artificial Sequence
  Description of Artificial Sequence: Synthetic oligonucleotide
ccuaaaagaauugaggauauu

SEQ ID NO: 22371 - RNA, 21 nt, Artificial Sequence
  Description of Artificial Sequence: Synthetic oligonucleotide
cuaaaagaauugaggauuauu

SEQ ID NO: 22372 - RNA, 21 nt, Artificial Sequence
  Description of Artificial Sequence: Synthetic oligonucleotide
uaaaagaauugaggauuaauu

SEQ ID NO: 22373 - RNA, 21 nt, Artificial Sequence
  Description of Artificial Sequence: Synthetic oligonucleotide
aaaagaauugaggauuagauu

SEQ ID NO: 22374 - RNA, 21 nt, Artificial Sequence
  Description of Artificial Sequence: Synthetic oligonucleotide
aaagaauugaggauuaggauu

SEQ ID NO: 22375 - RNA, 21 nt, Artificial Sequence
  Description of Artificial Sequence: Synthetic oligonucleotide
aagaauugaggauuagggauu

SEQ ID NO: 22376 - RNA, 21 nt, Artificial Sequence
  Description of Artificial Sequence: Synthetic oligonucleotide
agaauugaggauuagggaauu

SEQ ID NO: 22377 - RNA, 21 nt, Artificial Sequence
  Description of Artificial Sequence: Synthetic oligonucleotide
gaauugaggauuagggagauu

SEQ ID NO: 22378 - RNA, 21 nt, Artificial Sequence
  Description of Artificial Sequence: Synthetic oligonucleotide
aauugaggauuagggagaauu

SEQ ID NO: 22379 - RNA, 21 nt, Artificial Sequence
  Description of Artificial Sequence: Synthetic oligonucleotide
auugaggauuagggagaaauu

SEQ ID NO: 22380 - RNA, 21 nt, Artificial Sequence
  Description of Artificial Sequence: Synthetic oligonucleotide
uugaggauuagggagaaaauu

SEQ ID NO: 22381 - RNA, 21 nt, Artificial Sequence
  Description of Artificial Sequence: Synthetic oligonucleotide
ugaggauuagggagaaagauu

SEQ ID NO: 22382 - RNA, 21 nt, Artificial Sequence
  Description of Artificial Sequence: Synthetic oligonucleotide
gaggauuagggagaaaggauu

SEQ ID NO: 22383 - RNA, 21 nt, Artificial Sequence
  Description of Artificial Sequence: Synthetic oligonucleotide
aggauuagggagaaaggaauu

SEQ ID NO: 22384 - RNA, 21 nt, Artificial Sequence
  Description of Artificial Sequence: Synthetic oligonucleotide
ggauuagggagaaaggagauu

SEQ ID NO: 22385 - RNA, 21 nt, Artificial Sequence
  Description of Artificial Sequence: Synthetic oligonucleotide
gauuagggagaaaggagaauu

SEQ ID NO: 22386 - RNA, 21 nt, Artificial Sequence
  Description of Artificial Sequence: Synthetic oligonucleotide
auuagggagaaaggagacauu

SEQ ID NO: 22387 - RNA, 21 nt, Artificial Sequence
  Description of Artificial Sequence: Synthetic oligonucleotide
uuagggagaaaggagacaauu

SEQ ID NO: 22388 - RNA, 21 nt, Artificial Sequence
  Description of Artificial Sequence: Synthetic oligonucleotide
uagggagaaaggagacaaauu

SEQ ID NO: 22389 - RNA, 21 nt, Artificial Sequence
  Description of Artificial Sequence: Synthetic oligonucleotide
agggagaaaggagacaacauu

SEQ ID NO: 22390 - RNA, 21 nt, Artificial Sequence
  Description of Artificial Sequence: Synthetic oligonucleotide
gggagaaaggagacaacuauu

SEQ ID NO: 22391 - RNA, 21 nt, Artificial Sequence
  Description of Artificial Sequence: Synthetic oligonucleotide
ggagaaaggagacaacucauu

SEQ ID NO: 22392 - RNA, 21 nt, Artificial Sequence
  Description of Artificial Sequence: Synthetic oligonucleotide
gagaaaggagacaacucaauu

SEQ ID NO: 22393 - RNA, 21 nt, Artificial Sequence
  Description of Artificial Sequence: Synthetic oligonucleotide
agaaaggagacaacucaaauu

SEQ ID NO: 22394 - RNA, 21 nt, Artificial Sequence
  Description of Artificial Sequence: Synthetic oligonucleotide
gaaaggagacaacucaaaauu

SEQ ID NO: 22395 - RNA, 21 nt, Artificial Sequence
  Description of Artificial Sequence: Synthetic oligonucleotide
aaaggagacaacucaaagauu

SEQ ID NO: 22396 - RNA, 21 nt, Artificial Sequence
  Description of Artificial Sequence: Synthetic oligonucleotide
aaggagacaacucaaaguauu

SEQ ID NO: 22397 - RNA, 21 nt, Artificial Sequence
  Description of Artificial Sequence: Synthetic oligonucleotide
aggagacaacucaaagucauu

SEQ ID NO: 22398 - RNA, 21 nt, Artificial Sequence
  Description of Artificial Sequence: Synthetic oligonucleotide
ggagacaacucaaagucaauu

SEQ ID NO: 22399 - RNA, 21 nt, Artificial Sequence
  Description of Artificial Sequence: Synthetic oligonucleotide
gagacaacucaaagucauauu

SEQ ID NO: 22400 - RNA, 21 nt, Artificial Sequence
  Description of Artificial Sequence: Synthetic oligonucleotide
agacaacucaaagucaucauu

SEQ ID NO: 22401 - RNA, 21 nt, Artificial Sequence
  Description of Artificial Sequence: Synthetic oligonucleotide
gacaacucaaagucauccauu

SEQ ID NO: 22402 - RNA, 21 nt, Artificial Sequence
  Description of Artificial Sequence: Synthetic oligonucleotide
acaacucaaagucaucccauu

SEQ ID NO: 22403 - RNA, 21 nt, Artificial Sequence
  Description of Artificial Sequence: Synthetic oligonucleotide
caacucaaagucaucccaauu

SEQ ID NO: 22404 - RNA, 21 nt, Artificial Sequence
  Description of Artificial Sequence: Synthetic oligonucleotide
aacucaaagucaucccauauu

SEQ ID NO: 22405 - RNA, 21 nt, Artificial Sequence
  Description of Artificial Sequence: Synthetic oligonucleotide
acucaaagucaucccauuauu

SEQ ID NO: 22406 - RNA, 21 nt, Artificial Sequence
  Description of Artificial Sequence: Synthetic oligonucleotide
cucaaagucaucccauuaauu

SEQ ID NO: 22407 - RNA, 21 nt, Artificial Sequence
  Description of Artificial Sequence: Synthetic oligonucleotide
ucaaagucaucccauuaaauu

SEQ ID NO: 22408 - RNA, 21 nt, Artificial Sequence
  Description of Artificial Sequence: Synthetic oligonucleotide
caaagucaucccauuaagauu

SEQ ID NO: 22409 - RNA, 21 nt, Artificial Sequence
  Description of Artificial Sequence: Synthetic oligonucleotide
aaagucaucccauuaaguauu

SEQ ID NO: 22410 - RNA, 21 nt, Artificial Sequence
  Description of Artificial Sequence: Synthetic oligonucleotide
aagucaucccauuaagugauu

SEQ ID NO: 22411 - RNA, 21 nt, Artificial Sequence
  Description of Artificial Sequence: Synthetic oligonucleotide
agucaucccauuaagugcauu

SEQ ID NO: 22412 - RNA, 21 nt, Artificial Sequence
  Description of Artificial Sequence: Synthetic oligonucleotide
gucaucccauuaagugcaauu

SEQ ID NO: 22413 - RNA, 21 nt, Artificial Sequence
  Description of Artificial Sequence: Synthetic oligonucleotide
ucaucccauuaagugcagauu

SEQ ID NO: 22414 - RNA, 21 nt, Artificial Sequence
  Description of Artificial Sequence: Synthetic oligonucleotide
caucccauuaagugcaguauu

SEQ ID NO: 22415 - RNA, 21 nt, Artificial Sequence
  Description of Artificial Sequence: Synthetic oligonucleotide
aucccauuaagugcaguuauu

SEQ ID NO: 22416 - RNA, 21 nt, Artificial Sequence
  Description of Artificial Sequence: Synthetic oligonucleotide
ucccauuaagugcaguuuauu

SEQ ID NO: 22417 - RNA, 21 nt, Artificial Sequence
  Description of Artificial Sequence: Synthetic oligonucleotide
cccauuaagugcaguuucauu

SEQ ID NO: 22418 - RNA, 21 nt, Artificial Sequence
  Description of Artificial Sequence: Synthetic oligonucleotide
ccauuaagugcaguuucuauu

SEQ ID NO: 22419 - RNA, 21 nt, Artificial Sequence
  Description of Artificial Sequence: Synthetic oligonucleotide
cauuaagugcaguuucuuauu

SEQ ID NO: 22420 - RNA, 21 nt, Artificial Sequence
  Description of Artificial Sequence: Synthetic oligonucleotide
auuaagugcaguuucuuuauu

SEQ ID NO: 22421 - RNA, 21 nt, Artificial Sequence
  Description of Artificial Sequence: Synthetic oligonucleotide
uuaagugcaguuucuuugauu

SEQ ID NO: 22422 - RNA, 21 nt, Artificial Sequence
  Description of Artificial Sequence: Synthetic oligonucleotide
uaagugcaguuucuuugaauu

SEQ ID NO: 22423 - RNA, 21 nt, Artificial Sequence
  Description of Artificial Sequence: Synthetic oligonucleotide
aagugcaguuucuuugaaauu

SEQ ID NO: 22424 - RNA, 21 nt, Artificial Sequence
  Description of Artificial Sequence: Synthetic oligonucleotide
agugcaguuucuuugaauauu

SEQ ID NO: 22425 - RNA, 21 nt, Artificial Sequence
  Description of Artificial Sequence: Synthetic oligonucleotide
gugcaguuucuuugaaucauu

SEQ ID NO: 22426 - RNA, 21 nt, Artificial Sequence
  Description of Artificial Sequence: Synthetic oligonucleotide
ugcaguuucuuugaaucuauu

SEQ ID NO: 22427 - RNA, 21 nt, Artificial Sequence
  Description of Artificial Sequence: Synthetic oligonucleotide
gcaguuucuuugaaucuuauu

SEQ ID NO: 22428 - RNA, 21 nt, Artificial Sequence
  Description of Artificial Sequence: Synthetic oligonucleotide
caguuucuuugaaucuucauu

SEQ ID NO: 22429 - RNA, 21 nt, Artificial Sequence
  Description of Artificial Sequence: Synthetic oligonucleotide
aguuucuuugaaucuucuauu

SEQ ID NO: 22430 - RNA, 21 nt, Artificial Sequence
  Description of Artificial Sequence: Synthetic oligonucleotide
guuucuuugaaucuucugauu

SEQ ID NO: 22431 - RNA, 21 nt, Artificial Sequence
  Description of Artificial Sequence: Synthetic oligonucleotide
uuucuuugaaucuucugcauu

SEQ ID NO: 22432 - RNA, 21 nt, Artificial Sequence
  Description of Artificial Sequence: Synthetic oligonucleotide
uucuuugaaucuucugcuauu

SEQ ID NO: 22433 - RNA, 21 nt, Artificial Sequence
  Description of Artificial Sequence: Synthetic oligonucleotide
ucuuugaaucuucugcuuauu

SEQ ID NO: 22434 - RNA, 21 nt, Artificial Sequence
  Description of Artificial Sequence: Synthetic oligonucleotide
cuuugaaucuucugcuuuauu

SEQ ID NO: 22435 - RNA, 21 nt, Artificial Sequence
  Description of Artificial Sequence: Synthetic oligonucleotide
uuugaaucuucugcuuuaauu

SEQ ID NO: 22436 - RNA, 21 nt, Artificial Sequence
  Description of Artificial Sequence: Synthetic oligonucleotide
uugaaucuucugcuuuauauu

SEQ ID NO: 22437 - RNA, 21 nt, Artificial Sequence
  Description of Artificial Sequence: Synthetic oligonucleotide
ugaaucuucugcuuuaucauu

SEQ ID NO: 22438 - RNA, 21 nt, Artificial Sequence
  Description of Artificial Sequence: Synthetic oligonucleotide
gaaucuucugcuuuaucuauu

SEQ ID NO: 22439 - RNA, 21 nt, Artificial Sequence
  Description of Artificial Sequence: Synthetic oligonucleotide
aaucuucugcuuuaucuuauu

SEQ ID NO: 22440 - RNA, 21 nt, Artificial Sequence
  Description of Artificial Sequence: Synthetic oligonucleotide
aucuucugcuuuaucuuuauu

SEQ ID NO: 22441 - RNA, 21 nt, Artificial Sequence
  Description of Artificial Sequence: Synthetic oligonucleotide
ucuucugcuuuaucuuuaauu

SEQ ID NO: 22442 - RNA, 21 nt, Artificial Sequence
  Description of Artificial Sequence: Synthetic oligonucleotide
cuucugcuuuaucuuuaaauu

SEQ ID NO: 22443 - RNA, 21 nt, Artificial Sequence
  Description of Artificial Sequence: Synthetic oligonucleotide
uucugcuuuaucuuuaaaauu

SEQ ID NO: 22444 - RNA, 21 nt, Artificial Sequence
  Description of Artificial Sequence: Synthetic oligonucleotide
ucugcuuuaucuuuaaaaauu

SEQ ID NO: 22445 - RNA, 21 nt, Artificial Sequence
  Description of Artificial Sequence: Synthetic oligonucleotide
cugcuuuaucuuuaaaaaauu

SEQ ID NO: 22446 - RNA, 21 nt, Artificial Sequence
  Description of Artificial Sequence: Synthetic oligonucleotide
ugcuuuaucuuuaaaaauauu

SEQ ID NO: 22447 - RNA, 21 nt, Artificial Sequence
  Description of Artificial Sequence: Synthetic oligonucleotide
gcuuuaucuuuaaaaauuauu

SEQ ID NO: 22448 - RNA, 21 nt, Artificial Sequence
  Description of Artificial Sequence: Synthetic oligonucleotide
cuuuaucuuuaaaaauuuauu

SEQ ID NO: 22449 - RNA, 21 nt, Artificial Sequence
  Description of Artificial Sequence: Synthetic oligonucleotide
uuuaucuuuaaaaauuugauu

SEQ ID NO: 22450 - RNA, 21 nt, Artificial Sequence
  Description of Artificial Sequence: Synthetic oligonucleotide
uuaucuuuaaaaauuuguauu

SEQ ID NO: 22451 - RNA, 21 nt, Artificial Sequence
  Description of Artificial Sequence: Synthetic oligonucleotide
uaucuuuaaaaauuuguaauu

SEQ ID NO: 22452 - RNA, 21 nt, Artificial Sequence
  Description of Artificial Sequence: Synthetic oligonucleotide
aucuuuaaaaauuuguauauu

SEQ ID NO: 22453 - RNA, 21 nt, Artificial Sequence
  Description of Artificial Sequence: Synthetic oligonucleotide
ucuuuaaaaauuuguauaauu

SEQ ID NO: 22454 - RNA, 21 nt, Artificial Sequence
  Description of Artificial Sequence: Synthetic oligonucleotide
cuuuaaaaauuuguauaaauu

SEQ ID NO: 22455 - RNA, 21 nt, Artificial Sequence
  Description of Artificial Sequence: Synthetic oligonucleotide
uuuaaaaauuuguauaauauu

SEQ ID NO: 22456 - RNA, 21 nt, Artificial Sequence
  Description of Artificial Sequence: Synthetic oligonucleotide
uuaaaaauuuguauaauuauu

SEQ ID NO: 22457 - RNA, 21 nt, Artificial Sequence
  Description of Artificial Sequence: Synthetic oligonucleotide
uaaaaauuuguauaauuuauu

SEQ ID NO: 22458 - RNA, 21 nt, Artificial Sequence
  Description of Artificial Sequence: Synthetic oligonucleotide
aaaaauuuguauaauuuaauu

SEQ ID NO: 22459 - RNA, 21 nt, Artificial Sequence
  Description of Artificial Sequence: Synthetic oligonucleotide
aaaauuuguauaauuuauauu

SEQ ID NO: 22460 - RNA, 21 nt, Artificial Sequence
  Description of Artificial Sequence: Synthetic oligonucleotide
aaauuuguauaauuuauaauu

SEQ ID NO: 22461 - RNA, 21 nt, Artificial Sequence
  Description of Artificial Sequence: Synthetic oligonucleotide
aauuuguauaauuuauauauu

SEQ ID NO: 22462 - RNA, 21 nt, Artificial Sequence
  Description of Artificial Sequence: Synthetic oligonucleotide
auuuguauaauuuauauaauu

SEQ ID NO: 22463 - RNA, 21 nt, Artificial Sequence
  Description of Artificial Sequence: Synthetic oligonucleotide
uuuguauaauuuauauauauu

SEQ ID NO: 22464 - RNA, 21 nt, Artificial Sequence
  Description of Artificial Sequence: Synthetic oligonucleotide
uuguauaauuuauauauuauu

SEQ ID NO: 22465 - RNA, 21 nt, Artificial Sequence
  Description of Artificial Sequence: Synthetic oligonucleotide
uguauaauuuauauauuuauu

SEQ ID NO: 22466 - RNA, 21 nt, Artificial Sequence
  Description of Artificial Sequence: Synthetic oligonucleotide
guauaauuuauauauuuuauu

SEQ ID NO: 22467 - RNA, 21 nt, Artificial Sequence
  Description of Artificial Sequence: Synthetic oligonucleotide
uauaauuuauauauuuuaauu

SEQ ID NO: 22468 - RNA, 21 nt, Artificial Sequence
  Description of Artificial Sequence: Synthetic oligonucleotide
auaauuuauauauuuuauauu

SEQ ID NO: 22469 - RNA, 21 nt, Artificial Sequence
  Description of Artificial Sequence: Synthetic oligonucleotide
uaauuuauauauuuuauuauu

SEQ ID NO: 22470 - RNA, 21 nt, Artificial Sequence
  Description of Artificial Sequence: Synthetic oligonucleotide
aauuuauauauuuuauucauu

SEQ ID NO: 22471 - RNA, 21 nt, Artificial Sequence
  Description of Artificial Sequence: Synthetic oligonucleotide
auuuauauauuuuauucuauu

SEQ ID NO: 22472 - RNA, 21 nt, Artificial Sequence
  Description of Artificial Sequence: Synthetic oligonucleotide
uuuauauauuuuauucuaauu

SEQ ID NO: 22473 - RNA, 21 nt, Artificial Sequence
  Description of Artificial Sequence: Synthetic oligonucleotide
uuauauauuuuauucuauauu

SEQ ID NO: 22474 - RNA, 21 nt, Artificial Sequence
  Description of Artificial Sequence: Synthetic oligonucleotide
uauauauuuuauucuaugauu

SEQ ID NO: 22475 - RNA, 21 nt, Artificial Sequence
  Description of Artificial Sequence: Synthetic oligonucleotide
auauauuuuauucuauguauu

SEQ ID NO: 22476 - RNA, 21 nt, Artificial Sequence
  Description of Artificial Sequence: Synthetic oligonucleotide
uauauuuuauucuaugugauu

SEQ ID NO: 22477 - RNA, 21 nt, Artificial Sequence
  Description of Artificial Sequence: Synthetic oligonucleotide
auauuuuauucuauguguauu

SEQ ID NO: 22478 - RNA, 21 nt, Artificial Sequence
  Description of Artificial Sequence: Synthetic oligonucleotide
uauuuuauucuauguguuauu

SEQ ID NO: 22479 - RNA, 21 nt, Artificial Sequence
  Description of Artificial Sequence: Synthetic oligonucleotide
auuuuauucuauguguucauu

SEQ ID NO: 22480 - RNA, 21 nt, Artificial Sequence
  Description of Artificial Sequence: Synthetic oligonucleotide
uuuuauucuauguguuccauu

SEQ ID NO: 22481 - RNA, 21 nt, Artificial Sequence
  Description of Artificial Sequence: Synthetic oligonucleotide
uuuauucuauguguuccaauu

SEQ ID NO: 22482 - RNA, 21 nt, Artificial Sequence
  Description of Artificial Sequence: Synthetic oligonucleotide
uuauucuauguguuccauauu

SEQ ID NO: 22483 - RNA, 21 nt, Artificial Sequence
  Description of Artificial Sequence: Synthetic oligonucleotide
uauucuauguguuccauaauu

SEQ ID NO: 22484 - RNA, 21 nt, Artificial Sequence
  Description of Artificial Sequence: Synthetic oligonucleotide
auucuauguguuccauagauu

SEQ ID NO: 22485 - RNA, 21 nt, Artificial Sequence
  Description of Artificial Sequence: Synthetic oligonucleotide
uucuauguguuccauagaauu

SEQ ID NO: 22486 - RNA, 21 nt, Artificial Sequence
  Description of Artificial Sequence: Synthetic oligonucleotide
ucuauguguuccauagauauu

SEQ ID NO: 22487 - RNA, 21 nt, Artificial Sequence
  Description of Artificial Sequence: Synthetic oligonucleotide
cuauguguuccauagauaauu

SEQ ID NO: 22488 - RNA, 21 nt, Artificial Sequence
  Description of Artificial Sequence: Synthetic oligonucleotide
uauguguuccauagauauauu

SEQ ID NO: 22489 - RNA, 21 nt, Artificial Sequence
  Description of Artificial Sequence: Synthetic oligonucleotide
auguguuccauagauaucauu

SEQ ID NO: 22490 - RNA, 21 nt, Artificial Sequence
  Description of Artificial Sequence: Synthetic oligonucleotide
uguguuccauagauaucuauu

SEQ ID NO: 22491 - RNA, 21 nt, Artificial Sequence
  Description of Artificial Sequence: Synthetic oligonucleotide
guguuccauagauaucuuauu

SEQ ID NO: 22492 - RNA, 21 nt, Artificial Sequence
  Description of Artificial Sequence: Synthetic oligonucleotide
uguuccauagauaucuuaauu

SEQ ID NO: 22493 - RNA, 21 nt, Artificial Sequence
  Description of Artificial Sequence: Synthetic oligonucleotide
guuccauagauaucuuaaauu

SEQ ID NO: 22494 - RNA, 21 nt, Artificial Sequence
  Description of Artificial Sequence: Synthetic oligonucleotide
uuccauagauaucuuaauauu

SEQ ID NO: 22495 - RNA, 21 nt, Artificial Sequence
  Description of Artificial Sequence: Synthetic oligonucleotide
uccauagauaucuuaaugauu

SEQ ID NO: 22496 - RNA, 21 nt, Artificial Sequence
  Description of Artificial Sequence: Synthetic oligonucleotide
ccauagauaucuuaauguauu

SEQ ID NO: 22497 - RNA, 21 nt, Artificial Sequence
  Description of Artificial Sequence: Synthetic oligonucleotide
cauagauaucuuaauguaauu

SEQ ID NO: 22498 - RNA, 21 nt, Artificial Sequence
  Description of Artificial Sequence: Synthetic oligonucleotide
auagauaucuuaauguaaauu

SEQ ID NO: 22499 - RNA, 21 nt, Artificial Sequence
  Description of Artificial Sequence: Synthetic oligonucleotide
uagauaucuuaauguaaaauu

SEQ ID NO: 22500 - RNA, 21 nt, Artificial Sequence
  Description of Artificial Sequence: Synthetic oligonucleotide
agauaucuuaauguaaaaauu

SEQ ID NO: 22501 - RNA, 21 nt, Artificial Sequence
  Description of Artificial Sequence: Synthetic oligonucleotide
gauaucuuaauguaaaauauu

SEQ ID NO: 22502 - RNA, 21 nt, Artificial Sequence
  Description of Artificial Sequence: Synthetic oligonucleotide
auaucuuaauguaaaauuauu

SEQ ID NO: 22503 - RNA, 21 nt, Artificial Sequence
  Description of Artificial Sequence: Synthetic oligonucleotide
uaucuuaauguaaaauuaauu

SEQ ID NO: 22504 - RNA, 21 nt, Artificial Sequence
  Description of Artificial Sequence: Synthetic oligonucleotide
aucuuaauguaaaauuagauu

SEQ ID NO: 22505 - RNA, 21 nt, Artificial Sequence
  Description of Artificial Sequence: Synthetic oligonucleotide
ucuuaauguaaaauuaguauu

SEQ ID NO: 22506 - RNA, 21 nt, Artificial Sequence
  Description of Artificial Sequence: Synthetic oligonucleotide
cuuaauguaaaauuagucauu

SEQ ID NO: 22507 - RNA, 21 nt, Artificial Sequence
  Description of Artificial Sequence: Synthetic oligonucleotide
uuaauguaaaauuagucaauu

SEQ ID NO: 22508 - RNA, 21 nt, Artificial Sequence
  Description of Artificial Sequence: Synthetic oligonucleotide
uaauguaaaauuagucauauu

SEQ ID NO: 22509 - RNA, 21 nt, Artificial Sequence
  Description of Artificial Sequence: Synthetic oligonucleotide
aauguaaaauuagucauuauu

SEQ ID NO: 22510 - RNA, 21 nt, Artificial Sequence
  Description of Artificial Sequence: Synthetic oligonucleotide
auguaaaauuagucauuuauu

SEQ ID NO: 22511 - RNA, 21 nt, Artificial Sequence
  Description of Artificial Sequence: Synthetic oligonucleotide
uguaaaauuagucauuuaauu

SEQ ID NO: 22512 - RNA, 21 nt, Artificial Sequence
  Description of Artificial Sequence: Synthetic oligonucleotide
guaaaauuagucauuuaaauu

SEQ ID NO: 22513 - RNA, 21 nt, Artificial Sequence
  Description of Artificial Sequence: Synthetic oligonucleotide
uaaaauuagucauuuaaaauu

SEQ ID NO: 22514 - RNA, 21 nt, Artificial Sequence
  Description of Artificial Sequence: Synthetic oligonucleotide
aaaauuagucauuuaaauauu

SEQ ID NO: 22515 - RNA, 21 nt, Artificial Sequence
  Description of Artificial Sequence: Synthetic oligonucleotide
aaauuagucauuuaaauuauu

SEQ ID NO: 22516 - RNA, 21 nt, Artificial Sequence
  Description of Artificial Sequence: Synthetic oligonucleotide
aauuagucauuuaaauuaauu

SEQ ID NO: 22517 - RNA, 21 nt, Artificial Sequence
  Description of Artificial Sequence: Synthetic oligonucleotide
auuagucauuuaaauuacauu

SEQ ID NO: 22518 - RNA, 21 nt, Artificial Sequence
  Description of Artificial Sequence: Synthetic oligonucleotide
uuagucauuuaaauuacaauu

SEQ ID NO: 22519 - RNA, 21 nt, Artificial Sequence
  Description of Artificial Sequence: Synthetic oligonucleotide
uagucauuuaaauuacacauu

SEQ ID NO: 22520 - RNA, 21 nt, Artificial Sequence
  Description of Artificial Sequence: Synthetic oligonucleotide
agucauuuaaauuacacuauu

SEQ ID NO: 22521 - RNA, 21 nt, Artificial Sequence
  Description of Artificial Sequence: Synthetic oligonucleotide
gucauuuaaauuacacugauu

SEQ ID NO: 22522 - RNA, 21 nt, Artificial Sequence
  Description of Artificial Sequence: Synthetic oligonucleotide
ucauuuaaauuacacuguauu

SEQ ID NO: 22523 - RNA, 21 nt, Artificial Sequence
  Description of Artificial Sequence: Synthetic oligonucleotide
cauuuaaauuacacugucauu

SEQ ID NO: 22524 - RNA, 21 nt, Artificial Sequence
  Description of Artificial Sequence: Synthetic oligonucleotide
auuuaaauuacacugucaauu

SEQ ID NO: 22525 - RNA, 21 nt, Artificial Sequence
  Description of Artificial Sequence: Synthetic oligonucleotide
uuuaaauuacacugucaaauu

SEQ ID NO: 22526 - RNA, 21 nt, Artificial Sequence
  Description of Artificial Sequence: Synthetic oligonucleotide
uuaaauuacacugucaauauu

SEQ ID NO: 22527 - RNA, 21 nt, Artificial Sequence
  Description of Artificial Sequence: Synthetic oligonucleotide
uaaauuacacugucaauuauu

SEQ ID NO: 22528 - RNA, 21 nt, Artificial Sequence
  Description of Artificial Sequence: Synthetic oligonucleotide
aaauuacacugucaauuaauu

SEQ ID NO: 22529 - RNA, 21 nt, Artificial Sequence
  Description of Artificial Sequence: Synthetic oligonucleotide
aauuacacugucaauuaaauu

SEQ ID NO: 22530 - RNA, 21 nt, Artificial Sequence
  Description of Artificial Sequence: Synthetic oligonucleotide
auuacacugucaauuaaaauu

SEQ ID NO: 22531 - RNA, 21 nt, Artificial Sequence
  Description of Artificial Sequence: Synthetic oligonucleotide
uuacacugucaauuaaaaauu

SEQ ID NO: 22532 - RNA, 21 nt, Artificial Sequence
  Description of Artificial Sequence: Synthetic oligonucleotide
uacacugucaauuaaaagauu

SEQ ID NO: 22533 - RNA, 21 nt, Artificial Sequence
  Description of Artificial Sequence: Synthetic oligonucleotide
acacugucaauuaaaaguauu

SEQ ID NO: 22534 - RNA, 21 nt, Artificial Sequence
  Description of Artificial Sequence: Synthetic oligonucleotide
cacugucaauuaaaaguaauu

SEQ ID NO: 22535 - RNA, 21 nt, Artificial Sequence
  Description of Artificial Sequence: Synthetic oligonucleotide
acugucaauuaaaaguaaauu

SEQ ID NO: 22536 - RNA, 21 nt, Artificial Sequence
  Description of Artificial Sequence: Synthetic oligonucleotide
cugucaauuaaaaguaauauu

SEQ ID NO: 22537 - RNA, 21 nt, Artificial Sequence
  Description of Artificial Sequence: Synthetic oligonucleotide
ugucaauuaaaaguaaugauu

SEQ ID NO: 22538 - RNA, 21 nt, Artificial Sequence
  Description of Artificial Sequence: Synthetic oligonucleotide
gucaauuaaaaguaauggauu

SEQ ID NO: 22539 - RNA, 21 nt, Artificial Sequence
  Description of Artificial Sequence: Synthetic oligonucleotide
ucaauuaaaaguaaugggauu

SEQ ID NO: 22540 - RNA, 21 nt, Artificial Sequence
  Description of Artificial Sequence: Synthetic oligonucleotide
caauuaaaaguaaugggcauu

SEQ ID NO: 22541 - RNA, 21 nt, Artificial Sequence
  Description of Artificial Sequence: Synthetic oligonucleotide
aauuaaaaguaaugggcaauu

SEQ ID NO: 22542 - RNA, 21 nt, Artificial Sequence
  Description of Artificial Sequence: Synthetic oligonucleotide
auuaaaaguaaugggcaaauu

SEQ ID NO: 22543 - RNA, 21 nt, Artificial Sequence
  Description of Artificial Sequence: Synthetic oligonucleotide
uuaaaaguaaugggcaagauu

SEQ ID NO: 22544 - RNA, 21 nt, Artificial Sequence
  Description of Artificial Sequence: Synthetic oligonucleotide
uaaaaguaaugggcaagaauu

SEQ ID NO: 22545 - RNA, 21 nt, Artificial Sequence
  Description of Artificial Sequence: Synthetic oligonucleotide
aaaaguaaugggcaagagauu

SEQ ID NO: 22546 - RNA, 21 nt, Artificial Sequence
  Description of Artificial Sequence: Synthetic oligonucleotide
aaaguaaugggcaagagaauu

SEQ ID NO: 22547 - RNA, 21 nt, Artificial Sequence
  Description of Artificial Sequence: Synthetic oligonucleotide
aaguaaugggcaagagauauu

SEQ ID NO: 22548 - RNA, 21 nt, Artificial Sequence
  Description of Artificial Sequence: Synthetic oligonucleotide
aguaaugggcaagagauuauu

SEQ ID NO: 22549 - RNA, 21 nt, Artificial Sequence
  Description of Artificial Sequence: Synthetic oligonucleotide
guaaugggcaagagauugauu

SEQ ID NO: 22550 - RNA, 21 nt, Artificial Sequence
  Description of Artificial Sequence: Synthetic oligonucleotide
uaaugggcaagagauugcauu

SEQ ID NO: 22551 - RNA, 21 nt, Artificial Sequence
  Description of Artificial Sequence: Synthetic oligonucleotide
aaugggcaagagauugcaauu

SEQ ID NO: 22552 - RNA, 21 nt, Artificial Sequence
  Description of Artificial Sequence: Synthetic oligonucleotide
augggcaagagauugcauauu

SEQ ID NO: 22553 - RNA, 21 nt, Artificial Sequence
  Description of Artificial Sequence: Synthetic oligonucleotide
ugggcaagagauugcaucauu

SEQ ID NO: 22554 - RNA, 21 nt, Artificial Sequence
  Description of Artificial Sequence: Synthetic oligonucleotide
gggcaagagauugcaucaauu

SEQ ID NO: 22555 - RNA, 21 nt, Artificial Sequence
  Description of Artificial Sequence: Synthetic oligonucleotide
ggcaagagauugcaucauauu

SEQ ID NO: 22556 - RNA, 21 nt, Artificial Sequence
  Description of Artificial Sequence: Synthetic oligonucleotide
gcaagagauugcaucauaauu

SEQ ID NO: 22557 - RNA, 21 nt, Artificial Sequence
  Description of Artificial Sequence: Synthetic oligonucleotide
caagagauugcaucauacauu

SEQ ID NO: 22558 - RNA, 21 nt, Artificial Sequence
  Description of Artificial Sequence: Synthetic oligonucleotide
aagagauugcaucauacuauu

SEQ ID NO: 22559 - RNA, 21 nt, Artificial Sequence
  Description of Artificial Sequence: Synthetic oligonucleotide
agagauugcaucauacuaauu

SEQ ID NO: 22560 - RNA, 21 nt, Artificial Sequence
  Description of Artificial Sequence: Synthetic oligonucleotide
gagauugcaucauacuaaauu

SEQ ID NO: 22561 - RNA, 21 nt, Artificial Sequence
  Description of Artificial Sequence: Synthetic oligonucleotide
agauugcaucauacuaauauu

SEQ ID NO: 22562 - RNA, 21 nt, Artificial Sequence
  Description of Artificial Sequence: Synthetic oligonucleotide
gauugcaucauacuaauuauu

SEQ ID NO: 22563 - RNA, 21 nt, Artificial Sequence
  Description of Artificial Sequence: Synthetic oligonucleotide
auugcaucauacuaauuuauu

SEQ ID NO: 22564 - RNA, 21 nt, Artificial Sequence
  Description of Artificial Sequence: Synthetic oligonucleotide
uugcaucauacuaauuuaauu

SEQ ID NO: 22565 - RNA, 21 nt, Artificial Sequence
  Description of Artificial Sequence: Synthetic oligonucleotide
ugcaucauacuaauuuagauu

SEQ ID NO: 22566 - RNA, 21 nt, Artificial Sequence
  Description of Artificial Sequence: Synthetic oligonucleotide
gcaucauacuaauuuaguauu

SEQ ID NO: 22567 - RNA, 21 nt, Artificial Sequence
  Description of Artificial Sequence: Synthetic oligonucleotide
caucauacuaauuuaguaauu

SEQ ID NO: 22568 - RNA, 21 nt, Artificial Sequence
  Description of Artificial Sequence: Synthetic oligonucleotide
aucauacuaauuuaguaaauu

SEQ ID NO: 22569 - RNA, 21 nt, Artificial Sequence
  Description of Artificial Sequence: Synthetic oligonucleotide
ucauacuaauuuaguaagauu

SEQ ID NO: 22570 - RNA, 21 nt, Artificial Sequence
  Description of Artificial Sequence: Synthetic oligonucleotide
cauacuaauuuaguaagaauu

SEQ ID NO: 22571 - RNA, 21 nt, Artificial Sequence
  Description of Artificial Sequence: Synthetic oligonucleotide
auacuaauuuaguaagaaauu

SEQ ID NO: 22572 - RNA, 21 nt, Artificial Sequence
  Description of Artificial Sequence: Synthetic oligonucleotide
uacuaauuuaguaagaacauu

SEQ ID NO: 22573 - RNA, 21 nt, Artificial Sequence
  Description of Artificial Sequence: Synthetic oligonucleotide
acuaauuuaguaagaacgauu

SEQ ID NO: 22574 - RNA, 21 nt, Artificial Sequence
  Description of Artificial Sequence: Synthetic oligonucleotide
cuaauuuaguaagaacguauu

SEQ ID NO: 22575 - RNA, 21 nt, Artificial Sequence
  Description of Artificial Sequence: Synthetic oligonucleotide
uaauuuaguaagaacguuauu

SEQ ID NO: 22576 - RNA, 21 nt, Artificial Sequence
  Description of Artificial Sequence: Synthetic oligonucleotide
aauuuaguaagaacguucauu

SEQ ID NO: 22577 - RNA, 21 nt, Artificial Sequence
  Description of Artificial Sequence: Synthetic oligonucleotide
auuuaguaagaacguuccauu

SEQ ID NO: 22578 - RNA, 21 nt, Artificial Sequence
  Description of Artificial Sequence: Synthetic oligonucleotide
uuuaguaagaacguucccauu

SEQ ID NO: 22579 - RNA, 21 nt, Artificial Sequence
  Description of Artificial Sequence: Synthetic oligonucleotide
uuaguaagaacguucccaauu

SEQ ID NO: 22580 - RNA, 21 nt, Artificial Sequence
  Description of Artificial Sequence: Synthetic oligonucleotide
uaguaagaacguucccaaauu

SEQ ID NO: 22581 - RNA, 21 nt, Artificial Sequence
  Description of Artificial Sequence: Synthetic oligonucleotide
aguaagaacguucccaaaauu

SEQ ID NO: 22582 - RNA, 21 nt, Artificial Sequence
  Description of Artificial Sequence: Synthetic oligonucleotide
guaagaacguucccaaauauu

SEQ ID NO: 22583 - RNA, 21 nt, Artificial Sequence
  Description of Artificial Sequence: Synthetic oligonucleotide
uaagaacguucccaaaugauu

SEQ ID NO: 22584 - RNA, 21 nt, Artificial Sequence
  Description of Artificial Sequence: Synthetic oligonucleotide
aagaacguucccaaauguauu

SEQ ID NO: 22585 - RNA, 21 nt, Artificial Sequence
  Description of Artificial Sequence: Synthetic oligonucleotide
agaacguucccaaauguuauu

SEQ ID NO: 22586 - RNA, 21 nt, Artificial Sequence
  Description of Artificial Sequence: Synthetic oligonucleotide
gaacguucccaaauguugauu

SEQ ID NO: 22587 - RNA, 21 nt, Artificial Sequence
  Description of Artificial Sequence: Synthetic oligonucleotide
aacguucccaaauguuguauu

SEQ ID NO: 22588 - RNA, 21 nt, Artificial Sequence
  Description of Artificial Sequence: Synthetic oligonucleotide
acguucccaaauguuguaauu

SEQ ID NO: 22589 - RNA, 21 nt, Artificial Sequence
  Description of Artificial Sequence: Synthetic oligonucleotide
cguucccaaauguuguaaauu

SEQ ID NO: 22590 - RNA, 21 nt, Artificial Sequence
  Description of Artificial Sequence: Synthetic oligonucleotide
guucccaaauguuguaacauu

SEQ ID NO: 22591 - RNA, 21 nt, Artificial Sequence
  Description of Artificial Sequence: Synthetic oligonucleotide
uucccaaauguuguaacaauu

SEQ ID NO: 22592 - RNA, 21 nt, Artificial Sequence
  Description of Artificial Sequence: Synthetic oligonucleotide
ucccaaauguuguaacaaauu

SEQ ID NO: 22593 - RNA, 21 nt, Artificial Sequence
  Description of Artificial Sequence: Synthetic oligonucleotide
cccaaauguuguaacaauauu

SEQ ID NO: 22594 - RNA, 21 nt, Artificial Sequence
  Description of Artificial Sequence: Synthetic oligonucleotide
ccaaauguuguaacaaugauu

SEQ ID NO: 22595 - RNA, 21 nt, Artificial Sequence
  Description of Artificial Sequence: Synthetic oligonucleotide
caaauguuguaacaauguauu

SEQ ID NO: 22596 - RNA, 21 nt, Artificial Sequence
  Description of Artificial Sequence: Synthetic oligonucleotide
aaauguuguaacaaugugauu

SEQ ID NO: 22597 - RNA, 21 nt, Artificial Sequence
  Description of Artificial Sequence: Synthetic oligonucleotide
aauguuguaacaauguggauu

SEQ ID NO: 22598 - RNA, 21 nt, Artificial Sequence
  Description of Artificial Sequence: Synthetic oligonucleotide
auguuguaacaauguggaauu

SEQ ID NO: 22599 - RNA, 21 nt, Artificial Sequence
  Description of Artificial Sequence: Synthetic oligonucleotide
uguuguaacaauguggauauu

SEQ ID NO: 22600 - RNA, 21 nt, Artificial Sequence
  Description of Artificial Sequence: Synthetic oligonucleotide
guuguaacaauguggaucauu

SEQ ID NO: 22601 - RNA, 21 nt, Artificial Sequence
  Description of Artificial Sequence: Synthetic oligonucleotide
uuguaacaauguggaucaauu

SEQ ID NO: 22602 - RNA, 21 nt, Artificial Sequence
  Description of Artificial Sequence: Synthetic oligonucleotide
uguaacaauguggaucauauu

SEQ ID NO: 22603 - RNA, 21 nt, Artificial Sequence
  Description of Artificial Sequence: Synthetic oligonucleotide
guaacaauguggaucauaauu

SEQ ID NO: 22604 - RNA, 21 nt, Artificial Sequence
  Description of Artificial Sequence: Synthetic oligonucleotide
uaacaauguggaucauacauu

SEQ ID NO: 22605 - RNA, 21 nt, Artificial Sequence
  Description of Artificial Sequence: Synthetic oligonucleotide
aacaauguggaucauacaauu

SEQ ID NO: 22606 - RNA, 21 nt, Artificial Sequence
  Description of Artificial Sequence: Synthetic oligonucleotide
acaauguggaucauacauauu

SEQ ID NO: 22607 - RNA, 21 nt, Artificial Sequence
  Description of Artificial Sequence: Synthetic oligonucleotide
caauguggaucauacaucauu

SEQ ID NO: 22608 - RNA, 21 nt, Artificial Sequence
  Description of Artificial Sequence: Synthetic oligonucleotide
aauguggaucauacaucuauu

SEQ ID NO: 22609 - RNA, 21 nt, Artificial Sequence
  Description of Artificial Sequence: Synthetic oligonucleotide
auguggaucauacaucucauu

SEQ ID NO: 22610 - RNA, 21 nt, Artificial Sequence
  Description of Artificial Sequence: Synthetic oligonucleotide
uguggaucauacaucucuauu

SEQ ID NO: 22611 - RNA, 21 nt, Artificial Sequence
  Description of Artificial Sequence: Synthetic oligonucleotide
guggaucauacaucucugauu

SEQ ID NO: 22612 - RNA, 21 nt, Artificial Sequence
  Description of Artificial Sequence: Synthetic oligonucleotide
uggaucauacaucucuggauu

SEQ ID NO: 22613 - RNA, 21 nt, Artificial Sequence
  Description of Artificial Sequence: Synthetic oligonucleotide
ggaucauacaucucugguauu

SEQ ID NO: 22614 - RNA, 21 nt, Artificial Sequence
  Description of Artificial Sequence: Synthetic oligonucleotide
gaucauacaucucugguuauu

SEQ ID NO: 22615 - RNA, 21 nt, Artificial Sequence
  Description of Artificial Sequence: Synthetic oligonucleotide
aucauacaucucugguuuauu

SEQ ID NO: 22616 - RNA, 21 nt, Artificial Sequence
  Description of Artificial Sequence: Synthetic oligonucleotide
ucauacaucucugguuuuauu

SEQ ID NO: 22617 - RNA, 21 nt, Artificial Sequence
  Description of Artificial Sequence: Synthetic oligonucleotide
cauacaucucugguuuuuauu

SEQ ID NO: 22618 - RNA, 21 nt, Artificial Sequence
  Description of Artificial Sequence: Synthetic oligonucleotide
auacaucucugguuuuuuauu

SEQ ID NO: 22619 - RNA, 21 nt, Artificial Sequence
  Description of Artificial Sequence: Synthetic oligonucleotide
uacaucucugguuuuuuaauu

SEQ ID NO: 22620 - RNA, 21 nt, Artificial Sequence
  Description of Artificial Sequence: Synthetic oligonucleotide
acaucucugguuuuuuaaauu

SEQ ID NO: 22621 - RNA, 21 nt, Artificial Sequence
  Description of Artificial Sequence: Synthetic oligonucleotide
caucucugguuuuuuaaaauu

SEQ ID NO: 22622 - RNA, 21 nt, Artificial Sequence
  Description of Artificial Sequence: Synthetic oligonucleotide
aucucugguuuuuuaaauauu

SEQ ID NO: 22623 - RNA, 21 nt, Artificial Sequence
  Description of Artificial Sequence: Synthetic oligonucleotide
ucucugguuuuuuaaaugauu

SEQ ID NO: 22624 - RNA, 21 nt, Artificial Sequence
  Description of Artificial Sequence: Synthetic oligonucleotide
cucugguuuuuuaaauguauu

SEQ ID NO: 22625 - RNA, 21 nt, Artificial Sequence
  Description of Artificial Sequence: Synthetic oligonucleotide
ucugguuuuuuaaauguaauu

SEQ ID NO: 22626 - RNA, 21 nt, Artificial Sequence
  Description of Artificial Sequence: Synthetic oligonucleotide
cugguuuuuuaaauguauauu

SEQ ID NO: 22627 - RNA, 21 nt, Artificial Sequence
  Description of Artificial Sequence: Synthetic oligonucleotide
ugguuuuuuaaauguauuauu

SEQ ID NO: 22628 - RNA, 21 nt, Artificial Sequence
  Description of Artificial Sequence: Synthetic oligonucleotide
gguuuuuuaaauguauugauu

SEQ ID NO: 22629 - RNA, 21 nt, Artificial Sequence
  Description of Artificial Sequence: Synthetic oligonucleotide
guuuuuuaaauguauugaauu

SEQ ID NO: 22630 - RNA, 21 nt, Artificial Sequence
  Description of Artificial Sequence: Synthetic oligonucleotide
uuuuuuaaauguauugagauu

SEQ ID NO: 22631 - RNA, 21 nt, Artificial Sequence
  Description of Artificial Sequence: Synthetic oligonucleotide
uuuuuaaauguauugaggauu

SEQ ID NO: 22632 - RNA, 21 nt, Artificial Sequence
  Description of Artificial Sequence: Synthetic oligonucleotide
uuuuaaauguauugaggcauu

SEQ ID NO: 22633 - RNA, 21 nt, Artificial Sequence
  Description of Artificial Sequence: Synthetic oligonucleotide
uuuaaauguauugaggcuauu

SEQ ID NO: 22634 - RNA, 21 nt, Artificial Sequence
  Description of Artificial Sequence: Synthetic oligonucleotide
uuaaauguauugaggcuuauu

SEQ ID NO: 22635 - RNA, 21 nt, Artificial Sequence
  Description of Artificial Sequence: Synthetic oligonucleotide
uaaauguauugaggcuuuauu

SEQ ID NO: 22636 - RNA, 21 nt, Artificial Sequence
  Description of Artificial Sequence: Synthetic oligonucleotide
aaauguauugaggcuuucauu

SEQ ID NO: 22637 - RNA, 21 nt, Artificial Sequence
  Description of Artificial Sequence: Synthetic oligonucleotide
aauguauugaggcuuucuauu

SEQ ID NO: 22638 - RNA, 21 nt, Artificial Sequence
  Description of Artificial Sequence: Synthetic oligonucleotide
auguauugaggcuuucuuauu

SEQ ID NO: 22639 - RNA, 21 nt, Artificial Sequence
  Description of Artificial Sequence: Synthetic oligonucleotide
uguauugaggcuuucuugauu

SEQ ID NO: 22640 - RNA, 21 nt, Artificial Sequence
  Description of Artificial Sequence: Synthetic oligonucleotide
guauugaggcuuucuuggauu

SEQ ID NO: 22641 - RNA, 21 nt, Artificial Sequence
  Description of Artificial Sequence: Synthetic oligonucleotide
uauugaggcuuucuugguauu

SEQ ID NO: 22642 - RNA, 21 nt, Artificial Sequence
  Description of Artificial Sequence: Synthetic oligonucleotide
auugaggcuuucuuggugauu

SEQ ID NO: 22643 - RNA, 21 nt, Artificial Sequence
  Description of Artificial Sequence: Synthetic oligonucleotide
uugaggcuuucuugguggauu

SEQ ID NO: 22644 - RNA, 21 nt, Artificial Sequence
  Description of Artificial Sequence: Synthetic oligonucleotide
ugaggcuuucuugguggaauu

SEQ ID NO: 22645 - RNA, 21 nt, Artificial Sequence
  Description of Artificial Sequence: Synthetic oligonucleotide
gaggcuuucuugguggacauu

SEQ ID NO: 22646 - RNA, 21 nt, Artificial Sequence
  Description of Artificial Sequence: Synthetic oligonucleotide
aggcuuucuugguggacuauu

SEQ ID NO: 22647 - RNA, 21 nt, Artificial Sequence
  Description of Artificial Sequence: Synthetic oligonucleotide
ggcuuucuugguggacuaauu

SEQ ID NO: 22648 - RNA, 21 nt, Artificial Sequence
  Description of Artificial Sequence: Synthetic oligonucleotide
gcuuucuugguggacuagauu

SEQ ID NO: 22649 - RNA, 21 nt, Artificial Sequence
  Description of Artificial Sequence: Synthetic oligonucleotide
cuuucuugguggacuaguauu

SEQ ID NO: 22650 - RNA, 21 nt, Artificial Sequence
  Description of Artificial Sequence: Synthetic oligonucleotide
uuucuugguggacuaguaauu

SEQ ID NO: 22651 - RNA, 21 nt, Artificial Sequence
  Description of Artificial Sequence: Synthetic oligonucleotide
uucuugguggacuaguauauu

SEQ ID NO: 22652 - RNA, 21 nt, Artificial Sequence
  Description of Artificial Sequence: Synthetic oligonucleotide
ucuugguggacuaguauaauu

SEQ ID NO: 22653 - RNA, 21 nt, Artificial Sequence
  Description of Artificial Sequence: Synthetic oligonucleotide
cuugguggacuaguauagauu

SEQ ID NO: 22654 - RNA, 21 nt, Artificial Sequence
  Description of Artificial Sequence: Synthetic oligonucleotide
uugguggacuaguauaguauu

SEQ ID NO: 22655 - RNA, 21 nt, Artificial Sequence
  Description of Artificial Sequence: Synthetic oligonucleotide
ugguggacuaguauaguaauu

SEQ ID NO: 22656 - RNA, 21 nt, Artificial Sequence
  Description of Artificial Sequence: Synthetic oligonucleotide
gguggacuaguauaguauauu

SEQ ID NO: 22657 - RNA, 21 nt, Artificial Sequence
  Description of Artificial Sequence: Synthetic oligonucleotide
guggacuaguauaguauaauu

SEQ ID NO: 22658 - RNA, 21 nt, Artificial Sequence
  Description of Artificial Sequence: Synthetic oligonucleotide
uggacuaguauaguauacauu

SEQ ID NO: 22659 - RNA, 21 nt, Artificial Sequence
  Description of Artificial Sequence: Synthetic oligonucleotide
ggacuaguauaguauacgauu

SEQ ID NO: 22660 - RNA, 21 nt, Artificial Sequence
  Description of Artificial Sequence: Synthetic oligonucleotide
gacuaguauaguauacggauu

SEQ ID NO: 22661 - RNA, 21 nt, Artificial Sequence
  Description of Artificial Sequence: Synthetic oligonucleotide
acuaguauaguauacgguauu

SEQ ID NO: 22662 - RNA, 21 nt, Artificial Sequence
  Description of Artificial Sequence: Synthetic oligonucleotide
cuaguauaguauacggucauu

SEQ ID NO: 22663 - RNA, 21 nt, Artificial Sequence
  Description of Artificial Sequence: Synthetic oligonucleotide
uaguauaguauacggucaauu

SEQ ID NO: 22664 - RNA, 21 nt, Artificial Sequence
  Description of Artificial Sequence: Synthetic oligonucleotide
aguauaguauacggucagauu

SEQ ID NO: 22665 - RNA, 21 nt, Artificial Sequence
  Description of Artificial Sequence: Synthetic oligonucleotide
guauaguauacggucaguauu

SEQ ID NO: 22666 - RNA, 21 nt, Artificial Sequence
  Description of Artificial Sequence: Synthetic oligonucleotide
uauaguauacggucaguuauu

SEQ ID NO: 22667 - RNA, 21 nt, Artificial Sequence
  Description of Artificial Sequence: Synthetic oligonucleotide
auaguauacggucaguuaauu

SEQ ID NO: 22668 - RNA, 21 nt, Artificial Sequence
  Description of Artificial Sequence: Synthetic oligonucleotide
uaguauacggucaguuauauu

SEQ ID NO: 22669 - RNA, 21 nt, Artificial Sequence
  Description of Artificial Sequence: Synthetic oligonucleotide
aguauacggucaguuaugauu

SEQ ID NO: 22670 - RNA, 21 nt, Artificial Sequence
  Description of Artificial Sequence: Synthetic oligonucleotide
guauacggucaguuauguauu

SEQ ID NO: 22671 - RNA, 21 nt, Artificial Sequence
  Description of Artificial Sequence: Synthetic oligonucleotide
uauacggucaguuaugucauu

SEQ ID NO: 22672 - RNA, 21 nt, Artificial Sequence
  Description of Artificial Sequence: Synthetic oligonucleotide
auacggucaguuaugucaauu

SEQ ID NO: 22673 - RNA, 21 nt, Artificial Sequence
  Description of Artificial Sequence: Synthetic oligonucleotide
uacggucaguuaugucaaauu

SEQ ID NO: 22674 - RNA, 21 nt, Artificial Sequence
  Description of Artificial Sequence: Synthetic oligonucleotide
acggucaguuaugucaauauu

SEQ ID NO: 22675 - RNA, 21 nt, Artificial Sequence
  Description of Artificial Sequence: Synthetic oligonucleotide
cggucaguuaugucaaugauu

SEQ ID NO: 22676 - RNA, 21 nt, Artificial Sequence
  Description of Artificial Sequence: Synthetic oligonucleotide
ggucaguuaugucaauguauu

SEQ ID NO: 22677 - RNA, 21 nt, Artificial Sequence
  Description of Artificial Sequence: Synthetic oligonucleotide
gucaguuaugucaauguuauu

SEQ ID NO: 22678 - RNA, 21 nt, Artificial Sequence
  Description of Artificial Sequence: Synthetic oligonucleotide
ucaguuaugucaauguuuauu

SEQ ID NO: 22679 - RNA, 21 nt, Artificial Sequence
  Description of Artificial Sequence: Synthetic oligonucleotide
caguuaugucaauguuucauu

SEQ ID NO: 22680 - RNA, 21 nt, Artificial Sequence
  Description of Artificial Sequence: Synthetic oligonucleotide
aguuaugucaauguuucaauu

SEQ ID NO: 22681 - RNA, 21 nt, Artificial Sequence
  Description of Artificial Sequence: Synthetic oligonucleotide
guuaugucaauguuucauauu

SEQ ID NO: 22682 - RNA, 21 nt, Artificial Sequence
  Description of Artificial Sequence: Synthetic oligonucleotide
uuaugucaauguuucaugauu

SEQ ID NO: 22683 - RNA, 21 nt, Artificial Sequence
  Description of Artificial Sequence: Synthetic oligonucleotide
uaugucaauguuucauggauu

SEQ ID NO: 22684 - RNA, 21 nt, Artificial Sequence
  Description of Artificial Sequence: Synthetic oligonucleotide
augucaauguuucaugguauu

SEQ ID NO: 22685 - RNA, 21 nt, Artificial Sequence
  Description of Artificial Sequence: Synthetic oligonucleotide
ugucaauguuucauggucauu

SEQ ID NO: 22686 - RNA, 21 nt, Artificial Sequence
  Description of Artificial Sequence: Synthetic oligonucleotide
gucaauguuucauggucaauu

SEQ ID NO: 22687 - RNA, 21 nt, Artificial Sequence
  Description of Artificial Sequence: Synthetic oligonucleotide
ucaauguuucauggucaaauu

SEQ ID NO: 22688 - RNA, 21 nt, Artificial Sequence
  Description of Artificial Sequence: Synthetic oligonucleotide
caauguuucauggucaauauu

SEQ ID NO: 22689 - RNA, 21 nt, Artificial Sequence
  Description of Artificial Sequence: Synthetic oligonucleotide
aauguuucauggucaauaauu

SEQ ID NO: 22690 - RNA, 21 nt, Artificial Sequence
  Description of Artificial Sequence: Synthetic oligonucleotide
auguuucauggucaauaaauu

SEQ ID NO: 22691 - RNA, 21 nt, Artificial Sequence
  Description of Artificial Sequence: Synthetic oligonucleotide
uguuucauggucaauaaaauu

SEQ ID NO: 22692 - RNA, 21 nt, Artificial Sequence
  Description of Artificial Sequence: Synthetic oligonucleotide
guuucauggucaauaaaaauu

SEQ ID NO: 22693 - RNA, 21 nt, Artificial Sequence
  Description of Artificial Sequence: Synthetic oligonucleotide
uuucauggucaauaaaaaauu

SEQ ID NO: 22694 - RNA, 21 nt, Artificial Sequence
  Description of Artificial Sequence: Synthetic oligonucleotide
uucauggucaauaaaaagauu

SEQ ID NO: 22695 - RNA, 21 nt, Artificial Sequence
  Description of Artificial Sequence: Synthetic oligonucleotide
ucauggucaauaaaaaggauu

SEQ ID NO: 22696 - RNA, 21 nt, Artificial Sequence
  Description of Artificial Sequence: Synthetic oligonucleotide
cauggucaauaaaaaggaauu

SEQ ID NO: 22697 - RNA, 21 nt, Artificial Sequence
  Description of Artificial Sequence: Synthetic oligonucleotide
auggucaauaaaaaggaaauu

SEQ ID NO: 22698 - RNA, 21 nt, Artificial Sequence
  Description of Artificial Sequence: Synthetic oligonucleotide
uggucaauaaaaaggaagauu

SEQ ID NO: 22699 - RNA, 21 nt, Artificial Sequence
  Description of Artificial Sequence: Synthetic oligonucleotide
ggucaauaaaaaggaaguauu

SEQ ID NO: 22700 - RNA, 21 nt, Artificial Sequence
  Description of Artificial Sequence: Synthetic oligonucleotide
gucaauaaaaaggaaguuauu

SEQ ID NO: 22701 - RNA, 21 nt, Artificial Sequence
  Description of Artificial Sequence: Synthetic oligonucleotide
ucaauaaaaaggaaguugauu

SEQ ID NO: 22702 - RNA, 21 nt, Artificial Sequence
  Description of Artificial Sequence: Synthetic oligonucleotide
caauaaaaaggaaguugcauu

SEQ ID NO: 22703 - RNA, 21 nt, Artificial Sequence
  Description of Artificial Sequence: Synthetic oligonucleotide
aauaaaaaggaaguugcaauu

SEQ ID NO: 22704 - RNA, 21 nt, Artificial Sequence
  Description of Artificial Sequence: Synthetic oligonucleotide
auaaaaaggaaguugcaaauu

SEQ ID NO: 22705 - RNA, 21 nt, Artificial Sequence
  Description of Artificial Sequence: Synthetic oligonucleotide
uaaaaaggaaguugcaaaauu

SEQ ID NO: 22706 - RNA, 21 nt, Artificial Sequence
  Description of Artificial Sequence: Synthetic oligonucleotide
aaaaaggaaguugcaaauauu

SEQ ID NO: 22707 - RNA, 21 nt, Artificial Sequence
  Description of Artificial Sequence: Synthetic oligonucleotide
aaaaggaaguugcaaauuauu

SEQ ID NO: 22708 - RNA, 21 nt, Artificial Sequence
  Description of Artificial Sequence: Synthetic oligonucleotide
aaaggaaguugcaaauugauu

SEQ ID NO: 22709 - RNA, 21 nt, Artificial Sequence
  Description of Artificial Sequence: Synthetic oligonucleotide
aaggaaguugcaaauuguauu

SEQ ID NO: 22710 - RNA, 21 nt, Artificial Sequence
  Description of Artificial Sequence: Synthetic oligonucleotide
aggaaguugcaaauugugauu

SEQ ID NO: 22711 - RNA, 21 nt, Artificial Sequence
  Description of Artificial Sequence: Synthetic oligonucleotide
acccucgccacgccccugcuc

SEQ ID NO: 22712 - RNA, 21 nt, Artificial Sequence
  Description of Artificial Sequence: Synthetic oligonucleotide
cccucgccacgccccugcucc

SEQ ID NO: 22713 - RNA, 21 nt, Artificial Sequence
  Description of Artificial Sequence: Synthetic oligonucleotide
ccucgccacgccccugcuccc

SEQ ID NO: 22714 - RNA, 21 nt, Artificial Sequence
  Description of Artificial Sequence: Synthetic oligonucleotide
cucgccacgccccugcucccc

SEQ ID NO: 22715 - RNA, 21 nt, Artificial Sequence
  Description of Artificial Sequence: Synthetic oligonucleotide
ucgccacgccccugcuccccc

SEQ ID NO: 22716 - RNA, 21 nt, Artificial Sequence
  Description of Artificial Sequence: Synthetic oligonucleotide
cgccacgccccugcucccccg

SEQ ID NO: 22717 - RNA, 21 nt, Artificial Sequence
  Description of Artificial Sequence: Synthetic oligonucleotide
gccacgccccugcucccccgc

SEQ ID NO: 22718 - RNA, 21 nt, Artificial Sequence
  Description of Artificial Sequence: Synthetic oligonucleotide
ccacgccccugcucccccgcg

SEQ ID NO: 22719 - RNA, 21 nt, Artificial Sequence
  Description of Artificial Sequence: Synthetic oligonucleotide
cacgccccugcucccccgcgg

SEQ ID NO: 22720 - RNA, 21 nt, Artificial Sequence
  Description of Artificial Sequence: Synthetic oligonucleotide
acgccccugcucccccgcggu

SEQ ID NO: 22721 - RNA, 21 nt, Artificial Sequence
  Description of Artificial Sequence: Synthetic oligonucleotide
cgccccugcucccccgcgguu

SEQ ID NO: 22722 - RNA, 21 nt, Artificial Sequence
  Description of Artificial Sequence: Synthetic oligonucleotide
gccccugcucccccgcgguug

SEQ ID NO: 22723 - RNA, 21 nt, Artificial Sequence
  Description of Artificial Sequence: Synthetic oligonucleotide
ccccugcucccccgcgguugg

SEQ ID NO: 22724 - RNA, 21 nt, Artificial Sequence
  Description of Artificial Sequence: Synthetic oligonucleotide
cccugcucccccgcgguuggu

SEQ ID NO: 22725 - RNA, 21 nt, Artificial Sequence
  Description of Artificial Sequence: Synthetic oligonucleotide
ccugcucccccgcgguugguu

SEQ ID NO: 22726 - RNA, 21 nt, Artificial Sequence
  Description of Artificial Sequence: Synthetic oligonucleotide
cugcucccccgcgguugguuc

SEQ ID NO: 22727 - RNA, 21 nt, Artificial Sequence
  Description of Artificial Sequence: Synthetic oligonucleotide
ugcucccccgcgguugguucu

SEQ ID NO: 22728 - RNA, 21 nt, Artificial Sequence
  Description of Artificial Sequence: Synthetic oligonucleotide
gcucccccgcgguugguucuu

SEQ ID NO: 22729 - RNA, 21 nt, Artificial Sequence
  Description of Artificial Sequence: Synthetic oligonucleotide
cucccccgcgguugguucuuc

SEQ ID NO: 22730 - RNA, 21 nt, Artificial Sequence
  Description of Artificial Sequence: Synthetic oligonucleotide
ucccccgcgguugguucuucc

SEQ ID NO: 22731 - RNA, 21 nt, Artificial Sequence
  Description of Artificial Sequence: Synthetic oligonucleotide
cccccgcgguugguucuuccu

SEQ ID NO: 22732 - RNA, 21 nt, Artificial Sequence
  Description of Artificial Sequence: Synthetic oligonucleotide
ccccgcgguugguucuuccuu

SEQ ID NO: 22733 - RNA, 21 nt, Artificial Sequence
  Description of Artificial Sequence: Synthetic oligonucleotide
cccgcgguugguucuuccuug

SEQ ID NO: 22734 - RNA, 21 nt, Artificial Sequence
  Description of Artificial Sequence: Synthetic oligonucleotide
ccgcgguugguucuuccuugc

SEQ ID NO: 22735 - RNA, 21 nt, Artificial Sequence
  Description of Artificial Sequence: Synthetic oligonucleotide
cgcgguugguucuuccuugcu

SEQ ID NO: 22736 - RNA, 21 nt, Artificial Sequence
  Description of Artificial Sequence: Synthetic oligonucleotide
gcgguugguucuuccuugcuc

SEQ ID NO: 22737 - RNA, 21 nt, Artificial Sequence
  Description of Artificial Sequence: Synthetic oligonucleotide
cgguugguucuuccuugcucu

SEQ ID NO: 22738 - RNA, 21 nt, Artificial Sequence
  Description of Artificial Sequence: Synthetic oligonucleotide
gguugguucuuccuugcucua

SEQ ID NO: 22739 - RNA, 21 nt, Artificial Sequence
  Description of Artificial Sequence: Synthetic oligonucleotide
guugguucuuccuugcucuac

SEQ ID NO: 22740 - RNA, 21 nt, Artificial Sequence
  Description of Artificial Sequence: Synthetic oligonucleotide
uugguucuuccuugcucuacu

SEQ ID NO: 22741 - RNA, 21 nt, Artificial Sequence
  Description of Artificial Sequence: Synthetic oligonucleotide
ugguucuuccuugcucuacuc

SEQ ID NO: 22742 - RNA, 21 nt, Artificial Sequence
  Description of Artificial Sequence: Synthetic oligonucleotide
gguucuuccuugcucuacuca

SEQ ID NO: 22743 - RNA, 21 nt, Artificial Sequence
  Description of Artificial Sequence: Synthetic oligonucleotide
guucuuccuugcucuacucaa

SEQ ID NO: 22744 - RNA, 21 nt, Artificial Sequence
  Description of Artificial Sequence: Synthetic oligonucleotide
uucuuccuugcucuacucaac

SEQ ID NO: 22745 - RNA, 21 nt, Artificial Sequence
  Description of Artificial Sequence: Synthetic oligonucleotide
ucuuccuugcucuacucaacc

SEQ ID NO: 22746 - RNA, 21 nt, Artificial Sequence
  Description of Artificial Sequence: Synthetic oligonucleotide
cuuccuugcucuacucaaccc

SEQ ID NO: 22747 - RNA, 21 nt, Artificial Sequence
  Description of Artificial Sequence: Synthetic oligonucleotide
uuccuugcucuacucaacccu

SEQ ID NO: 22748 - RNA, 21 nt, Artificial Sequence
  Description of Artificial Sequence: Synthetic oligonucleotide
uccuugcucuacucaacccug

SEQ ID NO: 22749 - RNA, 21 nt, Artificial Sequence
  Description of Artificial Sequence: Synthetic oligonucleotide
ccuugcucuacucaacccuga

SEQ ID NO: 22750 - RNA, 21 nt, Artificial Sequence
  Description of Artificial Sequence: Synthetic oligonucleotide
cuugcucuacucaacccugac

SEQ ID NO: 22751 - RNA, 21 nt, Artificial Sequence
  Description of Artificial Sequence: Synthetic oligonucleotide
uugcucuacucaacccugacc

SEQ ID NO: 22752 - RNA, 21 nt, Artificial Sequence
  Description of Artificial Sequence: Synthetic oligonucleotide
ugcucuacucaacccugaccu

SEQ ID NO: 22753 - RNA, 21 nt, Artificial Sequence
  Description of Artificial Sequence: Synthetic oligonucleotide
gcucuacucaacccugaccuc

SEQ ID NO: 22754 - RNA, 21 nt, Artificial Sequence
  Description of Artificial Sequence: Synthetic oligonucleotide
cucuacucaacccugaccucu

SEQ ID NO: 22755 - RNA, 21 nt, Artificial Sequence
  Description of Artificial Sequence: Synthetic oligonucleotide
ucuacucaacccugaccucuu

SEQ ID NO: 22756 - RNA, 21 nt, Artificial Sequence
  Description of Artificial Sequence: Synthetic oligonucleotide
cuacucaacccugaccucuuc

SEQ ID NO: 22757 - RNA, 21 nt, Artificial Sequence
  Description of Artificial Sequence: Synthetic oligonucleotide
uacucaacccugaccucuucu

SEQ ID NO: 22758 - RNA, 21 nt, Artificial Sequence
  Description of Artificial Sequence: Synthetic oligonucleotide
acucaacccugaccucuucuc

SEQ ID NO: 22759 - RNA, 21 nt, Artificial Sequence
  Description of Artificial Sequence: Synthetic oligonucleotide
cucaacccugaccucuucucu

SEQ ID NO: 22760 - RNA, 21 nt, Artificial Sequence
  Description of Artificial Sequence: Synthetic oligonucleotide
ucaacccugaccucuucucuc

SEQ ID NO: 22761 - RNA, 21 nt, Artificial Sequence
  Description of Artificial Sequence: Synthetic oligonucleotide
caacccugaccucuucucucu

SEQ ID NO: 22762 - RNA, 21 nt, Artificial Sequence
  Description of Artificial Sequence: Synthetic oligonucleotide
aacccugaccucuucucucug

SEQ ID NO: 22763 - RNA, 21 nt, Artificial Sequence
  Description of Artificial Sequence: Synthetic oligonucleotide
acccugaccucuucucucuga

SEQ ID NO: 22764 - RNA, 21 nt, Artificial Sequence
  Description of Artificial Sequence: Synthetic oligonucleotide
cccugaccucuucucucugac

SEQ ID NO: 22765 - RNA, 21 nt, Artificial Sequence
  Description of Artificial Sequence: Synthetic oligonucleotide
ccugaccucuucucucugacu

SEQ ID NO: 22766 - RNA, 21 nt, Artificial Sequence
  Description of Artificial Sequence: Synthetic oligonucleotide
cugaccucuucucucugacuc

SEQ ID NO: 22767 - RNA, 21 nt, Artificial Sequence
  Description of Artificial Sequence: Synthetic oligonucleotide
ugaccucuucucucugacucu

SEQ ID NO: 22768 - RNA, 21 nt, Artificial Sequence
  Description of Artificial Sequence: Synthetic oligonucleotide
gaccucuucucucugacucuc

SEQ ID NO: 22769 - RNA, 21 nt, Artificial Sequence
  Description of Artificial Sequence: Synthetic oligonucleotide
accucuucucucugacucucg

SEQ ID NO: 22770 - RNA, 21 nt, Artificial Sequence
  Description of Artificial Sequence: Synthetic oligonucleotide
ccucuucucucugacucucga

SEQ ID NO: 22771 - RNA, 21 nt, Artificial Sequence
  Description of Artificial Sequence: Synthetic oligonucleotide
cucuucucucugacucucgac

SEQ ID NO: 22772 - RNA, 21 nt, Artificial Sequence
  Description of Artificial Sequence: Synthetic oligonucleotide
ucuucucucugacucucgacu

SEQ ID NO: 22773 - RNA, 21 nt, Artificial Sequence
  Description of Artificial Sequence: Synthetic oligonucleotide
cuucucucugacucucgacuu

SEQ ID NO: 22774 - RNA, 21 nt, Artificial Sequence
  Description of Artificial Sequence: Synthetic oligonucleotide
uucucucugacucucgacuug

SEQ ID NO: 22775 - RNA, 21 nt, Artificial Sequence
  Description of Artificial Sequence: Synthetic oligonucleotide
ucucucugacucucgacuugu

SEQ ID NO: 22776 - RNA, 21 nt, Artificial Sequence
  Description of Artificial Sequence: Synthetic oligonucleotide
cucucugacucucgacuugug

SEQ ID NO: 22777 - RNA, 21 nt, Artificial Sequence
  Description of Artificial Sequence: Synthetic oligonucleotide
ucucugacucucgacuugugu

SEQ ID NO: 22778 - RNA, 21 nt, Artificial Sequence
  Description of Artificial Sequence: Synthetic oligonucleotide
cucugacucucgacuuguguu

SEQ ID NO: 22779 - RNA, 21 nt, Artificial Sequence
  Description of Artificial Sequence: Synthetic oligonucleotide
ucugacucucgacuuguguuc

SEQ ID NO: 22780 - RNA, 21 nt, Artificial Sequence
  Description of Artificial Sequence: Synthetic oligonucleotide
cugacucucgacuuguguucc

SEQ ID NO: 22781 - RNA, 21 nt, Artificial Sequence
  Description of Artificial Sequence: Synthetic oligonucleotide
ugacucucgacuuguguuccc

SEQ ID NO: 22782 - RNA, 21 nt, Artificial Sequence
  Description of Artificial Sequence: Synthetic oligonucleotide
gacucucgacuuguguucccc

SEQ ID NO: 22783 - RNA, 21 nt, Artificial Sequence
  Description of Artificial Sequence: Synthetic oligonucleotide
acucucgacuuguguuccccg

SEQ ID NO: 22784 - RNA, 21 nt, Artificial Sequence
  Description of Artificial Sequence: Synthetic oligonucleotide
cucucgacuuguguuccccgc

SEQ ID NO: 22785 - RNA, 21 nt, Artificial Sequence
  Description of Artificial Sequence: Synthetic oligonucleotide
ucucgacuuguguuccccgcu

SEQ ID NO: 22786 - RNA, 21 nt, Artificial Sequence
  Description of Artificial Sequence: Synthetic oligonucleotide
cucgacuuguguuccccgcuc

SEQ ID NO: 22787 - RNA, 21 nt, Artificial Sequence
  Description of Artificial Sequence: Synthetic oligonucleotide
ucgacuuguguuccccgcucc

SEQ ID NO: 22788 - RNA, 21 nt, Artificial Sequence
  Description of Artificial Sequence: Synthetic oligonucleotide
cgacuuguguuccccgcuccu

SEQ ID NO: 22789 - RNA, 21 nt, Artificial Sequence
  Description of Artificial Sequence: Synthetic oligonucleotide
gacuuguguuccccgcuccuc

SEQ ID NO: 22790 - RNA, 21 nt, Artificial Sequence
  Description of Artificial Sequence: Synthetic oligonucleotide
acuuguguuccccgcuccucc

SEQ ID NO: 22791 - RNA, 21 nt, Artificial Sequence
  Description of Artificial Sequence: Synthetic oligonucleotide
cuuguguuccccgcuccuccc

SEQ ID NO: 22792 - RNA, 21 nt, Artificial Sequence
  Description of Artificial Sequence: Synthetic oligonucleotide
uuguguuccccgcuccucccu

SEQ ID NO: 22793 - RNA, 21 nt, Artificial Sequence
  Description of Artificial Sequence: Synthetic oligonucleotide
uguguuccccgcuccucccug

SEQ ID NO: 22794 - RNA, 21 nt, Artificial Sequence
  Description of Artificial Sequence: Synthetic oligonucleotide
guguuccccgcuccucccuga

SEQ ID NO: 22795 - RNA, 21 nt, Artificial Sequence
  Description of Artificial Sequence: Synthetic oligonucleotide
uguuccccgcuccucccugac

SEQ ID NO: 22796 - RNA, 21 nt, Artificial Sequence
  Description of Artificial Sequence: Synthetic oligonucleotide
guuccccgcuccucccugacc

SEQ ID NO: 22797 - RNA, 21 nt, Artificial Sequence
  Description of Artificial Sequence: Synthetic oligonucleotide
uuccccgcuccucccugaccu

SEQ ID NO: 22798 - RNA, 21 nt, Artificial Sequence
  Description of Artificial Sequence: Synthetic oligonucleotide
uccccgcuccucccugaccuu

SEQ ID NO: 22799 - RNA, 21 nt, Artificial Sequence
  Description of Artificial Sequence: Synthetic oligonucleotide
ccccgcuccucccugaccuuc

SEQ ID NO: 22800 - RNA, 21 nt, Artificial Sequence
  Description of Artificial Sequence: Synthetic oligonucleotide
cccgcuccucccugaccuucc

SEQ ID NO: 22801 - RNA, 21 nt, Artificial Sequence
  Description of Artificial Sequence: Synthetic oligonucleotide
ccgcuccucccugaccuuccu

SEQ ID NO: 22802 - RNA, 21 nt, Artificial Sequence
  Description of Artificial Sequence: Synthetic oligonucleotide
cgcuccucccugaccuuccuc

SEQ ID NO: 22803 - RNA, 21 nt, Artificial Sequence
  Description of Artificial Sequence: Synthetic oligonucleotide
gcuccucccugaccuuccucc

SEQ ID NO: 22804 - RNA, 21 nt, Artificial Sequence
  Description of Artificial Sequence: Synthetic oligonucleotide
cuccucccugaccuuccuccc

SEQ ID NO: 22805 - RNA, 21 nt, Artificial Sequence
  Description of Artificial Sequence: Synthetic oligonucleotide
uccucccugaccuuccucccc

SEQ ID NO: 22806 - RNA, 21 nt, Artificial Sequence
  Description of Artificial Sequence: Synthetic oligonucleotide
ccucccugaccuuccuccccu

SEQ ID NO: 22807 - RNA, 21 nt, Artificial Sequence
  Description of Artificial Sequence: Synthetic oligonucleotide
cucccugaccuuccuccccuc

SEQ ID NO: 22808 - RNA, 21 nt, Artificial Sequence
  Description of Artificial Sequence: Synthetic oligonucleotide
ucccugaccuuccuccccucc

SEQ ID NO: 22809 - RNA, 21 nt, Artificial Sequence
  Description of Artificial Sequence: Synthetic oligonucleotide
cccugaccuuccuccccuccc

SEQ ID NO: 22810 - RNA, 21 nt, Artificial Sequence
  Description of Artificial Sequence: Synthetic oligonucleotide
ccugaccuuccuccccucccc

SEQ ID NO: 22811 - RNA, 21 nt, Artificial Sequence
  Description of Artificial Sequence: Synthetic oligonucleotide
cugaccuuccuccccuccccu

SEQ ID NO: 22812 - RNA, 21 nt, Artificial Sequence
  Description of Artificial Sequence: Synthetic oligonucleotide
ugaccuuccuccccuccccuu

SEQ ID NO: 22813 - RNA, 21 nt, Artificial Sequence
  Description of Artificial Sequence: Synthetic oligonucleotide
gaccuuccuccccuccccuuu

SEQ ID NO: 22814 - RNA, 21 nt, Artificial Sequence
  Description of Artificial Sequence: Synthetic oligonucleotide
accuuccuccccuccccuuuc

SEQ ID NO: 22815 - RNA, 21 nt, Artificial Sequence
  Description of Artificial Sequence: Synthetic oligonucleotide
ccuuccuccccuccccuuuca

SEQ ID NO: 22816 - RNA, 21 nt, Artificial Sequence
  Description of Artificial Sequence: Synthetic oligonucleotide
cuuccuccccuccccuuucac

SEQ ID NO: 22817 - RNA, 21 nt, Artificial Sequence
  Description of Artificial Sequence: Synthetic oligonucleotide
uuccuccccuccccuuucacu

SEQ ID NO: 22818 - RNA, 21 nt, Artificial Sequence
  Description of Artificial Sequence: Synthetic oligonucleotide
uccuccccuccccuuucacuc

SEQ ID NO: 22819 - RNA, 21 nt, Artificial Sequence
  Description of Artificial Sequence: Synthetic oligonucleotide
ccuccccuccccuuucacuca

SEQ ID NO: 22820 - RNA, 21 nt, Artificial Sequence
  Description of Artificial Sequence: Synthetic oligonucleotide
cuccccuccccuuucacucaa

SEQ ID NO: 22821 - RNA, 21 nt, Artificial Sequence
  Description of Artificial Sequence: Synthetic oligonucleotide
uccccuccccuuucacucaau

SEQ ID NO: 22822 - RNA, 21 nt, Artificial Sequence
  Description of Artificial Sequence: Synthetic oligonucleotide
ccccuccccuuucacucaauu

SEQ ID NO: 22823 - RNA, 21 nt, Artificial Sequence
  Description of Artificial Sequence: Synthetic oligonucleotide
cccuccccuuucacucaauuc

SEQ ID NO: 22824 - RNA, 21 nt, Artificial Sequence
  Description of Artificial Sequence: Synthetic oligonucleotide
ccuccccuuucacucaauucu

SEQ ID NO: 22825 - RNA, 21 nt, Artificial Sequence
  Description of Artificial Sequence: Synthetic oligonucleotide
cuccccuuucacucaauucuc

SEQ ID NO: 22826 - RNA, 21 nt, Artificial Sequence
  Description of Artificial Sequence: Synthetic oligonucleotide
uccccuuucacucaauucuca

SEQ ID NO: 22827 - RNA, 21 nt, Artificial Sequence
  Description of Artificial Sequence: Synthetic oligonucleotide
ccccuuucacucaauucucac

SEQ ID NO: 22828 - RNA, 21 nt, Artificial Sequence
  Description of Artificial Sequence: Synthetic oligonucleotide
cccuuucacucaauucucacc

SEQ ID NO: 22829 - RNA, 21 nt, Artificial Sequence
  Description of Artificial Sequence: Synthetic oligonucleotide
ccuuucacucaauucucacca

SEQ ID NO: 22830 - RNA, 21 nt, Artificial Sequence
  Description of Artificial Sequence: Synthetic oligonucleotide
cuuucacucaauucucaccaa

SEQ ID NO: 22831 - RNA, 21 nt, Artificial Sequence
  Description of Artificial Sequence: Synthetic oligonucleotide
uuucacucaauucucaccaac

SEQ ID NO: 22832 - RNA, 21 nt, Artificial Sequence
  Description of Artificial Sequence: Synthetic oligonucleotide
uucacucaauucucaccaacu

SEQ ID NO: 22833 - RNA, 21 nt, Artificial Sequence
  Description of Artificial Sequence: Synthetic oligonucleotide
ucacucaauucucaccaacuc

SEQ ID NO: 22834 - RNA, 21 nt, Artificial Sequence
  Description of Artificial Sequence: Synthetic oligonucleotide
cacucaauucucaccaacucu

SEQ ID NO: 22835 - RNA, 21 nt, Artificial Sequence
  Description of Artificial Sequence: Synthetic oligonucleotide
acucaauucucaccaacucuu

SEQ ID NO: 22836 - RNA, 21 nt, Artificial Sequence
  Description of Artificial Sequence: Synthetic oligonucleotide
cucaauucucaccaacucuuu

SEQ ID NO: 22837 - RNA, 21 nt, Artificial Sequence
  Description of Artificial Sequence: Synthetic oligonucleotide
ucaauucucaccaacucuuuc

SEQ ID NO: 22838 - RNA, 21 nt, Artificial Sequence
  Description of Artificial Sequence: Synthetic oligonucleotide
caauucucaccaacucuuucu

SEQ ID NO: 22839 - RNA, 21 nt, Artificial Sequence
  Description of Artificial Sequence: Synthetic oligonucleotide
aauucucaccaacucuuucuc

SEQ ID NO: 22840 - RNA, 21 nt, Artificial Sequence
  Description of Artificial Sequence: Synthetic oligonucleotide
auucucaccaacucuuucucu

SEQ ID NO: 22841 - RNA, 21 nt, Artificial Sequence
  Description of Artificial Sequence: Synthetic oligonucleotide
uucucaccaacucuuucucuc

SEQ ID NO: 22842 - RNA, 21 nt, Artificial Sequence
  Description of Artificial Sequence: Synthetic oligonucleotide
ucucaccaacucuuucucucu

SEQ ID NO: 22843 - RNA, 21 nt, Artificial Sequence
  Description of Artificial Sequence: Synthetic oligonucleotide
cucaccaacucuuucucucuc

SEQ ID NO: 22844 - RNA, 21 nt, Artificial Sequence
  Description of Artificial Sequence: Synthetic oligonucleotide
ucaccaacucuuucucucucu

SEQ ID NO: 22845 - RNA, 21 nt, Artificial Sequence
  Description of Artificial Sequence: Synthetic oligonucleotide
caccaacucuuucucucucug

SEQ ID NO: 22846 - RNA, 21 nt, Artificial Sequence
  Description of Artificial Sequence: Synthetic oligonucleotide
accaacucuuucucucucugg

SEQ ID NO: 22847 - RNA, 21 nt, Artificial Sequence
  Description of Artificial Sequence: Synthetic oligonucleotide
ccaacucuuucucucucuggu

SEQ ID NO: 22848 - RNA, 21 nt, Artificial Sequence
  Description of Artificial Sequence: Synthetic oligonucleotide
caacucuuucucucucuggug

SEQ ID NO: 22849 - RNA, 21 nt, Artificial Sequence
  Description of Artificial Sequence: Synthetic oligonucleotide
aacucuuucucucucuggugu

SEQ ID NO: 22850 - RNA, 21 nt, Artificial Sequence
  Description of Artificial Sequence: Synthetic oligonucleotide
acucuuucucucucugguguu

SEQ ID NO: 22851 - RNA, 21 nt, Artificial Sequence
  Description of Artificial Sequence: Synthetic oligonucleotide
cucuuucucucucugguguuu

SEQ ID NO: 22852 - RNA, 21 nt, Artificial Sequence
  Description of Artificial Sequence: Synthetic oligonucleotide
ucuuucucucucugguguuuu

SEQ ID NO: 22853 - RNA, 21 nt, Artificial Sequence
  Description of Artificial Sequence: Synthetic oligonucleotide
cuuucucucucugguguuuuc

SEQ ID NO: 22854 - RNA, 21 nt, Artificial Sequence
  Description of Artificial Sequence: Synthetic oligonucleotide
uuucucucucugguguuuucu

SEQ ID NO: 22855 - RNA, 21 nt, Artificial Sequence
  Description of Artificial Sequence: Synthetic oligonucleotide
uucucucucugguguuuucuc

SEQ ID NO: 22856 - RNA, 21 nt, Artificial Sequence
  Description of Artificial Sequence: Synthetic oligonucleotide
ucucucucugguguuuucucc

SEQ ID NO: 22857 - RNA, 21 nt, Artificial Sequence
  Description of Artificial Sequence: Synthetic oligonucleotide
cucucucugguguuuucuccu

SEQ ID NO: 22858 - RNA, 21 nt, Artificial Sequence
  Description of Artificial Sequence: Synthetic oligonucleotide
ucucucugguguuuucuccuu

SEQ ID NO: 22859 - RNA, 21 nt, Artificial Sequence
  Description of Artificial Sequence: Synthetic oligonucleotide
cucucugguguuuucuccuuu

SEQ ID NO: 22860 - RNA, 21 nt, Artificial Sequence
  Description of Artificial Sequence: Synthetic oligonucleotide
ucucugguguuuucuccuuuu

SEQ ID NO: 22861 - RNA, 21 nt, Artificial Sequence
  Description of Artificial Sequence: Synthetic oligonucleotide
cucugguguuuucuccuuuuc

SEQ ID NO: 22862 - RNA, 21 nt, Artificial Sequence
  Description of Artificial Sequence: Synthetic oligonucleotide
ucugguguuuucuccuuuucu

SEQ ID NO: 22863 - RNA, 21 nt, Artificial Sequence
  Description of Artificial Sequence: Synthetic oligonucleotide
cugguguuuucuccuuuucuc

SEQ ID NO: 22864 - RNA, 21 nt, Artificial Sequence
  Description of Artificial Sequence: Synthetic oligonucleotide
ugguguuuucuccuuuucucg

SEQ ID NO: 22865 - RNA, 21 nt, Artificial Sequence
  Description of Artificial Sequence: Synthetic oligonucleotide
gguguuuucuccuuuucucgu

SEQ ID NO: 22866 - RNA, 21 nt, Artificial Sequence
  Description of Artificial Sequence: Synthetic oligonucleotide
guguuuucuccuuuucucgua

SEQ ID NO: 22867 - RNA, 21 nt, Artificial Sequence
  Description of Artificial Sequence: Synthetic oligonucleotide
uguuuucuccuuuucucguaa

SEQ ID NO: 22868 - RNA, 21 nt, Artificial Sequence
  Description of Artificial Sequence: Synthetic oligonucleotide
guuuucuccuuuucucguaaa

SEQ ID NO: 22869 - RNA, 21 nt, Artificial Sequence
  Description of Artificial Sequence: Synthetic oligonucleotide
uuuucuccuuuucucguaaac

SEQ ID NO: 22870 - RNA, 21 nt, Artificial Sequence
  Description of Artificial Sequence: Synthetic oligonucleotide
uuucuccuuuucucguaaacu

SEQ ID NO: 22871 - RNA, 21 nt, Artificial Sequence
  Description of Artificial Sequence: Synthetic oligonucleotide
uucuccuuuucucguaaacuu

SEQ ID NO: 22872 - RNA, 21 nt, Artificial Sequence
  Description of Artificial Sequence: Synthetic oligonucleotide
ucuccuuuucucguaaacuuu

SEQ ID NO: 22873 - RNA, 21 nt, Artificial Sequence
  Description of Artificial Sequence: Synthetic oligonucleotide
cuccuuuucucguaaacuuug

SEQ ID NO: 22874 - RNA, 21 nt, Artificial Sequence
  Description of Artificial Sequence: Synthetic oligonucleotide
uccuuuucucguaaacuuugc

SEQ ID NO: 22875 - RNA, 21 nt, Artificial Sequence
  Description of Artificial Sequence: Synthetic oligonucleotide
ccuuuucucguaaacuuugcc

SEQ ID NO: 22876 - RNA, 21 nt, Artificial Sequence
  Description of Artificial Sequence: Synthetic oligonucleotide
cuuuucucguaaacuuugccg

SEQ ID NO: 22877 - RNA, 21 nt, Artificial Sequence
  Description of Artificial Sequence: Synthetic oligonucleotide
uuuucucguaaacuuugccgc

SEQ ID NO: 22878 - RNA, 21 nt, Artificial Sequence
  Description of Artificial Sequence: Synthetic oligonucleotide
uuucucguaaacuuugccgcc

SEQ ID NO: 22879 - RNA, 21 nt, Artificial Sequence
  Description of Artificial Sequence: Synthetic oligonucleotide
uucucguaaacuuugccgccu

SEQ ID NO: 22880 - RNA, 21 nt, Artificial Sequence
  Description of Artificial Sequence: Synthetic oligonucleotide
ucucguaaacuuugccgccua

SEQ ID NO: 22881 - RNA, 21 nt, Artificial Sequence
  Description of Artificial Sequence: Synthetic oligonucleotide
cucguaaacuuugccgccuau

SEQ ID NO: 22882 - RNA, 21 nt, Artificial Sequence
  Description of Artificial Sequence: Synthetic oligonucleotide
ucguaaacuuugccgccuaug

SEQ ID NO: 22883 - RNA, 21 nt, Artificial Sequence
  Description of Artificial Sequence: Synthetic oligonucleotide
cguaaacuuugccgccuauga

SEQ ID NO: 22884 - RNA, 21 nt, Artificial Sequence
  Description of Artificial Sequence: Synthetic oligonucleotide
guaaacuuugccgccuaugag

SEQ ID NO: 22885 - RNA, 21 nt, Artificial Sequence
  Description of Artificial Sequence: Synthetic oligonucleotide
uaaacuuugccgccuaugagc

SEQ ID NO: 22886 - RNA, 21 nt, Artificial Sequence
  Description of Artificial Sequence: Synthetic oligonucleotide
aaacuuugccgccuaugagca

SEQ ID NO: 22887 - RNA, 21 nt, Artificial Sequence
  Description of Artificial Sequence: Synthetic oligonucleotide
aacuuugccgccuaugagcag

SEQ ID NO: 22888 - RNA, 21 nt, Artificial Sequence
  Description of Artificial Sequence: Synthetic oligonucleotide
acuuugccgccuaugagcagc

SEQ ID NO: 22889 - RNA, 21 nt, Artificial Sequence
  Description of Artificial Sequence: Synthetic oligonucleotide
cuuugccgccuaugagcagcc

SEQ ID NO: 22890 - RNA, 21 nt, Artificial Sequence
  Description of Artificial Sequence: Synthetic oligonucleotide
uuugccgccuaugagcagcca

SEQ ID NO: 22891 - RNA, 21 nt, Artificial Sequence
  Description of Artificial Sequence: Synthetic oligonucleotide
uugccgccuaugagcagccac

SEQ ID NO: 22892 - RNA, 21 nt, Artificial Sequence
  Description of Artificial Sequence: Synthetic oligonucleotide
ugccgccuaugagcagccaca

SEQ ID NO: 22893 - RNA, 21 nt, Artificial Sequence
  Description of Artificial Sequence: Synthetic oligonucleotide
gccgccuaugagcagccacau

SEQ ID NO: 22894 - RNA, 21 nt, Artificial Sequence
  Description of Artificial Sequence: Synthetic oligonucleotide
ccgccuaugagcagccacauu

SEQ ID NO: 22895 - RNA, 21 nt, Artificial Sequence
  Description of Artificial Sequence: Synthetic oligonucleotide
cgccuaugagcagccacauug

SEQ ID NO: 22896 - RNA, 21 nt, Artificial Sequence
  Description of Artificial Sequence: Synthetic oligonucleotide
gccuaugagcagccacauugc

SEQ ID NO: 22897 - RNA, 21 nt, Artificial Sequence
  Description of Artificial Sequence: Synthetic oligonucleotide
ccuaugagcagccacauugcc

SEQ ID NO: 22898 - RNA, 21 nt, Artificial Sequence
  Description of Artificial Sequence: Synthetic oligonucleotide
cuaugagcagccacauugccu

SEQ ID NO: 22899 - RNA, 21 nt, Artificial Sequence
  Description of Artificial Sequence: Synthetic oligonucleotide
uaugagcagccacauugccuu

SEQ ID NO: 22900 - RNA, 21 nt, Artificial Sequence
  Description of Artificial Sequence: Synthetic oligonucleotide
augagcagccacauugccuua

SEQ ID NO: 22901 - RNA, 21 nt, Artificial Sequence
  Description of Artificial Sequence: Synthetic oligonucleotide
ugagcagccacauugccuuac

SEQ ID NO: 22902 - RNA, 21 nt, Artificial Sequence
  Description of Artificial Sequence: Synthetic oligonucleotide
gagcagccacauugccuuacu

SEQ ID NO: 22903 - RNA, 21 nt, Artificial Sequence
  Description of Artificial Sequence: Synthetic oligonucleotide
agcagccacauugccuuacug

SEQ ID NO: 22904 - RNA, 21 nt, Artificial Sequence
  Description of Artificial Sequence: Synthetic oligonucleotide
gcagccacauugccuuacuga

SEQ ID NO: 22905 - RNA, 21 nt, Artificial Sequence
  Description of Artificial Sequence: Synthetic oligonucleotide
cagccacauugccuuacugaa

SEQ ID NO: 22906 - RNA, 21 nt, Artificial Sequence
  Description of Artificial Sequence: Synthetic oligonucleotide
agccacauugccuuacugaaa

SEQ ID NO: 22907 - RNA, 21 nt, Artificial Sequence
  Description of Artificial Sequence: Synthetic oligonucleotide
acccucgccacgccccugauu

SEQ ID NO: 22908 - RNA, 21 nt, Artificial Sequence
  Description of Artificial Sequence: Synthetic oligonucleotide
cccucgccacgccccugcauu

SEQ ID NO: 22909 - RNA, 21 nt, Artificial Sequence
  Description of Artificial Sequence: Synthetic oligonucleotide
ccucgccacgccccugcuauu

SEQ ID NO: 22910 - RNA, 21 nt, Artificial Sequence
  Description of Artificial Sequence: Synthetic oligonucleotide
cucgccacgccccugcucauu

SEQ ID NO: 22911 - RNA, 21 nt, Artificial Sequence
  Description of Artificial Sequence: Synthetic oligonucleotide
ucgccacgccccugcuccauu

SEQ ID NO: 22912 - RNA, 21 nt, Artificial Sequence
  Description of Artificial Sequence: Synthetic oligonucleotide
cgccacgccccugcucccauu

SEQ ID NO: 22913 - RNA, 21 nt, Artificial Sequence
  Description of Artificial Sequence: Synthetic oligonucleotide
gccacgccccugcuccccauu

SEQ ID NO: 22914 - RNA, 21 nt, Artificial Sequence
  Description of Artificial Sequence: Synthetic oligonucleotide
ccacgccccugcucccccauu

SEQ ID NO: 22915 - RNA, 21 nt, Artificial Sequence
  Description of Artificial Sequence: Synthetic oligonucleotide
cacgccccugcucccccgauu

SEQ ID NO: 22916 - RNA, 21 nt, Artificial Sequence
  Description of Artificial Sequence: Synthetic oligonucleotide
acgccccugcucccccgcauu

SEQ ID NO: 22917 - RNA, 21 nt, Artificial Sequence
  Description of Artificial Sequence: Synthetic oligonucleotide
cgccccugcucccccgcgauu

SEQ ID NO: 22918 - RNA, 21 nt, Artificial Sequence
  Description of Artificial Sequence: Synthetic oligonucleotide
gccccugcucccccgcggauu

SEQ ID NO: 22919 - RNA, 21 nt, Artificial Sequence
  Description of Artificial Sequence: Synthetic oligonucleotide
ccccugcucccccgcgguauu

SEQ ID NO: 22920 - RNA, 21 nt, Artificial Sequence
  Description of Artificial Sequence: Synthetic oligonucleotide
cccugcucccccgcgguuauu

SEQ ID NO: 22921 - RNA, 21 nt, Artificial Sequence
  Description of Artificial Sequence: Synthetic oligonucleotide
ccugcucccccgcgguugauu

SEQ ID NO: 22922 - RNA, 21 nt, Artificial Sequence
  Description of Artificial Sequence: Synthetic oligonucleotide
cugcucccccgcgguuggauu

SEQ ID NO: 22923 - RNA, 21 nt, Artificial Sequence
  Description of Artificial Sequence: Synthetic oligonucleotide
ugcucccccgcgguugguauu

SEQ ID NO: 22924 - RNA, 21 nt, Artificial Sequence
  Description of Artificial Sequence: Synthetic oligonucleotide
gcucccccgcgguugguuauu

SEQ ID NO: 22925 - RNA, 21 nt, Artificial Sequence
  Description of Artificial Sequence: Synthetic oligonucleotide
cucccccgcgguugguucauu

SEQ ID NO: 22926 - RNA, 21 nt, Artificial Sequence
  Description of Artificial Sequence: Synthetic oligonucleotide
ucccccgcgguugguucuauu

SEQ ID NO: 22927 - RNA, 21 nt, Artificial Sequence
  Description of Artificial Sequence: Synthetic oligonucleotide
cccccgcgguugguucuuauu

SEQ ID NO: 22928 - RNA, 21 nt, Artificial Sequence
  Description of Artificial Sequence: Synthetic oligonucleotide
ccccgcgguugguucuucauu

SEQ ID NO: 22929 - RNA, 21 nt, Artificial Sequence
  Description of Artificial Sequence: Synthetic oligonucleotide
cccgcgguugguucuuccauu

SEQ ID NO: 22930 - RNA, 21 nt, Artificial Sequence
  Description of Artificial Sequence: Synthetic oligonucleotide
ccgcgguugguucuuccuauu

SEQ ID NO: 22931 - RNA, 21 nt, Artificial Sequence
  Description of Artificial Sequence: Synthetic oligonucleotide
cgcgguugguucuuccuuauu

SEQ ID NO: 22932 - RNA, 21 nt, Artificial Sequence
  Description of Artificial Sequence: Synthetic oligonucleotide
gcgguugguucuuccuugauu

SEQ ID NO: 22933 - RNA, 21 nt, Artificial Sequence
  Description of Artificial Sequence: Synthetic oligonucleotide
cgguugguucuuccuugcauu

SEQ ID NO: 22934 - RNA, 21 nt, Artificial Sequence
  Description of Artificial Sequence: Synthetic oligonucleotide
gguugguucuuccuugcuauu

SEQ ID NO: 22935 - RNA, 21 nt, Artificial Sequence
  Description of Artificial Sequence: Synthetic oligonucleotide
guugguucuuccuugcucauu

SEQ ID NO: 22936 - RNA, 21 nt, Artificial Sequence
  Description of Artificial Sequence: Synthetic oligonucleotide
uugguucuuccuugcucuauu

SEQ ID NO: 22937 - RNA, 21 nt, Artificial Sequence
  Description of Artificial Sequence: Synthetic oligonucleotide
ugguucuuccuugcucuaauu

SEQ ID NO: 22938 - RNA, 21 nt, Artificial Sequence
  Description of Artificial Sequence: Synthetic oligonucleotide
gguucuuccuugcucuacauu

SEQ ID NO: 22939 - RNA, 21 nt, Artificial Sequence
  Description of Artificial Sequence: Synthetic oligonucleotide
guucuuccuugcucuacuauu

SEQ ID NO: 22940 - RNA, 21 nt, Artificial Sequence
  Description of Artificial Sequence: Synthetic oligonucleotide
uucuuccuugcucuacucauu

SEQ ID NO: 22941 - RNA, 21 nt, Artificial Sequence
  Description of Artificial Sequence: Synthetic oligonucleotide
ucuuccuugcucuacucaauu

SEQ ID NO: 22942 - RNA, 21 nt, Artificial Sequence
  Description of Artificial Sequence: Synthetic oligonucleotide
cuuccuugcucuacucaaauu

SEQ ID NO: 22943 - RNA, 21 nt, Artificial Sequence
  Description of Artificial Sequence: Synthetic oligonucleotide
uuccuugcucuacucaacauu

SEQ ID NO: 22944 - RNA, 21 nt, Artificial Sequence
  Description of Artificial Sequence: Synthetic oligonucleotide
uccuugcucuacucaaccauu

SEQ ID NO: 22945 - RNA, 21 nt, Artificial Sequence
  Description of Artificial Sequence: Synthetic oligonucleotide
ccuugcucuacucaacccauu

SEQ ID NO: 22946 - RNA, 21 nt, Artificial Sequence
  Description of Artificial Sequence: Synthetic oligonucleotide
cuugcucuacucaacccuauu

SEQ ID NO: 22947 - RNA, 21 nt, Artificial Sequence
  Description of Artificial Sequence: Synthetic oligonucleotide
uugcucuacucaacccugauu

SEQ ID NO: 22948 - RNA, 21 nt, Artificial Sequence
  Description of Artificial Sequence: Synthetic oligonucleotide
ugcucuacucaacccugaauu

SEQ ID NO: 22949 - RNA, 21 nt, Artificial Sequence
  Description of Artificial Sequence: Synthetic oligonucleotide
gcucuacucaacccugacauu

SEQ ID NO: 22950 - RNA, 21 nt, Artificial Sequence
  Description of Artificial Sequence: Synthetic oligonucleotide
cucuacucaacccugaccauu

SEQ ID NO: 22951 - RNA, 21 nt, Artificial Sequence
  Description of Artificial Sequence: Synthetic oligonucleotide
ucuacucaacccugaccuauu

SEQ ID NO: 22952 - RNA, 21 nt, Artificial Sequence
  Description of Artificial Sequence: Synthetic oligonucleotide
cuacucaacccugaccucauu

SEQ ID NO: 22953 - RNA, 21 nt, Artificial Sequence
  Description of Artificial Sequence: Synthetic oligonucleotide
uacucaacccugaccucuauu

SEQ ID NO: 22954 - RNA, 21 nt, Artificial Sequence
  Description of Artificial Sequence: Synthetic oligonucleotide
acucaacccugaccucuuauu

SEQ ID NO: 22955 - RNA, 21 nt, Artificial Sequence
  Description of Artificial Sequence: Synthetic oligonucleotide
cucaacccugaccucuucauu

SEQ ID NO: 22956 - RNA, 21 nt, Artificial Sequence
  Description of Artificial Sequence: Synthetic oligonucleotide
ucaacccugaccucuucuauu

SEQ ID NO: 22957 - RNA, 21 nt, Artificial Sequence
  Description of Artificial Sequence: Synthetic oligonucleotide
caacccugaccucuucucauu

SEQ ID NO: 22958 - RNA, 21 nt, Artificial Sequence
  Description of Artificial Sequence: Synthetic oligonucleotide
aacccugaccucuucucuauu

SEQ ID NO: 22959 - RNA, 21 nt, Artificial Sequence
  Description of Artificial Sequence: Synthetic oligonucleotide
acccugaccucuucucucauu

SEQ ID NO: 22960 - RNA, 21 nt, Artificial Sequence
  Description of Artificial Sequence: Synthetic oligonucleotide
cccugaccucuucucucuauu

SEQ ID NO: 22961 - RNA, 21 nt, Artificial Sequence
  Description of Artificial Sequence: Synthetic oligonucleotide
ccugaccucuucucucugauu

(The sequence listing continues in the following parts.)

---

We claim:

1. A composition comprising an oligonucleotide that targets a long isoform of Thymic stromal lymphopoietin (1fTSLP), wherein the oligonucleotide comprises a small interfering RNA (siRNA) comprising a sense strand and an antisense strand; and wherein the sense strand comprises the nucleoside sequence of any one of SEQ ID NOs: 15048, 15114, 15194, 15252 or 15272, or a nucleic acid sequence thereof having 1 or 2 nucleoside substitutions, additions, or deletions.

2. The composition of claim 1, wherein the sense strand comprises modification pattern 1S: 5'-NfsnsNfnNfnNfNfNfnNfnNfnNfnNfnNfsnsn-3' (SEQ ID NO: 34502), wherein "Nf" is a 2' fluoro-modified nucleoside, "n" is a 2' O-methyl modified nucleoside, and "s" is a phosphorothioate linkage.

3. The composition of claim 1, wherein the antisense strand comprises modification pattern 1AS: 5'-nsNfsnNfnNfnNfnNfnnnNfnNfnNfnsnsn-3' (SEQ ID NO: 34503), wherein "Nf" is a 2' fluoro-modified nucleoside, "n" is a 2' O-methyl modified nucleoside, and "s" is a phosphorothioate linkage.

4. The composition of claim 1, wherein the sense strand or the antisense strand comprises a 3' overhang comprising at least 2 nucleosides.

5. The composition of claim 1, further comprising a pharmaceutically acceptable carrier comprising water, a buffer, a saline solution, or a combination thereof.

6. The composition of claim 1, wherein the composition is formulated for administration by inhalation.

7. A method of treating an airway inflammation disorder in a subject in need thereof, the method comprising administering to the subject a pharmaceutical composition comprising an siRNA that targets 1fTSLP, comprising a sense strand and an antisense strand; and wherein the sense strand comprises the nucleoside sequence of any one of SEQ ID NOs: 15048, 15114, 15194, 15252 or 15272, or a nucleic acid sequence thereof having 1 or 2 nucleoside substitutions, additions, or deletions.

8. The method of claim 7, wherein the airway inflammation disorder comprises asthma, nasal polyps, allergic rhinitis, chronic rhinosinusitis, or a combination thereof.

9. The method of claim 7, wherein the subject is a human.

10. The method of claim 7, wherein the administration is by inhalation.

11. The method of claim 7, wherein the administration reduces a size or number of nasal polyps relative to a baseline size or number of nasal polyps.

12. The method of claim 7, wherein the administration reduces an airway constriction measurement relative to a baseline airway constriction measurement.

13. The method of claim 7, wherein the composition reduces a blood eosinophil measurement relative to a baseline blood eosinophil measurement.

14. The method of claim 7, wherein the sense strand comprises modification pattern 1S: 5'-NfsnsNfnNfnNfNfNfnNfnNfnNfnNfnNfsnsn-3' (SEQ ID NO: 34502), wherein "Nf" is a 2' fluoro-modified nucleoside, "n" is a 2' O-methyl modified nucleoside, and "s" is a phosphorothioate linkage; or wherein the antisense strand comprises modification pattern 1AS: 5'-nsNfsnNfnNfnNfnNfnnnNfnNfnNfnsnsn-3' (SEQ ID NO: 34503), wherein "Nf" is a 2' fluoro-modified nucleoside, "n" is a 2' O-methyl modified nucleoside, and "s" is a phosphorothioate linkage.

15. The method of claim 7, wherein the sense strand or the antisense strand comprises a 3' overhang comprising at least 2 nucleosides.

* * * * *